United States Patent 7,750,207 (ZEA MAYS RIBULOSE BISPHOSPHATE CARBOXYLASE ACTIVASE PROMOTER) - sequence listing, part 10

SEQ ID NO: 13192 - DNA, 3413 bp, Zea mays
  misc_feature (37)..(37): n is a, c, g, or t
gtttcgttgttttactggtcaccttaacctaccgtantaggttccagtttcgatgctatttaagaatgtttcttcttcaaacatgattcgcggggcttcaataatgcagacacccctcaacctgcagaatgatgctctggtcgctgagttgtatggtaccgagtggaaacagcaaagtggtttgttaatgatcgattttaatgcctgtatacctatggtatccttcgtagttcgtgtgctcttctacacatgtaaccccatgttcccgtcttgaaccgcaaaataagtgaaccccatgcacatggagatattttggtgaccccaaagttgtgtataccatttcattgctttaccctaccatgttctgtggcaagagaatcaaatctggataaacatctgggatgataatttatctcttgggcaagaacttgtgatgtaagatatgattcaaataaacaactttgtggggtcatttcagtatcacagttggcaaaaaaaaatggcaggtccaggtttctgggaaataccagttgaagcaattcagtttttgtgttgtactgccacgtacatgcgttgtctaagccaacaaaccttttggcttttgcttgtgaaatgaaacttgtgtgttctgtgtgatgcaatacctaccactagcacgcaagtgtatcagctggtatgcatgcgatggcttgaagctgacacgctcagtacattctctacaactaattcttgttgtctacttgggaccaaccagttggttggtgtgtcgtctaccgccacggctgcactccacatgtcccttctttatcatgttgctcatcttcgatagatgccatgattcagtgaattaagcatttatatttgagaaaggggcccggttttatgaataaaaaaaatgacaggattgtatatttgtatacgcaaaccgctttaattcttctttagacgggctagcgacatctaaacggccgaaagcagcagcagaaaaaggtgtgactaggagtccatattttgaatttgggaaatgcggatcctccccccttttttttgtcattttcgcaactgtagcagagtcagatattcttaatttgtgcacagttcactacttcactctaacagttgtgtcttcacttgagctgatgatgttgagttggagttgagcagattacacagcacgctttgcaaggcggcattctaacgagttgtgtagctttggaaaaagctaaggaacttgacaaagggtgcaaaaatgtgactgattttacaaataatattgttcaatgcagaattctggtagctgccctccctgatttcagtaacatgttgcagctcgtcaaagtttaagcaaaacccaaggcataaccagactctcgacagtgactcaggtacacaagagaaacttgtaagagaaatagaacatgaaccagcaagttcttggtcctgtgctaccgagacgagagaagcatgcgtgtattgatcacctccgtatatacacctgacacatcatcatgcactactcatcaaaggcttgattttttttcagctgcgtcagatgggcggcgccttccgcgacggggcggcgccggacttgtgcgccaggaagagcttcttgagcagcctgagcatcatgaggaggcccatcctccgccggcggacgacggcgtgcttgcgcgtctcgaaggcgccgtcgagccagggctccctcgcggccgcccacgatggcgtccccctggtgagcgggcagggctgcgcggcccgtgcgagctcctcgttgaagtcctcccacagcatgtccatcttgtcctccaccgcgaacctcgccgagccgtggcggccacccagctgctgctggtcgccgcccgcggcttgctgctccacggccgagacgctcctccggtggtcgtgctcgtgcactgccgccgtgccaacaacgccgccgggaacgagcagccacggcgacgcggaggcggagaagtcggcgttgcattgctcgagtgggaagctggggaatgcgaactcttccattgcaaatctctttctctctctctaggtctgagctgtgagctctgactctattgtggaagcctgtgttggaatggaagatgtatatgggtggttgcaacttgtttatctaccgcctcttgacatggaaatgactagaaatagaggaccggaggaaagggatgtgggttaatctaattaattgcttctgtagttgaaactgaagtggtggtcggcaaatggggttattataacatggtgatggcggttggtaagatgcttggcaagggaggttgctgtgtcaagtaatgccaatcagacaagcactaaccgcaaaagaaaggggcctacctgtacgatgcttaataattacatggccattatatatatatatatatatagagagagctaaagtctaggagcagaagataataactgaatgagccttaagaatgttcagacacatagccttgcccagcctgaattaacgttacagaagctcctctgaagtctgaacaaaaaaaaattgaggaagaagataagttagaaaactagatagcgtaagctctaaagtctaatcctttttttaaaatttggtagtccaaacttgcgttttctcatgtcgctccatctttctacgtcgctcatctacttagaagcttgatgccagaaaaaatagtctaaggtgcggctgctgaattagccaatcattcaggaacatatctgggtttgcgaggtccttaataggatcggtggttgaaaaaaaaagatttgtttatcttatcacttcgatttttatttgcaggagatgtggttggagaagcgaggaggaggtctttttgaatggtgttggagggaggagaggagaagagcatggaagcaggcggacagtgattttcagctaaaggtcagcgctcgccgctcacttgcctgacaaaggctgcagtgggggcggacgggtcagcatccgtagtggcaccagtttaaacgttggaatgtctcagagcaaattttattattttaaactttaatttacaaacaatataggtttttcacgacttacgctattactggtggatatcggatgaaaacaacttacgctattactggtggattgtgtatatgataatttagtagactactatctgttacagagtggggcttaaaaatataggatatatatagaggtggtaatggataactatctaaatatttcttcataggatccttaattaattttaacttaaaaataaatagaaatagagtttggttctaatcggatttgataattaaattttataatataaaatatagagtccaatagcacccctaaataagtatggaattggtggggatgcttttagtagtggctgtgggacaggttgttctggctcggtcactcctctgtcgcc

SEQ ID NO: 13193 - DNA, 4863 bp, Zea mays
acaagtatccgatatccgatcaaataatatccgtatccgtcacttatccgcccggataaatatccggttcctgtatccgtatccgtctcgtttctaactatccgtatccgatcccgaatccgttttaaatacattagggtaggatacaggatgagctactatccgttcgtatccgcccgttttcacccctattccttgccgctgaagtttggtatgggtcctgcagctgaccctgtggcactctactctaccaccgagtgtgtgtgtgagaagacaatagacaagtgaggaagcagcaggcggagtggggagcagggaggtgcgggtgcagccggtggcgcgtagctttcctgaaagcaagacgtgcaggctgcctgtgtgtgtgtgtgcgtcctggcagatggcagtggcatctgttaccacctgccgctgcagccattgatagaaaaatcgtcctcttcctgcgaccggcgaccgcgagccccgtgtctgtcacgacggacgccgaacaaacaaccctcaccgcaccagcacggcagcaccacacaacacaccgctgccggagtcacagaggacactgcgctatctagtagtatctatctatctaccgcggccgtgggcccgggtcacgggcccttgtgcaccacgggacccaccaccccctgggacgggaggacgacaggcggttaccgacagacaggtggccccgtcccgtcggagagggaaaccggacgaacgtttttaccctgccacccgcgcggaacgcaacgcaaccgcgtggcgccaggtgggcagacgccgccgctcgtcccgtcacccgacccgaaggcgtgacacgccacccggcccctccgctggtgctgatcgatgtagatccataggcataggggcagggtgcaggcagcgcggagcgaaaagcggcgggcgcgggtgatgagatcatggcttggcttggccccgacccgaggcggattgcgaggtttcaccagtgccgaggccgcacccgcacacacatgagcgagacgagagtgtggtccgtggcgtggcgtggctgccttgggtttcaccgtcgccgagcctccacctcggcacctcctcccccacaacccaccacccctttcgctttaacggcccacccgcccccaaacggaaacggtgggtgcggatcacgaggatcccggacgggttgttggtgacggtggtgctgccaattgccaaactcctgcccttcttttttttcccctttcttccgttcgtccacaaccagagcaacgtgaacaagaaaaaaaaaaccctactctttctcctcgtgtttcaaccaccgtactttcgagctccagctagtgggccactcgtttctttgacctgtttaacacccccagcagccttatttattttctctagcacggtaatattacataaagtatagtacggtcctatcctatccaccgttcgagtccggtttttttttactgcggtgaaagaggtgaagtgcgagggaggcaaaggcggtccgcagcgtcacggcgttcccatggccacggccagggcggtctcgcagttcgatactgctggcatcgatgctgcagctgcagcagcagcagcaggtggtggcccggcagcggcacccctcccgagactgcacgagcggagtcacgccgtgccagtgccagtgccaggcgattgccgccgatcagtgccaagtgcacttctccgcatcccgcccaagctttgatttttttatttatttttttccgccgtctcctctatatcgcgcaagtggacgacgacgcagagcatcgtccctgcgaccatgccgtggcttgatcaggaggtagcgtggctcatcaagatcatcgcaacctacggctacggctacggctacgagtcggaggtatctctatcctatctgcctatccgaatcccgagcacggcgaaacctgagccgagaaccgtcggagaacacgatcgcaagtatgcccagctgttcgtcggccatggcgccggccgctacaaactccagacgccaaggaccgagccaaatcaacaagcaaacctacctcttcgcaacattttttttttttttttctgcgacaataaggcagtgctcatatatctgcttctctttccgtggcaacaatataacaagcggcacgcacagttcgtctcctcaatacacaaattacaagcagcagcacataggacgtgatcacgcttgcgcctacaagcaggtatcgaaacgacgactgctgctacatattgcccggccgccgggcaggacggagggatcacaaagcccctcgagatgccagccaagaccaaaacttacaagcgtcaaaacaaaacaaaaaggaaaccataaggaagaaggcggcggcgagtgttttttctccttttccgaaaataaaacccggaaaacaccaaaacaccgaaaactagatccccaaacggatcgagaggcgcggcggaaaacaaaaaagaaacgaaaacgaagggagaattgcgagaagagcgggtactagctagctaggcagcagtagtactagtaggagcgttattctctgtccatcaccacgccacgctcagaggacggcggcgagccccgtgacgaccttcgccttgggcggcagctgcttcttgctcgcctcctccgtcgggcgccacggcgacaccaccaccgtgatcttctcgccgccgacggcgccgccctccgcggcggcgccggcgccggcgctgctacgcttcctgtcgaacacgagctcgaactcgccggaaaaactcgccgcctggacgggcgtcgccgcggcggcggcggcggccggcacggcgaccatgtcgcctccgacgccgccgcagcggacgtgcggggacagccacttggcgcgcatgtactccggcttccgccacggcgggaagtggagccccttcttcttgaggctctgccgcgccgcctccgccaccaccgccacgatctgcccgagccggtccggggtgcccacgaacagcggcggcagcgcctggagcgccgcgcggtacgccttggtcgaccgcgccagctcgaactgcgaccggaagtccacctccacgatcagcctcacctcctcctcctcctgctccttccccttccccaccacggcgtcgatgtactcgtgctcgcctgcgcacacggattccgcggtcagcaccgggcaccggccaggacacgctgtggaccgaaccaccgcgccaccacgtacctgctgggtgggagggggccttctcccaccgcgacgtgcacacggaggcgtcgtagcccagcgacctgaggccgtcggccaccgcgcgccggcactccgccttgcccttgcagcccttgccgcacttgtcggcgagcctagacgcgtccgccaggagattccgctccgcgacgctcgcgctctgcaccaggccctgtcaacacaccattcgtatcatttcgatccatgtgggtttggggttcgggtttgagttcggaaggggggaaggaagaattgcagatttccctaattaattcgcaagagatttcgcaccttcagagcctccaaggcgtcccctgccccagcggcggccgtcgccgaggcgtgcgcggaggggaggaaatcaaactcctcgtcgctttcctcgtggttactgccgttgaagcagttgcaacgcccccgcggcggccgctcgacggcggaggcctcttccatgaaactgagcaccatgcggtccagccccagtgaccccgcggcgtccgcatcgtcggtcgcgggcggcaacggcggcggcggcgggcggcagcttctcgtccttgtccctgtccttcccatccgcggcgaacttctccgatgaagacacccgcccgagcagcctccggagcctcgacaccctcggcgtcggcgcaggctgctgcgtcgtcggcggcggcggcggcttcccttccatggcggcgccgtggtgtggtgaccggtcttgagctggaacggcatcgatcgcatgagggatgaggcgcagcgactgcctacatccacaaaatctcgctcgcacaagtaaccaacccagagccaaccgcaccaacacaccaccggcctaaaccaaccaccagtcccagcgtgctactgcccgtacgccgggcgttcgccggaggcgacggccattctcggtgaacgctctctctctctctctctctctctctttctttcttctttttccccttccccactcctctttttcacagtctatacacgcaacgcgaggggcgaaaactaccaagagagaagaagggggttcaaacgggaggacactgggcgaatttaaaaggggtgggggactgggtcactgggggtgtgctctcaggcggggcccaccatgacgtcgccgtgcggtgggaccgggctatcagtggtacgtggcggagccggtcgcgccatgggtcgcagggacgccggcacgcggcccgcgccgtggggtcacggcgttgccgttcgtgctggggaacgcgcaaagacggagtcgcccaccgcccaccggctttgggtgacggtttggttcaggtcacaggggtagtgctggtatttttcgcaggcggggtggtggatggtgtgcggacgtggggaacggcagcagagtgtggactcggtggtgtaccgactaccggctcatccttgttttctggattttattttctggatagggctattattttaatatgagcggtgggaccagtagaatacttagcggtgttgggtctattcgtcttctagcgagttgtaacgcttctcggcagccatgctccggtatcatatttctctcacgatgtcagcagcggcagcaaaactgtcttggagtgcagataaacgggcc

SEQ ID NO: 13194 - DNA, 1187 bp, Zea mays
cgtgataccccgcgcggcaccctcgcctccgccgcacgcccccactctctcaccgccaccgccgagaatggcctgctcccacctcgccgccgcgggtggctcttcccctgccgccgccgcagtggttcgttccccgacgcattccccagccgccgccttcgcgcgcctccggtcgacgccgcgtttctcgagcgccggcctgtcggttaagggaagcagggcggctttcccgtgggtcgccgccgcggggccggccgcggcggcgccggtggccgacctggacggccgcccggccacggagaagcagcccatcattgtcatcgataactacgacagcttcacctacaacctctgccagtatatgggggagcttggattgaacttcgaagtataccgcaatgatgaactgaccatagaagatgtaaagaggaagaacccaagaggaatacttatttctccagggcctggtgaaccacaagattcagggatatcattgcagactgttcttgaattaggcccaaccatcccaattttcggagtttgcatgggcctgcagtgcattggggaggcatttggaggaaagattatccgtgctccttctggagtgatgcatgggaaaagctctccagtttattacgacgaggaattaggaaaggccttattcaatggcttgccaaacccttttacagcggcgaggtaccacagcttagtcattgagaaagaaaccttcccacatgatgctttggaggctaccgcatggactgaagatggactcatcatggctgctcgccacaagaagtacaaacacatccagggtgtccagttccatccggagagcatcatcacccctgaaggcaagaaaatcatcctcaactttgtcagattcattgaggagctggagaagcagcgttcctaatctaggggaggtatatgcgaatgcgacgggtggtttcatagatcaggcggaagcagagacataagccactgcgaagttccggcactggcagtggaagtttagctaggaatcaacgtttccctctcataattcgttgtgctcgtggtaacataatctgtgtggaccgaatgtcgaataaagtccaggcgtccagctgataaaataaaaaaaaaaaaaaaaaaaaaaaaagtggatatatatccggtaattttcggcaaggggaggccttggc

SEQ ID NO: 13195 - DNA, 1315 bp, Zea mays
ccggccgggaccttcctctcctctctccccccccctgccttttaagcgacgcgcccacctcccagcgcaccctctctctctctctctctctctctgatcgatcgtccttcctccacccgtctgccccctcctccgcgcgcgcctgttcatggccaggaagaggacggcggcgcgccatcagcaccaggaaccaccgccaaaccctaaccctaacctccgccgccgggccgcggccagcgacccggcctcggacgagccgccgccgtcgtcgaagcgcatgctggcctttcacttcctccgcgcgctggccaggatccacagcaccaccccggcgccgcgccgcccgcgcaccatccgccgcgcggcctactcgtccatggcgcgcgctgccagcccacgccgggcctggacgcaggcgctgctccgccaggctcgcgcccgcagggcggttgccaggtcctccaggggagccgtcctgctgcggagacgcgtcgcctccgccgcggcgcctcctccgccgccgctgctccgcgccagcgccggggagtcgacgtcggcgccgacgccgctggtggctccggcggccgtggcggcccggggcccgcctccgaggcaggccggggaaccggccagggccgacgcgctccgccggctcgtccccggcggcgcggagatggagtacggcagcctcctcgacgagaccgccgactacgtgcgctccctccgcgcgcaggtgcagctcatgcagagcctcgtcgacctcttctccgcccaatgatcgatcgtccaacaaccgaaccagtaattaattaataccgcatggttaattaattcctgttcttgcaccgtccatcgttcgccgcgccgccgcctttcgtatctatatcatcgcatatctcttcttcgtgccacatatgagatggatgagtgattaagataggagattattgagaagagattgttattgctggtacatatatatgtttagttggtaagataagattattagtaggtgtatgtataggttgggaacacacatgcatggaagatggcaccacacacaccaagctgcaattggagggagaggagattaatattgaggtaattaattgtaacatatatatagagagaattgaagcatggagtcacatacattacatacataagctattagtgcagtgcttgttgttgggtcagatgattgggtatacatatatgtttgtaaaaaattgtggagccatgtcatgtatcttttgtacctagctacaagctatacacatgtaggtagctgtgtgatacaaaaaaaaaaaaaaaa

SEQ ID NO: 13196 - DNA, 1293 bp, Zea mays
aaaaacctcgcccactctacaaacacgtgacacctccgcccaccctcgccccctccctaccggcaccgcccagatggcctgctcccacatcgtcgccgccgcgggggtctcctcccccgccgcagcggcggctcgttccccggcgcattctcccgcttccgccttcgcgcgcctccggtcgacgcctcgtttcgcgagcgctggcttgtcggttaagggaaacggagcggcgttcccgttggtcgccgccgcggggccggccgcggcggcaccggtggccgacctggacggccgcccggccacggagaagcagcccatcatcgtcatcgacaactacgacagcttcacatacaacctctgccagtatatgggggagcttggattgaacttcgaagtataccgcaatgatgaactgaccatagaagatgtgagaaggaagaacccaaggggaatacttatttctccaggacctggtgaaccacaagattcgggaatatcattgcagactgttcttgaattaggcccaaccatcccaatttttggagtttgcatgggtctgcaatgcattggagaggcatttggaggaaagattatccgtgctccttctggagtgatgcatgggaaaagctctccagtttattacgatgaggaattaggaaaggcattgttcaatggcttgccaaacccttttactgccgcgaggtaccacagcttggtcattgagcaagaaaccttcccacatgatgctttggaggctactgcatggactgaagatggacttatcatggctgctcgccacaagaagtacaaacacatccagggtgtccaattccacccggagagcatcatcacccctgaaggcaagaaaatcatcctcaactttgtcagattcattgaggaactggagaagcagcgttcgtaggggaggtagacgcgacaggtggtttcatttcatagatcagacggaagcagagacaaggcgcttaaagctgcgccaggttccggggctggcagttgaagcatagctaggaaacagctttccctctcttaattcgttgtgttcgtggtgacataatctgtgtgcggaccgaatttagaataaagtacaggcgtccgtctgatcaaataagcaccggtgttggtgctctatagatgaatatatccggtgattttcggcatgggaggcattggcacatttttgtctgagttctggcggtagcaagaccggagtaataaccatcaggcgtttctaaaaaaaaaaaaaaaaaaaacgccagggggggcccggtaccc

SEQ ID NO: 13197 - DNA, 1335 bp, Zea mays
agccgccagcccgctagcggagcagctcagcagcgccgaagcggagacgagcaggaactgccgaagcggagcagcacggagacgagcaagaagccagaaagccaataagtggagcagcactgcgtccagtggccgatctgattttcgctgcgtccaggtctccaggaagcaagcaccagccaccagtatatgggggagcttggattctcctgcccggtctgccgcaatgatgaactgaccatagaagatgtgagaaggaagaacccaaggggaatacttatttctccaggacctggtgaaccacaagattcgggaatatcattgcagactgttcttgaattaggcccaaccatcccaatttttggagtttgcatgggtctgcaatgcattggagaggcatttggaggaaagattatccgtgctccttctggagtgatgcatgggaaaagctctccagtttattacgatgaggaattaggaaaggcattgttcaatggcttgccaaacccttttactgccgcgaggtaccacagcttggtcattgagcaagaaaccttcccacatgatgctttggaggctactgcatggactgaagatggacttatcatggctgctcgccacaagaagtacaaacacatccagggtgtccaattccacccggagagcatcatcacccctgaaggcaagaaaatcatcctcaactttgtcagattcattgaggaactggagaagcagcgttcgtaggggaggtagacgcgacaggtggtttcatttcatagatcagacggaagcagagacaaggcgcttaaagctgcgccaggttccggggctggcagttgaagcatagctaggaaacagctttccctctcttaattcgttgtgttcgtggtgacataatctgtgtgcggaccgaatttagaataaagtacaggcgtccgtctgatcaaataagcaccggtgttggtgctctatagatgaatatatccggtgattttcggcatgggaggcattggcacatttttgtctgagttctggcggtagcaagaccggagtaataaccatcaggcgtttctatgttggttacgtgccgcacgcaggccgggcgtgcggaggatttatgccctgagaggctgagactatctccctcgtcccttattttaaacagtatcattatacaattccgcgttacctgctggagagttgcatggtttggtttatgtccaactatgccacactttattgcctgttttggtttatgtctaactatgctacactttatttaagattagttataaaattagataaaaatggtttatgtctaactatggtacactt

SEQ ID NO: 13198 - DNA, 1105 bp, Zea mays
tgtgacgataagtaatttcaacacacacataaaatatagggaatgacttttctccacttttatatatattacaatttaggtattacaccatgtagcccagccgcgcgctggcggcccatgggaggagagggcgcacgcgcctgggaccagtaaacggcagcccaacatagctgggagagggcggtgcccacccaggccgcagcctaggcccaggcgcccccccccttcaatcccgcctcaatcctgatcatccgtgggcatccgacggttccagatcaacacgggtactgtaggctgtctataacgggcggtgcctccgggccggccgaaaccctagctatttcctgtattctcttcctgccggccgctagagagattggcatcgcactgctctctgtgtttggccgctctatgtttggcggagtccctttcgtttctgtcggcttcgtctgtttctgtacgccgcctgtgagctttctttggccgccgttctactttccctcttctccctctctgttttttttttttaatttcacctgccgcactactactcggccgccagggagaacctgacaaccggtcattggtttctcaatgtcctctctttgctataattatttttttctttcagccgtacaagaacagcttcctgtttatcgatctgtctctctgcactgaaaacacgggccccgcagacctcgccgccaacgagcacatccctttgggcgggcgagctgctgtctgctgggagctgacggtggtccgagcacgacaggtcgggtgtgtgtaagatcagtcggtctcttgaccgtcttcgacttttaaaactcgtatctagtcctcatttacccgaatccctcgttgtgtaatgaatgtatggatctaatgtaatattcgggatcgagttatgagttgatagaacgtagatttttctgtgataattttctgtacctttactaatctgttctgtcatcaaggccgtggatgcaaaagatcccgagccactgtgatctctgttgacatatatttaaaactcattttgggttaggttattaaaccctaaccctaaaaaaaaaaaaaaaaaaaaaaaaaaaaaaaaaaaaaa

SEQ ID NO: 13199 - DNA, 1495 bp, Zea mays
aaaaaacggaggtcgggtactagcggttggcggccccaggccccgccggtcgccggtcgagtccttcggccttcccaaaacgcggaggtcgggtactagcggttggagcgcaggctgcccagtccccggacctgaccggtcgagtccttcggccttcccaaatcgcatctctgacactgcttccgttccgtcgcctcgccgccgcgacgagacgaccccgcccctacaaatacaccgccactttggccgcgtcagccgccgccacttcccagatcccgatgtcccgcgcccagattccactcccttgttgcatcgctactctgttcccagctcggggcctctgacgaggcccgaggcgcaggcgccaacctcccggcccgccctagggtttggggctgatcgatccggctaggtcttggcgggagctgctccaatgggggatcgggaggaggacgaggagctccagatggcgctccgcatgagcctccagggctccccgccggcgcagcctgagcccaagcgcagcaagcccccgccccccgctgcggagtctccggaggcagaggcgcgccggaagcagcgcgagctcatggccgccgccgccgagaagcgccgccgcggtgcagcctcaccggcctccgtctcggtggcgcggtctcctctgcagccagtggtggtggagccagcccccgccccggaggtcaccaaagagcaggtggaggagccggaacaagctggcgtatctatggaagaagcgaaggaggtggtggaggaggaagaagaagaaaagagggaggagttgcctccagatgtcgctgagaatctatgggcaatggtgtttgggagaggtgtttcaaaggcggtcttggcgcagtggagtaatcagggcataaggtgtggctctgttcctggctcctctctcggacgcgtgcaacctgaaggaggaccttgtggtgtcttagcaaccgtgcaggcttatgtccttaaatatcttctgtttttttctgatgacttgagtaatccagagatcagtaacccgctgtatactctgggacaaagacgcttttatcagagttcttttgcttgcaggggatgatttttcatcccttactgatgatagaaagacaagcgcattggttcatgctatggtggagattgtttttttatgtggaactgggaaaagagctgttgtagcatctgctgcacgtgccaatcgcggaaaaattgatgcagctttggaagatgtatctgtcgaatcagcagtggatctgcagaaagttcttaaaacaggtacatttacttcaagggaggatgcattcaacacccttttggctaacattcctttgtttcaaagtcgactgggagccatgctatagcttatttctgctttgctctcacgaggattggcagacatccaagcagacagggatgatccaagccagacattggtcactgcttcatttggtcatgctgcacaggaaattgtgaattatta

SEQ ID NO: 13200 - DNA, 967 bp, Zea mays
ggactcacgaagcagcacactctgcactctcggcaacaactgacggccggaggaagaaggcgcagacgacaagcagaagcttgtgccatcgatcaatggcggcggtgacaaagatctacgtcgtgtactactcgacgtacggccacgtggcgaggctggcggaggagatcaagaagggcgccgactccgtggacggcgtcgaggcaaccatctggcaggtggcggagacgctgccggaggaggcgctggcgaagatgcgcgcgccggcgaggagcgaggagcacccggtgatctcgggcaagcagctggtggacgcggacggcatcctgttcggcttcccggcgcggttcggcatgatggcggcgcagatgaaggcgctgttcgactccacgggcggcctctggcagcggcaggcgctggcgggcaagcccgcggggttcttcttcgcgctgggcacccagggcggcgggcaggaggagacggcgctcacggccgtgtcgcagctcacgcaccacggcatggtgttcgtgcccgtgggctacacgttcggcgccggcatgttcgacatggacgaggtcaggtgctgcagcccgtacggggccggcacgttcgccggcgccgacgggaggagcaggctgcccagcgacgccgagctgcagatggccgcgcaccagggcagctatttcgccgccttcgccaagaagctcaaggcgggagcggccgtcgtggcctgagcctgcctgagtagtgctctctcctctctgcccatcgatgccagctgctcttgtctgcggaaataaaataaagctccattacgtatacaacttttatgcgatagccgataggtggttgatgtgaaatcaggaacgtgtagctttcacttgtactatacttttggagtgccagcgactttctcggaaccttgctcactataaaatgtcaaattaaataagcgggtgattgattt

SEQ ID NO: 13201 - DNA, 1980 bp, Zea mays
ccccaataatcatttgtctggagaaaatttttaacaacctcttgaagttgctgttacacatgacacatatactccactgctcatgtcacggcgcttcgcccttgcattagcgtatgttgcatgtatccgtcgggatttatttggtttgtggctaactatgctttattttatttaaagttaatcgttcgaatcgaagaactaagcttagctagaaaagttatatcaacttagttaggctatcagtattgtggcatactacacgctttgaagacgagcggcatcagcaacgacgccactgatcacgtaagcaatctcagcaagaaccacggagccgccggctgccggcttttgatggtgcccagtgtctgctaactaaacaaatcatcgtggttgctcgcgctcacctttgccgcaaaactactcgttatttaaacgcgcgctctgtgagcgtcgatggactcacgaagcagcacactctgcactctcggcaacaactgacggccggaggaagaaggcgcagacgacaagcagaagcttgtgccatcgatcaatggcggcggtgacaaagatctacgtcgtgcccacgcctccccccacgcgtccgcgggcccgtggggatgctctagtaaatgcgtgcgagtacgtacgagtcggagtactcactggcaatgttttctgcgtgctgacttgaccaggtactactcgacgtacggccacgtggcgaggctggcggaggagatcaagaagggcgccgactccgtggacggcgtcgaggcaaccatctggcaggtggcggagacgctgccggaggaggcgctggcgaagatgcgcgcgccggcgaggagcgaggagcacccggtgatctcgggcaagcagctggtggacgcggacggcatcctgttcggcttcccggcgcggttcggcatgatggcggcgcagatgaaggcgctgttcgactccacgggcggcctctggcagcggcaggcgctggcgggcaagcccgcggggttcttcttcgcgctgggcacccagggcggcgggcaggaggagacggcgctcacggccgtgtcgcagctcacgcaccacggcatggtgttcgtgcccgtgggctacacgttcggcgccggcatgttcgacatggacgaggtcaggtgctgcagcccgtacggggccggcacgttcgccggcgccgacgggaggagcaggctgcccagcgacgccgagctgcagatggccgcgcaccagggcagctatttcgccgccttcgccaagaagctcaaggcgggagcggccgtcgtggcctgagcctgcctgagtagtgctctctcctctctgcccatcgatgccagctgctcttgtctgcggaaataaaataaagctccattacgtaaaaaaaaaaaaaaaaagcgcccccggctggttgctgggcgatcaggaacgtgtagctttcacttgtactatacttttggagtgccagcgactttctcggaaccttgctcactataaaatgtcaaattaaataagcgggtgattgatttataaggactaatttttagccactttattttattttattttacttctaaattactaaatacgaaaactaaatgtatctggcgaaacactatgcgtctgattggttgccgtatcagtctaatcaggatgcccgaacggagccataataagtagcatcaggttgagctcatgcaagacatatttgtttggttattttcacagactcaacagactaggtacagattttgtttggttaattgtaccgatatatgtattagagaagagtacataaataaatcttcaaatattatatagcatatgtggtctagttttgttcgaacaaaattaaattacattcggtattacgtgcttgcatgcggtgtctgcatgcctgtatcctgcatgcgcggagatgctgcagcgcacatctgagcggagctttgatggacgaccggttttgcatca

SEQ ID NO: 13202 - DNA, 8370 bp, Zea mays
  misc_feature (3772)..(3772): n is a, c, g, or t
tgcaaatcctataaaaattcctatggaataacctattgtagtgtgattttgaaggatttctaacttgacgtccaacctcttcgagatttttttgtgtgtctatctctttcctctaattgttgtgttctttctatattgcatccaaaatgctctattagaagttttcgcatttttaattcctatagaattgcaagtgttaagcaatttattcctacacatttttcttgttcctacatttcaccaatcttgtattccaaagggggtatgaggttcatttactgttatgtatagaaaaaatcaaaattttgggtgggctaatacagtcctattataggccttctcgtcgaattggtttagtcctcctaacatccgtcctcctcctcagcctagtttttgcatctattcattcggtctcattcttctagacgctgctcgagccagtatgccctaacgcccctttcccgacgtcacacgatgcgatgtcgcccaatcacgctcccttcccggtgtccttatcccgctcgccatcatcgcgacgccggttcacccaacatgtccgatcttgtatcatgtattgatataaaatttaaattacataatactagttttttactgtcttatttgattttgtcatatgttttttgcatcgatgaattctcgtactacgtccggcactgggtacaagtaaaattgtgtgcattggctttttatttagagaagcacgaaagtgtaggagtagacgtgtaggaaaagggagaagatcagtgccacctccatggatatacaacagcatggtcatcctatcaccaaagaaaggcaaccaaaacaataatttcgcaatcaaggccatcctttcaccaaagacaggcaaccaaacagtaacaattttgccaccaagcaattgccggttgcattacttaacactggcttgggctgacctcgtcagagatcgtctacttcgtgaagcaacgggaggtgagggaacaaaacacgaggggcttttttgggggcaaagcatccccgccccgccctagaaattgttcagatagtacacttcccgtattccccctatgccagcctttgctgtcctccgccacttgattattatttctgttgcttttctattgtatactcctgccgggtagtaccatgtatttgctgcagtggaccataccatcagccatcactgtcagtgttggaggcacatccaaccaaccaaacaaataactgaactcgagatatctccgtgggtttttatttttattttcgaacactggttagatattgacggcaaaattacattgagacaaaaaaaaatggactccttgatgcaaaaattatcatttttttaattggtcgatgactgaactctagtggcttttcggaacgcagatcatccgtacacgtgttttaatacaaaatacaagtaacaaccaacagcacctactttctcctccggaactgtgtgattaaagtggcagatttgacgcatctccgtccccaagcccacctcgctccttgcatgcatatgcagcagcagtcacaggtaagcagatcccctagagaagattagactaacgagaggtatcaatccctatctccatccccatctcccactacccatgcggccatgcatcagtaaatcaaaatcatagcaggtgaaaaaaaagagagcatgtgagccgagagagaaacaggaaaggagcaggaaaaaaaaagagagagagaagaagccgcaggggctggcctgacggtacggacagccgcctgcctccagcagtatccagccgcgaaagaattgagaagatccagaccgagctcgacgaggggaggcgcgacaaagaagtatcgccgccacggaaaggtttccttttttcccccctgtttattatgcgccataatcctttctttttatgccttcctgtttttccgtatatactagagcttttcccgttgcttcggtagctaaaggagtggttgttctccacggggacaacagaaaaatgatatggagatttggttgcttgtccaattaaggttggtttcttgtttatggttgtataagcccgttgagttagggttaacagcttgggtgaaattggactgtaaggttactttgggtggcgacgaacgtgaatgcgatgtgatatcttttattttatttttttttttgcagatggaggatctgaagaagttttatccttctttctggaagcaatctagcagttcacgaagtagcctgcactcgatccgtgagcataagctggtgagaggaacagctagatttcttttctctcccatgtaagatagtctaaatttgtcttgctaaagaaggattttttggtgccccagatggatttgggttcgaggcgcaatcaaacccaagaagtttccaccaatttcaataaacgcaaaccgttctccgaatctgtggaactgacttcagatgttaggacttcagtttggagaaaatccgatgcttatcacggagtgattgacttggagaagccatcgatttctggtgatgcgattgaagctattggttgttctggctttggcaaccctgccaaccaaaatggcaagtctcaggatggttcatgctgtatttcaccagagaacacctcacttgcagagtcgcttcagtcgtgtagagactggaacatatcgcgtgtaagcgttggtgagtctctattcaaccttgcatcctgtgctaacatgtttcagagctacttatgcaaacaggttgttgtcatcttgtatgacctattttttgactgtacctgttgcatatgtgtctataagttgaacctttgatgaataaaggctatagtgctcaattaatgacaaagaggatgatattgccacattgtttgtcacagccataagttacataaatagctaaaagttgttatgtactccctctgttcttttttatttgtcgcattttagttcaaaagtgagctagcggatgacaaatattcaagaacggaggtaatatatgctaactttttgtaacttagagggtgtttggtttctaatgactaatttttagtccctccattttatttcattttagtccctaaattgtcaaatacagaaactaaaatagaggccggaaacagttccattttctgaaaaaaaaactgctaactatttgcagcaattgagttttggagaacaagatcgatgtcattttactagtttggtgaaatattttttttcttaggagaccttcgtatcattatattaataagaggaataaatattttacaatatttcacagaaaggagaaacagctttgttacaacaatgtgatctttctcaatgctatccatgtctgcattcaaatattttctgtgttttttagggaggttttgttgctagccagctctactgggattattacaatgcaaagtctagtttaggacaagtcataaacatggatgacatatctgttgctctaatatctatgtctgctaactgaaatttataaacttctatgttaataattcacatgagagttccaagttctgcaagtctgtatattcccattgtagcatcattcgtgctttagagctttagttaatattagacatgccatgaattgagcatgaccacaagtccaagatcacaatgtgattatttgaacatttttcaggttttatttcccttactttattcttgtatgtgatgctttgttcattgcaagctaaatcataatccaacaaggcaacaagatggcctgctcatagagcttcatgactattctaancttgttcattttcaggttcagttggatctagtgacactccggattgccagtcccctatcaaaacaagtaacaatgaagcaagacattcactgtttgacctgaatgttcctcaagaagaaagcctttttatgtcttctactctggttccttcttcctcaacgtattgtggaattttttttcagacaaccgtagagaaacttctgagaaagagcatatcgctggtatcggatcaatgaaaggatcttctatcactgtggtcacgcccaactcagttgcagacagttcaagggatgtggtaactgaatcgccagttcaaccgaagtttctttttgaccttaatgtgtcgcttgaaaacaccgacatgccatcagaaatctgtgattatagagataaggatgtaaataatgatgtaagtaaaggaacagcaccctgtcgttctttctccaataaagatagtctgcatgcagaaacttccacaaaacatgtggttcttggacatgatcatatgttggcgcacaaggatgatagtaaggtgcttctcacatccccaacagctaatggtatcaataaggttcagttgacacagtctggaaccattaacaaggagtttttgatccctggatctcctcttgttgatacaagtttccctccaagacttgggatatccgacaatggagcatcgaatattcaagagttaagcatgcttcaagacaaggtcgatggtgatggcacaacagccgatactgcagctagaacccttctttccattttccagcatagttctgaacgcattgctcattgctttggaagcagcaaccagacagcagctcagaacgtgaacgatgagcctcagccttcattggactcgttcgagcaaaccgtgttgaacttagaggagatccaagatgacggtcaatcgatcaatgtggcaccaccctatatcgaaggaccagcatgtcggatcaagctaaagagagggaggggtatgagaaattttcagagggagatcattcctggcctccttctagggaggcaagagatatgcgaggacttggaagttataggctatgcgccaaagaaagctcggtccaggaaaccccgcaagggtccaggcgcatcctcagctcaaccgaggccgtgcaaacgtggagctgtcaagcgctgaccaggagcatctgcattccgtggcagggtgccataaggcaggcgattcagaacaggagagtccattctaaaccatgtgaatattcgtgtgtatcaagcctagcttcaaactctggtttgctggtgaccatttagttggggatattctttcctttcccctcttgaaacaaactacctgaacacaccaggttgttagattcaagatttttttttttgccttgcctttatatttgaaagtctagcggcgaagacagtcatagtgccacaatgatcagtctcgaaattccaggcttagatcagagtcgacgaagaaggcaagatggttgttcctgatgataacctagcactttctatcttgggttataccttggattaatgcgaaaacagtatacttgcttagattaaatttatctgggcctgttgactgctgcatctcaacaacaagccctcacttcaatccaggcgatttggactggtttcactgacctgtgaatcaaagaaaccatgtctgtcagtacaattgacgaccatactgatcgggggtcctaatggccccagattttctgtcctttgtgcagcattggtatcttttccaggtcttgatctcttctccagattgcctggtcttgatgttgaaccaggtagtgcatccatctaacacttgcgacgctgtctccaatctccattgatgatcaagaggccaggccatgtgcaggataataatgccccggtgtaacgagacatcggtcagggatcgccggcgagctcggggggtagtactgatgcacccactgaactgtcaaaccgtgtcgagtaaagttgatggcgcgtgcagctatttataacgccacgaactcgagtcgagtccagtcacagtcattgcgggaggtagggtaggcagtcaagcaagcaagcgaaggcgacctactggctactgcttgctacaagtaccgagtcatgatccaagtcgctgagccgtaaaccggtggagtatgagtgggatctctcggagcgatctggccggccggtcggtcggtgcatgaaattcgattcgacgctgggtggccaggtgggcggcatttggttgcggctgtggttgaatgaatcgatgaccccccgaattgaggctgagctgagatctcattgtcaccacggtgcaggtgcattgcatgatggcctgcgagagagccagttgtagctgtagcagtggactccctgctccatctccatgagagcatgagaccatgatccaaggcgaagccgtactaatctgctccaggatcctcgcagtcgcaccgcatccgccatccgtcgccccatctcctgcgcgcaataaaaggggcggacatggtcggtggcgaaacccggcaccgcatgattggcgctagatttttactgccgggtcgtcgccagagggagacacggcgctggcatgcatcatccaaatgcatcctcggccggctgtccagtctcccccactccaccatcattcaggacaggagcccgtatcgtaccggtcaagtggagggggatcttgacaagaccagcacggatttatcattcagagatgcgcagctagcgcactgttgcttactggaacgcaggcaagttttatgcccgtgccgctgctgattgctgtgctgtgcagtgcaggtatacggcgactcgctcatcggctcgtcgccgcgctgcaacctgcgcaaggagtaactcgcgtgggtcccgggccggccctgggtactggacgtcttcagttcgcttgttcagccttcagcgttcatgtttgaccatgtgagggtgaaacagtgacgcaaagacgactcagccactcgggcagcaggcaggactacgtccaaatctcctggacggaggtcaagcccacaccggcacaccccacagtggttagcgctgatagttgattggttattcagttctgaatgttggagtcacctggaactggaagcatggtaaacaacagctaccagacagaggtgacgagatgcaggccggctcggggcggtgagataggcggagtaaccataagagagggggcccatggccaatctacatgtgtggaagtggattgacgtgcaaattagtttaagttacgccacaatccaacttaatatatatagattaaggtgaatactagagtaattaaactagccctaaagctttgtttgattacatttggtttgagcgcaattgaaattttgattagagagagatttaatatcatccaatcttcattaatgcagatacaaccgaacaagctcttataaatgagtctcgtcgctcacttgcggcttgcctgcatctggatggatggaactctcggagagagagaagaatcgaatggatcattgttcattcagattccagtcggatcttgtgactgtaatctgctgtcgtcagagagagctcttgctgttcccaaagagaagaagtcaaggcgcctgctctccggaaatgccgctacgaaaattcagtgcaagttcagttgcggcgagaacgtgaggttccatccgggtgagcacaagcatccccggtggacggtggtggattaggcaggtgaaagcagactcgcagtgattctcgtcgccacccatgctcaacgaacctgacaacgagagagagagaggagaaatgatggttggtgcatggtgcttacggagacggtggtccagtcagtcacagcctcaccactctcgctccttgtctgatctggtcaggtgcccgtgcctccgctccgcaagagacaaggtaacatgccaatagctcagccctccctgagaggctgagagaaccggtggggcccggtgtcagccatccagatgtatggtcatgccatgtcagccagatctacacagccgcttccggaggagatgcatgattacacagctaatcttaagtacatcactgttcaaacctgtcgacacgtgatgggcatgtcggatccctctctggattagtgctgataatttggctcgcccggcctaggtctatcgtgtttcgggccaaacgactcgagctaaaaagaccttaaaaaacttttaaactgtatcgtgtgagtctaaaaagtagaaataatgatccaatctggctaaagcacgtcgtgactttgtttttgttagaccatatcaatccaagccggacctatatatttaaaccacataaaatctaaatattacaaccacataaattcatagcttcctaaattaaaaatattaaataatactaacatcatttgactatataaagtataaatcatttgactatataaagtataaatattataataaatataaggtaaaaaacttactaaattaaagaaattggattacatggacttcatggggcggtgccggcctaagcttgacccatgtataggggccatgctatgtgctcatggtggttaaaaaaaaacccggccc

SEQ ID NO: 13203 - DNA, 2513 bp, Zea mays
cattgggtacctcgaggccgcccgggaataacccccacaattcccacttcccagccgcgccgccgccgccgtgaacgagatggcggcagcccttttgctccgcagtctccgcccatcggtgagccgggcacatatccaccttctttcccatgcctcctccccgacggcgctggggtctttccttttaccccgcctctactcctctgcggcagcgtcaaccgccgcctctcctgttttcacgcccggcggcgtcatggacccatcccgcatccgcaacgtagcggtgatagcccacgtcgaccatgggaagacgacgctcatggaccggctccttcgacagtgcggggccgatatcccccacgagcgcgccatggattccatcagccttgagcgcgagcgcggcattaccattgcctccaaggtcacttctgtctcttggaaggaaaatgaactcaacatggtcgatacacctggccacgctgattttggtggtgaggttgaacgagttgttggaatggtggaaggagctgtcttggttgttgatgctggagagggacctttagcacaaactaaatttgtgctttcaaaagctttgaagtatggcttgcgtccaattcttctcctcaacaaggttgataggccttcagtttctgaagaaacctgcgatgaagtagagagcttggtttttgatctttttgcaaatcttggtgctacagaagaacagttagatttcccagttctttatgcatccgctaaagagggttgggcttccttaactttcactaagagcccccctgataatgcaaagaatatgtcttcactgctcgattccattgtacgacatgttccttcaccaaaagctgatcttgaggctccattccaaatgttggtttccatgatggaacgtgatttttatctaggacgaatactcactgggagagtaaggtccggagttgtccgtgttggtgacaaagtccatggtcttcgcagtgcagatgatggagttcataaaattgaggatggaaaggttgtcaaactcatgaaaaagaaaggcacaaatatggtaacagtagaggctgcaggggctggtgatataatttcaatggcaggattggctgctccagcaattggacatactgtggcaaattcagagatattgagtgctctgcctacaattgagttggatcctcccacaatatctatgacgtttggcgtgaatgattcaccgttggctggccgggatggcactcatctaactggagcaaaaattggtaaccgcctgatggcagaggcagaaacgaatttggctattaatgttctccctggaccattatcagaatcttatgaagttcaaggaagaggagagcttcagttaggaatattaattgaaaatatgcggcgtgagggatttgagctttcagtttcacctccaaaagtgatgtataaaacagagcgtggtgaaaggttggagcctattgaagaagtgactgttgaggttggtgaagagcatgtgggattcgtcttggaaaccattactcacaggaagggtgaagtagttgacatgggcccggttcctggcacaactggaagaactcgaatcttcatgacctgtccatctaggggtttggtgggtgtcaaaggaattttcagcagctttacacggggaactggatttatgcaccgtgcttttcaggcatatgctaaatacagaggtccactgggcagtgtcagaaaaggagttctgatatctgttggtaagggacttatcacttcacatgcccttatgagtttagaagctcgtgggatcctctttgtatcccctggaatggaggcatatgaagggatgatagttggtgagcactcacgtgacagtgatcttgaggtgaatcctgtgagaactaaagaacttacaaatatccgagcccctggaaaggatgaaaatgtccgtttgtctccaccccgattgatgagtttggaagaggcaattggatatgttgctgcagatgagcttattgaggttactcccaaggtcgtacgtcttcgaaagaagtacttggattccactaagcgtaagatgatgaaaaacaagcctatgaattagaactccagagacaacaaaattacatcaagcactgccagcactactatataagtttatcatgcaagactcttgcagcaagagtgttgctgtctcttgcagcaagagacagcatttatgtataggttggtgttcaatgttgcaacctgagctctttaccagcagcttcacccaggttttacgtgcacacaggattggctgacagaataagcccaccgtagcagctactggaggtaggatcctcgttggttatatctatttagactttttacggtgaaatttcagacacccacaggttctttgaaggttgtattattctttggaagttcaagaaatgcaggccaatccccgtaggtattttgtttgaaccggcttctttggtgacaattttatgaccatgtgttattactgatta

SEQ ID NO: 13204 - DNA, 1655 bp, Zea mays
gccactccccactcctcacggctcacgagggtacggcacctcgccgtggcccgcggctgtttccgaggcaagcggactcaccggcgtcctgcgcacgcgaggcgagcagcggctccgtcgacctgcgagccaatccgtctttatttctccaccccaatatccaaacataagataaaaatctatccaacactcatttcccacgccactcccccactccctctccaccctgcttccgttttcggccggcgatggcgacgaccgccgccgcatccacgtcgctccggccgctgtcaccgtccccacctcgcatcgcgagtttgccccgtcggtggtgttggggaatcccggtgcagtcctccgggcggagcgcattccatgctgaacggcggaggcggagcactttattatgcgctgctgataaagctcctgaagaatccctcaagaagaccattgaagtggataggcttattgatatgctgagggacgcaaatcctagagagcttgatcaaatagtggttgaaaatgttctggcattcgacgcaggtttctgggttcgactggcagctagaattgatctctgcaaatcagatgatgataaaaaagattatgaagagctggcggaaaatgtcatgaacattgttgaccggcttgttcacaagactgatcaaaagattgaacaatcaactgatgtgctgaaggcaattattagtcctgcaatgcatgaaggagatgtgaagtggccaccaagagatccagatacactcaaattgatggagacagaaataacacgccgagaacaagaaggacaacttgatgagggatttctgtcagaagttagtgctcagttgaggcaagctaaacaagacggagataagccagggcttcaggctatgctgcaaaaggtgttgcagttatatgcttctaaatctctccaaaaacgtagttatgcatacaaaggggggcaagttgtagttcctgaaaagtttctcgaatgtgtaatacaggctcctgagaacgagtggaataaggtgttgcttgacgggcttacagtaggaaaaggagacgtttcgccagatgatctgtatgccgttattaacaagagaattgagagagtcttgattcgtacggaaggtggttcttaccaacaacgcatactggttgagtatctaaaagagatacaggctagagcagaggaagttgtcaaagtgcttcaaggaccaacaatataacatctcctgatcttgtttacactacacatgatttcctgtttgcgcgtagtctgttgggacaatgacttaattttgttggagttgctcggcagacagctaagagcagtttcagacatgcctgatgcttggacctgatcaaacaaggagagcacaggaaatcgagaagagagaagccaggagagggttttcttacgtgggtattatttgatctttggtttggcaggccatttattaattcgtagtgattatgttatctttcctactcgatcatttctattttcaaaatagatttgcctatttgatgaatatgaatctacttcctggaggctccatctatcatgtatttgctgcagaatatgattattaggcgtttggctgatgatcgatctgatctgcacccatctattctaccgtgcctttttcttt

SEQ ID NO: 13205 - DNA, 2688 bp, Zea mays
ctgcagttattcagttgattatatgtaatttcatgtgccacgttgtgtatctaaaaatgccaatgtgcttccagtgttctaaaatgcttttattacatgccatcatgaaaatcacagaaaataacacgcctgttctaaaatgcttttattacatgccatcatgaaattcacaggaaataacacgccgagaacaagaaggacaacttgatgagggatttctgtcagaagttagtgctcagttgaggcaagtaagtgttagtttctgcattttgttcttgcgagttggttatttgtgttccaacatgtattaaattttattttcatgttattagttatctttatatgtgtttaggctaaacaagacggagataagccagggcttcaggctatgctgcaaaaggtgttgcagttatatgcttctaaatctctccaaaaacgtagttatgcatacaaaggtagtcttttttttctttcttgcattactggtgttcgacttgtgatgttgagtcagaattacacttccattttagttcatgagcaccttcctttttttcaggggggcaagttggagttcctgaaaagtttctcgaatgtgtaatacagggtctgtatttccacgtagagattctcgagttctcgttctctctccccctccccttccccctcacacacacacactctctctcttgcatctactagtcatcatatctgatcaatggatattgtgcaactcagctcctgagaacgagtggaataaggtgttgcttgacgggctttacagtaggaaaaggaagacgtttcgccaagatgatcggtatgccgttattaacaagagaattgagagagtcttgattcgtacggtgagatccacaaacatctggattctacagggagcagggccttttcttgagcatcttctcacactgacatatgttcttcctttctcacacgctgttctacaggaaggtggttcttaccaacaacgcatactggttgagtatctaaaagagatacatgctagagcagaggaagttgtcaaagtgcttcaaggaccaacaatataacatctcctgatcttgtttacactacacatgatttcctgtttgcgcgtagtcggttgggacaatgacttaattttgttggagttgctcggcagacagctaagagcaggtacgtttccccatttggcagagaacacagacgctcaactctgttgtctgcgcgttaaatacatttcacctttccagtttcagacatgcctgatgcttggacctgatcaaactaggagagcacaggaaatcgagagaagagagaagccaggagagggtcttcttacgtgggtattatttgatctttggtttggcaggccatgtattaattcgtagtgattatgttatctttcctactcgatcatttctattttcaaaatagatttgcctatttgatgaatatgaatctacttcctggaggctccatctatcatgtatttgctgcaggcatgcaggcgttattaggcgtttggctgatgatctatctgatctgcacctatctatactaccgtgccttttctttaggcacaatggcaccttgaaagttgcatacaaaactggcagatccttctgtgctagttggatgtgcattattcttgtgttcctgatgatgtgtactccctccgtttcgttttagttgtcgcttgatagtgcaaaattgaactatccagcgacaactaaaaagaaacggagggagtagatgttttgagaaataatttaagtacttagtagttttagggtcgagactgtccaaagttaaggaggtcaagtgacgcccgtagcataggctagccaacgggtgccagcggcgtgtggcgaacttcttcgaccaatctgcccctaagtcttgcctgaccagcgtctgcttctgatgatggtgtggctacctgagcagcctgtaccaatccctccctttgtttgccccgtccaccaggacagctgaaagcttgaagtgtgtggttaagaaactcaggcaggtggataaattgttgtgaacagcctagcttagagtttaaagacagatggtaggctgttggcaggccatgcgattccctcgttatgaaccctgaccaggaattgtgcagagctcaagatccactactttcctaacagaaggaagacaacaaatctcaggtaaagaagatgcaaggtaaattcttgcaatgtcagcaatcgtgacgagaaattccagaaaaggtgttcaaagcagatgcgcgatcgagatgagccgtcagtttctcctcttacgttcttctgatgtcgcatcaaggatgaagaccaagaatggctgttagctacctaaggaggagcagaaggtagcttcgggaagaaggatacaggcagaggtaacggagatttcttagagattcagaattctgttcattacaagcataccttcctaataacataacgcattatttatacccgctggcactgacatcagccacacacatcaggaagcacaacacagtgtccagtttacacctactctggtccagagatgcggacattggctcggcgcttgcgaccagcgtgcttctccacctcgcctgactgcagcttcttcagtgtatcagctgtagatggatcagtaggtagtgtagtaacaatggccaggcaggccaaggagaaacccttc

SEQ ID NO: 13206 - DNA, 3320 bp, Zea mays
cgactggaggtagaaaataaccatagtactactatgagtggtagagcttacttattaatgacaccattacattctcgaatattggttgtcctttaattcattttcaaattaaaccacgacaaataaatgttttcttcttctgtgtgagtactatttatcttgaattgaaccaaatagtaattctgtatatacattcacaccatcgagcattgctcggcgtgcaaggctttacacacatgacaaaaattgcaaaccaaccaactcggcacacacagacacagagatgaatcgcaaacaactcacacacaagctaaccactaataagcatgactacactgccactgaactctaaacatgatcgccagagccccgccaaacgaaaaccaccagctacgacctgagcttgagtgattccaggccgtggatccccttcttcaggatcccatggaccggccaaccaccactcctcaccttcgatctctccaccgcaccaccgtctcgctcgcacgcgtcgttctctgccacgcaaacgcctttgcccttcccgccgacgtgcgctcttcctgcgtcggccgcgcgcctgccgaagctttcgaacaggtcgggcgagtgctgcagcacctcgctcgccgacgagtaccccatcagccggtgaagcttgccgtctctagtacccgtcctttcgtcgacggtgttgaaggacgagttcctcgacacgtacagcggctgctgcccgtcctcggtgctggtcgagtggccgatgccgaacgagagcccgtactcctcggagtaggacaccgggtccgcctccccgaagaagccgccggcggcggcggcgttgtggccgccggaagcctgctcgtactcgtcagtgctgtactcgtcgcccccgaacggtgactgcagcctcttcctggcgccggggtccctgtaggagtaggagaggacttcggagcaggagccgcaccgcagccggcgcgttcccctgctcgggacggcgaactccgcgggcagctggaccaggctgacgcagctggagcagatcacgaacggggcgccacgtaggactggcaggcagtagtttctgggaggaggagggcgcttattgctcaccatgaccggtggcctgcgcgtcgctgcaggttcttgcttgcagggtctgtatctgtaacagggtggctgctggcaactatggtggcagcacccatgacggcaaggtctcgtttccgtctgcacgttgtggtggaagtggaacggataaacccagtgccggcgataccgcagcgacggcagtccacgagaagcagcagcaacctggccagacttgctcgggcgagacacgtagccagaatgcttggcggcaggatggtatgccgcgagaggtgcactggacgcgatggctgcacgagtcgtgcggccatcttgcttggaattggaaggtcgtggaggttggtgcgccttcggcttgcagtcgtctgcaggtttattactgaacagctcagaaaggtcgcccttcagctcgtccactgtgttcatgatcttcgactggaggggctcgctggcactgaagcttttcgactggagagaagtccgtgcagattggaaatcagtcgagtctcgtgacgatcgaagatcacaggaccgagacagtaccctcacaagataccccttcttgtttgctgcatgttcgcctccgccttcttccttctgctcgggatcttgcgcactgacggctgccttgctcatctcagaaggaaccgttttgatctcagaggcgttcaagcggcgttctgtatcatcatcatgtccacttactgctcggcaagtctctgaattctccgtaggctgttccacggtgtggttttccttgttctcagcgtcgtgagccaccaccacagcgttctgcacagccagcatgccaccaccattttcgccgctccctgccccgttgctgccatgctcggtgcttggagcatcagcaccgaaggagctctctgagccttggtctttgatttggggaggcgccccattgccattgctcacggctgtagcgaccgaataactgtcggagtcctggcgagcttgttttgcagacgcatgtcggccaccgctggcacagattttagctgcaaatccgtacggagggacacttcagaaactacgagcaaacgaacggtagactttctttctcagcgaacaaccgaacgaagttacctcgaagggtggtgccgcatccgccgcacctgtagactgtaacgttgtgcggttctgggagaacgttgagacagtttgggcatctcacgagccgaaaaccttccgcgttcgccatcaaccaagagagtaccagaacatcaccacccacagctcagaaatcccaggcggggccgcggttacctgcagtcagcagttcaagcaccaagccgctgaggctgagaagagttgtctttcaaagttcagagcttcagacagcaatagcagaagacggccgcagctgtcagcctgtaaacctgcaaatatatgcaagaggaaacggcggtcagaatctcaccaacagagcaggctcggctcggtctgggttggacttaagcatgggaatttgatcttcgttgacaaagcaattaagactaactgctgggtgctggccaagaaggataagaaaatctctcaatccagtcgtcaaaggctactgattaccctaacgcctatggcttgttcgtgaatcatgaggccaccaatccaatcatcttcagcttccccccccgcagaactcagcctcccacagaccgttctgcttcaaccaaaagcagttttgattttggtaccgtctcacagatacagcaaaaagaccaccactttcagagaacaactatagaactaacgcttgcggcgcaaactcccatgtcgaagctcgattcagcaactgaatcaagctacccgtgacgtgagaagaaccccggtcgaaaaaggcaggtagagggagggagagggagaaggcagccaagaagtcacctttcgcacagggtcccgtcgtcccctggtggacgcttcctcctcgtcgcctacgcctcgtgtgatcgtgtctccttctcctccgagccgaggcggccgcgtcgtcgtcgtctccttcctcttgttgcaacctccgccccactcgaaccccagttcttggaagttatggcgcgctcgcttcgcaaggggcagcagaaacgaccgggcggccactgccatatggtataaaaaaacacacacaccaccaagtctccgttcccgcggcgaggttgactagtacaagcaagcaagctctgcaacgctctatcagc

SEQ ID NO: 13207 - DNA, 3091 bp, Zea mays
cacccatgtattttgttgtaattctcgctgatttaaatgcatgctgattaagcaatgatgttctctggtggagagtatgcaggttgttttgcaagtgaatgttagcgttaacaaattggaagatcctgtgcttgaagtccttcagtttgagaaaagtatatcaaacaattgtatgcctgggaatcttgtggatggacaatgtgacagtaacgatgatccatgtcaggagctgcttagttggttgctccctcttagatcgcacattaccacctcgttctttggcaccccctactctcaatccaagtgtatcacacaagcaatcttattctgcttctggttctcaaatattcaacttcagaagttactccatgccttcagcctcttctgttcagacaccaaataatataagaccaccaccaatatctgaaagtcaagaatttatgcctgaaaaacctgcaaaaaccccagatattataaatgatgggcaactttcgtttagaggagttcctttagaacctgaacggtattctgtacgttgtggtttagaaggcgtgtatctaccagggaaaagatggcggagaaaagttgaaatcattcaaccaattgaggttcaatcttttgctgcaaaatgtactgtggaaaatcttctctgtgtcacagtaaaggtgcgtggagtatatcaaagcatccattcagttttcattgtgtgaaataatgttccaaggataatgtttgtatcatgaattcctgctgcagaatattgctcctactcatgcaaaagatatagtcgtattcatcgatgcaattactattgtatttgaggaggcatccaaaggaggtgctcctttgtctttaccaattgctagtattgaggttgggcatggtcacagcttgccaaacctagcactcaggtatatgcagctttctcattgattctgctcatgatctacctgctattgcagtttcatgttttcaagaactcagaaattgacatcgtatggtggtacaaaattgtggtttgtgcaatggtggagtgaacaaagtccataaatattgtttccatatccaagcttcactctagtgctgtgttgataggatccagaattctaccatggctccataagctatacgggtaggaggcgagcgagagagatgtgaaagatggcccttaaggctaggcaagataattgccttgcttgattagattgatacatctcttctccttatatagagactcaaagaggctgatttgacccctaggcaagcaaaggaaatctcctaacaagaatcaatcatggtcctattttaatggaaataatgcaaaatatctaagaaaattcaggcatttagcccctaactgcccacatggcctataggtgatgccagttggccctagcgcctataggtgacgctggtcataacatgtgtgctagtgtgtgacaattgttttaagtattctacattatttcttgtctttctaggaggggcgaggaacactcttttattctcaaaccagcaactatgtcctcaagggaacggaagaccaacagtcatgcacctctggccttatcactcccaacgatgaccggtgctactttaaatactcatacaccaaaggctggtgagccgtatgctgatctaagtgaccaatatgctgtactggtatcttatcgctgtaattacacaggtaaactattgttaaaccaagatatttcttcaaaagaggaatggagtggattttttatgattagcgcttttatctatgtagaatcgaaactttttttcaagcaagcaacaagctggcgaccctctgcagccagcgatcttatgatctcagtatcatccgaactgtctttacggaatcctagtcttggtgctcgtgttcctcaactccccgtgcaggttattgcagtatctcctcacttatattatggaaattctccaatttatcactatgataacgatatatcatttcctgcagatactaacactcgaagctactaatatgacatccgaaaaccttacattaactgtccttgctcctgaagcatctggttcttcttcagttgtatccttgaactcatctccaaccaccccaaatggttcttttgatggtgttaatgagtcagcaaaaagatctgggctgggaaaagatgggattggctttcgaagattgaattctgtcctagctactccaaaagaaggtgataatggaggaaacagaatgagtaatgcttcaggctgtactcatctgtggttgcaaagtgcagtgcccctagggtattgacccttacctgttctcacttacttaagagttcactcacaactgagctacatatattcgaaaacattgcagaatgacatttggttgttgtggatgtgtctaacaggtgtgttcctgcccgctcaagcaccactgtcaaacttgagctgctaccattatcagatggaattatcacacttgatactctgcaaataaccgcaagggagaaaggtaacgttttcattaaaaaaacaaatttgcaaaataagtgctgatttggcagctagatgtagattgttaccaacacagcaagtggtagtttagcagcttgacatagagtggatacggattgtcaattctaagaaagaagtttgttatttgtgtcatcctggtttgaagtgatctgggaatattaatacagtggatatagtaggctaccaaatgtcttaaatacattcagtgttttggctggttcgtattcgtatcatctaccttttatccttttaagacttgagaagtgattgttgccctgcaggcctgccttacataccggagcactccttggagatacatgccacctctggtatgtcatcaggaaggtcataggataggagagcatcaagaggcatactgttctgtatattgggggcctgggactcagcctgtacaaatgagttggaaacaaccaggccaagcatgttttttctctcatttgtattggatggacataaggcgctcaccttggagagaaactacccccagattttaccgaaggatggttgctgccaacatggggaaactaccccagatgaatcaattatgtatcac

SEQ ID NO: 13208 - DNA, 2777 bp, Zea mays
gtgggactgggcttttcaaatcaacagatgaagaatccccactgatatccatggacgacgaaggatggatcacaattccgtgcaaggcacttcctgaaagttggaacgacatatcagaaatggttcagttgcaggctctggaccgttccttcctttttccagttatcaggcgagcaggttcctatactggcgtgcctgtcagcttctaagcaagatgtacaggttatatccccctttagaattgccgcagtaatgtctaagaatggaacttctatgcaaaactttacaaataaatctagccctgtcagtgcaaatggtcatgataatggagcagctggagaaagtggctatgaggatgttgaacccaatggtgaagcatctccttcaggacatgatattttggagactcaatctctccttcagatggaggatcataagcagcagatcgaacatgtgttgcgaagatttagaggatcaaatttttttgtccggattgcggaatcagtggaacctctatggtccaagaaaagtgtaacttcaactacgatggcagatgaacgatcagataaccagggaaatagtaagagctcaaggagtaatgtttataataccatttctgataaaggggtttttgatggtaacacatctgggggagttgctcgagatgttgtcaagtgttattctctgcaaaatggagacatagtggttgttttgcaagtgaatgttagcgttaacaaattggaagatcctgtgcttgaagtccttcagtttgagaaaagtatatcaaacaattgtatgcctgggaatcttgtggatggacattgtgacagtaacgatgatccatgtcaggagctgcttagttggttgctccctttagatcgcacattaccacctcgttctttggcaccccctactctcaatccaagtgtatcacacaagcaatcttattctgcttctggttctcaaatattcaacttcagaagttactccatgccttcagcctcttctgttcagacaccaaataatataagaccacccccgaggccggccgggcaagaatttatgcctgaaaaacctgcaaaaaccccagatattataaatgatgggcaactttcgtttagaggagttcctttagaacctgaacggtattctgtacgttgtggtttagaaggtgtgtatctaccagggaaaagatggcggagaaaagttgaaatcattcaaccaattgaggttcattcttttgctgcaaaatgtactgtggaaaatcttctctgtgtcacagtaaagaatattgctcctactcatgcaaaagatatagtcgtattcatcgatgcaattactattgtatttgaggaggcatccaaaggaggtgctcctttgtctttaccaattgctagtattgaggttgggcatggtcacagcttgccaaacctagcactcaggaggggcgaggaacactcttttattctcaaaccagcaactatgtcctcaagggaacggaagaccaacagtcatgcacctctggccttatcactcccaacgatgaccggtgctactttaaatactcatacaccaaaggctggtgagccgtatgctgatctaagcgaccaatatgctgtactggtatcttatcgctgtaattacacagaatcgaaactttttttcaagcaagcaacaagctggcgaccctctgcagccagcgatcttatgatctcagtatcatccgaactgtctttacggaatcctagtcttggtgctcgtgttcctcaactccccgtgcagatactaacactcgaagctactaatatgacatccgaaaaccttacattaactgtccttgctcctgaagcatctggttcttcttcagttgtatccttgaactcatctccaaccaccccaaatggttcttttgatggtgttaatgagtcatcaaaaagatctgggctgggaaaagatggaattggctttcgaagattgaattctgtcctagctactccaaaagaaggtgataatggaggaaacagaatgagtaatgcttcaggctgtactcatctgtggttgcaaagtgcagtgcccctagggtgtgttcctgcccgctcaagcaccactgtcaaacttgagctgctaccattatcagatggaattatcacacttgatactctgcaaataaccgcaagggaaaaaggccttgcttacattccggagcactccttggagatacatgccacctctggtatgtcatcaggaaggtcataggataggagagcatcaagaggtatactgttctgtatattgggggcctgggactcagcctgtacaaatgagttggaaacaaccaggccaagcatgtttttttttatctcatttgtattggatggacataaggcgctcaccttggagagaaactacccccagattttaccgaaggatggttgctgccaacatggggaaactaccccagatgaatcattatgtatcacaattgtgttacaaatccattcatttcatactgaggtcgccgagacactggtgttcgtcttcacaaaggcttatgaaattcgtaacgtgttgcttagttttgatgccgttattgttgttggtggtgttcatttaatcccactcatgttgctgagttgtaccatatgcgggctctgatcataatatactggagaaatagaaacatgtgtgtccattggccattgctcatcttcatgatgatatatcagttgctcatgaatcattaaaaaaaaaaaaaaaactcgagccggggggcccgg

SEQ ID NO: 13209 - DNA, 1664 bp, Zea mays
tttttttttttttttttcgcaaacgtaaagcagatattttattaaagaatatatatatttggcatgccgcgacgacaaggcagtgcagtgcagcgcagcgcaggccgtggtgccagatgatgacagcttacaagatcacagacacacaccccaacagttgatttatacatgcaaataagcaagagaacatgggaaagcagaatggttggtattcatgcacgcttcactggcgacaaaacacatcaacaaaaaacggaacttccacatcgtcgacgactgtccatggacgcttctctctggcaaggaatctgagccatagggatccaatgtaaccaaatagagaagcaaatttgtcggcaagaataaacatcatgcagtaagggggccctctgcattgctacgcccattgagctgctctgggtggatcttcttccccaacatcttcctcatgacccgacttaattttcttgtcgctttcagtggttttggtgttggcttccttggtttcttttgatgcatcttttccatgcatgatgcatgctttgaagtggatgccacagcaacgtcaatgatatcctggcaactatactcccttggagaacttgatgagaatacttctgctgcaaataaatcagcaagtgtagttcttactttctccaccttttctaacatcagaagtggtcgttcctggatattagcacctcccccatcttccacctcacgtatcaggatttcttctgctacaaagcatgtaaagttgtcttctttcattgacaatgaatgcatcttagcaggctcaacaataggccatactggttcacatggctctgtttccaatgcaacatcttctttcacctgatcattcctgggttcctcatcatctctctcttccacaattgctttctcatcatccatgataaagagatcatcttcttcaatgcaagccacagggcaaagtgagtccacgtgatggccaagtgtgccaattgcaagtataccattaagaagcacatcatggagcagaagggcttcagtatctttctcaaccacactatgaggcacagagtccttgtcctccatggctttgctaccatggatgctgcagtactcagtattaggatgcatcctccgattcaaccaatgaaacacctttaggcccatgtctctagaaccaatctgaaatcacaggagagaggcagacagtagcattgacgagcctcaaaggcatggcatggctttatatgaagaactagccccataattgaatggtccaggagacaaaagatggagttttggttgcactggcttggcctgactcaagccaagtaaattctttcactgaggcctcactcgccccataattgaatcggggatgatgacgcgagtgaacggcgcggggaccttgggggaggtggagagctgctcaggatcctcgggggtagtagtggagggtgcggcgggaggggggcgccaggggaagcggaagcggtggaggcgacggagcgagacgtggaataacgcctcggtgaagaagggcaaaagggcgacgaggaggtgccgggactggcaggccccggccccgcgggacggcgggaggacgtcgcgataggcgcggcaggaggcacgcaaagcgaagaagagtcaggccccggccggcctcgagg

SEQ ID NO: 13210 - DNA, 1896 bp, Zea mays
attttcaacttgcttctcaagtttgctcggtgtcgctcgcgactggctctagttgtactcagccagctatccttggtgtgggggtttgatcgacggagccgtcacaacggcgcctatggcgaagccttccgtacagactcatttcgtcttggacgcgatggccgcggagagggtgaaagtcgcggagaactgggagcgagcgttggattcgttggagaacatgaatcagcgcctgggaaagttcgccaaggtccagcgccagttggtggagcagtcggaggtcgcggcgcaggcggccaagcaggcggcgaaggagcgttctgttctgtcgcgtcaagtggaggaatctgggcagctgctggcgcgggtacagctggaatccatggcggcggagaccgagaagtccaggaggagcggatccaccagcccgtcatctaggtcttcaccccctgttcaggtacggaagggtcctcagaagggtgttcagatcaatccactgcctgagatgtcattcccaaagtttgatggtgctaatccgagagtttggttggacaagtgtttggattacttccatattttcaaggtttctgaagctatgtgggtacaagtggcgtctctgcacttggaagggattgctgctcgctggtttcacgtgcatagactgaaacagaggacggggtggaatcattttactcgggatgtgttgaacaagtttggcgcagacgagtatccaaaggcgatgaggagattgatgggtctcaggcagacggggtcactggacgagtttgtgcgggcgttcgaggaagcacggtacatggtatcgctgcataacccaaagttgggtgaggtgctctttgtcactcagtttatttggggtctggagtatgatttgcaaggggcggtgcaatctcagatgcccaccactttggatcgagcagtactaattgccaagttgcaggatgaactgaatgatcaatacaaaggaaggtcgacaaggtcagtgttccagtcgaggtcctcgtccacagcagtcaaggccaaggcgatcagtggtactactggtaaagggtgcatgaaggtgcggggtcttttgaagaacaaagttacgttgctgttgtcaattcattccgggagtcctacttgctttatcaacaagaatctggtggctcgggctcgtttgtctgctgtttcttgtcctccagccaggttcacattggcaaatggcgagtccctaacgtcggatttgttggttcctcagcttgcctggtgcgcaaatggccacacgttccacactgatatgagagtgttggatctgggaccgtatgacgccatcttgggttatgactggctggaatcacatagccctatggaatgtgattgggcaaacaaggtcttggtctttcatgatgcaggggtggaggttactttgaaaggggatgatgataatatcaagaaggaggtgcaggaggtttcagccatttgccacaagtgttgatcagatggtccaatctatcggtggactcgtcgactcgggaagattactatatggttaagcggttccctaatgccgctgtttcggtacaaacagtatctgaaggtctgtgtgtgtcttgggttggggggcatgttcagagctgagcgctggacaagtgaagctgattgaggagtgatggcgtagtgtcatagggcgttttctattttacgttttccagttgggttggcgtctttaggcgcatactgtcccgaacaacccgtgcgtgcagcaagtcgctgatgggaggttacctcagctcatagtttatggaacagactacaacacgaagaatggaactagggtacgtactctgttgcttgtcgtgctgctctgttatcgtttaataatggttggtagtccag

SEQ ID NO: 13211 - DNA, 817 bp, Zea mays
  misc_feature (418)..(418): n is a, c, g, or t
  misc_feature (426)..(426): n is a, c, g, or t
  misc_feature (428)..(428): n is a, c, g, or t
  misc_feature (433)..(435): n is a, c, g, or t
  misc_feature (464)..(464): n is a, c, g, or t
  misc_feature (466)..(466): n is a, c, g, or t
ggtggcgtcgtctcaacaaaagcgagccgagcagagtgctgaggcacaaacaagtacaacaccatcccctctctaccttcttatctcttctcctcgtgcaccagcaacaaaggtggcaggcacagagagagctagctttggccaggcgtccacagcagccagcacaagatgtcgacggtggtcatgggggtggatcttgagtgccacaagtgctacaagaagatcaggaaggtcctctgcaaggtccaagacaaggtgagcatcaggaccatctcctacgacgagaagaacaacacggtgacggtgtccgggcccttcgacgccgaggaggtcgccgacaggctcaccgccgacgccggcaaggtcatcaccgacatacacgtcgtcgggggcttcggcttcggctttgggcgggggncgggagcngnaagcnnnagggaaaacaacagagcacgggggccggngnttcccggcccggccaaaggcccaatccttggtggcaacaattcctgggcaccttctttccggggccgaagaaagccgccatggacccccgtcccccacatggggggtaaacccccgctcggggggccccaaaccggaaaataacccacccccctgggaggcaaaaaaagggcccccgggttcggggaaataaacctactccccccgaaaaaatcccccccccttccccgaatgggggcccctccccctccccccctacaaaaaaaaacccccggggggtggggccggggcccccctataagggggggaaaaaatcttccaaaaaaataaaaaaacctctggggcgcacccg

SEQ ID NO: 13212 - DNA, 773 bp, Zea mays
  misc_feature (552)..(552): n is a, c, g, or t
  misc_feature (646)..(646): n is a, c, g, or t
  misc_feature (732)..(773): n is a, c, g, or t
cccacgcgtccgcgtcgtctcaacaaaagcgagccgagcagagtgctgaggcacaaacaagtacaacaccatcccctctctaccttcttatctcttctcctcgtgcaccagcaacaaaggtggcaggcacagagagagctagctttggccaggcgtccacagcagccagcacaagatgtcgacggtggtcatgggggtggatcttgagtgccacaagtgctacaagaagatcaggaaggtcctctgcaaggtccaagacaaggtgagcatcaggaccatctcctacgacgagaagaacaacacggtgacggtgtccgggcccttcgacgccgaggaggtcgccgacaggctcaccgccgacgccggcaaggtcatcaccgacatacacgtcgtcgggggcttcggcttcggcttgggcgggggcggaggcggaggcggagggaaacaacagaagcacggcgccgtcgctcccggcaaggcgcccaagccagggaaggccacggccccgcccacgcccactcctcgctgccaccactcctgtcacctcttccncgcgccgacgcagccgccatggaccccgtcgcccacatgggggctaaccccgctcgcgccgccgaaaccccggagatctacgaccccctggagnccgcgagaagcgggcgccagcgtcccgacatcgagctcatcgccgtccgagaactcaccttcttcgccggggtttgggaccggggnnnnnnnnnnnnnnnnnnnnnnnnnnnnnnnnnnnnnnnnnn

SEQ ID NO: 13213 - DNA, 1313 bp, Zea mays
atcggttccaagcttgtttcggcgtttcgttggatcagcagagcgttaaaccctatccgttggatgtagcactacaggcgtcgagcactggtaatcctgcaaccttcgtcatggcgcatgcggcggcggccgccgccgtgccgttacgtcgtccgctcctcttcctcaaggaggctcgactcctgtccacactcgcgacccccttacctgggctccgccacccgcgcgccctccgacccacaggccccttgccctccgatgccgaggacaccgacgatccagacgccggcgacggcgccgccgtgtccttcaagaagagccgcaacgaactgaagcgggaggcccgccgcgccgtgaagtggggaatggacctcgccaagttctccccacctcagatcaagcgcatcctcagtgccgcgtcgctggagcgcgaggtgttcgacgcgctaatgctcgtgaagaagtttgggccggatgtgcgggaaggaaggaggagacagttcaattacatcggaagtcttttgcgtgatgcacaaccagaattgatggatactctaatacaagcttctaaggatggagatgagaggaagttatataccttacttagtgaaggtaaactgttggtggaagaagaggaagaggaggaagaggacctacctgatggagaagaggagaatcaagagtatatgaaaattgcagatagatggtttgacggcctcctctgcaaagacatttcagttactaatgaagtttactctgtccatagtgttgaatttgatcgtcaggagctgcggaagcttgtgaagagagcccacatgttccaagaaagcacacaaaataaagatggggaagaatctaatgcgaagctttctggagcaaagaaaccacttatgaggttccttcgttcccttgcaaaggaggcttatgctccataggcgagctacaagctatcctgttaacttcttgtatccttatgtatgaaattgtaaaaattatcactatatttagggttgaaacaggaccggaaagtcttgtcctggtccgaatactgttttttcccgttcacttcagttatttttcggtttcggaacgaaaacaagtaggcagtgtttgaaaacgttttaactgatttttcgtttgttcttgcggttcctgttttttcggtgcagagactgttgccgcggcaagtgtgacatgtgtgtagtgtaatataatttctaactcaaataatgtcactatgtgttaatgtttgacagatgtgaacttaatatatattaatgtttgtcattcagtcaaaaaaaaaaaaaaaaaaa

SEQ ID NO: 13214 - DNA, 2360 bp, Zea mays
  misc_feature (1919)..(1919): n is a, c, g, or t
ccctttggctgccttcattgagatgtttcaggaaagccaccttggagtggtcttgaaggggtatgtaatcagaactgcacatctttttttaccttacgttcatctgataaatgatgataacatgacttagggggtgtttgaatgaactagaactaatagttagctagctaaaaattattagttggattagctagctaacaaatgactagctaactattaactactttaccaaaaatagctaatagctgaactattagctagagtgtttggatgtttcaactaattttagccactaactattaattttagtgcattcgaacacccccttacatagcaccttggctaatcaagttgtgaataagaaacaaataatgcatcttgatttgtgcattcgcgatcacctgtctaatagtcatatgagataagtaactttttcatttgtggagtgtggtttgtgatcagtggagtggaaaaaatgttgtatttggatccttaatgttttcagccgaggggatgtgttttggtgtaggcagctgttcttttttgatttttttctttggattctaaccatgaactatattttgtggtgctacagccggctgcaatgtttaaggtgttgcgcacggacccaccaattccagataacctgtcccctgaagggaaggattttctgagatgctgcttcaagagaaaccctactgagcgaccaacagcaaacaagttgctcgaacacccatttatccaaactttgaaccactacagcccacatagcgttgtacattcattttcgggaattaaatctccagtaagctttctgactttctccttatgacatgtgatatccaaagtttcaacttaaagctttatgcatatgtataggggcctcgctcgcgtcaggatactgtgcacagcagtgcaagagataaagtaccctggaaaagtgattcatatatgagagggaaacatgcaaatgggtgagtacatctgttgcattggtctgtttttttgttgatttgtaaatctggtgacgaaaatgttcacgttatttgggactttttgagtattaaccctgctattcttcattctgatagtgaaacaagcagtgctcggtcgtcagagtcattggcttatcggttgatgacacccctacccaacttgggaaccaatagtttgtcacctccacctttgagttcggcctccagttctggctctgcagcacatacaccgaacagtatgcatttttcagtcccataccatcagcctagtcctttgccaaagcctaacgggaaggaagcaataaatttggtttcgcattgaataacagcatgccacctatcacaacatctgggcaaagtccacataaacagcgcaagtgtatccgtccctagcgtctgacccttgtactgccagtaatagctaacaattttctgggtcgtgtaaaaataatttccatgtaaagagatcaccgcgatatgatcacagggaaatgctgctaaatgagggagctttgtgaaatctgttgtatcgtttgatttctgggaaactgattggattgcccatgtaacatatttttattagggtgtagctgtaggtgaaactaatggtcaagattgtgccgacaaataggacattagggttgtagctgtagcgtgttgttgatgctgtgtaatgatcatacttgatgtaatcattattgatttttttgggggaaggtaataatgcacgtcaattggccaaaggggattgagatcgcagatccatgtactccctccgttaataaatatatgacctttttaaaaaactttcaccatatgacttttttaaaaaactttcatcactggttttatttaaaaaataatgagttattaactttcagcactcacctttgacattcgtcttatttactttttttatgattngttttatttaagtagtttgtgtttaacttaaaattttatattttaaataagatgaatgattaaagttttttttaaaaaagttaaaggtgtcatatatttgtgaatggatgttgtatgatttaaacatcttcgttgcaggctaccgctttcattgtcagaggaagggttcattcgtgtatgttttcattttttttgtcggggagtttattatctacgaacataacagctcagcgtgctggcacctttgattttatataatccacctacagaaacaaatcccactagatttcaattctaatatggagtcgtctacgtcttcctctactaaacgccacactactactggtaatggttccctactaaatgccacgttctactactgattagatctctgttcaaatgtcgtgtacggtaatggttatttagcacggtccatgctcg

SEQ ID NO: 13215 - DNA, 3123 bp, Zea mays
  misc_feature (2612)..(2612): n is a, c, g, or t
  misc_feature (2654)..(2654): n is a, c, g, or t
  misc_feature (2680)..(2680): n is a, c, g, or t
  misc_feature (2697)..(2697): n is a, c, g, or t
  misc_feature (2703)..(2703): n is a, c, g, or t
  misc_feature (3008)..(3008): n is a, c, g, or t
tcctaatcaaaaaaactaaaaaaaaagccaaaatggcggggggaggtcgtcgtctcccctccctgcgatcccctccatccgcgacgccatctcggccacttcatgatcactagggtttcgctcttctacccataagccctcgtcccgatgcgctggtggaagcgctcctcctccccctcctgccccgcctcctcatcctcagcatcgacccccgcttcccccgcccgcgcctccaccccccgtctcatcggcggttggggtagcggccctagctcacgccgcgatggcagcggggccagcaacgatccgcagccgcggctgatcagagcgcggcggatgcgctacgtcgtcgatgacctcgaggtcggggtctccgcgctcggcgtggactctccggcgaggagggacgcggcggcggggtttgcgcttgagacagtgagctccgcgccgatctcgtggtctccgagcaacatggaggtggcgccggcgagatcctcgtcgacccccgtgctgctgccgcatccgctgccccttccaggcgagggggaatcgccgtgccgcgggccggggaggccgcttccgccaccggtgccaaggatgctcgacggggaggggaaagggcctgcagcggacgctcccggtgttttagagactgggagccaaaggatgacgccgttactcgcacggagagtggcggtccaaactctaccaaaggctcatgagcacaacgactttcggttaaatgggactacctgttgtcagcggagaaaggcttttaaagagaagttccaggataagaactgtgatgaaactttgaacttcagattgaacattcctgctaaaagtgctccaagcagtgggttttcaagccctgtacaaagtcctcgaagactgagtaatgtagatttctcatctgctgcaatctctatccaagataccaatgtatggtcagcacgatctctctggtcttctgatgcgatgggatcttcacctccttgtgattcacctgacaagtttgcaggtggtcaggagcgttctcctctctctagtccactgagaagtccagttttaaaatcaagaaacccaagtgcacctccatcaccaatgcatccaaagttgttcccggagaaccatgtttctcgccctgatggcaatggaagtgctagttttcacccattaccgctccctcctgcttctgtaagcccaaagcagacaaatgctagccaccagttagttccaaaagctgagatgccttcggtggctggtcaatggcagaaaggaaaactcttgggtagtggcacctttggatgcgtgtatgaggccaccaataggcacactggagctctttgtgccatgaaagaggtgaatataattccagatgatgctaaatcagtcgagtctctgaagcaattggaacaggaaattaagtttcttagtcaatttaagcatgaaaatattgtgcagtactatggcagtgaaactatcgaagatagattctacatatacctggagtatgttcatcctggttcaatccataagtatgttcatcaacactgtggatcgctgacagaagcagtcatccgtaacttcacacgtcatattctcaagggtcttgcttttttacatagccaaaagattatgcatagggatatcaaaggggcaaatttgttagttgatattaacggtgtagtgaaattggctgacttcggaatggcaaagcatttgagtactgcagctcctaatctttcattgaagggaacaccatactggatggctcctgaggttgttcgggctacactcgataaaagtgcaggttatgatcttgctgttgatatttggagccttggctgcacaatcattgagatgtttacaggaaagccaccttggagtggtcttgaagggccggctgcaatgtttaaggtgttgcgcacggacccaccaattccagataacctgtcccctgaagggaaggattttctgagatgctgcttcaagagaaaccctactgagcgaccaacagcaaacaagttgctcgaacacccatttatccaaactttgaaccactacagcccacatagcgttgtacattcattttcgggaattaaatctccagatactgtgcacagcagtgcaagagataaagtaccctggaaaagtgattcatatatgagagggaaacatgcaaatggtgaaacaagcagtgctcggtcgtcagagtcattggcttatcggttgatgacacccctacccaacttgggaaccaatagtttgtcacctccacctttgagttcggcctccagttctggctctgcagcacatacaccgaacagtatgcatttttcagtcccataccatcagcctagtcctttgccaaagcctaacgggaaggaagcaataaatttggtttcccattgaataacagcatgccacctatcacaacatctgggcaaagtccacataaacagcgcaagtgtatccgtccctagcgtctgacccttgtactgccagtaatagctaacaattttctgggtcgtgtaaaaataatttccatgtaagggcttgttcggttattccgaatacacatggattggatgggattggaaaaaattganaagaagtttgacttgtttgggattcaaacccatccaatcccnctcaatccacatggattaagagctanccgaacaagccctaaanagatcnccgtgatatgatcacagggaaatgctgctaaatgagggagctttgtgaaatctgttgtaccgtttgatttctgggaaactgattggattgcccatgtaacatatttttattagggtgtagctgtaggtgaaactaatggtcaagattgtgccgacaaataggacattagggttgtagctgtagcgtgttgttgatgctgtgtaatgatcatacttgatgtaatcattattgatttttttttggggaaggtaataatgcacgtcaattggcgaaaaaaaaaaaaaaaaaggggattgagatcgcanaaaaaaaaaaaaaaaaaaaaaaaaaaaataaaaaaaataataaaaaaaaaaaaaaaaaaaaaaaaaaaaaaaaaaaaaaaaaaaaaaaaagggggattttttttaaatggggagg

SEQ ID NO: 13216 - DNA, 2181 bp, Zea mays
acgttttttccttcgaacaagccgaaggtacagatgtaatgtacattatgtattactttattaatatatgagatgtattataatattgtttaacatttgatatgaaatgaataaatgacataatgttacatctgtaactatgctttttatatttatgaatgatgaaaacttattttttatgacattcgtctaagactcattatactcgaaggaagataatgcgccgaaggatgaagatccttaacgtttaacaattgtgttgtcttattttatggttcccagtaataaaaaataagtgaccaacacgtatatcgatggtgactttaatttttttatttttttgaaatttttttaaataaaaccagctaaatttgataaaaaaataaataaattataaattagggcggagagagcagattgtatcatccgccaacatgtcattagttacaacctagagatgtaaatcctttgctagcgccgtaccgttcttgtaaacttgacgtataaccgaaataaatataaaagataaataacaataaccatcaagagaatcaagagactagacgtcctgttctgatagacgaaaagttgaccttttctttataacaaatagtcgaggaacaaaatactcattttttcttttcacttttcagcctctcccaagtgggccgtgctaccgtcgagcgtggctcaagcccaaaacgcactcgattcgcgccatcgcgttgtcgggccaccagctcacggccgcgggccgccgccgccaagcgaaacggcacgcaggggctctgtcgcctcgcctgtcccctccagcgggcaacggctaccgttccctgccccccgactccccgaggcaccccctcctccctcctcggcgaaacgacaaccaccccgccggggagggtaatccaagcgagggcgagccatcaccgtgctgttcctcgtttgctgtcgcctcgaagagcctcctccgttccctctccctcgaccgatcggccggtctcacggggcatttcgcggggctggtcgatctctccccgctcattctgtcaagggattggtcggttgccgattccgtgcggccggataactcggatttattcagtttttcgggttcgctacatgcgtgtgcgatgccggccagctccctcccggcgtcccccgacgccaccggcgacattggcgccgcgctcgagctcgatctcgaggatctcgccgccggcggcggcacggactgcatcggcgcgctcgcctgcggcaggagcagcttctcctaccgccgcctcccggagccccgcctccgcctcaccgttcagaagcttgacgactccttcttcgacattgaaatcgcgcggtcggccacggtgtgggagctcaaggtgaccatagagaacttgttctccgccctctatgacgacacccagaagaccatctcttggaatcacgtgtggagtcacttctgcttatgcttcaaggacgagagactgacggatgacaaggcaacattgcgtgggtttggtataagagatggtgatgtgcttcattttgcccagcatctgtctgttgactacagcccatgcagggatcctcccaaaaaccagaaggaagcgtctcacactcacagaaggtcaaggacttcgctggatggttacaggccagtgagcatgctggatgatctcagcgaagatgatgatgagaagtttacacacagcaggtgctctacgagtgtcttagaagatccgtgtctttacgagtacatcgaggagcgcgtggaagaagaaactcccaagaaaggaagtctgttccaaagatggttctgctcctctaaactaaggagcaacaggaggacacatgcagaggacactgtgccactatctggtgagaagaagaatgctcatccaaagctggggaagtggctgaccttcaaattctgagatggtgttgtttattctgtctatacacgctcctccgttcggcgcggccagctgagaagaagatggcatggttccttgtgaacttattattgacggctaatttaggtttcatgtatctctgtgtatggtccgagctattcttccttctaatgtcatgcgcctatgcggcggtggtatgagcagaactgtttgtctcatgactcatgagaaacaacgactgatgcatcacccggttcacatttttttt

SEQ ID NO: 13217 - DNA, 3784 bp, Zea mays
gacagaaatgtattgtaaccagcaaagccccaacaattatttgaggtgattcttcataatatccttcagagagacaacaaaaatattattgaaaccatccaatgtttattatctcttgctgaaaggacaaatgatacaagagtacaagacctacttttgggagccttatatttgcgttttatgtaaaaaaataaagtgaaattatgtataaatgagtattcgaactttgttgttggctccacgttcacactcacctaatcaataaaaaacatatattttgtgttttattaaaacaaaatttattctatgtcatatataaaaatcgtagcaatgaacatgactagtagacttttattcatcggataaatttcaaagtgttattctatgcatggtctcatacttagtttcatagacttttattcatttgataaagacgcaattattgaataaatcttgaagctatgtctctttcgcgtaatcgggctataaattgtatactccacgccattttttccagatcaaaaaaagtccgtaattgtcgacccaccctcccgccacggccaaagcagagcaggagcaggccgcgcggaacgagggaagcagcaggccgctagactagggagcggtcgccggcctcggcggcggagggatggggcgtgggggtgcggtgatggaggacggcgacagggaggagggaagctatccgacgctgctgcagcggtggtcctcgtcggtgtgggccgtcagcggcagcgggcgcctgctgtgggcgggcaacgaggcgtggcgggcgcacgtcgggatggccctcgtccaggtcgcctacggcggctaccacgtcctcaccaagtccgtcctcaacgtcggcatgaaccagatcgtcttctgcgtctaccgcgacctcgtcgcgctcgcgctcctcgcgcccatcgccttctttcgcgagaggtctccccgcacgtcctcctcatccaatccctttccgcttcgcgcaccacacaccaccgaatttcacttcaatctcctttgcttgcccagcagcaacctgctgggggaggagggggggaaggcatctctttagcttcttccctactagtactagtgcagtgtatctctctcactcacccatcccaggggattccgattcgtcccgtaaattcggaatccattccgtccttgcagaaacgtgcggcgcccggtgactcctcgcctcctcgcgtccttcgctctcctcggattcactgggtgatttttccagccatctttcacttttttttttggttcctaatctttcactgtgtaaatctacatatagtttccatcaccactaacccttgctggaggaactaatgaaacggctttctcctcctaccttgcctgccgcaggatcttcgggaaccagctcctcttcctcctgggcctcggcttcaccaacgcctcctacgccgcggcgttccagccggccataccggtgttcacgttcctcctggccgcaatcgtcgggtaacactcggaaccttccttctctcgtctgacagcccgagtccttcctgacatggaccgacgccgccgccgccgcaataaattccacacattttcccatccaattccagcgtcgaggtgatcaacatcttcacgaaacacggggtcgtcaaagtcctcggcacagccgtgtgcgtctctggcgccgtcctgatggtcttctaccgaggcccatctctgatcgggaccggaggcgcggccgatgcaactgccctgtcagtggttattgaccacagccatgcctataactatgctcctcagtggctggccgcggccatgctccggaacggcgtggaggcatggcatctcggcgtcgtctgcctcatcggaaactgcttcctgatgggcgcttacctcgtcatccaggtgacgcagacttggtgacgcagacttggcagcactggggttggatatatatttattgaaatttcctttctgttactgatggattggtggatgcttactactgtaatcgtattttaatatctacgatgttcacgcctgatgcaacaaaatcgccgtccttttcctgacgcgacaacctgcaggccccggtgctgatcaaataccccgcgagcttatccctgaccgcctactcctactccttcgcaaccttgttcatggtggtcaccggcgcgttcgccaccagtgggctccacgagtgggcgctgacagcgaccgagatcttagccatcttgtacgctgtaagtttctgagtttgatattagattacatttcgaaatctccctggttgtgtaaccttgcttctacctacctgcctgacagggagtcgttgcgtcctgcctgaactacgcgatcatgacctgggcgaacaagatcctcgggccgtctctggtcgccctctacaacccactccaaccggcatgctctaccttgctctcgaccatgtttcttggaactccaatttacgttggaaggttcggccctagtcccaactgtattttttatcctctaaattctgagcttgttgacacctgtatttttactcgtttcagtgtgattgggggactcttcatcatcgctggcctttacctggtcacttgggctcgctacaaagaggctcagagcgctctggtagccggttatctgcgacctcttcttctgccgaccaccaaggcagaaggaagctccttcagggggctccattgatccttttacaccccaggcagagaggcagatggatttttgcctcaagtgtttctctaggccagcggcgtcagcagatttagttttcatgtctttgttgtataccaatcttgcatatatttggtttgtactttgcacggcagtttacacggtagagatggccagtactagtaccattttttcaagcattcaagcaaggttccattgtcagggaagaacggcagggcactgaagaaaatatcgtatcctgaacattgtattctggtgtcccaatcggcatttttgaagatgcccttttggttgtcctttcgacttcaacacttgtgtctgtaaggctagctgcagctgggcttaacgtcaccaacgaaaggtacttgccctgattgcttgacccattttgtctgtcttctgaatttgggagcatccgcattgtatgcaacgtagccgttcttaccatatgtatatcaacacccaaaactcatgtatactcgcaaatgatttattattagtattatttttgctatggttttttcctaacttgggcttatgttttgcgtttgcagaatatgaatatcattttcatgcctaagaagtgaagctgcagtgcgctagagctatcgtgctcgtggcaagatgaactattcttctgtgatgatggaacctaacccgttccctgtattcaagggagagtcaaaataatactccaaagttcacgtactcgtgtatcagattttggaacaattggacaaagtagtctcgtattgtgccctttttgttctactctttttgttctactatatgcgtttatatcttctctgttacctatgctgtctgtgcttctttgggcattatgctccaataaaaattcaactttgacagatgttttgccgtcacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacggggggcatgcaaaaaaaaaaaaacaatctataatgacaaccaaattcaaataaaactggccgttctttttacaacccctaaaactaagt

SEQ ID NO: 13218 - DNA, 2047 bp, Zea mays
ggccggccgggagataaaaatacagctacagccacggccaaagcagagcaggagcaggccgcgcggaacgagggaagcagcaggccgctagactagggagcggtcgccggcctcggcggcggagggatggggcgtgggggtgcggtgatggaggacggcgacagggaggagggaagctatccgacgctgctgcagcggtggtcctcgtcggtgtgggccgtcagcggcagcgggcgcctgctgtgggcgggcaacgaggcgtggcgggcgcacgtcgggatggccctcgtccaggtcgcctacggcggctaccacgtcctcaccaagtccgtcctcaacgtcggcatgaaccagatcgtcttctgcgtctaccgcgacctcgtcgcgctcgcgctcctcgcgcccatcgccttctttcgcgagagaaacgtgcggcgcccggtgactcctcgcctcctcgcgtccttcgctctcctcggattcactgggatcttcgggaaccagctcctcttcctcctgggcctcggcttcaccaacgcctcctacgccgcggcgttccagccggccataccggtgttcacgttcctcctggccgcaatcgtcggcgtcgaggtgatcaacatcttcacgaaacacggggtcgtcaaagtcctcggcacagccgtgtgcgtctctggcgccgtcctgatggtcttctaccgaggcccatctctgatcgggaccggaggcgcggccgatgcaactgccctgtcagtggttattgaccacagccatgcctataactatgctcctcagtggctggccgcggccatgctccggaacggcgtggaggcatggcatctcggcgtcgtctgcctcatcggaaactgcttcctgatgggcgcttacctcgtcatccaggccccggtgctgatcaaataccccgcgagcttatccctgaccgcctactcctactccttcgcaaccttgttcatggtggtcaccggcgcgttcgccaccagtgggctccacgagtgggcgctgacagcgaccgagatcttagccatcttgtacgctggagtcgttgcgtcctgcctgaactacgcgatcatgacctgggcgaacaagatcctcgggccgtctctggtcgccctctacaacccactccaaccggcatgctctaccttgctctcgaccatgtttcttggaactccaatttacgttggaagtgtgattgggggactcttcatcatcgctggcctttacctggtcacttgggctcgctacaaagaggctcagagcgctctggtagccggttatctgcgacctcttcttctgccgaccaccaaggcagaaggaagctccttcagggggctccattgatccttttacaccccaggcagagaggcagatggatttttgcctcaagtgtttctctaggccagcggcgtcagcagatttagttttcatgtctttgttgtataccaatcttgcatatatttggtttgtactttgcacggcagtttacacggtagagatggccagtactagtaccattttttcaagcattcaagcaaggttccattgtcagggaagaacggcagggcactgaagaaaatatcgtatcctgaacattgtattctggtgtcccaatcggcatttttgaagatgcccttttggttgtcctttcgacttcaacacttgtgtctgtaaggctagctgcagctgggtttaacgtcaccaacgaaagaatatgaatatcattttcatgcctaagaagtgaagctgcagtgcgctagagctatcgtgctcgtggcaagatgaactattcttctgtgatgatggaacctaacccgttccctgtattcaagggagagtcaaaataatactccaaagttcacgtactcgtgtatcagattttggaacaattggacaaagtagtctcgtattgtgccctttttgttctactctttttgttctactatatgcgtttatatcttctctgttacctatgctgtctgtgcttctttgggcattatgctccaataaaaattcaactttgccagcc

SEQ ID NO: 13219 - DNA, 1494 bp, Zea mays
cattgggtacctcgaggccggccggccggggattctcgagattctcgaatctcgatctccctgctctacccgcatcaccccgccgttgccggccccttcctcccgcttcccacctcgccgtcgccacctcttcctcttcctcatcgccggcgcttgcgcgccccttctccaccccgttgaccgccgcacccacggcctcgccgttgcagcactcgtgcgatccggtcacgagtggagcgcacgagctcattcgctgcttccgcctccccctcttccttgccggagcccgcgcctcctctcctcgccggcgccttcgcctgctcctgcgcccccttctccacgtcgcacccacggcctcgtgttgctgccctcgtgagatccggtcgcgagcgcccgacctaggccgctgcctcagtctctcctcgctcggtcgcatcaccaccgccggagacggaccgaggtgctctgcgagactccgcgccatagagctcctcctacggcgggttcttttccgtccggtagctgggttccctgaagccagtcatggcgatgaccaccgccgtgacgggcctcgccgtcgcagcaaccgctcccattcgctccttcctctcgtccgccgccgcctctgtcagcctgcccgccgatcttcgtgacctcgcctccgacctagcctcggaccctgccgtctcctaccgctctctgcgtgccatctggtgcgccacctcgccggacacccgcccgccgctccgcgacctcctccagggcgccgacttcgtgctacccagcccgaaacctcgtgagaagagcgatgagctgaaggcgaggctggagaagctccgggagacacaggagaggaaggagtatgctgagctcgtcagggacgtcgctccgcccagcaaggatgacgctcctgagcccttttcatcctacaaggatcagataggatttggtctgcatgtcgtggttattatgttcacaggttacttggtaggatttgctatgttcaaagctctgttcaacaataatgctgtactgaacgctgctggaggtatcttaggattagttggtggcatgctggttgagaccattctcttcatcatcagatcatcgagtaaagagttagcctctgttccaagatcaaagaaagctcagtagactcttgaaatgctatcatcagttagtggtgagagctataagtggccttagcttgtggaagtctatggagcattggtatgggtttgaaaatgcaattcatcgaatatatgcaattgacatccgatttgaatttgcatcatgaaggaatagggcagagggatttgatttcaatattattagctacccagaattttgtatctcgcccaatgattggctcgatgataattgaagaacatgtacctacggatatgtaaaaagtacatacaagaagatggtatgcttaacagcttaagtaccattggagagtatattggctcgaaattaaacagtaaaaaaaaa

SEQ ID NO: 13220 - DNA, 1237 bp, Zea mays
tcaaggaaccaatttctagaaacctggactgttattcaaagaaatcacgccttgttgactcttcacatatcgtaccaattattatttgctacacaactgaagaacgcaccatcactcgatgaggtcggtgatggcaatgcacaagaccgtgatctgctgggcgtactccgcgcgccgcgcgagcagcgacggcatcccggcctcggcgaagacggcgtcgcagcgccgcgccaacgcgatgccctccacggccatctccttccccgccgcgtaatcgcgcgcgtcgatgtcgtcgtacgcgcccgcgagcgcgagctccatgtcgaagtagagccctgcggcactgccccagcgccgccttcgtcttggcgccgtccgcgccctcgcccgcgcccggcggcgggccggccagcagcgcctccgcgtcgcggaccgcgccgccggcgttgttgacgccgaggttggccgccaccttggccaggccccaggcgtccgcgccagggctgtcgcggtgcttgctcagctccgacacgcagaagccgtagtcgacgcggtcgtccgtggcggctgccgccttgcacgtcgtctccacggtagcgtcggccgcgaggagcgcggcgaaggccgcggtggccaccaagaggggcttccaccacggactcatcttgcaggtggcggtggggcgacggagagctgctgcggtacggtacggtgttggtttcttgatgatggactgcaatctgcagctatatatttccgtgggccggcgtcagttgttattgaggattttaagagagcgcgtgatactcaggagtcaggaatgcgaacgcattgcgatgggttttttagtcactcatcaatttggcgttattgcattaacttgtttatcattctgtttcttttttttttggcgcctctttgtctcgtggagtcaagagagaactcaaaagttgaagccctggagcgcctgcaactggcatatatggaaaaaagccctggagcgcctgcaattggcatatatggaaaaagttaaatggcatagttgtactctacctagtgaaattctccctccacttcaactaataagatatctactttcgctatcatatacattgtgtctgaatatgtagtagtaaaagcaatatatttagaaaaaattaaaaaaatgaataacgggagaaagtattttatatctacatctatgcaaaatataaaacatacatatcttcatctctat

SEQ ID NO: 13221 - DNA, 1842 bp, Zea mays
agtatagtttaatggttttctagtcgtccgtcctcctcggttctggctgccaaccccaagaactgccttgcctagtgcctactgcctagggaaggaccgaaggagaggtgcgcggctggtggcgtgcgagtggcagcggcgccgcgggactcttctcctcgccgctcgcctgctgggtgcgccatccctcgacggtgacaccgtgatattgctgtgaagttttgtggcacttcctgcatcccttatatggtattaacaataattttaattgtctgggtgatccatttgagcaaatggaaggcaatgatgtaccccttggaaacatgttgcaaggggttccctatgaaagtttagacttacgtggcagctctatgcaaaattatgctccaaactcaggaaaacatatcttcagcagctcccagatgccaggtactttcacaatgtctatgaccagggctacagagcctgatgactttcctgggtttcagttcaaagaacagggaaagagtgatgaccaccaccaccaacaccatagtcatcactcaaagaactgcaagagtgatggtgaggaacatgttgtggctgaagatgctactgataccccaagtggcaaaggcaagaagggctctgcatggcatcggatgaagtggacagattcaatggtaaaacttttgataacagcagtgtcttacactggagatgatcatggtgctgattccggcggtggcaggaggaacttcacaataatgcagaagaagggcaaatggaaggcgatatcgaaagttatgggagagagaggctgccatgtgtcaccgcaacagtgcgaggacaagttcaatgaccttaacaagagatacaaaaggctgacagacatccttggtaggggcactgcatgcaatgttgtggctaatccagcacttcttgatagcatgactcatctttcagataagatgaaagacgatgcaaaaaagatacttagctcaaagcacctattttatgaggagatgtgttcctaccacaacaacaaccgtgtaaatttgcctgaagatcatgcacttcagcattcactactgcttgcccttagatgtaaagaggagcatgatcctcagagggatccaagtggagatgctgatgaatacgatcaaagtgctgattctgattatgaggagaatgacgacgatcaacatcctgtgcatataaacatgagggagccctcaatgcacaaaaggaagcgccacagtgatgtggctttggtcacatcaagttctcatgaaggcagtgagaggtctgattcccatgctgtcacagtggacatcaacaaggctttcacagatgcaaccaacatggttttgttgcaacaagacttggcttcacaagccatagagattcagaaacgtcgcttgcagattgaagcaaaggaactggaactcacaaagcaacgtcttaagtgggagcggttcaggaagaagaaggacagagagatagaaaggattgcattggagaatgaacatatgatgattgagaacaaacgcttggagcttgagctgagacataaggagttagagctagagctgaagctgaaagacaaggggaaccatccgtaacttttgcttgaccaacactacagtatgtaagatggtaaacaagttgcggttgagcttctggaagagagctggtagattagagtagactctgacaaccattcctgtgcgtatgactttgttctgtcttgtcagatgtacttgctgggcctactgcttgtagcaccgcctctgcagcagatctataagactgtgatttccaacttgccatttttttattcgaaaaaaaaaaaaaaaagtg

SEQ ID NO: 13222 - DNA, 763 bp, Zea mays
ttggagggaacacactatgttgtccatcccaatgggtcttcaatgtttataacgaggatgagtgagccatcaacagagccctttccgtggcagactgatggggagtttgatgtcgagaggagcttcgcaggcgagggcattgccaatgggtatggcttcagataccctagctcaaagcctggttcattgtttgtcctccagaatgggctacttgcatttgtttggagagaaaccggggccgtgcttaccttgcaaagactggatttggacgaactgctgaagaaaggggagcgtgtgcctgcattgcagccagtgccgaactttgcttacctgacaaagtcttactccaatgttttcaccagtttccctgtcggcgcggcttctcccaggtaaaaggtgtgagtggaggaggatgtatcaaatgatcacctgatgcagacaacggagaaacggtctccaggatcaagtttagctcttcttgcttgccatttgccaggtgatagtcacctggcgatgcttccataatacatactacctcgtggctgaaggagcatagcagcagccgtaatactttaggaattcaaatactttgtcatgaaggaaatagcaaccacaccccatattccttactacagctatttttcatgtttgtgctataaaatgaaaccaatctggagtgtaaatttgtatgagatctgtacatctcttcactataatgcaggcgatttatacgaagtctatactggaacagctttcaggtgtc

SEQ ID NO: 13223 - DNA, 744 bp, Zea mays
gcacgagccctaattttaaccgccaccacgacggcacgccgcctcgtcggaaaaaccatcatctaaagttcaacgcccgcaccgcaagcgcaacacgccaacacccgagacccgacgcggccttcgccttccctccgcgcgagggagattcgaggggagagaggttctcaccttcgcgcctgcggttgcttggcgcagagtcgtcgcagatggaccggtaccagagggtggagaagccgcgggaggagtcccctatcggcgccaacgagatccgcatcacggcgcagggccggccccgcaactacatcacctatgcgctcgccctggtccaggacaatgcaacagatgacattgtcatcaaggccatgggaagggcgatcaacaagacagttgccatcgtggagcttcttaagagaaggattgctggtctccatcagaatacctctattgaatccattgatataacagacacttgggagccattggaagaaggccttgtcactcttgagaccattcgccatgtgtccttaatcactattaaattgtcaaagaaggagctggatacatcatccccaggttaccagccgcccataccagctgaccaggtcaggccagcagctgactttgatcaggatgcagaggccgtaccaagtggtcgcggaagaggacgtggtcgtcgcagcaggggcaggggcagcgggaggggggtcagcagcggagcacactatgatgatgagattggag

SEQ ID NO: 13224 - DNA, 2412 bp, Zea mays
caggttccgtcgtcccgcactgcacagccgctcaaaaaccctagttctcgccgccacctccgccgccagtccaccacttgcccacctcgtcgcgacgtcgcgcagatatcttcaccgcccgccgcagcaggttcagctgctggcacgggacatttgaaccggcactacaaagcttgtttagcaaagctagggcgggctcgcggccgaggtacgcaaacccatcttaactttgctgctgatggtacaataagtacatgggtttacaacccacaggtagcacgtgatgaaatagccaaatttattgtttgtgaagatttaccgattatgttgggcgagagccaaaattttaaaaacttgattcaacgtgctttttgcccacaatatcagcctgtcactagaaaaactacaaaatctgatttgattgcaatatacaaaaataaacttgctgctcttaaagagtcttttaaaaaggttcagttctcatttgctttaacatcggacatttggacatcatcacaccaaaaaacatgttatgtttctgttgttgcccactacttggacgattcttatgctttaaacaagcgagtcatcggttttagaatgatggatgagtcacacactggagatgcaattgccaaccatatacttgaggtagttcgtgattttgagatagatggtaagattctctctataacccttgacaatgcttccgcaaacacaactgctattgatattctcacccctcggttgcagtcatatatacaaggttatattatccaccataggtgtgtgtgccacattataaatttggttgttcaagctggtataacagttgcaaataagtacttgaataatatccgtgctgctattcgtttcataacaagcacacctcaaatgatttctagatttgctgagtattgtaaagctcaggatatgagaccaagaaaatttggtcttgatatgaagatcagatggaattcaacctaccatatgcttaagagtttagaaggttatgaacaattaattactggtctttgtgaatgccaatggagggtaaagtttctaaaatactttgaacaaatatcacatgtatactgttttgcaactatttttgatccacgcaagaaactggatggtttgcaaattgcattggagggaataggtgatgcattggacatggatttttcagatgcttttaatcatgcaaaagatgacttgttccgtgtctttggctactattacaaaaaatatggtgaaagtgagatagactcacatgctattgagtctggtgcagaaatttcagatacctctcttacagctcacttatggaagagagcgaaggggaaagaaaatgccgcctcatctcaaaggtggaatcctaatgctgaattaaatcactatctgtccactaactttgtaggtactgatcgcgcactaaggggtgagaaggtaaagttacttgagtggtggagggaccacaagtatagttttcctgtcttgtctcagtttgctagagatatacttgttattcctgtctcaactgtttcctctgaagctacctttagcactgttgggagaataattgaggaacgaaggtcttctctagcacctaagacggtggaggcaatcacttgccttaaagattggaacagagccgaagagcggaagcaacatcaacttgaggatcctgagattgaatttgctgctgcagatttggacattgattagacaataatgtttagttgctgctgcagattgaatttgctactatgaactttatgtggttgtaatatttagactttatttggacattgccggtctgtactcttttccttatagaggggccctgtaatggggtataaggtttttaatgagacagaccgaggaatatatttttgtttccctcaaaatgtgtgttgattcattagttcacatgtttgtaagtttgtaacatatagtctggtgctactattttagtttgtaatgaaatactatcatgtatatctgtgcaattgtgctaatagtttagcttctatgttcttgaacactggtatctaaaatatgtgggccgggcttgggccggcacggcccgacaaaggcccaacgtgttttagggccgggctgggccacagtttctgttctttgggccaggatggcacgacccgaaaatttgccgggcctttttggcccgaatccgtttggcccgaagcacgaagggcttgggccatgccagcccggcccggcccaattcccaacactagctggaatgggggatgggctggcgcaaggttatgggccgagggaggcagtttcggcctgagaagctgataggctttatttcttttctttttcttgtctattctccatttattttatattttcatatttctagcttgaattcaaattcaaact

SEQ ID NO: 13225 - DNA, 2285 bp, Zea mays
ctgcagctctgcaagtcaaggtatggatggacagatcgactgcactgggcgtcgtcgtcgcggcagctgatcatggtcggcgtgatcgatcgggtacaataataattaataataccttcgctctgctccagcctcccactccttccaaaacaaatcaaaacaaaacaaatgaactgtcaacatcgaattgatttccaccgagtaatgcaccaccgtgctgtgccgacatctatcgtccaccacaagtgcatgcactgcgctgcgttgtgccgtcagtcagacacatggtaattaatatggcatttactttggtaattagttttcatcacttacaataaacgcaatcatgcaggtatctaattaataccggttgcccttatgtatgcctcatattttggtcgtagtagaagaggcttcgtcaatggactaggaacattcaaattcgtgtaccctttccaaatccgcacatcacctctattagtgatctcaccaataaggcgtgatagcaatgaagcataagcatgtgtttgatttttttgtgcaatctatgttccattgcatgcgcaataatggcgctgcaagcatatataggccctagtttggttttgatgactatatggcaccataagattattgtaactaatgtatgttttgcaaaaaaaaaaaacaagttaagttagaccatcatagtaatgaaggatgattatgaggtattcatgcccttgttgatggagagaccagcgattggttctaaaggaatggatgaaaaggttaaggtgcgaccaaagagaggatacgtgcgctataaacttacaaccgacttgaacataagaactaaaaaactttgtaagagagacaagtgtgttatgtattaatactgaagagctaactactgtatagatgatctaaaagataggctataaggttgtgcccagtatgtatattgttttgcaatatagattatattatttacaaaatggagtttaaaataagagataaaatgagtaaaactgttggagagagcctaaagatccttgtagttagcagttgactatagtacgtaggatacaatgcgatgttcgaattcaaaatgcacgcaggcttctcaaaagcaccggcgagaaagaaacggcccgttgaagcccatgtcccaatccttttgttgcatcagcaggttagcttaaaaaaaattaaagtttgggacagtattattatgattttgataccggatcgaaaaaatgcgccgaatgatgcagtttagtttattttttttttttttttgtggaatgctgggtgcatcgtcagttactcagtttggtacgacagtgtaatacgtagggttacatcatatttgcgggaagagctgcaagctgcaacaagaagagaggaagaaactgcaagctcatttggctcccctgttttacaggcgacgaactgcaaaccgaaatgaaagaggaagaagaagaagatgaggagatttgcgtttttcgatgcctcttcttagcagttagcagtagcactagctattcatgtgaatcatgtctcgctttcggcgctacccttgttcatgctcctcttggtcgtcgtggactccaacgccgacgacgagctccacctggtcgtcgaggtaccggtgcagcagccggagccggccgccagcgcgcaccatcgtcgtctcgtccggcacgcggtcgcggtcgcggtctccgtcgccgtcgcagcagccgccacgcgatctcccgctggccaccagcttcctcctgaccctcaggaagcggacggcggccacggcgcagcagagcagcggcagccagaggacggccagcgccagagccgccgggagcagccacagcgccagagccgccgcggccaccgccctccacgacgtcggcggcccgcgggctccacccatatgtccttccttcttctgcccggccggctggcagtggcaggacgaaggaaggaaggctagctagctagaacgacggcgacgagtgaggcacaggcactgaggctttgttgcttgcttgcacggatggaaaaggacacgacagccctgggctttgcttctgaggagagttcctttttttttcacttggcttttgccttgtgccctgtgactgagggttcgaatcgaagtcgagtagcggcaaagctttcttcttctctctctctctctcgcaggcggcgttgctttgcttgtgcgtgacggaggcgtttggtctgcagtttgcgctccatgtcccgtcccgcctttttgacgcgtcgccctctttggatcttgc

SEQ ID NO: 13226 - DNA, 2227 bp, Zea mays
tgcatgcctgcagcatagtcactgaaataaactgaaatgccacattggaacctacggctagcaagcactctgcactagaaacattggattttttaaagtcattatggcccgggcctaaaccacacgctcacacatcaaatcatctgtaagaagtatttttggatgtctgaattaaatgtcacataacccgattacgtatgtagatgtaagttttaagttattgtttctaattggcactcgtcaactcattctctaggtggaacaatcacttctcatcacaggttttggatatgaacatgatgatgctaggatgaccaatataaatttgtttaaggaatttactgccctaagcagggtaagtgtttcctgaactacaattgttttttttggctttttgcagatctgcacatctgaatttcctattatcctgttgggctgcctcttttttggagtgactgtagcaaccacttctaattcattttcaattgtattgaactggatgttgaccttcctagcataattagctctattttttaaaaaaatagttcattatgtatgtttctattttttatggtaccgcctatgtttatataaatttagcctagcactgcttgaataacaagtgattgaatgaggctcatatgcaaccattaaatcaatatttatgaaccaatgtttgttaaagtaataaaacatttacaaggaccatcgatgacctcaagaagctggtggtggcgtagatgggaacgcaccccgagaagatttgcatctagaggtggtgaccccacctctgtcctcaaccgccacctcgtacctcgtcttcggcgccgccggctcctgccccccttggcacgccttcggggtcctcgctggcggcaagcacctccgtcccggaggcatctgccgctgcagcatagaccaccgcgtcctcgctcagcagcaccgatgtcgatgatggcaacaaggaggacggctccgcgagcacccccgagatctgctgctgccactcccacgcagctcttgcttgtgagatctgtgtgcaggttgatgtcctcgtggcgccacgccgacctcaccgccaccaagcgcgccacccatgtcctcaccgacctcgccaaaaactataagaataggtgtagtcactgtcggggtgtacatccaattgagttttgagttggtgtttagctttcccttaccagggacggatcaaagcaccgtaataagtgtcgatatagctctttcaattgcgcctattgttttgtgcgggctatatggatcaaggaaccctctttgcagcagaggtttgttttgtgttctgctgctagtagtcgcatgtcagtttaatcttttgagttctggaagctgttggtcccttaggtgtttgggagatccttttgaatcgaagcacacacactcaggtgctatgacctttggcatttcatagttgcatatttaactggtgtgcgaagagcaccaggatagcacccttgcagcaggaacttacttttggttgcttttctgttgcctgtcatatcccgatatttgtttcctccggccccgctttgtttaattgtattctattgattttacagcttttgtacttgtacagttacattgtcatctggtttctattgcacgtgtagctgattagttgtagtcactatcttgcaagcatagatattagggaggtattatgtccagtcaagttttgtgttggctatgtgtagcgaattaggattgcttttcctgggatggatcagagcacatgtactgtggcgatatagttgtttcaatagtatagttgccaaattttatgtgtgtgctatatagaccagggaacccacttagaagcagaaaattttctgtgtgcgcgcgaaattttctgtgtgtgctaacaaattgcaggcaaccatcttaacaacaaaagaggctcgtacaatagcagagatgatgctaaaccacttgtgcatgcaaagtatcaaaaaggagaccagacacatgttgatgaaacatctaaaaaggtcctggaatctgaatgcacaaatgtggagaccttatagaaaagggcacaagcacacatgcatcttgctgatcttgatttggcggaggcagacatcaagaaagctctagataaactacagatccagacatgttaatcatatgtactactgaaattggcttaatgaaatcttttgagaataagaaaaaaaaaaaaaaatttgcggcc

SEQ ID NO: 13227 - DNA, 1515 bp, Zea mays
cttccgtcccacccgggaaacatccctctccctctgacgctgctgctactcaccctctcggatccctttccaccccacctcccagatgcggctggcgacgacagcgccggcgcctccgcctccggatccgttgatctagttgctgctgcttgattggggttaggaggaggtggaagaggagggaataggagatgttgttctggaaggacggcggcggtactggtggcggcaacggacgggaccttagcggcgggccgccctgcggccaggttcgtgtactcgtcgttggcgactcaggtgttggcaaatcttcattggtgcatctcttactgaaagattctgcagtggctcgaccagcccaaacaattgggtgtgcagttggtgttaaacatattacttacagtagcccagggagttcatctaatagcgtcaagggtgatgctgaaaggaacttctttgttgagctttgggatgtttctggacatgagcgctacaaagagtgccgttcacttttttattcacaaattaatggtgtcatatttgtttatgacctctcccagaggaaaacaaagacaaatttgaacaagtgggcagtggaggtttctgaatctgggaccttttcagctcctcttgggtctggtggtcccggtggccttccagttccttacctagttattgccaacaaagtggatattgctccaagagatggtagaagagtgagcagtggtaatcttgttgatgttgctcgtcaatgggttgaaaaacaaggtctgcttccatccagtgaagtgcttccacttgcagataactttcctggcaattctggtttgctcacggctgccaaagaggcaagatatgataaagaagctctaatcaagttcttccgcatgttgataaggagaaggtatttttcgaatgagcttcctgcccctagcccatggtcactcactcccagggaagataccattcttcccgtagaaactgtgaacgatgatgacatgttccaaagaaaaagctacggcggacagagctacaaatacaatggggttaccccactgcctgcacagcggaacctaactccgccccccacactctatccacagcagccaatgtcctcttcatcagaaaactacagataccacagattttcctcttcgtcaatacctgattcaagtggtggttcaaaaagccgagcgaaccttaatatatgatgggatatgtaagtccttatccattatcacctggagtgtgggaaaaaaacatgacacctgggttttttggttctcaggtttttgatctttttgagttgttcatctgtctttgatttgattgtaatatgtgcatgttgacagggcgccagagcattatgtttgtgggatcactagtgataattctttggttcttctctgtatatctcctaattttgtgtatgaattcaatatagttatttaggaaaacacattacatggtcaaaaaaaaaaaaaaaaaaaaaaaaaaaaaaactcgagcccgggg

SEQ ID NO: 13228 - DNA, 1886 bp, Zea mays
gaaataaatctccccgtctcgctgccccgtgcctgcggggacactccatctcctcctccagacctccacgatccggcctcccccacctctcgccggccgaggacgatccgccggcatcagagcgcgcgccccggagccgaaaagcggggggcgtcatgaagcccccggccggcgccagcggcaagggcggcgcggtggacccctctctgccgcggttcaggtgccaggagtgccgccgcgccctcgtcgtcgtcggggtcgagtcctacgccgacagactgcccgcacacgccgcgcccggtaatcatgcatcttctgttcagggcagtgttatgggtgcaagcaagatggacaactcttatgttgtgctatctagacagaacaaatctcagggtcctagaattcctccacgcccaccaagtgcagcagcggcacatgctgatcccagccaatcaacaagagcgatagaggggtcatatatagtgcttccacctcctgccgcttccatatacaggacatctgcctctgaaggtggtgcacagctcacaccatcaggtgtaatctccagtagcccctcgctgggaaacaattctgggtttcactctagtgttactgtgctgaaaagggcctttgagattgctagctcgcaaactcaggttgaacagccactttgtctggaatgtatgagggttctttctgataagatggataaggagattgaagatgttaatgctgatattaaagcttatgaggcttgtcttcaacgtttggagcaggaaccttacaacatcctcagtgaaacagattttcaaaaggagaaacaaaagattgaggaagaggaaaagaaacttaaagctgctattgaagaagctgaaaaacaatattcagaagttagatctgagatggaaaatcttgaaataaagtctaaacaatttgaggaattggaagagcggtattggcatgaattcaacagttttcagtttcagttgacatctcaccaggaagaaagagatgcagtttttgccaagatagaagtttctcaggttcatttggaactgttgaagcgtactaatgttctcaatgatgcattctatatatcacatgatggagtaatcggaacaataaataactttcgcctaggacgtctttctaatgtagaggttgagtgggatgagataaatgctgcatggggtcaggctgcactgctgttgcataccatggctcagtatttcaccccaaaattccaataccggatcaagattcaccctatgggaagctatccaagagtcacagacatccagaataacacatatgaactgtttggtcccgtgaatttgttctggagcacccgatttgacaaagccatgacatggtttcttacttgcctgcaagagtttgctgagtttgccataagtttggataagcagaacaatgttccccctgaaaaatcactgaagcttccctacaagattgatggtgacaaagtagggagccacacgatcgtccttagtttcaataagaatgaaaactggaccaaggctctaaagtacatgctgtgcaatctgaagtgggttctctactggtttattggcaatacaagttttgcaccaccctctgtatcactgcacacacaatctctgaagaacaagagttgatgctgttctctctctgcaacaactgtacatagtttgtgtactcgaccctattcgttggatatagccgcagtgacaataatgacacgtttgatgtgcatttgtttattgcttgaaatctgccatgatgtgtttattgtacaatctaaatctcaggaactacattttcacccttaggtaacgcctccaacattacgttttggaaaaaacaatgcaaaaacagtgttttaggtg

SEQ ID NO: 13229 - DNA, 1765 bp, Zea mays
ttaacgcgtcgttcggtactactagtagtcaatgatttcatgaactccaaagattttacatggtttcttcatgcttcaaaatgtattcgaattttccccccgaagtttagctatcgtagctcaaatacaaattctaaacttttcaaaaattattctaattatgaaattcttgtttccaaaaacaacaaaatatttcatttggcatttgctgttgcgccgttgccgtctgcgtgcgccaccgtccactgaactgtggattacatgcgagtatgcgactcaagtcaaaaatcaccacccgctcccactcccagccatgcctctcatcttcttctccgccgcagcccccctcgtcgccgtctccctgctgcccctccccacccactgctgcctccgcctcaccgccacccgcgcggccgccacgagcacaaccgccaccccgggtcccgctcccgcgagcaccttcgccgtcgaggactacctcatcgccagctgccacctcaccccaccgcaggcgctcaaggcgtccaagagcctggcgcacctcaagtccgcatccaacgcggacgcggtgctcgccttccttgcggacctcgggctctccccaaaggaggtggccgccgttgtggcgtccaatccgcgtgtcctctgcgctcgcatcgaccgttccctggctcctatctccacggagctccgcgcgctcggcctctccccgtcccagatcgcgcgcctcgcgcagatcgccggccgctacttcctctgccgcagcttcgtctccaaggtacggttctggctcccgctcttcggctcccccgagcggctcctccaggccagcgactggaactactggctcctcagctccgacctcgagaaggtggtggagcccaacgtggccttcctcaggaagtgcggcctcagcgcagtcgacatcgccaagctgctcgtggccgcgccgcggctcgtcaccatgcctccggagtatgtccaggacgcggtgcggcgtgccacgcagctcggcgtggcgccgggctcccagatgtttcgccacgcgctctccaccgcgggatgtatcgggcaggagaaggtcgactccaaggtcgccgtcctcaaggagacgctcgggtggtcgcaggaggaggtgagcctggccatcagtaaggcgccgcggatcctggttgcgtccgaggagaggctgcgccggaacgcggagttcctgctcaatgaggtcgggctgccgccgcagtacatcgcccgccgttcggtgcttctcatgtacagcctggagaggcggatagtgccccggcacctcgtgctggtggttctcaaagagaaggggttggttgagcaggaccggtgcttcttcaacgtggtggcaccaacagaagagaaattcttggagaaattcgttgctccctacgaggaatccatccctggtcttgccgatgcttacgagtctgcttgtatggggaaagtgacccggggtctatgactggaatgtcgaggagaatttcgaaggtgtgtgttccctccattgtgcatttgtgtaacctcattctactgatctcgcttcaacagaaaaattattccactgatgaactatcgaagacaaaggcagtttcgtggacattagcttaggtccacactagtaacagcataaattcatgttatagccatgaaaatgttcatttctaacttaaggatcgtttcatatgaaagtgcaagcaataaaattttttcccatgagattttagcaaaaaaaaaaaaaaaa

SEQ ID NO: 13230 - DNA, 1874 bp, Zea mays
ggtaccctcgcaggcccggccgggactagcagccggcaggccgcaacccgcaaccgtggcaccctgcgcgcctcgaacaatctcgtttcgtactcccgtttcgtttctccccctcgctccccagccgcatctcgagcgcgctctcggcggccgtccacgtctcggtcccacgcgctgctcgcttgctcgccggcggggcgcgagggcggtggcctaggtcgtacccagcgaagcgcggcgtgccacgaggtgggggttggctcgggaccatcgagcctgtccggaattttttctggcgcgtgatttgccgctgagaaagcatcggaaaagggaacggggatttactctcagtagccgcgagctacccgccgtcccctggtcgattcagtgcaaatcctccaggtttctgggtcttaatggcttcctcagatatctctgttgatattcgtcctgacataaactcatttgatcattttttaagcatgcgatacattgcaacagatagaccctggctgaaattatatggaataagagttcagcctgtgccaccattcagcagtttgagctacaaacctgatccagcgctcattcatcattgcctacctgatgaactaatgctcgagatttttacaagaatgagcccatatactttagggagggctgcatgtgtctgccgcaagtggaaatatactgcacgcaatcctactttgtggcgtgctgcatgcttgaaaacttggcagaggagtggaatggaggcaaactacatgatggttcggtcgttgtatgattcctcttggaggagaatgtggctacagagaccaagaatccgaattgatggtctctatgtgagcaggaacacatacattcatactggagttacagaatggcaattcaagaaaactgtcaatgtggtttgctactaccgttacttaagatttttcccgagcgggaagtttctctataagatctctccagataaagttaaagacgctgttaagtgcatgcatttccgggcatcaaaggctgattgtgtatttaaaggtgactacgtgctgtcagaggatggccagatagaaatggctctcctgtacccagggcatcggtacacgcttgtcaggatgcaccttaggcttaggggcaccacagttggtgcaaataacaggttggatgtactgaagattctaaccaccggagtgaatgcaactgagctgcaaaactggaaaggaagcatactagaactcgttgagggctgggaggaggatgagacgcatgacccggatgtgcctgccgtttcccacagcaggggtttgtcaccctttgtgtttgttccgtttgaggaggctgatacttcggtgttaaacctccccgtggagaagatggactactacgtccctgggtgagctcttcatgacgacgatggccattggagaatgagatgatgggtggtcatgttacaggttaaaatgatgatggccaacgatctccttccctctcagatcccttgctagagcaaatgtgtaaatacagtgttgttttgtttacacttttcggttggtcgcatgctgttgtatgacattatgtttgttgatacctggaaacaggttttattattgttggtgcttgaaaatggtgtgggaggaaactcactatcaaaaaaagtagagctaccctcctgaagtaatgtgggtctgtattattatagaaacaagcagtctatcgttgcgaactttttagtctgtatgtattttcgtattgtacagttaaaaaaaaaaaaaaaagcttcgtttaacattaatgactaaaaatagatgggctgtaataatgtgccatatatgatcaatctgcttgtaccttttggtgtcttatataaggaa

SEQ ID NO: 13231 - DNA, 717 bp, Zea mays
taggggccttttttttttttttttttcttttgtttttttttttttttatttcaagctttgttattattatcttctccaaaatcaaatggttctgaaacactgcacgagatatccaacgtgtaacatctgacatcaacgccttcgaagaagcaaacgttcatcaagtgacaggtatttctggatatctgcttatttaagtggcagctggtttcttgaacaaccaaccatctacatgctgctgggtttgggatggggttcttgatccttgtccacgagctccttcaacgccggattccgaggcaggtacgtgtcggagatgtaggagcaggtggggaggacgcgcatgccgcgggcccgcgcgtgggcgaaggcagcgtcgcagagccgcgccgcgagcccctgcccgcgcttgctccgcggcacgtacgtgtgcaccaggtccatcactgccgcagcgggggccccgcggccgtcgaggaggcggtactgaaggaaggcctcgccgtcgggcgtctggaacctccccttgtcctccctccacacgatgctctccgtctccggtggaggggccttgaccgcccgctcggccgcgacgccctcgttcgccatcacccgtgagctcgtgtgccccgtcgtcgtgcttgtgcgtgagtcgtttcgtcggctaggggaaaccaggcagccgcccggcttggcccaatcccggaaccggccggc

SEQ ID NO: 13232 - DNA, 1984 bp, Zea mays
cacagcgtcgtttcagtcccgccctccccctcctccctttcgctgaatcccctgccttctcctgcctccccgtccaagatccccaaaactaccgccgcgccgccgccgccaccatgcctctgtcacaccggaacctcctcctcttcattccctccgtcatcgttctcgttgtcacctccgccgccgccctatccgtctccaccccggttgagctcacagtcacctcgcatccgccggcctccgtccacctcccgcacgcgcgacccctccccggtggcggtaccgccgggccctactgcacgcgtgttctcctccaaggccgcccctcccgcatccgcgacccgtctcgcttcttccacgcgcttcgactccgcgccaacgccacccgcccccacggcctcgagctctgcttccacagaaatgccacagtggggccatgcaagtgcgccgcgtcccaatggcagaaaatgcccaagagcgggctctggatgcaggtcatctcaccatacgactaccggattcttgatttccgaatgcctgctgacccttcgaggtctgttgtggtgtccactgaggaagaattcttgctccacagggtggtgttctttgtcgtaggattggtgctcatggtggtggcacacacattgagcgagtctgtagtgttctactatggtggagcaatgactattggcattttccttgtgatactgattatactctttcagggaatgaagcttttaccaactggtagaaagagttctcttgctatttttgcatactcctcagtcgttggcatgacgacatattttcttcactatttgtcgggtatgctgcgctcagttcttgtggaaattgggattgctgaagacatgcataatcctcttggaatattcgctctagtatgtgtcgtcttagctggagcctggtttggttactggggtgtccgtaaacttgtcctggcagaagatggatctgttgatgagggtgtggcttattttgttgagtgggctatcttgattgtttcagctgttatgatcctccagagttctctggactatctctttgcctttgcagctctaatcttctgtgtaatcatcaaagcgattgcaagaattgaaggaaagtcaaaagttttacactatatattcggtaattcatctcgttatggagatttctttgaagactattctagcatgaatggaggtcgccaagatggcaagcttcatggtggataccagagacgtacagagagtagaaactctcctcttgcaggctcagcaaagtcattgtcgcaaggtgttgctagggacagcttctattcaacgtttcacaccaccccagagaggaggaaattctccaaagaggaatacgaagcattcacgagagaggagacaaagaaagctatgaagcaactgttgtcctcaccggatttcaacaggtgggcgttggctaacccggacagaatatctgtggccccaccaggaggaaactacagcagcagcaacagcaaccagcagcgacatcgtttcttgggactgttttaagctgcgcgcgtggtgtgctttcagcaataggagtgctcattgctcaatgatttcgtgcgtgatttgattagcaagggtaggataacatcagtgttccacattttgaagtggcagcaaatatgtagaatattgtagtttagtcgcatcttaggtccaaagttcaaacagcatctgtctcttgtaacattccattcagtgctaagttgagtgaatctcaacttgagttgtatatgacgcttgatcatcattaggataggatgaaagcattcaagtgtttctatgcctgcataggaactaggaagcaagctgtgtgtgcagtattttgggtttgtagtcgggtcatgcgttggatactatttctcatttatgtctctaaactaataatttgttcttgattgtttaatatgtatgaatgatatgatacatactattttgccttt

SEQ ID NO: 13233 - DNA, 2005 bp, Zea mays
tttctttggccgaggtaccaggggcaagcagggcagaagaaactcagagccatgtccacagaatgtacttcatgggacctaatactttccgagagccctggcatctcccctactcacctcctgatgcgataattggaattgtttatgaagatgctttcaaccgttttattgatgagatcaatttggtggctgcatatgagtggtgggaaggatctatacatagtatactttctgttcttgcgtatccttgtgcctggtcttggaagcaatggcgcagaaggaaaaaaaaccatcgtcttcaagagtatgttaaatctgaatatgatcattcatgtctccgctcctgcaggtcacgggctctctataaaggcttgaaggttggttcaactccagacttgatggttgcgtacatagatttctttctcgggggtgatgagaaacgacttgatgtagcatccaccattcagaagaggtttcccatgtgtctaatttttggtggtgatggaagctatatgtccccatactatctacatagtgatacattgctatcaaatcttcttggccagtatgtatctactgcgatctggaatagattagtcgctggtttgaatgctcaattaaggacagtaagacaaggaagtgtccgttctactttgggccctgttgtttcttggatcaacagtcatgggaatccccaacttgagagacatggtgttcgagtggagctagggtggttccagtccactgcttctgcatattaccagcttggtattatcgtagctgtgaatgagaacttctacaagaatctccgccaccatgagcatgccacagaattttgtgaacgctcaaggaagaacgttgcagttccacttcaggatttcaatcaggcaaatctggatcagccttgcacaagctatgctgtttctagaaagcgattgacaggtggagtcaatggtgggatcataaatgagggaacgctcaagtcactgcactataaaagagactatctctttccattctcattgttattgcgtaattccaggcctctaggctatgcggaaacattgcaattgctcatttgtattgtacttctgggtgatttctccatcaccctgcttatgcttgtacagtactattggatatctgtcggagcttttcttgccatactgctcatcccccctcttgctttgctttcaccttttcttgctggtctcaatgcactttttagccgaggactaaaacgatcttcagtgacccgcatttttgcactttggaacattacttctgttgtaaacattattgtagcaatcatatacggctctttgtatttttggctctcttctttggcggtgtcctcagttcatcaagtatacaacacaaaaagcttcaagagtagagaagacaatgaatggtggatactgcctactatcctttttctcatcaaatcactgcaagctggactagttaactggcacgttgccaatttggaaatccaggactactcgttatttagcccggacccagatagattctgggcaatgtagtcgcctgcagcaaactaagaattgcagaaagcatggtttagtgatcgcaagaatggcaagtattaattattggatgctgaatatttgcgttttgtcccttgcaacgtcatcagcccaatacaatctctgaatctgaaggggtctaacacgctggctggaacttccttctatttatgggaagcgctcctgcgtagtgcactagtgcagatatgttcattttctttttctcagtttttttttcccgtcttggtcgtgtgcctagaataggtctgtcgctcggtggggattagatttgtgcattttctttggttcaaattaaaccgttgattcgagtgtacagcaagaaactattgtgattgtcgctctagatgtacatcactgtaagtataatagtagaaccatttcaactgtatacaatcctcaaaggaaagtatgtttctttctattttctttttcctaac

SEQ ID NO: 13234 - DNA, 1448 bp, Zea mays
aaccccccgtctcgtcccccttcctctcagagtcgagacccaggcagccgggccggcagttccagccccacctcgcctctaccctcctcaaaccctacaccacgccccccggcccccggcccccggccttcgcccaacccgatagcgtagcgccggcgcagaaccggaccctgccgtgcggttgtccaccccgctcggcgccgcccgccgccgccgccgccgcctttgatgtctcctacctgcgacctcggcttcctctgcccccggtcgcagaagagctcccaagaggtcccccgagccaccgcttccggcgcccagcgattggcctccccaccgcagccgagatgagcagcggcggcgacaagatgttgttgtttgggtcctttacggaggacgagactgagttgttacatggtcagcccctcaaaagtccaactaaaagtgtcagcaaagaatgtgaacggacggagatccagtttggcaccctgaacttttcagtgctgaatttagagaaaatatctacttcaagtgttgttcttcctgcaaaatcagcaaaaggggaaaccagtgccatcacgaaggagaatgcatgcaataatgaaaagaaagctgcagggtcaagcctttcaaacggtggaccagttctggctaatggatgccctcctgttaatgttcctgctaacaatggtttatttgagaatgtgaagacagaggctgttgtcccaccagttatacctgtcaaaatcatcagcaatccaacaccgcaaatgacgttggagacgcataaggatggcaccaaacccactgaaagcagaaagttaaataaggaaagggaaattactgaaaatggtagtccaattgtcgataaacacattgttgctgctccagcagaagaggcagtcacaagcctaaataagaaagcctctcagaacatgcccttgcttccacatggtttgaggaacacaggaaatatttgctttctgaatgcaactttgcaggcattgctttcatgctcgccttttgtctaccttttacaggatttgaggaaccgcaggatacctaaggttggctacccaactctgagtgcatttgttgagttgatatctcaattggatgtgcctgatgagtcagttatcaagaaaaatgagaaggttattactgttgccgcaaaaccacttaatcctgccatgtttgatgctgttctcagaaactttacaccagatgtgccggctggaataactgctcggcctaggcaggaagatgctcaagagtttttaagttttgccatggatagaatgcatgatgaactgctgaaacttaatggagatggtttgaattcaaaggaggggatggttgtttcatccgctgatgatgatgcttgggagacagttggacgaaagaacaaatctgcaatagttagaactcagagttttgtcccctctgagctt

SEQ ID NO: 13235 - DNA, 1131 bp, Zea mays
tgggtccccccgggcccggcggggccggcaaaagaaagcccagaccaaagcagagctgcttgcttctccacgccttgtgcttccacagagcaaccagttctcagaagcaatgtccgcacccctggtggacgccgagtacatggccgagatcgagagggcacggcgggacctccgcgctctcgtcgccagcaagaactgcgcgccgatcatgctccgcctcgcgtggcacgacgccggcacttacgacgccaagaccaacacaggaggccccaacggctccataaggttcccacaggagtacagccactcttcaaacgcagggatcaagatcgccattgacctcttagagcctgtgaagcagaagcaccccaagatcacatacgcagacctgtatcagctcgccggagttgtcgccgtcgaagtcactggtggaccgaccgttgacttcgtccctgggaggaaggattcttcgatttgtccagaggaaggacgcttgccggatgctagaagaggtgcttcgcatctcagacaagtattctaccggatgggtttatcagacagggacattgtggcgctctccggcggccatactctggggagagcgcatcgagagaggacagggtttgatggcccatggactagggatcctctgaaatttgacaactcttatttccttgagcttctgaaaggcgactctgaagggctcttgaaactccctactgacaaggttcttgtggaagatcctgaattccgtcagcatgtccaactatatgccaaggatgaagatgcatttttcagggactacgcggagtcacacaagaagctgtcagagctaggcttcaccccccctcgctcttgtctctcatccagatctgcgaataaacacaagtcgttgctggtgcaagctgcagctgggctcgcagttgctaccgcagttgtcgcatgggcgtacctgtgcgaatccaacaacaagttcatctaacttacgcttaccgttagtacaaatacaaattggagtcgccaaaatatttcagttctgtgcacatgtatttgcatctacatattgatataataccaagcatgttatgtgttgtgaaataaaaaaaaaaaaaaaacggccgctctagagga

SEQ ID NO: 13236 - DNA, 893 bp, Zea mays
  misc_feature (888)..(888): n is a, c, g, or t
gggtacctcgcggccccccggggggaaacggcatggcggaagataaggaggctctcgccgtctcgcacaggctcgttgttcctcttatccgcggaggaagaaccttggcccgacaccatgctcccaatggccgtccaccccaccaccacgccggccttgtccccgcgcgcccgcgtctcgccgcacaggcctcccatctcctccctggcggacccctcgtcctccccctgccatcgcatcgtcagtttcaaaagcaggaggctgccacttcgctctctccacatcgccgctgccgctgccgccggggcagaggaagaagaggcgcaactaggtggaagtgtgaacgcggtcgacgaggaggaagcggagaataaggtggtggtgcccgagagacaggacccgatgctggtactcaagttcatctggatggagaagaacatcggcatagcactcgaccagctggttcctggctatggcagcatcccgttgagcccgtactacttctggccgcggaaggacgcgtgggaggagcttagagccaagttggaagagaaagagtggatctcgcagaagcagatgatcatccttctcaaccaggccaccgatatcatcaacctctggcagcagggtggtgggaacctgtcgacatgagtccctccccgccctgttctttcaaccgtgcaaagcttgcgttttgttggtttcactacaggctctctctgttgttaatgttaaaagtatggtacatggccttgtagatcggttcaaactgttctcaggtatggccttttccatggaaatcatcttgtgatttatcttagttattatgtgtatcagtcgtccacccccccccgggaaaatcaagaaacatatccttttcggtgtggntacag

SEQ ID NO: 13237 - DNA, 899 bp, Zea mays
actccatagggcgattgggtttctacaagggcggccggacgggcaagtttgttgttcctcttatccacggaggaagaaccttggctcgacaccatgctcccaatggccgtccaccccacgagcacgccggccctgtcgccgcgcgcccgcgtctccccgcccaggccttccacctctctggccgccacctcgtcctcgccctgctctcgcatcgtcagtttcaagagcaggaggctgccacttcgctctgtccgcagcgtcgtcgccgctgccgctgccgccgctgcagaggaagaagaggtacaactaggtacaggtgtggatgcggtcgacgaggaggaggcggagaataaggtggtggtacctgagaggcaggacccgatgctggtgctcaagttcatctggatggagaagaacatcggcatagctctcgaccaattggttcctggctatggaagcatcccgttaagcccatactacttttggccgcgaaaagacgcgtgggaggagcttagagcgaagttggaagagaaagagtggatctcacagaagcagatgatcatccttctcaaccaggccaccgatatcatcaacctctggcagcagggtggcgggagcctctcgacatgagtccctccccaccctgttctttcttcaaccttgcaagcttgtgttttgttggttaattggtttccttacatgccctctctgttgttaatgttgaagttatggtacataatgtagatcagtcgaatctgttctcacgtatggttcttttacatggaaatgatcttgtgaattatcccagttattacgtgtatcagtcggttttttgttgggaaaatcaagaaacacaaataaaatccatttcggtcaaaaaaaaaaaaaaaaaagcggcc

SEQ ID NO: 13238 - DNA, 3003 bp, Zea mays
cctcgaggcggcgggccggggttcaataacgctgcgtcttgacgatacgtgtcagcaagtagcaagactcaagactcaagagggatcccttagcaaaaccggtctcgcaaagggacacaattccctaggaaccgcacaaaagcttcctgcaatccggcggctttggcgttgaacctccccccttgatcagtagtagaatcggctgctaaagatttctatttttatttttttctcggttcggaaggtgccgtgcggcgagcgaaataaatcgctgcggcgagaatcctgtggagatgagttgcgttaggtggcaggaccactcataaattctgcctgttcattcagatctgctccgtgctgtgcttcttctgctgctgccttgcagcgaccagcgagaagaaatccattcgctaggccggcccacccacccacgatagcggttgtggtcactcatgcgtcgtcgccggagtccaatctcgccgctcggagtttcttgacttttctggtcggagtttccatttcctcctggaggagattatttctttctcctctttcaccccgagaatctcgtctcgggtcgcgctggtttgattcctcctcgcctgagtccaccgctttcgcttccagtggagaagcttgtccgtgaagcagcgctcgtctcctgcttaaaatttcttccttctgccttggtttctttgctcgcgcccgccgatttgcttgctgcccagtccacactcctccgttcgtgtctcgcggctttccgcactcgttttcccggtctcggatttcgttaccaatgggcaacgcgttcgcgtgcatgccgcgcaaggagcagcgaggcgcggccgcggtgtcgcgcagcaagcggatggggagcgcgcggtcggcgcgcggcgggcccaagctgacgcccgcggaggaggagctcctccaccgccaggctctggccatggccatccaccagcacctcgacgccggcggctccatgtcccgccgcatcgacgccggggcctccctgtcccggcgcatggccccgggctccaccagctcccgccgccgcggcgacctgccggactccgtcacgaatgccaagcccgccccaattgttctggagaatttggaaacaaagaaaattgtccttgttcatggagaagggttcggtgcttggtgttggtacaagaccatctcacacttggaggaagctggtctagatcctgttgccttagatctcacaggctctggcatagaccatactgatacaaacagcatagctacgttagcagattactccaagccattgattgattacctcgacagacttcctgaagatgagaaggtcattttggtcggccatagttgcggaggtgcgagtgtctcgtatgcactggagcagtacccccgaaagatctcaaaggcggtgtttcttactgctacaatggtaaaggatggccagaggccctttgacgtgttctcggaggaactccggtcggcggatgttttcttgcaagagtcacagtttctagtctatggaaatgggaaggacaagcctcctactgggctgatgttcgataagcagcagatcaaggggctgtatttcaaccaaactccttccaaggatatggcactagcagcggtgtccatgaggcctatccctctagccccaatcatggagaagctctccctcaccccggagaactacggctccgtccgtcgctacttcatccaggcactcgacgaccacatgctgtcgccggacgcccaggagaagctggtccgcgagaaccctcccgacggcatcttcaagatcaagggcggcgaccactgccccttcttctcgaagccgcagtccctcaacaagatcctgctggagatcgcacagatccaagctcctgcggcgctgctcaaggcgagctcccccgaggagaccgtcgccgccatggtgacagggccagccaagtcatgactgcatgtatgtagtgtacacgaaaagagaaatgagtaagcacataggttgcaaaagggagggggaggaggtctggggattaactgaagccaagctgtgtcggataataatgtagggagttcaaagtgtttctttctttcttctgtgatcagatcagatcatatagagaatgagaggtggtcagcagataattgcatttcttttttcctttttaccttgtgaatgaatgagatattcagtgaccaatgtcaacgcggaaagcctttgtggtgatgctcactaattcatcagcaatcattatttaggtaattataataacgtcaatgcaagtaactccgatgagtcaatcgaatgaggcaatccccacttggttcgaatgattgatggttccattcaaagggagttagtttttctttctaaaaaaatccatattctcaaactgtgacgtcacctcttctaagccccctgtggtgccaattcagatgggctccaggatgaggccaggcccatgggggcacgattcggccttttcttgtcttgctcgtcaaaagaataaaatcccaacccataggaaagcgtagcataggaggccaggaggggagaaaggcgaactcgaattgggggaagagagcgagagacgaatcgcatcgagccggagaggatcgtcagagacagggaggagggcggcggaatcggcgccggcgggaggcaggcatggaggacttgagcgtggaggagctcgcctccaacctctccacctacaaagagcagctacgcgaggtctcttccccgtcccctcgatctggccacgccccctttccgttctggctgcaattcttgtagcacggaaggttctagctagtctcctcgtttgcagctcagggttcgcgcgtagccggattactatggatgttcggctctgattctagtctagggttttgagtaatttggttaatttaagctttattcctcatcgaattcgtttatgcgtaataagattatatacttggcaggtttgctcggttatttgcatctctgca

SEQ ID NO: 13239 - DNA, 1115 bp, Zea mays
gaatgcccagcccgtgtccttgcaccgtcgttgccgcggtcgtgtcaagagatgttcaattcttggtcatggccgccgccggaggaggtagccgcgaggcgacggttgcggcggcgctagctcgggaaccccgacgctttttcgcgggtgcggccgtacgggagagagcgcatccttgccgttggaggccggagaagttttttgaagtggagatgaaggtgcgcgactatgaaattgaccagtatggtgttgtcaacaatgcaatctatgctagctactgccaacatggtcgtcacgagctgcttgagagcgtaggcatcagtgcagatgcagtggcgcgcagtggggaatccctggctctctctgagttgaacctcaagtactttgcccctttgaggagtggcgataagtttgttgttaaggtgaggcttgcaggcatcaaaggtgtacggatgatattcgaccacatcattacaaaactgcctaatcatgagctaattctggaggcaaaggcaacggctgtttgcctgaacaaagactactatcctacccgtattcctcgtgaactattgtccaagatgcagctcttcttacccgtggacagcagagggtcaaatgaagacgttaataatcggaataacagctgcaactaattctggaggcaaagacaagggctgtttgttcgaactgaagactaccatctcatctccaaaactgtttatgtcatccaagctgcagctcctcatcgaagaatatagtagaatccctccgttcttttttatttgtcgtggtttagttcaaaaatgaactagcggacaataaatattcgagaacggatgtagtagaatctagtcttggagactggcggctgcttggtcctgcagtgccaacgaaaaccacctatgtatctccatctcaggagcgctgtcatagaagagcacagtccatcttcattctttgtaactgttcacccgaaacatttgatccgttactgcagtcgtttggtacagaaagctcttcttgctctggaggaataatatgtgctatgtacatctgcttgttgtattaggaacatgaaaggaaattgtcggaagtaggatcatgaggtgccgaca

SEQ ID NO: 13240 - DNA, 1187 bp, Zea mays
gcacgagctactgcccactaatacattggtcaagctcgcgagccgccgcgccacccgcccgcactagcccactccggagtccggccctcgccctgctcgccgcaatgcatcaccggttcgcgggcctcgtgcccaccgcccgccccgctctgccgccgatccacggcggagtcgtcggccggagctatccgcccgtccaccggtccttggcgcttcgcctggcgccgtttgcctccgcgtctgtccgacgcgcgtgccgccccctcgccgtctccgcccaatccaccagcctccggccggagaagttttttgaagtggagatgaaggtgcgcgactatgaaattgaccagtatggtgttgtcaacaatgcagtctatgctagctactgccaacatggtcgtcacgagctgcttgagagcgtaggcatcagtgcagatgcagtggcgcgcagtggggaatccctggctctctctgagttgaacctcaagtactttgcccctttgaggagtggcgataagtttgttgttaaggtgaggcttgcaggcatcaaaggtgtacggatgatattcgaccacatcattacaaaactgcctaatcatgagctaattctggaggcaaaggcaacggctgtttgcctgaacaaagactactatcctacccgtattcctcgtgaactattgtccaagatgcagctcttcttacccgtggacagcagagggtcaaatgaagacgttaataatcggaataacagctgcaactaattctggaggcaaagacaagggctgtttgttcgaactgaagactaccatctcatctccaaaactgtttatgtcatccaagctgcagctcctcatcgaagaatatagtagaatctagttttggggactggtggctgcataatagtaatccatccgttcttctttatttatcgcagtttagttaaaaatgaactagcggacgacaaatattcgagtacggttgtagtagaatctagtcttggagactggcggctgcttggtcctgcaatgccaacgaaaaccacctatgtatctcaggagcactgtcatagaagagcgcagtccatcttcaatctttgtaactgttcacccgaaacatttgatccgttacggcagtcgtttggtacagaaagctcttgttgcgcccccggaataatatgtgctatgtcc

SEQ ID NO: 13241 - DNA, 3395 bp, Zea mays
  misc_feature (2238)..(2238): n is a, c, g, or t
ttcatgcatggtaaagaagttgttaccatatatttagcgtttttttcgaccgtaagacttccaataaggtccgctatcgagttcgctaaaatagcgatcgtccttggcagcggctatatttggaagtgtgtcgtgtgttgtgtacccaagcatgctgcacctttcagttgccactcgctggcatgcggtcctttttttattacgttttggttgttgtctaaatgtgaccaatataatgatgtagagagagaagagataaaaagatgagatatagacgatggattttggaggattttgctagagatattcaagatatatagaaggcgaaatttcttagctgcaaaagataaagacttcgaacggacctttaatttagccccgaccccgaacagtccatgatgggctataaaggatctcgaatgtcaactcttgaaggcgccttggcccttggatatatttaatgtatatatagaattttatttatttatttaaaaaataagtaattaaatctaacagaaggtaatagattttctatcaaaaggttttgaaatgtaccatcagtgctgccaaacccggtgaccactaccgcgcgaatctggaagggccgctgtggtacggaggcgttgcactactggccgcttcgatgtcatgcctgctcggcgctgtcaggtgatcgccggccgtggtcatgccccaccgctgtcgcgccagtatcgtttaaccaaccggctccaggcttcagccaggtacggctgcctatccaatcaggggaagagaagaggagggccgaatggagggcgcgggatcgccggatcggagcagaggcggaaaaaaaaaaccagcatgcatgcatgtattaggccctacgtgctgctgttcccttgtcgggtccctgtactagttgtactgcacccctttgacggcgcatgcgtgggagcggacgaaaacatgcaggatgcattcccattcccgtccagcggatctcgatgacaacaaaagctagctaggtggcctacatatactctaaacccttcgctcggtcgccggaaccacgccccacagagagagagagagaaaaaaaaaccctcgtttggtcgccggcacacaagacggtagtaggcggcgatcgatcggtggacgacggacggaactcagctaagcaatctcgcctcgtcttctccggcggcgacacacacgcgccccttctacgtcgagaaatcagttccccatcctccatcatccattccgattctccatctatcgctggtgcggcaggatcgcagtagctagcacgcgtccgtcgtctcgggtccgtccggcggcgcaatggccgcctgtgccggcgtaggacctgttgtggggatggtggtgttccagattatctttgcatttgtcaatatcttctataagctagctgtgtcggacggcatggatctgagggtactcatcgcctaccgctaccttttcggatcagccttcctcggcccgctcgcctacttcgtcgagaggtagggcccgacgtggcggtgcatacataccaatcaatcaatcaatcaatcaaatatttctaggtaatcatttcaggaaaaaccgaacgaaactgacatggagggtggtgttcttgtctttcgcgtgtggcctctcagggtatgtatgtgttactcacgtcccctgatttctcttctttatatattatataaaacaagaaattaagtactcctcttttcgttttttagtttaaaaataaatgataaatatttaagaacggatgtagtacctattatcctgatttcaatttatttacggcaacatacatacaaaaattcagagttagttggccgtagacacctcgacatcaaccatggcctgatttaggtccaacgtacgtacacgtcgatccagcatggtgccgttcctgatttttgttcatttctttcgtacaatggcgcaggggcacgatggcgcagaacctgtacatcgccggcatgaagttcacctcggccactttcgcctccgcgacaaccaacctcctcccggcgtgtaccttcgtcatcgccctcgtcttccgctacgagaagttcgccatccgcagcctggccagccaggccaaggtcgccgggaccctgctgggcgtcggcggggccatgctgctcaccttctacaagggcgtcgacatcacgccctggcacagcaacctgaacctcgtcgccacgctcacccagcaccaccaccatcacnaccaccaccaccaccaccaactacgccatggggtcgctgctctgcgtctgcagctgcttcttctacgcgctttggatcgtcgtgcaggccaagctgagcaacgagtacccgttccactactccagcaccgccctcatgtgcatcatgaccacgctgcagtcctccatcttcgcgctctgcttcgacagggacgcctcgcaatggcgactcaagttcgacatcaggctgctctcctgcgcctactcggtccgtactagctacttgttcttgctgctactacctgcgttcagcagaacacccagctagctagccgcctagctctgacgactggctgcatgctcgcagggcatctttgcgtcgggcgtcgcgctggtgataatggcgtggtgcgtgcagcagcgcgggccactgttcgtctccgtgtttagcccgctgatgctgctcattgtggccgtgctgagctcgctgctgctgggtgagaagctgcacctcggcacggcattgggcgcggtgctcatcgtcatgggactctacgccgtgctctggggcaagggacgcgaggcagcggctgaggcggccagggtcagcgtcaacgaccaccccaccaccagcaacagcaacagcagcgaggaggacgacgacaagaagcggcacgttagcgtcccaatgcctcccgcaccaaactccgtctgatgttaagctacaaacggggccggggttggggcgaaaataaatacggagtactagctagtatatataattatatatatatatacgactatggtgatacttccattcccatgcccatacatccagtctctcacaacagaaatcggatctctcaaaacatgatgatagccgatcaaaaaaaaaaaaaaaacgtcgccgtcgtcccaatcagactagctagcgcagcgccggaagagtctcgctctcgacctcgttccccatcgagctcgatcggccacccgccggcctcgctcctttcttcatcgctagctctcttgcgcagtggccggtgccggccctgcggtggcctcgcggcgatgcagacatgcagaggcttcattctctcctccacctaatccagattcaccattggcctaattgatccactggtacatatagtcttgcattgattgtatctatttttaagt

SEQ ID NO: 13242 - DNA, 572 bp, Zea mays
gtttcacgcacattcggtctgttctccgctagtccgcagcaagtgacttggtctagggatctctcgagcgcttcgagaaagtttcaggcccctgcacgcgtccactgaccagacctggccagcccaggcgtggaggtgctcgtctcctccgccgcgccgggaccggcgatgaacggcgggctccctggattccacaatgcgccggcgtcaaaggccgtggtcgtcgccgcaggtctcttctccgtcgcctttggcttccgcggccactccctcaacctcggccttgcctaccagagtgtttatgaaaagctgagtgtatggagactgatcacctcattttttgctttttcgtcaacccccgagctgatctttggagcagtcctgctgtactactttagagtgttcgaacgacaaatagggttctaacaagtatgctgtcttcactatcttctcaaccatggtgtcggtactgcttcagatccttgctttaggttacatgaaaggtatgctgtttttggtacttgccaatgtatagttacttttaaatcctgcttaaactattttcgagtttc

SEQ ID NO: 13243 - DNA, 1489 bp, Zea mays
  misc_feature (1471)..(1471): n is a, c, g, or t
  misc_feature (1473)..(1473): n is a, c, g, or t
  misc_feature (1485)..(1485): n is a, c, g, or t
  misc_feature (1487)..(1487): n is a, c, g, or t
  misc_feature (1489)..(1489): n is a, c, g, or t
acattcgtatgttctccgcaagtccgcagcaagtgacttggtctagggatctctcgagcgcttcgagaaagtttcaggccctccgcccctgcaagcgtccactgaccagacctggccagcccaggcgtggaggtgctcgtctcctccgccgcgccgggaccggcgatgaacggcgggctccctggattccacaatgcgccggcgtcaaaggccgtggtcgtcgccgcaggtctcttctccgtcgcctttggcttccgcggccactccctcaacctcggccttgcctaccagagtgtttatgaaaagctgagtgtatggagactgatcacctcattgtttgctttttcgtcaacccccgagctgatctttggagcagccctgctgtactactttagagtgttcgaacgccaaataggttctaacaagtatgctgtcttcattatcttctcaaccatggtgtcagtactgcttcagatcctttctttaggttacatgaaagatccttctctaaatcctttgacatcaggaccatatggcctcatctttgcatcttatgtgccattcttctttgacattccaatctcaatgaagtttcgcatatttggactgagcttcagtgataagtcattcgtatatttggcaggactccagcttcttttctcatctggaagacgttccattgtgcctggactttctggcatactggctgggcttctgtatcgcctgaatacatttggcgtccgtaggttgaagttcccagagttggcaacatctctcttctcgcagttgtcattgcccttttcaagcaatccatatcaagggttaccgatcacagaaaatgatggaagcatcccttctcatcaggcacatcaaattgaggatgcacgcgcagctacccaagatcctacggagtcttctattgccgcactggtgactatgggctttgatcgcagtgcagcaattcaggcgcttgcattgaccaactacgatgtcaatttggcgtcgaacattctgcttgaagcacaagctctacagcaatgataccctggcatcgagtcacaaaagacgggcagatgcactgtacattaatgagcgttaagtgtttgatactccgattcattcttctgttctagattttatcacaggtttccttgaaacaagccaccgtatatgaacgtgaactatgggaacgaaagacaattgatgcaggagctttctctatttgcttgcagcgattctgaatggtggttgactagtgaatgtctggcagtgtgcattggcaatagtgttggctttaaagattgccagcagattatggtggtttgtggatatgtagccaagtagccaattggtgtcaggaaagaaaagttgctataatcgagaaagcgaaaggttgatgtcaaacagctcgccctgattttcctccagtgcccccctttctggcagagcgccaccttttttcatttttttnanaaaaaaaaattnantn

SEQ ID NO: 13244 - DNA, 6272 bp, Zea mays
atctgattttagttgggttgaagcagctaatggctatttgagagacgtataactaacaattaattggaaattaattggtctattagctgaccattcgaaacctcacgagtaattttaggtgctaagtattggttttagaagtttgaaacgcggtttaagttgggacgaaacaaacaagaacgcacgctctcatcatgcctcgctctacccaggcccggtcccctgtcccggactcccggctcgcctacccgacagcaaccaatcacgccatacatgaatgctctctttcagtctttgtagcaagcacatctcatcaaaacagaagaaacaaacgggaaacctcatccacagcaaggaggagcaacttaacggcaacccaccaggcattgtaatcctcgagtttattctaaaacccaggagggaaatagacttttcaagcttatcgctcgtgcaatcacccatgcatatccagatagtatgagatgagcgtgagctgacgcagcgtcaaaacaaaacctgtacggcgccgctcgcgctacagatgggataagctcctggctgcaccggtgtcctttccatcagtcctaaaaacccttaataacagacaacttcgcctagtccatccagctccagagtccagcagcatgcaactactcacacgtcagctgcgaccgccgaccggtagaattacctctcatgcatgcagaagcagaattgcagttacctgcaccacaagcagccagacggggtccctcccagcgtagcgtatcatgagcgggtagcagccgcggtgaatatggcaaagcgacgcccatactccctggcccgcagacgccgaggcggaataattggcctctgaattctgaaaccgttggaggcagccccatgtttcccttgccgtcagtcccgctcccttatcttgatgatgagagaccgccggagcccacggacggcgtggccgtgatccggccgtgccgtgccgtgcgcgccagccactaggaacaaacagcacacaggccgcacataggcacccccaccggccaccggcacaggagaagacacgcacacacaaacctctccggtcggtctggccctcttcttcctatctgtccccgtctccatctccatcctttctttttttccgatgactactcctcttcactctcctcagtcctgagcttatcttccttccccacacgtcaagaaccttgtgacacctctcagcgcctttagcgagttagcctccctcttgcgcgcgccgcagtggcacaccataataaattgggcccctccctccccccccgccgggagtcttcacctagcaacaaactacctgtccaagaaccagcagccaaaggacaagacaagagacacaacgaaaggaaaggaaccaagagaaagatcgagaagagaggagccttcgcttttggacttgcaccgtcgtgatctgtcccgcgaccacatgaggatccacccagcatcccccaccgccggcggcaagaaggacctccggcgcctgccgcacgtgtacagcaaggtgctggagctgccgctcccggcggacaccgacgtccaggtgttcgaaggcccagacgccttccacttcgtcgcggcgccggccgccggtgcgcgtgccgccgccaccgtgcgggtgcgcaccgtcaggatccaccccggggtcaccaaggtcgtggtgcaggccggagccgccgaacgggccgctgacgacgacgccgccagcgacagcatggagctcgacaggtggcggtcccggctgcccgagccgacctgtccggccatggcggtggccgggtacgtcgacggccagctcgtcgtcacggtgcccaagggccccggtgccgaggaaggcgccgacgcagggcaaggcgaggttacctggaggtgcggcggcggaggcaagatcactggaagactcgtggttgtacagtaggagcgtctaatctatgtactactactccatagtaatgtcttgccatctttctttctttttttggtaaattaagatgggctagctgttcatcatgttgccttccccttccctgcttcgcatcagagacagtcagacaggcgatgtttcatgagctatgttctcttcctcctgcttctcttctcaagcatgtgagaaccagctactgtggattacctttggttgccctaaaatcagatgtaaatttctagataaacaaactgtgcggtgtttgtgtgcccactcgacgcaacttggatttttatcatggcggataagatttggtggagcatgatctgtagaccagatctggtgaccggttactgttactgtttctgaacatcaggtgcaaagtggaccacttggttggtgctgcatgtcacatggattcatcaaatctctccatttttttcatggcccacagtttgcagcctagtgtctgttagtcctgcataagataagatagccgttttggttggtacaaggcaatataaatcgaaaaaatatcaatggttttataatgtatatttatgtagggctacacaaccagaggtactgcagcttgatgaaccatgttctgatgttctagagaagtataccttttttcaatctttctgtgttgcaactcttctagcaacagttcctttgtatactccatccgttccaaattaaaatccgtttacctttgtagtagattcatacaatagttaatgtatgtgttctacatttcttatgtaactagatgaactgaagtcattgatcacccctgatattctacatgtcccagtcaatacagttgccagctgctttcacccgaaattaaacatgtaaataaagttatcatgagtcaattagtcaacaataccagaaaagattggatgaatagaaactcttgcacaagggtcccacaaaaataaaaccatctgctaccattctccttggaaacagcttaacatgatacacaaacataataaggttttaaacatgattccacccgaaataggaaataaatgacaaaactaccagaactactttgataaagtggagcatcaaaatatgaatttgatatttccaaagttgctagttgatgcatgttgcaccgttgactaggatataatggtgcagaagtccaaagatcaacgagaagatcatatgaatataacaggcacttgcgattgataaatctttgttaatttcactggttgtagctaaactatatgcgcagttattttcacaaatctcagtccaagttgcaataaagggaacggtgtcacgatacagagaacaccgagcagctgatgggaaggggcggggaaggaaaacaagcagtgatactagtttcaagaatcatggaaaggcatatatgacgggccgaacaaaggggaacccagtttggtaaagcgtctactgcattattgacgagtgcgcgaaatcctatcaagattaaacggaccacccaagttgttgcccatgcataatattaagctcaattgctaaagcaccgaacagtgctttatgacgacgatccttctcaagaaaagtggattctgttggacggtcattacgtttacatctactatcaaatacagtgggtaatatcacattggtttctcccatagcaatttgatagaaatatggatttggcgttattttaatttaactacaacaatcagggcagagcagacacaaccaagaatccagaaaaatagtaggataacagatcccagcaccaacctaatctatcaagaacccacacctcggatattattaagagcactaaaaatctgctacataggttaggctattgaacaaacactatctagtaccaggccctcacaatggggtcaaggttctatattcatataggccgatggagtgatggacaccagtttgaataaatatgccgtggagccagctaggaaatgacaccatcacttgctaaagggcccaactactgaataaataaggtccccatcagccaactcaaacaaaggtgaatcctagtgcctgctcgtaacacatattctatttctgaagtacaaacaaagtagggcaaaatagattagcttcattgaggactgaggtaatcagccatacagctcataggtccatcttatcttcctagtgggtcggccaaatcgaagggtttgacagtggcagagtctattttatcttgtcaacttaagaaaaatttctaagtgtttgtcgaacactgtacagtgcagagtacaagaccaagaaggatgcaagaaatttatttatgttctggaatctgactttgaaaaataggttatctcaatcaaaaactaaagaaaaatggtaaaacatggtagcacctgggtcacctatatcccaatatcacatactctcaatcccacaataaataactttctgagcaaatccaggagatatccctcaggaaaggaaagaagagtgtacatgcgtcttttgccaatatgcttagggtgcgttccgttccgggggattcgtgggctggacccattccaacccggaatgcttatctaatttgtataaactttgatcagttggaataattcctagcctcgatcctgaacaaccaaaagcactgtctgaaaattttcagaaaattatttgtttcgggacagagggtacataactagataacaagtcaagtgactagagaaaaacagagggtacataactagatgacaagtcaagtgactagagattttttcaagttgacaataaacatcacatagatcttctttagttctttctaaataataccttctgcagcctgagcacagcatccatgtaatttcacgcttacggcttctcaaagtcaaatgcatccatgacatgataatgtatcttaatctgagatattttccaagtcaaacacagaactgatcaaacaattttgaactgaactgttataaaaaatatcccaccctggatttcatttttcaggctcaatgcacttaaggctatggaaatattaggctatctccagcagcctctctataacacttcttatctcacttcctatttcaaacttcgctctgtaaacagtgcactctacagtgcaaacagtgttttgcacgcccatatccacgttccgctggagatggccttaccgtggaaagtcatggtgcacagatagttctttgtgatctcatgcaaatccagcttccctcatcatatcagctatggttgaatcaagtctttcatgtaaatcaaactttcggtatccagcaaccagtatgtcatatgtagacctattgagcttgaacaaacttcggatgcgattcaaaaagagatccaacctatcaaattccctgtgacgaaaataacaacagattatgacatcaacatcctccgggcacgtaaacatcacaccattgtccaacatccgataaattgcatcctccatatccgctaatcgatctgcattagcatagaacctgataattccatggtgcagttgtgtttcagaattcaagtgtgttcccttttgtattagggcaagcagctgctccatttcatctattacccctccatctaggcatattcttgtcaacctcacaactgtggctttgttcaactcccaattgccatcccttgcacgttttaaaaagtctcctactctgctggtctcctcctttctagagagaatctcaaggctggcctccaaaatagtagagtttggcttaatctccaaggcaatcatttcctcaaacaccgttttggcatcgtctagcatgttcaaccgaacaaacccagtgatcaaagattcaaaagcttgaatacttggcgtaaacccggcgttctttgcagctacataccagctcatcatagcatggccacttccaagcagcgaaaatgcacagatgaatgcatcatatgtagcggaattgggactgcaagcgtccatgctttccatagtctcgtataaggtcattgcagaaaggaggtctccggctgacaagaaagcatcgacaagggcattgcaaatgttagtgttcagctggattcccttcgcctccacgcattcgaaaactctcattgcaaacgttgcattccttgtctgaccacagaaacgaattatcctggagtagggctcgcaatcttgaatgtctccctcctgccgcttctctagtttccattccaatatctaagtcaatgttcaccattcaaacagtgttaattggcggcattgaatacctctttctgacccgtattctgacccgtgaggaaaacagaaatttccttcttcagtaaaagctaattaactaaaccgacc

SEQ ID NO: 13245 - DNA, 6532 bp, Zea mays
attttcttttgtgatatatatatataataataataataataataataatgtgatctcgcttgacgcatgagactacgaatatatatagtatggacaaaatattagaccaactccagcagcactggctatcccactccgtatcccttttttacacggtcgcaggcaccgtttcgctctccagcagtctccgcatccctctccgcaaaacgcacggcctgtacctgcactccctatttccacgctttctctctcctccttgcagctctctgcgtgcgcgcgcgcctgctggcgggccccaggtgtcatagactgcatgcggagtgagatggggagtgttgttggaaacggagacggatacggagaggagagagaatctgttggccgcgcgttttagggatacggagagggagtctgctggagttgatcttatgaccagacgcacacggatgtgatggcctgagtgctctcaatgcatgggcgccctagcttgctagcgcgtcgtttctcgttaattagggcctggccttttggccggttacggacgaattattggctgcttgtcgcaatatagtagctaggtatgctctccgaccgagaagcaaatatcactggcgccgccgagttgagctgttgggtatcataacgctgacgtcgatcgcttgcccagatcgggcacacatctgtaggtgtagtggccgatccaatgagtgacgcgggctgctggatcataatagcgttgcgtcccgatgcgcaaacgtgtgggggtgtgcggtgtgcatcgtataggcaaccatcacaccgcatgttggggcacaccgctggaataacgagcgacgccgacgacgcgcgcggggcgacccgatcgataggaggaagctcagtcgccgatcccgaggaagatgaaccgtacgtctgcttcccgagtccccgtaacgtaccgcgtacgtacctcacgtgtagcgccggggacctggactacacgaacgacgacgacctgctaggctgctatacgcactcgatgactcgatcgacgtgcagtggccgccggagagttcacgacggcgagagacgacagcacccagcgcacaccatgtgcccatggcgcgtcgccctgcttcgtgtttggagagtgcttcacatgatcggcgccaaatcgccaatcatgcacacacagctagctcgtactgtattcatcccgatagcacagtatttacaagcgcgggataggatgcgacaagtatcagatgtgtttgcatcgtcctaacggtgccattacgcgatatcaccatcgctgttgtaggctgtgtagctggtactgtaccagctacacatacactggttgttggggctgctacgtaccttttgaattgccagtttcccatttcacgacgtactgcagcctgcagatcacctacacgcaagctacgtacagccagtcagccacaggttggaggacgcatccgtgacgatcaggatcaagcacacagactccatcgcatggggcacacacaccacatgcaccaacacccacccaagaaactagaagcaggggaaacccactcgtcttgttggcctctccccactgcccagtgcccacacatatataacgggccggccctcccgcccggcccgggatctccactgacaaacgaagctctcctcgccgcactcgcgcctgctcgaccgctccaacaagaccctctcgcgccaccgcagcagcgtcgtcgtcgctacgcggatgctgtcttctcaccgcgagagcctgctgccctacgcgccggggcggcgggcggcggtgctgctcgaccaccggcggtaccgcccgaacgtcgaggtggcgcccagctgcccgcgctgcgactcgcccaacaccaagttctgctactacaacaactacagcctcagccagccccgctacttctgcaagggctgccgccgctactggaccaagggcggctccctccgcaacgtgcccgtcggcggcgggtgccggaagaaccgcagcaggggcaagccggtccgagccgtggccgtcgattccgtggcgcccagcagcggtggcgcggcggcgttcacgcaccgggcgtcggcgtcgtcgtcgtcggcgtcccccgccacgctgcggccggacatgctactggaaggcatgctcggcagcccaagcgagctgtgccagctgacggtgacggacgacgacgcagcggaaaacccggctgtggcgcccgatggacccaggatcgacctggcgttgctgtacgccaagttcttgaaccaacagccgccggcgcccgagcggcgcgccgtcctgccggaatcgctcgtcgtcgacaccttgagcgggtcgtcgtcgagcgacgtgggtcccgtcgtcccatcgcgggatcatcagccgttcacgacgcaagacgacgggctgggcgagctgtccgcggcggcgagcgcagagccgagcgctcctccgccacagtcgtcgtcgtgtgcggaggcgcttattggggcgttcggcatggaccagcgctgctacgactctctgggtttgccaccagacggcggggatctagtcctaccgtcgacgtggcctcttcttggggccaagtacgagctgttcgatccgctacctgaggacgccgtgagccttcaggacggcttcgccggcgacgaggacgtgtggagcggcgccttggcttgtcaagggctggaagcagctctctgcaggccgtaattttttttaactcgcctcttgattttcaccgtgcttgtgattgttttatgcgctcttttctttttcctggttgtgatcgtgttcaggagtaatttatatagagaccatatatacagcatgtccagatcatgcattatgatggatcaacgggtatacatgtgagatatagaaagaacttaataaaattttgacattttgtttgacaatttccctgtccctttttcttcccgcgaaaagacactctgttccttcttttttttttcttttttgctttgttttttgcgaaaagacactttgcctgttcgcagatgtaagatattttggacatggtcatgtgactagctctcttttgttgaatttttttaacaaaaccttacattactcgattatgaaactattattcgtaacgaattcaacgatgttgtatccatgtggccaatctagattgatttagagcatattcaacaaagtgactcaaactagtgcccaaaattttttaaaaaactacaacatataacatgtttagggcactaaaaacaagttgagctccaacagtaaaccataaatcatgtatttcagaaaataaactatacttttagaaaagaaaatgttaagaacaatgtagaaaataaggatatgacactaatttgaggtgtagtatatttgggtcactttatggtgtgctttataatttttttggtaaaaatgcaaaatatggcaccgttgaagttattttttatgagttgagacttatatttaaagttaggagactcatttaagacactatttatgcaacctatagtaaaaacaagacaactacaaacttgaagcgatatgcgctttcaactgatcgttccatctaatctactatctatcaatggtataatgtcatattcataatatttatgattcttttccacttcgatcgaataccatatttaagaagtccctcggcaaaaaaattgtaacgtgagcccgaccaggattatgtgtcaacaactactcaccttgtgtatcgctatgcactatacaagtgtaacactagaatggagaaccaacttctttggtatatttatcatctcccacacccttcaaatgacttgttgtggtagtatttatagtatctaagtccaaaactaggcgttgtcaaaagtgcagcaatttgtgtattcatcagacatgttaggtgatgacatcggacatcatattggacttgtgacaactcgatcaatgaaatttgaccattacgatgtttttctctaagcaacgaacaagttgatacatgttgaaattgtgtcacttgagtttttgtggggtcaatgcccccaaaaaaagcctgcccggcttcagtgccgtattgggccttgtttttagccgtttggcccagcgcggcccggtacagaaatatttcgtattggcccggctcgcactgattcggatgaagcccaatggccggtacagccctggcccaactttgagcactagaccgagatccagcagctgaggaattcccgttttgtaaaaagattttgattggccaatgcagcagcagtggttgctgactccaagcgtctgcggtctctgaagcagtgaactagtgaagcgggcaggctcgcgtgcaggcaacgtgccgctgctccctcacatcacagtcaccggattggcatcttctccgtggccaacgctgacgcacgtggacgccaccacaagtcccctacagcagtacaccctcgctctcgccgatcgtcggatccaggtcgcgggacgccgggagcaggaagcaggcagcttcgtcgccaaattatttcctgttgcggggttcaggtcaggttcgcgcgcgcgggcgcgtcctggggcacaccaccgagattctgccaaagtgccaaccctgtgactgtgatggctcactttgccgtcttcaccagacgtcctggcccaaatggctcgctcattctgcccggtctaatcggcttccaaatctaggtgagctgttcagtcgattgatgagggactttcagatgaacataatttgggtttaagtccctccaatgataaaccggtaacacgtccagtgctcagtgctgaaagcctagaagcatattaacttaaaacatatacaaaataagacacggtattagccaagaggtaaaagaaaaaaatggataaaagcgcttagttactgtactctggttcagactaccagtagcggcaccaaatactagaggggatcggtagaaaactgcctaattttattaaaaaatgttaacttttttgaaattttaattaaaatatagaattcttaagaaacttatatgaacgtcaaaacaaaagtgccggtgcacatacaaatttatgaaggtcaaggataaaaacggaaatcgcgaaatttaggccgaaaaccgtgcactgcaccacccggagcgttagacaccaccttttaaaacgctgttaaactgctaacgaccttctaattttggttctaaaataatttttacatttcaacctcctaatccgatcaactcgacgatccgatcaatgcatatgacgagcatgaccacattcacactcatctagccaacacaacctacgagtcattatgttttatgtttttactcaagtataagtaaataatatataaattaaaaaaaccttagcagcgtacgtagttgttttagtactgaggcagtacataaaaaaactattaataaaaacgtcgcaccatgctgatgttaacgtaggaacgctctaaaacccaccaccgcggccccacattccttccgttccgtgagtaggcgtaggtaggagtaggtgtaggtaggccgcgactccactaccactaggcagacaaaacgatctcttcagaatccccaaatgaaacgagcagcttatgcatggttggttggacgacagcctgattacgttggacaatacaatactagactagagtgattaaaaatactatgcaattaatttttttatgtaatcaccgtacagctaaaactattgaaaatcacaatatttttatatccaagtgctaatttattttatatttttaaaaagcaacagattctttctttcggtatctcttaacgtaaggtaaattataatataatatactagcggattaaatgattaagtatatctgttatctcttttaagatttgtctatgtcttttggtagtttgattacactgaaagcttgattggaggctattttttttttctccactaaaaagtacggtactttaaaaaaggcaaagcaggtgtcaaatgactcgcgcaagagagacgtcgccatcggcagatcaggcgggcctcgcttccggcccgagcccgaccccgacccctcgtgcacgcctggacccgaaggcatcttgccttcttcctgatgcagtcgctggcgggtagccggggaggataagcgagtcctaacccctcttcctttcttcaattaggtcgccccgctttctctagacgctggagcgtgtcatgtggccccctctacgcctgcctgtagctttcgttgttggcttgtccggtgtcctctcctcctcgtcctccagcgcgatcgcggtggttgcggcgtcctcctcctccctctgctccggtcgccggccggccgggacaacgtcatcgtggggctgcgcggcgacgagagcggcggccgcgccgtcggtcggacgccaacggggcaccaacctgagatggggttcgtacagctttttccggccggctcgaaatcctcgaactggattttcattggaaccggaagggtggcaaagaaatacatgtacgggtggtgggttatac

SEQ ID NO: 13246 - DNA, 1160 bp, Zea mays
gcacgagaccattacctagaacatcctaatcgaaaaatccccttatccgcttcgccacccgcggtctcgcccaccacccgctccggccggctcttgcgctagctgcatgctcgcgccgccctcctctccatcatccagtgctctctcctcttgcgattcgctcgctcgatcctagcttcccttcccagaagcgcagcgcccatggccatggccatggggcaccgccagtcgggcagctgcgcaaaggtgaggcccggcggcatcggcatcggcattggcatgggcatggtgtccaagcagcaccaaagaacaccgccgccgtcctcttactgtctacacctccaccacatcctctaccttagacctgtcgccagcagccaccacttgacgtgccactccgtcgacgtcaccaaagacgataagccgcttgagccgctgccgccggcggctgcagagacagagagcacgcagcagcaggaggacgaggacggcgggccaaagctggacccgaggcggttcgaggagaagttcgcggtgctgaacacgggggtccacgagtgccagtcctgcgggtaccgctacgaccaggcggcgggggacccgtcgtacccagtgccgccgggcctccccttcgcgcagctgcccgatgactggcggtgccctacctgcggcgccgcgcagtccttcttcgagagcaagagcgtggagatcgccgggttcgcgcagaaccagcagttcgggctgggcggcaactccctcacctccggccagaagggcctgctcatctacggtagcctcctcatcggcttcctcttcttcatctccggctacttcctgcaatgatgacgccaacaacgactctttctgatctgatcttctttccgtttgtgtgaatagaatacttcgtccgtgcatgtactcctccccactcccagggaacaacattcatcatcaatcgactataaactcttggttttagatttttttgatataaaaaacaaaaatcgttaagttcacaggaacaccaagcgcatatcccctccatggttgtaatatgtggacaacaaaactacaaactagacataaagcatgtcataggcacagtggtagaggagggtacgcgtggtgcacacatatcttatccaaccattgcctggcct

SEQ ID NO: 13247 - DNA, 1337 bp, Zea mays
cggtaaggtcgtcgccgccggtctatggctttggcttctcggctcttgtcgcccaccaccaagcgcgtggcccgctgtttccgcgaaagaacgctgctagctcccacccggacacggcagccgcgggcggcggctctcgacgagcacaccccgtcccgaatcatcaccatggctattagccagtgcccgtcccagaacagccacacggagacggctggtcaaccctgatgagccttgtccaaggcacaagtgggatggcgatcgaaaaggtccaaagcagcgctcacctcatgtgatcgcgacccgcccccacaccagacgccatcttctccttccctcgtcgtcgtcgtcgtcgtcgtcgtcgacacactcaattccttccaactccctcatcccaccaggccaccacgcacctagctactcagtacctcctcctgacttcactaccctcccactcccaacctccgccctccacacccaccaacgatcgacccacctcgcgatatccgccccccgcctcctccgccccgacgatgatgcggggcgatgacgagtaccggtaccagcagcagcacggccccggcggcggcgcgccgcacggcctgatcatggcggtggtggtggggctggtggtggcgggcccgctgttcctgggcgacggcggcgaggcggtcacgtccgccgtggcggacctgctcggccccacgggcctgctcctgctccccgtcggcctcgtcctcgtcatccgcgtcctctcctccgaccgcggcgccgccgcgctcgccggcgccctctccctcggcggctccccggactccgtgcaccgcgtcggcggctcgcccgtcggggtcgcgctcgcgctcgcgctcatcgccgccctcctctactacaggtcggcgctattcggcggcggcggcggcgacgacgagtagacagcggctgcctggcttggcttctgtgctgtgctgtgctacctcctgcgctacctacctaccttccttgctggaatgtttcagtagtttaggcaagattttctatttaattttgttaattaatgccaacaccgctgaacaagacactcgcatgtttgtaaaaaaaaaaaaaaaacccgggacgaacaccagagcttacttaatttgtgctctccgttgtctccatagaccgacccatatgttacattctgcaaacggctgcctcgatgcgattttaaaatctgagctggatgctctgctcccgtttggaaacgcgaagcttctgcggttggtggctatacatgtccaaacgggccggcccggcagtgggcccgtgacccggcacggtcgtggcccggcacgaac

SEQ ID NO: 13248 - DNA, 3611 bp, Zea mays
tggtcgaccgctccgcctcgctagcttgctcgacagggacttggtcggcagccctgcctcgttggcttgcttggtgagggcttggttggtcgcttcgctgaccggcttgctcaacgggaacttagtcggtggctccgcctcgccggcttgctcgacgaggacttggtcgaccgcttcgccttgctggcttactcgacagggaattggtttgataatgaggttacatgcttatttagggtaccatgtccctgggtaaccgacaggggaggaatgaaggatgatcgaaataatattgttcattaatttaagtgagtaagggagaggttaatccagcgttctgaaccgttgattttgatgatgtgttaaggttaggtataatttgtttggtgaatttagtggagggttatgagtgtggaggtgatttagttggggtgggttttgcaaaatttaaactgatgaattatatagtggtatatatatatatatatatatgatactgagttttaatataatcacctcttccattcgaaagaagtacacaattactaacattcttattatatttaaggacctttttgttttcacttatagattatataatctagattaaataatttggatgtggtaacctagcttattggaactttgattaatcatgtgttgcatgacaggagcaggagaagtagatgacacattttttatgtaagaagtggcattgataggcaatttcttataaagttgtcataggttttttagtaaataagctgaaataagtatccgtttagccgcttatgaggttataatactctgacctctagattatataatttagcctaataatttgtcagtttgtttttcatctatattatttaagatggattatataatttgaaaagattataagttgaaacaaatagtatatacgacatttctagtgttcctaaaatgtgacataagatttgatcgactgacattagacgaacgcgaaagaattttgatcaactaacattaaacgaacgcggaagaaaaccaatggttaaaattttgattgactaaaaaagtggggaaatgatttatggctaaatttttgattaattatacatgtatatgtattgctatattttctatatatagtatataagtgcatcatgctcgtatgtgcaacacgaaaggtaggtccggtacaaacaagttgtattgttttttttctgtttttttattaaaacaatagcatacaatataaaacacaaaaagtaagtgtattctgttagtttaataagtatgaatatgaaggcaataattaagattcaaactccatgtatgccaaattttaccttatttattttttcataaagtgatgacaatagtagaatggtagaaactactgtttcatatagtagaaaaaatgttaggctttctctagcggactcactattccactccctatttcaaactccaatttgtaaagagtataatatatagtacaaaaattacaaaacaacactttgtatacacgcccttgccgggtagtccgcccaccaaaacaaacatttcagacagctttagaatatctccaacaataccataaattggtgctttaaattgaaatatagggctctacgcaggaaaaactactccagtatctcatttcataaaatttggtgaaaaaattatagagcaccatctctaatgcctcaaatatactacaccatattgagctgctctataatttagatttaatgttttactgttggaacgagatgttttgttagtgccctaaattatataaaatatatatttatttttaaattatagaatatttttataggtcacttccaacctggcgttatgcagaagcacaaatctgatccaaaatccaaacagtcttcccgatcaaaacacctatgggcttggacttgtttgtacacatataaatctaacttaatccatatagagaaagttaaactgaaatttataatttaatatgaataaattgaagtaaacacaggtgcgtcaaacaaacaacacctgacagattccgattcaagcgcctgctgccaatgtccccgtacgtgcgcagaccgcagaggcagagccgaataacccgatcagatcaaagcgaagcctgcccgtcccgtgcagcgtttcccccctcaccctcaccctcacctagtcacccccgtgcgccgcgccggttcccataaaaaccaaaccccccgacgcctcgccctctctttcgttcccgaccaattcgcctggcttgccctcgcccgcccaccgctcggagccgatacaagacgagggcaatcgatctgttccgaatccgcatgcgcccgcggccgccgccgcccgtcgccacctgaactcgaacccctggccggagcgtgcggcccgcgcccgcctatggacgagtaccagacgcgccggtcgccggcgggcgagcggttcatcggcatgttctcgtcgccgtctacgccctcgtcgtccccgaccgagccttcgttcgtcgctggggacgaactccacgaggacgacttcctcttctcgtcgccggacgccgcggcgccgcagcccgacgggcctaggagcccgggccggggagcgccgcaggggcatctcggtcttcttgccgccctggcgctacacgagggggacaggaggctcctggttcgcggtggccacggcgggggagtggcggccgcggccagcgcggggacgctgctccggcgcaaggcgaccatcgcggcggccgccgcatctgcctcggccacggtggcgtcggggaacgggggcgcgttgtcgcccacccagtccccgacctcctccgcgcgggccatcccggcgaccgcgaagccccagaacgccgggcccgcccggccgtaccaccagtcggcgcccgtgaaggtgcccgtgcgtccactccgaaagccagctacgggccggtgggacgaattcgatgacgacgcggacttcgggcgcggcgacgccgccatgctgcccccgcatgagatggtcgcccgcgcatccgctggtggggctgggcccgccgctccgttctcgatgctcgagggcgccgggcgcacgctcaaaggccgagacctgcggcgtgtgcgcgacgctgtgctcaggcaaaccggattcctcgattgaatccggcaaggtgacgtggttcttgccttttgttcagcaaccgtgtgctcagtcagagtcgaagatgcgttacattaggtatgtgtagtgggttctactgtgtgagcactgagcaaagcgggaaggtaagataacaagattgaatttcccggcttgcaattttggtgttcttggatgtctgcgtgtcatattaccgcaagcttcagcagtaataagaactggtgtcctgtgtgggtctttctctgcgagctctctgtaatccaggagggaagagattttttttgtttccgtcaaggttgtctgttaggcgtagtacatatgaattatcgttatgttagtcgagactaatgctttcagctcttagtgaaagttttgttagttttgtttcttactcttttgttgatggtactgaattacctatggtgatgaaaatatgcattgtttcaaaaaaaaaaaaaaaa

SEQ ID NO: 13249 - DNA, 988 bp, Zea mays
tacccgggattcggccttatggccggggggcgtacctgtatatgagtcaaagtctgtgcctggcgtttcacctctaaccaacagcgttcggggctctcgccgcccgccggcaaactatgccatttcacctcaatatgttcagtcaatcgtggggcataatacatccagactagacccagctagagtaggcacaccataccatcccatgcaggtgggggcaacctacactacccctagtcctcagcctgcaatgactgggaagttcagtcctgttgtttatgttcacccagttcctcaggatccattgcatggaacaccctctggttttcaaggatggcctcgccctgtgcttttgaattcatatcaagctagcatgcagaagttccaaggcaacaccccggtgtatttggcccctccaatcatggcaactgggaacctgccattggtggtaccaagccctgcaccacttgtgcagccgttccaggccattcatcccatcatggttcctgctgcaagcagcgtggtcccaggaaaatacatgtgaacttgtcataccaatgacaatctccttctgttggaagagtcctggctttccagttacccctttggtttggggtatacgtctgaaaggactccgcgattttgcctggtctgttgattcacttgtcagttgctggtctgtgtccgtattttagttggaagggctttgcaacttcgtcattcttcatgctctgtgtgggttttcgaaatattctttttagaggggggaggcatggtgcagtaaaatgaaatagagagaaattgcagcaattctttgttatcttagcaacaccttttcttcttccgagagcactatgtacaaggtgacattataaaagattaagatagtgaaggccttattttcgcgaggctaatgtacattcatcttgcaagtgttgcaacttttttgaagtttgtttaagtctcgtgcgacatgaagtttgtttcg

SEQ ID NO: 13250 - DNA, 1231 bp, Zea mays
tctatatttgaggccatgcacgtactcagttactcctatgtgctttgcctttgcagttgagctattcaagccattcttacctgttagctgtctaatttacttgtctgttggattaaatgaataaattgaacttgtaaactgattcttcatgtcaacttacagcttatcagctttaatttaattctgatgcaagaaaaaaaatctttttactccgaactgaaaaacctagctcacatgtaaatgtattttttatgtttgaaagcttcttttaacaacttgccttttatgttctattactgtactttgtgcaagcatattttaatacacttaaatttggtcttgcttgttgcctctatcatggatgtctaacattaccatgcttctggattctggtactacttaaccttttgggtcatagatcatgggccataatgcatcaaggctagacccatccagaattggcacaccataccatcctatgcaggtgggggcaacttatactacccctagtcctcagcctgtaatggctgggaagttcagtcctgttgtttatgttcaaccaggtcctcaggatgcaatgcatggaacaaccgttggttttcaaggatggccttgccctttgttattgaattcgtaccaagctagcatgcagaaattccaaggcaaccccccggtgtatttagctcctccagtcatggcaactgggaaccttccattggtggtaccaagccctgcatcacttgtgcagccgttcgaggccattcatcccataatggtccctgctgcaagcagcatggtcccaggaaaatacatgtaaacttgtcgtaccaatgacaatctccttttgttggaagaatcctggcgtacccattttgtctgaaaggactctagtctgttgattcacttgtcagttgctggtctgtgtccgtattttagttggaagggctttgcaacttcttgtcattcttcatgcttggtgtgggtttccaattttttttaggggcgggacagtaaaatgaattagggagaaaatgcagcgattctttgttatcttagcgacacctcttcttccaagagcagtatgtacaatgtgacattgtaaaagattcatatagtgaaggccttattttcacgaggctaatgtacatccatcttacaaaaaaaaaaaaaaaagaagttctgttttgagaaaataaacttgttcgacaaaaaaaaaaaaaaaaaagcggcc

SEQ ID NO: 13251 - DNA, 2736 bp, Zea mays
cattgggtacctcgagaaaaaagatctccactccagtatcccctccccgacttgcaacctctcctgaatcccaccgatcacgcgagctccccgccgcgatgtccgatcaccgagcgaagcggccgtccgacggcgcagccactgtggcatcgccggcggcgaagcgcgcccgcgacccgcccgcgccggcgttacccacgaacaaggaagctcccgacatggcccccaagacccgcatcttctgcgacatcctggcctcccgcgccgacgacgaggaactgaatgccgagctcgacaaggccgacatccgcgtaagcatcgctgacgtcgagcaggtgctccgcttctcctacgcgcacccgcgcgccgccgccgccttctttcgctgggcgggataccggtacctcggccacgagcactccccctactcgtggaacctcctcgtcgacatcctcggtaagaatcgcctcttcgagcccatgtgggacacagtcaaatctatgcagtcgcagcagctgctctcgctcgccactttcgcctccatattctcctccctggcggcgacccccggcggttccccgctcaaggcgttcatggacatgccccgctacggcatgacccgcgacacgccggcgctcaactcgctcctctccgcgctgtgtcgtgccaaccgcctcgacgacgctcgcgccgcgatcccagtagcccgcgccgaggctggcacgcgcccggatgccgactcctacgccatcctcctcgagggcagcgaggccgccgccgatctgcgggttgcgcgcgaggtgttcgacgaaatggtgcaggccattggattttatcctgacaacgtgcctgcctatgactccttcctcactacgcttgtttcaagtgactcctccacggcgctaccggaagcaatggagtacctaaatgtcttgagcaggcacggctgttcgccaggagagaagttcttccgtgctgctcttgctgcacaccttgaggcacgacaattgcgcggagccatgaatctctgggatgactttgttgggcgtcgaggactcgtcccagatatggaaatgtacaacacaatgatcaagctgcagggcagtctcgggcatgctgagctgatagtgggttatctcgacgacatgatctccaatggagtcttccctgataccaacacatacaatgtggtcctccagcttttgttgaagggaaagaagcaccgagaggcagcggcaatatttagcgagatggtcaagaacgaatgttggccaaacgagggaaattgttcacttgcacttcgcatgtttttggatacacactattgggagactgggatcaaagtctggtgctgcatggtggagaatggcttgccacctttacaggagtgtgggaacatgcttgtagcaaagctgaaggatgacaggctacctgaggcatgcaaatatgcagaagacatgattgatcggggtatcaagttgagttcagcgacactgtccaagctgaagcagcgcctgcagaggattaagaaaggagagatccatgatcacctgcttgcaaaatggaaggcacattagtttgttgtgctccctcgtatgggtaacctggtgcgatctcagtgttgacaatgaggttgagccttttatcactctgcaacgtttcaaacaacagttggaagtccctttctagtttctacattgaaattatcatattaatcagctggagcatttgggtctcaaggagtgagctggaacatcttccaagaaattctaccgtctgtatcaaatggctaagcctttttcaagaaagagtttgcccaggttatccatagagcatagaagaaatatttccttgaagaatgactagagcgtcagttgtggtctttttttaatatcttttgtgtcctttttttgtttcatgaattttgttgcttgcagctgtctggctgcaatttaggtagctgttccttttatgtatttgcataattatcaatgcaacattctaggcgtaaaagtgcattctgacgtaccaggtaaaaattgtttggtatctccacatttaaaaaaaaaaaaacggcctccgtttggcatggtttcggcagttctttctttttccccttatgacgcagtttgcttattgaaaattactcgcggttgttccattattgcctttggatgagaatgtgagtgattaaatcaaaatttaggactagtttgagaacttcattttacaaagtaattttcatttttctaagaaaaaataaactaatttctcttgaaataatgaaaaacccttagaataatgaggttcctaaactagcccttaatctatatatggcaagttcctctctataaagtgtattaaacatcccaggttatgggtgttggaccgaatgtccatcaccggagtactaggacctgttatggcgtagtatggcagctgtcataccttaaattttatatctcactgtttgaatgcactagagctaatagttagtgactaaaattaattgagacatccaaacaccctaaactattagctatttttgataaattagttaatagttaggtatctatttgttagctacctaatttcagtaacaatttttagccaactaataattagttctagtgcatttaaacaccatctaaagcatatgtggagtattggttgtgctttagtcgatatttgatcccttctgttggtctttttttcttcctcctagctatcaggtac

SEQ ID NO: 13252 - DNA, 2702 bp, Zea mays
ggccgggccgggaattccacgccgtcgggcaagacccgctcctctcgcctcccggcacttccgcttgccctcggtcaaggtcaaccaatcgccaattcgccatggacgccgcgtcctcgtccgcggcgccgctgcgccttgtgatcttcccgtggctcgggttcggccacctgctcccgtacctggagctcgcggagcggctggcgctgcggggccaccgcgtgtccttcgtctccacgccgggcaacgtcgcccgcctcccgccgctgcgccccgccgccgcgccgcgcgtcgacatcgtggcgctcccgctcccgcgcgtcgacggcctccccgacggcgccgagtccaccaacagcgtcccccacgacaagttcgagctgctgttcaaggccttcgacggcctcgccgcgcccttcgcggagttcttgggcgggtgctgcgccgacgagggcaggaggcctgactgggtcgtcctcgactccttccactactgggccgccaccgccgccgtcgagcacaaggttcgtccgcagtccgcagttccgcacaccaaacgaaaactggttactagcgttgtttgttttttctgagaacatatcaatgcacatgaaattttagtgcacattaaatcatcaccactcattttagatttaatgtatgtagttgtttgatatatttgctaagaacactctccgacgtggtggatgtagtgatagaaagtgttatttgtaaattacaatgataaccagagacgttagatctaatatggataattgtgatttaatatgtgcaacatgtgtacaaagattagcttggcttgtcaccaggtgccatgcgcgatgctgctcccgagcgccgcgtgcctggccgtgggcagggaacggcagtcctcgagcggcaagccggccgctgcaccccgttacgagtcggagcagaacaaacagtattccgccaaggatggcgcatccggtgtgtccatcgccgagcgctacttcttgacacgcgagaggtgcacgatcatggccatacgaagcagccacgagtgggaaccggagttcctgccgctggtggcgccgctcgtcggcaagccggttctgcccctcggcctgcttccgccgtcacccgacggagggcgtggcgccagcgccaacgcgaacggggagcacgccaccgtacggtggctggacgcgcaaccgccgagctcggtgctgtacgtggcgctggggagcgaggtgccgctgcgcgcggagcaggtgcacgagctggcgctggggctggagctcgccgggacgggcttcctctgggctttgcggaaccctagcggcgtccccgacgcggacgtccttccggccgggttccaagaacgcacccgcggccgtgggctggtgaccacggggtgggttcctcagcccagcgtactggcgcacgccgccgtgggcgggttcttgacgcactgcggacggaactcgctcatcgaagggctcctgtacggccgccctctcgtcatgctgcccatcttcggggaccagggcccgaacgcgcgcctcatggagggaaagaaggtggggttgcaggtgcccagggatgagcacgacggctctttcgaccgccatggcgtggccggcgcggcccgggccgtcatgctagaggaggaaaccaggggtgtctttgtcgcaaatgctctcaaggtgcaagccattgtagctggtaaggaacggccggacaggtacgtggatgaatttatacagcaactactaataagagggaggccatgccctgcctccagctgagactgccgtgcagggtttgtaactttcccactggggtttgttcggttagctctcaatccatgtggattgagtgagattagatgagtttgaatcccaaacaagtaaaacttctttttaattttttcaatctcatccaattcatgtgtattggaaataaccgaacaaggccttaataaaacatctagctttcaaactatgttatcggaggcgacaatggattgggataatttgccacaataagagagcatgtattgttatatatttgtctatttcatatgctcacaccctcttgcaactttgaaagtgtgaccagaggagaaagcacccgattttgaaatggaaataatcatgctgtttggttgctagcagtctcagcgcctggaaataatcatgcagaatatgaacatgggtgattgggttcatgatcaccacctttcacctaaccccgaattcgtacatgggtgattgggtttacgatgacaccttccactcaactcaactagttgagtaagacccacttcatcttattttgtcaagttatgttttttacaaaacttaataaaacaatataatattaaagcatatacttcttctagcatcgagatcctctaacgtaacgtcgtcagacgtagccgaccgcggtcgactgactcgtgagcccggttgcagctcggccccgccttggtagcggccggacgttatgacagaggagccgctggcccttcttccatctccctcttttgttttcaaccagatcctctgtagtaacgtgcatggacgtatttatcggtcgatcactgatgtgtgggactagtcgatgcctggtcccgcatgctagcggctagatgttactgtagagggtttgcttcccttttgttcctacttccaactacagtggcgtgtgccacc

SEQ ID NO: 13253 - DNA, 1095 bp, Zea mays
ccgaagcagttacttccccactccactcatgatcacaaaactaattacaaaccctcgggaaacaattccactcgccgcggaaaccttccttctgggcctcgtccggtcgtccgtcccttcgcgcccctgaaattgtccgaccgcgtggcgactcgggtcggacggatgccggtcgacgtcgaggcggcgatggccccgccccaggcggcatcggcctgcagctcgtcgtcgataggcagggacagcgacgagtgctcgccgccggggaaggaggaggaaggggagggggaggtgcagagcgcgtacgagggaggaggagggggcagcctcgctgggttggaggcattggaggaggcgctgcctattcggcgcagcatatccaaattctacaatggtaaatccaaatcatttgtgtgcctgaaagaagctataacattttcaggctctgcaaaagacattactaagtcagagaatgcatactccagaaaacggaagaatctctttgcctacatcatcatgtatggaaattcacatgaaccacgggcagctcaagtttatgaaactgccgcccctaagaggcatgctagtttgagtagaaactctttggtgactttggctagcagcagttccaggagcagcagcagtatcagcattgaagagcatgaactgcccgagcatcttgattctccgcgttcacctgatggttttatatccgcaccacgatctggctcttgcgtgcctgatgcatctgtgcctaggtcattgtcaatgatggacttgcatcgtctgaataggtcaagttcctcagttcgtctcaaagatgggaaataggaaatacgactggacttggatccagaggattttctatttctttttgtcatcttttgctcgaggtttctagcaccatcttctctaatagaactaaggatggcatggaggtttctggataaataagtgatcacttagtttggcgaggggtatatatgtgtttgtaaaatagctcttcactccattgtaattagcatataatgtactaatatgaatgcctctactcatgtgaccatcttcagctgtaaattaacaaataccttttta

SEQ ID NO: 13254 - DNA, 2000 bp, Zea mays
tgtatgctgcttttggatccgttcaaattctaaatgaattatgtttgtatgctgcttttgcatctgttgtctcaaaaaatggcagcaatggagctctatcagccatgtaccctaaacgcttagtgcagaagcgggcccagacatttgatattggatattcaaaaattcaaaagattaaagaaattagtactctaaccctattttgtgtaatacattattggtaaattactatagatcacaaaaattttgggtattcaatgaatacccatgaatacctagtgggcccgcctctggcttagtgtagaatgtgattagacagaagtcttgatggttggattatggtccgcctgccatttatgtaacctgattgtatatgtatgtattgatacagtggtttactgtatgtgtcattatattatatatactattcaatatggtttatatgtgactattaccgtataattaggtgttacttactgcccaataaagcgcccgaaggggcgccccatgttctagtgatgagttcaaacttggagctttgctctgcctgtcttgacgggcgcgccaagttagaccacgtggtcagcagccaagtccaatttttcttgatccttatcagtaggtaaagttcagatgagggtatatgatttattgattgattgacgtcaccattagcaatataaaacgtgcgcccactcgcccgaaaaccacactgtcagtcagtcgctggcagagacgagcaccttctccagtttttttctcagttctcactccatggccgccgcggcctgcaacccagtggctccttccgggcctgtgccgttcaaggacgtcgacgacggcagtgttccagagcacactcccaaggaggagttcggcgacctcgtggccgcgctgccgagcaggcagcagtccatcctggagctgcgcctgtaccagggcttctggctgccggagcactgggtgccggggaccatcgtgttccagcgccgcttcacgccgcgccccgacgacgtgatcctcgcgagctaccccaagtgcggcaccacgtggctgaaggcgctggccttcgccacggcggcgcgtacggcgtacccgcccggtggcgccaggcacccgctccgacggctcaacccgcacgactgcgtcccgttcatcgacgagatcttcgccagcggggaggaggcgaagctcgaggccctcccgtcgccgaggctgatgaacacgcacctgccctacgccctgctcccggcgcccgtcaccgccaccgccaccgggtgcagggtcgcgtacgtgtgcagggaccccaaggacatggtggtctcgctctggcacttcctccggcgcgccaagccggacctcttgttcgccgacacgttcgagtccgtctgcgacggcaccgtggtggtcggcccggtctgggaccacgtcctctcctactggcgtgcgagcgtggcggccccggacagggcgctcttcctcaggtacgaggacatgctgcgggaccccggcggcaacgtgcggcggctcgccgagttcatgggccgcccgttctcggccgccgaggaggccgccggcgacgtcgcggccgtcgtggagctctgcagcttcgacgagatgaaagggctggaggtgaacaggcctggtagcggcaccgcggggaggtaccgccccatgccgcgcgacgccttcttccggaagggtgtcgccggggactgggcgaaccacatgacgccggagatggcggcgcggctggacgggatcttccgtgaaaagctccaagggacggggcttatcttctcataatgcaaatgtgtatacggctcttgatttgcgtggtcatctcttctgatcttttccgtggtgtcttgtgtttacacgagatatgttagatccaaaataagtagtgatgatttaatatatacatcatatgcatcaatctcccatgtacaccagatatgttttcccttttatattgttcacacgaattcgatcaaatt

SEQ ID NO: 13255 - DNA, 1648 bp, Zea mays
gtcaaagcaacgcacggcggctgcctcactttgcataggacgcatccgccagaccgccactttcttcagcatttcctcaaacaattcgcgcgccgccgccgccgctctccggcgtctgctactcggctccgtgcccccaccaggcagcaggccaccaccccaatccctctcttccttcagagatgcagaaggtgcggctcaaatgggtgaagaaccggggcctggatcacctgatcgagcgcaccacctcaatccgcgcgtcctgcctgctgctcgaccacctctcgcgcctccctggtacctcccccgtgccggcgcgctccctcgcacgcctccaaaagccgcttggcctgacggtgcctgtgcttcgcttccttcgccgccatcccacgctcttctccgagcaaccgcaccctcggttccccacgctgctctccttttccctcacggctgcgtcacacaccctcctgtcccgccttgccgatgcctatgcgcacgacgcgcacctccgcctcgcgcgcctcctcctcctcacccgctccaggtcgctcccgctcgcctccgtgctcccgctccgcttcgacctcggactgccgttcaacttcgccgccgcgttcccggcctcccaccccggtgtcttcgccgtcgccaacaaccgcatctccctacggtccacctccggcctccccgaggacatcgccgtctcctctctccaacgccgccacgccgcggccatcgactccgcgacctaccgcgcgctgtcccggccgccgtcctcgtcgagcgccccgctcgcgttcccgatgcgattcccgcgggggtacggcgggatgaagaaggtcaaggcctggatggatgagttccaccgccttccctacatctcgccgtacgacgacgcgtcagggatcgaccctgagagcgacatttacgagaagaggaacatcggcttgctacatgagctacttgggctaacggtgcacaagatggtgcggaggaacgccatccggcttcttcgggaagagctgggcctgccacacaagttcactaggctgttcacgcggtaccctggagtgttctacctgtcgttgaagtgcaagacaacgactgtggtgcttcgtgaggggtacgagagaggtaagctcgtggagcagcatcccctggctgctgtgagggacaaggtgcattatgtgatgcgcactggagtgctgtaccgtggaaaaggtttgtccaagcttgttctggatgaggatgtcactgaggaagagggtgcactgaatggggaggaatttgaaggggagggaatggatggggatgctgatgtcgagtgcttcagaatggagattgtggatgacgatgggtctgctgatgatgtggatgatgaaggttatagtgatggttgacatggactgatgactcttgccttcttgatttatgttttgcatttgtggcttcagtcgtgaattacagtgactgttttttattcaacttattagtggcttcaattgagaagttcagcaagttattgtagattactgtgagtatcatgctctgctaatactttgatatatgctgcattcatatgcttaagaagcagcaaactaaactttatatgtgattattggttggagagctaaaaaaaaaaaaaaaa

SEQ ID NO: 13256 - DNA, 1153 bp, Zea mays
atacgtatctatatctatatagagacggctgcacaatatttttttttgcctctttaaacatctatgcctcttattaaacacctacaccactctacatgcaccttgtagctgcaagcagccggctcctcaccttcctcgttccttccactgtgttcaacaggaaagcgatggacttgtaccaatttgcacttgcgggtcaagattctcctcctcttcctctccggtcaaagtggaccaagtcgccgcctcgcatccactggaatcataaaagaacagagcggagcagctgcacttccgcgtcgagaaatcattagagctcaagaaaacaggtcagcaatggaggccacggcgacgccaagaacccaagaagtgatgaagcccgagcccggcacggccaaggtgaccgtggacgaggtgacgctccgcaagttcgagctgtccgacgtggacgcgatgatggcgtgggcgtcggacccgcaggtggccgccgtgtgccggtgggagccctacgagtcgacggagccgctgctggccttcatccgcgacgtggtactccctcacccgtggttccgcgccatctgcctccgcggcgagccccgccccgtcggcgccgtgtccgtgtccccgacgggggacccgtgccgcgccgagctcggctacgtgctggcgcgcgcgcactggggccggggcgtggccacggccgccgtgaagcgcacggtggccacggtgttcgccgaggtgccggggctggagcgcgtcgaggcgctcgtggacgtggccaacccggcgtcgcagcgcgtgctggagaaggccgggttcacgagggaggccgtgctccgcaagtatggcgctaacaagggcgtcgtcagggacaaggtcatgtgcagcttcatcgaccccgacgcagtgcccgagtgacttgagcgccctgtcgcaaatcttttgctgtcggatgcatccagttccgaatttgaatgcaagcaattccaatcgatgacacacggtgcgcccgccgggttacgccgctagtgtgtggaccttaggtgtttgaaagagtttgtatttgtcctcactaaggtgatgtttggtttctcgggactaatttttagtccctatattttattctattttagttccaaaaaaaaaaaaaaaa

SEQ ID NO: 13257 - DNA, 775 bp, Zea mays
catccactggaatcataaaagaacagagcggagcagctgcacttccgcgtcgagaaatcattagagctcaagaaaacaggtcagcaatggaggccacggcgacgccaagaacccaagaagtgatgaagcccgagcccggcacggccaaggtgaccgtggacgaggtgacgctccgcaagttcgagctgtccgacgtggacgcgatgatggcgtgggcgtcggacccgcaggtggccgccgtgtgccggtgggagccctacgagtcgacggagccgctgctggccttcatccgcgacgtggtactccctcacccgtggttccgcgccatctgcctccgcggcgagccccgccccgtcggcgccgtgtccgtgtccccgacgggggacccgtgccgcgccgagctcggctacgtgctggcgcgcgcgcactggggccggggcgtggccacggccgccgtgaagcgcacggtggccacggtgttcgccgaggtgccggggctggagcgcgtcgaggcgctcgtggacgtggccaacccggcgtcgcagcgcgtgctggagaaggccgggttcacgagggaggccgtgctccgcaagtacggcgccatcaaaggcgtcgtcagggacatggtcatgtccagcttcatcgacaccgacccagtgcccgagtgacttgagcgcccctgttgcaaatcttttgctgtcggatgcatccagttccgaatttgaatgcaagcacttccaattgtttcctccaaaaaaaaaaaaaaaaatccgta

SEQ ID NO: 13258 - DNA, 1632 bp, Zea mays
  misc_feature (4)..(4): n is a, c, g, or t
  misc_feature (9)..(11): n is a, c, g, or t
  misc_feature (13)..(14): n is a, c, g, or t
  misc_feature (16)..(17): n is a, c, g, or t
  misc_feature (19)..(19): n is a, c, g, or t
tccnccccnnngnngnncnctctgaacctatgcctagccgccgaaccgtgcgcccccccccccccccaggtcccgtaaaatctggcttttctccctccccataccccgcagtcccgcacacacactcgctttcttcggttcttcctcctcgagcagccacttccgtctctaaccctacagcgacgacgagagcgaggccatgaaggggaagaagccggtcaaggagctcaagctcaccgtgccggcgcaggagaccccggtagacaagttcctgacggcaagtggcacgttcaaggatggtgagctgaggctcaatcagagcggcttgcggcttatctctgaggaaaacggggatgaagatgaatctacaaagctgaaggtggaagatgtgcagttatcaatggatgatcttgagatgattcaagtcattggcaaaggaagcggtggtgttgtccagctagtgaggcacaaatgggtgggcacattatttgccttaaagggtattcaaatgaacattcaggagtcagttcgtaaacaaatagtacaggagctcaaaataaaccaagcaacacagagccctcatatagttatgtgccatcaatctttttaccacaatggtgtaatatatcttgttcttgagtacatggaccgtggatcgcttgcagacattgttaagcaagtgaagactattctggagccataccttgcagtactttgtaagcaggtcttggagggtttattgtatcttcatcatcaaaggcacgtgattcacagggacataaaaccatctaacttgttggtcaaccgtaaaggtgaagtcaagattaccgacttcggagtgagtgctgtgctagcaagctcaataggtcagcgagatacatttgttggaacctacaactatatggcgcctgagcggattagtggtagcacttatgactacaaaagtgacatatggagtttgggcttagttatacttgagtgtgccattggccggttcccttatataccttcggaaggtgaaggttggttaagcttttatgaacttctggaggccattgtcgatcagccaccaccttctgcacctgcagatcagttctctccagaattctgctcatttatctcctcttgcatacagaaagatccggctcagaggatgtctgcttcagaactcttgaatcacccttttttgaagaagttcgaggataaggacttaaacctggggattcttgtggagaacctggaacctccaatgaatatacccgaatagcctgtcgtttttagtgatgaagcctttgttgtgccttcagggtttggcctcgaagcctcttggcatctgctcctcaactgcagcctccctacctgaatatgctataacatcattgtatgattcaagccccttgtggctatctgagcataagagtagagggaactatgctgcattccgtgtatggtcaccttattgtagctattgttgcgacgggccttgtgattttgagtcttgttttaacttttgcagtcttatcggctgtggattcaaaatgaacgaactgaatattcaaaacatgtttgccaacaaaaaaaaaaaaaaaaaaaaaaaaaaaaagcggccactcgagggggggccccgggtac

SEQ ID NO: 13259 - DNA, 3008 bp, Zea mays
gcacgccgtaaaaggccaaaaacctaaacatacgcgcctaactccgcgtcctcccccccctccctcgaagcggccaaggcggcggcagcagtgccggcatgggcgcaatgtcggcttcgatttcgtcggtgaattggctagtcgaggatgacatcctcctcaagaacgccgtcgaggctggtgcttcgttagagtccttagccagaggagctgtatgtttttcccgtaaattcactcttcatgaaatacaggaccgctggaattcattgctatatgacccagatatctcaacacaagcagcttctcggatggctgagtatgagaatgaactttctacttccgatccagccaaggcacataaacttttcaactcaaaagcaaaggatttttcatttcagaaacggaaaatagacagtgtaaagaatctatattatgcgatgagaaaaagagtacgcaatgatccacgcaacagtggcgaccttggatttcttgtcccctgttcgtgtacggcaattggtagtgagtgtatctgtggaggcctacctaacaatattgaaccagagctgaattcagtaagccgctatgggcaagtaggttcaaggtacaccattggacattcatattctgaaatgaacgaacatgcttttcatacgaagcatactgaaagcatgacaagagatggggatggcaccagtaatgttgtgtatggctactcagatgtaggccaactatatgaacatcatgcgtacacagcgaataatcatgggaatagagaagggaacaatctttctctaaagagtatcacaaattttcaggattctatgcagtttcagcagttggacaacaatcaatgtggtaatggggtggtagactcaaaggctttggtgatctctaaccatttcagtggaagtgtgcaggaacctatgcctctccaaatgattggtcaacctgagggttctgaagcaccaggtggtgcaatcttgagtggggttcagcgaagcgacaggctcgctcttgctgatgataaggatgtaaaatcagaagacagggaccctctcacatttgaagcgcatttagatggtgggatatctggtttagatcacgctactgagtttatggacttcccatatttcactaatagtgaagaccttgatatcctgaatagtgaaaatcttttgaattctccaagtgagggaatccaggaggatttagacgatactgcattagttgttcatggggttagatcaaccatgcaaaatctggttcatgctgatgaagccaatatgtcctgtgatcaaatagatcttggtgatgtgaaaaataatgtagatgcttctggtataatcttatttcctacttcattagtagtgccctgtcctggcctgtatgttgagtgcaaattgaacacagaagatactgaaattccttgcaacgacgatgtttctacaccaacagagtatcctcttgaatgctgtacttctacctttgggcagaaatctgagaatactatctattccgtctcccctgcaatcagccctccatcaattgctgaacagcccaacccatccacttcagaacaaaaagaagattcagtggctcatgacgaaggtggtgtcctaggagctaaaccatcagaaggtgctttaacagttggaggccttttgcctggtaacattgacacaaatgatgcaaacacatgcatgctagctttgccttcttttagcactgctggatttggtgaaggatcaccttgtagtttaggaccacacgagagctttgataactctcatggtttgactttgcaaaattcagttcaagctcctgatcagatgcaacacaactcacttgatggtaaaccagaattaggtgacaaggctgctctacagaactgtatgccatcaaatgcactgcccgatttggatattcagaacactattgcaaatgcgccaacaccagctcaagcagaagaatgccctgactatgaaaaagatgttccaaattactatgatctagaagctttgattcttgaccaggatcttatcccgtgggaccaagactccgattttatgcatcctgaagttaccggatttcctcacccggaaagcaggaaggcattgattagattggagcaaggtgctcggtcttgtatgaacagagctatcatgtcgcatggtgcctttgcagttatctatggattgcacttgagatgctacataaaggatcctgaggttactcttggaagagagacagaagacattaaagttgacattgatttaggaaaagaagggagggcaaataagatatctcgccgacaggcggttatcaagatggatgaatctgggtattttcatattaagaacactggaaaatgtccaatctttgttaatagcaaggaaataccaagctgcaaacgcatcaacctaagctcagactcattaatcgagataaaggacatgaggtttattttccacgtaaaccaagaggctgtgaggcagtacattgatcgtgacctgaagccagaacgctaatttcccctggctttccagtcagcagcagcctgtgagtgactgcctcattaacagcaatagaagtagcatagcagtaaatttgagtaagcattgctcgtttaggatgttccttcatatgatgttaacaagttaggttcacttggctccggtctgtaaatggttgtagtttgttgcgttttctgtctgtttggcgggcataaatcatgcatataaccagcgcatttgcttccagtttgtacctacactcccaggaatgatttcatttgtaatactggcaccctagattgtggtgactgccgccaagagcaagaggcatccaatgcaataaagtgcggaaaagaatcaatagaagggtagattctagggtagaacaggaggagggtgcacttgtgcaagaaaccattcggttcttgcgacgctataagcataaactttattggtttttatttatataccctgatgatcttgaagcaaagggac

SEQ ID NO: 13260 - DNA, 1668 bp, Zea mays
ccggccgggagattaatcgtgacctaaatcgttcgatcagtttaggaacgatcagcctggctggctggattgaaatttaggcccagtggcccacttcacttgcccagcggccctgcccagcttcctttttcccaattccccccactggggcacacacgacacgaaccaggcaaccagctgcggagggaggaaccctagcggaacactgtgcaggtgacggcggcgcgctaccggtcacgggggatacggcggcatcgtcccctcctccatccccggcgcggcggcgccagcagccggcctgcagggacggtctccagtctccagaatccagattcagagcttgtccctgttttgtggtgtgctctgttgtactgtagcctgtagccagggcaaattaaagctacaatgcaggctgcctactatgcaaaggatcttttggtttgaagtccagttgaccgaagttggaaaatacttctgatacttacagatttcacagaggtcttgtttattttctactattttccttcaagcacgtggaatagtacgtttgacaaacaatttgctgacgaggttttcgaacacggctgaacacgcgcgcaaggcgtgcacagtacacgcgcgcagggggaggaggagaacaagaggatggtgaaggcaaggcccaagccaacgccggtcaaggcggccccagaagtgatcttcgacccaatggcctctggtgcccggaagccccgccgcccaggggcgccgtcagccagcaaagaatggcacagcttcatgggatcgagtctgtcggatatgtatcggaagccagttttggagaaatctgctgacacatctgatgaggagcctgacattgatatcatgaagctgctgaaagatgttgagatcattggtgcccctacatttaaggggcgaaagcaaatcgagaaccgcagagtagttgagttgggtggaaagtccgttaagaagcaccgcacaccattaagtgttgcgaagccagctctgaagaatcagaagaaacgagaacagaagaaaatggaagaggaaaaactacttgggatctttaggaagagggacaaggacaccaaacctcacaagacaaggccagaggaccgagtgcttagggccacagaagggcgctttaggaacggtatactgaacgtcaagcatcttctggcgccaccgaaaccatcaggcaaggacatgtcggaaccgaagatgaggaaggacaagcacaaggggaagggtaagcagaaggggggcagaaggaagagacgttgaagaaagcacacttctgtaacctggtttgctattaagaatttaagatagatggttgatgaaacgtttaaatgacaacacctttttgtgtccgtcctgaaattaagacgtttccttgctctgctggaatctttgaagtgatccttgaaacgatgtaattctccaccttgaaacgaaacgatgtaattctccaggatgcggttcaggaagaggcttatttggttcaattttaaaaaaaattcgatccctgggcatatttgtttttgtattgtcatcttgtatatgatcaaagctaggggtatttgtcaatggctaaaatgctgccgtccctaaaatgttagattgattccattctgcaaaaggaatacatttccattgtccagaggg

SEQ ID NO: 13261 - DNA, 1290 bp, Zea mays
cgttgctgtcgggtagctgtcactgtgtgccttcgttttgggaggacttttcttccttcgcctctacaggtttggaatcggcgctgtccgtcttcgctcttctcgccagggcaaattaaagctacaatgcaggctgcctactatgcaaaggatcttttggtttgaagtccagttgaccgaagttggaaaatacttctgatacttacagatttcacagaggtcttgtttattttctactattttccttcaagcacgtggaatagtacgtttgacaaacaatttgctgacgaggttttcgaacacggctgaacacgcgcgcaaggcgtgcacagtacacgcgcgcagggggaggaggagaacaagaggatggtgaaggcaaggcccaagccaacgccggtcaaggcggccccagaagtgatcttcgacccaatggcctctggtgcccggaagccccgccgcccaggggcgccgtcagccagcaaagaatggcacagcttcatgggatcgagtctgtcggatatgtatcggaagccagttttggagaaatctgctgacacatctgatgaggagcctgacattgatatcatgaagctgctgaaagatgttgagatcattggtgcccctacatttaaggggcgaaagcaaatcgagaaccgcagagtagttgagttgggtggaaagtccgttaagaagcaccgcacaccattaagtgttgcgaagccagctctgaagaatcagaagaaacgagaacagaagaaaatggaagaggaaaaactccttgggctctttaggaagagggacaagcacaccaaccctcacaagacaaggccagaggcccgagtgcttagggccacagaagggcgctttaggaccggtatactgaacgtcaagcatcttctggcgccaccgaacccctcaggcaaggacatgtcggacccgaagatgaggaaggacaagcacaaggggaagggtaagcagaaggggggcagaaggaagagccgttgaagaaagcacacttctgtaacctggtttgctattaagaatttaagatagatggttgatgaaacgtttaaatgacaacccctttttgtgtccgtccctgaaattaagacgtttccttgctctgccccctctcccacagtgatccttgaaacgatgtaattctcccccttgaaacgaaacgatgtaattctccaggatgcggttcaggaagaggcttatttggttcaattttatatgcccttcgatccctgggcatatttgtttttgtaaaaaaaaaaaaaacaaagc

SEQ ID NO: 13262 - DNA, 1670 bp, Zea mays
agcaggcggcccgggcagatagcaggcgtgttgctcgcgcctcggcacataaatcgtctccgatctccaggtgcccggccaccctggttcgtcgaagcaccctagtcgtcgtagcggcctacgggctcttgggcagagagagaagctgcatagccagtcgctcctgcatatgctccagctgctgcgcgcaatgatggcactgacggagcggcagccgcagctggagaagaagccggcgcgcgggagggcgccgctgtcggggaaggccgtcgcggcgctgtgcgtgacgagcttcgtcgtggggctgctgcttagcggcaacgtgtcgctcatgtcggcctcggcgtcgccgtcgtcctcgagcacggacagcgccgacagcgacaagagcattcgtgtttccggttgcgacaatgagcgtaaactcggagagaaccaccccaaggatctcctgaacgaggtgtcgagaactcatcaagcaatccagtcgctggacaaggcggtgtccaccctggagatggagatggccgtggaacgcgctaggggcggtggcggcggcggcggcgccgcgtccatggcgtccagcaggactcctcagaaggccttcgtcgtggtcggcatcaacacggccttcaccagcaagaagcggcgcgactcgctccgcgacacctgggtccccagaggggataagctgaggaagctggagcgggagaaggggatcgtggtccggttcgtgatcgggcacagcggcacgccgggcggcggcgcgctggaccgcgccctggacgcggaggaggccgagaccagggacttcatgcggctggaccacgccgagggctaccacgagctgtcgtccaagaccaggacctacttcaccaccgccgtcgccacctgggacgccgacttctacgtcaaggtcgacgacgacatccacctcaacctcgggatgctggcgagcaggctggcgaaacacaggacgcgcccgagggtgtacgtcggctgcatgaagtccgggcctgtcctgtcacagaaaggagtcaagtaccacgagccagagtactggaagttcggcgacgagggcaacaagtacttccgccacgccaccggccaaatctacgccatctccaaggacctcgccgcctacatctccatcaaccagccgatcctgcacaggttcgcgaacgaggacgtctcgctgggggcgtggctgatcgggctcgaggtcgagcacgtcgacgaccggagcatgtgctgcgcgacgcctccagactgcgagtggaagaagcgagccgggaacgtgtgcgtggcgtccttcgactggtcgtgcagcggcgtctgtaagtcggtggaccggatgcgccacatccacaaggcgtgcggcgaaggcgaaggcgccgtctggaacgccgccacatgagacgagattgccattctcgtcggaacacttgttgtatgcggagcttcacttgatgaaaacgcgaaggcgagagggaagcgcctgcgccactgtttggcatgacacattccgcatggcaagcgtggttgtttcacttgagacggcatgctatgatccacgtaaaagcgcatggattattattggtgtgtcaacgtgatcctttttggatgaaaaaaaaaaaaaaaacggtggcccttgaaaaaaaaaaaaaaaa

SEQ ID NO: 13263 - DNA, 1563 bp, Zea mays
acataaatcgtctccgatctccaggtgcccggccaccctggttcgtcgaagcaccctagtcgtcgtagcggcctacgggctcttgggcagagagagaagctgcatagcctgcatatgctccagctgctgcgcgcaatgatggcactgacggagcggcagccgcagctggagaagaagccgacgcgcgggagggcgccgctgtccgggaaggccgtcgcggcgctgtgcgtgacgagcttcgttgtggggctgctgcttagcggcaacgtgtcgctcatgtcggcctcggcgtcaccgtcgtcctcgagcacggacagcgagaagagcattcgtgtttccggttgcgacaatgagcgtaaactcggagagaaccaccccaaggatctcctgaacgaggtgtcgagaactcatcaagcaatccagtcgctggacaaggcggtgtccaccctggagatggagatggccgtggaacgcgctaggggcggtggcggcggcggcggcgccgcgtccatggcgtccagcaggactcctcagaaggccttcgtcgtggtcggcatcaacacggccttcaccagcaagaagcggcgcgactcgctccgcgacacctgggtccccagaggggataagctgaggaagctggagcgggagaaggggatcgtggtccggttcgtgatcgggcacagcggcacgccgggcggcggcgcgctggaccgcgccctggacgcggaggaggccgagaccagggacttcatgcggctggaccacgccgagggctaccacgagctgtcgtccaagaccaggacctacttcaccaccgccgtcgccacctgggacgccgacttctacgtcaaggtcgacgacgacatccacctcaacctcgggatgctggcgagcaggctggcgaaacacaggacgcgcccgagggtgtacgtcggctgcatgaagtccgggcctgtcctgtcacagaaaggagtcaagtaccacgggccacgagtactggaagttcggcgacgagggcaacaagtacttccgccacgccaccggccaaatctacgccatctccaaggacctcgccgcctacatctccatcaaccagccgatccttcacaggttcgcgaacgaggacgtctcgctgggggcgtggctgatcgggctcgaggtcgagcacgtcgacgaccggagcatgtgctgcgcgacgcctccagactgcgagtggaagaagcgagccggcaacgtgtgcgtggcgtccttcgactggtcgtgcagcggcgtctgcaagtcggtggaccggatgcgccacatccacaaggcgtgcggcgaaggcgaaggcgccgtctggaacgccgccacatgagatgagattgccattctcgtcgtcgtcggaacacttgttgtatgcggagcttcacttgatgaaaacgcgaagccgagagggaagcgcttgagcattccgcatggcaagcgtggttgtttcacttgagacggcatgctgtgatccacgtaaaagcgcatggattattattggtgtgtcaacgtgatcccttttgaaatattgaacggtgg

SEQ ID NO: 13264 - DNA, 3567 bp, Zea mays
tgcatgtcctgcagtcacagaacagccatattttttttgtggtggtgaggtatgatcatggaaaattgtgatacgcatatgttgctgttgctaacgacagctatcattggagtatcgttgagtgcctgctggagatctatataatactagcaagtagcaaccagactatcagtatcacgctgcatgtgccaatcagagaaatatgatactactagcaaacgatgacgatatgacagtgatcggctagtagagaaagaaacaagaaaggggccggccagaccacaagtgatggggcagagtagtgaacatcccagaagcaaacgattcggcaggagattagtcatgggcgccaaacgatcggcatggaatgatgccccagtcacgatcgagatcacggcatgaacgcgcatccgatggccgcctcgcggccggccgggagggggcatgtggttggacttggaggagaggaacacgtacaaatatgggcaggcactagctagctaggcggcaaagagccaaagactgccggcaccgctgctagcttgctagcatacttccggtcggcaagcagtcgatcgtcgcatggcgccaggaggcagcggcgagcggtggagcctggccggcgcgacagcgctggtcaccggtggcagcaaggggatcgggcaagccgtcgtggaggagctggccaggctcggcgcgcgcgtgcacacgtgcgcccgcagcgcggcggacctggaggagtgccgccggcggtgggccgagaaggggctccgcgtcaccgtctccgtgtgcgacgtcgccgtgcgcgccgaccgggagaggctcgtcctggacacggtcagcggggccttcgacggcaagctcgatatcctggtcaacaacgctgcgctgctgctgctcaagccggcggcggagtgggcggcggaggactacgcgcggatcatggcgaccaacctggagtcgtgcttgcacatctcccagctcgcgcacccgctgctcctcaacgcctccgtcgccggaggggcgagcatcgtcaatgtctcctccatcgccagcgtccttggcttcccgcaggaagtcatgtacagcgtcaccaaaggaggactgaatcagatgacgaggagcctagctgtggagtgggcctgcgataggatccgtgtgaactgcgtcgcgccgggcgtgatcatgacggacatgggtaaagagctaccggcggcgttggtggagcaggagcggtcacgcatcccgctgcggcggaccggcgagccggaggaggtggcgtccctggtgtcgttcctctgcatgccggcggcgtcctacgtcaccgggcaggtcatcttcgtcgacggcggccggaccattagtggcgcctgatcgacgacgacggccagctatatatatagcgaagaataaatgtggatctattctctattctactgtatttgaatttgttttcgttcttgtcttcttgatcggccatgtatcaccgtcagacgtcagcggcaataatccggccgccgtcggcttgccgggagggagatacccaactagcgacatgcaagctgcccgatcagtcgtctcgtctcgcctcgccggccggcaaggtgcagccactgtcgttgcctgcagttctgttcctttttctactatggtttcttgtattcactgcccactggtgatgtttctgtgataacgacttcgacagaggggatacattttaaaatccttgtgctaatcattttttgtgcacatcagagttttttgagaacagaaaacgtgcgtctgtgatggcatatggatatgacttttgtaaacagagagaagcgaccacaaatctctactcttggaggagacagagagaggagagacttcattcgaatttccaataaaaaagaatatacaaaacaaaagacccggttcccaactgtcgtcggattcaaaacttgctgcttcctcctcgtcactttcatcatcagtgaaccacaaactgcacgaagcgtgaagcgagtccatttcgaacaggtcaatggcagggcgtctccagatcctccactccttccttcttgcatgcgtaacatgggcctggcaagcaaaaaaaaagtgttgggtggggggaggcaacagtgacttatctcagtgtcccaaattaaattgtaaggctcaagctacaacaagctgctccaacagtaccctattatataaaattttataaaaaaagttatctcttgaagtgccacaaaaatattgtaccttattgtactgccccatatctagatttaaacgaacataggcttcacaaaacttttatttccaaacgaacgaagaaacttttctttccaaacgaatggagtacattaatagatttcggttaatcacttgatttggagcttagcaggtcaaaaaatgcctcaaactagtgactcaaattaaaatataggtctctacacatgaaaaactactcaaacaatgccttattttataaaattcgattaaaaaaatataaggcaccctctaaagcgcatcaaatataatacacctttgtggctgctttataatctaaatttagagtttttactattgaagtagaatattttgtctattctcaaaaattctataaaattttctcatttttaaattataggatatttttatagatcacgttgttggagatgctctcaggcctaagagttgtattatatagtcttttagttgtctcttatatctaggggtgataatgagatctaaattttacactataaaatttaaggataagatcggattagaatcaggttatatttctatttatttttgaactaaaattaatttagagctctaacaaattataaaaaaatatttggctcatgattcgttaccacacccgtacttttacctagaagactgttaggttttagattatacgtgcccttagagcatctccaacaatacctcaaactagtgcctcaaattgaaatatggggctttacacaggaaaaactactccaacagtgccttatttcataaatttttgtcaaaaaaaactatagggcaccctctcaagtgactcaaatatactacaccgtagtgggctgacctataatctagatttagagctttactgttgaagcgaagtgttttgttggtgccctaaattctataaaatatacttatttttaaattataggacattttgttaggtcacgttgttggagatacgttattggagatgctctaagtacacgcagaatgttcttcggtccgtccaagtatacaggtacaggttaattagacaacaaatgcaacaggaacacgcttcgcttggtttgacagtgtacgtgtggtatatgatacgatgctagaggaagaagttccttgtgacaaagaatcgaaccaccggtcaattactggctttcgaagtcaggcagataatgcaaagcgatcttcgcagctagaacaggtcttcgcagaagggaacccttccgaaacctgcatttgttccgttgggatcgggagcaggtcttcgcagctagaacagcacgcgagccattctcgctcaagatggtgtgctgt

SEQ ID NO: 13265 - DNA, 1574 bp, Zea mays
attgggacctcgaggcggcaggaagaatacagagaagctgcgaagtaaatcttggcaagatgcattaaggattgtgatgatcagcgtaaccaatcatttcccttcatttgaagcccttgctttggttcagatagaacggacactagaggatatatcacagaaactgcaactggttcaacgtctccatactcgctttctcttacttcccaatctccaagatgttacaagaaccatccagcgtccttctattcatgaatggtcaagcaatggaatgcaccgaagcatttgtttcgtcaacaaagctacgggttatattctaatcgcagagcccccaagttttttgacgatatatgatgttatcgcaattattgttagtcacaggttaggggcaccaatgatcttgccgattgcctcagtgtttgcatgcccagatggttcagagaaagaagtccttcaaattcttcacctgggttcagactttggagtttcaaaacgtgaagggagatacgacgcttcccttggagcagaattgttatctcaggatgctcggcaggtgcaattccttccattaagaccgttctatagtggtgaaattgtggcatggaagacaggcaaagagggggaaaagctcaggtatggtagggtccctgaagatgtaagaccctcagctggccaagcactttacagatttccagtagagacagctcctggcgaaactcgcatgatgctttccagtcatgtttactcatttaaaagtgtttcaatggctgatcttctgtctgcaccttcccaagtgaatggtgatgtggcattaggtggccaagagaaactcttggccaccaacactggcactgaagtcaccaaggatgcggatgctggacttgaatatggaaaagtatcttccactgaactggtacaagcagtccatgatatgctttcagctgcaggagtaaggatggatgctgagaaggaaacactctttgaggctactctttccttgcaagatcagcttaaagaatctcaagttgctctcttggtggagcaggagaaggcggaggcggctgtaaaagaggctgatgtcgccaaagcagcatgggcatgccgtatctgcctgaatgctgaggtcaacatgaccatcataccatgcggtcatgtcctatgtaaccgatgctcaagttcggtttcgcggtgcccattttgccggacgcaggtggccagaatgatgaaaatattcaggccataaaaaacattgaaggacgtttggtctgactaaccgcttcagcttgtgaatgtgttacgatatcggggctcggctcccttctggttgtgcgttgcattcctttctggtctgatgcatctcattattctccatcggtgatgattggtaatccgatatggggggtgcaagtatagttacgttgtacaggaacgatgcattgcagtgtacagattccaaaatgaaatcattttacacacttcgaagggcatcgatgtctgaagctggttttctcgtgcaatactttcagagtcaacactacactgccctggttatccattcagcatgtatggtggtg

SEQ ID NO: 13266 - DNA, 1459 bp, Zea mays
  misc_feature (1217)..(1217): n is a, c, g, or t
atctctagttctctacacaccgacacgcatgcagatcggttgccggggcacgatgaggaccgcgtggccgctgctcctcgtggcgacggcgctgctttcgacttcggcagcaagggccaggaggacctgcaggttccctgccgtcttcaacttcggcgactccaactccgacaccggcggcttctgggcggccttcccggcgcagcagggcccgttcggcatgacgtacttcggcaggccggccggccgcgcctccgacggccgcctcgtcatcgacttcatagcgcaagcgatggggctgccgctgctgagcccctacctgcagtccatagggtcggactaccggcacggcgccaacttcgcgacgctggcgtcgacggcgctgctgcccaacacgtcggtgttcgtcaccgggaccagccccttctccctcggcatccagctcaaccagatgaaggagttcaggaacagagtgctcgcctccaaaggaaacaacggccaactccctggcccggaaatcttgggcgacgctctgtacacaatcgacatcgggcagaacgacttcacctcgaaccttggatccctcggggtcgaaagcgtcaagcgaagcctaccttcagtcgtcagccagatctcctggacgatacagcatcggagctcgcaacttcatggtgttcaacatggcgcccgtaggatgctacccggcattcctcgcggggcttcctcgtgacagcaaggacctggacgagttcgggtgcgtgaaaagctacaacggcggggtcacgtactacaaccagctgctgaacgacagcctagccgagatgaggaagacgctgcaggacgcgtcggtcgtgtacgtcgacaagcatgctgtgacgctcgaactgttccagcacccaaccgctcacgggctgaagcacggggctagagcttgctgcgggtacggcggtggaacctacaatttcgatcgagatgtttattgtggtgacagcaaggtagtgaatggagaagctgcgacggcgggggcttgtgcagacccgcaaaactatgtcagctgggacgggatacatgccactgaagctgcaaatagtaggatagcgtatgctgtgatcagcggctcctattcgtacccacctttcgatctttcaaagctatgtagcccttaggcatcatcagtcgtgaaagggagtacagcatcaccatacaccgcatttctntgaaacaagcagccacatttctttcattgacagcatcaacacacaggacaaaagctacgaactcaagaacgacgcacgcctacaacgagtcacgacgagaacagaggctaaagacctactccctctgccctagaaatgaagtcgtttgacttttttaagacaagtttgactggtttgttttattcaaaatatttatgaaaatatagaaaaaaaacatttgatagtcaaaaaaaaaaaaaaaa

SEQ ID NO: 13267 - DNA, 1079 bp, Zea mays
  misc_feature (1)..(1): n is a, c, g, or t
  misc_feature (23)..(23): n is a, c, g, or t
  misc_feature (25)..(25): n is a, c, g, or t
  misc_feature (30)..(30): n is a, c, g, or t
  misc_feature (38)..(38): n is a, c, g, or t
  misc_feature (40)..(40): n is a, c, g, or t
  misc_feature (43)..(43): n is a, c, g, or t
  misc_feature (46)..(46): n is a, c, g, or t
  misc_feature (49)..(49): n is a, c, g, or t
  misc_feature (51)..(51): n is a, c, g, or t
  misc_feature (55)..(57): n is a, c, g, or t
  misc_feature (59)..(59): n is a, c, g, or t
  misc_feature (72)..(72): n is a, c, g, or t
  misc_feature (1024)..(1024): n is a, c, g, or t
ntacacaccgacacgcatgcagntnggttnccggggcncnatnagnacngngtgnnngntgctcctcgtggngacggcgctgctttcgacttcggcagcaagggccaggaggacctgcaggttccctgccgtcttcaacttcggcgactccaactccgacaccggcggcttctgggcggccttcccggcgcagcagggcccgttcggcatgacgtacttcggcaggccggccggccgcgcctccgacggccgcctcgtcatcgacttcatagcgcaagcgatggggctgccgctgctgagcccgtacctgcagtccattgggtcggactaccggcacggcgccaacttcgcgacgctggcgtcgacggcgctgctgcccaacacgtcggtgttcgtcaccgggaccagccccttctccctcggcatccagctcaaccagatgaaggagttcaggaacagagtgctcgcctccaaaggaaacaacggccaactccctggcccggaaatcttgggcgacgctctgtacacaatcgacatcgggcagaacgacttcacctcgaaccttggatccctcggggtcgaaagcgtcaagcgaagcctaccttcagtcgtcagccagatctcctggacgatacaggacttgtacagcagcatcggagctcgcagcttcatggtgttcaacatggcgcccgtaggatgctacccggcattcctcgcggggcttcctcgtgacagcaaggacctggacgagttggggtgcgtgaaaagctacaacggcggggtgacgtactacaaccagctgctgaacgacagcctagccgaggtgaggaagaaggtgcaggacgcgtcggtcgtgtacgtcgacaagcatgctgtgacgctcgaactgttccagcacccaaccgctcacgggctgaagcacggggctagagcttgctgcgggtacggcggtggaacctacaatttcgatcgagatgtttattgtggtgacagcaaggtagtgaatggagaagctgcgacggcnggggcttgtgcagacccgcaaaactatgtcagctgggacgggatacatgccactg

SEQ ID NO: 13268 - DNA, 2025 bp, Zea mays
cttagatatcccaataacaggtttttctaactctgctgttctatacgtgcaggaacaaggctggagatctgtacagtagctaccatgactactcggtgacacagcacgacgtgttgagagatcttgctcttcacatgagcgggcgtgacccgctcaacaagcgcaggcggttggtgatgccgagaagggaagaaacacttccgagggattggcagaggaacaaggatgctccgtttgaagctcagatagtctccattcatacaggtatagcgttagtagttaattgttcttcattacatttgtagatattcatcgctaacaactcgtcatccaacttatttagtgcgcttattctgaattcctccggaaatttcccgctgctccctccatcccaggcgaaatgaaagaatccgactggttccagatgagcttccccaaggcagaagtgctgatcctcaacttcgcgtcgagcctgtactacctgccgccgttcatcgcgacgatgcagaacctgaaggccctggtgctgatcaactacggcagcggcagcgcggccctggacaacctctccgccttcaccacgctgagcgggctgaggagcctgtggctggagaagatcaggctgccgcctgctgcccaagacgacgatcccgctgaggaacctgcacaagatctcgctcgtgctctgcgagctgaacagcagtctaagagggtcgacgatggacctgtcgacgacgttcccgcgcctgtccaacctgacgatcgaccactgcatagacctcaaggagctgccgccgagcgtctgcgagatcgggtccctggagaccatctccatctccaactgccacgacctcaccgagctgccgtacgagctggggcggctgcgctgcctcagcatcctccgcgtgtacgcctgcccggcgctgtggcggctgccggcgtcggtgtgcagcctgaagcggctcaagtacctggacatctcgcagtgcatcaacctgacggacctccccgaggagctcggccacctgacgagcctggagaagatcgacatgcgcgagtgctcgcgcctcaggagcctccccaggtcgtcgtcctcgctcaagtccctcggacacgtcgtgtgcgacgaggagacggcgctgctgtggcgtgaggccgagcaggtcatccctgacctccgcgtgcaggtggccgaggagtgctacaacctggactggctcgcggactgatgtctcgttcctggatggatgctgcggcgtccaaactgaccttgtacatatgtgatgttgcttccccccaaaccgagcgtagggaaactcatcaatccacctgccaattttgacgtgttcagtcagtgttcgtcatgcatccatccactctttattcttgggtggcaaagcctccccttcatccaaaatacaaatgcacacaaaacaaataaccacagaaaacacaactgtacaaaaggctaaagatacaacattccgatttttcagctgcagcaatgccagcaaagagaggccaagcagggttctcaaaatgcaggaactacataggtacacagtggatagctgtacagtaacgaactaaggatcaacggttagaatcagcaatggcgtcaaaacgatcaccatgcaacagcttgaacaccgatcacttcttaagcttgagctgttcgtccagagcatcagcgagtacttcttaaacatgacctgatctacagtttccaccccaaccgttcgtggttacgtttcacatactatcactccactgctcccgatgtcgaggactcgaggtccaggtccatgtcgtcgtcaaggacgtcgtcgatgcacagaaactgggtcgtccagcgggcgccatcggccggcactgttgtctccgccatgctctccgactcctcgtagttcactgtgccgtcgcccatgaggtcagctgggaggttcctgacgaaccaaggatgactctttatctcaggcatcgtcgtgattctctgcaaagagcatgcgttatggcacatcgatc

SEQ ID NO: 13269 - DNA, 1865 bp, Zea mays
gccggccgggctgcagtttgcaagctctctctctcccccaccccttttcatgattcggacttagggtcttcttggccccagcctacttcaacgacaggatcttcttcgagacgatctcgcagtccgcgaatctggaggccatcaagatgaagctgtgggagcagatcagcggcaacatggtgctgggtacatacaaccagatcccagaatggcagctcaggctaggaccaagggaccgaggacccgtccttgtgatcctcgacgatgtttggtctctcccgcagcttgaggagctcatcttcaagttccctgggtgcaagaccctagtcgtatcaaggttcaagttccccacgctggtgaaacagacgtatgagatgcagctgctagacgaggcggcagctctgtccgtcttctgccgcgctgcgttcgaccaggagtgtgttccgcagaccgccgacaagagattggtcaggcaggtctctgcagagtgcagaggtctccctctggctctgaaggtcatcggcgcgtcgctgcgcgaccagcctccgaagatttggctcagcgccaaaaaccggttgtctcgaggagaggccatttctgactgccatgagaccaagcttctggagaggatggcggccagtgtcgagtgcttgtccgagaaggttagggactgtttccttgacctgggctgcttcccggaggacaagaagatccccctcgacgtcttgatcaacatctggatggagatccatgaccttgatgagccagatgcttttgccatcttggttgagctttcgaacaagaaccttcttaccctcgttaacgatgcacagaacaaggctggagatctgtacagtagctaccatgactactcggtgacacagcacgacgtgttgagagatcttgctcttcacatgagcgggcgtgacccgctcaacaagcgcaggcggttggtgatgccgagaagggaagaaacacttccgagggattggcagaggaacaaggatgctccgtttgaagctcagatagtctccattcatacaggcgaaatgaaagaatccgactggttccagatgagcttccccaaggcagaagtgctgatcctcaacttcgcgtcgagcctgtactacctgccgccgttcatcgcgacgatgcagaacctgaaggccctggtgctgatcaactacggcagcagcagcagcagcgcagccctggacaacctctccgccttcaccacgctgagcgggctgaggagcctgtggctggagaagatcaggctgccgccgctgcccaagacgacgatcccgctgaggaacctgcacaagatctcgctcgtgctctgcgagctgaacagcagtctaagagggtcgacgatggacctgtcgacgacgttcccgcgcctgtccaacctgacgatcgaccactgcatagacctcaaggagctgccgccgagcgtctgcgagatcgggtccctggagaccatctccatctccaactgccacgacctcaccgagctgccatacgagctggggcggctgcgctgcctcagcatcctccgcgtgtacgcctgcccggcgctgtggcggctgccggcgtcggtgtgcagcctgaagcggctcaagtacctggacatctcgcagtgcatcaacctgacggacctccccgaggagtgctacaacctggactggctcgcggactgatgtctcgttcctggatggatgctgcggcgtccaaactgaccttgtacatatgtgatgttgcttccccccaaaccgagcgtagggaaactcatcaatccacctgccaattttgacgtgttcaaaaagtggtcgtcatgcatccatccactcttcaaataaccacag

SEQ ID NO: 13270 - DNA, 1019 bp, Zea mays
ctggccgggaggacacagagaccgagggcctgtccttgtgatccttgacgacgtttggtctctcccacagctcgaggagctcaccttcaggttccctgggtgcaagactctagttgtatcgaggttcaagttccccacactggtaaaacagacatacgaaatgcagttgctagacgaggcggcggccttgtccgtcttctgccgtgccgcttccgcgcggccggccgggccgcggtctcctggccagagattggtcaggcaggtctctgcagagtgcaggggccttccactggctctgaaggttattggtgcgtcgttgcgcgaccagcctcctaagatctggctcagcgccaagaaccggctgtctcgaggagaggctatttccgactcccatgagaccaagcttctagagaggatggcggcaagcgtcgagtgcttgtcggagaaggttagagactgcttccttgatctgggatgcttcccggaggacaagaagatcccccttgatgtcttgatcaacatctggaatggaggttcatgatcttgatgaaccagatgctttcgccatcttggttgagctttcgaacaagaaccttcttaccctcgttaacgatgcacagaacaaggctggagatttgtacagcagctaccatgactactcggtgacacagcatgatgtgctgagagatcttgctcttcacatgagtgggcgtgaccctctgaacaagcgtaggcggttggtgatgccgagaagagaagagacacttccaaaggactggcagaggaataaggataccccgtttgaagctcagatagtttccattcatacaggtgaaatgaagggatctgactggttccagatgaacttccccaaggcagaagtgctcatcctcaacttcgcctcaagcctgtactacctcccgccgttcatcgcgtcgatgcagaacctgaaagccctggtgctgatcaactacggcaccagcagcgccgcccttgacaacctatccgccttcacacgc

SEQ ID NO: 13271 - DNA, 1374 bp, Zea mays
gtcgatatctttttcgtctctgtctatccggcctgttctaactgctcacgaggtctgaacaaatttgttcgggagattggtgaatctggtgattatttaaaatccatcaattgtgcaaatacgaatttagaaacttagtctagtcctccgattttgtcccaaacaaatttattagaattcgagagatcgtgcacaaggtttataattgcattgtttgtccagcagagtaatcaaacgttcgaagcgagaataaaaatatgtttttatgactcgtgccggtctaattcagtctggcatgtgactgattaaaaattcgaattattcaaattcttgtgatttaaaatctaatcaaattaagccctgatattacgatcaagattgttgttttagaaatgcaaaccgtggaggagaagaatgtgtattaattaaatagaaaataaatgtggaaatatctgttatccttatcctcccattatattctgttcttttatttccagccgtactcccttcctcgtgataagaaatctctggaaaagtcctgttaagcgttcgctgcctcgctcacacctgctgcccctcccaaattcccttctccctcacgtctctttctctccccaagccgcctcctccctgccgttccgtggagcaccaggccagtgccgttccgatggtcattccaagccagtgccgttctcctttggccgtccctgctccagccgtgagctcacccaggccacggcctcgtcgaaccgcacagcccctgcgctccttccccagccgcgcttagcccagccctccctgctcgatctccttcgagccgtaacggctccctggcgtgtccggctccctgcccctctccatggcgtcgcccagctctagctcgccccccctctgatctgtgcgcaggggtttcttccatggcgagctcccctgcaaacttcatctagccgccggccgagtttccttggtggtcgcttacccccagcatcggccagagcttgctgtcattccccaacaaacatgtggttgtaggtgagagatttcagaagtctgttggatgaagaaaagagaagtgaaatttgtgcagcgcccgtcaggtgttaggtttaatagatattgtgtctaccgtgtgagggaatcgcgccagcttcctttgggtttgggactgggagctccatcgctctatgcggcggtgctcgcccgtgtctcagctgccttcaatggcccccttgcccgcgcagtcgtctttggggtccatattgatggtcacttggtcgtggaacggcttcttattgcagtcatagtgttccagctctccaggaagagctacaaaccaccaaagaagccactcactgaaaaggagattgatgagct

SEQ ID NO: 13272 - DNA, 426 bp, Zea mays
cgttgctgtcggccaaaacaggagggagatggtaaaggtgttcatactgtggccactcgagttgaatctctgactataaatgaagatgtaaaagaaaacgagccagaagatgaagacagccttcctatttacctgtatgaacgtctgaagaccacaactgctgatcctgtcactgaaattgatgtcacgaggcgagagacctacttatcttcgactgaattcatagagaagtttgggatgacaaaagaagcatttagcaagcttccgaagtggaagcggaacaagctaaaaattgctcttcaacttttttagcctgctcatcaacacttccaatgtctcatttaatctttgggtcaaatggccatttggtgaaaatagttctcttctacatctgattagcccatgcccgacagcaacggaattcga

SEQ ID NO: 13273 - DNA, 720 bp, Zea mays
gcacgagaaggtggctccgagtcagagaagccaaaacaggagggagatggtaaagaaggtgttgatactgtggccacaagagttgaatctctgactataaatgaagatgtaaaagaaaccgagccagaagatgacgagggccttccgatttacctgtatgaacgtctgaagaccacagctgctgatcctgttactgaaattgatgtcacgaggcgagagacctacttatcttcaactgagttcaaagagaagtttgggatgacaaaggaagcatttagcaagcttccgaagtggaagcagaacaggctaaaaattgctcttcaacttttttagcctgatcatcaacacttccaatgtaatcaccatctgcaatgccacatcaattttcacattgtcctggatcggtctcctttttcctagtttggatttgttttgctagctaagtagctctcttattcttccagttcataggtgtgctattccctttttcctttttttgtcaagtgctcttcattgattcaaggtcacacaggtttgattctgaggcttgatttttttgtgtatcaactctgcctgctgtgttctttttttgtttttgagatgagttgcggtttgagggagcgataagtatgtacagcagagtgccggcactgtaacatcacaataccgttatctttgatcaatataattattttttgtgtgtaacaaaaaaaaaaaaaa

SEQ ID NO: 13274 - DNA, 898 bp, Zea mays
  misc_feature (898)..(898): n is a, c, g, or t
tatgaattcggcacgagggttctccctattaatgttcctaatctgtcgggtccatgaaggcaatttgaaggtaagcaccgtagacctataatttagtatcttatgctgtatgctacctgtttttacatttaaaatctgtattcgaaatctattgagcaggtcaaagaaatacaccactttactcaagatgatctaatgacagaagatgttttcattctggactgtcacacgagcatatttgtttgggttggtcagcaggtggatgttaaaggcaggttacaagctatggatgctggggagaaatttattgtgcttgattttcttatggaaaaccttgcccgtgaaacaccagttttcaccgttatggaggggaatgagcctccctttttcactagattcttcacctgggactccgcaaaatcactgatgcatggcaattcataccagaggaagctcgccattgtaaaaggtggaggtgctccagcattggataaaccgaaacgacgaacaaccgtctattcaggaaggagtactacacaagataaatcccaacgctccagaagcatgtccttcagccctgaacgcgtgcgtgttaggggaagatctccagcattcactgcattggctgctaattttgaaagttcaagcaacagaaatctttccactcctccacctgtagttaagaaactttacccgaaatctgttacacctgatccgtcgaatactgcttctaagtcacctgcaattgctgctctggctggttctttggatcacccttctcaaactcctgctctagaattcaagaagagagctgatgctgagaaggctcttcttcacatggatggtggtcaaattgatgggaatattgttaagttgagattcgctcttcaaccaggcn

SEQ ID NO: 13275 - DNA, 3644 bp, Zea mays
cttcaccctgcttttcgtcttcctttcaccccgcttgcgctctctctctctctccccccacctctctcctgcgccaactgggcgaccgccgccgccggccgccgggccgccgcacgcctccaggtgcccaggtcttcgtaggtcccttagctcggccttcgtcggggttcggggtccttcgctggcgacgatcacccaccaggtctcctttgaaagaagaattaggcagcacatctttacgaattgaggatgtcagtttctatgaaggacctggacccagctttccgtggctctggacaaaaggacggcttggaaatatggcgtattgagaatttcaagccgatccctgcccctgcatcttcgtatggaaagttcttcatgggtgattcttacattatcttgaagacaacagccttgaaaaatggttctcttcgccatgatatccattactggattggtaaagatactagtcaggacgaagctggaactgctgcgattttaacagtagagcttgatgctgctcttggcgggcgtgctgttcagtaccgagaaatacaaggcaatgaaacagaaaaattcctgtcctattttagaccatgcatcatgccacagccaggaggagtggcatctggattcaaccatgttgaggtcaatgagcaggattacaagacccacttatatgtctgccatgggaagcatgttgttcatgttaacgaggttccctttgctcgatcatcccttaatcatgatgacatatttattttggatacgaagtccaaaattttccagttcagtggctcaaactcatccattcaagagcgagcaaaagctcttgaagttgtgcagtacatcaaagatacatttcatgagggcaagtgtgaaattgcatctgttgaggatggtagaatgatggctgatgcggaagctggtgaattctgggggttttttggcggctttgcccctcttcctaggagggcacctgcagaaggcaatgagaaacatgatgaaactgctttcaaattgctatgttttgaccaaggaaagctggagcctgtcgactgccaatctttagcgcatgaattacttgagacaaacaagtgttacttcttagactgtggtgctgaattgtatgtttggatgggtagaattacatccctgacggagagaaggcgtgctagtgaagctgctgagaaattgctctctgattcaaaccgaacaagaacacatataatcaaagtgatcgaagggtttgagactgttacgttcaagtcaaaatttaaggagtcgccgctgtcgcctgagttgaagttgtcatcggaggatggaagaggcaaagttgcagctcttctcaaacgccagggcttaaatgttaagggtttgatgaaagctgctcctacacaagaagaacctcaatcctatattgattccactggcaatctgcaggtttggcgtgtaaatgataaagacaaggttcaactctcaccctctgaccaatccaaattttacactggcgattgctacatatttcagtatacttatcctggagatgataaggaggaatgtcttattggaacctggtttgggaaaaagagtattgaggaggatagggtaatagcagtttcacttgcaagcaagatggttgaatctgctaagtttcaggctgtccaggcgccgacagcaacggaattcgctcccattcagttctttgtgatatttcaaagcttccaagtgtttaagggtggtcttagttctggatacaagagatttatcgctgaaaatggcatcgatgatgaaagttattctgaagatgggcttgcactctttcgtattcaaggttcaggaccagaaaacatgcaggcgattcaagttgaacctgtggcctcatcattgaattcatcatattgttacattctacataatggaaacactgtgttcacttgggctggaaatctgaccactgcattggaccaagagttaatggaaaggcagcttgatgttattaagccaaacacacagtctaggtcacaaaaggaagggtcagaaacggaccagttttggagtttactgggaggcaaatctgagtactcaggccaaaaaatggtgcgagaactcgaaagtgacccccatcttttctcatgcatcctgtcgaaaggcaatttgaaggtcaaagaaatacaccactttactcaagatgatctaatgacagaagatgttttcattctggactgtcacacgagcatatttgtttgggttggtcagcaggtggatgttaaaggcaggttacaagctatggatgctggggagaaatttattgtgcttgattttcttatggaaaaccttgcccgtgaaacaccagttttcaccgttatggaggggaatgagcctccctttttcactagattcttcacctgggactccgcaaaatcactgatgcatggcaattcataccagaggaagctcgccattgtaaaaggtggaggtgctccagcattggataaaccgaaacgacgaacaatagcgtggtcgcggccgaggtactacacaagataaatcccaacgctccagaagcatgttcttcagccctgaacgtgtgcgtgttaggggaagatctccagcattcactgcattggctgctaattttgaaagttcaagcaacagaaatctttccactcctccacctgtagttaagaaactttacccgaaatctgttacacctgatccgtcgaatactgcttctaagtcacctgcaattgctgctctggctggttctttggatcacccttctcaaactcctgctctagaattcatgaaaggtggctccgagtcagagaagccaaaacaggagggagatggtaaagaaggtgttgatactgtggccacaagagttgaatctctgactataaatgaagatgtaaaagaaaacgagccagaagatgacgagggccttccgatttacctgtatgaacgtctgaagaccacagctgctgatcctgttactgaaattgatatcacgaggcgagagacctacttatcttcaactgagttcaaagagaagtttgggatgacaaaggaagcatttagcaagcttccgaagtggaagcagaacaggctaaaaattgctcttcaacttttttagcctgatcatcaacacttccaatgtctcatagttcatgggtcaaatggccatttgctgaaagtagttctactctacatctgattagcccatgacaacgacagctattttgcagaacgcaatcaccatatgcaatgccacatcaattttcacattgtcctggatcggtctcctttttctagtttggatttgttttgctagctaagtagctctcttattcttccagttcataggtgtgctattccctttttcctttttttgtcaagtgctcttcattgattcaaggtcacacaggtttgattctgaggcttgattttttttgtgtatcaactctgcctgctgtgttcttttttgtttttgagatgagttgcggtttgagggagcgataagtatgtacagcagagtgccggcactgtaacatcacaataccgttatctttgatcaatataattattttttgtgtgtaacttaaaaagggaaaaaaaaaaaaaaaaaaaaggaattaaaaact

SEQ ID NO: 13276 - DNA, 1889 bp, Zea mays
aattcggcacgaggccgcgtgccccgctcccccagcaacgccggcttccatccacccccgcgcaccgctccccccggccccctttccttgcgcgatgcgagcccacaaatcacgccaatccatggcagcccgcgtgccccgctcccccgcagcgcctggctcccctttccttgcgcgacgcgagatcggcgagattgccctcaacgcgctcgcgtcgcgccgcggatcccccaccctcctcccctctgcacgccgccatcaactcgcaccggccctcgcccgtgatccatcctctcccccgcggcaatgatatggcgtcccccctcaaccgaccattcccgcagcggatccgcaccaacccgttcgcgccggcctctggaagaagaatccaccgaaggcgaaaacgacgacggaggtccggctgactcgtctgggtctttgcaatagcggcaagcgggttggagctccgcttcgggcaggggagaaccacgtggagacctggagtcacgctgcctagactcgccgctgggtggattcgtcgcgatggaggtcggattgtgaacacgccgtccagttaggacgctgtcgtcttcagatccaggggatggggttgctcggcatggcggccaagggcccctcgcccacgcgtcgcctaatgccacagccgcacttggccgtctcctcgctggcggcctccgtggctctgatccactgcttcctcaacacccggagatggttgacgtcaccttcgtcgtctcctcgccagtggcctccaccagccccgcagtccaagacaaagccacgacatgagtcaacccaagtccggtcgcacctacacagatggccgtacccaacaagttgagctttaagaggaacgtggtgtcattgtcatctgagctcaagggtgtgaggagcaagcttgcttcctaggagcagctgtttgtaagggaatctcaaactagaaagcttgcggagacaaaaacaaggagcatggaggaggaagtaatcaagctgcagaaatgcttacaggacaaggatgggcaactgtgttcatccacaagtagcacggaacagtaccatcatgagttggatgatcttagaacacatctgtcatttactcaagctacaggagaagcaggtgttgcatcagctaagttagctcggatgtagtgcatgtcattgctgaaagagctgaatgagaaggacaactcactcaaagaccatagacttcgagtgaacaatctaggtgagcagcttgatcttctccagaaggatgtacaagcaagggaggtcacacaaatgcaacttaaagatatagttataaggatcgagaccaacatcatggatgaagttgccaaagcttttgaaattgcgatgttgagaggggaaatcagaatattgtctactcactggacgaacaaaaccaagaaccttgaatcacagttaaaaaagcaccagagaactgatcaggagctgaagaagagggttctgaagcttgaattttgtctctggtcctgtcatccactggtgcgttcgccaccgcacctaccgctgttactagctcccttgctcttctcttgctgcgactgggatatagcatcgtggatcttgaacctaggccagaatttaggcaggtctagaaccaccatgatgcctggaacatactcctattttatccatgtatgagccttatgggaactctgcaattactatggatcctcttatacattatgttcgacatggagacaaggtagtatattgagttggaccaataatccttcatattgaaaaaaaaaaaaaaaattggactggtgtcctgtccttttgtttgtgctttataatttgtaattcttagctattgatatggtatgatggatgggaggtggctg

SEQ ID NO: 13277 - DNA, 3727 bp, Zea mays
  misc_feature (2009)..(2009): n is a, c, g, or t
cgacccacgcggtccgcgcgtgccccgctcccccgcagcacccggctccccttttcttgcgcgacgcgagatccccgccggggccctcaacgcgctcgcgtcgcgccgcggatcccccaccctcctcccctctgcacgccgccatcaactcgcaccggccctcgcccgtgatccatcctctcccccgcggcaatgatatggcgtcccccctcaaccgaccattcccgcagcggatccgcaccgacccgttcgcgccggcctctggaagaagaatccaccgaaggcgaaaacgacgacggaggtccggctgactcgtctgggtctttgcaacagcggcaagcgggttggagctccgcttcgggcaggggagaaccacgtggagacctggagtcacgctgcctagactcgccgctgggtggattcgtcgcggtggaggtcggattgtgaacacgccgtccagttaggacgctgtcgtctccagatccaggggatggggttgctcggcatggcggccaagggcccctcgcccacgcgtcgcctactgccacagccgcacttggccgtctcctcgctggcggcctccgtggctctgatccactgcttcctcaacacccggagatggttgacgtcgccttcgtcgtctcctcgccagtggcctccaccagccccgcagtccaagacaaagccacgacatgagtcaacccaagtccggtcgcacctacaccgatggccgtacccaacgtgagtcaagccaagtccattcccctcccttgcttcctcaacttgttgtcttgtggtctgctatttgtctcagagaaggtggtgccatcatcaccagttgtgattatgaattatattctaccgataggtattcaatctctctattcggcaacaccttaaaaatatgtacttcaaaatattgacaagtggattgcaggcttagataatttttggaacacaacattgctccaaaaagtttttctaaagaaaaggtatcaatctgcagtttggtaagtgagtctgaatctgcagcaccaaggacttcaagaattagtctgaacctgcacttacagttccatccacgcgtccgattattaataatattattttttaatgaataattgaatatatattgagtctgtgtcatagattcagtcaccttaacaccctttgttgttttcccacttaagttagttaatgagatgaatggatggaaattacgtagtgaatgtatgataagtccaggctacatgttaaaagacacacttggctacttgagctctgtattgccatgaagaaatcttactgacgggtgctttcatctgctatttggatccgttgctgatggatcttacaaagaagttgagctttaagaggaacgtggtgtcattgtcatctgagctcaagggtgtgaggagcaagcttgcttcctaggagcagctgtttgtaagggaatctcaaactagaaagcttgcggagacaaaaacaaggagcatggaagaggaagtaatcaagctgcagaaatgcttacaggacaaggatgggcaactgtgttcatccacaagtagcacggaacagtaccatcatgagttggatgatcttagaacacatctgtcatttactcaagctacaggagaagcaggtgttgcatcagctaagttagctcggatgtagtgcatgtcattgctgaaagagctgaatgagaaggacaactcactcaaagaccatagacttcgagtgaacaatctaggtgagcagcttgatcttctccagaaggatgtacaagcaagggaggtcacacaaatgcaacttaaagatatagttataaggatcgagaccaacatcatggatgaagttgccaaagcttttgaaattgcgatgttgagaggggaaatcagaatattgtctactcactggacgaacaaaaccaagaaccttgaatcacaggtatgctacatttcttttatttgttcataagaggccccaataacttggttacaaatgctttngtttcctataacgttgaactgaagtatatttacatgagatttattgatatttgatcagttaaaaaagcaccagagaactgatcaggagctgaagaagagggttctgaagcttgaattttgtctctggtcctgtcatccactggtgcgttcgccaccgcacctaccgctgttactagctcccttgctcttctcttgctgcgactgggatatagcatcgtggatcttgaacctaggccagaatttaggcaggtctagaaccaccatgatgcctggaacatactcctattttatccatgtatgagccttatgggaactctgcaattactatggatcctcttatacattatgttcgacatggagacaaggtagtatattgagttggaccaataatccttcatatttatttatgtgaattatgttgtactggtgtcctgtccttttgtttgtgctttataatttgtaattcttagctattgatatggtatgatggatgggaggtggctgaaatcgttcagataagtgccaatttgttgttttcttttttaatgaatggttttctatttcagctgatgaaccttttatagttcttttattatatgctgccactgattgctaatagggtgcatgtcttctatttctaggtatggtgcataaaaaagtaggaaccacaatgagattgtaatgctgcacatggcacatcaaggtgcgcaagatatgtaccgtagaaattatcgtaaagtgcacacagctgtatgtatagatgtttagaagtggtcgaagttaggcttgctcaaccggggcaatgatttacttagcctgctgaaatgtactataggtagcattcaagtttgtgaccatcatgcaagtacatgtgggtttgttgaaattgagtggtcatcggagaagtagcaaaatgttccctatcgagagctcgtgtactatatttgttttatgaacttaatttttattacaacggaacatgtggtcatacatatgttattgctccaatattttttccgttgcaacgcacgggtatttacctagtacccaaaatatataaagtgatactatattggatctccttaccccatatgccatatttgcatcatagaaagagcatacatatatttaagagtggttaattaaaacaaatgatactaaaataaaagaaagtgcatcttgttggacatttatatgtttgtgcattaactaaaataataagataataatcactagaagttggattaaaccctaaatggaaattagggtttgaaaataagaaaaggagagaagagaaagaaaaagagaaaatgacatagaaaaataaataatatatatacctaaaaataccccaaaaatggtatttatgatttcacaatataagttgagaaaaaactggacacaagatttgaatttaaactctaggtttgaaaataaaaaggaaaataaatagaaaagaaatgaataaaacaaaactaacctaactgggctcactgcgcgctttcggcccacttctgaattccttctgcgcggcccatctccacgttctacgcgtgtgccgggcgccgacatatggggcccgctggccagccaccagcctcacgcgcacgttcgcttctgtgtcactgctagcgggaccgcccagccagtctcctctcgcgcttgccaagacacctacatgcggggccacgacgtcagcttcatccccgtaacaaccc

SEQ ID NO: 13278 - DNA, 8056 bp, Zea mays
cagatttaaagaagcaccacaaaaaacaaaacatgcagctctcttgcatattcaagaaaaaactgtgtatcgtcgtgtatggatgtgacctgatcttgatgtgagataacaaaaatgggcagacccaacgcatgatactcccacataaggacatgttcgttttaatttcaatccatgtggattggacgggattgagtgaatttaaatccctagcaagtcaaagtttttcttattatttttttctaatcccatacacttcatatggaatgagaataaccgaacaagttctaaatgaagtctggggaagcgataaagctaggcaaaccctttgcccataaatgcggagcctccccccctgcaaatgagatgacacaacaaaggatagttttaatgtatataccaatctcctgcaggcaattccaggtgttccaaaaatcacagaaggatacaatcccgcaacatggatgctggaagttagctctcctctagctgaggctcgcttggatgttgattttgctgaaatttatgcaaattctgccctgtaccggtaaatatattccttaattagttattactgcagggtttttgtttggtaaatttatttcttctttgacaatcgttaaacttatttgttctccaacaaacaagaccacaattttcttcttacatttcataatgaatatatgtccaggcacaatcaagaacttatcaaggagttgagcattccaccaccaggctaccaggatctctcgtttcctactaaatatgcccagaatttcctaaatcaatgtatggccaatacatggaagcaatttcgatcttattggaagaatccaccctacaatgccatgcgctatcttatgacaatcctctacggtctcgtgttcggttcagtcttttggcgcatgggaaagaacgtgtatgaccctactctgtattatgacattcgcacatatcattcattatgctaattgcgattaattcattggatagtgttccatcgattaccttccatgctaaggattctttgtgtacctgcttttgttgtgcaggaaatcagagcaggaactgcaaaacctacttggagccacctacgctgctgttttcttccttggatctgcaaacttgctctcatctgtacctgttttttctatcgaaaggacagtcttctaccgtgaaaaggctgctgggatgttctctccgctgtcctattcgtttgcggtggtaatttctagataccttatcgtgtgttagtagttattttgtcacagttgtttttgaacccttgcagacacaaaatctctactaacgcttctctgttgaaacctattggtgtgtgcagacagttgtggagcttgtctacagcatagctcagggcatcctttataccatccctctgtattcaatgattggttatgagtggaaggcagacaagttcttctacttcatgttcttcctaacctgctccttcctctacttttcactttttggtgcgatgctggttacctgcactccttccgcaatgcttgcgagtattgttgtctcattcagtctaaccggctggaacatcttcgccggattcctcgtaccccgaccggtagggatctctgagagccctcagcgttacgtacttttacaccactctcggctgccaattcaattttcggaaactgtttcgctcttgcaggcgttgcctatctggtggcgatggttctactggtgcaacccggtgtcctggaccatctacggcgtcacggcgtcgcagttcggcgacgtaggccgcaacgtgacggctactggcaacgccggcacagtcgtggtgaaggaatttctggaacaaaacctgggcatgaagcacgacttcctcggctacgtcgtgctggcgcatttcggctacatccttctgttcgtcttcctcttcgcgtacggcaccaaggctttgaacttccagaaacggtagaaggtgatcgatcagccgaagatatataacacctgttctggctccttgctcttttgattaaaaacgtgtaaagttttgtgctacgtagcggatacatgtaattattcagtgcaactcaatgcagagttaacagttacgcagatgctgctttaggttttatttttccaacagctacgaatctagatctcctagcagcaatatctggcagaagtagaatttggttgcaggttcaacttctgccaagttggcttcttcattttgaagtaactcattccaaagttattgtagctaccatctgaagcatctgccatttttttttggcgaagttagaatcttggtttggtgcgatatgccgatatgtggaaaaaaaaaaaaatgcaaggagaccgtttcagagcagcagctctgacccctcccattttgtcagactcggatccaccctgatgcaacactctgaactaaaacattcttcaccgaacaaaagcatatacagatcaggctactcacatccacctatcccatcttgtcggactcacatccaccctgatgtactgttgaataggaataggcagcaaatatccatgtaccctgcttttgattcttgcctgaaaatgaatcgatgacgcaacggagaaacgtgaccagcatttaaacctgattaggattggcagctggcatgagcccatcttccttcctggctttccatcggtttggcccgcttttttttaacgtaatggagctctgactttctattaagaagattaaaattgatctagttttaagaaaaaccgagactaaaatctacacattatatgatgtgccatgttgagagacatatttatgagtattaaagatgataaggtattaatgcatttttaagatatgagaatcgcggaagattaaattacctcttgctagtggttttgacgaaatacttcagttataatttgcttaatactactttattgctctattttatgtctttaatatatgattttttttttgtttccatctttagaattggagctatctttactactctatatgttagcagtgtaggcgtgcacactgccttgttctgccatcgcgcgctcgcctccctccccgcgcccgcagtccccgcatccgcgcccgcagtcccgccgcgcccgcagtccccgctgccgagcagtcctgccgcgccccctcccctgcaaaccccaccacgacgcagcaacagatccaccatcgacgtgcgcgccgcgcgccccgacgcggaacgctggatcccacgcagcaggaggtggccaaccagtcgccatcgcccccggcccccaccccgcctgctgcagcaagcggcgtccgctaccgcacgccctcgtccccggacctcctcctccctgccgacgccgccaagatgcgccgctactccgcgctgcccaacggcggccgccaggagacgctggccgaccgcgcgcaccgctaccggggcatcgtgctcgtcatcctcgccccgctcgcgctcgtctctctcgtcctcctcctcatgccacgctcacccgctggcaccatgggcagcgcccgggatagacaggtacgccgtcatctttgacgccggtagctccggcagccgcgtccacgtcttccgcttcaacgccaacctgaatctcgtccgcattggcagcgagatcgagctcttcgtccaggtacacactcccccgcccggtgacccgttgccggacctggagtcacgctgcctagactcgccgctgggtggattcgtcgaggtggaggtcggattgtgaccacgccgtccagttaggacgtcgtcgtctccagatccaggggatggggttgctcggcatggcggccaagggcccctcgcccacgcgtcgcctcctgccgcagccgcacttggccgtctcctcgctggtggcctccatggctctgatccacccttcctcaacacccaaagatggttgacgtcaccttcgccgtctcctcgccagtggcctccaccagccccgcagtccaagacaaagccgcgacatgagtcaacccaagtccggtcgcacctacaccgatgaccgtacccaacgtgagtcaagccaagtccattcccctcccttgcttcctcaacttgttgtcttgtggtctgaagtttgtctcggagaaggtgatgccatcatcatcagttgtgattatgaattatattctaccgataggtattcaatctctctattcggcaacaccttaaaaagatttacttcaaaatattgacaagtggattgcaggcttagataatttttggaacacaacattgctccaaaaaagtttttctgaagaaaaggtatcaatctgcagtttggtaagtgagtctgaatctgcagcaccaaggacttcaagaattagtctgaacctgcacttacagttccatgggtcttctcaattcttaataatattatatttttaatgaataattgaatatatattgagtctgtgccatagattcagtcgccttaacaccctttgctgtttcccacttaagttagttaatgagatgaatggatggaaattacgtagtgaatgtatgataagtccaggctacatgttaaaagacacacttggctacttgacctctgtatttccatgaagaaatcttactgacgggtgctttcatctgctatttggatccgttgctgatggatcttacaaagaagttgagctttaagaggaacgtggtgtcattgtcatcagagctcaagggtgtgaggagcaagcttgcttcctaggagcagctgtttgtaagggaatctcaaactggaaaggttagtatgtaactggtaccttcgaggttgttagtggggtttgtgctgacaaagaaaaaaaatttagcagcttgcggagacaaaaacaaggagcatggaagaggaagtaatcaagctgcagaaatgcttataggacaaggatgaacaactgcattcattcacaagtagcacagaacaggtaaagagctttcacagcaaaatacaccacttcttgcaatttattggagttatggcattaaattgaacttttttctttactttatggtaaagaacttttttcttttcattaaaatttggatactatgtatagagcccccaaaaggttgactataatacaacaacaataatttggagtcaatattttttcttgcagaattgctgcctttggttataaaaaaacttttggtcaggaaataaattttagcttgacttacattgttttcttggttcgcttctttactaatcaacttgatcgaatgttcatgactactaaattcctactgtgtgtgtcaggaaataaattttagcttgacttacattgtcacgcaagccaaatgcagttccttaataatatgttttctaattatatacagtaccatcatgagttggatgatcttagaacacatctgtcatttactcaagctacaggagaagcaggtgtgggtctgtgatagatttcttcatctccgagaaatggaatttcactcattcaatttatttctaggaacccaactgaaccttcaacttgcttgttctgggagatctgtgagcaagcgagttgtcctataacagttggctcctcacaatgggtattcgacatgagccccatccctgccacagacttgggaaaggcacagtgatttttatggtgacatgaagacattcctcttcaaattatatctttaagcaaccaattttcgccctactggtgcaaacaagaatttgcaatgggtatgttttgccctgtatgacatatctccttattttattttcttccttgtttgtgttactactaatcatctctagaatataaagggtagtttacatcattagattgcttatgtttatcgatgactggatattaaatgtattacccatccaacatacatccagtttccttaaatgtatatcgccaacactcttaattcatgtaagcatagattctagagaatatagataggaaagacgtatgcaaaaaatattccagttgctacatgctttactttttgtggacctggaaggcatgtctttgtataaagttgaagtaccttgaagtgctgctaactggaaagcttcagagaccttattttcttcacagcatccaagacagggtcagtacactcttaagtcttagaattgctgcagttggtgaaggaatcaaaccaagaccaacatggccatagaaagagacctcccaaccaaagtgaggtttggtcttgtacattccaacgctaatgacaagtatgaatacgggatttccatactgagctagacaaaatggtcacttgttctttattgtgttcttggagaatggcagcagtagtggtggaacgcctgacaatcatggtcaacaatattggtcgattctcttttggcatattgttctggtggatcatacagtatgttcaaggaagaaacaggcatgctgatttcattgactgatgggtggtgctagctggtgaccatttatgatcagtgccaagcgtgccttgctggacttgactattattttatgtctgcttattgggtttttttgggaggggggttgggggggtctttcatgcttgttattatttacttgtgcttcagtcataagatctggatttgtagtcattccttctacctgtaaagatgccagtatttttgtttagccatgtgttttgcaagctgctcataacatggaatggttttacatttctagaatttctattgcttgcaggtagggtactggctgcacttgtttttgaatacttggagtgaccacaactaagtcacacaatgaaactttactttccagagtgtaacctggtaaccggtgaccttctgatagaatgaactgaaagacttctctaacaaaagtggagctgaggggagcaagagtgctgaaagcctgaaagtggtccaatgtttttagatgttctcgaatgttatctgaaatatgaggtttatctcttgcttgatcaacaatagaagcaaacaatcatccttttgtttatttatgtttcccaatataaaggaaaaaggggaaatattttggtgcagtgtgcccaattcttttgtccctagaaaactgtgtagtcgcctatagcaggcgctatagtcagttttagctattttagacaccactactatttgtacacacatttctattagcctattttagcctgctatatccatgtatgggccttatgggaactctgcaattactatggatcctcttatacattatgttcgacatagagacaaggtagtatattgagttggaccaataatccttcatatttatttagcctgctgataccgcggcaatgtatagatgtttgtaccatagaaattatcgtaaagtgcacacagttgtatgtatagatgtttagaagtgaccgaagttaggcttgctcaaccggggcaatgatttacttagcctgctgaaatgtactataggtagcattcaagtttgtgaccatcatgcaagtacatgtgggtttgttgaaattgtgtggtcatcggagatgtagcaaaatgttccctatcgagagctcgtgtactatatttgttttatgaacttaattttgttgatgtaggactattacaaagttctagagacaacttaatttttattacaacataatatgtggtcatacatatgttaatgttgcaatattttttccgttgcaacgcacgggtatttacctagtacttgtcatatgtatttatttttgacagagatgatgtcatgttcatccatccaatgcagtcacccgtgaaatctgctaatgccgctagctgcatccttcacatgtgtttgtcccaactcaggttccctgccccctgacaaattgttctgctgtctccaaagattcagtcttggtccccatgccgtgcagaaggctgcccaaaaatgtttcctgtttcctagttcaaagcttgtccagattgactacaaaatactagttaggtttcgaggtaaagcttggtttgttggctgtggcttgttactgttttattcggagtgcgacttttatagtattttgcctctataaattacagtgtttaaacagcacagctgcag

SEQ ID NO: 13279 - DNA, 2619 bp, Zea mays
  misc_feature (40)..(40): n is a, c, g, or t
ccccgcgtccgccccgcgtccgatcttcctgttcgcaggnattctcctacccagacaggacattaaacattggtggatttgggcctactggtcatctcccatgacatacagtaataatgctatatcagtcaatgaattccttgccactagatgggccatgccgaacaatgaagcaaacattgttgcaccaacaatagggaaggctattctaaaatataaaggctactttggtggtcaatggggctactggctttccatcggtgccatgataggatatactattcttttcaacattctctttctttgtgctcttacattcttgagccctggtggcagttcaaatactgtagtttctgtttctgatgatggcgacaaagagaagtctacagatcaagaaatgtttgatgttgccaatggcacaaatgaagcagcaaacaggagaacccagacaggaatggtcttgcccttccagccactttcactctctttcaaccacatgaactactatgttgacatgcctgctgcatcggccggtcaaggtttcactgaaagtcgcctccagctgctatctgatattagtggtgcattcagaccaggcgttctgactgccctagttggtgtcagtggagctggaaagaccactctaatggatgtactagcaggaagaaagccaagtggaaccattgagggagatatcaaactttctggttatcctaagaaacaggaaacttttgctcgtgtcagtggctattgtgaacaaactgatatccattcaccaaatgttactgtgtatgaatcactcgtttattctgcttggttgcgcctttcttcagaagttgatgacaatactagaaagatgtttgtggaagaagtgatgtcactagttgagcttgatgtattacgtgatgctctggttggtctccctggtgttagtgggttatcgactgaacaaaggaagaggctgacgattgctgtagaacttgtagcaaacccttcaattatattcatggatgaaccaacttctggccttgatgctagagctgcagcaattgtcatgcgcacagtgagaaatacagttaacactgggcgaaccgtggtttgtacgatccatcagcccagcattgatatctttgaggctttcgatgagcttctgttgctgaagagaggaggtcgtgtcatatatgctggccagcttggtgttcagtctcgcgtactagttgaatatttcgaggcaattccaggtgttccaaaaatcacagaaggatacaatcccgcaacatggatgctggaagttagctctcctctagctgaggctcgcttggatgttgattttgctgaaatttatgcaaattctgccctgtaccggcacaatcaagaacttatcaaggagttgagcattccaccaccaggctaccaggatctctcgtttcctactaaatatgcccagaatttcctaaatcaatgtatggccaatacatggaagcaatttcgatcttattggaagaatccaccctacaatgccatgcgctatcttatgacaatcctctacggtctcgtgttcggttcagtcttttggcgcatgggaaagaacgtgaaatcagagcaggaactgcaaaacctacttggagccacctacgctgctgttttcttccttggatctgcaaacttgctctcatctgtacctgttttttctatcgaaaggacagtcttctaccgtgaaaaggctgctgggatgttctctccgctgtcctattcgtttgcggtgacagttgtggagcttgtctacagcatagctcagggcatcctttataccatccctctgtattcaatgattggttatgagtggaaggcagacaagttcttctacttcatgttcttcctaacctgctccttcctctacttttcactttttggtgcgatgctggttacctgcactccttccgcaatgcttgcgagtattgttgtctcattcagtctaaccggctggaacatcttcgccggattcctcgtaccccgaccggcgttgcctatctggtggcgatggttctactggtgcaacccagtgtcctggaccatctacggcgtcacggcgtcgcagttcggcgacgtaggccgcaacgtgacggctactggcaacgccggcacagtcgtggtgaaggaatttctggaacaaaacctgggcatgaagcacgacttcctcggctacgtcgtgctggcgcatttcggctacatccttctgttcgtcttcctcttcgcgtacggcaccaaggctttgaacttccagaaacggtagaaggtgatcgatcagccgaagatatataacacctgttctggctccttgctcttttgattaaaaacgtgtaaagttttgtgctacgtagcggatacatgtaattattcagtgcaactcaatgcagagttaacagttacgcagatgctgctttaggttttatttttccaacaacagctacgaatctaggtctcctagcagcaatatctggcagaagtagaatttggttgcaggttcaacttctgccaagttggcttcttcattttgaagtaactcattccaaagttattgtagctaccatctgaagcatctgccattttttttttggc

SEQ ID NO: 13280 - DNA, 1870 bp, Zea mays
cctcgggcccggcatcccgggatcctcgttttgtttcccttcccccacccttcctcttcctccctatctatcagcactgctcgccggcgccgcctctgcaaaaggctcacttttgcctccggaacccagcggaatccgccggcggaccggaaacactcgctcgcccccctcaccccctgtctgcccggccgtcggagcgcgtcgcctccgggcgtgcagcagcagtccgtggaggtggagccgggaggaggaggaggaggacgaggacgaggcataatctgccgagagcgggacagcaggagtgggctgctccgctcgcgctggagccaaagctactgattgccttgtcctgaccagcgaaagagggatctttgggaggcaatcagaggtgttcggtttggtcaaacaaagctcagctctcttgggatgcttgctgcgagctgcttgtgttcatacttgagagaataaaacagtgcatcatcttgctgtcttgtccttcgtgattggaagagaaaacgtgctgctgttcttgctatgtctgtctcggagaaggtggcgccatcgaagtcatcagtttcttcgtcgtcagatttggatccgctgctgaaggatctcacggagaagaagttgacctttaggaggaacgtggtgtcattggcagctgagctcaaggatgcgaggaacaagcttgcctcccaggagcagctgtttgtaaaggaatctcaaactagaaaggttgttgagacaaaggcaaggagcatggaagaggaagtaagcaagctgcagaaatgcttgcaggacaaggatgagcaactgcgttcatccgcaagtagcacggaacagtacctccatgagttggatgatcttagaacacaactgtcaattactcaagctacagcagaagcgagtgctgcatcagccaagtcagctcaggtgcagtgcttgtcattgctgaaagagctgaatgagaaggacatctcgctcaaagagcatgagcttcgagtgaacaagctaggtgagcagctcgatcttctccagaaggatctacaagcaagggagctctcacaaatgcaacttaaggatgaagttctaagaattgagaccgacatcatggatgcaattgccaaagctgggtctaggtctgacaaagacaatgagcttttaaagatcttatctgacgtttcaccaaggaatgtccagaacctcaacagccttttgaatgctaagaatacagaaattgcgaggttgagagaggaaatcagaatattatctgctcactggacgaacaaaaccaaggaacttgaatcacagttagaaaagcagcgaagaactgatcaggagctgaagaagagggtcctgaagcttgaattttgccttcaagaatctcagtcccagatgcgaaaattaaagaggatgggggagaaaagagacaaggctctcaaggagctcatggaccaggtggccatgaagcagcccaacagcatgtgccatggaaacaaggataatttctgggagagccagggcttcaggttcattgcctctatgtcgatgctggcgctagtgatcctcgcaaagcgttgaagcggcatagtttaagcagatgtgaatgtagcgtttacattagcttgtaggcttgggcagttgtgcatactgcatgccaaaatttgccgacatccaatcctagtctgtaaactgtaaaaatagttgtggcctgtaatccgtagcgcagtttctgctagttcatgtaaacccatataagctgtcttgtagtcacagctagtgaatgtcagctcatgtagtcaagaatctacaaccttataatttcagttccagaactgcttgagcagttgtcaaaaaaaaaaaaaaaaaa

SEQ ID NO: 13281 - DNA, 1007 bp, Zea mays
ggatcttacaacgaagaagttgagctttaagaggaacgtggtgtcattgtcatctgagctcaagggtgtgaggagcaagcttgcttcctaggagcagctgtttgtaagggaatctcaaactggaaagcttgcggagacaaaaacaaggagcatggaagaggaagtaatcaagctgcagaaatgcttacaggacaaggatgaacaactgcattcattcacaagtagcacggaacaggaacccaactgaaccttcaacttgcttgttctgggagatctgtgagcaagcgagtgctcctcataatgggtattcgacatgagccccatccctgccacagacttgggaaaggcacaatgatttttatggtgacatgaatacattcctcttcaaattatatctttaagcatccatttttcgccctactggtgcaaacaagaatttgcaatgggtaggttactggctgcacttgtttttgaatacttggagtgaccacaactaagtcacacaatgaaactttactttccagagtgtaacctgccggacttctgatagaatgaactgaaagacttctctaacaaaagtggagctgaggggagcaagagtgctgaaagtggtccaatgtttttagatgttctcgaatgttatctgaaatatgaggtttatctcttgcttgatcaacaatagaagcaaaaaatcatccttttgtttatttatgtttcccaatataaaggaaaaggggaaatattttggtgcagtgtgcccaattcttttgtctctagaaaactatgtagtcacctatagcaggcgctatagtcagttttagctattttagacaccactactatttgtacacacatttctattatcctattttagcctgctatattcatgtatgagccttatgggaactctgcaactactatggatcctcttatacattgtgttcgacatgcagacaaggtagtatattgagttggacccaatatccttcatatttatttagcctgct

SEQ ID NO: 13282 - DNA, 3176 bp, Zea mays
attgggtacctcgaggccggccgggttgcaagctgctcataacatggaatggttttacattctaggatttctattgcttgcagataggttactggctgcacttgtttgtgaatacttggagtgaccacaactaagtcacacaatgaaactttactttccagagtgtaacctgccggacttctaatagaatgaactgaaagacttctctaacaaaagtggagctgaggggagcaggggtgcggaaagcctgaaagtggtccaatgtttttagatgttctcgaatgttatctgaaatatgaggtttatctcttgcttgatcaacaatagaagcaaaaaatcatccttttgtttatttatgtttcccaatataaaggaaaaaggggaaatattttggtgcagtgtgcccaattcttttgtccctagaaaactgtgtagtcgcctatagcaggcactatagtcagttttagctattttagacaccactactatttgtacacacatttctattagcctattttagcctgctatatccatgtatgagccttatgggaactctgcaattactatggatcctcttatacattatgttcgacatgcagacaaggtattatattgagttggaccaataatccttcatatttattgatgtgaattatgttgtactggtgtcctgtccttttgtttgtgctttataatttgtaattcctagctgctgatatggtatgatggatgggaggtggctgaaatcgttcggataagtgccaatttgttgttttcttttttaatgaatggttttctatttcagctgatgaaccttttatagttcttttattatatgctgccactgattgctaatagggtgcatgtcttctatttctaggtatggtgcataaaaaagtaggaaccaggatgagattgtaatgctgcacatggcacatcaaggtgcgcaagatatgtaccgtagaaattatcgtaaagtgcacacagctgtatgtatagatgtttagaagtggccgaagttaggcttgctcaaccggggcaatgatttacttagcctgctgaaatgtactataggtagcattcaagtttgtgaccatcatgcaagtacatgtgggtttgttgaaattgagtggtcatcggagatgtagcaaaatgttccctatcgagagctcgtgtactatatttgttttatgaacttaattttgttgatgtacgactattacaaagttctagagacaacttaatttttattacaacataatatgtggtcatacatatgttaatgttgcaatattttttccgttgcaacgcacgggtatttacctagtacttgtcatatgtatttatttttgacagagatgatgtcatgttcatccatccaatgcagtcacccgtgaaatctgctaatgccgctagctgcatccttcacatgtgtttgtcccaactcaggttccctgccccctgacaaattgttctgctgtctccaaagattcagtcttggtccccatgccgtgcagaaggctgcccaaaaatgtttcctgtttcctagttcaaagcttgtccagattgactacaaaatactagttaggtttcgaggtaaagcttggtttgttggctgtggcttgttactgttttattcggagtgcgacttttatagtattttgcctctataaattacagtgtttaaacagcacagctgcagtactgccagccagccgaacaggaaagcggtgcacactgactccgaatcataatagcacggctccaaatgttggtagcaggtgtgcagaaattatccaagtgcaggggcatctcctgtgacaaatcgacactgtattatctaattcaatgcactgtcctttgtatttactagcacccctgcctttccagttcagcctgcctgcccaacagtgtatacggctgctcctcgtagatactagtacttggtgatccgtttcacatcgccatggtctgctcttagctgagctgtccatccatgacttgctcttgctctcaaccatttgcgcagtgtagctttccccccccctgtttccgccggtgcgagatttcagatgacgaagaagagttgctgtgggacacggacaactgcttgcgctgcccaccaggaccaacccaaggtgatctcggtataccctacccattcagatttcagaagctctgtacaaaccttaaccatgccccatcatctttttttctctcacatctactgatctacatgctgcgcaactcaagcctgaacctgaactgctgccgattctcatgccagatcaggggaggggagtatctggccacgcaacgaaacgtagacagagcagcagtccaggcccaaacgctcctccgaagaagccgacatggaagaggtttctgtccatgtttcagaacaaggtgaagcacaaacccagcagcctgaagcagaagcggcccagcagcgcaatgctgcaagagtgcgccagtctggtccgcgtggtccggcgcacggcggcagagtgctttgcgcctgcggttgctggcggggacgaagtcgacgaactgccctgttattacatgcagcttgaccaggtgagctacggggtcagacgggaggcctacggtcccatctacctggtcacgtagacgactgggactgaagtatctgttccatttcatgtgctgttgtcttgtctcggttgcctgtccgtgttcgtcatggcaatcttcttggttgccggacaatatcatatatcttcagaaatgctgctaccatgcgtgtgcaataaagtgatcttctgaccgaactgaaagacaggaggctagcagccacaggtttctctagtgtaaaatctcgccacagctgtggtatcaggagtttggcgccaccatagcttgacgtgttgtgtctgggaagcgctgtataatgcattcctggcttttctccaacagcctagacaaacggccacgtagagcagaaatacctcttccacggcactgtagcatgatcaataaataatgcatacgaagtacaatttacgcttcaggaaagaattgaaccaaaaatgaataccaccctcctttttcgaggcatccagccacaaagtaacgaccgcttcctagaacctacaaacccattctagaaaatgcccacaaaccaaccgtcagagcgaaagagaggtcaaaag

SEQ ID NO: 13283 - DNA, 1852 bp, Zea mays
gtttcccttcccctactctgatcctctctatcagcgccgcctgcctccaagtccctgaatccacgggcgactcgcttgctccccctgttttcctcggccgccggagcgcgtcgcctccgagcagcagcagcactccggcagtccctggttgttcctggtggttcttgcctcctcgtctgggtgggtgggtggtggaatagcgtcgtcttcgctggaacccacctgcctgctcttgctccgctcgcgcagtcgcgctggagctaaagctactgattggttcgtactgaccagccaagccaaagagggattcttgggaggcaaccagaggtgtttggtttggtcaacctcccttcttttgtcttgcccatggaatgcttgctgtgagctgcttgtgttcatgcttgagagaatttcagtgtagcatcttgtggtcttgtcctctctgattggaagagaaaacgtgctgtcttgtggcttgctatgtctgtctcggagaaggtggtgccatcatcatcagtttcttcgtcgtcagatttagatccgttgctgaagggtcttacggagaagaagttgagctttaggaggaacgtggtgtcattggcagccgagctcaaggatgtgaggagcaagcttgcttcccaggagcacctgtttgtaagggaatctcaaactagaaagcttgtggagacaaaagcaaggagcatggaagaggaagtaagcaagctgcagaaatgcttacaggacaaggatgagcaactgcgttcatccacaagtagcacagaacagtacctccatgagttggatgatcttagaacacaactgtcatttactcaagctacagcagaagcaagtgctgcatcagctaagtcagcccagatgcagtgcttatcattgctgaaagagctgaatgagaaggacatctcgctcaaagagcacgggcttcgagtgaacaagctaggtgagcagcttgatcttctccagagggaactacaagcaagggagctctcgcaaatgcaacttaaagatgaagttataagaatcgagaccgacatcatggatgcagttgccaaagctgggtctaggtctgacaaagataatgagcttttaaagatcttatctgatgtttcaccaaggaatgtccagaacctcaacaaccttttgaatgctaaggatacagaaattgcgaggttgagagaggaaatcagaatattgtctgctcactggacgaacaaaaccaaggaacttgagtcacatttagaaaagcaccggagaactgatcaggagctgaagaagagggttctgaagcttgaattttgccttcaagaatcccagtctcagatgcgaaaattaaagaggatgggcgagagaagagacaaggctctcaaggagctcatggaccaggtggccacgaagcagccaaacagcatgtgccatggcaacaaggagaatttctgggagggccagggcttcaagttcatcgcgtctatgtcgatgctggcactagtgatcctcgcaaagcgatgaagcagcatcgcatacccaatcttgtgtaaatcaatcgttaggtgagcaactagctcatagcttaagcagatgtcgatgtagcgtttacattagtttgtattcttgggcagctgtgcatactgcatgttcagaagttgcggtctgtaatccgtagtctctgctagggcatgtgaactcagaagctgtcttgtactcacagctagttcatgtcagctcatgagcagtcatgaatctacatcttgtaatttcagagtagcttcagcagttgtcacatgtaactctataattgctgaatctacatcttataatttgcactcttatggttgcg

SEQ ID NO: 13284 - DNA, 2185 bp, Zea mays
actgccatgccgataatttctagccacaattccatgccttgcccgtccagtagctcccatctcatcccatcccgacgaatcaaatctccatcaccacttcaccaggcaccaccttgcctagcctccgtctgctgcggacgccagacatcagtcagcacgagggaagcccaaactctgccgcctcttcctctgcgctgcgctaacaacgattcccgattccatggccgcgaccgccatgattaggattaccactttacgttgccgccacgacccgctctcctcccttccccgcaccacgtcggccgcctgctcctgtacccttccgcctcgatgtcgccaatgcagactgctccctccccattcttctggctgttccccttcctcctccatctttccgcgccgggtccgggtccgcccaacagcagcattgaagcgcatcggtggcggcaacaccagcttcatgggtccagccaacaatggcgccaccacgcttcagcgatcttcatcgcccgaccttcgtcgcagcctgatcgtcctcaagtctactgctggtacaggaggtggcaatgcttcctcaggactgctgcccaccattcttggggtggcgcatctgcttgtgtcgctgggcattgtgctcgccaccgataagttcctcaaacaggcatttgttgccgcgtccatcaagttcccaagcgccctcttcggcatgttctgcgtcttctctgtgctagtcgtgttcgacacattcgtgcctgctctggcgaaggcgttcatggacttctttgagcctgccacgctgttcatccagaggtggctaccgttgttctatgtcccgtcactggtcgtgctgccgctcgccgtcagggatgtcccagcggcttcaggagtcaagatttttgcaatcacttttggcggctggtttgctacccttgcggtcgcaggatatacagcattagctgtgagaaaacttgtgaaaacacagcttataccagcagagcccatgagcaaggcatcgccattttctacagtagaaacctgggcatgggctgctgtattcgttgcatcgttcggtgttgcatgtttcaatcccagagctcttggtaccacagcaagaacatgccttccctttctgctcgctgccactgtgctgggatacatggttggttctgggttaccatctggtgtcaagaaagtgttacatccaatcatcacctgcgcactttctgcagatttggcggcagtagcgtatgggtacctctccgggtctggacttgacgctgtgctaggtgattacctcacaaaggcgccctctaatcctggagctggtgacgtacgaatgggtttccttgggtctgtgatcatatcatttgcattctcaatgttcaaacagagaaagcttgtaaagaggcacgcagcagagattttcacatcaattgccattgcgtcgacattctctctgtactcaaccgctgtcatagggcgcctgattgggctggagccatcgttaaccatatccatattgccaaggtgtataactgtggcgctggctttgagcatagtatctttctttgaaggtgtaaactcttccctaaccgctgccgtggttgtcgttaccaggctcattggcgcgaatttcgtgcaagtagctatggataaacttggtctcaacgaccccatcgccagaggaatagggacagcttccagtgctcatggactggggacagcagcactgtcagccaaggaacctgaagcgcttcctttctgcgccatcgcttatggtctcacgggaatttttggctccttggtttgctcggttccagtagtgaggcaaagcttggtattcatagctggttaggagcagctcgtgatgatctgaatttgaggatctgattctttagataaaggaaatcgtttcatgtgtaaaagaagtcgtgctcagaagacgaggaagcaaaacgcccccacgttttgggtcaggatgaagaaaggtgaataattccgtaatcaggatgtaactaaaacactagagcaaggcggatccattgtttgtttgatactttgtgataacaaaaaaaaaaaaaaaatgacacgagagatataaagtacttgtaggtttcataaattcgacaatttgtttagacaaattacggtttgtagttggagaagaaaaaatcattccagatct

SEQ ID NO: 13285 - DNA, 6796 bp, Zea mays
tttacgatagcaagtttggtgtgagagcaaacacaatcatttggtctacttggttgagtcaaaattggtatatttttgtcgagtcaaaatgacgtgaatctgacaaaaagacactaactttctatttacatgatcatttagcgttataattggataagtttctttttgatctattctaaaaaaaactactaaccaatcttaaggctagtttggtggacagagaaatagaggggatccatttccgtgtccactaaatcagcgcttaagggcttattcggttagggcttgattgagggagattggagggataatagtggatttaatcttctccaatcccccttgtctagtttggttactctaatattgacttcaatccatatgtgttgaggccccgatctacctcaacatatgtggattgaaatcaatactagagtatccaaacaaagtcttaatcaatttcacgaacacgccttaaagtgggcagtattaatagagattttctccaaacataggtagctagcttagaataggttaactgtgtaagtagtttattgctacttatggttgagagttcacttttatgcctgagacttgttttatatcatcaaactttggttgagtgcataaacaaaggatgaaacaaaactttatgaaaaagctatttataaaaaagatttcacttagcctttagcctctacggctcaacctatggccaacgatcttttcttttgaagcatggcccataattgtgttcactgaaaacgattgcctactgacttgtagtcttcccaagaccaaatgcaagtggggattctagcgcaatccgcacccaactggccgacaccactccttttgtaccagccgtcctggtattcatagagaaagaaacatcattcgctgcagcttaaaaccatgtacggagtatggaaaaaacaaatcttcatcactaatatataaaacatgagtttctaatagcgacctaggatttgaggtacgagtattcaaaacagctaagaaaacaaactgatatgtgtataaccgcaaataaagtctattatttggtactagcatatagcctgcaacactgcgattccgcggagaagtggttaatagcggtgacgacacgagtgaagggattataggtggcgcgagggaggggatggtggggacacgtaggagaggggaggccaggggatgcttggagcggcgggatcataggggagtgaggatgagagatgaatgatgaaacaaataatattatatatttgattttagtaagtaaatgtgtcggtgaaatgatagctagatgcgtatgaataaaatagtggatagttcaatataaagaaaacatatagaaaaataggagtgcaaaacagtctgatattattaatcttactgattacctagaatatttcttttaaaatagatatttagtggaaaaaagagtgttgatagcctccgtattgttggaccacagtttagtccgttattagattacatattaaataattttttgtctaacagattttactcgttaactaacttttacgaactaaagtctagaaggcggggctctccttctgcagaaaaagagagagaattaaaaaatattcctctacaaataggtaagtgtaactaaggaaagtaatcctctgatcctatcgctaccaccttcaacccggtgtccttctccttcactcctacttggcactttgacagagacaaaaaccaaacccgcggcgcctgtcgtcgctccttcgttctcgccgctgccgcactcccgacggccaccttaacaagcctctggcggaggaccaaatactctcgcgatcgccgtagcgccaccgcgtcgcccaatccgttgggagccgtcgcgcgatgcaggcggacgagcaggcggaggcgccgcgccgcgccaaggaggccggcaacgacgcctaccgcaagtccttgctcgaggaggccgtggagcactacaccctcggcgcgctccttgaccccagtgacatcgccttcctcaccaatcgcgccgccgcctacctccgcatgggcaaggtctctcccggttcgcgctcccactctccgttccctctatgattctatgctacccgccggcggcttacgctttgggacatgttcagtacgaggagtgcgtgagggactgcgatgaggccgtgaagcgcggcagggagctcagctccggcagcgagctgatcgcgaaggcgctgtctcggaaggcgtcggcgctgctcgagctcgcgtgctgcgccgcggactacgcaccggctatcggcgccctcaagctgtcgctggccgaaaattacagcgaggagacgctcgagaagctcaacgacgcgcagagcgtgaggaaggaggttgaggaacaggagcgattggatcaggaggccgccaaccaatgccgcgaggaaggtttggatgttgctcgattacagcaccattgaaatgggaaattgggcaatgtttctttgaggatgttgggaaggggagaaccttacccaattttaaattaaaattaaatgcaaggtgtacatatgcaaagccaaggcggcaaagaatggaaaacacaaggaccacaagagaaagacaaaagaaaaacaagaagaaggaaaaggaattagaaattaaaggaaaagaaaataaaaaatacttgttttctcaatctgttgatagctttcgccttgttttttttttgttgttctgcattcccttaccaatcacaaaagaaacacacattttggtcgacaatgaaatactctcagaaattcccatttagttcttttgtgcgtatatggtattgggatttccatgcgaaagaagacagagcacaaaagaaagggggcgagtagacacttctcctagtaatctactaatctgtgttttttaagcatcatgtatccaattcctaagtactagttgcatgccatacaatgatacaattgcccaaatgctgcaggcaatgaattttttaggcagaagaaatacaatgaagcagcaatacaatacacacgagctataaaaatgaacccaaaggatccaagagtaagcatattggttgttaccctgattttccttctcaagtaaaggtaattccagaacactagtaaagtagtactatcttcagtcaaatatagatgattttcaggcaagaaaacaagaagattataagccaactgtcccatgtctaaacatcaagtaaatatgactggaggtggtacccttttttttttttgaaatttctaagatttctgataaattgaattttttcattggtaaaacatcattaatgataactcttattttccatgcaccttggctgtaaaaacattctctggagttgactttttttttcctttggcactccttgttgtagtaatttgtttagtttatgactgatcttacaggcatttagcaacagagctcaatgccacatccatctgggagcctttcctcaaggtcttgaggatgccgagaaatgcattgaactagatccaacttttctgaagggctatgtgcgtaaagctaaagtccagttcctgatggaaagttatgaaaatgctttggcaacttacctagagggtctgaagtgtgacccaaataatatggaggttctggatggcttaagaaggtagctttccagttctcttctagtcttctttagtcatggtgtgatttaaattgactttgtgtttgattgaattagatgtgcagcatgtgttaagaggtctaatgcgggtgatgttgagatcgaggatttgaaatatgttgatattgatgaattgaaatatttctcggtaagtgtaataataaacccaaaattaaaaagaaaattcaggactaccattgtttagagagtaatgacactgtcggtgccacagttccatttattcttggcattcgagttggtgttttgcatgcataaacaaaatttcttttatttccaaaggtacattttatatgaagtagagcaagagaactacatgatgaagagcaggccgaatggccatcgaaagtcaatcgacctctatcctgcatgccatgccatcatgaacaattggctattcagcttgactgaaggtctcgggtctatatctcctttgtttatcctgtccagtcctaccatccctatccttttctcttccatcagctctggcagctttctgcacaagtgacctcggtctcaccgtcagtgctggcatgatgcaggtctgaatctacatcgatattaacaaaatactgccattaacatacagtgttctccatttccttcccccttctgtgcccataccatactgtgtttgtgcttgttcagacaatgccggctgcagcggctgatggtcttgatttcatgtgtcgcaatttaatttagtaaaacattaaatccttgacagcatattcagaattccacaatctagattgatacttaatcctaagcaaaattttaccttttcaagatttaaggttatgattttattgaagtcgaacccatgtgtgcaaggtcatcctctgacagatcatctagatcgccttatgcgtgcatgacttaatttggggacttagggtagtaatatgagaatttcagcggctcggcctttgacaaccttcctatgacaattgacaagagatttatttccttttaaaaaaaacaaaacactggtctttctttaaaggaaactgatgaggatcctcctggaccaatatgtgttactgagacctgagaagttagtacagttatttccacttgaaatatttcggtttagtgtgcttgattgggtatttttgtcagggtggtggtccaaacactgtacaccagcagaggaggagtggggtgatgacttctgagtgtcaatgcaagtaagatgttgcacttttcttttcaaatactggcaggagctctgcctgccagttaaaagtaagatgctgctagttgttgcttcctcagataattgcgagaaacttctccctgttgcgtcgtttcagttttattgtcttccctcattttgctctctctgttcatagcaccaaggacattgacgagtcatccgccgagaggctgtacgacgcagtgaagtacaccacggacaacatgatgctgatccaggtcccagtgttaggaacaacgaaggaattctggtgattatctgacaaagcgactaggatcagcagaaaacttgcattgatactgaggagccaccactccgtcggcaagtacctagctgctcctctgcaggtgtccaacatctggattgggagcaatgggagtgtcaagctaaggggggtcagtttcactggtcaaggcttcagcactgagcgtgtgagagatgactacaaacgcatgtccaggatcctgatggcgttaattactctctcgggtggggacagaagcaaattgcctccggactacaaagagttcctcctgctcttggaatcggacacccttacaatggaagatgaattcttgattgtaaacaatgctgcactgctgcccataaaaaaccggtaatgtctttacttattttacctttattttaccacatgctcattttgttacttgtgtccgcacttcacagcactgaggtctttctgatgctacacgatagaattgtcgattatcttgggagtacggacaaaacgaagaagaagaaaaagaagaggatactctcgggtcttccctacaaggaagactggctagatactgccaaggcaaatacaaaaatcaaccagtgggttgccaatgttcagaacgagtacagagcgactccacatgatctgctgcggctcaacagaaatgtaagaagccacatgcatcgctacagcgacggtgacggcatcgaggaagttctgtattgtgaatggcccgagctgctcatggtcatgcagaagatgttgcacttggaaggcgagctcgaaggcactgacattcagaacaagtttggctaggcgtcctacttaagctactgttcttcgatcgagttcaggggccgaaagtttatgctggtggagtgatggtcgatgtaagtttgtcgctctcatcatgaaggtaaagctggatcagctttataaaatgtatgctaaaatgtaaagtaaactttaaaccattctctctgagaaggtctcttcttaatacaataccgggagtctgtctcgtcttgcttgtaaatcgtgcctgggtatctggctgtaggtttgtcttgcttgatcttgtgagggatgctgctcgcgttccttggagatcaagcatgcaaacgtctgtaaacaacatcctcctcctcttactgaagataaagctggaccagctttataaaagtattatgaaaaatgttgcattaaaactctaaactctgctgtatgtttgacttgccattgggtctttgttcaccctttttaatttctgaaccttttaacgatgcctggatttcatcggtgagcggcgtttcaagacagcggagtcgccctctcgtactatagatgcttgccagcaaccgaaatgaataacgttgtcgcttcccttgtctctggactggtccacgacaagttatgcttcaagtgcccgtcaaacaagttggtctcaagcccttctctcacgttaaaacagcatgttgtcttaatctagactttctggtcccgatgcttggtttggtcaccatttctcactctccagttagaaaataaattgctggcacacgggaattcatcatcatccatttatacaatacttaatatgtgtgtgtctaaattcatcatcatccatttgaatatagacataaaaaatcgaaag

SEQ ID NO: 13286 - DNA, 2075 bp, Zea mays
tagagcaagagaactacatgatgaaaagcaggccgaatggccatcgaaagtcaatcgacctctatcctgcatgccatgccatcatgaacaattggctattcagcttgactgaaggtctcgggtctatatctcctttgtttatcttgtccagtcctaccatccctatccttattctcttccatcagctctggcagctttctgcacaagtgacctcggtctcaccgtcagtgctggcatgatgcaggtctgaatctacatcgatattaacaaaatactgccattaacatacagtgttctccatttccttcccccttctgtgcccatagcatactgtgtttgtgcttgttcagacatgcccgcctgcagcggctgatggtcttgattccatgtgtcgcaatttaatttagtaaaacattaaatccttgacagcatattcagaattccacaatctagattgatacttaatcctaatcaaaattttaccttttcaagatttgaggttatgattttattaaagtcgaacccatgtgtgcaaggtcatcctctgacagatcatctagatcgccttatgcgtgctcggcctttgacaaccttcctatgacaattgacaagagatttatttcctttttaaaaaaaacaaaagactggtctttctttaaaggaaactgatgaggatcctcctggaccaatatgtgttactgagacctgagaagttagtacagttttttccacttgaaatatttcggtttagtgtgcttgattgggtatttttttgtcagggtggtggtccaaacactgtacaccagcagaggagtggggtgatgacttctgagtgtcaatgcaagtaagatgttgcactttttttttcaaatactggcaggagctctgcctgccagttaaaagtaagatgctgctagttgttgcttcctcagataattgcgagaaacttctccctattgcgtcgattcagttttattgtcttccctcattttgctctcactgttcatagcaacaaggacattgacgaatcatccgccgagaggctgtacgacgcagtgaagtacaccacggccaacatgatgctgatccaggtcccagtgttaggaacaacgaaggaattctggcgattatctgacaaagcgactaggatcagcagaaaacttgcattgatactgaggagccaccactcagtcggcaagtacctagctgctcctctgcaggtgtccaacatctggattgggagcaatgggagtgtcaagctaaggggggtcggtttcactggtcaaggcttcagcactgagcgtgtgagagatgactacaaacgcatgtccaggatcctgatggcgttaattactctctcgggtggggacagaaccaaattgcctccggactacaaagagttcctcctgctcttggaatcggacacccttacaatggaagatgaattcttgattgtaaacaatgctgcactgctgcccataaaaaaccgcactgaggtctttctgatgctacacgatagaattgtcgattatcttgggtgtgcggacaaaacgaagaagaagaaaaagaagaggatactctctagtcttccctacaaggaagactggctagatactgccaaggcaaatacaaaaatcaaccagtgggttgccaatgttcagaacgagtacagagcgactccacatgatctgctgcggctcaacagaaatgtaagaagccacatgcatcgctacagcgacggtgacggcatcgaggaagttctgtattgtgaatggcccgagctgctcatggtcatgcagaagatgttgcacttggaaggcgagctcgaaggcactgacattcagaacaagtttggctaggcgtcctacttaagctactgttcttcgatccagttcagggccgaaagtttatgctggtggagtgatggtcgatgtaagtttgtcgctctcatcatgaaggtaaagctggatcagctttataaaatgtatgttaaaatgtaaagtaaactttaaaccattctctctgagaaggtctcttcttaatacaataccgggagtctgtctcgtcttgcttgt

SEQ ID NO: 13287 - DNA, 1958 bp, Zea mays
gaacaaaaggagaaagaacactgaccaatcaacaaaacctacagatttgccaaacaggttgtgtggagcagaaagtgagcaagctgacaatgtaggtgcaaaaagcacattgccccagattgctgtagagcctcactgtgcagcaaagcactcgaagggtgatccacaaattgccaaacagggtgttgttgctcgtcaaaatggtgcagaaactatgaaagggcatgaaaatcaatttggcatttcattttgtgttgcaagtactgaaacagagaagagggtaacatgtttggcacaaagggggacatgtttagggacacaatatgacgggccatcaaccaagggcatgtatgattgttctgttcaggacaccccaatggacgacgatgttgagttggataatgtggcctgcataatcgcggtggataaatatgtcaatggaaggggaaaaacacaagaggactacactaggaaagaagctgctcagcgcaaagactcgagtgaaaatcaagggcagaatgatgctctagagctagacaacctccggatggagatgcaagctgacgaacgtccgttagaaccaggaaacaagagggacaggaagtggcagaaaaatgtatatggactcggatcagcttcgggacagaaggaaaccttgtccaggagagaaaatccacggtcagatagagggatggtccacagtaacgacagcaaaacaatttattacaggaagggtgggacggaagtcgataatgttgatgaccaccctttagaaaagcaagaccaccaggatacatcaagtgacggatctaaaaagagaagccgacctgtggacaacgcatctggtggcaacagaccatacttggatgagaacaagaagcgtaatctcagagaagatggaagatatgctcattatgaagactggagaagtgaaaggaatacagcagcagacacgtctggatataaggcccaatcagaagagaagcctgtatggacaaacactcgaacaggatcaagggagcattcactggacaggcaaaggatagagtgcggtgacagctatcgtggaacctataacaatagacaaagacatgaatggccgcacccgcacgctagtggtaattcctcgagaattggttgggatgacaggaggcagtggagttcatctcggtcaccatttccttcggctgaatttggtggtgaccgttcctgttctcgtgcccatccgagaggttctaaatacagaaccggcgggaggcatgatcacccccggtacctgggactgggaacacctcaacatggtacaagtagaccgcaccaaagaatgggctgggacagggacaccaccttccatgatcaccagcatggcagaagaccgccgcaccacacaatgggctgggacagggcccccttccgtgatcaccagcatggcgaatacgacgactccaggtatggtgaatatgatgcaactgacaatggtcctgacagcgcgcatcgaccctacacggctgctggcgtggctggacgttcagcaccgagttatcagcttgctggtggttatggagagggatcaagggcttggcggccagttacggacaagtacgccccatggcccttgccttgaccgcacaaactaatattagccaaggagccagagtgagctacaagaacaccgtttgctattgtcggaaatgctttcttcgaggactgtctcagtacggggaattgatgggtcggtgttgaaacccaaatgatatctgccttccagttgcttgctttgcctatcgtaatcactgcatgttatttcacataagcagctggattctcaagttatgtgggcggtgcatttgagttatactagatgacagcctgtgcatattgttactgaagtaaaatatcttttttttaggttccccttaaaaaaactcgagggggggcccggtaaaaaaaaaaaaaaa

SEQ ID NO: 13288 - DNA, 4795 bp, Zea mays
  misc_feature (578)..(578): n is a, c, g, or t
  misc_feature (4154)..(4154): n is a, c, g, or t
ttttaactcgtttcgaatcgtctgcttctcgcagctaatgagactgcttatacgtgttgctacatcgagtaagaagtgaaatgagttttcatgagataaagtgttgcttgcactaaatgtttgttgccatatatgtttagaagaatgaaatctagtttaaggaatattactaaacttggaaaagttaaaaattgattttagacttagctattgctcttggtaaaccaaacccctcaaccaaacagctttatgatctagaggtaaagtagactcctactcattcttgcatgtggcataatttttataggtatcttaccgaaggatatggttctgggttaatttggtcgttcaccttgccaagctcagggagtccgtaaaaccttcttccgatacagttttccttttacacgaggggatttttgcatctagtttatccatcctgtttggttacgagcttaaccaggctctccacatatattgaccagacctcgacatggaacagacaaggcctggatgtgtagatgcaaacagccaaatcaaacagctttgccggcatccgtgaatgacgcggtcgaggnacgtatctaaccagccagaggctgcaacgagccgaacgctcgacgtcgacgcacagcggcacaggcaaccaatcgcatggtaagtgaacaaccggcagtttacacttggatggtaatcgagcgctcagcgctggccgtgtgcatgagcgcccaggcgtttgcacgccagtcgctgccggaccagtcaagtcgttttggggctgtttccgagttctgaccaggaccaaccgaacagcacggaagtcctataaaaataaataaaaacaaacaaagttggtaatatgggcgccaaaaattaacagaggcaagtagctgtgagagaagggcgaggaaaacaaatagaatagaaagcccgaacgaatactcaaaggttctcctctatggaagctttcacagctttctcgatgctattctccctaccccctcgctttgccacggccatactgtacagtgtgtaccgcttctccgctgctcgtcgcccagaggccaaagccatccggtgcctgcctagttgcgagagccagcccagtctgcacggcactacttttaccactagtagcaagcaaatccaaccggacggcattgaaggcatccataaccacccaagccgcaacggcagcattttgaacacacccaacccaacacgggggctgtcccgtcgatcagatgcagacatggttccagtcctgcgaggctgccctacccaatcaccgaacaatcacagcacagaatatcacaacagatattagtagtattacaaaacaaagaacgtcggaataacaattactggctacactataaaaaaggatggttagctggtggttgaagatctggacgagcaggaggacaccaggatctcgtgttcctccccctcacattccatcgtcgcccacggccttttcctgactgatgatcctttctacaagaacacgaaatgaaatcaaagctaacaagatgcaacgaagagtaactctaaaaggctttcaaaggtgccgcttcttcctactactccacagcgacatctgcacagggaagaaacggaaaccgtatgtacagtttcagtacggccgggagggccttgtctggtcaggtagaaggtactgtatatgcttcacttctccatggcgtccgcctcctcgcaggcgcaggtgcaggcgccgggggatacgacggcggcagcgctctcggagcgcgcggcctcgtcggcggcggtggcgtccaccacgcagccgccgtcgctgtggcggtctcggcagagctcctcgacggctacgagccggcggcggaggtcggccatgtcgcgctccatcaggaagaggcggtcccggagggccaggttctcctcctccagcctcgcggtgcgcgcctcctcgtcctcgtcgtcctcgtccccgccgcccagggcggccgcggccgcggccgggccgggaggtggaccatctcgaagcggctgaggtcgtggtccaggcggcgctccacctcgacgtgcccctccacgtcgctctcgccggagcccgagtcgtcgccggccgcgtcccgggcgtcggcgcgcaggcggatgaggcccttcatggacccgtacccgtccacgccccacgcctccttggccatctccaccagcacctcccgcgccggcgacagcacgggcgtcgggagcaccgccggcgtcacggggcacggggacaccagcgacgccacgccccccgcccgcttcgcgcggatcaggaacgacgtcgtgttgcgcggggccgccgcaccgccccacctcgcgccgcccgacgccggaggctgggccttgcgcttccagggcgtccgcgccgcccgcttccacgccgcccgcaccggcttgaaaggaggctccatcgccggcaccgccgcccacatctggtggaacggcagcggcgccggtggtcgcatcagctgctcattcatggtctgactcggaacttggagaactaatcctccagatccgaaaccctaacaacagatcacaaaatcccaccccaaaaaaaacacacgattagcaccgagacctggccacaggatcggaacgttttcgttttaatcccttcgatcccgttaaccgtgtgttttctgagattatttaacgaatttgtttgatccgaatttggtgaggaagaaagtagagagaaggaagaaagagaccgcgtagtctaggatggacggggaagagggggtacgcgggtatataaaggaaggtgggaggtacgccgacggctggatccggggctgcgggctacggacggctaagatcgagcagggaggtgggtgcggttgcgtgtcgtggatggacagcacgggctgtgccgctatgggactcttttttttttacatctcgccttcggccttctggttgggtgcactacgaagcaaacggcaaaaagcgcacgatccacccttttatcgtttttttttagaaaaaaattaaattgtacatgtcttaattcatttttctgcttcaaacaaaagcccatggtgccatcactttttatctacgactctgtttgggagagctcgtgattaaaaaatttcaagtttattttagcttttttattcaaacaggttaacttaaaaaaactgaaattgaactgaaattgaaggtcagtttcatgaattttttttaagctcatcaaaggttgcttttaaaaacactgactcataaaattgcaccaaaattaatcatcatgacattggttacatgacctaccgatttatgtccttttttccacccgttaatcacaagggtaattaagaaaactcataaaattaattgtattataaaagctgaagtctatgtattagccaaatatttttgaacaccgctctaccaatttgttgaagttgttccatgatgaagctataaaactgaaactataatttttgaaatggagccctctcagagagagcctacatttatagttttcttttatagagcaaaatagattctaaaagggaacttatcggtgagtttcaatacttagttcccaatactatcacatttggcttaaattaggtatctatgtatgcatgtttttgtccctgtaaaaaatatattatcttccataaaactctttttatatttctcctcttaaatacattgtcattttaccgaacacgatagcgcatcaccatatttgggggatgttcggtttgtagggattaatttttaatctctctattatattcttttttagtctctaagttggcaaatacggaaactaaaatctattttgttttccatatttagtaatttaggtgctaaaatagaataaatcaaatggactaaaaattagtcactaaaaaccaaacacccccttaataattagtacgaaactcacaccttcctaatagtttatggcattgagcattgtttctacatgattttcgtcgtaaaacaataggtgaaaccattttcgtgagttgtgatagttatatctttagataaacaattttaaccgattaattgtgtagagaaaacgtaggattataacttgctgcactttcatgttttagttttctctaaattcgaacatttctattaaccatcatttttcnataaactcctatagttcaacactacaaaaacatttatgttttgggcataagaaatataatgcctcatggcccatattaaatagcaaacacatgagagtattctttatatgccttaaaatatttggtggagattgttggattaaatggtcatcccacttaagacagttaatatttcatggcctaaactaaatactatggagataaaaggttagtcctacatggctagtcaaggggggggggggggggggctttaaccaacttaaacagtggagttaaaatatatctgttgtgaagttgggagaaggagactgacctgccacacatgcactcgctcacctttctttgcaggacgtgttgtgtcgaggcaaactagcgaaaattatatttatcactatcatattggatgtagacttttttacaactacatgtacatattttcattgtaactagtagtttcacaccaaatttccgaattaaaaatacaattgaaaaattataactttgcaacgtctacttctctcctatatattccttcttggttttaccacacctgttcatcttttcccaattccagagtctaaatttgaagcgtcaaatattttaggatcgatggatggagtatatcatactatgtaaccccg

SEQ ID NO: 13289 - DNA, 4506 bp, Zea mays
gctcaagttagcctcctaaacagatgagagggagcacttcgtgggcgatgatcccgccatttcttccccgccaacctcttcaacggtcctaatgactcctaccttcccgacattttctcttcgcctctcactctacctccgatccacagatacacaggcctgcgcttccccttcctctcgcgattctcccatccactgtaccggagctccaccacgtcctccggcaagaaacagatgaaagacagcgacgacgagggcgccggcgatggcgtcaaccgcccgcacccgtccaacaaccttccactgccggctccacactccgacccgaacctccagttctcgggtgggacggacgatgagtcctcgaaccgggacagcagctcctctgccaccggcggcgcgagcccggggtactactccgactacccgtccagcttcagcggcgagtgctcgccgtacaacatgtccccctggaaccagaccatggcgtctccctggtcgcaccacagcgagcccgccgggctcggaggcggcccgcccacgatggcgccggggacgagcctcatcagctcggctggtgagggaggaaggccacatctactcgctcgccgccaagggcgacacgctgtacaccggctcggacagcaagaacatccgcgtctggcgcaagcagaaggactcgggagggttcaagtcctcgagcggcctcgtgaaggcgatcgtcatgtccggcgagcgcatcttcacgggccaccaggacggcaagatcagggtgtggaaggtgtcggccaagaacggcatgcacaagcgcgtcggcagcctgccccgcctgcgcgacttcctgcgcggctcgctgaacccgtccaactacgtggaggtgcgcaagaaccggtcggcgctgtggatccggcacagcgacgccgtgtcgtgcctgagcccgacggacccggcgcaggggctgctctactccggctcgtgggaccgcaccttcaaggtgtggcgcatcagcgactccaagtgcctcgagtcggtggtggcgcacgacgacaacgtcaactccgtcgtggcggcgttcgacgggctggtgttcacgggctcggccgacggcacggtcaaggtgtggcggcgcgagcagcaggggaagggcaccaagcacacggccgtgcagacgctgctgaagcaggagcacgcggtgaacgcgctcgccgtgagcgccgtcgcgcccgtgctctactgcggctcctccgacggcctggtcaacttctgggagggcgaccgccacctcgtccacggcggcgtcatgcgcggccacaagaaggccgtgttctgcctcgccgcggccggcgcgctactgctcagcggctccgccgacaacaccatcttcgtgtggcgccgcgactgcggggtgcactcgtgcctctcggtcctcacgggccacaccgagcccatcaggtgcatcgccgtcgtcgaggacaacggcgagaacagcagcgagtccaacgccggtgactccgctgccggaggggggtcgtcggcgtcgcggtggatcgtgtacaccggcagcctcgacaagtcgatcaaggtgtggcgcgtgaccgacgaggcgccggacccgctgttccacggctccggcgatgcgccccagatattcgaccggtatcccggcgacgccttcgggaccagtggctcgacgacgtcgttccgctaagacgatttgtctgatcgatcacatgcagcgaaattacacgtcgtctcacttcacaagaaaacgtcttgggaggactaaattatactctaaatacatatacatataccacgtccatatatacactgttggaaatggctgaaattgtaaggtataaaaatttatgatctatagcttgtgctgggcacaaccgcacgagctatgtagtttggttaccttttaaatttgtgagttgtgacagagatggcgaatttagttaggtatatacgtttgctttttgcaactttgcattgctatatggcaaattttgaagcatgcttatctgttgtactagctgaaaatgaattcgttttgtgctaacaatgtattcaataaatatctcgattttaacccccagtggtctttttgaattcaaacctgaaattgtcatctgttgaaacataactgacacgccagccactcattgttccgagaagtgcttacgataaaaaataccaaatggatactcaaacaaccctgtcttgtaacagtgtttcttaaaatcataactttacaatattatattttacaattgtcttaataataccatagtagccagctccaaaaatactggatacaatgttgaaatagtaatccgtcaaagatcttaaaccgagtcttatcttaaaatatagcattctagactaaaaaatagcatccaacataagtcataatttataaatttagatcaaatagcttccaacagaagtcatagaattttctaatctagcttctgctgggcacgagctatgtagtttggttaccttttgtgacagagatggcgtgtacgtttgctttttgcaactttgcatttctttatgggacattttgaagcatgcttatctgttgtactagctgaaaatgaattggttttgtggtaacgatgtattcagtaaatgtctcgaatttaaccccaagtggtcttttcaaatccaaacctgaaattatcatctgttgaaatataattgacacgatactcgttgtgccgagaagtgcttatacaatggaaaataccaaatgaagactctagaacaccccttttagtctgcaagtaaagtggtaatcctgagcagaaaagttattgtatgtatatcgagatggttagcatattaaatctatatggaacacatctaacaaaaacatgatgagtgactcgtcgttactagcatggagcatggcttcagcttgatcgaagatgagtttacaccgtcgttgaagttcatagatatcatgatactgatcaactcaatggacaaccatgtgattgctgacctaaaaattgatccggtctaacccatgcaagttcttcagcggagcgaggtttcaaaaacaacgctttcttcatcgttgtcgttagactggcgtcaaggatcgagtagtctaaggtcacgcaacactggaactcactcatataaaacactaacatacagtaaattggttgtttcttgtgaccaagaacaccgtctattatatataaagattagctttatgatatccacacaaaaggagaagcgaactctattacgatgatcgattcagtcgccgtgcaagacaggatcaaattgagtgcaatacgttaagctaccacctgattcctttttggatctggtgccggcggcactttaacctcttttgattctggagttcgaatatttggatatccattataagtattaaatataacctaattatgaagctaattatatagataaagactaaacgaggggataaatttattaaacctgattaatctatgattagtaaatatttactttagtatcacatagagttaggtttaatatgtttgtcttgtcgtttaatcttcatgtacgtaattagttttataataattaaactatatctaatatatttaacgagcatctagatatggaatattcgatatgacagcctatcctcttcatccggtgttggaattcagtgttggtgcagaagcgaggacggaaaggccgaactgcgacggcgagatggtgagcacctgatggtttggttggtggatcgagatgaacagatgcgttaggataagctatcaatcaaagctttcaggtgtgtcagacataacacatctctacctcatgccttgttccgacggcagacagacatgcgagcttttttctattatggtactagttttttaacttctccctaatagcatttacaagtaaacctattctttaaaatagtactctagcctctttaattatttttatattcttttcttatttcttcaccacatagattccctcgtgattaatgcagagtaatgtagttgttcatagcttgctggagtcccttcaacactaatttagacaatcaaagtaaacttcaggaaacatcattctgttattataattaatcaacaacttgagcacactggaaactcccgttcagcgtgggctgtttggcagcttaagtatcatcaacgaaatattctgacaaaatatttgttgataacgatcaaggactgaccaaaggttgctttctcgttctgatgggtgcagaaaattgttttgccgcattgcaagcgcaataacagcttaattggtttattctaaaagatgcttgtaggaagaaataagaaaaaaaaaacaaaaataatttaaaagaggtcaaagtactattttaaataatgtattcacttgtaagtgctattagggagaagtagaaattgtgagtataaaataagtattataatagcaaaaaaaaaaaactccagacagacagagctggggacgttacgctcg

SEQ ID NO: 13290 - DNA, 2698 bp, Zea mays
  misc_feature (418)..(418): n is a, c, g, or t
  misc_feature (641)..(641): n is a, c, g, or t
gaccatgggctaggttatagcccgaaaatcgtactttgcacaaagcttttagtcaaaagcccagttatgagttatctgccatttgggccttttgggatgtgtgatctatgtagtatcctacatcggtccgtctagagccctacagtacatacacgcaagtgctgaaggacgcaccaacacgttcgcggcgaaaagccgacacatggtcactgtctggcgtgtgtgcgtctgtatcgtgggacagtgtccctgcttgtgaggcttctcgtaagtagtggccgtatgccttgggcaaggggaggattttctgaatacggaatagaattgcttactgttgccttcgttctcctctctttgctaccttcgtctttctctcattcttccctaccctagatctctcctcttcttcattccttanttgtagctaacaatttatatcagagtacacaaatatgcgccgcaattaattgcatcggccggcacgcccaagatccccggacattgaccagcctcgctctcgtcttttttgttttcttccaataaacatgaatgcacgtcaatttgatggaattgggaggcaacaggtggctcgccgtcgccgacaatgccgtggcgggacgggacggcgaaagcgaacgccnacgagcagctagcacgacgacaagcgtaagcggctcgcgcctcgcactcgtgctaccgcaaaacagcatggcgttccccgttccgagcgcacgggtgacgcgtcccggtcgttgtcccggcgacctacctaccaaatgatctagcggtagcggtccagtccaccgtactggcactgtagtctatgatgatcagtggcccccgaatgtctgatcaagtctgaacccacgcccgaacacggcgcagcggcagccaaattccaccaccatccggttccggtgccgcccggcccgacccgtacggcgcacggccgggcgcgaggcacacgcgcgcatcagagagctgcgtagctgaccagtcaagtccaccgtgcgagtgacgcgtcgcccacggccactcgtcgtccacgcggttgggctcgcgggccatatctttcccatctttcgagcgtgtttttttccttttccgcacttacgtctctaatctctatcgaggtgaccggaagctacgagacgagcttcttttggccgtccgctgtgcgtgggccgcgcttagattctctgtgtcgttcgcttcccgtctatcctctgtcgactgcgtcactactcactgtgatcctttttatctattcgcttgactttaatccttaattcgtatcagattctactgcttctatgtgtttctgtctctttaagttacagatgcagcagtttatctcaaacgaacagtatgaacatagtatgaacatgtggtattactctactcgttagccatgcagataactcactgctatgtttgtgcaagcgatggccgcagaggaggaggcataaaacgaaccacgaagcacaaacacggcttttaatccaaaaccgaagaaaaccgatctatcatccatcgtggcttgcgcctcgcggtcgcggaacgcgccccccgccctttttatctcaactgacacgacaaccattaacgcgtccccggccccccctcgtggccggccgcgaccaccattcccagtcctccctctcccctctctctcgtctcaacggacgccgcgacttcacttcctcgccgtactaggccgaagcacagagacagcgcccggcggttcggcacttcggccatgcggcgatcagagtgggaggaccggtgcaatcggcacccggaccaccgcacgttcaaaggcgtctgcccgtactgcctccgcgaccacctcgcgcgcctctccgcctccgcctcggcggcccccaccaccaggcgcgcctcctcatcctcttcctcggcgaccacatccgcgtgctcctccggcggctcgtccccgccgcgccaccgcgccgcgctctccgcggacgtcagctcggtccacgttgtcgccggctcctccttcgccgacgccgcctcctcctccttcgccgacgccgccgccttctcgcaggcgctgatgccgacctctgctagtaagaagccgccgccaacggcggcggcggcagcggcagggaggcgagacgaggcggcgcaaccggcgagggggaaggcggaggtgaggaggaagaagatcgggaggttcctgtccaggctcgtcggggcggagaagcggcggcacaccggggacggcggcggcgagctcgtccactccaaaaccatgaaggagaagacggcgttcaagtgggtgttcttctgaattccaccatctcagaccagatgccaccaccatgcacacacgctcgaggaccagtttcctcgatcggtcggtatatagttccccctcacgtacttttgtgcttaaattaatctgcagttttagcacggtttcttttctattgtgtacacgagaactctaagccaaaaccattgaccattctgtactatttgggattttttctttgggaaaaaggttatatgagaaaccgtgtatgcttattttgtaaaattagaaggaaagtccaccagctacgaagtgtaaagtatattacgtggatcttaaatctatgttccagtatccgatagtgttttagtttatgccgtctgtgccatgaatccaaccgccttttcttttcttttc

SEQ ID NO: 13291 - DNA, 1496 bp, Zea mays
agttgaggttcagggccccttttttttttttttttttccttttttttttttttttggccgcttttttttttttttttttttttttttttttttttttgatataaaggataaatatattgaacgttattggagctaaggcacaatgtctcaattattccccacgtcagcaatgagcgcagctcgggcaccacagccataggtaggtgcaaaacttacacacgaccaaaaaaacaacaatgcatgtcaacatattagtaccatatcagggctcgatttcttctgaaacaccaacctcatcaccggagctcagatgtcgactgtccggacgccatccccgtccttggttgccacggcgagttgttagcaacgcgacagttgcgccgtatctcccctttcctggggttttggagctcccccatctttatcatcccctcgatgaaggccctgaagaaggcgtcctggtccttgctgagccgctcgacgacgcgacgggtcctggtgttgtcagagaagagcgtctggtcggagttgaggaagccgcggagcgcgacgaggtcctcgaagtactggttgtcgaagacgcgtggggtggcgtccaggcctcccgtgacctcctcgtcgccgcccttggggcagagtgcgtcgagcgagcggcggtaggcggtgtccatgtgcgggtcggggcggccggatccagactggttgtagaggcggaagacgatggagaagcagcgggcctcgccgatggagtgcgagcccgagagcgcgaccaggtcggtgacgctgaggttgagccccgcgaagagccggatgagagcgctcgcgtttgcgcgcgggctcggcatgatgttgtccgcgtcctcctggctcgccgtcatgctgtcctcgcgcccgagccgcacctcccagttaggcccaccggtcaggacgacggcgtcgcgggcggccatgatgacgatgtcggcgcaggagaccactccggggcagcgctcctccagcgcgtccttgatctcgtcgacgacctcgaacgagcgcagggagttgatgttggagagcgcatccttctcgccgggcatcgtcggcgtggcgtccatcagcaccgagccgtcgcacccgttgacgaagcagtcgtggaactggaggcgcatgacggaggcgacgctgcgggcctcgcgtgcgcgcgcgcgcgccatggtctcacggacgatgtcctcggcctccgggcacgtctcggcgtagtacccgaccttgagctccctcaccgccgcctggccgcggcagagggacgcgaggagcacggcgaccagggggagcccgaggcacccgcgggggaccgccatggatagagagggaggggtggggcacggacgcgcacgctctggtggtccgcgctgttccgagacggggcacactgcgctgcacttcgccctctgctctactctactctgctcagccgtttggcaggcagcgtactagtcgcgtccgggtccgcgtgg

SEQ ID NO: 13292 - DNA, 1892 bp, Zea mays
atccacttcgcccgcccgcccgctgcctgactgccattattgcctcccggtcttcgctgtccatccgaccgtccgtggcttctccctccggtccccgctacccgccccgccccgccgagaagcttcgggctagctagcaagctagctagccacctacccgtgctttggttcggttggttggcgccatagccattgccgaggagcgagggagcagccgggcgggcagtcaggaggcggcgagtaagcatgctgggagcgagccccaggggcaggaaggccgccgcgccgccggtgaagctggggtcggcgaaggaggcgccggcggccggtggaggagggagcggctgcaaggtgccggcggaggaggtgtgggaggtgcggcccggcgggatgctggtgcagaagaggggcggcggcgacgacgagccgtcgcccaacgtgaagcccgtgcccaccatccgggtcaaggtcaagcacgccggcgtcacgcacgagatctacatcagttccgaggcctccttcggggagctgaagaagctggtggccgccaagacggggctgcaccccgacgaccagaaggtgctgtacaaggacagggagcgtgactccaaggcgttcctggacacggccggcgtcagggaccgctccaaggtggtggtgctggaggaccccgaggcccgcgcgcgccgactcatcggggagcgccgcagcggccacctccagaaggccgccagggccgtcgccgcggtcaccgccgaggtcgacaagctggcacccaaggtggcggcgctggacgcgtcggtgcgcaggggggagaaggtcgcggagaaggacgtggtgcaggtgacggagctgctaatgaacgagctgctcaggctcgacgccgtggtcgcggacggcgacgtcaaggcgcagaggcggatgcaggtgaagcgcgtccagaagtacgtggagacgctggacgcggtggcggccaagaacgccgccctcgtcggcaagtccggcgagaaggccgcggccaagccggcgccggcgccggccccggccccgccgccgcggcagcagggacaggggcagacgcggtgggagatgttcgacctgctgtcgtcgctgccgtccacgtcctcggcctcgtcaacgacgaccgtgagctccacggcgtcctccggcgcgccgccgccgaaccgcccggactggatgctcttctgacgagtggacggcggtcccgcaccggccggccaccggcgcaaaagcgaaaggcgagtgcttgatcgatgcgatgcgatgcttgtgtgccaagaattgcaccccaaatctggtagctcgtcgagtgtcctgatgaggccatgattgggcaggcggggggctatctagcttggccacacagctgcattgcgttgggctgcatggtacccgtaccagccaattcgagttcatcaatcatgtggtgtgagagtatttttcttcttcacctctcctttttctttctttccttttgagcttttttttccctcctcctcctcctcctcctcctcttcttcttgttcatggaaggtttgggattcttttggagtgcatactatactattcagatagagaaacagaaagatggagttggttagggcaagtgaaacgtcttcagatagggaaataaataaaactagtcggtgtccaaactctgaagaaacgaacaaagaggtgcatggattgttagcttatcacactgttgtttgagagtgatgagagatgtatcgatcaagaggccacttggtcggtagtctgtcactccttgttgctgccgagtttcttcctcctcatcatcatcctgtataatgtaatcaagcaataatacaaaataaaaaaagcgttttgaatcaaaaaaaaaaaaaaaa

SEQ ID NO: 13293 - DNA, 1905 bp, Zea mays
atccacttcgcccgcccgcccgctgcctgactgccattattgcctcccggtcttcgctgtccatccgaccgtccgtggcttctccctccggtccccgctacccgccccgccccgccgagaagcttcgggctagctagcaagctagctagccacctacccgtgctttggttcggttggttggcgccatagccattgccgaggagcgagggagcagccgggcgggcagtcaggaggcggtgagtaagcatgctgggagcgagccccaggggcaggaaggccgccgcgccgccggtgaagctggggtcggcgaaggaggcgccggcggccggtggagctggaggagggagcggcggcaaggtgctggcggaggaggtgtgggaggtgcggcccggcgggatgctggtgcagaagaggggcggcggcgacgacgagccgtcgcccaacgtgaagcccgtgcccaccatccgggtcaaggtcaagcacgccggcgtcacgcacgagatctacatcagttccgaggcctccttcggggagctgaagaagctggtggccgccaagacggggctgcaccccgacgaccagaaggtgctgtacaaggacagggagcgtgactccaaggcgttcctggacacggccggcgtcagggaccgctccaaggtggtggtgctggaggaccccgaggcccgcgcgcgccgcctcatcggggagcgccgcagcggccacctccagaaggccgccagggccgtcgccgcggtcaccgccgaggtcgacaagctggcacccaaggtggcggcgttggacgcgtcggtgcgcaggggggagaaggtcgcggagaaggatgtggtgcaggtgacggagctgctaatgaacgagctgctcaggctcgacgccgtggtcgcggacggcgacgtcaaggcgcagaggcggatgcaggtgaagcgcgtccagaagtacgtggagacgctggacgcggtggcggccaagaacgccgccctcgtcggcaagtccggcgagaaggccgcggccaagccggcgccggcgccggcgccggccccggccccgccgccgcggcagcagggacaggggcagacgcggtgggagatgttcgacctgctgtcgtcgctgccgtccacgtcctcggcctcgtcaacgacgaccgtgagctccacggcgtcctccggcgcgccgccgccgagccgcccggactggatgctcttctgacgagggagggacggcggccccgcaccggccggccaccggcgcgaaagcgaaaggcgagtgcttgatgcggtgcgatgcttgtgtgccaaaaattgcaccccaaatctggtagctcgtcgagtgtcctgatgaggccatgattgggcaggcggggggctatctagctttggccacacagctgcattgcgttgggctgcatggtaccgtaccagccaattcgagttcatcaatcatgtggtgtgagagtattttttttcttcttcacctctcctttttctttccttccttttgagtttttttttccttctcctcctcctcctcttcttcttcttgttcatggaaggtttgggattcttttggagtgcatactatactattcagacagagaaacagaaagaaggagttggttagggcaagtgaaacgtcttcagattgggaaataaataaaactagtcggtgtccaaactctgaagaaacgaacaaagagagtgcatggattgttagcttatcacactgttgtttgagagtgatgagagatgtatcgatcaagaggccacttggtcggtagtctgtcactccttgttgctgccgagtttcttcttcctcatcatcatcctgtataatgtaatcaagcaataatacaaaaaaaagcgttttgaatttcacaaaacaacaatggaactg

SEQ ID NO: 13294 - DNA, 1509 bp, Zea mays
atggagcatgccgattccctctttcgaataaatgacttttcttccctgagtgaggcagttgaggaaataagaagccatgggcccatggccttattgtccttgtttcgagagtgtccagaaggcacgaacagttgattccttgaccacagaaagtcatgttcaactcatggaacattaatttctcagggttcagaacgcccatctgttacatgatctttttacctgatgaaatgctgggtcctttcccagaatcagtcataaaacaagatctgtcctgttgccattccacccaactgtttgctacagaaactaacatattcttttgttccacaggtggcagaaagagcgctcttcctatggaacagcaatcacatcgagggtttgatcaaacacaacagcaaggttatactgcccgtagtcctcccagcattagaacggaacacgaaaggccattggaatcaggcagtgcagagcctgagtctaaatgtccgtaaaatattcatggactacgacccagcactgttcgaggagtgtcgcgagaagtttgaggaagaggaagctcaagaagccggcatgaggtcaagatgtgaggctagatggaagcgcctagaagaaattgcctcgtcaaaggaggtgaagtagctcgtcttgccgactgcccaggctgtagctcgtcagcagagttcctctagctatctagccttgctggctgcatacgagcagctagctctttctggcaggatcaagtagatgctgatgtaactgcccatggatggctgcttgcctcgtgttacttgctttaccgaacattttacaggctgacatgtaaatacgaggtacatggtgggccgtgaagcttcaacggggactcaggttctggctgccgtgtgatccactgatgacagtatcggttttcatcatcagaggacaaaggaaaggatgtaaaatggtcattcctgctttactgagatgctcatgccacatgttaacgtctagtctgcggctcaatgtcttgatccaagcactgctagaagcacttgaaagacagtcgagcagcacttgttcttgcctgctgatggtgattttgctgaaatgtatagcatgctttgtgtatgatgaatggtaacttggagccatgtcttgtgatgatatgtaatcgtgttgtacatgtcttttccttcctttgatgtatacagaaatttggaatgaagtgctcattgattgatgttttatcgtatcattcttttagactgggcccccgcccgcgaaaaataggggtagcattcaacctaaatggtttcaatttcaaccaatctgtagttgatagccaaggtcgcgttattagtacttgggctgatatcatcaaccgtgctaatcttggcatataggtaatgcacaatcgtaatgctcacaacttccctctagatctagctgctcttgaagttccttaccttaatggataaggtttttctccttaacatataggaattttgaaggaaggaaagcaaa

SEQ ID NO: 13295 - DNA, 1237 bp, Zea mays
  misc_feature (1235)..(1235): n is a, c, g, or t
gacaaacggattgacaccgacacataaaaaacacctttttagacatttctcgagaccaccactactcgtgcccgtgcggtggttcgaccagatccatctcacacccttatcctctttacgcctcaccactacagagaaaaagagaaacctgcgagcgacggggactatggccgccacccgcaccgccctggccctgctagggcacgagggcatggaatctgggcccaggccggcggcgccgcgccgcagcaggctacgcgtcgtcgccgtcgcgctgcggaccaggcccaccagcctcgcggccccgggtctcccgcccgcggcgccggagcccgtgctgccgtcgccgcccgtggccgcgggcgccgcggcggtgctgctcgaggcgggcgtgccgcccgccgacctccggcgcgcggcggggatgtgcccggagctgctgtccgtgtccgcggaggccgtcgaggccgcgctccggttcctcacggaggaggcgggcgtcgccgaggccgacctcccgcgcgtgctccggcggcgcccgcgcctgctcgtctctcccgtggcggcgcggctgcggcccacgctctacttcctgcgcgcgctcggcgtgcccgacctgcaccgccgcgccgacctgctatccttctccgtggagggcaagctgctgccgcggctcgagttcctcgagtcgctgggcctgccggcgcgcgccgcccgctccatggcgcgccgcttccccgcgctcttcggctacggcgtggaggggaacatgcggcccaaggcggactacctcctgggcgccatggcccgccgcgccgacgagctgtacgacttccccgagtacttctcctacgcgctggccacgcgcatcgtgccgcgttacgaggcctgcgccgcgcgcggggtcagcaggctgccactgcccgccatgctccgccccggggacgccaagttccgcgccactctcgccagctgtgtcgggtccatgctgccccggaggcggtcggcgctgtggcacgccaagtgggtggatgacgacgcggcggcggcggcgaaggagaccacggtgtgacgtgcgcattggtagcgagcgagaggctcttgcctcttggtggtgtaacatatgtccataaggatcggcattggctgcttgtaaagtatgatagccatgatgaattatctagttggtcctcccagtgaacaatggcactgttggctaataaaaaaaaaaaatnaa

SEQ ID NO: 13296 - DNA, 863 bp, Zea mays
gctccggttcctgacggaggaggcgggcgtcccggaggcggagctccagcgcgtgctccggcggcgcccgcgcctgctcgtgtgccccgtggcggcgcggctgcggcccacgctctacttcctgcgcgcgctcggcgtgcccgacctgcaccgccgcgccgacctgctgtccttctccgtggaggacaagctgctgccgcggatcgagttcctcgagtcgctaggcctgcccgcgcgcgccgctcgctccatggcgcgccgcttccccgcgctcttcggctacggcgtggacgggaacatgcggcccaaggcggagtacctcctgggcgtgggcgccatgggccgccgcgccgacgagctgtacgagttccccgagtacttctcctacgcgctggccgcgcgcatcgtgccgcgccacgaggcgtgcgccgcgagcggggtcgcgatgccgctgcccgccatgctccgccccggggaggccaagtttcgcgccacgctcgatagctgcgtcgggtccacgctgccccggaggcggtcggcgctgtggcacgccacgtgggtggacgacgacgcgacggcggcgaaggagacgatggtgtgacgtgcgcattatattggtaggctggtagcgtatatgcgtatgtccatatggcattggctgcttgtaagtatgagagccatgatgaatctggttgcgtgcttcttccatcaggtgaacggaggcattaattcttgcttggctatacttggttgtgcttatatagccatgcaggtgattgttaccctgatcgtgtgaatatacactcctcccagaggcttgggcgtcagtcaaaaaaaaaaaaaaaaaaaaaaaaaaaaaaaaa

SEQ ID NO: 13297 - DNA, 3482 bp, Zea mays
tactcgtatttgacttccaaatatttgatgtaacataggctacagtttagtccttgaacaaacatctcttgacttttggccgccccgtcacgcacttccgcaaactgaacagcgccctgcggctggatctcgcgaatgaaaatatcaggtctaggccgcgcggaaccgaggaggaaaaaggcagggcggccgccactcgccacccacccaaccgctgaattatccatccccatccaagttcccacacgccccacgggcacaacacggccaggccgcgcggctgcggagcagcggaggcgggcgctcgcgcgccgcgcccaccacggcacgggctccgctgggtgcggcgccgtactcccgtggcctcgtgccgtttcaatcgcgcctcctttcctcataggctcgtgccctcaggccaggcctcgtccatcggccgcgagtacgcggctctgcgacaaaccccgcaaaaccaccgcaccgctccgcccgcccacgcggccgcaccggtgggcgatgccctccgtagccggtcatttcaccgcgggcgcggcccatgcccgcggcccaccaccgcaccgcctcgcctcctgctccttatatgaccggttccccacctccgcctccgttccccatctccaccaccaccaccaccaccaaaccctagccgcctcccttcgccgccgcagctgatcggccatgtcttcctcgacctccgatgcggccagggacgacgtcgtctcatctcccgacctgccccccctgtccgcgcacgtcgccgcggcggctgctgcggccgcggcagcggcctcctcggggggaggaatagggctcgggggcgggggctccggccggaggctgccgccgccgtgctggacgcacgaggagaccctcgcgctcatcgaggcgtaccgcgacaggtgggaggcgctgaggaagggcaacctgcgcgcggctgactgggacgacgtggccaacgccgtcaccgctcgctgcggtcggttccccaccgccacgcataagtccggcgtgcagtgccgccacaagatcgagaagcttcgaaagcgataccgcgctgagcggtcgcgatccgcggggcggtccaaggggcccaagtggccgttcttcccgctcctccacgacctcgccggcggcggcgtgccggaccctagccctaacgccatcgtcaagatcaagaccaagggccctgccccgccggcatccccgccttcccctgtgtcctccccttcctcctccgaggaggctgtgcggagcaggagcctgcacgggctcatctccaacggcggggccgggagcgggctgcgcttcaccatccctaaggcctgccgcacgaagcccgccgcggcggcagctgtgaagccggagaggagcggcggcgaggacgacgccgagtcagaggcgatggccgaggtggctgccgcactgcggtccgtcggggaggggttccttcgtatggaggagcgcaggctcgagctgtcgcttcagatggagaaggaacgaatggagtcagagatgaagcgcacccagacgatgctcgacgcccaacagctcttcctcgaggccttcctgggtaagcagcagcagcagcagcagcacaagaaggccagggtctccccttcctctgccgcaatggaagaggactgatcaatccatgtagcccggttgctctagttctgctctgtcaaccttgtgtgcatccttcctcgctctgcgttgactgctgttcatgctagtattgttaactttgtgtcagtagcaatataatcttactattgtgtatggatggtgatgtaggtgtagggatatggatatggataaggggggaagggcgaggtttgaattagaaattaggtggtctcagttttaatcagtgaacgacttgtgttatgagcttatgatgagctgctgctgttacgttgaaacacttcagcttgttcaaatggcttctactcgttgtcaattttattgttgtggttgatcgcttcgctagactcttgttatgaccgtccaattgctagattagtttaacgctgcattcgaggtattcggtgagcaagcatatggaatctctatatttcactgaggttcatcctgtgttgtgagtaaactgtaatgctattgttatgcctggagtacagagacgaaggctataagcctagtctatagtactcctgatcagattactatttcaaattagattggatctatagttaagaacttcagattagttagataaaagttagctactcttactagataagaggagagttagttactgttattggataaggacaaaattagatgatatctctagttagcctagtctatagtgcttcggatcagattactatttcagattagattgaattagtatttcagattaaactatctagttacccggactttgctatagttgttatatatcatataaatatgtattgagatatttattcaaatataattattgtttatttctaaacactaagatacttaggtatgtgtggtcttgtggttagcctcaaatttctatagtagaaggcgcgggttcgagtgctcactcttcaatatttttgctcagtgtggtagctgcacggtgggatcgggtgttgggcagacattgagatgggacacgtgggggcacgtgcggcgggccctgagtgtcagcgtggagagtaaagtcatagtagcacgagatacccacattaggttcttaataaagtagtatagattagatctatagataagatccttagattagatagatatgataagaattagctactcttactagataagaggagagtttgttactgtcattggataaggacaaaattagatgagatctctagttcgataaggcttagagtcctttctgtttcaggattagatctcttatgaactataaatacttctaaagggtttttttttctggaaattaagtagaagcaaattatttgttgtcatcttccctcagtgagctgggagacctagccgccagcccgccaccccgtctttctccttttcttgcagccctaaatgcgtgaacaatacttgcagcactatagcgcgagtactgtagcaccttcttcctttatcacgtgtggtggccacggtatctagtcactgccctcgttccttgcgatcattgaggccacggtgtctagtctcacctccatcaacgccaactccgccaccctcacgcactctgtggcgaccattgaggccttcatggcgcgtgtggcgtttccttcccaaccaccgcccgcgtcacctccgccggctctatcgcttctgccggcgtacgcgacaccaatcctaccgccgccggcaactaggcctgggcagaaatcctgttactcgttacccaaatccgaactacccgaacctagatccgatatatccgtacctgaattacccgattaggccttgttcggttacatgggatataatcccaccatgaattt

SEQ ID NO: 13298 - DNA, 2135 bp, Zea mays
gtcgtcgaacattctgttggatggaagtttctcaggctgccgaaccgagagagaaactggacaggtttcagctgaaataattctctgatagaaactggactgatcaagtgaaagacctggatcaactaaaacctggctgttactgttcctggcctggaactgaaaccgggctgccgaaaatagtagagatttcctagttttgacaaatttctcgcttttggaaaggaaaaaaatcaagacgaggccgcacggagcccacggaaaaaggcaaggcgaccgccactcgccatcgtcagttcgtcacccacccactcacccatcccgatccaacacggccacgccgcgcggctgcggagcagcggagacgggcgcccgcaccaaccacggcacgggctccgcaacgatgcggcgccgtactcccgttggctcgtgccgtttcatcgcgctaccttccttccttcacggagcgactgcgaccaatcccgcaaaaccacccacgcggccgccgcggtgggcgatgccctccgcagccggtcatttcaccgcggaggcgcggcccacgcccgcggcccaccaccgcaccgcctcctccttttatgaccggttccccacctccgcctccgttccgcatctccaccaccatcaccaaaccctaatcgcctcccttcgccaccgccgccgccgcagctgaccggccatgtcttcctcgtgttccgacgcgtccagggacgatgccgtctcatctcccgacctcccccctctggctgcacccgtcgccgcggcggctgctgcggccgcggcagcggcctcctcggggggcggcataggactcgggggcgtgggctccggccggaggctgccgccgccgtgctggacacacgaggagactctcgcgctcatcgaggcgtaccgcgacaggtgggaggcgctgcagaagggcaacctgagggccgcggactgggacgacgtggccaacgccgtcaccgcgcgctgcgggcggttccccaccgccacgcccaagtccggcgtgcagtgccgccacaaggtcgagaagcttcggaagcgataccgcgctgagcggtcacgctctgcggggcggtctaaggggcccaaatggccgttcttcccgctgctccacgacctcgctggtggcggcgtgccggacccgagtccgaacgccatcgtcaagatcaagaccaagggccccgccccgccggcgtcctcgccttccccggtgtcctcgccttcctccgaggtggaggctgtgcggagcaggagcctgcacgggctcatctccaacggcggtgccgggagcgggctgcgcttcaccatccccaaggcctcgcgcacgaagcccgtcgcggcggcagctgtgaagtcagagaggagcggcagcgaggacgacgccgagtcagaggcaatggcggaggtggctgccgcactccgggctgtcggggaggggttcctgcgtatggaggagcgcaggctggagctatcgctgcagatggagaaggaacgtatggaatcggagatgaaacgcacccagacgatgctggacgcccagcagctcttcctcgaggccttcctcggtaagcaactgcagcacaagaaggcccatgtctccccttcctctgccgcaatggaagaggactgatcgatcgatgtatcccggctgctctctgtcaaacttgtgttcatatgcttgcttgatctttgttaactgttgttcatgctggtagttgtggacttcgatgctagtagaattaatcttattgtgtatggatggtgaatttaaccgaacaaaggggtttgggggcaaaggatgttgctgtagggatatagataaggttggaaggatgatgtttgaagtagaaattaggaagtctcggttgtaattagtgaactacatgtgtttggtttcgaggaggagagcaggagtttctggcagctgtggcgtgagggatgtgccggaatttggttggtgggttttttaaagtttaaactggtggattatatagtggtatagatgaacttgtgatggtgaaaaaaaaaaaaaaaattgaaacactgcaacttgttccaatggcatatcctcgttgccaattttgttgttgagtttgcttgcttgattcttg

SEQ ID NO: 13299 - DNA, 2789 bp, Zea mays
cacaatccaactcaatatatatgaattatggattaaaatgaatacaagagtatctaaacaagcttccttgggaaattgctctcaaactcgcgctcaaacccctttcagccttactcaaacagacccgaacctgagcttactaaactttagtctaaagtggtggggcccttctaggacagacggggtcacgagaggcgtcgccgcgtcggtcatctagccgttcccgttctgaccgctggagagagtagggctgcgtataaaggaggagcaaacccagcgcttctcgtcttaaccatcctcaatggacatccgtgatgctgactgagcaagatctgtgatggccggcccatccttgtgggcggagcaatgcaagaccttggaaagctagatatggaattttatgagaagacaggagagtcattaaagtacatactatcataccccgaaagaaagacaggtcttcacctttcgctttcctggcatgatcaaacggagtgatgctgactgactgaggatagcgaaagcgcaaacccaccccccccgccccgcgtccgcccaccggccttttttttttttttttttgcgacatgattcattattgtaatccatccacggtatcttacaccggagcagagggagacaatggaatggaggagtcctaggctacagagccaaggccgcgcgccggcctggacacgcccacacagtggttgcccccacccgtgccactggaagtggtcaccccggcaacggagccccgccatcgccatcgccatcgccatggcacagctcggctgccgtcggcctcctctccgactcctcctccggcattccgtcaggtctccggctccagcggagcctccacggccgccgcgtccgggacgaggtgctccgggcggcaccaggcgacgaagtcgacgagctccttgccggactcgtcgtcgtcgcccgcgggcggcggcgagatccggagcagcacggcgaccgccaccaggaagaagcccgtggagaggagcagcggccagaagaaggacaccagggcgctgagcctgggccccacgacggagatcgagacggcggccgcggccaccagcgccaccgctacggccgcctgcacccggtgctcccacattagctcccctagcttccccttcgccgccaaggccgccggatcggcagcgcggccggacatggggatgggatgggagatctaggggaaagaaagcttctggagcgaggtagtagctaggggtttgccactcggcctaacaggaggaggagggggcgagggaggacgtcgagtggggaaagggtggtggcctggtgggaagcctgtgattaatctcaggctgcggagattcgccctgccgccgcctccggccaagggctgtgtgcttgttccgtgctgtttgggggttgtatgtttgtattttttttttcttcttccagcgcgtggcctgcctgcccttttaccatagtgccccgccggtcgggctggtacatgtgaccggtttttagctcatggttaaatgagccatttgtgctctacgtaggagggcgttcatagtttgcgccccaaatttcactgtttcgtatgcgttttccagaacctaattaccatatggattcgtatattcttgtgtaggtgatcggagaatttcctatcctataaacattacgtttgtagtagtcgaagcgttacacgcacgcggatacgtcggcttacgttacacatgtaacaaaaaaaacatattggttttaaacatacgtgcgactcatagaaccacgatctctttctaaactgatgtctttcccttttgatctcttattagttgacctctcactaggttcaaccgtgctttgacaatctcttgtaagctcattatgatatttagggttggattgaacgtataatgaagggcactttaggaaaggtttgctacgagttccttacattgtcgggtccactgatggtacaagttccaacatgggacaacagtgcatacatagctgaatgcctgcatcctctatgactagacgctccttgcccacgtgctagacactcgccgtcgccgacttgcgtgacggcagtttctcccgtggccccttgatttcgattgggccggccgatcgcttcgatctataggcaggccacagcaggggcgctagctagatgttgctcgtctttggatcgtaggtggtgtcgtgtgcaagtgcatttgttgtacaactagctagacatttcctcctactaaatgtatcaaacccgatagtattaaaagttaaaacggttcaaaggaaaacaaccaccaagtgcacaaaggagttatagttcttgttgaaaattctttttatggctagtttggaaactttattttccctcgaaattcttatttttcaaagaaaaatgaactaatttttttagaaaaataaaaatttcatataaaatggagtttccaaactaacccttaatcttagttttctaatcagtacggtacatgccgtcctttggtgtcaattagataactaggattaaaagataatatagttgcgtttgataatatcaactagaacaaaggaggcatacaacacgcaatcggtgacaggcacattttcttttttcttttagggctagtttgggaacctcgttttcccacgggattttctttttcttaaggaaaattagttcattttcctttgagaaaatagaaataccgaaaatgtagtttccaaactagcccttaacggaaggtcccattttctttttcccttttctcttttctttattt

SEQ ID NO: 13300 - DNA, 5402 bp, Zea mays
aacattccggtaagcgcggagtcggcggcgcacggggagaagtcgaacagcggccgcgcgcgggaagttgctcggaggcggcggcggatctcggaggcagcgacgcgcgggtggaggagctcagtgacagcgccagtgcctatcgagctagcgaatcgaggagattttccccactgtttctttcctgctgattccgatttcacgttgaaacaccggggggagaagaattgcgggcgaccataactcggcaagaagcggctccaaaaagggcatctacctttgccgattccggcaccgatggataccgcggcgtcggggaggttcgacaagctccagagctcgttcaagctctccatccagtgcctcctcacggcctgctcccgcgaggatgtcaatgacgctttctcgtccttcactgatgctgagaaggagcgtttgcaccggatgctcacccttgtgatgaagaatctgcatgccaacgtagtggatgagtttgacgacttctgccaagaaacacaggtggctgctgcccttgaaaagatagatgactttgttgaaaagcagaatcttgatgcattatcttcagagaagactactgttgaagaaatcgaagaaaaggtatcaagagcaaaaaaggatgaaattgaatatttgactggtttactgaaaaaggttgaagaaagtaacaatgctatgaaagctcgaattgacctcctaaagaaaggggaggatctaactgctgcaagagatgtcctcaataagatgacgcagtggaactctgcactcgtggagaacattaacccttgaatctgtgtgatgacgattcattggcgtcaaaggacatctttgtataggggtgtgttagattggatgacatgtgaatgtgattcatggatcagcctggatgttctgttatgattaagaactgctatgtatcgtgcaatagacacatcgtctgtacttttgatgttattatcaggtcccaaacttctttatatccaatatgttacaatatcattttggtgactcaaaaaaaaaaaaaaaacgtgcctccagaaaaagaagaaaagaaatgggcggtggttgcccgacaagtccttgtcagccgcacagtcttcacacgaccaggggccatgagcaccactcttgccttagccacggcccacgggcagcacagcatctccatctatccaaatggcagccagcagccgtccccttcctccaccctctgccatcctcgcagtcacagcccctcaccatggctgccacactctcctccgtggctgccccttccctccccaagcacatccccgttaccagagctcagcagcaggcgcctccttccatcatctcggcatcaactgtgagtagggatgctgcttttatttctgtggtttgtttcctgtgatcgctgatgttcgtatggacgtatggtgcagcagaagactgccttccatggggtgtcgctggtggtggacaggaggtgggcggccggccaccggagaggcggcggccggcggaggctgctgcaggtgaacgcgaggaccgccgccaagaacatcgaggtggaggtcgagaagccgcttggcttagccttgggccagaagcccggtggtggcgtcgtcatcactgtaagccctctctccacttccgtttccattgcttcctgtgcttgttttttctcttcttttttcttttgtttcacaggaaaggtttccatcgctttattttattgatcataaagagttcatgacagttaagttccagcgaatcaaacagaaaaaggccttaaaagccaacagcaccactacccgaacacattttgattactttgggtcaccatcgagtcttcattcgtgtgacgaggagcatctaaacattggccacacaaggatcagaaaacagatggcaaatagactccctctcactacagaaaagacaggactggtccaaggcttctcttctcttagccaaattatacctagtataagtaacttgttcttagttaacaacaatctgaatcccagtaattttccaaactgcatggacacacaccgctataactcctctattgctgatcaccgcatgcaaagatcgcactgagtatctaccattagagctaaagctccaaatcatttgaccttcctcctcagatttacttcacccctttcattatctccagcaattcacaccagagctgcatgactctttcagacacattcctcctcaaggagagtttcagaacctccccatcccaaacctcgtcaatggacttaccatgctgttcatttataatatatataatggccaaaactgaatggccaaactggagttaccaaaccacaacaacaaagcctttgatcctcccccaaaacgaattttccccatttccaaccttccacataatccccatttcagcagcctgtatagcccacaacacccctttccggaagaggaaaaacatttagtctgttaggccctgtttggttcttctgactcaattttagtccctatcacatctgatgtttgaatgctagttagaaatgttaaatatagtctaattatacaggagatgactaaacggtaagacgaacctattacacctaattagtccatgattcgctcgtgtgatgctacagtaaacatttgttaattatagattaattaggcttaataaatttatcttatcgtttagtcttcaattgtttaattaattttataattagattatatttaatatatttaatggacattcaaacatttagtgtgacaaactttagtctctggaaccaaacactcccagtcataacctatggtctacaatcttagtccaaacagtgtgattctctgaatctggaggcaagtattgcgaacggtaattattttatgattgacttgttcctttggcatgggattattagtctgtggagtctggagggaatgcagccagagccggtctgaaaaccggggaccaggtcctgtacacaagcagcttcttcggagacgagctgtggcctgcggataagcttgggttcaccaagacagccatccaagcgaagtcagactccgtctacttcgtcgtgagcaggtacgtgcgcacttgttcatcctggctacatggtcagagcttatgatctgatgttgctaaattttagtgaaatgattatagttctcccgaaatctcaccccgagtgatctcaggggtgccgaagttgacgtgaagcgcctacctaagaggccggcgccaccccggtttggacggaagctgactgattcacaaaaggcaggaccagcataaccatggctactttcttttttttcccatccaacttgaagcctctgcccgtgttttataaactgcaaatgtcccattttttccaggagagagcaacgcacgtctgccttgattgtgggtacatatacttcctacccaagccttttgacgaacaggtaaagaactgcatagctctctatgaatcagtgtttgctttacccgtttatatatctaaccaagcactgtattttcccgttttcttctgacgaatctgaacccatcttctgtacggttgcagcccgacgactacggttgcccacagtgcaacgcgccgaagaagcggtttgcgaggtacgacgctgccaccgggaaggccatcggcggcgctctgccgcctatcgccgtgatcgtaagtttggtgatcggcatcgctggggtaggagctctgctcgtgtacggcctgcagtagcccgctcgttcttgttcagaaccttttttttttttttgctgtgctcaagaagctcagctgactgctgctgtactctgtctcacaagacattccgagtgatatacatacataaaagggaagaaggaaatacacagtatttgaggctaatggcttgtctaattttcatgcactgctggtggttatacagtcgctcaatatgagtaccgagaggtcgcatgcttttcggaaatgcttccgttgtcgatgctgctctcgtcagcatagagattttgtcacaacatttttttctaccactcaggtttcaatccaatcccaaaaaaaaaaactgctcatgataccagccatcattttgtgcttactcatgagtttgaagtcttaatggggtcgataaaaagaacatttctcttcatgaaaccgtagtttaattagtttgtgattgtaacttaagcatgagaatgacctgatctgcacaccttcaagtcgttgacttcggtcggtgtcatctttctctgggatcggctcatctaccagatcaaagttagctcctcatcgtggtggcgctgggatgggtcatctgccaagagaccctgatgggaaacggtgacggacaactttggcaaacttaggctagctccagcaagagatcctaaagggttctgtactctaaatatagaggagactttagcggctcttgctggagccagctctgaaaagaaaggtgcatatatttggtcgacatatgaaaacttccaaccgagtttgatttcaaatggactataactcaaaataaaacctatcattatttctaatctaagaacctgtaatttctccatttataagctatgtaatgagttatactagcaataaaacattaaaggatgaagttgctaacctttaaaaccctacaacgaatggaggaataaagtaactacgaactcaatccacgagcaactgagcaagaatagaaagcaactaagcaataatggagagctcggacggagagaaagaaagctagctaataattcttaaattccggctgaagccaccaacaaagactaaggaccacatagtctaatggctagggatatttagggtctatttagttcgctgtctaacttgccatattttgtctaactttttctgtctaaggttagttattcaatttgacgactaaccttagacaaagtgtgtcataattagccacaaaccaaatagacctttactttcggatggtggcgccatcgtctgggaccaaagacaaccacttgcattgtcctaattagagctaccaaccgagtaagggtctctttgggagcgttctctcgtatgctttggtcactccggctctggccacagagctaccttcgctcagctcctagaagagagccaacaactgcgagagtattatttacggaaccaagcgtagccagagtcaatccgttgagcacgtggattgtcaggtacctatcaaccaggagccggagcgccctagagctctcccaaagagaccctaaagggtgagtcgcctttacaaaagcacctcggtcccgtttgattttgatgattattaataataacataagatcattataactaaccatgctcttggatattgtgttgagttcactttgatctccgttggtgggctctatccgaaat

SEQ ID NO: 13301 - DNA, 1077 bp, Zea mays
gcacgagggcagcacagcatctccatctatccaaatggcagccagcagccttccccttcctccacccgctgccatcctcgcagtcgcagcccctcaccatggctgccacactctcctccgtggctgccccttccctccccaagcacgtctccgttaccagagctcagcagcaggcgcctccttccatcatctcggcatcaactaagactgccttccatggggtgtcgctggtggtggacaggaggtgggcggccggccaccggagaggcagcggccggcggaggctgctgcaggtgaacgcgaggaccgccgccaagaacatcgaggtggaggtcgagaagccgcttggcttagccttgggccagaagcccggtggtggcgtcgtcatcacttctgtggagtctggagggaatgcagccagagccggtctgaaaaccggggaccaggtcctgtacacaagcagcttcttcggagacgagctgtggcctgcggataagcttgggttcaccaagacagccatccaagcgaagtcagactccgtctacttcgtcgtgagcaggggtgccgaagttgacgtgaagcgcctacctaagaggccggcgccaccccggtttggacggaagctgactgattcacaaaaggagagagcaacgcacgtctgccttgattgtgggtacatatacttcctacccaagccttttgacgaacagcccgacgactacggttgcccacagtgcaacgcgccgaagaagcggtttgcgaggtacgacgctgccaccgggaaggccatcggcggcgctctgccgcctatcgccgtgatcgtaagtttggtgatcggcatcgctggggtaggagctctgctcgtgtacggcctgcagtagcctgctcgttcttgttcagaaccttttttttttttttgctgtgctcaagaagctcagctgactgctgctgtactctgtctcacaagacattccgagtgatatacatacataaaagggaagaaggaaatacacagtatttgaggctaaatttgaggggggttttcaggccaagaaaaaaaaaaaaaaaaaagcggcc

SEQ ID NO: 13302 - DNA, 1822 bp, Zea mays
  misc_feature (232)..(232): n is a, c, g, or t
  misc_feature (628)..(628): n is a, c, g, or t
  misc_feature (662)..(662): n is a, c, g, or t
gggcgagcagagacagagccatctccaaggcgttcatctgcattgtgagggaggtgcccttgatggtgaggagcgcagtgaattgggcgagaggagaggtggctatgggggtagaggggaaccaccaacgaccatggatgggatctttatgatggatggattaacgacttgctccccttccccctccccgcttgccgtgggcgccatcctcgtcgctgcagccatggcgacnagcctcctctataggcccctaatgtcgcgttttcttccgcatatgatgtacgaggagatagaaacgatatgaatgcgagaaatttatatcgagattaattttgcctcgggtgagataaggcttatccaaggaaggggaataaccatacacgcttcgcacgtgacgcacgacgacacacgaccgtcgaaactcatgctttaaaggagtacaagtacaagagagaagagaaagaaataagtaagcccgcattctccagcaacttacccatcctatctcccatcacatcttctatttcaaacttcatcatgtgaacaatataatctataaacagtgttttacatgatcatatatacgatttgcttgagacaaccttatagactttgtttgctctcgccnagctctctagcgcgatggccacgtggaggcaagngcatgttggacgttggacgcacgagttaaagcctcgtttggagtgtaggaatttcagagagattatacatgaatctcacagattcaggaatctgttcaatttcacacgaaaaactagggaaggatccaaatacttattcgaatgttaagcttttagtcttcttttttcgattgcgaacaaataggatataaaatttattatgtaaatttatattcttgtttttatcattgagcttattaagattcataaaaagaaaatcttaaattcaatctatatatttttaaataattgatataaaatttggatacagacactatttgattcgaatgttttttcacatttttcgttgcagggagaaaataataaaaaacatatataaaaatttattcttgtcatcagtaatataattaacaatatggataaaaattagcgccaaattctatgtacatttatgttaaaatattagatatatttcggatgttttaaaaaaatcacgcattcctacgttttacgtgtgaaactaacgggctcgaacccgcaggccggccggaaaacccggtttcacactagttctgtattcgtgtcctctggtctctcgcaggccaaacaaaagcgccgccgccgccggcaatgttccgccgcctcctcccccaccgtcgctacatctccacctcgcccgcctccaactccaacccgaccctctactctgacggaaccatcccattctctatcctctcgtggggccgtggcgcttccggacagctcggcggtggcaaggaggagcgccgcctctacccatcccccgtcgcccacctacttctccccgaatcagacccacgccttgctcccacccccggacgccttccctctgcagaggagacgtctggagtggaggttgggatctcttgtgggctcttccactcctcgctcctcgtcgaaggaggcgcctgggtgtggggcaagggcgacggaggccgcctcggcctcggtgacgagtcttccgccttcgtgccccgctctaaccccaatctccgcgatctccgcctccttgcgcttggcggcatccactccgccgcgctgaccacttccggtgacgtcttcacctggggttatggttggatttggagctctgcgtcaccgaggaaactgccaaaaggcga

SEQ ID NO: 13303 - DNA, 1929 bp, Zea mays
ggggtaccctcggagctgggcacgtgacctttacctaggacatcctgaggtttaacactagttctgtattcgtgtcctctggtctctcgcaggccaaacaaaagcgccgccgccgccggcaatgttccgccgcctcctcccccaccgtcgctacatctccacctcgcccgcctccaactccaccccgaccctctactctgacggaaccatcccattctctatcctctcgtggggccgtggcgcttccggacagctcggcggtggcaaggaggagcgccgcctctacccatcccccgtcgcccacctacttctccccgaatcagacccacgccttgctcccacccccggacgccttccctctgcagaggagacgtctggagtggaggttgggatctcttgtgggctcttccactcctcgctcctcgtcgaaggaggcgcctgggtgtggggcaagggcgacggaggccgcctcggcctcggtgacgagtcttccgccttcgtgccccgctctaaccccaatctccgcgatctccgcctccttgcgcttggcggcatccactccgccgcgctgaccacttccggtgacgtcttcacctggggttatggtggatttggagctctgggtcaccatgtataccatagggagcttttgccaaggcaagtgaatggcccttgggaagggaagataacacacatttctactagtggagcgcatactgcagcaatcactgactcaggtgaactttacacttggggtcgtgatgaaggtgatggtaggctggggcttgggagtggaggtggtccaggtgaagctggctccctcagcgttccttccaaggtgaatgcactgcctgttccagttgctgctgtagcttgtggtggcttcttcacaatggctcttacttcagatggacagttatggagttggggagcaaattcaaacttcgaactgggtagaggaagcaatttcagtgattggaggccacagcttgtccctagtctgaaaagcacccgtgtaatccaagtagcatgtggtggatatcattctttagctttgactgatgaaggcgaagttctctcttgggggcatggtgggcatggtcaacttgggcatcccacccttcaaaatcatagagtcccacttgccatcaaagctttatcagatgagcgaattgtccatatagcctgtggaggatcaacctctgctgctatatcagagaaaggtgacttgtacatgtggggaaatgcaagagactgccagctaggcatccctggtctgccagaagttcagccactcccagtcaaggtgattttcctcagagacgatgatgaagggttgggcccttctcgtgtcatctccgttgcaataggagcctcccatgccatgtgcttggtctccacgcaacaaaccgagaagtagggcagtctgggtttctgctttgtgaaggcacttatgtttcggtattcatacgtctgagtcagttcgaagcggaccctgttctcttctgatttgatccagctgttcctgttggtggaaactggaatccctgctcggttaagctgaacacatctggaagaaagaataaaaaaactgccacacgctgatagaaagcaggaaaggccccctgtggctggctccgggtaggcatagctgtagtagattcgaatccttgaatttcatctgtggaagttcttatgagtgtagacattgttcttgctttttctgtagcactgtaatacgagggacgaaactgcgagaagcgcggatgtaagacatgcgcccttgtgcgttctcaccaaagatttgtagattctgtcaaaaaaaaaaaaaaaaagaattttgtagcgctaattttattgtgactctgtcaggaggcctggcctgattttagttgctgttcaataaaggcaaccgttggtgttttattc

SEQ ID NO: 13304 - DNA, 1013 bp, Zea mays
ggggcccgaggctataacccggactcctcgccctcgtacctcgttgctggcgaagagcgtcatcaatggcgagtggaggttcactacacagaggcccgccggatcttggagcatcattcgcggtcttggcgcgtctacgcaactgtatcctaagggcgtcgaagaggagagacggtacgccggtggcgacaaggtacgatagatttgaactggagtgtggaggtatcgtcggccagtgccatcagcgatgggtggaggtttccgtcgagtcgaggaaggagcgcttcgtgtaaagatgttgcttgtttattgttattatcttatcggaagtgccgtcaaggaagatgacgatggtggtagggatcgacgatagcgagcacaacttctacacgctgaagtgggcgcactgcagcacttcttcccgccgaccaagctgcaacactactgccttgttgtcgtcaccgccaagccctctgtcgcctccattgttcgccctgccaacctaggaaatcataagtggagattgaagttgatcaacttgacactcgaataaaagaatcaacaaatattgcaagtgctgaaagttgtgactgctcaagtccaattgctttatcacacaagttctggtggagatacttattctagaatcttcaaaagcatcaacgttagtgttcaagggactgattctggactttcaacttaccggccgggaaaaaatctctacctgttgtcatactgaagctactgctcctggaagagcatcaccaacatatccctgatggccctctctgcttcatgctccaagcacttggatgttcaccttgaaatataattattaatagggactgtccaaatacttcagctaagcaaaatagcgacctccataaaaaagcaacctgtaactatctctgaaaattttgaaaaaaactgatggtaactgataagctgctgctagcaactaccgtcgcctaaaaaaaaaaaaaagcaaaaaaaaaaaaaaaaaatttgcggcc

SEQ ID NO: 13305 - DNA, 2002 bp, Zea mays
cctgccgggaaactcgaggccggccgggccgggccggaggggcaaagctgtaaacttgagctggaagcactgcgcccctgtcttcacaccagtttgctgtttctttttcaccccgagcgcgagaactagggcgaccgcagcactacgcccctgctgcccatgtcttcgtcggggcctttgccggcgaccggaacccaccacggcagtcaaagggcagagtgtaaatcccagggttccacttctgcacgcaaggtacaaaaggctgatcgtgagaagatgcgaagagataaattaaacgagcagttccaggacttgggaaatgcacttgatccagaccgtcccaggaacgataaggcaactatacttggtgacacaatccagatgctgaaagatttgactactcaggtgaacaagctgaaagctgaatacacgtcactttctgaagaagcgtgtgagttaacacaagaaaagaatgagcttagagatgagaaagcttcactgaaatctgaggttgataatttgaataatcagtatcagcaacgaatgcgggtgctatacccatgggttggaatggagccttctgttgtcatggggccacctcctgcatatccctacccagtcccagttccaataccctctggtgctgtacccatgcatccgcagttgcaaacataccacttcttccacagtcaagcttctggaaccatcccaaacacatgcatcccttacatggcatatacacaaccctgccatcctcccactgatcagccgtctaaccaacttaatactccagttgcccattcaagtagtcataggtctaactctccagctcaagactgtagaagcaagtcatctacattgcagcaaccaagctgtggagtgagaagcagtgatgctggtgatattgctactgatctggaattgaagactcctggttcttcatgtcaatcacatgcagagattgcttacaacgattcctcttcggatttgaaaacaaagaagcattgcataaagcagattaatgattgcactctcactgaaagcagtagttcaagcagatgctcttccaatggtcccccagatgtttctaatagtgctattgatgaataagctgcttgacgaccgattaacatacaaaccgttgactggtatagattgagaaaagatctcgtttaaccacccataagtgagctcccaactctatatgcagtgtaatttgctattgttgctagcttatttacatagaagtggtcagattctaatgtgatgactcacaaattgggaggcgtggactttgtagataatctcatgattgttagtggtaaaagtttggtggaagggaaaaaaggagagaacaaaatcatagacagcagcatctatggtggttcggtagggactccaggactaggtatggtgagcattgtcagtgttcggcatggcaggtagatattcataataactggattctagtaccattgcatagttcgtcctagactggcattttacataaatttctgtgtcaaatatgtaaataactcgagggcggataactggatatatagtgtctatgttggcctattcaacttgctgggtaacgccttgtttgggagcaagtgtattggatgggattgaggggtctaaaatcccttactattaggggtgtttcggtagtgatcaattgcatctgaaactgctgcagcttcaagcttgttgtgttggtgtctagtgtctgcatgagtttgttccttggctacggtagctacagcatgctttactgaacaagcccttgaagtttgtacattgagctttggtatatatttgcattggactatagtgcttggtgctgtcctattattctcacattacgtttaatggtaaattcgctcacttgtttgagttcgaaggtagatattgtgctttgaggcaaccatggttttattaggcctgtttgtttcgttggaattgaattccattctaataattataatttagacaaaattaa

SEQ ID NO: 13306 - DNA, 1205 bp, Zea mays
aattcggcacgagggccgatctcaaccagcacctcttctcggcgttcatcgcacggcgctgccacggcccaggtgaagccgccctcgaggcgcctctcagcgtacgcatcaaatccagaacgccgcggcgacgcgcggaatccacgaccacgaggatcctctgcaggggcgcagaggcgcagcagggctctggaggagggaggaggagggagccgctgcggcgcggggccgtcagcgcgcgcctcccggtgccggaccacatacgccggccgccctacgtcggcacggccgccgtcccggaggtgtgccccgaccggcaggtgcacgacggcgagagcatcatgcggatgctggacgcctgcgagctcgccgctcgggtgctgcaccatgccggggcgatggtcaagccctcggtgacgacggacgagatcgacagggctgtgcaccagatgatcgttgacgccggcgcctacccctcccctctcggatacggcgggttccccaagagcgtgtgcacgtcggtgaacgagtgcacctgccacggcatccccgactcacgcgagctacaggatggcgacattatcaacatcgacgttactgtctacttaaacggataccatggggacacctcgaggacgtacctgtgcggagaagtcgacgacgcaactaagcagctcgtgaaggtcactgaagagtgcatgatgcgcggcatatcagcctgcaggcacggcgccagtttcaaggaaatcggccagagaataagtgagcacgcggagaagtacggatacggcatcgaccccttcgtggggcacggcgttgggaggatgttccactgcgagcccatcatatggcatacctacgattacgagcccgggttcatggtcgcaggccagacattcaccgtagagccgacgctgtcgatggggagcacgcagtgcgtggtgtgggacgacgggtggacggccgtggcggcggacggcagcctcagcgcgcagttcgagcacaccgtgctggtcaccggcgacggcgcggaggtcctgaccgggttcccgtagctgcctgcacgcatcacgtgagcggtgagcctgggtgggccactgcgtcggcgagggacggaactgcaggagcaggcatgcagctatgcgcacgctgacaattttattaaaaatctatgttggacggttgccgtaaaaaaaaaaaaaaaa

SEQ ID NO: 13307 - DNA, 1907 bp, Zea mays
  misc_feature (1639)..(1639): n is a, c, g, or t
ttcgctcggctggaccggtccttctgtcaagtctccatgcttatcattcgctgctcccggtcctcggcacgaacctgtatgacctacacattcgtcgtcgaccactgtccatgtgcccacacctgcacaccacaagccgacagacatgattgcacaacacatatattcaaaccccggttagtccacgactcaacctgagatggaacccgttgacaatcactcatcatcaacccgaatttaataaatttaataaaacaataactatgcaagataaatattaatattttattgtataactcaacatgacacactacccgttaacaattactcatcatcaatccgaatcataaggaacaaattaatattggtttcgtatttaataaatttaatatgaaaataattatccaagataaatattaatattttattatatattcaattaaaattaaaatatatttgacatcttggaaaccatcagcacagatgaaaagagacggagagggagctgtagagataagacgcaacatgtcagctgttggatgattagcgaggcatattattgaggtgggagtttcagaaagtagagagcaaatcaacaagttgaaacaaaacgcacaaagagaaccaagatggccccagcacgaaaatcgcccaatacacctaccagcccctccaatttataagtgcccccgctaggtggaagacgtccaatacgcatccaaggcactaggcagcaccaactttcctagctaatttgcaaatcgcgtggaagagggagaaagagagatcagcgaccgagcatggacaagagggcgtcgtccacctccttgctcgtgctcatcagcatcctactcgctctggcagaccccgtcgcagcggggatgaaggccacgttcgcggcgggggtgggcgtcgccgccgacacggcggtgctgcggcatctgatgacgacgaggctggaggacggcgtggcgccggagctcacggtggatgtggagcttcaccgccgcgtcctggccggcggcttcgtgaaatcaaacgtgctgaatccagacaaggcggcctgcataaagtcgtgcccagcgcgcgggcggccgtacaccggccggggctgcagtaacatataccagtgcccccactgagctagcagctccacaagtgattgctctgcccacgggtactacacgcatgcgtgattgttgatcggttgtgttgtgcatttgctggttggttcgaccatcgagatcttggttgctagctagtagcatgtcttgaaataattatgggattatttacttgattgtgtcagctaattgattctgttattgaagtatatggcatcttgcgaagaccttgcaaagctgatatataaactgaatgatttctcttgcttctcaaaaaaaaaaaaaaaatggccccaggcccgtttgtcttgatcacatagctagcaatacaaatcatcagagttacaagtggattgagatagactgaaagggattaaattcctttctattcaattttaatcaggaggattgcccgttcggttgacatggaatggaagatcgaaactgttcctaaccagattgtttctgtaattagtataagttttaatcaacagaaacaattcttgttgcattcntgcagaaacgaacgggccctaaaaaaaagttatgcatttctctccacttgatcaccgaccaccatgcttacacatgtaatttgtaaatgaggttatcccgcacaaactatcgaggaccagcaaatgcatgaacggactaaaaatcagaatgcggcttagcggcatctgaccagacagccgcaaatatggtcatgatgagcttgctttagcccattttccgtcgggcatccacccactttttgagcttagtgtgcgatccacgagcaga

SEQ ID NO: 13308 - DNA, 2149 bp, Zea mays
aactcgtcgttctcgtaggcagcgcgccagcgccgccgtctactctcctttcttgccgcgcggcgccgccgtctactctcgctcaccggaatgccgtcccagcctcagccgagctccatcggcggaacctcccagaccccggcgccgttccagaccgcgcccgtcttcaccggcggaagcccccggaccctggcgacgctctccgctcagtccgtcccccgcgtcacgcggagaagcattgcgctcgtcgattggtgtttggagagggtggagggcgaggagggcaagatccgcgtcgctggaaccacctacaccccgcaaacgagcccgcaaacgaggcatctcctccgcggttccatttatcgatttcgttttcccaattaccctcccaaatgtgctttagttgtacatcctgtttggaaaattttgatagctttcttttcctcaattaagaaatttagtagatcggtaaatatgatattttctttggcaatttgagaaattcaatggtagcaagggaatgccaaaagatttccatcggtactccacaattaatctcacggtgctgtagcctactatgcaaacaggagagaagcatcgtcctcaaagggaagcaggaaagtggcaggccgagtgttcagatcatctgctattgttaggcgccatgatcacttcagaattatgtccgaggatggttacctcatacggataggctgtctcttgaatattcccaaaacacgtaacaatggattttctgaagaggtgtgtgaatgctttgagtttggctttccaattcaatggcacaggcttgttaatccaaagatggtgcccgataataaacatgcactgtcaccatcagaaacaactgctagtgcaccaagtcattcagttggatattacatggagaagttcttaagtgacagtttttccaattctaacagatattctttcacagagaatgattcttacacatctgtagtgtgtactggcagcagaaatggacttactacccaaaccctttcaaacttaccagatgataatgcaggaaacataactgtatcttggggattatatggcctcgggatggacatgtctgagaaaccttggacaccacctgcagaagcgtgtaataatagacaagaaagtgatcaacatgaaagtatgcaaatagatgcatgtaaacaagagttagttaatcgctccatgagttctgtttcagttaagcaaagtataagttccatcagccccaactcaaaagtagacggcaacagaattgtaccatccaaaattatgtcagttgtgaatgaaagttacaggagcacagtaggttgtggtcaggctgaggaagacgttggtattcagcaagagaaaaagcacagctgttcaagtgagcatggaatggttactctttctattaactgtacatcctctcaactaggtgcaccaggaattccaaaatttgggaaagattcagtgaacctttggactacagatgcattagaactatcaactgaagggatgactccaaagattggagctgacagtactgacaggagattacgaagtggcaaaattcttggaatgccaagtggtggactaatgaatagaggccacaagctgaaaaagatcaagcaggaagcatccagtaaacagatggttaatcaaggggctacatgcactgtggatctgacttctcatgaaaatgatttttcagcagctgagattgtcgttgaagaaaagctggaatcacatagttcatgccttaaaggacgaggaggaccagcgaaggggaagaggaagagggagagatggtaggattcagcgtgtctgttttcaagccggatgtgaaccgtgtttcagtttgtttctcggcttgagtagctaacttatgtagatgggtcgtgtgtgccagttccatgagcagatggtgccactaagggtgtgtttggtttgaggtcaaagtaggatgagtcaggggcgacatcgttccctcgactttttgggatcacgtcgccacaaaaaactactccggggtttttctcgctcatgcgtgattctcatccaaacactgttgaaactgtggtcactctattccattcctccatttacatccaaccaaatacactctaatttaaaaaaaaaaaaaaaa

SEQ ID NO: 13309 - DNA, 4939 bp, Zea mays
gttttgtggtacaaactaggctgctagagacaggagagagagaaaaaaaagagagagaggcctgtaagcctgaattttggcataaacagactatattctgaaaccaaaagaagataaagccccagcaagcaagagaattgcatgtgccagtggtgcttctttttcagagtccagacccatgactcctttagcaaacttatgatgtgctgcagaccatacagtgccaatgcaaaagaatgaacacctcaaagaaacacagggtacttgtactgagatgtataaagcagctgcggccaaaagacagggagaggaggaggaggagctcttcttgcccacatccctttgtcaagaagaatctctgatgcttgcttgtttccatgtgacagggaagcttggtacttactgctctctttacaaaaaaacaaaacaaaacaaaacaaacaaacccccactggcagaatagaattgaatagaatagaatagcctttgtttcccctcccccaaaaagctaaagttctcatcatgcttaaaaccgtcttaaatagcagtgcttagaagaagatagggcaggccacctccccctagttacacccagcatcccagccagacccaccaccccacgatgcacctcttgtctgttcctcttcctccatgcaatgcaagtatgcaacgcaacgcatcttctgtttgcttgccgccgctcccaacacgtcgctatcgccggcctcttcgggttcggaagcttccacgcctcggcatgcgcgctcccgacgtcatgctcgtcccggcgatcgtcctgacttgccggttcctctgcaggatttgaaaccgggttagaagctgaagctgaagctgaagcagggactgagacagcagcacagtctttgtttcggcaggtgatgcactgaaaccgttaaggctttcctgtagtttaccatcatgatgaaccgtgggtgtggtgctgtgctgtgctttgttttgactgctttcatggatgtagactaatgatttcaggaatgatatgtgcatctacgttgctcactgggggaataggacttgtgtggttgcttttgctgaaagattatagcatatcatcataggggaatgtgggagtggtgagggaaaaagagcgcatggcatcttttgctcatatgcgtcgtctccctttgttttttcttccctctccctgcgttttatccgttatcatttattttatattattatgaaaagtattgttttttttttttttttttcctgacctatcctacgtgaaaatatccaacaaaacatggtaaatgggagcatatggcaagacaaaatgatcacaacagacgcactgcaaaacattcacctttgcataccaccagtcagaaactggtgaaacaagaacattcccttcattccgtaacgcaagcttaacaaacaaacaagccatgacaaaaaaaaacgtcaagcgttggaattctgctagttcaagttaggtgaaggctgcagcatttggcctcatatcgtacgtagtaattttttttgaaaatcctaaagcttctagtttcaagaaaccagtgcattgggtacaaggggaaaaaagggggggccaactcaaacaccaaaaccaaagcttgcagcgcagtaagctgtacgtagatcaaagtacctgttgtggataggatcagggccattgggcacccttctcttgctgtcctggaagggatcatgagccttgaaatcctccagggtcctcagccctccggcgcctccgcccagcatcatcctcctcccgccgatagccgccggcggagccgctttcctgacgccgtccacgacgaacgacaccagaaggagcgctccgaacaagatggccaatgccgctggcgccgcccgcctcacggacacggccgaccttctcatgacacccaccgaccagtcgtccgtcgccgcgcagcgcagcgtcgtcttcttcttccgtagagcggcctcctcctcctcctctcctggcgagcgacaacgctggtcttctaagagcttcttctcatggcatggggtggcgctaagtgtgatgcaacggctgcggctgcgcaacgtgactgcatattataatgtggggaagaagtagcggcaggatttgtgtcagtcgctgtcgcgcgggtattcctgcttcttgttctgttctggccttctttcgctttggcccgattctgctgtgcttttgaaggatgccctgcccctaatggaggggagggggggcagcagagagtagaatcaaagcaagctgagccacgctcgcttttctttctttttttttttttttgttgcgctttgctttttgagccatgttgttttcctcctgcctttcccttttttttaatcccccttgttttttcttcttctcgtgaagagaagaagggtaaaagacggtggataaataataaaaaaaagcattgctatccgatccttaaggctgcccctgttctccttctccctcaagtagtagtaccattcctgttgtgaggtgaattcaggtcacatgtgggaaaagaaaaaggggaaagaactcatctttgagtcattctaggagagaagcagcatgacgcatgagagatcgcagccacggcaaaggtggcgctcaaaagcagcggctctccaagtccaaagtgagctgctgcagcagcaccctgaagaaataaacttcgctttcatgtgatctgtcacaatccttttgagtgtccccttttttctctctcttttactttgggtgaattgatgcaaatgctcttccatcacgaaccgaaactgtggtttttttaaaaaaaattctccgctaagtaaagtgaatttcaactttgatatggtattctgaacatgctcactgaagcccatccgtttcgaatattatctgtatcggcgtgaccagatcttgttggattgctgcttccttcgtgctggtgcccgtgcccgtgccctccttcctttctttggcagatcagagcttgagacaggaggccgaggccattctatattgtggaaagggccaatgcagttggttatttgggagacagcctgacgcgctcgctgtccttaaacccactgtgaagcaagacaacaaaataccaaagcaagcaggaacaaacagaaagttccattccatggcatggcatggcacagtggtgtcaccccgagccagcctactgtggcaggcagtaagatcacaaatcacagcgtctccagattgcagtaaaaactcaggtttcatggaaacacggacagacttgaaaacctctaaacattatgaatgccatcaccatccataatcgcaaaaaatccaatccaatccaaggccgcggtccaatccatgcccatcctcatccgaatttggtcctgcgctggctcctcccaacggcggctcgagttgcaaccttggcatattacagacagctcttcttgtgctgagttactgacctgctgactgctgagtctcgtgaccgggctaatatcgcatgagtaagcctgatgccgcccatgacacgcaaatctcgcttttctgatgctttttttctttctctccccacatcaatccacttgggtgcagaccatttctcaccctccctaagaccctaaccttacaaccctacaggcgacaagaaccgtacttggcagtaggtgtgggctagcaggccgacggatatgggcctaatggtgtgggcaaagatgtctcggaggaacatgtcttgggccccagcgtaaggccctgtttggaatcaacttagttttcaagtctctagaaactggtttctataaaaagaaaaaaactgatgatgtttggagccacctggtttctataaagtagttttatctagagatgactagcttcttagtttttaagaaactggaaatcaagtttatataaactggaggaaaaactaatatgtttagaaccgccacagttttataaaccaaatttttaagaattggatgcttccaaacatgccataagttatttacagactcgtttgtcagagtttcgctctatgattctctatttccaagagctgattctctaatacatttattttgaatgattctctagcaaagtaatctatgtgatgaaaaccaattggtaaatagtctgtaaactcatttctaagggtttgaagagtggagagcagatttccaatacaaaatatagactagattcactatgttctcacaatggagcagctcagttttttgttgtttggctgcgcatgagtggttctcactagagcgaagccgtgggaactctaccaaacacccctacatgtatatttccattccgtggaggttcctatgcaacccacaatttgataatctagtgtcattaggtattggaattctatgtattaaatataggccttaggcataatggcacaatcacaaagtaagcgggaatatttattaaagacactttcaaaataccaaatacgctctaaaatgtttgataaacacaattgagaattagcacacatgagaagagatgagaaactgttattggtatagcttttctgcatccaaccagacctgatcatggaccacctgatccaaccaaccggacccggctcgtccgatcaaaactcggcccgacttgatccgaccaatacaacgggcgggtacgtaccataatttttgatccataataattcacgggtcgggtatggatcatgatttttgacccaaaacccgacccaacccaaaaaaaaccgacccaaagccacaaaactcgacccggcgtttgaacaggtctacatctaacgaacatctcctagatatgcctcgttatacgtgtttgaagaagcaccaaataacacactccactgggaactgaaagggaaatgtgcccttgggccatttctaagtattttggtgattgagtgtcaacacaagtgcttagatgtgaatcaatacc

SEQ ID NO: 13310 - DNA, 2449 bp, Zea mays
accgaggacactgtcgtcatactcccggcccacctccccgagacgccgcattggatgctccctccgctcgaatctgccgctttccattatcgctgacccaagcaacattctctgcttcttggcccttgccttcttggttcgccctcccgcaatctctggttctggcctctgggcatcgcgggagtaaggcgtttcttggttttcctttcctgagatgggtctgagaaagagaaacgccatggttggtgaggcagccgtgttcgccgcatcttggtagccctcactcagcattggcatcctctcgttcttggacttggagttaactcagccatgaggaagcatgggtggcagctgccgtaccaccctctccaggtggttgcgatagccgtgttctcggcactggggttcgccttctacgtcttcttcgtgccgttcgtggggacgaagccgttccagattgtggccatggctatctacactccattgattacatgtgttgttgtgttatacatatggtgtgcggcaacaaatcctggagacccaggcattttcgattcaacgaagaatttgaagttagataagaatgaaaagcactcctatgtgaattcggatcaggggattaatcatggaggaaggccattaagtgagacttttggtactgctgataacagtgagaagctgagcagcatgcttgagaggaacgattcgccttcttggcccagattttctggaattatctccctggtttgtctcccattctcttgcctttgcaaacggtgcctccattcagacagtctatcttcagaacacaaaatgtgtgaagaaggcatgtttttctgcagcttatgcgaagcagaggttttgaagaacagtaagcattgtagagtatgtgacaaatgtgttgatggctttgaccatcactgcaggtggcttaacaattgcatagggaaaaggaactacaaaggtttctttgttctaatggcttctgcagttatcctgcttgtgatgcagtggttgtcggggggacttgtgttgattctctgtattgtgaagcgaggagaattctccaggcaggttgtcacaaagttgggaagcagcttctcaacagtggcttttgtaattgttgtggcaacttgcaccattttagcaatggttgcaaccgtaccacttgcccagcttttatgttttcatgtccttcttgtgaaaaagggaattagcacatatgattacatcatagctttgagggagcaggaggaacaacaagaggttcctggacaccaaagcccgcagatgtctattgttagttctgttactggttttagcacagccagttcttttgggcctcttcatcgtggttcatggtgcactccaccaagattattcctggaagaccagttcgatgccattcctccagagattggcatttcacggaattcaggcagtaagaaaactaaggaagaggaaggagcaaggagaaaagctggagcagtgaaaatcagtccatggacattggcgcggcttaatgcagaggaagtctcaaaggcagccgcggaggcaaggaagaaatccaaaatcctgaaaccagttggaaaacatggcgccccagagaacagcagcaaaccagaccatttgcctagctacaagagacggctagacaggagaggtttccctgctgaactctctcttgacccacttgcaactctatccgcaagcggcaccgaaagcaactacagcgacgcagcaacagaaatctgtggcagtctagccccgttacagctcgaagcgagaagtgctttccaaccgagtactgcagcgtccacaagaaatgttgcttcatcgcctgaaagtagctttgactcaccaaatctccaccccttccgcacttcctcggccacagctgatgagatgcagggagccatgatgcatacagctcacaggggcatcgagtttaaaagatcgtcaagcgatggttatgaagcatcaggaggtgaagatagcgaccgcatcccttcaaggatcgtgcacaggtcgtcaaactgggccagtgtctttctgcattctggtcagggagaccctccagctgatctgctgacgacatcagctgaaggttttgtagctaacgactctggttcctagagcaggcattgctgggtatgacagagcgatgttgacaagacattgactagtatctggcattaggtttaggtttaggcgcttaatttgtctgattacatgcggggatttggattagttctaggggccgattacatgtctgtaaaactgccttcttgctggtgccacttttttggcattccattgtcgccttcggcaaaatgtgaatttgacgccattgtgcttgctgagcttgatccaaagtactgtcgctgagtagtcttttgtaatcacatccgagtgagattaataaggtgtttggctcggcaaaaaaaaa

SEQ ID NO: 13311 - DNA, 3524 bp, Zea mays
ataggtgggaaccgcttccagagataacagatttgattgagctttttttttttaatgaaggaatctctgacgatactgattctgagtacaatggcatggatgagtattcaagtgaaggagaacaggatattatgagtggtgattcttcaggtacttcatattcgagtggagaaattgatgcagataaccctgatagtgctcatctccgccgatcaagaagaaagaagaaaaaatctgaggtaagtaccaactctcaagatcatcctatattacttggtgtcgtgttctaagtttcgacatgttttctttctattacatcttctgcaggctgatcttgttacttcatctggtcggcgagtcattaggaaaagatttttggatgatcctggtgtagccacagtgtcaaggccacatagaggaaggaaatctaggaatggatgttctagtaaaaagaaaagatcccctaaatccaggggtttgcgacctcggagacgtgctgctgaaaccgcattaattactttcccaaagaaaggagtttcaacagaagaggatgaagatgactccgagagtttctcagatagtgaattgaacacggatagcactgaagctgaacagttagaatggagtggtcagttaagaactagaagagagattaactccccatttgacatcgatgatgttacagatccttctcagtttactgataataaggaaaattctggaactggtaagaaactagttctcagaataccacgacgtgatttaagaactcaatttcctttaggaagcggaaaagcagaatgctccatacaggataaagcagtgaagtctctttctctagctaatcatgaaccagttgagcacgaactgactattgaaccaggacattcccctgcctccaaggctgaattaacaattgatggtgatctgcatgatagttctgctgtttgcagtaataactcaattaggtggggtgaggttaagatgcgatcctcaaagcgttgcaagtacagtgagccagctggaggtttgtggtcctcttcaaataacgttgctttgcaggatatcgagggatcgagcagtcagcagatacctcatgaatatggcgatggcatccagccaagtgttgtgcaaaacgtacaagaagtgcaacatggaacaattctagataacattccggaaaacaacagtactgatgaacacactagagaaaattttggggatttagaaaagatagctaacaatattaatgctcatgcagacggagtgaatgacactgtacaagttcccaatacttctcagcctcaactaaaagttaagtttaagtcaagaggctctgcagatgcagtaggaaatatcatgaactccaagcatgtcaaagattcagtgcagtgtggcgatgattcttccatcaatcaaccaagaaatgctgacttctatattgtgcccaaaagttctcaggaatgcctagataaaagcactagtttgcatgattcaaaaaaaccgtacttggatgcttcaaagaagtacactgcagtgtacaaaaggtcaaagcgaaagaacaagaaaaaaatggattcagatgaatgtccgaacgaggatagcacttctatctccaatgacgatggtggataccaacctgcagaatacagtcctgttgcagctgcaagcagtagattgagaagaagtgctaggaagtcatttgcatacaatatcaatggtacaacacaggatgatatctcggaagtgaaagtttcttacggttcccatgaagcatcaactagtggaagacgagttgtcacagatgtgcgtgaagggatgtggcgacaaaactcaagaagtgttggtttaaggtctgctaggaacaaaagagaaagtaacagcttccttgatacacatccattgggtagaaggcaccaggtttcttttaagtattcatggttaatgttgcttgagcatgaagatagctaccgttatattcctcaactcgatgatgaggttatgtacttggggcagggccatgaggaatatcttaaacaagtgcaatcatctgaattttgcccttggaaccggataaaaggacttaaagctgtagaactttgcaaaatacagggtcttgattatgccacctacagaggatctggtgaaagctgctgtaaattaaccattgaatttgttgattgcacgtccagtggatttggcaaaacatttatgatcacgttgcgtgagctggtcaactttccagattttcttgtggagagaacaaggtacgaagctgctatggagcggaactggacccacagagacaagtgcaaagtctggtggagggacgaagaaggacaggtaggaggaacttggtgggagggacgggtgatggcagtaacacctaaatcacctgattttcctgagagtccatgggaaaaatatgtcatacagtataaggaggatggttctgatcacgctcatagcccctgggaacttcatgagacaggcagtttatgggatccatggaaacatccacatatggatctcacggttcgagataaattgttatcagaaatggaaaatttacaggaaatgtcacacagggatcaggatcattatggtgttttaaaactggacaaggttgcagaaaagtcagatttcatcaacaggtacttctaatatattgtttttaacaagttttcaccgaattataatttgcaaggcaatatttgttgaagttttcttcccaaaagtttgataaaagaattaatttgatacttcgtttcttttttatttcataatatattcttttgtcagacaacacagaaatttaggagataccatgcacggagtacattactttgatttttgttgcttagtacaaagattacaaattaatattatacctaacagtaatgttcatcttaactgactcctagccgtacaattcttgccctaggtttcctgttcaattttctattgaggtgatcaaggcaagattagcgaacaaatattacagaactctgggggctgtcagacatgataccactgtgatgctttcaaatgcagaatcttacttttcaaagagcagtgaaatgaccaaaaagatccgcaagctctctgagttgctcgaccagatcttttcatcactgtagggaacattgcttgatgcctgattgacaatttcccttttcgtttctgcaaaaaaaatttggccttaggcatcgagatgatttttactggtcctactgaggcattagagaattagccaaagtagttctcaggacagaaagggtttccggtgtagctccaaccagttaaactagttgctgatacaaagtgctcgttgctaacacatttgaccgtttgatctgttgtcaagatacaatggttcatcctattggacatgaaatattggggttttgttagagaagatgccaaggtgtaaatctggtggaggaaatgcattaactgataatttcattttgtacagacaccctcagcaataaaaggaaaacaagaaatgtgcatcgttgtct

SEQ ID NO: 13312 - DNA, 914 bp, Zea mays
  misc_feature (14)..(14): n is a, c, g, or t
  misc_feature (26)..(26): n is a, c, g, or t
gttcctttgctagnacacggaccagnactagctcaggggccagtttcctgctgatgctgttcagggatgtaatacccaagctaaagagatgctggccttagggagctgcatagcagagacatacctgtatcagtatcacacgtcggttccagagtccgagaccgggggcctcacgatgcggcgaagcgtgcagtcctgaagaagtggtcacagctagagcgtccagattcgttcgattcttgcgacacttaccactcccataacttctcgaacgccatgttccttgggggtactctctcatcgaagaatggcttcaagctccagggcggtcataatcaagaagagaaggtcgagtactcgggccctttgttgtcccagtcgcacaaggtcgatgaactgttgcagaagaacgagcgccacatccggcaagctgttcgaacatcatggttcaggagaggaagaaaggtggacaagtgaggaaaagcttgaccatttctttccatgggagggcttgtgacgcttagagaaaggggagagcatgtcattagcttctgatgggcctctgctgccaatctgggaagcgggcaattgctgctgacgagtccattgttaactgaaaacatcatcaactttggtgatcctatctcacagcaaaacaaaattagctactgtgccttgctgcttctggggtttgttgtagattccccgaagtgccgtatccttttttttttgttgtacagagaaatattagcggctgactgacggggcggtgtggttgaacagaagattgtgtagttggaataaccagtaactaagctgcacaacatgcatggtcggttgtagtaaaggcagcctctgaagaaaatgagaagtgaaatccaataactgttcgttgtctaaaaaaaaaaaaaaaa

SEQ ID NO: 13313 - DNA, 1705 bp, Zea mays
  misc_feature (1656)..(1656): n is a, c, g, or t
  misc_feature (1674)..(1674): n is a, c, g, or t
  misc_feature (1679)..(1679): n is a, c, g, or t
ttaggttctgatattttttcttgcttctgaacgtgtgttccacaaattgaaaaaaaaaaacttaccttatggctttaagctgttccagtgcacaatttaacgactggaagttgaacatttttttgtctgacgactgccatagtcaataacaacgacattcctctttttttttgtctcagaagaaaagcaagtagcagagggcacgggacagaagcatccaagaagtcttcaaggctcagtagagcagcaagagaacctagtgcagtccctaagcagataataagtagaacagaggtaccatttgttttcctatggctggataccttcactgaatgttatgaacagagagattcggccaagctatgtgaatacttgagttgatggtaacaatactcaccaaacctcttctcttatgcttgtattctgtatttcaggaatccaaaactaatgtgaatgcaaccaaagatggtacaacacaggaccgtgcgaaactgaatggcgatgctaggctatttgtggacatacaaccagtgtcagcggctcaagttaaagagagtgctcgccacgttaagaatgaatcacgagagcaaatacctttctccgggccattgagtgtttcttcatctagtggctttgcatgggccagaagaccacatgaggaccgttcctttgctagatcacggaccagatctagctcaaggggccagtttcctgctgatgctgttcagggatgtaatacccaagctaaagagaatgctggccttagggagctgcatagcagagacatacctgtatcagtatcacacgtcggttccagagtccgagaccgggggcctcacgatgcggcgaagcgtgcagtcctgaagaagtggtcacagctagagcgtccagattcgttcgattcttgcgacacttaccactcccataacttctcgaacgccatgttccttgggggtactctctcatcgaagaatggcttcaaggtgcgttgagacagtcatttacttgatacgggttcctacttttgttatatcgaagtcgttgctaacgtgcgagcggtttaaagctccagggcggtcataatcaagaagagaaggtcgagtactcgggccctttgttgtcccagtcgcacaaggtcgatgaactgttgcagaagaacgagcgccacatccggcaagctgttcgaacatcatggttcaggagaggaagaaaggtggacaagtgaggaaaagcttgaccgtttctttccatgggagggcttgtgacgcttagagaaaggggagagcatgttattagcttctgatgggcctctgctgccagtctgggaagcgggcaattgctgctgacgagtccattgttaactgaaaacatcatcaactttggtgatcctatctcacagcaaaacaaaattagctactgtgccttgctgcttctggggtttgttgtagattccccgaagacgccagtgccgtatccattttttttgggggttgtacagagaaatattagcggctgactgacggggcggtgtgattggacagaagattgtgtagttggaataaccagtaactaagcagcacaacatggtgcggctgtagtaaaggcagcctctgaagaaaatgagaagtgaaatccaataactgttcgttgtcatcntaaataatatttttatanaaatntttttatttttatttttttttttata

SEQ ID NO: 13314 - DNA, 3185 bp, Zea mays
gtaagctcggaattcggctcgtgagagaacctagtttatttcctaagcagatgttttctggatctgggggatccaaaactaatgtgaatgcaaccaaagatggtacaacacaggaccgtgcgaaactgaatggcgatgctaggctatttgtggacatacaaccagtgtcagcggctcaagttaaagagagtgctcgccacgttaagaatgaatcacgagagcaaatacctttctccgggccattgagtgtttcttcatctagtggctttgcatgggccagaagaccacatgaggaccgttcctttgctagatcacggaccagatctagctcaaggggccagtttcctgctgatgctgttcagggatgtaatacccaagctaaagagaatgctggccttagggagctgcatagcagagacatacctgtatcagtatcacacgtcggttccagagtccgagaccgggggcctcacgatgcggcgaagcgtgcagtcctgaagaagtggtcacagctagagcgtccagattcgttcgattcttgcgacacttaccactcccataacttctcgaacgccatgttccttgggggtactctctcatcgaagaatggcttcaagctccagggcggtcatggtcaagaagagaaggtcgagtactcgggccctttgttgtcccagtcgcacaaggtcgatgaactgttgcagaagaacgagcgccacatccggcaagctgttcgaacatcatggttcaggagagctgtttgattgtgtggtcacaggaagaaaggtggacaagtgaggaaaagcttgaccatttctttccatgggagggcttgtgacgcttagagaaaggggagagcatgtcattagcttctgatgggcctctgctgccaatctgggaagcgggcaattgctgctgacgagtccattgttaactgaaaacatcatcaactttggtgatcctatctcacagcaaaacaaaattagctactgtgccttgctgcttctggggtttgttgtagattccccgaagtgccgtatccttttttttttgttgtacagagaaatattagcggctgactgacggggcggtgtggttgaacagaagattgtgtagttggaataaccagtaactaagctgcacaacatgcatggtgcggttgtagtaaaggcagcctctgaagaaaatgagaagtgaaatccaataactgttcgttgtcatctttactctggcattctgctgcacctttccctggcaaggggcgacgaaccatccaaccacggcgtgttcttggtttagctgtgcctctaaagcatagcgactagcgtcctctggcaggtagcacagctgcgaagcctgttggacgttctacagcaacgacggtggcgttgctctgaactgaaaaaggcgatgggctcattcctgccgcagagctttcttggtttgtccaattgtcttggcaccgggagggagagcggcttgacgacgagcagagcagggggcgggccggccgcagtggttgtcactgcgacagcacgagttgctgggacggacggtccttgccacctgccggccgccgtggaggagcagaaagcgacctcgctttctttaggtgagtcgggactgccggacgggagcaggcaggcaggcaccagaggttcgagaacccaccgggataagatctcgggtaacccagtgaaagttaggttttctatttttagttattttaaattaatatttaaaactaatttctatagaaaatttaaatgtaaatctcaggtacagatttctgttctcgttttcaaaacgaataggtttatgcgggctccttgttggtagagagatcacgcttttaagcatacaatgatacaaacaacaggcagcacaagtgacgttagcaggtcagataggcgagatgatgagagaggctctttgtaaaaagaaaacggagaaggattcgagtgatggagattgtttatttcttttagcaaaatatttaacacagaaagaggtaggcgtaggtttccttgagagccgaaatagatagctgccgaagaagtaaggaagggagtgcggctggggcgttccgatccggggcgagcgaggacgcggcggacgtgcccatgttgggctgggcaatattccggctgtcgcttagcactaaatttttctcttatatcaattttttcctctatttttcctcctatttttttatctcccgcagtggtttcctttaaatacttccatatacctcactacaactataaaatattattttctatatcaactatcaatttttttatctactaacaattactcgggaacccacaacacagtgtttaagatgatgaacagtgacacactagatctagggagagaaagaaggggaccgatacgtaggaggcgctgtagggacatagttgcgaccgtagagtgccttctacagccggtatgaagggaaggaagctgggtaggggctctgttgcggttagtctaaaaagtgggcgacactggcatgtgcctcgcgccccgctcccgcgctgcagttcgcttcagctcacgtgtgttttctgcactggccgccagctgcccagttctgctgctggccggtcccataatgatgcctatcaagggaacggaattgagctgattaggctgtgtgcaacaacgccacgcataattaggtaggcaaacaatcagatgtctggccacattaaaatacaaaccgtatgtatactttttgttctccaacagacagtagtttgtgcggcccatttatactggttcagtaattttccgggggcgggaactagaaggcgggaatagacgaactttgccgcctaggcgcgggaaacaaaggccaacgaacacacgatcttctccagttctcctcgtgcttgtagctatggctggatggtacatgaagctctccatgtatggggcggctgatggttactcaagcgaggaagatgatatgaaaaaagagagtactcaaatatcggtagcctctctactccgatgcattttgcgtggcgtagttggctattctgttggatggtgtttgcctcgtgctacagtgcagggcgatgcccattttggatttgggtggccgtttgcaaggtctattgcacacagtcttagtggatgatgttaatcagcacagggaaagagtgtgtcttgtccat

SEQ ID NO: 13315 - DNA, 1578 bp, Zea mays
ctgcgacggaactgcgactacgagctcaccccacgcccctcccccctgtcccgtcgagctccacagttgctgctgctgctgccgcttctccggccaatatcggtgcctaaccttttcagtcccggcggcgcggcagggcgggtttcgccgttcttggctgccgcgccgtcattcttgttctggcggtttcgtgatctgcccccgcgcagcgtctgctctgcggtcgcggaaacgccgtgccttctccgcgcgtccgctcgataacccctgcgtctccgccccgccccgcccgaccacgccttgcggaagcgtcgccgtcgtggtccgtcgacgggagcgcgcggtcagtggagctgcgtcaacagagtcgcgcactgctttgttttggtgatggctcgcgtcgcgtcgcgtcgcgtcttgatggaatcattaactagtcttccaggtcaatcccgtcgtgttcttgactactagtgccgtgttcgacccgtgacgcctgtggttggcgggcggaaggggtcaagctttccgatcttcattctttatttacaccgcggcagccggctctcagtctcagcccaatgctggcgtgagggaggggggtttgggagcggacaggggagacgattcttgaagaagatcgcgcgctgatcttggcccgtgcccgtccgtgcgcgacctcggcgtatggttggtggcgattggcagtgctggtagtgcgccgccgccatgggctgcgtcgcgtccaagaacaccgtctcggtgacgccggcggccgactcgtccggcgggctcagggaccggagccatccgcgcgcccaggagtctgctgctcctgtgccgttgccggtgcccgtgccttccctgcgtagctcgtcgtccgcggcgaggaggtcggagaaggtcaaggacgacgcggaggagccagggaaggccgtcgtagccgtggcggcgtcgtcccggagcttccgcctgcggagcctgcggaagagccttgagggtgagcagggggctgccgggtggccgccgtggctcagcgccgtcgccggggaggccatccaggggtggatcccgctcaaggccgactccttcgagaagctggagaaggtactgttgtggagctttcggtttgctaggtgattcatttcggttgaaatttcgtgactgattcaattcaatagctcgtgggtcattttccatgacaatttttttttttgcttgcatgtggaattttagaaggatgatagttgttgggactgtaatttggtctaactggttggtatctttctggtgtcctttgtcatgtgtttgttagtacactagtaatactctgttgggtgatggattggttgggtgatggattatgacatgaagaataaactactagtagcatagcaggcaattgttgtgaaagtaaatgcggtgaaaaggaggtgacttgggtgatctagtgttttcttctatgaggcatcacatgttttagccgtctccattgttggtatgatctgctgtacctgttagggagttttacctcctatcgcttcttgtctgtcatcatatttcaataggaaaagtaga

SEQ ID NO: 13316 - DNA, 2175 bp, Zea mays
tcgcgatctagagatcgttgccttgaagaaggttcgattcgacaattttgagccagagagtgttagattcatggcaagggagatacagatattaagaagacttgatcatccaaatgtcatgaaactggaaggtttgattacttcccgactatcatgcagcctttatctagtatttgaatacatggagcacgatcttgctggactttgctcctccccggacatcagattcactgaagcacagctcaagtgctacatgaaccagttactgtcaggactggagcattgtcattcacgccgtgtggttcatcgtgatatgaagggcgctaatctcctcgtgaataacgaaggggttctaaagatagctgattttggacttgcaaatttctttgatcccaacaaaaaccatcctctaaccagccgtgttgttactctgtggtatcgaccacctgaactgctactaggttcaactcactatgacgcagctgtcgatttgtggagtcttgggtgtgtatttgccgagatgtatcgtgggaaacctatcctgcagggaagaaccgaggtggaacaactacacaagatttttaagctatgcggttcacctgctgatgattattggaagaagtcgaagttgcctcatgcaacagtatttaaaccgcatcatccatatcccagtacccttcgagatgtttttaaagaggtaccagaaaatgccttgagtttactagaaactctcctatcggtggagccctacaagcgtggtactgcatctagtgctctttcttctgagtttttcaggacaaaaccttatgcttgtgaaccatcgagcttgcctaagtacgcacccaacaaggagatggacgcaaagttacgagatgatgcactcagaaggaaagctagtagcagagggcatggggcagaagcatcgaagaagtcttcaaggatcagcagagcagcaagagaacacactgcagtccctaagcagataaataacgcagaggaacccaaaaacaacgtgaacgcaaccagagatggcacaatactacaggatcgcacgaaactgtcactgaacggcgacgctaggctattagcggacatacagccagtgccagcagcggctcaagtgaaaggaagcgctcgtcacgctaagaacgaatcacgagaggaaatgcccttctcagggccactgagcgtcccttcctctagtggcttcgcatgggcggcggcccaaagaccgcaggaggaccgtgctctcgctaggtcacggaccagatccagctcaagaggccagtttcctgcagaggccgaccgggactgtactaggacccaagccaccgcagagagtgctgccgggcacagggagctgcctagcagcagagacatgccacgcgtcggctccaaggtccgggagccggagcctcacgacgcggcgaagcgcgcggtcctgcggaagtggtcgcagctagagcgcccggactcgttcgactcctgcgacacttaccactcccagaacttctcccacgccatgctcgttggtggtggtgctctctcgtcgaagaacagcttcgagggcggtcatggtcatggtcaggaggagaaggccgagtactcggggcctttgttgtcccagtcgcacaaggtcgacgagctgttgcagaagaacgagcgccatatccggcaggctgttcgaacgtcatggttcaggagaggaggaagaaaggaggacaagtgaggaaacgcttgacggttcctttccatggtggaagtgggggggagcatgtctgatgggcctctgctgccagtctgggaagtggacaactggtgctgacgattccattgtttaactggaaacagaatggactttggtggtcccagctcacagcaaaattttagcctctttttttttcctggcgtgtgttgcagattgcccggagacgccagtgctctatccgttttggctgtacaaaaaaaacagtagcggctgacccggcagttgtgtagttggttggaaccgataagctggcagcaccacgtggtgcgagcgactgtagtaaacattacaggctggttggttcatggctaactacgacacactttgtctaacgttagttgttcgaattgaaaaactaatattagttaaaaatattagacagtaacttaaatagcgagccataaaaa

SEQ ID NO: 13317 - DNA, 1482 bp, Zea mays
ccggccgggacccattcacttgcaaggcgggcctgccccctcaatctccagcgtgcgcggcgtcccgatcgcttcgtaatctgacctgaactgctgtcccagccaggctttcaccgcgcggctttaatcccgattgggttggctggaccgcaacccaattgggggttaattgggattgctactccgcggctgcctgtctctcgtgttcctggattggcgaggcgaatcgactggtttgctgcagcctcctgggtagaatcatgaagctgaaaaatagcgcagtggagacttttaaggagaacaatatgattttcacttctgaaggaaatctccactctaaaaaaatgagagaagattatgttgctagtccaaaccaaccgggtgttgtccagacaagatgcaaatggataattggagatgtaactgaggtctttgatcgcagcacatggaagcttggaaagatcttaaagatgctaaagaacaactactttgttatcaggcttgctgattgcatccagctcaaagagttccacatatctagtttgagaatcccacgtggtctggaagctcctcaaagcaagccctttcatgcagcagataaggccaccggacgcggtaatcgtcgacctgctgatggcgccttgcccggcgcaggggctgcggatcaaatgggtcaccgagcctacgagctggggagcagcggcaagaagcggaaagcaaccgcagacgcctctcaccatctaggcagggcagcagcagaccacttcccggaaggtcgccgcagcctccaacccgaacggcggcagctacccgcacagctcttcacaggccatagaagacgccgaatgctcggtggccagctgcagcgtggacgacctttaccgcctcggcaatggcggcaacgccaagcgtcgccccgccgccgcagggtgcctccctgacgacgccatgtccgcgtgcccgtgcacgcccggggcgagggacggggaggacgacgacgcggcgggcgtgcacgggctggagctggaggcgtacgggtcgactatgcgggcgctggacgcgtcgggcccgctgacgtgggagcaggaggcgctgctgacgaacctgcgcctgtcgctcaacatctccaacgaggagcatctgctccagctcaggcgcctactgtcctcgtgattattggcacttggcattggcgcattgccagccaccgcccttctggccttctctttcgtacgtctccagcgtcgtcgtcggccaacggccatgcacgtcggcttggctcgccgaacgccgcgttcagcgagcctcttgcttttactcttgttgctaattgctattacatggttctctgtctagtctaggtagaaagaatcctatgttcataccagtgtcgagacatgtcatgccttttgtatcctggatatagtcttgcttgtaaatgcaaacaagttttcctttgagggaccaaaaaaaaaaaaaaaa

SEQ ID NO: 13318 - DNA, 1115 bp, Zea mays
  misc_feature (722)..(722): n is a, c, g, or t
agcacgtttctctgcgactcgcacggcccgcgcccaccaccgaccaccccacctggttcggtcggcactcggcaccccgccccgcatacatgccgccgcccagcctcaccgtggcgcgcgacccggccgccgccgccaccacgcggcaccgcaaggtccacccgacgccgggcggaggcgcagggacgacgaaggagatgggcgcggcggaggggtgggcgcggcccgagtggtgctcggcggcgggcgccgcggccgtgctgcggcggcacccggcgcccgcgctcttcgggtgcggcctcctgctcttcatggccgtcgagtacaccatccccatggtcaggccggacgcgccgccgctcgacctgggcttcgtcgccaccaggggcttgcacgccgccgtcgccgcgaggccctggctcaactcgctcctcgccgcgctcaacacggtcttcgtcgcgatgcaggcggcgtacatcctgtgggccatcctcggcgagcagcggccgcgcgccgccgtcgccacgctcatgatgttcacctgccggggcgcgctgggctgcgccacccagctcccgctgccggaggagttcctggggtccgggatggacttccccgtgggcaacgtctccttcttcctcttcttctcgggccacgtcgcgggcgcggtcatcgcggccgccgacatgcgccgcgagggccggctggcgctggcgcgcctntacgacgcgctcaacgcgctccagggggtcaggctgctggcgtgcaggggacactacaccatcgacctggccgtcggtgtcggagcggggatcctcttcgatacgctctccggatggtacttccacgccaagaacgcaccggagaagcactgccgcagctgccagtgccacaaggctctcctttcacgctagctcataggtgtggtgtgtttggtaagttactgtagcggtgctgttttgtaagaaatggttttgattgccagtcgttgtgatagttttcatcgcgggtttataatacgaatcgactgagaactattttcgccaacgattcgatatactaaccgttgtgaaaaatatgttataggtgtatttatcctaaaaaaaaaaaaaaaa

SEQ ID NO: 13319 - DNA, 3520 bp, Zea mays
gagggcacgaagattgcgtgcctgcagcaacggacaaggccgagcatccaggaaagaagaacctgacaccctcaaccccacccgtcagaggtgcaagacattgaggcatccgttgattactctgcccgtgggacccacaccgcggtgccccaaatagaccaggcgacgtgaatgatgggatggagtcatcatcggctaggggattaataaaatcgaaaaagattatgtccacgtcttgactagtggccaaacggccatgggttttcacgtagattttaggcttcatttttttgttttattttcctgttgtcttatttctgttttaaaccttacttcaaatccaaatccagattataaattcaaatatgagtgcaacaatacaagaaaatcacgcatgatgcaaagtatattttattttacttctgttactattccattcttttaagtaaatgcgccaaaacatatagctcactacaaattaaatcgcacccttcaaagatttttttttcaagagaatagatctttaaccatattcaaaattaaatgttttaatatttacttataaaggaatgcctatgaaacatttatttattaattattccattaaaaaaatgagcactataaaaaaataaactatatattaatagaattattaattattccctattcatatataattcaggtattacaatgcaggaagagacgagactgggaaaagaggagaaccgtttgttctgctccgtctgcattggggtccgcccgcatcggacctgcttcccgcgcgcacaggtcacacggggtggccaaggatccagagagcagagatggccttgcgaggagattaatgtattacaacctccctaaactgtcattgtattggtatcaggttgcactgcacccaagatcaacacacaaccatcctatactccttgctacgtgtctaacctatttttatcttttaggtaagttcagtactccaccactacgacaaacactatataagaaagatataatttttccaagacatttgtacgcggttaatgtactgcttaaaatttttttaagcatcttaacgatcttcaatagaaaattcaaaattagaaagctatggatatcggcgaccaagtactgccattttttatatagagatcattttcatccaaaatcatatgaaagatatacctttatatatatatatatatttttgtctcgttgcaccaattcagttggtgcggcgctacagtgctttgcccccaccgggaaagtctacactgctagtgctacaccattcatctcctgcgctggccacgggccacccaccgctgcgctgccagcgagggtaaaatacctcgcctcgccgcctataagaaaggtccctctccgtttcttcaaactttagttctagagcccaccaaagaaaaaacaaataccggatagatattaaagcattttcctcgtcgacttaaaaaatagaacaaaaaggttcttccttttcgcagctccatcgtccaccaacctcctccgattcggccgtcgtagcgtatagccgaattgccccactccaggactctcgccagcttctccggccgactagaggctgtttccggcgagtgctcggctgatctcctccgcgcggctgaggagatcacgcggtctcgctcgggggggctggggcgtgcatgatgggactttggttgattccgacgatggagactccggcgaggcttctgtggagcaccagcttcttccgccacaaaatcgccgacatgcttgcatcctcctcctgcttcttatagatcccacccctcgacgtcgtcgccggcagctagctcgctagcttctgtacatacgtcgacgccatatctagctagtctcttcatccagtcccgataagtgataactaataattaggagcttgcttcgacgaccttgcattggtccatggagtccggacggctcatcttcaacgcgcccggctccggcgccgggcagatgctcttcctggactgcggcgcaggcggtggtcccggcggcggcttgttgcatcgaggtattagtcccatccaaatctattcctagggctcatcgatcgagcttggaactgttttgtgtactgctgattgcgtcgggggttgccatgtgggagtcatgaaggcgggagaccgatgcttggccttgaagaagggcgcggcgtaaaacggcccttctacacctcgcccgacgagctcctcgaggaggagtactacgacgagcagctgccggagaagaagcgccgcctgacgccggagcaggtaactaggcaactagctagtcaactgatctagccacacatagctaggcaacacgtagatgcatagtggcctgaccctgagtccctgacgcgtgcgtggcgcccacacgtgcaggtgcacctgctggagaggagcttcgaggaggagaacaagctggagccggagcgcaagacggagctggcgcgcaagctgggcctgcagccccggcaggtggccgtgtggttccagaaccggcgcgcccggtggaagaccaagcagctggagcgcgacttcgaccgcctcaaggcctccttcgacgccctccgcgcggaccacgacgcccttctccaggacaaccaccgcctccgctcacaggtacttacatcctctcgccctcagcaaccgcgcgagcagagctttgttccacggcctcgctccgagtccgagcacgtcgctgatgacggaggagtcggccgtctgttggtgctctggttggtttcattaaggtggtgtcgttgaccgagaagctgcgagagaaggaggcgacggagggcgacgccaacggcgccgcggcggcgttgccggcggtgggcgttgtcagggcttccgtggccgatgacgtcgaggaaccggagccggagccggagccggaggcagaggcggcggcgttcgaggagcggcaggtgaagtccgaggacaggctgagcacgggcagcggcgggagcgcggtggtggacgcggcggacgcgctgttgtacaacggcaggatcggcggcgcggccgtcgatagcagcgtcgagtcgtacttccccggcgccgaggtccaggaccagtaccacggctgcgggacgatgggtccagtaacccacggcgctggaggcatccagtcggacgacgacgacggcgccggcagcgacgagggatgcagctactacgccgacgaagaagccgccgccgcgttcctctccgaacacacccaccacgcggacggcgacgacgaggacgccggccaggtcagctggtggtggatgtggaactagcagagcaatcttcccgcggggaccgaccgccaaatctcgtgccaaaaaaaaattactgtatgcattttcgcatgtgtaatagctgtgagtgaaagtgaaaccgatagcgcgttctgtccgaattttttgtttttttagctccttttgcgataaaaatttacgtttagaccccagaaattttatttgcgagcttagacctaaaaactcgag

SEQ ID NO: 13320 - DNA, 1510 bp, Zea mays
ctggatggctaggcccaaccaaacacgacggcccacgggtgcacctgaggcggcgcacgttgccgactcggctgtctcgtcttccttgtgcttcgcgcactcgccgcccctgcgccctgcgggcagtctcttcttgccctttctcctgtgcgcagccgcggcggacccaatctcgcattctcgcgttccgagatactgttgttctttcagggagatagatagattccgactgctcgccattggggctgccttggccgcgtgccatccgtcgcttcgtcgagctgcgtgcggggcgctcctcgtcctcctcacgatggggggctggaaccggtcgctgtacgtgacgggccaccgtgaccgctccgccggcgcttcgcgtactcctctgcctccgccttcgcctgattacggagacaagcaccagcaagtcccattatgggagagggaattctgccgccacgttggcgacatcacttgggagcgtttctgtgaaaacaagcagtatgttggacaattccataatcacgagccttgggatgattcagcggcatttgattgtttccagaacgcaaaggcaaggttctgggcgagctaccatggccagccttctgacattcctttgctggacgacccggatctgtacatcgacaaggtcgaccaccaatgcgaagtcgacccggagttggtagctgatctggatagcgtagggctaccgttcgagtcggatgataatcccgcctcagccaaagggtggaccaatgcttgggccaacaacaagtgcacccagaacgggtctggaaactgggacgccttcgtagaaaagccagctgaagtcagtaagtgggactccgaggccaatctcgcatccaacacgacttggggcggccaggccaatgtagcaacacctgaggcggtttggagaggccaatctttcagtaaatggggcaatgatagcaacaccagccggggtgttcctctggagaagccgagctggcgtggctgtagcaagaaccgctacacacccaacagctggagcagcaactttcatagcagaccatccgacaataggtaccagcagctggaggatccgagctacacttctgggactggaaggaaatggaatggcggcgacggcggctggtacgtcaagcagaggaaccaggaccaggggcagcaccagcagccgaggagtggcagctggcagcaggaccaaagaagaaggagcaggcagtggcgtccggtgcacagcagggctccctaaaacggtccggcgtcttgatctcgtggcgagactcgcaggtgtcttcttttgtgcagtcagttttcagctgctgctggcaaagtggtgcctgtaaatagatgttttttgttgttgttttgtttgagttgtatgctgcagctgctccttcgcagctgcgtccttactttgcttatggtgcaatgttaatatgttataatgttagttaatatggggagcatcacagtttttggttcaaaaaaaaaaaaaaaa

SEQ ID NO: 13321 - DNA, 2088 bp, Zea mays
gaaaccctggctgctctcggaccttggacgacacgtcgacaccagtgcagcagccaccaaagatccggcccgcccgcgccgcacgagaccgccgcccgcgccgcacgagagtcatgacgacgccgcggcggcacgctgatccgtcgccctcgccctcgccctcttccccgccgcagcttctctcccgcctccgctccggggcctccagtttcctggcgcggcagtacagcacggggaagggaggcgataacaccggtccttcgaagccgaaaggtggtggctcctccgcgccaaggcacctcaggccaggattcgtggatccttcatcatggaaacattttgactcaagggctgttggcattaaaccgggtgctatacatacagatgcatgggcggttttaaaaaagctcagacgtgaagcttaccttgttggtggctgtgtgagagatttgctactcaaaagggtacctaaagattttgacgtgattaccactgcaagtctcgaacagcttaagaaaaatatattcaggagatctaggattgtaggcaaacgctttccaatatgtcttcttaaaatgcgtgactctgtaattgagatttcgagctttcgaacagttgctaattatgggaatagaagtgaagtggtagattatgtggcagagttgaatggctctgacgttagggatattcttcgctggaaggattctatgagaagagacttcacaataaatggtcttttctttaacccgatgaactgcaaaatttatgattacgtgaatggagtaagggatatgagaaaaaacaaagtgtgtacagtgattcctgctcacatttctttcatggaggaccctgcaaggattttacgtggcttcagaattgctgctcgccttggtttccagttttccagtgaaacttctaatgcgatacgtgatttttcttcatctataaataatatcgataaggcaaggctgatgatggaaatgaattatataatgtcttatggagcagcagcaccttctgttaggttgcttagaaaatatggactacttgatattttgctgcctttccagtcagcatatttgtctgagcagatgaaaggtggttcaagtgacagacatctgatgcttatgaaattactgtctaatcttgataggttactctctgcggaccggccatgccatagctctttgtggctggcgttgttggcatttcacagtacattggttatatatccacaagacaccttggtaataagagcttttgctgcagtgttgtatttcggaacatgggaaacaacagtcaaatttctgagagaagaagttggagctgaagttccatttgccccagagacaatggggccttctcggaccaaactggattgtcttaaggaacaaacgtcacatctagcatcactagtcaattcttcagtagatatattgacatgtcctcatgatctggagcaatcgctagccagattctcggaacctctgcaattttcaggagtggtagtcgcatctaacaatgataggaaaaagttgtcggccgtatttgagggccttgcttctgacctacattcatatgatgggagaagagggatgcgtgggattgattactcgtcgctgaaacttggggatcttgccgaggtccgatttgttctcggtaaagtgatcatggacacaatgtacgacaagttaccatgcgaatctactgaggatgagggcgctgctgcagatgttgctggtggaagcctacctccattgtccgcattgttttaatcgtagtgaagcatagggttcactcaacaaactaggcagcccttttctggtttagtcagtgctgcaaagcaatcgagttgttcagaattttcttgtgttgcaagatgaccacaacgacaactgtagacgtatttcagaatttttatcaaggaactcgaatgtgcagttgtagctaaactcccatgaatcctttcggtgaacccccggtgtgcacttatcaatctctttgctagggaaaactttaggcctgcgtcaccattgttgtgaaacatatgctgatatgcgtcttcgaacatacatctctttcgctccc

SEQ ID NO: 13322 - DNA, 970 bp, Zea mays
  misc_feature (823)..(823): n is a, c, g, or t
  misc_feature (883)..(883): n is a, c, g, or t
  misc_feature (908)..(908): n is a, c, g, or t
  misc_feature (953)..(953): n is a, c, g, or t
ttgggtccctcgaggccggccgggccgggatcattattttccagaaaccctggctgctcttggaccttggacgacacgtcgacaccagtgcagcagccaccaaagcccccccccgcccttcccgcacgagaccgccgcccgcgccgcatgagagtcatgacgacgccgcggcggcacgctgatccgtcgccctcgccctcttccccgccgcagcttctctcccgcctccgctccggggcctccagtttcctggcgcggcagtacagcacggagaagggaggcgataacaccggtccttcgaagccgaaaggtggtggctcctccgcgtcaaggcacctcaggccaggattcgtggatccttcatcatggaaacattttgactcaagggctgttggcattaaaccgggtgctatacatacagatgcatgggcggttttaaaaaagctcagacgtgaaggtttccaagcttaccttgttggtggctgtgtgagagatttgctactcaaaagggtacctaaagattttgacgtgattaccactgcaagtctcgaacagcttaagaaaaatatattcaggagatctaggattgtaggcaaacgctttccaatatgtcttcttaaaatgcgtgactctgtaattgagatttcgagctttcgaacagttgctaattatgggaatagaagtgaagtggtagattatgtggcagagttgaatggctctgacgttagggatattcttcgctggaaggattctacgagaagagacttcacaataaatgggcttttctttaacccgatgaactgcaaaatttatgattacgtgnaatggagttaggggatttgagaaaaaacaaagtgtgtacagtgattcctgctcacatttnctttcatggaggaccctgccaaggnattttacgtggcttcagaatgctggctcgcccttgggtttccagnttttcagtgaaacttct

SEQ ID NO: 13323 - DNA, 1318 bp, Zea mays
agagggagcggggataagcgagggaggagggggaaaccgaagatgctcctgctgcgcggcgccagggcggcgtcggcgtgggcggcatccaccgcggtgtccgcaggcgccagcagcagcaggtccatatccattcggctggcccccgtcgccgcattgtcctcgggcggaaggaagaggaagggccagcggcggggcgaggccaagcccccgagcccgccgccgccgccgcccctgcctcggcagggcgagaccccgagcagcaagaagaagtccggcgcgaggccgtcgggcgagggaaagaagagccgcttggtggagctggaagaagcgcgcggcccgcggaggccggagggcggcgaggcgaggaaggggaatacgcagcagcagcagcagcaggaggagaaggcgaaggcgaaaaggctggtgaagtggaagtgcgcgagcgggtgcggtgcgtgttgcaagctagacaaggggcccgacttccctattcccgacgagatcttcgccgaccatcccgatgacctccagctgtacaggagtatgatcggctctgatggatggtgcattaactacgaccaaggccacccgcacctgcaacatctaccaggaccgaccttccttctgcagggtggaaccaaagatttttgatgaattatttggcgtgccacgcagcagatttgaccgggaagcttgcagtgcttgtgtggataccatcaagatggtgtatggtgatgactctgctgaactcagtaatttcaagccggacgcgtgggaggaaagtaacaagctggaaagcaagaaccaagatacattgttggatgcatagatcctgcatggatctgcaatagaatctacagcacaccacattatatgcgaaggtaaaattgagaagtgaacaatgctcttaggttaaggtggaaaatggaacatcttgagggaaatactcagtgcaagcttcagttctgaacacgtccttgattcttttagtcaagcttggtgtgttcagaagtctgtggtgttttttttgtatatatagaaaattgttagcaggcaagagcatttcagttgattttgttggtcccagacttatcatttgattgcggtcctagtacttgaatttttgctgcgtgcctaaagtcgtatgcctatttcatctgtactatcagagaaatgctagttcttttaatcaacaacagttttttttgtctcaaaaaaaaaacaaaagggaaaaaaaaaaaaaaccacataagccatatggacaaagacaaaaagctgaaaacgacaagggggcggccctccactagtgagctgc

SEQ ID NO: 13324 - DNA, 2430 bp, Zea mays
agggagcggggataagcgagggaggagggggaaaccgaagatgctcctgctgcgcggcgccagggcggcgtcggcgtgggcggcatccaccgcggtgtccgcaggcgccagcagcagcaggtccatatccattcggctggcccccgtcgccgcattgtcctcgggcggaaggaagaggaagggccagcggcggggcgaggccaagcccccgagcccaccgccgccgccgccgcccctgcctcggcagggcgagaccccgagcagcaagaagaagtccggcgcgaggccgtcgggcgagggcaagaagagccgcttggtggagctggaagaagcgcgcggcccgcggagggcggagggcggcgaggcgaggaaggggaatacgcagcagcagcaagagaaggcgaaggcgaaaaggctggtgaagtggaagtgcgcgagcgggtgcggtgcgtgttgcaagctagacaaggggcccgacttccctattcccgacgagatcttcgccgaccatcccgatgacctccagctgtacaggagtatgatcggctctgatggatggtgcattaactacgacaaggccacccgcacctgcaacatctaccaagaccgaccttccttctgcagggtggaaccaaagatttttgatgaattatttggcgtgccacgcagcagatttgaccgggaagcttgcagtgcttgtgtggataccatcaagatggtgtatggtgatgactctgctgaactcagtaatttcaagcgtgtgataagggaggaaagtaacaagctggaaagcaagaaccaagataaattgttggatgcatagatcctgcatggatctgcaatagaatctacagcacaccacattatatgcgaaggtaaaattgagaagtgaacaatgctcttaggttaaggtggaaaatggaacatcttgagggaaatactcagtgcaagcttcagttctgaacacgtccttgattcttttagtcaagcttggtgtgttcagaagtctgtggtgtttttttgtatatagaaaattgttagcaggcaagagcatttcagttgatttggttgttcccagacttatcatttgattgcggtcctagtacttgaatttttgctgcgtgcctaaagtcgtatgcctatttcatctgtactatcctatttcatctgtactatcagagaaatgctagttcttttaatcaaccaaaggaaaaaaaaaaaaaaagaggctagagttttaatggaagttcttttaatactacatatttattaatctttctccacgccatacaagcttgttattctggtgtggtgcctcaacatttgcatggattctggatcctccatggcttggaagggtctggaccctaagcattagagtaactctgtctacgttcatgtttgctccctaacaaagaggctcaatccttcaatcccgactcgtgggtacacctgaatcatgtgttacaactaataccctttccattccaagactccggctcagcctctgttcacgggtgcaggccgctacctaggttcagaccatgaaaccggccttacgccagtgcccacctaggtcgtttctcatcccatttcaacgttcgccgtggatatttgacccgatgattcaatgtaaatgtcgcgcggtattattcacatgatttttgttgcctgagagaccctacacccccccagctccggagaggctcacgaacccgcaggtggggccataactgcgctttgctttgaacttgttgatcatcaacggcgctcagaggcatcgagcctgcgcccccatgcctaccgatccaaaccaaggatgtccctgcacgtaacttaggattggtgtttagtaatacacccacggaaactccatcccgttgcattcatgagttccaaagtatgcaaccagatcctgccgagcatactttcggaaaccagcccttttgtgagggcgagattcgaacctctaggggctgagtccttggtactcaggggcggagcgcccggtatggcgcgatatggcgcgcgccataccttggcttggccgttcgtaatacattctccgctcatggcttgttctctccgacgctctactttttccagctcctgtgtaatgtgtgcagtgtcgcgatcaacaggcatcctcgaactcacgtccatacggccaccaggcacaagtttgtgctcgcgccgcgactaccagctacagtgccactgaacggaaccatggccataccttgatttctttgtacgctccgccactgttggtacttggacaactgttttggggtggcggagggtgcaggcttacgatacagaaccaggctaagcagctactctggcaccgtaccacccttgagaacgtggtcctttccgtgggcttagccccttatggttcgaatttcacccatcataaaagagtatttg

SEQ ID NO: 13325 - DNA, 2768 bp, Zea mays
gttctgttggcagcaagtgcaatgagcatcaatgcatcagccatcatgctggtacttccaaaagagcgaaaggtttgccaattctgaaggagaaagcaaaccatatctgaaagacaaagcgcggacggaccctttgggagcatccaattcgtgagctttggcgtctgtgtatttttaatcgggagctgtaggctgtagctagctagagaggtttagagcagcaccaaatggcgagcaaggtggtggacctccggtcagacacggtcaccaagccctccgaggccatgcgggccgccatggccgccgccgacgtcgacgacgacgtcctgggcgcggacccgaccgcgcatcgcttcgaggcggagatggccgcggtcatgggcaaggaagccgcgctgttcgtgccgtcgggcaccatgggcaacctcatctccgtcctcgtgcactgcgacgtcaggggcagcgaggccatcctcggcgacaactcgcacatccacgtctacgagaacggcggcatctccaccatcggcggcgtgcaccccaggaccgtgaagaacaaccccgacggcaccatggatatcgacaagatcgttgccgccatcaggcatcctgatctccattacccgacgaccagactgatctgcttggagaacacacatgggaatactggtggaaagtgtttatctgtagaatacactgacaaggttggtgaaattgccaagagccatggcttgaagcttcatatcgatggagctcgcatcttcaatgcgtctgtggcacttggagttcctgtagatagactcgtgaaagctgctgattcagtttcggtatgcctatcgaaagggttaggcgcacccgtcggatcagtgattgttggttcgaaggccttcattgacaaggccagaattctccggaagaccctaggcggtggaatgagacaggtgggagttctttgtgctgctgctcatgttgccgttcgtgacactgtgggaaagcttgcggatgaccacaggaaggctaaagctttggcagtgggactgaagaaaatcgagcagattacagtggacccagcttcggtcgagaccaatatggtattctttgaggtcatggatccaagaatatcacctgacaaactgtgtcaagtcttggaacagcacaacgtgcttgcaatgccagccaattcaaaaagtattaggttcgtcgtccattaccaaatttcagacgctgatgttcggtacgcattggcatgtgtccagaaagcaatcaaagagctactggaaggcagtactgagttggggcattcgataaacggagctaccaaaagctcgtatgggcactagatcactcggattctgccaacctgatgcatgcagcgacacatggtacccagctgcttgttagctgctctgcttgtctgtgaccaacgcctagctgttgtagtctcgcctttcccgaataattgttgctgttcagtctctgtttggatctgctcgctctcgtgtgtctctgcttcatctgctttcgcttcatggtactgagtactgacgctgtgaagtggaacaagtactctctcccccaaaaaggccggtagacccaaacatcttttcttgcgggctggtaaagccaaatatttttaaatgtactcgaacgaaaatatcatagcatagtcttgcccacaaaggaagaaatacgataagaagtgaatgtaaagcaaagcactacagatgcaaagagaaacgcaggtctcgtattatggtgctgccgtgctggtcttactacccggatatctgtgaaaaggtagaagtgaggaggtcaatgtaaagcaaagcactacgcatgcacaagctggtgcgacaccacgtacgtacgccactcctgtcgtttatgctgcgcaccgctgtgcctaacagtaaacaggagcctgagtggcctggtcgtgctccgctatccagagtccagagcattattgtgctggatgtacgtacagtacagactacagacgctcctatcgtcctgagaagagcgtatgtagcatacataggtatcgatcacacaacatgcatgctgcagggcgcagactcgttcgttccaccgccggttccccgaccttcgcttccgagaccgagagacggcgacgacgacattgctgccgactgcccagctctagagcgcggccggtacgcgttccggcggccttccatgctcgcccattgttgggccgccgccgcggcgccgctcaccgagagaacatggtcctgcagtttgttggatctctactacacgcagccacccacgctgacactagtacactactgctaggagacagggaaatcgtagaacagcaagagcacgagtgggcggcgccggcgccggtgcgttcgcgtttttgtttttggccccgcggttcgcgtccgccggtcgatccggggcctggccggggaggggggcaggcagagagggaaaaaaaaggccgaagagcgaggagcccgggccagcggcgtgcgtccatttgtggtgagcgctggcaaatcccgggagctgggcggtgagcgctggcgctgtccctggctccgccgggtcgtcgtctcgctcgcccccgatcgccgacagagagtaccgcgacccacgcgcgattgtgaccggcgcggggccacgcccgctcgatggagtcaaatggtagcgcccgtcaagccttctgcgtgcgcggcgcgggtgggaatcatcagcatcagcccggccccctctgcagccagcaggtgtggccacag

SEQ ID NO: 13326 - DNA, 5522 bp, Zea mays
gaaacaagtgttagtgaagaacagaacacgcttcatcatattgattgatttcatatctgattacaaacaacaacaaagtctctttgtgtttatcctaaaacaatggcttcttttactgaatcatattcatgcttcatataaattgtatcttagctactacaagcaccaagtcacaaaactcccatccctgtagcagaagcattgttcccttatttatagggtcaggtcggtatacatctttgtgccaaattacaagaatgcccttcctaatatatacgatgggtctttgaaactgggggatataattatgtcttttttacagcagagacatgtcgtacatgtcatctcttctccccagccttcttgttccattcccttttccaaagatggcttcagatgatctgcgactgtgtattttcgtcggcaatgcctcttagctctggccttttagcgatcggctccatcctgatccaaagctcttaccatgtacttgaatctcgaaagtctgattaaacaacttggattccgaaagttcgtttaagtaatggtttgtgttaatatggaccttgagcaagagaccctcttcccaacaacccgttatttatgtatatatgtctttagaatggtgcatgtctctatgtatttatatgtttgaaaaacagaactaatctaataataaggtctatgtcggaattgaataatagacatggttgtggtttatcatccgcatgtataaaacataaattgctgatttaacaatcaatattagctgttgatttaactcagataaaggatacacaattacttgtcatatacatatgtgagcttggcttatcatccgcaaccgggtttggacctctgataagctcgcagctcgtggatggccgcacagtccttcttgtccgctttgcaagcggcaccctgagacagctcatcacattattgctggttgccgctactcgaggagaatttgggacgccctagcatcttggctctccattggccctttagctccagctacctggccggactctacttccatcaagcagtggtggtttatggtcggctcagtcgctgtgcccaaaaagggaacgcgctccctgctcctactggtggtctggcacatttggctggaaaggaacaaccgcaccttccaaaggcaagagaggtcagtggcagatctgctagcagcaattaaggcagaggcaaggctgtggggtgtcgcaggtgctaagcaccttcttgcgcttttacctatgctgtaattacgtaacctctatgtacccttcctgcggtgtctcttgggcactgcttcactctcttctttattaatagaaacgtgcacaatctcgtgccgttcgttcaaaaaaaaaagatgatggctgggcgagcctgcagttggccttgaaatttcagagttcgaaacccctctgcacctccccaagcagccatggatactaacacaaacagttattctgtggtagactcctctggattctgtgattcagtttcatgttgatcagttaccaagagttccccaacctcttctagtgcatgaagatgagcagcagcaatgcatttgtgaccatgattctatttctctgcgcacttttcacaaagacctcttgctcgacgaaatcggcgcaacacatccaatttatcttcagcggatgatgtcttgtggctgtcaggtggttgaccccatttaggcgatcccgactggaacccgtagtgtggaagcaaggatcgatgattagacgaagctccgcattgccatctccctgacgccaacgcctcctcctgtaccaaaacaagagagcacgcagtatccagagttgaaggacgttgcaccataatcactgatttaatatcatcatgtaaaccatcaatgaaacacatggtataatataatggatcggcattatcttcataagctgattggtgatcaacaaggacagaaaactgctctacatactccaccaccgaacccgtctgacgaatatgaaagagccttctaatcaaggattgatgctgatcatgcccaaagtggctatgaatttgagcacaaaactctgaccatgacaaaaaacgcacgcggcggcccacagcttgcagccaacccacgacgcggccagagaaatgcattgttgtcacccgaatccagtgcgttgggtcttcctcttacgtatcaaagtaattctcacaactcgacttccataattgtagattatccccatcgaatacatgaaaattcagacgaggaagactaccatagcccccttaaaatcttctgggtccctatgcccttcgtgcggtctagtaaaatcaggtagtaaaatcagggataacaccaaacctttggaagtgtggatcggggatcttacccttgaccgggccgtgaggttgggtcgggatgcgaccaaactcacgctcccggtgattgtgttcgacgcagtggccatccggcccgtcggcgttgtggaatccggcaggtgagcgcctgaacgccgaccccgaagacacaatcagaccgggtttggaagcttcggcagtgaaggtgccgcgctccaggagcctggtcgccctggcgagttcaagaacatgttgtcgaggcgcttctccacatctgggcgccactcctcgaaccgcgcctgatccatctctagggagatgaatcgggtctccaccttgtgctccgacgctttgattcgttgctcgagctcgctgcagcgcccaatcatggcgtctgttatcgactctccatttgggacaactggtcgaggacgcgttgcatcaccgcatccatagccgccatcgacgctccaggatcgtactcgtgtaccattgacagaatacaccttttaaagggtgggttttggatagtcttgatatgtttaaatccatagcaagtcaacatctttactaccttttttttcgatcttattcaatccatatgacgtagaaataaccgaacaaaatcgtcaggaacccacaggaggatgcaaatatccttagacatgcgtccttgtataatgtcgtctctgcagagcagttttgtaatgcatatttggtaaatatagtagcatgttttacctttcaatgatgacagaacttgttgcagatgtgaaatacttgtgctggttatttgttatatatgaacgtcgtaaactaaactttgtgcaatggatatccatcgatatattctgacattattatcttggacgcgacaaagaagcttgcgagggatgccttctgttcctgggggttcgtgcctacacttctcaccgaggcgaactgaagaaaattttcatggtgaagaaagctccacctgggccatgtagcgaggagcttcgggctaaaagagtagccatcgcccatcgctggttggattcgaagctcacatcagaagagcagaagcgtgagcggcctgccaagaggagaaagaaagccgctaccgctacactctacaaagtgagcttgcacaaccacaaccgaaatgctgcatcgtctgactttggatcatgatgcgcgcccccttgcaaacagtttgtttagaaataatcagaaccatcaggccgattgtgttcgcccatggattcggggcagccaggagccagctgtgcacattgctgtaccatacctggtcaataggtagatctggagtgtcactgtcagagtaaacaattagacctcgatcacgggcaatctttgactttcattttcattaactaccaatgcacgttattgtatgcctttcatcactgtgtgtctgtccgtaagtaaaggggggaaagttagctgcaatgctatgatcaggtagattccagaagccaacaggcaaattccagaagccaacaggcccccgctccaacgtgctccccacttgtcctccaaagacaacctgccatgtgggccgttacgaccttaaatcatccatcccacatgtcagtgacggcaacccctccgccaaaagtgaactgtgaaccggacgatccaggcatccagctaaccgcttccccctcgtcgcgctcgcgccgcgccgcgcctcgcctccaccagctacgccgtcacgcgagctcacggcccgggggcctcggaagcacaaccaccacgcgtccacgccgaagccacgaggagagcctgtctctcctccggggattctatcgccggctggtctcagcggcgccacttggagcaggcggcacccgctccgtactgctgctgatttggtgagcgcgggcagccgcgggatgggagatctggtggcgtgatggtgagcccgggcagtaaccggggcggcctgtcgcgcgtatcgacgcggggcggcgtcgccgggccggggagcccgcgcgcctctcctgccgcgaccgctttcgcggcgctacggcgcaggtggcggtgggcgcccccgggctcgtcgacgctggagcgcgcggcccgcgcgttcctgctggcctccgcagcgctcgtgctctcctgcgcgctctacctctacgtgctgcgctacgtcggccggggaggtcgcgccttcgccgccgcgggcttcgtcggggacgccgtcctgggcctcggcggcgagccgtgcgacgtgttcgacggcgcctgggtgcccgacgacaccggcctccgcccgctctacaatagctccgggtgcccgttcgctgagcgcgggtttgactgcctcgccaacgggcggaacgacactgggtacctcaagtggcggtggaagccgcgccggtgcggcgtgccgcggtttgcggcccgcaccgcgctggagcggctgcgcgggaagcgggtggtgttcgtgggggattccatgagccgctcgcagtgggagtccttcatatgcatgctcatggccggcgtggatgaccccaggacggtcttcgaggtgaacgggaacgagatcaccaagacgatacgccacctggcggtcaggttcgcgtctcacggcctcaccgtggaattcttccggtccgtgttcctcgtgcaggagcatcctgccccgcggcatgcccccaagagggtcaaatccactttgaggcttgacaggatggataatttcagccggaaatgggtcaattcggacgtactgattttcaacactgggcattggtggacaccgaccaaattgtttgatacgggttgcttccattgattcaggctgtgccgtttagttctaacttgaaaatgtgtagttgtttcagtagtgccaatgtctgctttgcaattcatattttctttttcggacaatttcttaggattgaatattctatattcatggttgaataggtagtgaatcatttcttctttttccttcagaaaaaaaacagtgaagggatatgtggtgttgtgctcactttgatgctttggctgctgaccaatatttttaataccgtgccttattttagaaatataatcctaactcatattctagttagaggtagagtttgatacatcttggatattggggagtgatgcatctctctatttcacataggtaccaataacgcagcagaaaa

SEQ ID NO: 13327 - DNA, 4276 bp, Zea mays
cccccccacccccccacccacacacacacacaccagctcatgtcagtttacgaggtaaagccgtaccagatttgttggatgagaaataattttattcattacgttctgattgactgacagttcaggacaaggtggtcatgctaaatgacagcagcatacactatatccttgctgactcatggagcagtgccttctaaaaaaacaaaaccacacacaaaagagaaaggattcgaacagtcaacagtgttctccagtagcagtacgtaccacgtggtgatgagcctaggaataggaaattactgacaccaccatccaagcatctatgctgcaaaaaaaatgtttgacatgcaccagtattggctgtacggttttctattttacttttggctgttctctatataacagcaaattctacagtctccactctagtgagctagcgcatattcagaagtgctaatttcttgtgttgctgtagctcgagagttttttttttccagcacaaaataattttaagagcagttctcatttctcatacacagagcaatcgctactactacagattcggtattgccatggccatttctggccacggagaacaaatcccgagaccatccaatgcttctaccactatttcatccagcacatttcctgcaatctgctctgtgatctcatccaactcccatctcatggatttcacccagcctctcccttccacctcctgccgcatgattctctccaacaacgttccggcgtcgtcgttctcgtttcctgcaaactttcctgacccatggagccaatccctcatatggcgtggcacttcctccgccaaagcttgagagagggtctcctcccaggccatggagcacgcctgcctccaggggtaggcgcatagtaaggtgtcatggccaatctcgaccactgccatgttcacgtaatcgaaaagaagcttttggttcgacctccgctccctcgacttagcagcctcctccttccggtccaatagcttgtcgcacaatgcagggtctacagggcagtcaggcaagtaccagcctgtgaagaccatatccaaccgcaggtcgcctagcccagcagatgatacaatcttttgtacaaaggcaacacattcaagttcatcgtcgtccacgcttgagattggggttaagtttgtcgaatcaagtaaaggcgaaggtgagctcatatcctcctcccatgataatgagcgcgtgacagattcaattgcatcggatcgtaaggcaattcctacgatatgataaaggaggtagttagtataacaacaaggaagcgcgcgagtcaaatgatggagccagacttactctcgttgctacaaggaatgcttcttgacgattcagatccattaaggttgctatcttcaaatgatacatcaagaattgaagtagggctaggcttatcacagctacaattcagaccacctgatctcgatccatcaatatgttcacttggacaggcagaagaaataggtacttcaactctagcgccgtcctgcagcatgtctcatcgttagtttactgaggaataaggataacaaaagcagagaacaaaaacgaaacgtatcgaggaaaatatagttaagaggccctaaactggttgtcacagaaaattatagcagaaatgatcaaagcaacaacaagaaaaaaaaagaacaacaagggcatatgaaaataatttgagttaagtgcctacttttgaagaacatattgtttgagtagcagaactatcatctgtgtcctcacaaaatggcatagaaccaatattatgaccaccctgtggtttcatgctgccaaaacaagtgacttcgactttcccatcaaagctagcagatgggatgattttctcttttgactgccttttatttttagggaagaaaaaactcgaaactctccctttgaatgatgactttgctttatcagatcttgtggccgagtttggtgttttacagccttcacaattggatgacggggcatttggtgctatgtcatcaaacatggacgatgacactgggacagattttgatcttgctaaagtcgttggagagctctgcccatctccttcgttctctctaagaacagttatacacgtagctcgcagggtcatctctttctcggcatcacatggcctactacttgaaacagaacccataccaccagcttctttcttgactccccgaagggaaagcatttctcccaaagtgcttgaacttcttggtaggtgcagcttttcttggttgatctcattatatgctactgacgcccatctttctgaaagccgttttttagcttccctgatcacagatgactcgggcgaccgagatgttctgctaaaagttgaacctgagtgaggactgctgtatcttttgaagtgatcccatgaatgcagcggcggtactgggctaacgatctccgagtcacttaggttactatcttcttcatcaatgtagtcaacttctgatctgccgaaagaactttcatctccaccatagccatttgagtatacagaagataataaagactcatcccgccgatgtagagcatctgatgggtaattgtgaccttctaaacctccataaaaacctatctgctcagcgaactgagctggggctgcttcggttgttagcctagccattgttctgctaggcttgccaggactaggcttcaggaccactatcctagttggctgggataaggtatcttctgctgaatgagatctccagtgtgtcctccgcatcacgtgttcatttccttcatttattctgtgtgttctgatttcccttctgcaatcgctctcaacaaatttagttggtttcaacacagtaatacgctttgtctgaggtggtgatgggcttctgtgaagtccagctagctgctttgagaaagtagagtttggttcctcaagaaacttaaggaacaaatctctgttagaacttagaacctcaagagcttcttgaaactcctttgaatgcaggagtttctcatctgtagcaagacgctttgcttccatgaacttctgacgaacaatttccatccttatgtctctcttgctcctggaagacatttccctaggaaaagtttggtcctgaaaatggtatgttctcaatggttcttcactgacttcataaacatccttaaattcaactgtttctttgggtcctatgtgtttgtcgcatgttgtcatactggaatggtactgctcttgatgtcgatggagattgtttgttttgaccaagttgccatttaggtgtcttttcttcaaatttcttttagtggaaggtaatgctggctcttgaccaggtagatcttcttcaagtcccatcaatctggcaaccacacttggtgacttcttctttgattccaattccttggacatctccttttctaacgccacattcaatggagacacatttgatttatttctggatgagctccagttactagctccctgcaggcatgctcttattattacagcacaaaaaatgtatcacttcaatgaaatttagtggctctcgcctactgtattatatttaacagaaaaaatcacctaacgaaaatgataggtaaaaccaggagggatatgacatgttacttactactttatcgttggtataaactttagcaggatcaactgttctcttggcatcttgcctgcttctacacgctggagaacctgaaatatccaagcagaacgtacacggcagtttcagttttgagttttgagaaccagtccttgcaaggttgaaaggagcaagagaacctctgaatacttttaatctaagaaaggcaaaaaacaaggaagaaaatgacaagtcaagcatgtcatcgtctgaaaatggcaaaatggtgcaaaggaatcacattgttcacatgacaccaatgtcaactagccccacacaaaagaggacatcggaaatatttgtcccaggccaattgcaaaagattgcatctcatcagcattgcaacaaaaatacaaagtggaagagatttatgtaccatctatacgagctcgatctgtgagcatgtttgtgctagacatccctgcgctgaggtcaaataagttgatcattgccttcttctgatcataaacgcgacctctgagcatggcaatatagcagaaaaggatataagtgcaaggacatgaagaaaatgaaactttaccaactaggcttgtacctgagatccataaagcctaaagaaatctaactgagagacaggagcatgacagttagctagtactactactacca

SEQ ID NO: 13328 - DNA, 4746 bp, Zea mays
gaaaccaatagcttttaacggtacagctgtacaaacgatcgattacttatgtactttgctgcaagacaaagtatgtaaagcatgccattcatgtctttcacttgaaacaaaatcctgctggttatcattcaggtagtgttgttggacaaggcttcaattacacaggtatttttttcttggttccagaactttgcccctagttcttaggcgttacttggacagaataaatgccatgttgtcatccaacaaagcacaaagatatcagatgtttatgacagaataattgtcacttgcttactgctgctaacttggatctcacttcatgtagggatgataaagctgccatgacaggcactgagcccgcccggggcccatccggacttcgcctctgaagttgacgcctctccagttcgctgattcccagtacagactgctcaatttatcacatctggtacagaccttataactccaccccgagaagatgcaaacccacactttctggtgctctggtgctcttactcttcagaccatagacaatgaccaccgaactagatgtgagcaagtctcgccgcttcgacattgccatgtcgaggcgaactcggcgatcaacaagcctggtagcctgcttccaagatcagtatacaccgtccctggcacatcatcgccaccaagagctgaaggcatttctgcaacgccaagatgaagagctgaagtcactccagcaatgccaagaggaagagctgaaggcactccagcaatgtgaggatgcagagcagaagacactgtgtttgaatgaggatgaggatctgaagattccacaagcaccactgcagtatgaagatggtgaacaaaagacaccggagcaatatgaagatgagcacaaggaatcacagcagtgttcagacgaagagcaggagataccagatacatatcaagatgatgagaagaaaccagaccaggaccagtatctaaatgaagacaagatgccagagcagtatcgagctaaagatgagttaccatcacaataccaaaaccaggagcttatgacaccaaacctacctgagaaggagactgcatcagagcgattccaagaagcggagcagctggtgacaccaaacctacctgaagaagatgaggagactgcaccaaagcaattccaagacgaggagcagaagggacttcaacaacaccaagagccggatgagcaggcatcgcaacctgaagagcagaagtctcagcaggaatgccatcagaaggcaccggagcaattccaaaccttgaagaagctaggcgcgccaccacgtcttgctgacaacgtgccccggttctcccttcaggagcttatacaacagaagcagcttccgaccggcgatgcgatgcttgccagcaagcaaggcagccgtggagagagtgtcctcgctgatcacagtgtttcaggaccaggagcagcagcaggcggcacgacactggccatggtgataaagcgacccgagggagggaagaagtcgatgggggtgatacgccggtgcgtgaaggccctgaacgggatgatcaaggccaagcacggttccaagaagaacttgcatttctagctttcaacagaatccaggagaccaggagtacatacatacatacatacatacgcactgatgagtaagtgtggtccagagtttcttagtagaccgcacatctctgaataatgcattcgcagttgcgcagaaccaaaattttgggcatgatgcagggtgtgcaagatctggcgagaaactccagggctttttacgccctggtctaccccggccgcctccacccataaactgtggtagttttattagctgaatatcacaaatctgttcctcctatgcgagaagatggtctgctaagtccaagagtagagatcaggctctgatcatgtgctgttgacttcctctgcaaaagcctgtttgcttttagaagtgtatgggtgtgattagaaaaggtggaaaatgatcggttctactcctaccgacacctgccccccaggtcggcagcggttttggtgcagtctccttttctgcctttctgtgccgcgtcccgtttcggtttggtgcgtcacttgaatgctgagaaaacaagttagtgcaaaagaaaaggcgatggagctgaagcctgtgaagcttcttgtgaattattggttgaggacgcagcgcatggtacgccatcgcatatctcttcttcgtttatgatcactctctgtttactcgatttgagcgcttgtgttgttggggttgggacctgggcatgtttatgatctgaagttctaaacatttactactgtatttttctggaaattgaacagatagtgtttcttcatcttctatgagactatttttttttcttgttttacccaatgaagaaccaagatgtgtcgatcacggcgtagatgaacttttgcttttccacaaactgtcttcgtaacttcagcctaataggctgcatcagggcagattacctggcgatgctcgatcacatccacatcaacccctaggttctggccttcccctcactttcgcacatgagtagattgggtctcgttgaggaatgtagggtagtgaggaggtcccaacgaattggttcgtgtgttgaccctgttttcaattttttttatatggtgtaaagagggactacaatcaaagtggttgttgcacaatggatccagctcgatcctttgactaactgtagatgagatgaacctaacacccgctacctccatactgtgtttgcagtgtttgatgccagtaaggctcctctcctacgtcgcgctcctatcacactgccgctggaatagcgacagcgaaagctctagcccgtcaaccgcgccttcgcctcacacccttgcatgtgtggtcacctcctactccatcgatttgaactggttcctctaccgctccaggacccagcctcaccctcatactcatcttcatgttatctccagcagcccttatctcattcaatgtttaaactttactctacaaacggtgtcaaatagtgtcatctataatcatgtgtcgtctattttacacaatccattaaagatagccttactacacaattacatatgttcatgttgaacaagatcaggggcagagccagacctttttgttgaggtcagctgaccccattaattttctgaatgtctaatagaaaaacagtgttaataacaagagttatatagtgaagatccaatagataatactaatgacctcgataaaatatttactagcttcactactaaggtatgagatgggtagaactagtgttcatattcttgtgtgtcgtcgtcggtcattgaactcttacgcattgtgtccacaacacagaaaatataacacaaaaataaacagcaaaaaggagagtagttaaggttcaaataaattgggaatgttcgcttcgggctgcagctacactctacagagataaaacctaaaaatagtagaagtcgatacagattaaagccaaataaacatcttgaattttaaaatagtccactcgcatgacatgatttttattttttatgtctaaacttattttaaatttttctagctaaaaaattttattttagaaattttagaattcagttatttagaaattttaaattacataaattttctagagaaaatgaaaaggatttttgaaaaaaaaatctacaatgttgtcatgaaagctattttacctctcttgcggctaacataacgtcatgtcactagatctacctcagccaaattaatcgtgggaccctattttttgttttctaatatgggaggcaaatctgatttttaactaaaattataggtaaaatgaaatatttttcttatcttgcgctttttagcctaatgagtaatgacactagattgactgtatagatgaacaaaaccaggcccgtgcgagagggagtgtggcatgttcgacggaagaggcccccaaatctaatagggcctttaaatttgtgtcacttcttaattcagtgagccagtttaaagcatgtataggcactgcccttctgtattaccgtaatagtactactaggttcatgcccgtgcgttgccacgagagtgaaaaattagtatgaaatatatatacgaaacaacaaacatcacttgggtggtaaggtggaacctcgacgtcaacctcatctaggcgtcacggggagactcaccgccgctcggcgacgccatcgctagtgatggtgcctcgtggtcgggaacggcggtggctactgcgggtccaaatccggacccgaggccgatgtcggcgttgcgggggtggcagcgaggtggaacttagcgtcagcttcatctaggcgtcgtcgagcttgtggatgagtgtctggcgagatgacactcgatcgtgagttgttggccggttaggttagtgaggaaagctcccaccaattattggaatcaatcgccattcaatagtggtggctatgggagaaaccgatgcaaccttatctgggcgggcaccctccttacgggtggagtaccacgagtccacgacgtgagaagcggacgggagtctgttgtggagtgggcgggtgggacgcaacaactgacatggcatggaggttgcggatggcgtgaagacgcggagggtgcgggaggcgacgcgggtgttggtgagcgtgtgcgagcctggggaggatggagtcatggtctgcttgtgtacggtaggggtgagttggtgtgcgttttggtgtgagtgtgtgca

SEQ ID NO: 13329 - DNA, 1726 bp, Zea mays
taatttactaattctcgaatcacaatgctcgtgcataatgcataggtacacaagaacttcgctaaaatcgtgtgccgtttattgatcccagcggacctgccatggttccttaaatccaggagaaccacgtcccttatgaatagcaattaacctgtgtttcggtggatgtgcactagataacaaaattattgtgcttcattattacactgctagtgggagtaccggctgcaaaaaagaattaactttagcacagacaaaataaaaagaaaaaaatagtgacagctgtgggatttgaacccacgccctttcggactagagcctaaatctagcgccttagaccactcggccaaactgtcttattgttgatataattttatttataatactaatatcagttattttaggcaatggtcagaacaatttgacaaacgttaggcggcaggtcgaggagtcgagcgaaccacacaccttgtgaggaggtgaggccgccgagccattcgcttcagccttcaggcccatcagcttatccattctctccctcacgagtcacgaatgaatagtacacggcgctccctccctcctcgagagcgtgtatgcgcagctgcagctccgcaaggcagatgttgctgactcgtctgtccagcgtttcttgctcgtcaacagcgcagcagttgcatgcgggcgtcggcaagttcgccgccgccgcatgctggagctggaagaagaagcgcgaggagctcccctgcttcagggccagactggccggcaagccgccgcgcgcctcaccggcgaagggcggcattgtcccggccagcgacgatgacgacggcgttagcctcggcaccgtgaagctgccgggcaacatcgacaccgctcggttggagtccttgctcttccaggttagcgctgttcgtgtcgtgcgtgcgtgcctgagagagtacgagctccgtgcatcttttttctgcgttttctagcgtgcgtaattgacactgatggtatttgacttgacgctggcagtgggggaacagcctctgccaaggcgccaacctgccacttccggtgcctctcaaggtaggggagcaaaaaaatagagcgacctgctacaattctgatatggcttgttgatccagatttcttcacctgatgcgatcgaccaggtggacaaggttgagggcgggatcaggctagggttcgtcgcggtcgaggacggcgcgacgcggacgctggtgtacatcgattgcctggtctctccggccccggatggctctggtccggtgttccgagcgatcaggaacggtcctatgaaggacaaggagccacctggggagcccaggatcatgagaagcctccttcaggctctcgaaaagtctattcagatcgctcgtgtttgaccgtgtaaacgccacacgatcaagcgctgcatctctgtaactattaattaagagccctctaaaccctgctattctagttgtctcttgagtcttgaccattccagggaaaaaaataaaccaagaaagttacaggaaccaataaaaaaaaaaaaaaaaagcaccgtggtacagcatttcttcattattgattaccattattacgcgattccagcagttgtgtcaattgatctaagaagagatgatggttacaggctcaaacagcaagaaattatgtcaactgaatctaacagctggtacatttccaacccgcagttcaagtatacaggaatccggtc

SEQ ID NO: 13330 - DNA, 854 bp, Zea mays
attcgcttcagccttcaggcccatcagcttatcccttccctccctcacgagtcacgaatgaatagtacacggcgctccctccctcctcgagagcgtgtatgcgcagctgcagctccgcaaggcagatgttgctgactcgtctgtccagcgtttcttgctcgtcaacagcgcagcagttgcatgcgggcgtcggcaagttcgccgccgccgcatgctggagctggaagaagaagcgcgaggagctcccctgcttcagggccagactggccgccaagccgccgcgcgcctcaccggcgaagggcggcattgtcccggccagcgacgatgacgacggcgttagcctcggcaccgtgaagctgccgggcaacatcgacaccgctcggttggagtccttgctcttccagtgggggaacagcctctgccaaggcgccaacctgccacttccggtgcctctcaaggtggacaaggttgagggcgggatcaggctagggttcgtcgcggtcgaggacggcgcgacgcggacgctggtgtacatcgattgcctggtctctccggccccggatggctctggtccggtgttccgagcgatcaggaacggtcctatgaaggacaaggagccacctggggagcccaggatcatgagaagcctccttcaggctctcgaaaagtctattcagatcgctcgtgtttgaccgtgtaaacgccacacgatcaagcgctgcatctctgtaactattaattaagagccctctaaaccctgctattctagttgtctcttgagtcttgaccattccagggaaaaaaataaaccaagaaagttacaggaaccaaaaaaaaaaaaaaaaaaatgcacg

SEQ ID NO: 13331 - DNA, 819 bp, Zea mays
  misc_feature (814)..(814): n is a, c, g, or t
gcacgagaccattacctagaacatcctaatcgaaaaacgattcacgaatgaataatacacggcgctccctccttcctcgagagcgtgtatgcgcacctgcagctccgcaaggcagatgttgctgactcgtctgtccagcgtttcttgctcgtcaacagcgcagcagttgcatgcgggcgtcggcaagttcgccgccgccgcatgctggagctggaagaagaagcgcgaggagctcccctgcttcagggccagactggccgccaagccgccgcgcgcctcaccggcgaagggcggcattgttccggccagcgacgatgacgacggcgttagcctcggcaccgtgaagctgccgggcaacatcgacaccgctcggttggagtccttgctcttccagatttcttcacctgatgcgatcgaccaggtggacaaggttgagggcgggatcaggctagggttcgtcgcggtcgaggacggcgcgacgcggacgctggtgtacatcgattgcctggtctctccggccccggatggctctggtccggtgttccgagcgatcaggaacggtcctatgaaggacaaggagccacctggggagcccaggatcatgagaagcctccttcaagctctcgaaaagtctattcagatcgctcgagtttgaccgtgtaaacgccacacgatcaagcgctgcatctctgtaactattaattaagagccctctaaaccctgctattctagttgtctcttgagtcttgaccattccagggaaaaaaataaaccaagaaagttacaggaaaaaataaaaaaaaaaaaaaaaaanacttg

SEQ ID NO: 13332 - DNA, 605 bp, Zea mays
ctaacccccaagccggtgtgctgccccagcaccagcagcagctattcggactcgtgggcgagctcaaccatccaaaactcccagggcgctagctcttcgttgataaaaacacccctgcttcccttcctgcctgcacaccacatctcaatctttgctgcgagctcccgatctgtggtacttccggcatcgcgaactgaagtttaccaccgatccgttggctccttggcattccttttcctccagcagcggcaaagcctccatctttttgccaaccgacttgaggaatggggtgcatgaagctgcttggagtagacgcaagctttatggaagatttctagtacttcattcccaacaagcaatcagataaaaacaaaaggagcaacttcaacagaacctgcggctccagtgattggaccgaccgatatttgcaaactgctgaaattgaatccatgggtagaggaagaggaagagggaagaagctaaccactgtcaggagccacgaagataaaggtagcagcggcgaagaagttgtgcctgcaaaaaaaagaagggcgggcccccaaaagcgcttcgccagtaagatcgatcaggcagtcgatgttgaa

SEQ ID NO: 13333 - DNA, 2004 bp, Zea mays
ctgagcgatcctcgaagtagaaagttcaacgtcacgagcgcccacctccaacgaagcgcagcagaacggagaagaaagatactagtactagtagtggccggaaacccgtcgatcggagaccgggtagtgtaaacacgatcttcgaggtggatcctgagagcgacatcggtctccccagaaatggcatgtgctgaattcaacgtcgacgtcgtggactcttccaagttccaaccacgcagtgcagacagacaccgatcgatggaacggaatcgccggcgcccgcctccatctccgtcggtgcgttgcgtggtcctcgatccatcttgtccgcggcttccgacgaagcttccctgcgccgggtcgacctgctgccgccgccacatgctccgcgagagagaagggaccagcgtgcgcacggccgcctgcgaagtggacggacgtactggccgtgggatgcatgcggcagctgaaatccccatccggaattaaagacgcctcgccgtgctgccgcagcgacgggacagcccgccgccccgccccgccccgccccgaggtagccgcgggccggctgccaaccccggctgcacccggcgggcgacgacgacgtggcggccccggaaggccgcagcccgcagcgcagtggcgcgggccacgtgccgctgctgtgtgggcctgggccgccgccgccacggcgccacctattccgcacgcgggcgagcgggccaacgacgcttctcggaaggtgggggagcgaccgtgacacgttatcgaatcttgggcgttgactggaggagcacgccgatccaacggatggcagcgtctggtggcccgctggctgggtcactataaatgactgagccccgcggccgtgtccaatccctccctcttccgacacacacacataacaacgagcagcacagctcacgctcggctacgactacgatccgcgcgcatcgatggcgatgagtgacaccggctcgagcttcgcgcagtgggccgcgctctaccaccaccacgaccccgccggcggcccggtcctgcccgacgacgacgcggcggacgctggcaacggcatcggcagcggcaccgccaccgccgcgagcccgacgtcgggagggtccagcggcgggagccccaccaccaaggcagcgtgggggcagcagcatctgcttcacggggtggaggggccccgggtcgccgggaagccggcggcggcgcggcggcggtcccgcgcgtcgcggcgggcgcccgtgacgctgctcaacacggacgccgccaacttccgcgccatggtgcagcagttcacgggcgtccccgcgcccctcgccggcgcgttcagggtcggggacggggccccggtcatcagcttcgccgccgactacggcttcccgcccgcttcttcttcctcggccgtcaacgtgtccttcttcgaccaccagctccaccggagccaacaacaccctgcagcgccgccggtccacaggcagcagcagcagtacgccggcgcgtcgccgttcggcggctacagcagcggcctggtgcaaggcggcggcgcaagcgacgtcttccccgcgtcggcggaggacaggatgctcctgcagagcattctggccgcccagatgccgcacatgccgccggtgtccggcgctaacaccagctctcatggcttctttgcttgaataagtaagtagctgaccaaggtactacgacggcgtcatccatgccagtatgccacatgcatggaagctagagaacatgggggagatggagtgaggattagcagcctagcagtagcaaagaagaagaagaagaaggggtaatcacaagtttccctggttgcgtttgattagttttcttatccgcgcgcgcagcttcatttgtttctccgctagctgcagcgatgtaaatatctttatcttgtttttaaaagatgcagtagtctctgtacacgtactagctcatccgagaaacgcaataatatataatgaaacaaataaaaacagg

SEQ ID NO: 13334 - DNA, 2298 bp, Zea mays
gttaattccatttagatgagctttacctgcaataatagagtaagaggggtgttgcattgcatagaaggtccgagccaaccagaccaaactcccctgaaccagaccaccagcaaaaacccgttcacctcacaggttgcgttgcgatccggtgatggaaggcctcatcccgctgctctacaaggccatcaaggaccggcggagcaacgccggcggcggtgggcgatcctaccgcagcggaggtgccctcctctcctccgcgcccgtggacctggacgaccccgagcagaggaggcggtggctgcagcaggagctgcggtccccggtgcacgcgggccacacccacacggcgagggcggcggcggcggcggcggcggcggcggcggccgaggggtcgccgctgcaccggcggaacctgtcgctggaggagctggcgggcgaggtggggctctcgcccgaccggcggctccgggtgccgctgcccaaggccaggagcgtccgcgccttcgcctgcatcggcgccgcctgattgccgcccccaaccgagcgcgcgcgcgggcgtaggcgtacgttagggtcggtcgttcacgagcatggcaaggtcactcatcaagctgtatgtgtacatacatatgtgtcgttatttgattttgatcgtgttggagaactcgagattgtataatatgccatgctagctagtgcaaggtttgtttcgacgttcttgatgggagcagcgggcggccggtgatcttttcgcgattctttctcatcagttgctagcaataataattgcttacagatggcaacttttgtccagcttccttccattcgaattgaagcgatcgcctggcaaagtttgcgcaacaaacagctttgcaaatatgtcttcactgagcacaccgatctcgattatcgaccgtgtatgaataaacaacgatttcttctagctgtccaagatttccaaggttgatcaccatgtatgcaaccttttttctagtagtatttggaggcaccagtctggctctggcctggtttgcgttttgcagcattttttaagaggaatttgcgtttctacagctgtacctggctagttgatcttttgtctaggcgatgtcgaaacggaagcagcgtgacaggcccagtgagcccagcagccgctccagtcgctattgggccttggtgacgagcagcaaccatccgattggcgattggtggggtgggaatgtgagcaacgcgtgagctggctctcggttaggcaaatcgctgtaacggtccagcaaaaccagcggtggcaatggcaatgccatcagtagcgcacgcaagttgtcccctgatcggtacatggccgcatgcaaagttgcagttgcaaggctcatgtgaccatctcaaccgaatttgtccacatacggcaaaaatctcagtgacacccttactttccatataatggtatcctaggcgtacttgcacggaaacccaaatatcatccgcaatccccatcttaccctgtcccttactattaaaccaagccatggactgagctaaaccaaaacaccgagaaaagaagatagacggatcctcccggtgaacgaacatgtcgccaagagagtggatccacgacggagactacaccccggtaatcgtggtcatgattttcattgtgctgctcacagtcgcgtccgtgcttttctcccattattgcgtcggggaccgggcgttcatgcgcactggttatgactttgaaggctatgtgatgcgcaagttcgccgtttgcgtcgacagtggccttcccaagcgggcacatcatgatataaagaatacaaaccctcatgaggttagggttgaggtcgtggaagaggtgcatgcatcagagccctctactcctgctcttcctcttgctacgcctgctcctcctactgctccttaccatgttgctacgggagcaagagcagaagaagtaccatcggcggccgaggaggagcaggaggaagatgaggactgggaggatgatggcgacgatgaggaatttgatttcgaggaagaaggagaccttctaaacctatgatctaggtttgcggaacttctagggtcctttaaaactagccttcatgtgtttcttaaaatatacccttttcaaggtattcaaggggcaacgaatctgatcatggaggatcgagaataatgagaactaaaagtgttgtcaatttccttatgcatgtcctttccatggtatttaattacctctttacatcaatctattgcttaattcaaactacgggaggaaggtccgtgccgtcttggtct

SEQ ID NO: 13335 - DNA, 2361 bp, Zea mays
atatacacgatctgtcataatgtttcactaacacgcacaacacacagcgttgttggcaaagtttgaacgcaatcattttgcggggaaaatgtgagacttccgacaaagggtctgctctgttctacggaaaaagggcttcggtccctgcggacgctggacggccatctcataacacggcgctcccccggcccggccggccgttccaggtcgtggtctttgccaaattcccacgcccctgcccaccctgcccgaatcctctcgccctttacccccgcccgcgaccccattcacactctcgctgctccactccgctccgctcagctcgtcgggacgcgcccccgcctcccatcccatgcccgcccccgcgctcgtcggaggccgctcgcggcggcctcccatcccgccgcgctgacgagagggcctctcggtgggggcgcttcgggtgttcattttgtccgttcggggaaggggagtgcggcgatggggaagcagcaggaggggaagcggcggcgcggggagaaggacgggcagcggaaggggagggggaagacagctgcagcggcggtgccggaggacgcggcgccagtggccgggtgctggatccgcttcccgcgcctccgcggctgcatgccgtcgcgcgccaaggtcgactcctccaccagcgcgcgtggcggcggccgggaaaccaaaccatctactgatgatgcttgccaggaccaatcagtaccaccagcctctggttccgcaacaaccagtaacactggaagtatctcaccttcttccatagttggagaggagctaaaactagctttccaactgcgtagatttacttttagtgaactgaaatgtgccacgagaaacttccgacctgagagtcttcttggcgagggaggttttggctgtgtctttaaaggatggattgaggagaatggaactgctcctgttaagccaggcaccggattaactgttgctgtcaagacactcaaccatgatgggttgcaggggcataaagagtgggtggcagaagttgattttcttggaaaccttcagcatccacatctagtgaaattggttggctactgcattgaagatgaccagaggttgcttgtgtatgaatttatgccccgtggaagtttggagaatcatctttttagaaagtcattgcctctaccatgggccattagaatgaaaattgctcttggtgctgcgaaaggcctcgcttttcttcatgaagaagctgaaagaccagtaatctatcgggacttcaaaacctccaatattcttttagatgcggactataacgcaaaactctctgattttggacttgctaaagatggccctgagggtgataaaacacatgtgtcaactagggtcatgggaacatatggatatgctgcacctgaatatgtaatgacaggtcacctgacatcgaagagtgacgtatatagctttggagttgtactactagagatgatgactggtagaaggtcaatggacaagaacaggccaaacggagaacacaacctggttgaatgggcacgcccttatctgggagaaagacgcagattctataagcttgtagaccctcgtttggatgggaacttctccataaaaggcgcccagaagacggctcagctggcccatgcctgcctcagccgtgaccccaaggctaggcctctgatgagccaggtggtggaggtgctgaagcctctccagaacctcaaggacatggccagctcttcctactacttccagtccatgcaacatgagcggcgcacagcacttgccaacccatatggcagtcaaagcatgaaagcgcagagcacctttgcgcggaacgggcagcagcccatgaggagcctctcgtatggccctcatgcttccccgtatcgccagtcgccaaggcttgacagcaagcggcaatgagtcatggtgcttgtctgtcgaccataacatattttcaagactgaagttgtaaccagaactggtgtatgaactcagccatccaacaagcatctgagctatctattattgtggatgaagcagcaacattgattcgaatttgcatatcatctgcgagtgaatttttttctctcttgttatcgcttacattttagctgtactgtctttacggctctagataccttgacttgaaaggtggaactaaacagggttttgatcggtctttgaaacaatgctcaggcagcaaatgattggaatttgttccttcctggaaaccagcagtaggcaagtctgatatatgttacatagttgtcctaaggctgttcataacctatggtttcttgtcacaatatccaaatttgccacgtcacatattactttaaaaggtatatttgtccc

SEQ ID NO: 13336 - DNA, 2811 bp, Zea mays
  misc_feature (1794)..(1794): n is a, c, g, or t
gggtacctaattgaccagcgagtcaggtttgagtaccgctagtgcagtttactctaattatttagacaaggctagttggcgctaaaaattaatcaacaactagttcaagaattagtaaaaagttaaccgccaaatctcatcggaacgtaagataaagaggaataaagaggatagtagatgtactttgatttattggatgttggataaacgatcatgaccctcctatgtagagagagggaatagtcttgttactacttcaaaatttgttctaaagtcaatttaaaacgaatcaatttgaaaacccaacaaaattcggtctgacggctactaaaagcgtctagaccaggttttgtggagaaataggcgctctagccgattgtaataaaccgatctggtcgagtttcgatagccagatctattttatcaaggtctatatcacttcttcttttctttatccagtatatttttagatggcaacacaaacagtgacacatcattggatattagtatattacgcacggagtacataattggagatgccctcaacagtccgcatcagtgactacctatcgagaagtatccagatactatttctcagcggtgaaaccgtgaaggtgacgcatcatattggcattgttgtaaagcaaaaaggtatggcaccgcgcattttttgcctttttttttttttttttttttgtcaaaggaaagttttttccatggtccatgttatcaaaaatatttacaccaaatgagggcctcaaaggcagaactaattgatcctttacagcaccgtgtagtatagccaatagaaatcaacagacaaaaggaaagcgagaaacacaccgtggatcactggtcaacctacagtatctactactagctgcctcaagcgcaggctagtgggtgggcggccatggcgggcagtaggctgaaacccctgagaaaaatggagccaataatcagactcgggtggtaacgtggagggcgtgcggcggcggcggcgggggcagaggcggcggcacgaaggggaggctccgcagcatgaggaagcgcatccggcgcgggaacggcgcgtcgttgagcagctgctccagcacccgcgccaccagcgcggtgtactcctcgagcagctccgccactatcgccacaagaatcatcgctgctagctgcaaggaaggaaatgaaactgcttccacttccgctgggattggattggattggattggtcttgtatcgcggactgggaattttggatgtgcccgtccggcccggcccgccccaggcttttaaaagggggtcgggattggggaggaagatgagatgaggtgggggaacctggactccttgcgtgtcgtgtcgcgtcccgtgggcagcgcgccctggtttgatgtgacccgggggcggctgccgttgggtcccgcgaggcgcgctgctggtatgcgctagaaaccgagggaaggaatggttcggttcgctttcgcgcgtcgggccgctggttagggagtccagaaacaacgcacggtgttgcgcgtcaggccgcgaacatatccgatgtaccagcgcgggccccagcaccagaagccgctctaggccctccagctgcggctgcccatagtaggtggcgccgcagtcacaggtgtggttataaatatcgatatttattacgtatttttagcaaaaggtaaaaaatatttgagaaaataagaattattttaagacagagggtgtacttctccgctgtatcttgacaagttatttggttaggactgatttgaccgacagagattataagangattgaggaagaatctctttgttacttaactttgagtagcaaggagatttcttctcatatatcttctcatgattcatactcactaaatcaatccttaggatttaaggtaagtcatgcatgcataaaattgacctatgttaagtaagagatagcatatgtaaacagaatacttgcaaacatatccacgtggtcacatgtaagcaccataaaggataagtacaagtctggaatgatcaagaataaacttccactaatcacattcataaatagcagggatgatcgttgcatattcctaaaataaaggctatatcagttaactacacatagagtctacaatggcgtagctagaattttttcgtgagttatgccattagaattttttataaataatttaatataatatataataatttgctatatagttcaaaatataaagataaaaatagcatataacactataaatttaacatttaagtctataaatttaacatttaagtctataagtatatatatatatattaaaatgcaaatataatatatatcaatattttttatatagattttggtggactgatgatccggtgggccggcttaggatatgctatggcccacccggaccacccactgtctacgcccatagagagaagatcttgtggggataattaacaaatttttcacacgcactcaaattttcgataaaaagtactcggcaaagaagtatttatcgatgtactgtttgctgaaaccctctttaccgagtgccacactcggcaaagactttgccgagtaccacactcggcggtttttcaggatttgcctaatgcttcagacactcagtaaagcgcccgatttcggtagtgttgccttgagacacggtcttgcaacggtgtagatccatctcttaccggagaagcggaccgccaccacttgtttacgtttcaagcttacataacaatactgtacataattttcggcggtcagagctcagccgtaaaaaataaagaattattttcggta

SEQ ID NO: 13337 - DNA, 746 bp, Zea mays
gcatcggccaagcaacacgcgcagtcaaaatgttcgaaaaccttggatggatggtgcctttcttatcgaaatggcatcatggactgtatcatttgtgtggacattgggtaacgttttcagttcaacagattggtgatttctggcatgggttcaaaagtacaaatctaacgctacattaacaggcatagagttatcatcaaccgcgcccaatcagatgatacagtttccgaaacataagagagttttctttgcagaatgctcagggcttcgtatcgctcttcagagcttcggtggttgtggtggagcttggttctgccagcgaaaacttcttcaccctcttgcgcacgatgcattcacggagggcgtcgacgagggcgaggcacctatcccggtcgtaggggaccgaggcgacgcagttgagcagcgccagcgactcctccgcgcagaccggctgcgccgtcgtcgtcgtcttctccatgccgatccaaacaggaggatgctttgcctaatccagagagagggagcgcaggccgctcccgtgccgcgaggcctttacaaaggaccgcgccggcggcgcggcttgggcgagaagaaagaaaaccagcggcggtcggcggccgttgatgggatcgcaatcggaaagctctctctctcgagccgtcttactccaagaagctcctgctccgctcctctcgttaccaaatgctccggagacggcccggcccacgcgtccgcccacgcgtccg

SEQ ID NO: 13338 - DNA, 709 bp, Zea mays
ggccgccccttttttttttttttttttgttcgaaaaccttggatggatggtgcctttcttatcgaaatggcatcatggactgtatcatttgtatggacattgggtaacgttttcagttcaacagattggtgatttctggcacaagtacatctggcatgggttcaaaagtacaaatctaacgctacattaacaggcatagacttatcatcaaccgcgcccaatcagatgatacagtttccgaaacataagagaattttctttgcagaatgctcagggcttcgtatcgctcttcagagcttcggtggttgtggtggagcttggttctgccagcgaaaacttcttcaccctcttgcgcacgatgcattcacggagggcgtcgacgagggcgaggcacctatcccggtcgtaggggaccgaggcgacgcagttgagcagagccagcgactcctgcgcgcagaccggctgcgccgtcgtcgtcgtcttctccatgccgatccaaacaggaggatgctttgcctaatccagagagagggagcgcaggccgctcccgtgccgcgaggcctttacaaaggaccgcgccggcggcgcggcttgggcgagaagaaagaaaaccagcggcggtcggcggccgttgatgggatcgcaatcggcccgcgctctctctcgagccgtcttctccaagcccggcccggccggcctcgaggtaccc

SEQ ID NO: 13339 - DNA, 1748 bp, Zea mays
ccacgcgtccggcgcaacgcggtcgtgattgcgagtgaatccgtggtgtccaactcccaagcccctaccggcaaccctagcgaggcgatggggaaggcggaggcgaggtcaagggggcgcggcggcggcggcggcggcggaggcgccagcggcaatccggggaagatcttcgtcggagggctcccgcgggacaccacggatgctacatttgtgaggcattttggacagtatggagaaatagttgattcggtgataatgaaggataggcacacatctcagccacggggttttggcttcattacatactctgaccctgctgttgttgataaagtgatagaggacaatcatgttatcaatggaaagcaagttgaaattaagagaaccataccaaaaggttcggtgcaatctagctctaaggatttcaagactaaaaagatatttgttggtgggcttccgtcaacactaacagaagacgaattcaagagtttctttgcaagatatgggactgtggtggaccaccagattatgtttgatcatgaaaccaaacgttcccgaggctttggatttatagtttttgcttctgagcaagttgtagatgatttgttagcaaatggaaatatggttgaccttgctggttcaaaggtggagatcaagaaagcagaaccaaagaaatcctccaatgcaccgccaccaccagtgcatgttagaaatgctaggtcagcatatgatagcggctctagagaccacccttcagctgacaactatggtggaatggccagtgcttatggaaactacaggggtggtggatttggtccttataggagcgatacaggatttggtgctaggctcagcagctatggtggggtaggtgattttggtggtgcatatggtcgttactatgcaggattaggagggggatatggagccgcgtcttcgtttggttatcctggtcgctttgggttatatggaggaggttttggtggatcttatgctggtgctgacttaagtggctatagacgcggtggaggtgatgagagcttcggcgcccctggtggtaatcctgggtttggtggtgatgctgaagagagctttggtggccctagtagttctggctttagtggcaccgcctatggtggggcatatgatcctacgctaggtggttatggatctgctagcacacctgacatgaataggggaagcttcactggaggatatggacgatatcacccatatggataacaagaagagcccttgaaggcttaacacttgcatgcacgtttgctgcccgtcattggagaacacccaccatttctggacaatatccagctgcctgaagcttcaagaacaacttaatgtcatgtgtacatgttttctcgttcccgtgagctttaacttatatatcctatagcatgtagtgtgatccagagtagacgttgtatcgaaggttattgtgtttggcataatatagaattctggtatactttgtagtagtttttaagcttctatgtaagcatactccatctgggagcagattagctgtgtgaacgctaggagggccagtctctacccattgccacttagcattgtacctgatcaagttattcactcttttggtttacccattgagagcattgtccgtgatgtcctccttggttcacctagtattagctgcccttagctggggttgaggagattatgagataaatggcatttgtgctccagcttaagtttatcttcagcggccggtc

SEQ ID NO: 13340 - DNA, 1634 bp, Zea mays
cgtcatgctctagccaggcatcccatagaagggaaccgtcggtagttagggaaggcaagaagaagattttggagagatggtctatggtatcgtcaacagtcagtagcgaggaggaaatggaaggtcgcagaagtacaggcacgcttggtgacatactcacaataccgaaagtcaaggaccaggaaggaattggggcggaaacactagggagcccagcacctgagctggaacctgaggagcctttctcatgcttgccaagatctcggtctcttccactttctctgtcccgtggagtcgctgagtctaatggaggagtagcctctggtagtactcaggaagctgaaagggagaggatcaggaagtcatcatcgtttaaggaaaaggtttcaagcctgttctctaaaaacaagaaaccagttagggagaaggcagatccatccgcgagcaatagacttaaggtctatggaggggctgaaactactgctgatgtgaagaagggctggaaccgtcttgcgttagacagtcttcagaaacaaagtactagtcgtgtaaacacagacgagaagaagaacgctgcgcaaggactcgtcactagttcttgtggtactaatgatacagctaatacccctgccaagttagcttcgctgtatcaggacaacattgcctccattccaagtcttggcgccccaggaatccttggtgaccctcaggaccagcctagtcctgtatctgtgctagatggaccgtttattatacgtgataacagcaggaatgtactgtactcatctccatccccacaggctttgtcgaggtctcccttgatcggatcgtttccacggtccctgccagtgtcgtgggaggaccccccgccggaagccacgtcgccgaattccctgagactctcgaggcttttctccaaggccgacgaggatctagactcgctgacgttcatccagaagctggtccgctcctgtggcatggaccgagcaagctgcgtgttggctggccctctggacccggacctgctcgagaaggtttcagagcacgaagacgacggaaccaggttcgggagaaggcggcttcttttcgacgccgtaaacgaagcgctcgccgagctcgcctggacggcggaactggccgcgtacccctggggcggcggcagatcacgcctggactgcaactgcaagaacggttccggtggtgactcggcggccgaggagatctggcgcgttatcaggaactggtcgacacttgacaagtaccctccctgcgaaactatcgaaggaaacgtcttgctggagatgatactcaggcgggaggcggacagcggcgagacggctcggttggaggtgtttggtctcggcgcctcggtctgcgccgtggtgttggaggagctggttgaagagacggttgtggatctcctgactgactgctagtgagtgatacttgctgctgctgttaacactgctccgttaatccacccctcaagatggaatgggtctcttttgccttgttcacatctttgttttgaccggcatttgctctagccgttgactggtaatggatcatgccatttgtttcgccgttcaattacacacacgagacaaaaaaaaaaccggtaagtaattgcatct

SEQ ID NO: 13341 - DNA, 1854 bp, Zea mays
gcacgagaccattacctagaacatcctaatcgaaaaaaattgggtacctcgaggccggccgggaaaacacaattcacaggccctctccgatactcttccttcctcggtccaccttttttttcccggccctctatctccttagctgccaagaacacgctgttcgatcgtctcgtgctagcgtggtagtctggaagcgtctctttttttttcttcttcctgttcgatccagttctacccgtccaatccaatccaagctcctcccttcaccccaaagggacgagagagagagagagaggtcctctatggccgggcctgctgtccaccctcgtcacggcagccggccggcgctctgaactcccgagccggctctccatcagccacgtcgcgcgccgcccaggagaaggagctctttaatctgtgctagcagcggtcccagagaatgcggcagatctcgtcgctgctgcagggcctggcccggtcactctcggtggggagggacagggacagggacagggaccggaaagggaacggcgcaggcgaccgcaagaccgccgtgccggcggtgctgcggacgtcgggcaccctgtggggcgacggctcggacacgttcgccgccgtctgctcgcggcgcggcgagaaaggcatcaaccaggactgctccatcgtctgggagggattcgggtgccaggagggcaccatcttctgcggcatcttcgacggccacggcccgtggggccactacgtggccaaggtggtgcgcgactcgctgccgccgtcgctgctgtgccactggcaggaggcgctcgcgctcgcgtcgctcatcgacgacggcaagaaaaagctcggcgactgtcagtttgatctctggaagcggtcctacgtggccgcgtgcgccgccgtggacgacgagctgcggcgtagccgtcgcttggacgcggtccagagcggttgcaccgcgctgtccatcgtcaagcagggggacctcatggtcgtcgccaacgtcggcgactcccgagccgtgctgggcaccacgtacggcgatggcaccatcgtggccgtccagctcaccgtcgacctgaagcccaatctgccacaggagaaggagcgtatccggcggtgcaacggccaggtgtactgcctcgccgatgagcccggggtgcaccgcgtgtggcagcccagccgggagtcgccggggctcgccatgtcacgcgcgttcggcgactactgcgtcaaggactgcggcgtcatctcgacgccggaggtgacgcagaggaggatcggcgccagtgaccagttcgtcatcctcgccaccgacggggtgtgggatgtgctctccaacgacgaggccgtgcagatcgtggcagggacgctggaccgggcgaaggcggccaagcgtctagtggagtgcgccgttcgcgcgtggaggcgcaagcggcgcgacatcgccgtcgacgactgctcggcgatctgcctcttcttccacccatcgccgccgtcgtagacacgaaaacctgtaacgtgccgaagtccacgccaaggaggagggggcaactaaatgcacatctcaagacagactacgattattgtgcccgtggcgttcgtagagtgcactgccgccgtccaccgttcagaacgtgcagtttgtcgcgtgagagcgacactccacgattaggaactgcagccggtgcacggccaaacaaaaagatctccgggtttcacacgttgccagtcaagatgtacgagaacatcagagaaaaagtgtaggaaagacgcattttgtcctcatttttgggtgcctggctctgaatttctcagtcgcaattatagatgcacgtcagtcacaatttggtcacg

SEQ ID NO: 13342 - DNA, 1828 bp, Zea mays
cattgtgcccccccgggccggccgggaaaccacaattcacatgccctctccgatactcttccttcctcggtccacctctctctctttccctctctctctcccggccctctatctccttagctgcaaagaacacgctgttcgatcgtctcgtgctagcgtggtagtctggaagcgtctccttttttttttcttcctgttcgatccagtcctgtccgtccaatccaatccaagctcctcccttcaccccaaagggacgagagagagagagagagagagagagagagagagagagaggggtcctccatggccaggcctgctgtccaccctcgtcacggcagccggccggcgctctgaactctcgagccgagtagccgactctccatcagccacgtcgcgcgcccaggagaaggagctctttaatctgtgctagcagcggccccagagaatgcggcagatctcgtcgctgctgcagggcctggcccggtcactctcggtggggagggataggaaagggaacggcgcaggcgacggcaagaccgccgtgcccgtgccggcggtgctgcggacgtcgggcaccctgtggggcgacggctcggacacgttcgccgccgtctgctcgcggcgcggcgagaagggcatcaaccaggactgctccatcgtctgggagggattcgggtgccaggagggcaccatcttctgcggcatcttcgacggccacggcccgtggggccactacgtggccaaggcggtgcgcgactcgctgccgccgtcgctgctgtgccactggcaggaggcgctcgctctcgcgtcactcatcgacgacggcgagaagaagctcggcgactgccagttcgatctctggaaacggtcctacgtggccgcatgcgccgccgtggacgatgagctgcggcgcagccgccgcttggacgcggtccaaagtggctgcaccgcgctatccatcgtcaagcagggggacctcatgatcgtcgccaacgtcggcgactcccgggccgtgctgggcaccacgtccggcgatggcgccattgcggctgtccagctcaccgtcgacctaaagcctaacctgccacaggagaaggagcgcatccggcggtgcaatggtcaagtgtactgcctcgccgatgagcccggggtgcaccgcgtgtggcagcctagccgagagtcgccggggctcgctatgtcgcgcgcgttcggcgactactgcgtcaaggactgcggtgtcatctctacgccggaggtgacgcagaagaggatcagcagcagtgaccaatttatcatcctcgctaccgacggggtatgggacgtgctctccaacgacgaggcggtacatatcgtggcggggacgccggaccgggcgaaggcggccaagcggctggtggagtgcgccgttcgcgcgtggaggcgcaagcggcgcgacatcgccgtcgatgactgctcggcgatctgcctcttcttccacccgccgccgccgtcgtagacacgaaaacctgtaacgtgccgaagtccacgccaaggaggagggggcaacgaaatgcacatctcaagacagactacgattattgtgcccgtggcgttcgtagagtgcactgccgccgtccaccgttcagaaacgtgcagtttgtcacgtgagagcgacactccacgattaggaactgcagccggtgcacggccaaacaaaaagatctccggctttcacacgttaccagtcaagatgtacgagaacatcagagaaaaagggtaggaaagacgcattttgtcctcaaaaaaaaaaaaaaaaaaaagcccccactcgaggaagggccgcggtacc

SEQ ID NO: 13343 - DNA, 6642 bp, Zea mays
gggagagttgactggggagtatgattaataaggtagacaacagtgtcaaaagttttgatctagaatttaagtgtcatgaatgcatgggtgggaatggcatgcccaacctcaactatgtggcaatacttacgctttgttcagccatttttagtgagaataaggatatgaaatatgacgggatatgttatcttgcacagagaagaaattgagtttctgatatttgcctccatggtcagtctacatggtaagagttctcgtaccaaattgccggtcaactatgttttgaaattcttgaaaattctagaagacttgtgacttgtactttaggagaaagatccatttgaatttactatagtcatcaataaatgacacataatatttatgttcaataattgagcttgggacaagaccccaaacattagagaagacaggcaccaaataataatgagacacactattagatttattataaggtaattgttgaatttctgccttctcacaaatatcatggactaattgttgatgggactcaaccaaaaatagaactggtgactttttaactatagaaaccgaagcatgatctaatttaccatgccacttggtgaaacttggttttgttgtaaggaagacttgattggttgatggtgattagtgaggatgaaagatgttttgttatatggaagacttgcttagtagatagtgaggatgaaagaggatagagctcttgatgacactattctttaagtagagttctcctcatggtctgatacttaacaaagaagacatcaacatgaaattcaagatatacagaattaactttagcaaggcgataagtagaaataagacttatacttgtgttaggaacacaaaggatgttgtttaagaaaagatgatggattggagttttcacaactgagtgtccaatatggctaatcttcatatatgcaccacttgtcgtgtggatctggtcaatccctttgtatttatcatggagcattacttctcaagttctcttatgattgatttgtagcttatgtgtccatgtataaattgaatatttgtcgacgaatatcatctcattcggggtttgctcttatatttgtcgaatataatatctccgttctcgaatatttgtcgctggatagtttatttttaaactaaaacatgacaaataaaaaagaacggagagagtatatcgtaacaaaaaaaagtatctaatgatactctaatgttttcttatatatatagttaaaatctaaagtaattggtttatgcgaagcgacatgtgtgtgcatcttttgacgagagatggttgcgtgcacgtacaggtacaggtacaagcagcaagcagatgagatgcccacgcgcaacacggagctgggctggggcaggcagggccgcatcggcatcggcatcggcatctgcatctgcatgcatgtgcgccatcatcggtcgtcgcggggtcagcgaaagatctcgtgcccgaatcgggcgggcggcgcgcgcaacacgcggccaggcgaggcgacgaatcgatcacccgtcgacgacgaatcggagaggatcaaagcgggcgcggctgccggtgccggccggtgaacgcagtgtcagtcgcatcaacggagaaaaggagtgaccgcctaattgagcaccgccgctcgtagtggtagactggtagtaacaggtggtgttgacgcaacagcaacgcacccggccagtccggtcgtcgagccgagccggctgggcacagtcgcacagagaagtatctcgcttcgtgtggcctccaggccgggctcgccgcggggaatctccctcgtgccacgcgtggtaggagcgccggtcggtgttcttcagccggggcggtggcatgcccatgtcagcctgctgctgcgtcggcttccgatcctgtacgtacgctcccgcgtttcagggaggttcgtaaacccaggtgcaaaattgcaggtttccgttcgtatatatatcctacgaatattcttacaaacacacctatgtacctatgcattcttgtgggtcattgctgacactatttgaatattctcgctgcctttagataactaattaaatgttatctcctttccgataagttggcacgtacaggacgcgacggataaacaagcatatcaacgcttccgcggatatgttttattacaattgctgaataccaacccaaaaaaaatagaaattatgatctcactattcatacgtcttaaaaagaccctacaacaaaagcacattccagaacgggccgttcatgtcgttaccagaaagcggaggaatggatatgccagcctgaggggcctatcctgtccgtcaacacacgagggagaagccgcgtgcgtgcctgtgccgtccgtccagtgatccagtccgtgcccgcccaacacacaacacaacccagacccagggaatgttgctgtgcaagcgacgggcaccgcgcttgttgactcggcttcccctgctcccacggctctccctcccacctcatcttcctcctcctctcctcctccatctcctttaaaagctccgtccaagctttcacctcgcttcaaaccacaattcacaggccctctccgatactcttccttcctcggtccaccttttttttcccggccctctatctccttagctgccaagaacacgctgttcgatcgtctcgtgctagcgtggtagtctggaagcgtctctttttttttcttcttcctgttcgatccagttctacccgtccaatccaatccaagctcctcccttcaccccaaagggacgagagagagagagagaggtcctctatggccgggcctgctgtccaccctcgtcacggcagccggccggcgctctgaactcccgagccggctctccatcagccacgtcgcgcgccgcccaggagaaggagctctttaatctgtgctagcagcggtcccagagaatgcggcagatctcgtcgctgctgcagggcctggcccggtcactctcggtggggagggacagggacagggacagggaccggaaagggaacggcgcaggcgaccgcaagaccgccgtgccggcggtgctgcggacgtcgggcaccctgtggggcgacggctcggacacgttcgccgccgtctgctcgcggcgcggcgagaaaggcatcaaccaggactgctccatcgtctgggaggtcagctctctctctctctgtctccctctctctctgttactcggcctctgctgttcgttctgcttctttcttccattaatttcgttcggctttttgtactggatttcgggtgtcatcataaagtttgtgattgcacgtgatatctccatagagttctttttttaaaaaaaaaaaaaactggaaaattctcgtcgggctcatgcgttctactgcatatatataagaaaccaaacatgaaacagcgtcagatcagtgtttcagctcattttgtgattctgacaactcatggaaaaaagccccccctttttttaaccaaacatataatagtaagcacttcttcgtttcagagggataaaggccaattaggaggcataggtattggagcacgagtctctggtgtttcctcttggctttctcttcctcacaaacaatacaggagagggccggggtcatacgtgtccttggtgatatggtttcttttcagctctcggtatctcaacccaagtcccaaggtagctgtagttaagctcactgcttaagacggaaaagttagccacatcatcatcacatagtggattaagattaacccacaacacattcctgagagttcttcgtggacggcatatttttccttcctggagattgtattttctattcgtgttgcctaactaatctggctttttaattctgcaaaccaaagcatccgatagagtgaggacaatcatgacctactggctactgctaggtggctcaaatggttggttcttctttcggttggttgtgtgtgatgtcactgtggaatcataaaattgtcgtctatggtgcaatgattgtacagcattctggcttagttttgacccacccaattcgtcagttactgattgttttggaccggacaaaaatctgaagaatttcccacggcacgaattcttttaagaaatactaatacaagtttgtgcatgattgttcttgttcttgtgtaatgaaacaaaacttgttcacatggccttctccgtcgatgtcctcagggattcgggtgccaggagggcaccatcttctgcggcatcttcgacggccacggcccgtggggccactacgtggccaaggcggtgcgcgactcgctgccgccgtcgctgctgtgccactggcaggaggcgctcgctctcgcgtcactcatcgacgacggcgagaagaagctcggcgactgccagttcgatctctggaaacggtcctacgtggccgcatgcgccgccgtggacgatgagctgcggcgcagccgccgcttggacgcggtccaaagtggctgcaccgcgctatccatcgtcaagcagggggacctcatgatcgtcgccaacgtcggcgactcccgggccgtgttgggcaccacgtccgacgatggcgccattgcggctgtccagctcaccgtcgacctaaagcctaacctgccacgtaagtcgctaccgaccggtggccgaccgtgtgttcttgtgtgtgcgctgggacggcggtgtacatgcgttgcaacagttgctgacgttgtgtcctggaatgtgatggtgcatgcagaggagaaggagcgcatccggcggtgcaatggtcaagtgtactgcctcgccgatgagcccggggtgcaccgcgtgtggcagcctagccgagagtcgccggggctcgctatgtcgcgcgcgttcggcgactactgcgtcaaggactgcggtgtcatctctacgccggaggtgacgcagaagaggatcagcagcagtgaccaatttatcatcctcgctaccgacggggtagctttcggcctatctgcctttaattctctatgcaaacacaggcacatgcacccatcttttcgtttaagaaagcatacacattgcttggtgactgacgatggcaaacgggaattttatccgataggtatgggacgtgctctccaacgacgaggcggtacatatcgtggcggggacgccggaccgggcgaaggcggccaagcggctggtggagtgcgccgttcgcgcgtggaggcgcaagcggcgcgacatcgccgtcgatgactgctcggcgatctgcctcttcttccacccgccgccgccgtcgtagacacgaaaacctgtaacgtgccgaagtccacgccaaggaggagggggcaacgaaatgcacatctcaagacagactacgattattgtgcccgtggcgttcgtagagtgcactgccgccgtccaccgttcagaacgtgcagtttgtcgcgtgagagcgacactccacgattaggaactgcagccggtgcacggccaaacaaaaagatctccggctttcacacgttgccagtcaagatgtacgagaacatcagagaaaaagggtaggaaagacgcattttgtcctcatttttgggtgtctggctctgaatttctcagtcgcaattatagatgcacgtcaatcacaatttggtcacaaatcacatgttttggtgacacctgccgaacaaaccaaaatcctagatcttctgcgcggagcaccatgcgtcatttcgaacatcctggaacacactagtactaaatcctagtaattcactaactcttaatacgatacactgcaagcgcatgatagcccaagctgtggtggatatcagagtcaagatcaaaccagccaccgtagcgactcgggaggctcatcttcaaccgcatcccgcgtggccaatatcaggttcatttcatccggtaaaggggtatttgattttcctgtcgtatcgaacgtttgaatatcaattacgagtattaaatatatacttaactagacttaataaatttgtctcgctgtttaatctttgtgtatataattagttttataattagactatatctgatacttgtaattgtcatttaaacattcaatgtgatagagactaaactttagtttggtggaaccaaataccattaaactgaactcaaacttatgtgcgataacttatagctactgtagaaagagagtcggcatgtgaagaatataccatagtcgttctacctcatcatccttgagatgaactatcgctttagtatcgttgtcattaaaccccgaacgtataagctccgttctagcgcatctagtggctggggttcgcgagcaagtttatgtcagacttaactatggtactaaagataggttggtgtccatactttaaccctagatatttaaaaatcttcagtttagggatgaactcaagcgaaaccctctcaaagtcttgattcatccattagaaagcaagtagaacaaggagagatcaaatccttaccgattttcccccaaaaccctaacctcaactagccatcctaagcacacacagagagaaaagggcgtaaggcttacctagtcaacgatgaccatgtaagaaggaaacaatgttgctgatcttacatgtgatggtgcgtgtggacattatggcgccgctaagagaccactcgattgtg

SEQ ID NO: 13344 - DNA, 3014 bp, Zea mays
ttctacctattttactttctcaggacatttagaccacatgaaatcaacaaacagagacctctcaaaggaaggaagaaaaaatagaactattatcttcttcccacctctagaagaatctaaaactatgctttcataggaaaatcatgaaaccaaagcacataaaaccggaagattaaattcctgatcttttttttggtgtcaatgtcactgattagtaagttctatatcctatagtaaaaacatcgagactatatttataccttaattggatcctttatattgttatacgtagaatttaaactgccatgatgtacgttgattgagatggatatatacatgtctattcaaaacaagtcgtaaagcaatttaaaaacctcattagaaaaaataaatactccatctgccctaaattaaaattaaattttagaaatagtagatgcgatacttgatgaatgtgcgatatatatatatatctcaagattcattattgtctatttaattataaacatcaaaattaaaagttaaaacggatactattttgagactaagtgagtatataactccctttctgattaaaaaagctgaatttctgcaacaagaaattttattctaaagacgcaaacaaagttgaaatggtaaaagacacttttgagataaaaaaaataaaaaatcgaatcttattattgtttattacttaacaattacgcatcgaaatctgtttttgatagaacactttcttcttctacccttcctccttcctcacccacatactctcccctggttgggcctgtgctgtgtggccgctctccctccacccaacccaaccaagaaacacaggccctcgctcaacactgggccgcgcgagagagaactccatggccgccatggacctcctctccggcaagctcctacgctccctgcgtctccattcctcactcctcccctctgctccttcctcctcccgcgccgtccccacatcccgccgtctccggcgccgccgccatgcccccctgtactgccgccttaccaccacctcctcctcctcatctgcctccaccaccacaaccaccggggtggaggaagacgtcaaaagccaggacctttcctccctcctcacctcctccgacccttctgccgcgcccgccgtcgggaccaagaagaagcggtcgggcggcagcagcggcgcgtctagcatcccgtccggggtgcggctggagggaatctccaagtcctacaagggcgtgacggtgctcaaggacgtgtcctgggaggtgcagcgcggcgagaaggtggggctcgtcggcgtgaacggcgccggcaagacgacgcagctccgcatcatcgcggggctcgagaagcccgacggcggcgccgtcatcaaggccaaggagaacatgaagatcgccttcctcagccaggagttcgaggtctccgcctcccgcaccgtcagggaagagttcttcagcgccttcgaggaggagatggaggtcaagcggcggctcgagcaggtgcaggcggcgctcgagggcgccactgaagacatggacctcatgggccggctcctcgatgagctcgacctgctgcagcgccgctcccaggacgtggacctcgatatggtggacgtcaaggtgcagaagctcatgccagagctcgggttcatgcctgaggacgccgaccgcctcgtcgcctccttcagcggtgggtgggaaaatgaggatgtctctaggcaagatgcttcttcaggtcccggctttgcctccgcctcgtcacgcatgatcctgaccttacagaagtacgatatgaggaattgtaatgactgcaaatgtaattgcattgtactagcaaattggcagtgaattctgatagattgtcactgggttattgatagaaattgattttagttttaaatgttctaagcatagtgtcccaatttgttaatgacattgtaaatttgactttgtgcaggaccctgatttgcttttgcttgatgagcctacgaatcatgtcgatttggataccattgagtggctggagatgtatctcaagacgcaggatgtgccgatggtcattatatctcatgacagggcgttccttgatcagttgtgcacaaagatagtggaaactgaatttggtgtgtccaagacatacaagggtaactattcagagtacattctagcaaaggcggtagcagtggaggcacagtatgctgcgtgggagaagcaacagaaggaaattgaacagacaaaggagctgataaacagacttggtgctggagttaatgcagggcgtgcttccagcgagcagaaggtaactacttggattgcttattgggaaaccaatcactgtgaccgagttgtaattttagttgctatttttcttcatatacttctacacacttgtgtgtgactagtaacttttatcttgtttcaacagaaattggagaagcttgaaaaagaagggttgattgagaaacctttccaaaggaagcagctaaagatcagattccctgagcgtggaagaagtgggagaactgtgttgacgataaacaatcttcaattcggatttgagaataaggtcaacaatgttgtgcaaatgctcatttcttccaagattttatttttttcgaatttatacactgtgatattctctacatcaaacttttgcacatatcctgattgctgtgttgtgtgtccagactttgttcaacaatgctaatctgatagtagagagaggtgaaaagatagctattattgggcccaatggttgtgggaagagcacactgcttaaacttatgttggggatggagaagccacaaggtggtgaggtgcttcttggggagcataatgtgttgccgaactattttgagcagaatcaggtaaaccgagctactctgtttgttatcttctattgtggttatttcagataaaatgtcaccatggggggacttggttattagtcatgttcctactcaacaaatacagtaaagttatccctttcctattagattaatgggc

SEQ ID NO: 13345 - DNA, 2369 bp, Zea mays
gggtacctcgaggccggccgggatactcttccctggttgggcctgtgctgtgtggccgctctccctccacccaacccaaccaagaaacagaggccccgctcaaggctcctccgagagacagagaactccatggccgccatggacctcctctccggcaagctcctacgctccctgcgtctccattcctcactcctcccctctgctccttcctcctcccgcgccgtcatcaaggccaaggagaacatgaagatcgccttcctcagccaggagttcgaggtctccgcctcccgcaccgtcagggaagagttcttcagcgccttcgaggaggagatggaggtcaagcggcggctcgagcaggtgcaggcggcgctcgagggcgccactgaagacatggacctcatgggccggctcctcgatgagctcgacctgctgcagcgccgctcccaggacgtggacctcgatatggtggacgtcaaggtgcagaagctcatgccagagctcgggttcatgcctgaggacgccgaccgcctcgtcgcctccttcagcggtgggtggccacgcggccggtctctaggcaagatacttcttcaggaccctgatttgcttttgcttgatgagcactacgaatcatgtcgatttggataccattgagtggctggagatgtatctcaagacgcaggatgtgccgatggtcattatatctcatgacagggcgttccttgatcagttgtgcacaaagatagtggaaactgaatttggtgtgtccaagacatacaaggggtaactattcagagtacattctagcaaaggcgggccgcggggccggcccggtatgctgcgtgggagaagcaacagaaggaaattgaacagacaaaggagctgataaacagacttggtgctggagttaatgcagggcgtgcttccagcgagcagaagaaattggagaagcttgaaaaagaagggttgattgagaaacctttccaaaggaagcagctaaagatcagattccctgagcgtggaagaagtgggagaactgtgttgacgataaacaatcttcaattcggatttgagaataagactttgttcaacaatgctaatctgatagtagagagaggtgaaaagatagctattattgggcccaatggttgtgggaagagcacactgcttaaacttatgttggggatggagaagccacaaggtggtgaggtgcttcttggggagcataatgtgttgccgaactattttgagcagaatcaggcagaagctcttgatttagagaagaccgtgttagacactgtagcagaagctgcggaagattggatacttgatgatatcaaaggtctccttggccgttgcaacttcagggatgacatgctggatagaaaagttcagtttttaagtggtggagagaaggcaaggcttgcattttgcaagttcatggtgactccatctactctactcatcttggatgaaccgacaaaccatcttgatatcccatcaaaagaaatgcttgaggaggcaatatcagaatatacaggcaccgtcataacagtttctcatgaccggtacttcataaaacaaattgtcaacagagtcatcgaagtgaaagatcagactatccaagactatcaaggagattacaattactaccttgagaggaaccttgaagcccgagaaagggaacttgcccgcgaggaagagctcgaggagagagcccccaaagtaaaagccaagtccaagatgtcgaaggcagagaaagccgtcaggaagaagcagaagatgcaggccttccagcagagcaagcagaaatccaagtcgcttaagaactcgaagcggtggaactgagatttttcgtcgttcgtagaggcggcgttggcgttcgtcacaatgccgaatgccatctgagacaccttgcaatgcagataccagtgtttgctactctgcctgctgtgccgtatgctataatagtcgccatatcagcagaagcactgcaaatacatcatcagaaagtagccctagtagcaatgaatgtagaagatcgaaaaaaaaaatactgtaactataagcaggaagcgttatgtgaccttgtacataatacatgcactttcggatggaggaacggcttattttttggatgaacggaataatggaatcaaatcgcacagcatttcagaaaaaaaaaaaaaaaaaaaaaaacataccctggttgaaagcttttcaaagaaatgtgcactatactaccttcagaagctcaccacattctggaattgatgaaaagaagggaagggcaccgaattaaaaatcaccctgtactctcaggcatcgagattttcaattcagcgaatgtcagcagaggaatccttgcttct

SEQ ID NO: 13346 - DNA, 1906 bp, Zea mays
cattgggacctcgagccggccgggaaactttcttcttctacccttaccctcgaggccggccgggactctcccctggttgggcctgtgctgtgtggccgctctccctccacccaacccaaccaagaaacagaggcccccgctcaagctccgagagacagagaactccatggccgccatggacctcctctccggcaagctcatacgctccctgcgtctccattcctcactcctcccctctgctccttcctcctcccgcgccgtccccacatcccgccgtctccggcgccgccgccatgcccccctgtactgccgccttaccaccacctcctcctcctcatctgcctccaccaccacaaccaccggggtggaggaagacgtcaaaagccaggacctttcctccctcctcacctcctccgacccttctgccgcgcccgccgtcgggaccaagaagaagcggtcgggcggcagcagcggcgcgtctagcatcccgtccggggtgcggctggagggaatctccaagtcctacaagggcgtgacggtgctcaaggacgtgtcctgggaggtgcagcgcggcgagaaggtggggctcgtcggcgtgaacggcgccggcaagacgacgcagctccgcatcatcgcggggctcgagaagcccgacggcggcgccgtcatcaaggccaaggagaacatgaagatcgccttcctcagccagggagttcgaggtctccgcctcccgcaccggtcagggaagagttcttcagcgccttcgaggaaaggagatggaggtcaagcggcggctcgagcaaggtgcaggccggcgctcgagggcgccactgaagacatggacctcatgggccgggctcctcgatgagctcgacctgctgcagcgccgctcccaggacgtggacctcgacatggtggacgtcaaggtgcagaagctcatgccagagctcgggttcatgcctgaggacgccgaccgcctcgtcgcctccttcagcggtgggtggaaaatgaggatgtctctaggcaagatacttcttcaggaccctgatttgcttttgcttgatgagcctacgaaccatgtcgatttggataccattgagtggctggagatgtatctcaagacgcaggatgtgccgatggtcattatatctcatgacagggcgttccttgatcagttgtgcacaaagattgtggaaactgaatttggtgtgtccaagacatacaagggtaactattcagagtacattctagcaaaggcggtagcagtggaggcacagtatgctgcgtgggataagcaacagaaggaaattgaacagacaaaggagctgataaacagacttggtgctggagttaatgcagggcgtgcttccagcgagcagaagaaattggagaagcttgaaaaagaagggttgattgagaaacctttccaaaggaagcagctcaagatcagattccctgagcgtggaagaagtgggagaactgtgttgacgataaacaatcttcaattcggatttgagaataagactttgttcaacaatgctaatctgatagtagagagaggtgaaaagatagctattattgggcccaatggttgtgggaagagcacactgcttaaacttatgttggggatggagaagccacaaggtggtgaggtgcttcttggggagcataatgtgttgccgaagaagccacaaggtggtgaggtgcttcttggggagcataatgtgttgccgaactattttgagcagaatcaggcagaagctcttgatttagagaagaccgtgttagacactgtagcagaagctgcggaagattggatacttgatgatatcaaaggtctccttggccgttgcaacttcagcatgtcatccctgaagcccgggaaggccggaccggaactgcagga

SEQ ID NO: 13347 - DNA, 9260 bp, Zea mays
  misc_feature (937)..(937): n is a, c, g, or t
ccacacctccttcaccgtctccttgtcggtgactgcagacaccatctcaagtggcaatacacaacagagagcgtcaagcgccatcatctcctcgtgtgaatcgtcatctcccttctcgatgaccttctgccgagctcatgccttcaacttcaccttcatcgggagcactaaatatgagtaatttatctttgtgagggcggtgtagttatccctaccacccacctcatgaatcacctcctggatgcctggatcaccatgccatctttaaaggtgttgttcttagactttgtcttggatatcttcgacaatatatctctgataccaattgttaggacccttagaactttgttgtagcaagcacttgaccaagagagcacacaaactcacgtaacagtaacacataagaacacatatgaagcacaggacagtagcgcaaggattgacaaatcacagctgggtggagcatattagaggggccctgtcagtgcaagttctggtcgaaaatttgcaactttgggatcttgtatatgcgctggaactccaagccaacaatctaggcggtcaaacacataaaggctaattttctaatatgggtaacataccaaaacttagcactcaaggtttattttcaacatgtccatgtgaacttgattaggctaataaagggattttgggtctttcgtttgggtgaatttagaatgaggtggtcttggagtatttggcctacaattaagcatctttgtgtgagtttgtgctgttcatgggaggttttatttgattcctttggggattatggaactctgtattttgacatggggaagatttggattgagccatattgtttgaataatgattgtctaacatccatccttatcctctcctcctagttgcaggtacaaccgtgaataccgacatccctgttgtactcacaggcatntccatcaacctttgttttcttcgtgatgtgtgtgctaaatatttttgtgttcagatgatccattcacattgtactgactgagtcaacacactccactctagcatgatattggttcttccgatgtggcagctcagttcaaagtcatctcgatgctactttgtgtgcttgctcacatggagagtgctaaaatatgtggttttgagttattataaatgcccatgccaacgttttttttttgtttttttttttttgcagaagaatacaaacctgtggctttgtgttataaattgctttacatactgtagttttgtgagatttgttttttctttcctatcaaaataagtgtagaacaactgattctatagctcatggactaatcctttagtcttgggcttctatcatcagatcagtaggccagacaacctctcttgttcaccagttgcatgactaaaaaatatggtccacagagatagtaaagtgtggcatacaactattgaaataagttaaatgtgccatatagagaagattggaataaattaacttatcctgcttgtcaacatatttcaaataaataaaagtcctactaatattactgttaatttcggtttttatttatcttttatttatttattctggtcaataacaggtgctcagcattgtggcgaatgtgctttggtaaataagattatgactggaaatctcatacaccgccatgataagataaagcgtgaagctgatatcagtggcaatattaagatttttacggaagatgagattgaaagaattaccaacaacttcagcactcttatcggaaaaggtggctttggagaagtttacaggggaacccttgatgacgacaacgagcctgtagcagtgaagaaatacatcaacgaagattcgagggaagtgttcatggaagaggtacgcatccacagtaaaattggccacaagaacgtggtgaagctcataggctattgcatcggggaaagcactctcatgatcgtgatggagtatatgtccaaaggaaatctcaacgacctgctccactctgaaatctcgatccctttggatgtgagattgggtatcgctatagggtgtgcagaggcattgagctacatgcactcgatgcatgtatcatccggcaaccttgtctgtcatggtgacattaagccggccaacatacttttagacgacaatctgacagcaaaattgacggattttgggatctcaaggcttctggttggtggcgtcactcgctacactaccactgtgaaaggaagcataggttacatggatcctatatacattcaagagggacgccttactccaagaagtgatgtttatagctttggattagttctatgtgaactaatggctggaaaaggggtaagaaaaggtgcaatcaacctcattctatacgccaacaaaggctgtgcaagtggtaaagggttcagagagatttgtgatgctgcaatcgcaaacgagaacaacatgaagatccttaaagagatgcagaaactggcagccgaatgcctatcgctgaccatttctaggcgtcctcagatgactgacgtggtcaaacgcctccggacgctgagaaaggaactaaagaacaggcatgagaactattcggaaccaatcttggcatcgcaccattcgtggcgcaagaacaagaagcaagagatgatcgcgcccacctataactctaagctgcagatcaagaagagcctgagcttcttcaagaggagcatcagcagttccaaggtccaatcggagcccagcaacgtgaggattttcgcgcaggaggagctgaaagaagtcacgcacaattactcttgtctactcggtggaggtctttcaggcaaagtctacagagggacactcgaggacaacgcagtggtcgcggtgagagtgttctctgaagtgctcgagggcttcgaggaagcgtttgtcaatggcgggatgatcctgtctcagatatcccacaggaacgtcgtcaaactcttgggatactgcttggacgccgattgcccggcgttcgtgtacgagtacgcagctagaggcagcctatccgatgttctggacaggcacgaggacttcccgctcgatctacgcgcgaagatcgcggtgaagatcgcagaggcattggagtatctccattcaccagcgaccggtatcatcaggcacggctacgtggtaccgtccaagatacttctggatggcaatttcatgccgaagctcactggcttctcatgggcgaggaagcttatcaaggacccgattcacgatcgctgtgtgtcactgagagtgaaagccgatgtgtaccagttcggcgtccttctcctgatgcttatcagcaggaagaactttgtgttctacgccgaccacgacgacatcgttgcgcagttccgcgcggctcggcaggcagatggcagcgggagggcgttcttcgacgatgatgttgcaggtcatggcggagacgttggtctgcttgaggagatggggaggctgtcgctcaagtgtgtttgcgaggaaatagaccagagaccgacgatgagtgaagtggcagagcaccttcggatcattacgaggtcctggaagaagtgttcttcgtcagagggagctacggcgctggtatctaaagccatggctaaaaagtcccatgtcgccgccgaggctgaagccactaaacttgattggccacctggttcggacattagagactgaccaccgtaaggaatcgtgtacatactgtgaatgatgtattgtattgtataatcatcatcagcaatctttcatgcgctgcaatttggtttgcaattatataatgtgtcatgcatgtggtcatgtggatgaccaaccggaacgtgtcctgttcaaagttaacaggtcaacttgcaacctgaatgtgtcatgcatgtggtcatgtggatggcaaccttactgcaggagatgggaagagtcacaagaacacggttggcgaagcttggaggcgcagaacaggtctccgaacccgaggccattccctggtttgatggcagttccattctggaaacggtgggcgcatgtaatcggatcaaatatgaacggatattatttattttatatttgttttcattttttgaattcagactgggatactgatattatcaagtcgtgtcggataagatttgaatagatatcgatatcttaaatatctatctttaagaatatggatacgtataaaaatcgaatacagatcgaatactgagtactcggatttagatataaatcggatctcaactcctttagataaatcgaattcgaatacgaacgcataatatccataccatttgctccactagctacatgttaacatgtagagctgtagctaagatgcactatattttttactcaaggtatcggtgcaaatttgtcctaaattattagacactctagattgctcaaccatatccatgcatgcgtgtattttcttacagctatgcgttgctatagaaattaaacaagttgacgaccaaactaactaattcgtgaaggtcgaattaatgttctgccacactgcttatcaccacatagatatcttggaggcagtggaagatcataaatcagctttagtgattgttgatggcttcggtcattgattgtgaggagctcttgtgcttatttttgtgagagattcatgaagagcaattctagtgaaatcttggatggttatagtgcttttgtagtgtggttcttatgttgcccatattatggatttgacgtgtgatgtcaattagcgtgtgaaccacctatcttcaactcaccacaaaaacaatgtaggttgcctgcaagcaaccactcctcatgaatatatcttgtgccatcccttgtctcgtgttgtttcctcacgcggcctcctcctccagtcaccatcatttacttgttgtacttgactacttgtacaactagtcttgtgtaaattgtaattagaggtacttgcatttgtatgatatctcttgctattaagtatcttgccgtgtctagattaaggacctatttggcaacaatgttactcaaaccatggttttacaatactatactttgtaattatcatagtaataccatagttttggccagctccaaaaaataccatggttttgagaaacattatttagatacaattgtaaaccataatattaaacaaaagctagccatgccataaaaactttgtttgaagtggaattttcaatactccaaaaatatcatgatatctagaataccataattttaaaaacatagttttcataaatgcacccaaacaacttatagcataaaatactatggtactactaaaaaccatagtattacttaaaaactataaaaatattttacttccaaaaggggctcaagcacgcactgcccagtgcacgcacagcagctacggtgaaggagcccattttgaggaggttaaaagtaacacaacttgtacatctttagaattgaattccaaaatgtgctaataggtgacatactagagcttgtcacaatgaaagggacagaactttgacatactagcagaagttgcttttcgaagtcaagcttatatttggaatttaatttggtgtagatttgaactttccattatacacatactgccaattgtatatatacacctccaaaattgtttctttcctgaatatgttaagtggcctagtagtgttagtcacctcgaaaaagacggcctagcttggacgtactacaagagtcgccttcaaactgaccttaattcttaacttgtagtttcaatttagtgccattttgaagaggttgtgtcagcatatatatatggtgtacaaatttgtcaagaacaaggtagaatgtcactttggaagtgacgtagctctctagtatgtcacttaagatattttagttgatcaattccaaaatatacaagatggcattgcacatgataacaaatctgattgtccatgccgcattctttcctcgtcaaagattgcttagttttttcatctattaatggtcataagaattgctaaactttttttgaagttttaataacttaacaaattatgaatcatccaaaacaaccatatccattggcttaacaaaatttttagtttaataaaaaatcgtttgctgaaggttattttatatttttattaaaaatataaggtctttcaaaaatatactaatactcttatccataagagtatgtatttgtattgcaggtgcagcggtccaaagctgcagcagccatgcagactactacaagagacagacgagacgacgatcgagtgcgagctgaattcagacagaccgccgccgcaaagccaagcaggacacgcaagcactcagccatggagggatccgcagcagatgggccgctccgcacgcgcgtatgcatcatcgggagcggccccgccgcgcacacggcggccatgtacgcggcccgcgcggacctcaagcccgtgctgttcgagggctggatggccaacggcgtggccgcgggcgggcagctcaccaccaccaccgtcgtggagaacttcccgggcttccccgcgggcatcatgggccgcgacctcatgaagcgctgccgcgaccagtcgcagcgcttcggcacccgcatcctcaccgagaccgtcaccgccgtcgacctctcggcccggcccttccgtgtcgtcgcctccgacaagtccacgaccgtgctcgccgacgccgtcatcgtggccacaggagccgtcgcccggcgcctcgacttccccgggtccgacacgtactggaaccacggcatctccgcctgcgccgtgtgcgacggcccggccccgatattccgcgacaggccgctcgccgtcgtgggcggcggcgactccgccatggaggagtccagcttcctgaccaagtacggctcccgcgtctacatcgtccaccgccggagcacgttccgggcttccaagatcatgcaggacatggtgctcaagaaccccaagatccaggtcgtctggaactcggtggttgtcggggccttcggcggcgcggacggggacggtggccggccgttgttggctggcgtcaaggtcgagaacctggtgagtggcgaggtcaaggatctccaggtggctggcctcttcttcgccatcgggcacacgccggcgacggagttcctcggtgggcagctccagctggactcgccttctggatacgtggtgaccaagccggactccacccacactagcgtgaagggggtcttcgctgctggcgacgtgcaggacaagaagtatcgccaggccattactgccgccggatctggtgaacactactgctctatgcatgattcagtcaagatataccggatcatttgagatgttttaaattgaagtgttgaaactatgataaattctacgcggcaaaactctgatgatcgaactgctctgctgcacaaatggtgattgtgtctacttcatccatccttgactccttgtttataaagagttaagagttacctgttttatgaagaaaatcaaaatgttcaacaaatatgttagttatcgttttgcaatagtagtaacgtaagtcagaatggtggttggtctcttaattacaagatgaatcttggaaattaactggcgtctgatggtttcatcacctgagcgtatacttgtggatggtgctgggtgcatggccgctttggatgttgagcactatctgcagggggtcgcggtcgtcggtgcacaggagggcaagtctgttcagccgttgacgatgctggaataagccgcaggcttagggctagtttggtggatcgggaaatggagggaatctatgggagagagattctcttaatatttatttaattttgaataataagggatccgttcctatggatcctatccattttcatatccaacaaaccagtcattaggagtggcacgccatgggttgtcatgatgattggtatttatatatagatttatctcgctcgctttatatatatatatatatatagttgtcgtctcgtctaaacttttaacatcgttgtactggaaactgattcgtccgcttatcaacttctcaatgtctagcagcctgctagtttctttctttcctttcaagagaaattattattaaggaaattatattggacaataaactctaacaatcccccacaatatcttgaaagaacaacatgatcgactctccaaatatcatcaaatgttgtttatataccaattttatgttggtgacaattaagtttaacattgatatagaatcacaagaattacatcagctcacaactactcagtggttgtgacttgaattggtagtgtgcaaactagtttcgctcaagaatctaactaatacttagggtcttttaggctacttcttccgttggagcttataggccataccccctatgtctttttttcatgagcttcttatagaattctcacaactcatagaccacgatcaactcacaactcatagaccgcgatcaacgatcagcttatataggtgtgttcgtacaaaaataccttgtaggacggtatctcattattaatcatctagatagattaagacaaaagtcatcttgccatattacagactagagtactagattttctctgaagcaggtaacatagtatatactctcctagttacactcatagcttgtcccccccccccccccaaaacttttaatttatggggtctccaatcaccgaagggttgtgttgccgccgtgtgcaactcaaggagtctcaagcccatttcgttcaatgcattatctaacacatttcaacagacctttaataaatggttctgcaagacacctattaaatatgattgtgtgatgattgccacaacgcacggacatttcgctgcagccgcccacggtaggcgctaagccgatccggggcacgcgtgaatcgacgccacacatggatagattgtggttgaggcggatatagctgtgcaggatcggagttgaggacgccgagtggttgtatatggtcctccgaccgtctgggtcgccacccgcgacgagctggccaggaaagccgaaagcggacagcggcgcgagtctccttgggtacaggcagagctccgatccatccggcacgccgaggattcgcgcacgaatgcgagacggacaaaccagcagcccaatcacgcagattcgcctgctgtctatcacccacgactagcctactcctccgtcgcctaccacgcaaggaaattgaacggcagcctcctccttttgtcgcctgccgccgatcctgcgattaataattaaactactacttcctcctccgtcttaaactat

SEQ ID NO: 13348 - DNA, 1026 bp, Zea mays
tccgggtggtgtggtcgtcagcgtcggaggaggacagcaggcacgagcccaagcgtcaggccaggagaaggtggcggatacgcccggccccaagctccgcggaagccaggagactgtgaacccggccccggtggtgtccggcgccggcgccgaggaggccgacaagcaggagggggcggcggccctggaggagaagaagaagaggaacatggccaaactccgcggcggtgcctaggcccagcagagcagatggatcggagcaggtgcctaggcccagtctgccaggccgcgctgcgctcccgtcatcatctattcatctcctcacccagattttgcttccctcgctcgctctctcattcgtttgtgcagctgattacgctaggtctatttacgcaactgtcgtgtgtcgaattttaacagcgacggccatgcaccaaacccccaccccacacatcattttctttcttcctttcttttgattcgacgacgcctgtgattcatgcatgctctcgatcgaggcaaagctgttgtatgttgttatggtgtactgttctttttattatttataaagttttgataaaaaacatgtaaacaaaacaatcacatacatcattcaaggatacaaggaactacagtatttgttatgtcctacgaccactcaactacgtaacaaaattcagaagaaggtaggtttcagcggaaggagaataggaatagtattgttccaaaatgttcgataattctgattcttccctcctctctcctaatctccctctatactgctacttttcttacatgggttgggtcttacatggaccacttgtccgacgcgaaaaaagactattggacctacggacacgttggcacaagacctttgcctgctcctctcgctgaacaattgtgtctgcaggcgccgctagagcatccggcacgctgacaccatttcaaataaaatctcactttggtaaaactgaagccggtctgcaagctaaacaattttaaaaaacttcaggtaaagcaaagctg

SEQ ID NO: 13349 - DNA, 740 bp, Zea mays
  misc_feature (733)..(733): n is a, c, g, or t
  misc_feature (735)..(736): n is a, c, g, or t
cctcgaggccggccgggttattagataaaaggctgacgcgggctgagccgcccatttgcgccgccgcagcccgcagtcgcttgcgcgcagcagcacttcgcaccgccgccccatcccatcgccgccagcggctgctcgatccgatggctcccacgaagaagtcgaagaagagcacagagagcatcaacaacaagctgcagctggtgatgaagagcggcaagtacaccctgggctacaagaccgtcctcaagacgctgcgcaactccaagggaaagctgatcatcatcgcaaacaactgccctccacttaggaagtctgagattgagtactacgccatgctggccaaagttagcgtgcaccatttccacggaaacaatgttgatcttggcactgcctgcggcaagtactacagggtgtgctgcctcagtatcatcgacccaggtgactcggacatcatcagtaccacccctggcacccagtgagccagccccggcacccattgcagctgcttcgcctttctcaagatgagatgagatgtagcgctccggccctatgtccgtttccttttttatcttttagctatgtaattttgctaccatgtgtccatctaccatactgatagtacctcttattatggctgctatgcaaggcatatccatggttttgtttgatgaaaaaaaaaaaaaaaaaaagaccaaaagacggcacgactagaaaaaaaaaaaaaaaaaananngggg

SEQ ID NO: 13350 - DNA, 825 bp, Zea mays
cattgggcattgggttcctcgaggccggccggggagccgcccatttgcgccgccgcagcccgcagtcgcttgcgcgcagcagcacttcgcaccgccgccccatcccatcgccgccagtgtctgctcgatccgatggctcccacgaagaagtcgaagaagagcacagagagcatcaacaacaagctgcagctggtgatgaagagcggcaagtacaccctgggctacaagaccgtcctcaagacgctgcgcaactccaagggaaagctgatcatcatcgcaaacaactgccctccacttaggaagtctgagattgagtactacgccatgctggccaaagttagcgtgcaccatttccacggaaacaatgttgatcttggcactgcctgcggcaagtactacagggtgtgctgcctcagtatcatcgacccaggtgactcggacatcatcagtaccacccctggcacccagtgagccagccccggcacccattgcagctgcttcgcctttctcaagatgagatgagatgtagcgctccggccctatgtccgtttccttttttatcttttagctatgtaattttgctaccatgtgtccatctaccatactgatagtacctcttattatggctgctatgcaaggcatatccatggttttgtttgatgagatgattgtacttgttctcttgttgatgttgatcggatcaggtcaatcgatgcgctgatgggctgcttggttacgctgtttgtcttagttacgaatcacaaaaaaaaaaaaaaaccgacctccccggtttttatataaggatatatattcctaaaacattat

SEQ ID NO: 13351 - DNA, 1763 bp, Zea mays
gaagttggagtattgtattatcctttttaatcctacattaacgggagaacacgagtggacagtgggctctgaattaaacacaagccctaaagctagcaagtggcaagtagcaagtagcaactctacttaatttcaacctgtcagcaggagcagctgttcatgcggatggcgcccctcgccttcccctgctacaatgcgaagaccaatatcgatccaaatggctcctcacatacacaagtcagtcaggtcacgtatgtgcactgtgtacatggcagtagcacccaaggtgcaagcaagccaagaacaaaatggtcactcctgcatctccgacgacgacgctgccggcggcccggaagccgttgcccttgctcctcttctccctctcgctccctgccctcctgctgctgctctccctcgtcttcctcctctcgcacaccaccttcagcctcctcatctgccctctcctcccgaggatgtcttcgacgcgcaatgcgacgagcgccggtagtagtggtacccacctcggtgtctccatggacaagaccttgcaagtcttccatgccacgatgccgacgacaccttcgaggcgcaatgcaacgagctccagttctagtacgagctttggtgtctcagcggacaggaccttgcagacattccatgccttcgcggcggcgccaccgccgccgccggcgtggccggctgctccttctgttactaagagcagcagaaagaaggcgtccgcaaagagaaacaagagcctcctcaagctcctgctcaggaagacaccgcagacgcggcaattcgcaccgtgcacggacgagctcttcgcggcaccatgcaccgaccgcttcttcatgacgtggctctccccgctcgagcagttcggtcgccgcgagctcctcgtcctggagagtctcttcaggtggcaccgcgatggttgcctcctcgtcgcctccgataccatggactccacgggcggcagggacaagctgaggccgttcctcgagcgcggcttccgcttagctgtcgcctcgccggaccttgcctacctcctgaacggtacgcccgccgaggcgtggctcggcgcggtccagcgcggccgcgtcagcctcgggagcatcccgctcggccagaacctctccaacctcctccgcctcgcgctgctatacaggtacggcggcatctacctcgacgccgacgtcgtcgtcctcaggccgctctccgagctccgcaacaccatcggagcgcaggccatgaacgatgccacgggcgactggaggcgactgaacaacgctgtgatggtgttcgacagggcacaccagctggtgcacgagttcatcgccgagttcgccgccgcgttcgacgggagcaagtggggccacaacggaccgtaccttgtgtcccgagtggcggcgaggctacgccacctcagcccggggctcgccttcacggtgctgccgccgcgggccttctaccccgtgcactggagcaagatcggcgggctgttcgttgcacccaaggataggaaaggcgagaggtgggtgaaggccaaggtggagaacatcaaaggccagagctttggcatccatctttggaacagggaaagcagtaggatggaaatggaggtggggagtgttattgaaacgctgatttcagacagttgcctgttctgcaactcctccatgtttgtaaaccaaggataggataacaggagattctgcacatttgcagctgcattcagaagatcaaaaaaaaaaaaaaaa

SEQ ID NO: 13352 - DNA, 1319 bp, Zea mays
gatgttgaacaagcacggggcaactattcaactttgcaaggattagagtggaaaccccttttgtcttgagggaaaaaaaataaagggagaagctctcctgagaagcatatagcaccagcggaacacgggaacggcggaagcaaacaactagaaattccccagcccggttctttgcgtgcggttgatctcgtcggaggcccggccgcggttccccaatccgccatcgaattcgatggcggccaacgccgggaataagatccgcaacgccaagctggttcttcttggagatgtgggcgctggcaaatctagcttggttcttcggtttgttaagggacagtttgttgaattccaggaatcaacaattggagcagccttcttttcccagaccttagcggtcaatgatgagactgttaagttcgaaatctgggatactgccgggcaggagaggtatcatagcttggctcccatgtactataggggtgcagctgctgccattgttgtctatgacatcacaaatccggcctccttcacccgtgccaagaaatgggttcaagaacttcaagctcaaggaaatcagaataccatagtggctcttgctggaaacaaggctgatatgctagatgcgaggcaggtgccagcagaggaagcaaaggcgtatgctcaggagaatgggctcttcttcatggagacatctgctaaaactgcaatcaatgtgaatgacatattttatgagattgcaaagaaattgcttcaagggcaacaagctccaagcccacaggctggaatggttctgaatcagagaccaaatgagaggacggtcagcagttcttcatgctgctcttgagctgtgtttcaacctcgtagtgccgttatcaaatgtatcagaggaggtttatggaaaatatcccatgtcgcttgtgtggctgcctttcaggctgacgtgctcccattctgctcctcatttcctttcacatgttcgtcatgtaaatgccaatactaaagtgtcactgcatgggcagaagtgttaccaaagtgttgattgtgctcttatcatttgattaagcccctgcttaagttctcaattttgcataaatacatggtggagtttcatttgaactctttaaccgatgaactacctgggttactcctactgacttggtagagcatggtaaattcagctacagtatcattgctgcaggaaccaagaaaggaaaggtgccctgttaataatgtttcctttctaaatgtcgctttgccagtttccaaatttcctgacatggaacagtaattgtaattttgaggagtattgtattgtcaaa

SEQ ID NO: 13353 - DNA, 1222 bp, Zea mays
gggtacctcgaggcctttttttctgggaaaacaatgaaccatataccaccaacggaacacgggaacggcggaagcaaacaactagaaattccccagcccggttccttttcgtgcggtttgatctcgtcggaggcccggccgcagttccgccatcagccatcgaattcgatggcggccaacttcgggaacaagatccgcaacgccaagctggttcttcttggagatgtaggcgctggcaaatctagcttggttcttcggtttgtcaagggacagtttgttgaattccaggaatcaacaatcggagcagctttcttttcccagaccttagcggtaaatgatgagactgttaagtttgaaatctgggatactgctgggcaggagaggtatcatagcttggcccccatgtattataggggtgcagccgccgccattgttgtctatgacatcacaaatccggcctccttcacccgtgccaagaaatgggttcaagaacttcaagctcaaggaaatccgaatacaatagtggctcttgctggtaacaaggttgatatgctagatgcgaggcacgtggcagtagaggaagcaaagacgtatgcccaggagaacggtctcttcttcatggagacatctgctaaaactgcaatcaatgtgaatgacatattttatgagattgcaaagagattgcttcaagggcaagaggctccaagtccacaggctggaattgttctgaatcagagaccagatgagaggatggtcagcacttcctcgtgctgctcatgaagctgtgtttcaacctcatacatagttccgttatgaaatgtatcagaggagattaagcaaaatatcccatgtggtgtcggtgtcgtccaggctgatgttgtccccttctcctgctgctcgtttcttttcacatgtttgtgatgtaaatgcccatactagaatgtcaccaaagtgttgattatgctcttatcatttgattacgcccctctcaaatttgcgtaaatacaaggtgtaattttttaagtctttaactgggttactcctactgacttggtagagcatggtaaattcagctacagtatcattgctgcaggaaccaagaaaggaaaggtgccctgttaataatgtttcctttctaaatgtcgctttgccagtttccaaatttcctgacatggaacagtaattgtaattttgaggagtaaaaaattaaaaaagagcggcc

SEQ ID NO: 13354 - DNA, 1809 bp, Zea mays
acaaagggattaggcgcactccacccatcatctagctgtcttgagagagctgagccaggagcggagggaagaataccacgcgctgggtccgaaccggagctggactggattcttcaaggcttccattccattccatggggtaaagcgatcccattcccactcctatcgtctgcctccaagacaacagttttaatctgcttgcttgcgctctgctgcctctggttcacgttcaccgcctctattccatggggtaaagcgagcagttttaaatacgagaggccctcgcttgtcactgaagccgcggcttcttgtgccttgcaacctgccgttggggcttcttctctacaaatacgttgcgcgccatggatggcgactcgaagaagctgaggcttcgggttgtcttctttttttctccgtaaaagctgaggtgaaaaaagggttcggttttctggagtaggaaagggaggtagaggtggacgccagggttcagcgataccacctcaagaaagcaggcctattggaatagcggaaatgaacagcagcggggagtacgatgctgcgttcgcagccacaattgcagcagcagcatttgcaatcgctgcccgtgaggataagctcgcggctcaaaagaactccgtccccatcgaggaggtgaccccttccctatcgccagtcaatagagctgaaggcaccaaaaagcctgcaggaggcaacaaaatcgcgagatggtttagcggcaaggagcctatagaacacgacgacgacgacgaggggccagttaatgtatcggtaaggaggccactgaaaccagcacctggaaagcctgaggacgtgcctgcagatcatcacaaggtggcacccaggatgcttgagacttctctgggtgtgaggaagggttcgggatcttccagcaggtcggcagagaggaaatggagcaaggagtttgagcaagaacaggctgttcagaaagcgccctcggccgtgaggccagccacgtcataccgctctggacggaatggagaaggcgcggcaggagtagctgctactggcggcacgggatctaaggctgatgaatgggagaaggcaaagcttggaagagttagagaggagtatgagaagatgatggagaccatagccgaatgggaaactgagaagaagaccgagctggacagaaagagagaaaaggcactagaagaatacaacctggagatgacaaggatcagcaaaatctctggaggagcaagggcgatggcggaggagcgaaaatacaacgataggaaaaagatcagagagaaggcgcgcaagatgcgatccacaggaaagcctccccgcacgtgtgcttgcttttgagaacagctgcatacgctgaaatttggaaccaaaaccaaatgaaggacgtcattttggacggttgtaaaaggcacgcaatagtgacgttctgtattgtaatatgtatttggctttgacaagttatgagtgcacattccactgaaggcaacatcaacatatttttcaaaaaaaaaaaaaaaagatccaccatgcatcaacattcaagatgaagcatggagtaggaactgccccaagaacaacgagaacgaaaacatatattcatcataaaggtcaagatttaggattcccattcaaggtataaggtgtgagactagtatcatccaattcaagtgctgaggttcttcttgagctttggccaccagacttctcagattcattcctatttttgttgattgttgtctcctcatcctgtgtaccagattcatctgattccacttaattcaaaatcatactcttcat

SEQ ID NO: 13355 - DNA, 1255 bp, Zea mays
ctagctgtcttgagagagctgagccaggagcggagggaagaataccacgcgctgggtccgaaccggagctggactggattcttcaaggcttccattccattccatgggggttcggttttctggagtaggaaagggaggtagaggtggacgccagggttcagcgataccacctcaagaaagcaggcctattggaatagcggaaatgaacagcagcggggagtacgatgctgcgttcgcagccacaattgcagcagcagcatttgcaatcgctgcccgtgaggataagctcgcggctcaaaagaactccgtccccatcgaggaggtgaccccttccctatcgccagtcaatagagctgaaggcaccaaaaagcctgcaggaggcaacaaaatcgcgagatggtttagcggcaaggagcctatagaacacgacgacgacgacgaggggccagttaatgtatcggtaaggaggccactgaaaccagcacctggaaagcctgaggacgtgcctgcagatcatcacaaggtggcacccaggatgcttgagacttctctgggtgtgaggaagggttcgggatcttccagcaggtcggcagagaggaaatggagcaaggagtttgagcaagaacaggctgttcagaaagcgccctcggccgtgaggccagccacgtcataccgctctggacggaatggagaaggcgcggcaggagtagctgctactggcggcacgggatctaaggctgatgaatgggagaaggcaaagcttggaagagttagagaggagtatgagaagatgatggagaccatagccgaatgggaaactgagaagaaggtgaaggcgagacgccaaaaagagcagaaagagaccgagctggacagaaagagagaaaaggcactagaagaatacaacctggagatgacaaggatcagcaaaatctctggaggagcaagggcgatggcggaggagcgaaaatacaacgataggaaaaagatcagagagaaggcgcgcaagatgcgatccacaggaaagcctccccgcacgtgtgcttgcttttgagaacagctgcatacgctgaaatttggaaccaaaaccaaatgaaggacgtcattttggacggttgtaaaaggcacgcaatagtgacgttctgtatggtaatatgtatttggctttgacaagttataagtgcacattccactgaaggcaacatcaacatatttttgaagggtgtggagttaaggaacaaaaaaaaaaaaaaaa

SEQ ID NO: 13356 - DNA, 4071 bp, Zea mays
ctcgtgccgttttttttttttttttttagaatccctgaatgtacacaagccttggtcatatcattagaaattttacattgtcccgctagggcgctcgtacgggcgcctcatgttctagtaaaataaaaacctggggagagcctttggcaagccacacgtccggctacacctacacctccatccacactgcctttggcgctcctgtttaaaaagccaccgccaccaccgccacaaccagagtccactgtccacctccaccagattcaccaccccaaacgcagccaaagccccaaagcgggctcgcgcggccgtgcctcccactcccacccacggacccaccgcccacgcacgcacgggcgtgcggccatgcagatcctacgcctcctcgcggcgcggcgcttccgccggcggcggcgcggggtgtccacgatcacctcgacggcgactgcgccggccacccctcgcagcggctgcgtcgccggcgtgtacggatacggcgaggaggaggaggacgagggcccgttcttcgacctcgacctgacctgctgctccgcgcccgcgtccagcgcgggcagccaggcggccgagtcgggctccgagtccgaggacgcctcgtcctgcgccaccgccaccggccgccgccaccgagcgcggcgacctcgactttgtcgtctcgctgcagcggagccgtatctacgatgagccgccgccgccgccgccgccgctcatgttctgcgcgtccgagccgagcccgagcgacggccgccgcagcagcgccagcgccagccgcctcgggagcaggctgcagctgcggacgctcagcttcgggtccgccaaggccgccctctacggcgggcgcgccagcttctcccggagcaccggcagcgcgcgctcggccaggctcttcgccgcgtacgggtacgggtacggctcgcccgaccaggacccgcgggacgaggggaaggccaggccgccctccggcgacgtcatccgccggtacctgagcaagatctccagccggctgcagcgccggcgcggcgcggccactgacctccggctacggaagagccgctcggcctccgcctccgccgcagcggcggcccggcgcgacgactcgctcgtcgagaagcaagacggcatcgccagcgccatcgcgcactgcaaggagtccctccaccgaggtccgtaccgtgccagcgccgtaatgccgacgccaccgaccaggacgcgcgtcccgtgcctctccattaacccaagctgacgcgcgcgcacgcgccacttgcgtttcttgcagcgtccgtctcggaggccgacacgtcgctggcgcgatcgcggagtgacccagggccgtaagcagcgtcgacgccgggttgcgccatctgccacgctcgccattccacgctccggagactcctgcggcggcggcggcggccgaagcttctcgctgaatttcgacaaggacgcgaggaaaagacgaggaacttgccggcgcgactgcccgagtacgaactgataaaggatggcttgccaagaacatgcagcggtcggttgaatgagggcggggagtgtctttaggattgtttatgtgtgtgtgagaaggacttctttttcgtttttcgattaggatgttctaggtaatggtctcgtgcttaggctcctttaaccaccttttttttgggggttcagttttttttctatcttttcagttcgacgctttttgtacaagaggcttgcaacaggacctgtaattagtagtagctgttaggtaggtggtcagcctcatgcaaatctttcaacatgttcgttcgttgtctcaacatgttgccgtgcatcgtttgtttgaagctcagaacattgctgtccgtggttgtttttccccccagcacagtcgtctttcctcgtcgagtttcgtactccgtctcgccactcgtgccagcttgcgtattacaggagaactgcacggcgcggtcaactggtggtgctgcaggtcactggtgcagcgtgtgaggtgctagtacgaaacatgtactagtcacgtcacatctcgtctcgtctgcctgccaggagggaggggagcgcgtggccactcgctgcttgtcctgtttggccggtgccgtgcaagtgcaaagccgcgcaggcgcgcccccaggccgtgtgtgtgtgcctgggactgggagtggctgagggagacgagacgcgacgggatcacggaaaaggccggggtccccgcggccgcctcgcgtcatgatggcaaccggtggcggcgagacaggggagagagggagcgaccggcgacgcaatggagtagtacgttgtacggtgagggtgatgagtccaagacaaagatgtgtgtgcgtgattctgatgaggggtctcgtctcgtcgctcgtcctggggaaccgcgccgcgccatctctcccgcgcccgctgccattttcgtttcggtgcgtgctcgtctcctttcctccgtctttccatttgcagttgcgttgcgtctggctggccgtcctcacctgcgttgcatgggagggccgggggcggaggaaaagaccgcgagaatgagcccaaagctacaccccgctttgggcacggaaagaggacagaagcgcattgttttagtctgacctttgtttgtggatggctttcgtccaggcctggtattttaaccttatctacacgagcaagaccgctgacagcttatttatataatagttaagttttcactactaatacacaatatatagttcatttatatttttgtttgtagagtttcttgttgtttttatataaacaatagaactcggtttccctccctctctctctctctcctccgtctcgccatgcaacttcagctaacaaaagtcttactagcaggcaaaagctaggacttgtgcagtcagcctgagtggcgaatccgaggcggagcttttgcccgcgcccagccccagcgtgcatctcagctgaggtcgcggcgtggggcaggcacagaggccaccatcatgcccacgagaaagcttttcccatctcctgccgcgcgagaaaaaaaaaacactaggtactctagaatccgaaaagcaaaagttgctgcgctgatggcaaaaccggcgaggcatgcgggcgcaatgatggagcggggcgacgcgtaggatttcgcggatcttgatttcttgaccgccgctgctgtgcctggagcggagggggatttttttttcagaagctgcagaagaactcgaaattcaggcaacgagctacgttctcgcacaccgatccttgtagtccgggtacagtgcacggctccaacagcaacagtcgcatcgggcctggggcgttcggttggtcgcgtccgtcgttctagggctccaacaccaacagtgaggtgaccccagctgcccgcctgctgcagaatagcaggcacatacgcgccgccctacaacgaactgtttgttgccgcctcgcaagtgcaacgaacacacacacgccgcatcgggcctggggcgttcggttgctcgcgtcgttctagggccccgcccggacgtgcctctgaatcgcggacagggacgataaataaagccttcccagggccgagaaatccttccgtggcggtgcgaccgtgacacgtactatggcttgcgacggcagcagccgtgccctcctgtgacgcaacactttgaaccaaaggacttttagttttctagcaaacaactgacaacaattttttttatagcaggcaattaaaacatttttttctcacgatagacaatagaaccaatgcacccttagtataaacacaagtatcacctaatcatgttataaatgtcattcgatcatatctatggccatgttaacgtagacaacatgaagtgatagcgatccaaacaaacgtgacatacatctacagcattgatcttatctatctgcagaaagtgtcggtcccccatgataggctagctaacaggccatctcaaaagcacatagttaatgggtcatcgaacaggaggaaaaaaatcttcgaaggtgacgggcctcgttatagcaatccaagtaaaagaacttcaaaagtgccgagaggag

SEQ ID NO: 13357 - DNA, 1907 bp, Zea mays
acttacttttcacgtcatgaatgctcgtcagctcgtgagacgtgacgccgtgtcctgaaaaaaaaagacccgtcccggcgacccccacacccttcaatccgggaaaaaaagcaacagctcgattgcccgggtcctccaaaaccctcgagatctcggttggtggtgtggtggggtgctcttccctctcgcctccgctccgaagcatcgatccgaactcctcggttactcgcggcagcggcgtgtcgagatgcgccccaacattatcacagaggctgggattccaactaggttgaatcagtggtggagcagcattccgttcgttacttctggtgttatcttgatatgtggagtaatttatctgctctgcttgttgattggctatgattcctatgtggagatatgcttcttgccttctgctgtagcatcacattttcaagtatacaggttctacacatctgttctctttcatggttctttgcttcatgtgctattcaacatgcttgccttggtacccttgggcactgagttggagagaatcatgggatcagtccgtctcttattcttgatgctccttcttgcaacaacaaatgcaattctccatctcacaattgctttcttggtggcttacaatcctctgtatcacgttccaaatcttgtgaatgaatgctccattggcttttctggagttatattctcaatgattgtcattgagacaagtctgagtggtgtgcaatcacgaagtgtcttcggcctcttcaatgttcctgcaaaatggtacgcatggattttgctagtgctatttcagtttctcgcaagcaatgtttcattgctgggacacctttgtggcatcttgtcaggatttgcatacacttacgggctgttcaactacttgcttcctgggccatcattttattctaaaatcgaaggcttgtcagcattatctgtttgtgtgaggcgtcctggctttattatgtgtactggaggcactacttatggtcagcttcctacatactctaacacgtctgctgcaccaagtgctctcataaatggaaatttcttgagaaatatatcttcatggatgcctagcagacacatatcaactgctcaggaaggagaagacacaaggtttcctgggagagcacgaacacttggttctgtaggaactgaacccactgcaagggaggcaagtgcgcatttgcatgctaggttgttggataacacaactccaagtgacccactaacgaatacacagcatacagctgtgaacacagtcagagctgatgcaacagtgacagctgagcaggttgatacatttgatgaagaacttaagaagctggttggaatgggatttgaaaagactcaggctgaagttgctcttgctgcagctgatggggatccaaatgttgccattgagattctgatgagtcagcagggttgaagtttgaccataaagtacaaattgaaaggaagcacggtatcgagccattttttgttcttacaaaggttcaaaaagtaggctgtggtttggggagtctgaaaaaggatggctgcaatcttgtttataccgggggtgcagaaacaacgtgcagcctaattgcaattctcaattcttccgactatagaatttatgtaaggtagaaagtaacgttggatgttctgttaaatacgaacaatcagaaaatgctgaatttagtctgaaaatagccagtgtgtttgttgggctgtaaacaagattgagacctttgactagattattgggctgtaacaataagactttgacgttgggactggtgtggatccgtcctgcgttgagacttttttagcggcctatgaattttcacatgggaaaaatctgcaaaaataatgcataagctttaacctcgaaaaaaaaaaaaaaaaaagcggcc

SEQ ID NO: 13358 - DNA, 1206 bp, Zea mays
gcgactcctttccttcctgtacagtacgccacgccactaaacaagtcaaaaggatggtctcacgggcagcagcatctcaggcccaggggagggaacataatttttttcccaggggagggcgcgccactgacgactaatacgcatcactgcatcagttcacacacgcaccagttcacacgacaccctgctctgctgcttgcataatttatttagtagtcaaaggggaaaacaagaagatatggatcattttggattagatatcttgattaagacttgaatatacataaagacgtatgaacgggcgggcgaagatagtaagggaaacacggacagaaaagtattggggcctttggctctttttttttgggatatatagatattggtattgaacattgattgatatacagagacggacatgatgggggtttggcgtcaataaataaaagaggaagggccaggggaaggagaacgccaaaacaaagcttttgttgtctctcacctactattcttcttgcctcctccctccaccagcatccctgagtctgccatgggcaactgctggggaaccaagattagctctgacaccgccgcctccccttccacatcaccgttccctcgcagcgagggtgagattctccggtgtgccaatgtcaggagcttcaccttgacggagctgatgacctccacccggaacttccggcccgacagcgtcctcggcgagggaggcttcggctccgtcttcaaggggtggatcgacgagaccaccttcgccccggccaggcccggcacagggatggtcatcgctgtcaagaagctcaaccagcagggattgcaggggcacagggagtggctggctgaagtcaactacctgggccagttgtctcaccccagtctcgtaaggctcgtagggtactgcctccaagacgagcagcgccttctcgtctacgagttcatgccgcgaggaagcttggagaaccatcttttcaggacctcacgtgtccagccgctctcctggaacctacgaatcaaagttgccctgggagcagccaagggccttgcgttcttgcacagcgacaaggccagagttatctaccgagatttcaagacatccaacgtgctcctggattcgaactacaacgccaagctgtctgacttcggtttggcaaaggacgggccaaccggcgaccagagccacgtgtccaccag

SEQ ID NO: 13359 - DNA, 1016 bp, Zea mays
attaggtccagcccacctcagactcacctacatttggacagaggagagtctagtagggttctaagcctcggccgtttcttcgtctccacagctcccgccgccgcggaccagcgtgtcactctacggggttccggcgtctccccgtagcgcggcatccatggcggagcagacggaaagggctttcttgaagcagcccaagctgtttctctgttccaagaaggccaccaaggggaacaaacctggcaagggaggaaacaggttctggaagaacattggccttggtttcaagacacccagggaagccattgaaggaacctacattgataagaaatgtccattcaccggcactgtgtctatcaggggtcgcatcatcgccggaacatgccacagtgctaagatgaataggaccatcattgttcgtaggaattatcttcacttcgtcaagaagtaccagaggtatgagaagagacactccaacatccctgcgcacatttcaccatgcttccgtgtcaaggaaggagatcatgtgatcattggccagtgcaggccagtgtcgaagactgtaaggttcaatgtgctcaaagttattcctgcaggttcgaagagtggagcagtgaagaaagctttcactgccgcttaagatcatgacgagttcatcatccatggcccggaaaagctctgtgttataacgttttgatgctgcctattagcctttttccccgtaactactatatgggtacttggaattggacttgaattacatccagaacttgaaatcctgaaaaaaatcataactctgattgcttagcaccttttagtttcagtaaaagcatatgaccctcaaagtgttttctaggtcagtagtgatacgtttgaaaccttttggcatccatcttggctttgaaaaaattgctattttaacattctctattgtggctctgtgctattatgccatattgtatctataaattataggacaatttgtgtcaaacaaaaaaaaaaaaaaaaaagcggcc

SEQ ID NO: 13360 - DNA, 863 bp, Zea mays
attcggctcgagggagagtctagtatagggttctaagcctcggccgtttcttcgtctccacagctcccgccgccgcggaccagcgcgtcactctaccgggttccggcgtctccccgtacccgtagcgcggcatccatggcggagcagacggaaagggctttcttgaagcagcccaaggtgtttctctgttccaagaaggccaccaaggtaaacaaacctggcaagggaggaaacagattctggaagaacattggccttggtttcaagacacccagggaagccattgaaggaacctacattgataagaagtgtccattcaccggcactgtgtctatcaggggtcgcatcatcgccggaacatgccacagtgctaagatgaataggaccatcattgttcgtaggaattatcttcacttcgtcaagaagtaccagaggtatgagaagagacactccaacatccctgcgcacatttcaccatgcttccgtgtcaaggaaggagatcatgtgatcattggccagtgcaggccagtgtcgaagactgtaaggttcaatgtggtcaaagttattcctgcaggttcgaagagtggagcagtgaagaaagctttcactgccgcttaagatcatgacgagttcatcatccatggcccggaaaagctctgtgttataacgttttgatgctgcctattagcctttttccccgtaactactatatgtgtacttggaattggacttgaattacatccagaacttgaaatcctgaaaaaaaatcataaccctttgtctgtaaaaaaaaaaacaaaaagtttcagtaaaggccggccaaaaaaaaaaaaaaaaaaaaaaaaaagggcgagccgccgact

SEQ ID NO: 13361 - DNA, 2604 bp, Zea mays
ctgcaggtctttaagatattaaatgagggaacatctacttttgagcagtttattttgaccttaagatccacagttggtgctcaggttcttgtacaagcaattggaattggcaaaggaaaatatgacctgacaggatttgcattagatcctagtagaaatcatggtatctcagcacgcccagaaatccctgttggcaaggcttgctcagcactttcatctggagatatcataaagtttttgactggtgatttcagaatgagcaaggcaagatcgaatgatctattctgggaggctgtttggcctcgcttgctttcaagaggctggcattcagagcagcctaaggattcttcaccaattggaaaacatgctttagtctttctgattccaggtgtaaagaaattctctagaaaaaagcttgtcaagggaaatcattattttgattctgttagtgatgtcttgagcaaaattgcatctgaaccaaggctgcttgaatttggagttgagcgtggtaatgatgaaagtgtcattaagcatgaaaatggatggagccatgattctgaacctgacagaaacatacttcctaacaagaaaccttcatgctataaccgtcccactgagcctggctgttctccagagctaatgaaatttactgtggtggataccagtcttgttcaaggggaagaaccttccaaggtgaggtcactaagaaacctaccaacagattctagccatggttacatgtcttcaccacattgtggaggctctggaagtgacagttcagaggaacactcagattctgaggacagctctcggtcttgtgaacatataatcactgatgatcgaagcacaaccaatgcaaagtatgctagtgatgagagaaaaagtaagcccccaacagctgataaggtggattctagtgtaattcagaagtctgcttcctcaggcacattagtgtcgattaatggtcatatttcaactgatcaaggtttcagcacaatgaataatgtatcctcttcaaatgcaactattcttcctgttgatgttcaaatggtccatgctcctactacttccactgaaataagctttcagtttgatcaaaggcttaatgctgagtcccaaattttcttagcgcctttttcaaagaggaggaggttggtttcatccaagactgaaagaactggtcgcaagaataccaccaccattgaaaaccattactggaagcaagttgacgagccagtgcatcatgatgcatctggagaaaatgaagcaagcggacccaaagcttttgtatggggtgcaactcctagctcatcaactaacatttcctttgaagtgaataacaagaaaccgtactgcagacagcttgacaatgtgctccctaacgctgaaacaatggtttacaaggaaacatgccaaaataggcatgtcattgatcttaatatcccacaaatgccttctgattttgagtcaactgtgagctacatcgtccctccatctgacaaaaatgcagaaaccacaatcagacctatacgtacttctggagctgaggaggtgactgaccgtgttccagacatagaggcctctagtgatgtgctctatgatgagttttctttcaactcaagaagacatagtagcagaagccgcccaccaacagctcgagctttggaagctcttgcctgtggctttcttggaaccaaacagaaaggcagggagacaagtttcccatcttcaagcaggagcagcagacctgttcggcgaccacgaagatcacctgatgttgcacggccatttccttctgaacgcaaagaatgcacttctcgtttccctgatccacccatggatgtcaatgcatggcagatgaataattctccataccaaatgattcatagcagctcctccgataaatccacagaaaaaggtagccctgacttgtttggagcagacaagtctaccgataaaggagttcatgaattgtatggcataccttagatcacatgtaaggtcgatcatatcctgctatatcttttgattaatcaacctttattgaatggattggctgctggttaagagagtgaagtgatggtatggtcaagatgcagcctgcagttaagtcatgggtactgcttgttcaaactttagtttgttgttgagaaacaaatggaagaagcttatacagctgaggtttctgtttcatctatagttttgtgcatgtacattgcctaaatattccagcatcgatacttaacaagaatagatgacaccaacgaactacaaagatgtgatcgacgattgctttcgcatcggcgcttcagcttccagtagcttgtcaaactttatgtgatagaatcatgtgcttcttgtcggaagcctgtgatgaatctttgaccttttcctttgagattttatggttaagctttactgagagttatactcttgctctttattacatgtactgtgtggcggtagctgaacaagtgtaatagcgcaccgtataagaaccatacctgaactagacctgagttgagactgtttctctgtcgacaagccagaagacctaatattataagcttacttgtgaaaatgtatatgttctttgcttaccag

SEQ ID NO: 13362 - DNA, 1686 bp, Zea mays
aattgaagagaaatgaggaaaagagtctagagtctcccgtcatccgtgtccgtgcgatttttctacacaatcgtctcgcaaagattctcgttggtcagtttgagacttagccttggaggagaacagaacagccacgatgacttcgccgattcagctcgcggccgcgcctttgctgctgctagtagtagtggtcgcgggcacacggtcgagccgcatcttttcggtggccgactatggtgcggcgggcgatgggttccgctacgacacggcggcgattcaggccgctgtagacgcctgcgcggcggcgggcgggggccgcgttcttctcccggcgccgggcaactacctgacagcgaccgtccaactccgctcgcgggtggtgctggaggtgccccccggagcgcggcttctgggcgggaccaggcaggcggactacccgcccgagtcgcgccggtggtacgtcgttctggccgagaacaccacgggcgccggcatcacggggggaggcgagatcaacggccagggcggggcatttgttgtcaggcccagcgaggtgaagaacgtcatggtgagctggaatgccaccggcgattgcctgggcgatgagtgccggccgcggcttgttggcttcattgactctaaggatgttaggatccacgacatcacactcaaccagcccgcctactggtgtcttcaccttgtcagatgtgacaacacagtcatccacaatgtgtcgatatttggagattttaaaactcccaacaatgatggcattgacattgaggattctaacaacactgtcataactgattgccacatagacaccggagacgatgctataagcccaaagtcgacaactggaccagtttataacttgacggcaacaaactgttggatgcggactaaatcttgtgctatcaagtttggaagtgcaagcttcttcgacttcaaaagactggtttttgacaacattacaatagttgattcacatcgaggacttgggatgcagatccgggatggagggaatgtgaatgatgtggtgttttcaaacattaaaatgaggaccaggtactaccatcctttatggtggggaagagccgaaccaatctatatcacaacttgcccaaggcacccagattcaaaagaaggcgccatttcagacataagattcatcaacatctcatcggtatcagaaaatggagtttttctggctggatctaagcatgggctgctccgcaacctgaaattcaagaacatagaccttacctacaagcgttggacaaactacacgggagggctctatgattacaggcctgggtgccaggagatggtgaagcacaagactggtggcatgatgctggagcatatctccggtctggagattgacaacgtgaggatgagatgggcgagaggaagcctgaagggctggaatgttaaccctatcctcttccggccatcaaccatcgataatctgtctttccatgactggcagtcagtggatgttcagtagatttaagtggcacagttgtattacgtgtgtatctatcagaataaaggggtgattctttttattcaaaaaaaaaaaaaaaaataataagcaatcccaacagcatttaagcttctgcagggactggtgtggtttgctataataattttataaatctgaattcaaatgtttgattgttc

SEQ ID NO: 13363 - DNA, 1294 bp, Zea mays
  misc_feature (1286)..(1286): n is a, c, g, or t
cattgggacctcgagccggccgtccctccaggccgggccggggcacaagcgtccacagctcttgcactagctagagaccgaacagagagagattggagaaccatgatgaggtctggccttatctcgctatgtttccacctagccctggccatcacactggctgcaagtgttcctggccttgctcgtagtagggtaatcgacatggaaccgcaactcaaaccgacgctgcaactagaaccaaagcatggtgtatctcaaccagacagaaaccaagaacccaaaccgacaccacagcctgagccaaaaccagagcctaaaccggaaccgaaacctgcaccacaaccagaccccaaacccgcaccacagccggacccaaaacccgcaccacaaccggacccaaaaccagaacccaaacctacaccacagccagacccaaaaccttcaccacaaccaggcccagagccgaaacccaagccagcgccacagcctgaaccaaaaccagaacccaaacctacaccacaaccagacccaaaacctggaccacaaccagacccaaaaccagaacccaaacctacaccacaaccaggcccagagccgaaacccaagccagcgccacagcctgaaccaaaacccacactgcaaccagatccgaaacctgagccaaaaccaacaccacaaccacccttcccacagcccgagcctcaaccagatcccgaaccccaacccgaaccatccaagccaggccctaaaccccaacctgaaccatccaagctagaacctcagccaggatctaaacctacaccggagccaaaaccctaaccagaaccatcgaagcggagccaccgtcgtctcttccaccaccatttggcacgggcgtcgtggaagggaactgagaggagcatagtggaaccgatcatcatcgtggatgccatctatagcttttggctatgactgataagtaatactgtttgtgtaagagtgagctctcttttttatatagggtgtgtgtattgtgtgtagtactatatttggacgatgtgtgtgtacccacctttttccgtgtgtttccatcagcatgcatccatgatccatgtatatgtcttgctaagtttgtattatcaatgaataaaaaaacatgcctttgtaaaaaaaaaaaaaaaaaaaccacccaccgccgccgccaccgcctccgcccccagcgcgccgccgccgcagccaccatggggtcgcgtccgcaccaagaccgtgaagaagacctccaggcaggtgatcgagaagtactactnccgcatga

SEQ ID NO: 13364 - DNA, 1479 bp, Zea mays
ggttgcagagctgggccgcggcaggagggcagcgacacgagagcttgctggtggtggttgcagcagaattattgccaactaaataacaggctgcggttacgtcgtacgaagaatgagattaaagaagtatacttcactaatggaacatgcatgaaaatgacgttcgcacaaatgacaattctcttttccgagacagtacgtgacgacccttttctggtgggcaaaatcacgagcagagagagggacacgcgtcaagcctcgcttggcttacaatgcctataaatcacccatgccgcccacgccatctatgcacaagcgtccacagcttccactagagaccgaagtaccgaacagatagagattggagaaccatgatgagatccggccttctctcgctatgtttccacctagccctggccatcacactggctgcaagtgttcctggccttgctcgtagtagggtaatcgacatcgaaccgcaactcaaaccgacgctgcaactagaaccaaagcatggtgtatctcaaccagacagaaaccaagaacccaaaccgacaccacaacctgagccaaaaccggagcctaaaccggaaccaaaacctgcaccacaatcagacaccaaatcagaccctaaacccgcaccacagtcagacccaaaacctgcaccacaaccggacctaaaaccagaacccaaacctacaccacagccagacccaaaaccttcaccacaaccagacccagagccaaaacccaagccagcgccacagcctgaaccaaaaccagaacccaaacctacaccacaaccagacccaaaacctggaccacaaccagacccaaaaccagaacccaaacctacaccacaaccaggcccagagccgaaacccaagccagcgcctcaacctgagccaaaacccacgccgcaaccagatccaaaacctgagccaaaacccacgccgcaaccagatccgaaacctgagccaaaaccaacaccacaaccacctttcccacagcccgagcctcaaccagatcccaaaccccaacccgaaccatccaagccagatcctaaaccccaacccgagccatccaagccagaccctcagccagagcccaaacctacaccagagccaaaaccccaaccagaaccatcgaagccggagccaccgtcgtctcttccaccaccatttggcacgggcgtcgtggaagggaactgagaggagcatagtggaaccgatcatcatcgtggatgccatctatagcttttggctatgactgataagtaatactgtttgtgtaagagtgagctctctttttatatagggtgtgtgtattgtgtgtagtactatgtttggacgatgtgtgtgtacccaccttttcccgtgtgtttccatcagcatgcatcaatgatccatgtatatgccttgctaagtttgtgtattatcaatgagtaaaagaaccaggtcttgtaaaaaaaaaaaaaaa

SEQ ID NO: 13365 - DNA, 881 bp, Zea mays
  misc_feature (13)..(14): n is a, c, g, or t
tcgagggccggcnncgggaaattgggtacctcgaggccgtgccggggcaccagtgcacaagcgtccacagcttgcactactagagaccgaacagatagagattggagtgtgtgatccagcgcccatctggactggtggcaaccaaccatgatgaggtccggccttctctcgctatgtttccacctagccctggccatcacactggctgcaagtgttcctggccttgctcgtagtagggtaatcgacatggaaccgcaactcaaaccgacgctgcaactagaaccaaagcatggtgtatctcaaccagacagaaaccaagaacccaaaccgactccacagcctgaaccaaaaccagagcctaaaccggaaccaaaacctgcaccacagccagacccaaaaccagaacccaagcctacaccacagccagacccaaaacctgcaccacaaccggacccaaaaccagaacccaaacctacaccacaaccagacccaaaacccacaccacaaccgggcccagagccgaaacccaagccagcaccacagcctgaaccaaaacccacgccgcaaccagatccgaaacctgagccaaaaccaacaccacaaccacccttcccacggcccgagcctcaactagatcccaaaccccaacccgaaccatccaaaccaaaccctaaaccccaacccgaaccatccaagccagacccccagccagagcccaaacctacaccagagccaaaaccccaaccagaaccatcgaagccggagccaccgtcgtctcttctaccaccatttggcacgggcgtcgtggaagggaactgagaggagcacagtggaaccaatcatcatcgtgcacgccatctatagctttttggctatgactg

SEQ ID NO: 13366 - DNA, 1128 bp, Zea mays
ggccgggacaagcgtccacagcttgcactagagaccgaacagatagagattggagaaccatgatgagatccggccttctctcgctatgtttccacctagccctggccatcacactggctgcaagtgttcctggccttgctcgtagtagggtaatcgacatcgaaccgcaactcaaaccgacgctgcaactagaaccaaagcatggtgtatctcaaccagacagaaaccaagaacccaaaccgacaccacaacctgagccaaaaccggagcctaaaccggaaccaaaacctgcaccacaatcagacaccaaatcagaccctaaacccgcaccacagtcagacccaaaacctgcaccacaaccggacctaaaaccagaacccaaacctacaccacagccagacccaaaaccttcaccacaaccaggcccagagccaaaacccaagccagcgccacagcctgaaccaaaaccagaacccaaacctacaccacaaccagacccaaaacctggaccacaaccagacccaaaaccagaacccaaacctacaccacaaccaggcccagagccgaaacccaagctagcgcctcaacctgagccaaaacccacgccgcaaccagatccgaaacctgagccaaaaccaacaccacaaccaccctttccacagcccgagcctcaaccagatcccaaaccccaacccgaaccatacaagccagaccctcgaccagatcctaaaccccaacccgaaccatccaagccagacccccagccaggacctaaacctacaccagagccaaaaccccaaccagaaccatcgaagccggagccaccgtcgtcttttccaccaccatttggcacgggcgtcgtggaagggaacttaaaggagcatagtggaaccgatcatcatcgtggatgccatctatagcttttggctatgactgataagtaatactgtttgtgtaagagtgagctctcttttttaaaaagagtgtgtgtattgtgtgtagtactatatttggacgatgtgtgtgtaccccccttttcccgtgtgtttccatcagcatgcatccatgatccatgtatatgtcttgctaagtttgtattatcaatgaataaaagaaacatgcctttgt

SEQ ID NO: 13367 - DNA, 2993 bp, Zea mays
acgcggggcagtaaataaaaggcaaaaaaaaagcacccaaggaaacgccagaacatcaagcaggccgcggccgcggcttgcttcatccgagctccggccacctcggagcgccacagtcagctcaagcgcttgaagggacccacaatcttgcaatggaagcacttcagccaaacatccaggctgggatccatactcgtaacctcccagtaaaacagcttggaggggtgatctttggttgcaagcctgatacaattgaagaatgcttcaaaaagcagctctttggtctgcctgcagtccattattcatatgtgaagaatgtaaaacctggtatgcctttgtttctattcaattataatgacagaagactccatggtatttttgaggctgcaagtcttggtcagatgtctattgatccatatgcttggagtaatgaggacttattaaagacaccttttcctgctcaggttcgtatttgcataaggactcggtatccaccaatgttagagagcagatacaaaacggtgcttggtgctaactattatgatcgtcatctattctactttgagctggaccatacacagacaaaagctttaatttctttgttcaagttgctgccccttgttaacaatcaagttccagctgctccaagcgaaaggagtattgctgtgtctttatcaccaactaaaaggaaggcaccagttcttcctgacccaaagaaagtcaaagaaaattcaaaggatatcaatccatttagtgttttatcaaatgcaagtgatggtgctcaagaaaactgggttgattctgacgtggaaaatgctagcatcaatgaaaattcacacagtgacactgatgagaaggaatttgaggagccagtttctgattgggaagatttggatgacaatgctcttcaataccaattcagtccttattcaaattcagatgaggtcagtcaaaactcctcatacaaaacagtttgccaagaagtggagcttgctgaatgcattcctccagttgtcaatcctgcgagtgaagaaaaactcaccatgcttgtacataatgagcataaagctgctgtgtgtattggcaaaatagagagtgaagttaacagtatcatggatggtgttgggctacagcctgaaagacacactatcctgaaaaagctgaaagagttattttccatgcgacagcaaggggtttcttcgcaggattgtgttgagtcaagcccagatcaatgtgtacctgaagaaaccctttcctgtgacccattagatgtcactgtggaagacaaaacctcttttcaggaacaccttggagaatttgatgagcttcgacaaatcattgctgatttatccaagagggctgaagcattggagaagaagcagaaaggatcagatcaagatctactttttttgagggaagttgttaaagattcaggaagaaaagtacagcaactggaatatcttgtagatgagttacaattccgatttgactcttcattgtctcttcctggaagcatgcacaatactttagccaagccatcgatatttctgatcggtggctacaatggtgtgacctggttatcatctcttgattctttttctcctgagaaagacacaatggtgggtctcacaccaatgagttttgcccgctcatatgcatctgctgctgcattggatggtcacatatttgcttttggtggtggaggtggcaagtcatcatggtataacacaggtatgccatgggtatctatgatatgatttcactacttttgtgtgacctttttatgttttgtggcatgtacttctatatggttgttttcatttgatagtggaatgctatagttcgaggaataacgagtggatagaatgcccctcgttgaaccgcaagaaaggaagtctcgctggtatcagtcttaatagcaaaatatatgctattggtgggggagatggaaatgaaactttttcagaagttgagatgtttgatccataccttgggaaatggttatgtggtccatctatgctgattcctcgatttgctcttgccgtggctgaattgaatggaacaatctacgccactggtgggtatgatggaagcatgtacttacaatcagcagaacggtatgaccccacgcggccggtctgggtccgtcttccaagcatgaacacaaagaggggatgtcatgcccttactgtccttggagaaagcctatatgcaatgggcggatacaatggagacaagatggtttctagcgttgagatcttcgaccctcggctcaacgcctggaggatgggagatcccatgagcgccccaagagggtacgccgctgcagttactctggatggaagcgcgtacttaatcggtggcctggagtccaatgtgcagatcctagctaccgttgaagtttacaacgcgagctccggctggtcagttctcggtttgagttcactcgggaagaggtcctttgcatctgccgtagtcatgtagttactgatcacgatgttaactactgtcgataacatcaggtttaacatagtcgctgcgttatgcaaggagtagttagggtaaggtgggtggggctagatcacccttccgatgtgtaatgtgttgagatcttcatcaggggaaattcgcatggtatgggagactacggcccgtatacctttgaaccctcgtaggaagtcttgagaacccttgcatgcattcgctgttgtatgcgtgccatgctgttgaatttagctgtactacaccagatagtgatacccgaactcacggagtttaatggaaccggatagaaagctgcccaaatagtttggtgtttgttgcttacgttgtggattttactgtagtgacttgtctaatgctccgtttctccgtttggttatcgaccatattggagggcatggaattaaaataagttcaataccaaatcaaatatagtattgaaatgagatgtaatttcaattctattgtttggatgtcgctgatttggaatt

SEQ ID NO: 13368 - DNA, 1658 bp, Zea mays
ctgcagttttattcattgggcaatatttactttttctaatcatgtcgagagttgatatgattagttcaagcataccagtttctttaaccaagaatcgctaatgctttctcttgtatttgtatgagctatgaaccatttatctcatatctacactacctgttttttgcatttgtatgcttcctgtagtttttcaaatctgcttgtcttatgaatttgcggtgggaactttgttgcacaacatttatggctatgcaaatgttttctgcacaagattttctgatattgttacatcatcttctcagaaaggatcagatcaagatctactttttttgagggaagttgttaaagattcaggaagaaaagtacagcaactggaatatcttgtagatgagttacaattccgatttgactcttcattgtctcttcctggaagcatgcacaatactttagccaagccatcgatatttctgatcggtggctacaatggtgtgacctggttatcatctcttgattctttttctcctgagaaagacacaatggtgggtctcacaccaatgagttttgcccgctcatatgcatctgctgctgcattggatggtcacatatttgcttttggtggtggaggtggcaagtcatcatggtataacacagtggaatgctatagttcgaggaataacgagtggatagaatgcccctcgttgaaccgcaagaaaggaagtctcgctggtatcagtcttaatagcaaaatatatgctattggtgggggagatggaaatgaaactttttcagaagttgagatgtttgatccataccttgggaaatggttatgtggtccatctatgctgatttctcgatttgctcttgccgtggctgaattgaatggaacaatctacgccactggtgggtatgatggaagcatgtacttacaatcagcagaacggtatgaccaaagggagggtgtctgggtccgtcttccaagcatgaacacaaagaggggatgtcatgcccttactgtcctgggagaaagcctatatgcaatgggcggatacaatggagacaagatggtttctagcgttgagatcttcgaccctcggctcaacgcctggaggatgggagatcccatgagcgccccaagaaggtacgccgctgcagttactctggatggaagcgcgtacttaatcggtggcctgaagtccaatgtgcagatcctggataccgtggaggtttacaacgcgagctccggctggtcagctctcggtttcagttcactcggcaagaggacctttgcatctgccgtggtcatgtagttactgatcagatcaggaggttaactagtgttaataacatcaggtttaacatagttgctctgcctttcgcaaggaatagtagttagggtaaagtgggtgccgatgtgtattgtgtttggatcttcatcagggtaaatcatccgaatggtatgggagactgggtacgtggcccgtggattgaccgttgaaccctcgctgactgtcagtcttgagaacccatgcatgcattcgctgttgtatgcgtgccactgccacgccgttgaacttagctgtactatcagatagatagtgatacccaaactcacggagtttaatggaacaggatagaatgctgtgcatggggtttgttgc

SEQ ID NO: 13369 - DNA, 6125 bp, Zea mays
  misc_feature (53)..(53): n is a, c, g, or t
  misc_feature (5524)..(5524): n is a, c, g, or t
tatttagtgtttgacggccatcacaaattatatggactaactagtctgcctanttgatattttatcaggcacataaaatttacataaatatacaaagaaaatgatcttaataattctattcgattggagcaaaacaaaaaatagaagcgaaaaattcgattttttttggtagaatcccataccgccgagcaccggaaatggaaaaaaaatatcggttccggcaaatcctgagcgagatttttcaactctgatgtgactcttacaccaatgcaaagcaccgttcaaaaatgcgataatcttttccaacgtcaaaaaatgaaagggtaatataacgacgtccctagtacactccccataaaaaagttgaagaggcacatacaaaaaggtaggggaaagatgaacataaaaaaaagaaaatctaggtcgtcccagcctgcgtacaactagtttaaatttttttttgttacccgatagaagggtagtactactaatataaatctaggagcgaaaatgcaagcacgttctagagcacctggctggtctgattccggattcccattcccatcaaccaacagggttatggtcgcgttgtaggtaggatctgtttggtagatggagtggaaaacgcactcgcgctgtgttgttcgtacgggatgtaggtggcacggcggcagctagctcctccgtccctcacggtgttcgcgccgcgcggtcaagggtgagctcaacgacgcgtacggcgtacccatcactcgtgcaaccgcaaggaacccattcatcgtcgtcagaataataataagtaaaaacactacgccgtcgtcgtggtagaggagttgtgctaataattggcggagtcttgtctcttctcagacgccatggcgacgtcagccatgcgtgccctgccctgcgcgatggccaccaggccatgctactcagaccgcattttttaatttaatcatttttccaaaaatcgtatttatagcctggtctatttttatttatgtttggactagaattattgaaaagtttttaacttattgtaaagaaatatttagatcgttatccattaccacttcacggtggctagagttcgattagagttccatgagtcatgtaattttactttagccctaagttatgataatttagacttcctaaaattttaccataacatgagtttgtgattttaccacgggatagaaacgtggtaaaatggctagccagattctaacaaatacgagtcacactaaattatagtgtgttaaattataacagatttagtgtgttaaattataacaaaaatcttaaatcgatcatggtaaaattttaagacacaaaaaacgatttgactgttggcgtatttttaggccacacatcaattattcctagatcccgctcacggggagttgagaccttaagaacccttccacgaggtgtcggacggtccatgataggtcactagaccatccgcatgtaggtcatcgtggagcagataaatacgagcttctctgcaggcgcgtggaccatcggcgtataagcgacaaaccgtctggtgtttgctatgacgcagagcggttcatgtagaacctagatctcgcctctcgggaggaaccttgtcagggaggagagattatatggttgcttcataatcggcaggccacccaaagcacctctagacggcgtatagtcgaagagaggtaaatattgattgagaaactacaactaaagctaggcgaaatctaacgagtccttgtgagttttttaggataaccacgtatgagataggggtcccaaactgaattaatctaatcggggactgtccggactactcacgcagagcgtggatcatctgggccacaagatcaaaccgtccgaccatacattttaagcatcaaactgtctgaagcaccagactattcggtgatagccgccgaattgtccgatgtacgtcatctaggagaactctaccgatgtcttacttcatcatgccctctagtgcttttggtcttattactgatccttacggttcctttctcgcttggaaccttccgagtagtagccactcctagtgatgggttcgacgtgtgaggatcaccgatgactacactcttgcccctgtctttatccgccacatcttaccgaacaaagaccttctcattggtcagctacagtgtgttgatagagaatggttgtatgccaatatgcatttattggaagtttaatgggacttcatttttatccgattgtatttgccgacaatagatgtagcatgtgttgtcaatctacctcttttgatcttgttgctctttgcttttttttatacaactcgaggcagtcaataatcatcatgtaccttatggccgtgtatttccgcgtgtggatatatatagaggccagatttgtatcactatctctagaaacaacaacgttccccctcctcctagcattataggggtatagcagagacaggctttcgcagtgctccgtggttgcttttgtaccgtgctagtacacgtacacctacaagatcaatcgaccgatgcagcgtacacttcaaacctccggacttgaacgtacacttcatcgtcagtgacctactctactacctcgtcagacgtcgtccgtcgtccgtactcacgagattatatatgttttttctagtacacaaactgtcactctgcttgagccttgactcttttaattattgacgagtagagtggtttaacaaccgtgtactagctagcatcgtgtcgaagctagattacattacacacagtacacaggcagagagcgtgtccatcatcatcagaatactgtactaccgctacgttacgtcgtccaagcgtccaacacacacatcgctagctagtgctagtcaatagaactaggcaggaaccgtgcatgcgtgcatgcgaaacctgctatatgcctgtttagtttaggtacgatttacgcacggttccagaggaaaaccccaagtccaagtaacaagtgaaaagggtagttgggttctttgaggaccgaacaccggctcgctcgctcatttcccagctccaggttccagaacacagctccgatcccattcccctccaattgggtcttggaatcgcattccacgacataaatagcatctgcactgcatcccatatgtttctcagcgagcatgctgcaggccatttcttcccaccagtgtgccgttgtcgctgaagccccagcccccagtagtgtgattcgttcataaaggtgtgagatcatccacacaactagctagctcgaagctagtagctgctgccatggtagtagcactgaggctgggacacttgtgctgcgcggttgtgcttgcgttgtccatctcttggtgcagaggtaatccgtcgacccggccacgacgacagcttctctgtttgttgccgtgtgaagcattcatcttgactactgttaataaattccttactccattcttctgactactgttaaaatcccttacttcgaccttgtttatttgtggggtttagttttataaagttttgctcctcttcttcttttgtgcaaaaaaaaagggttttatatatacaatacttattttgtcctcagaatctgaagcctttgccaagtagaagccagctcctgtgtcttttttcatagatattctaaggccttccagagcacataatgacacttgacaggcgtatataatttactgaacacttctgttgtttctatgcgcaatgcaggacaaggaggaggaggaggaggtgctgctggtgcaggtggtgctggtgcagcagggggcgcggcaggtggtgctgtggttccagggacacaggatgccatccagatcgtgtcacaggctgctctctgctttgacaatagacaggtaagctaacgactctttggcctgcgtccgaaggtaaaatccatcacatattcacatcaactgctctctgtgagggttacccacataaacaaggttccatctgactaaaacatcccagatcccaatgactgcagatcaaatactatgaaaatacatcgaaaatccccaaatcccaaatcccatgtagagcatattagatttaatttgcccaatattatagagaacattacaaagatttatgatatcaaatacttatactatggaaataaaaattaatagtgaaacttattatacttatttagtatcataaatatcattttacaatataaatttgactaaacttaagatgctttgaatctccagaaaagttaaaacatcctgtgatttggaacggaggcagtataaaccagagaatgatctttagtttcacccccttccttccggatagcctttctttgccttttttttgcatatgtatttgattctagacaaatgtatgtacaactggaaaatgcactctactgaagaaagaaaacgtcgcgtgacaggtgataaacgggtgcctccaagcaatgggcaacaatgtcaacagcaacggcaacggtggcagtagcaatggcagtggcggcggcggcagcagcaacagcaacagcgggtcaacggcaagcatgtgccaagggccgtgcttcgggcagatgatgctgatgatgaactgcgtgaacggcatcctaggcaacatccagggctacagccccggcctcatgcagggcgtccaggccgtcttccaaatgtcgtgcggcaatgttggcaacagccagcagggtggcggtgctagtggaggtgccgccgccggtggtgctgctgctggaggtgccggaggtactagtggatcgtctagtagtgggggtgccgccgctgccggcggtggagctaatggcggaggtgccagtggtgctggtggtgtcactggcagcgccggcaatgctgttggtgccagcgggggcaacaatatggccaacggtgtcactacggctggcggtaccacgagtcctaacggaggtatggccattttttcgatgcagaattttcttggcctccccgctccacctcctccgataattcgaatcgaaggcaagctctgactcgtcactcccgcctttggcctaggcaagccggatgtctagcagcaccgtctggcgtctgctcggcggtggctccgccgcttcgcttgccgttgatcgagccgcagccactgccgccgagtcacaccccatctaaagccgccgaccattgcacccctgcaaacctaagcctttaactccgaaactctaacaccatcgagctcgtctccgatccggaagcgacgatggtggaggacgaaaggcacgagccatgggccgggtcgcgtcgggctcacgcctgcgttatacggaatactttctagtatctgcagtaatagacaatctgtttagcaagacgaaagcattatgctagtaatttcagacaccaaagatagtaccagaatctaagatgctgttcgattcacaaatcataacataaatggtaataataatgattcatgctcgagggacagcggtaataattttgaataggccgatactaattttcagtgtggtgtccgattangcgattatggtagaacttaaataaatatgatttaacgttatagactatcggccacgttacaattatatagaccaaacaacacctaaaaaatatgattaaggcaaaaaaaacgaaacataatacagcggattgaaacgggatgcatctacgactacgagtcacatctaacatctgcaatgttgacctgcaggctcacacgtggcggtaagcgatcttgatgagccaataaccagcagcgcaaacggccccatgggcagcaggcttccctcgatgtcgatgctgaggacttggacgtgtatttggctactgcgcctgctgtggctctgacgaaactggattagagataagaacgttgtaaacattgagagcagcagctattcgtttctttcgcttggaagcgtactagcagtagttttaattttaccatcagcaaagattttacgtgaagcgtgtgcgactttaaaagtacacatcggcaagcaattcgcaacgtttgcttcaatataatcttagctacatccttcgttatcatttctatttctatattattaaagcagcaagaaaacgcggccaaagagcctatacaaaaaaaaaaaaaaaa

SEQ ID NO: 13370 - DNA, 1432 bp, Zea mays
atttcccagctccaggttccagaacacagctccgatcccattcccatccaattggttcttggaatcgcattccacgacataaatagcatctgcactgcatcccatatgtttctcagcgagcatgctgcaggccatttcttcccaccagtgtgccgttgtcgctgaagcgccagtagtgtgattcgttcataaaggtgtgagatcatccacacaacaactagctcgaagctagtagctgctgccatggtagtagcactgaggctgggacatttgtgctgcgcggttgtgcttgcgttgtccatctcttggtgcagaggacaaggaggaggaggaggaggtgctgctggtgcaggtggtgctggtgcagcagggggcgcggcaggtggtgctgtggttccagggacacaggatgccatccagatcgtgtcacaggctgctctctgctttgacaatagacaggtgataaacgggtgcctccaagcaatgggcatcaatgtcaacagcaacggcggcaacagcaacggtggcagtagcaatggcagtggcggcggcagcagtggaagcggtggcagtagcaatggcagtggcggcggcggcagcagcaacagcgggtcaacggcaaccatgtgccaagggccgtgcttcgggcagatgatgctgatgatgaactgcgtgaacggcatcctaggcaacatccagggctacagccccggcctcatgcagggcgtccaggccgtcttccaaatgtcgtgcggcaatgttggcaacagccagcagggtggcggtgctagtggaggtgccgccggtggtggtgctgctgctggaggtgccgggggtactagtggatcgtctagtggtgggggtgccgccgctgccggcggtggagctaatggcggaggtgccagtggtgctggtagtgtcactggcagcgccggcaatgccgttggtgccagcgggggcaacaatatggccaacggtgtcactacggctggcggtagtggtaccacgagtcctaacggaggctcacacgtggcggtaagcgatcttgatgagccaataaccagcagcgcaaacggccccatgggcagcaggcttccctcgatgtcgatgctgaggacttggacgtgtatttggctactgcgcctgctgtggctctgacgaaactggattagagataagaacgttgtaaacattgagagcagcagctattcgtttctttcgcttggaagcgtactagcagtagttttaattttaccatcagcaaagattttacgtgaagcgtgtgcgactttaaaagtacacatcggcaagcaattcgcaacgtttgcttcaatataatcttagctacatccttcgttatcatttctatttctatattattaaagcagcaagaaaacgcggccaaagagcctatacaaaaaaaaaaaaaaaa

SEQ ID NO: 13371 - DNA, 4296 bp, Zea mays
  misc_feature (963)..(963): n is a, c, g, or t
  misc_feature (2997)..(2998): n is a, c, g, or t
  misc_feature (3056)..(3056): n is a, c, g, or t
agttggaactgaacctgtgggatttcagcacagaacctgatgattgtgtccttgatttaactctcagtctgaagccaagtttttctggaacagaccttggtaagcatgttccacgacgtacagaagaggaaattctcctgtacccgggatttgagaatacccctgtgaagtccggtttttggcctctggtgccatctgatcgtcccgttggtgatgttccggccataccatcctggcagcaggcgtacatggttgacagccaaggcgcattttctggctctccgttcttgcagtcgaacctgttggagaaccgttcgttagcacctatccggcaggtgaatttcttctgacggagacaggattaacagattcatacgattcttgatacgtccagcttctcgctgtatacacactatcttgaataaagtgttgccagtagaggaaatgtatatacagttcgttcgtagctcttgagcttctttctttctagagtacctctttttttttaatcgtctgttcatattccacaccactcctatgtaaataacggcatgcatgataatctctctcccaaaaacaaacaattttgtttgtacgccggctgctttattttagaaaactttaaaacagatacagtatttgcaatacttcagttttaaaaaaaaaaaaaaaagagcagctccaaaagagcacaaaatttgttcctaaaatctttatcagcatagttggaaaataaaatccatttagagctagtttgacaaccctatttttctaaaagttttttattttctcatataaaattatttcattttcttttgagaaaatgataattatttacaaaaatagagttgctaaactaatcctaaaaatatgttatctcacagcagactaaaaacttgtccctagaaagatttaaaagggacatgggccaatagatgttgtactgggccagtacgtacgcantgctgttcttggttttgtgcaaacgccttcatccagtgtccagcaacaaacaagaaaaaagcgcgtcaggggagaatggcgtcgtgagatgagttttcgcccttaaaatacctttgggattagttttggtcatttgttcaagttgctcttagctagcttatcaaataccattttgtatataatactatagtattcaaaaatactacaatattttttaaaactgtaaacaaaacttcactactaaacactcccttaaattttgtaatgtaagtagtgcgacgtcttagagactagtcaacccctttgagagttagtaaaagggcgcgtaccgcctagcactaatagtagcacgagaaatcaatcctacataggccctgtttgtttgaggtgactaaaatttagtcactattagtccctaaacaattaaacatggtgactaaagtggagtgactaaattttagttctttagtcaccaaggggtaattaaaagtggctaaagtagtatttttaccttatttgtcctctctactttcttcttatagcaaacattcattaattaataggggtaaaacagtcattattcatagcaattaatgttctttagtccggtttagtcattgaaaccaaacagggtactttagggactaaactttagtcattaaaatttagtctaatgactaaaaaaaccaaacagggccatagtacatatgacgtcgttgattttttttttgaaaattttgaccacttatcttgttcaacaaaaaatctagaatattatttattccgaattctctctactccgcatttagaaaagctcactttgcgcatttagaaatcaaacccctttgacaaaaaattatctatttagtcagattctctttatattcggattcttagaaaagctcattagaaaaaaaaaactgaataaataggcctatagtgcaacagcatgcaaaaaaaaattgcatttgcattttgcgcgacgacgtggatgctgtcggctcggtcacgtatttttttgcgcgttctctctactccgcgggagccgggagatgatccgtatgcgcatccgcgagctgctatacgcgttcacttttttcattgtgcaaacaaacgtcgtggcacgtgcgatgcacatgcagatccgcgaaccgctggacacaagtatagatgtatacaaaagtccatcctgaagcatgttttttagcctcatacgtaggtacggcccgtttttataggggactaggctggaccgacacgaataagcagactggatttaaatagaaactaagtacggtaggctagcctgacacgatccgtttacctctaaacctattaaatctgatttttgaactaaactgtacttaccggaccgtttagcctattatggcccggttttttcgtgcttaacaggctggcccggcccgtttagacccgcaatcggctggacttggacagggaaacgagcccacgagcttagacggtccggcctaatttcctaaccgtgtctagcgggccaggccctaaacgggccagggttcactgggccggactgagcagcccgtttgatcatctctagacacaagggtgtttgttttagcttaaaatcatgttttgatcgttggactctcgattctgtcagtcaaacattccgcttctcggtttattaaacacaacaaatcaatgtaaatgtagaatctatcgagtcgtcgtgatgagaggaattcatcacttcctaaatcctaaaccctatagactcctttatctgtcccgcctgtaaatttcaagatatttagatttttcatgacagctagactatctatgaatcgagattctcagaaaagttttagaaaatgtactcgtagcctaagggatgtttggtttttagagactaatctaagttcattcattttattatattttaatatctaaattgtaaaatacagaaactaacatatttagcaatttagatactaaaataaaataaaatatatggattaaacattagccacggcgaaccaaacaccagagganntcgcagtagcacgagctcgctgactgctaggtccatcacgctcaataaacatgcctgngcggcggcggcggcccccattcctctatgtgcggaggccgacgggcacgcaaccgtcgttggtgtggtgtggtgtggtctggtctgtctccgttgcactgttgagcttgctcggcgggccggtttccagagccaagaggctccgagcaagagcaagaacgatcggagaaggcgaggacagcctcgctcgctggctggcacttgggtggcacagctaggcgaagatgctactgagtaccgtcggcgttgtcatcacagctttctaaatctatgacccgaactctacggtcagtagcagcggcgcaagaaagataattcctctatcctaatttataatttatttgactttttaaatcttaactttaacagtttgtcttattcaaaaatttatgaaataacaaaaaatctattttgcatttattatcaaatatactttacatataacttaactttttttcattttatattttttaataagatgagtgatcaaatttaaggttgaaaatgtcaaatgggttataatttgaaacagaaggattttaaaatacctattgttgagacttgttctcaatgctatgggttaagaacaagacaacacaaatgttaatagttaaaaaccttcgttcttcgaagcattatctccctcgggatataataatcttcagacgaaggttatgaaggacatattttcatcatctcaataggtaataatgaaagtagaaacatatgaaacatgaaaagaacatggaataatcacattaaatcatcatattattatttatgttcttattatttaatcatgaacaaacattaatgatattgattacatttgtaccttcggcttgatagaaggtaaaaatccaagagcgatgtgcagatgattaccaatcagcgtaaacatgacacaaattatcatgaactgaacaaacttttcctctttaagtcggtgtcgcccttcatctcaaggcgtgtcatcatgccgaagctccctggattgtagctttggcatataccttcgtgttatgtctgcttgcatatcgtcctgtcgaaggtgtttttgtttagaggaacttcgacgaaaaaaagaccccaacacctatttatctgtgtaaatatagagatagaagataataatgacatatcttttctcttctcatggtagtattcgttataaggaggtgcatatttattacatataaacggatagatcccttcaggagtatatttaatattaaccccac

SEQ ID NO: 13372 - DNA, 845 bp, Zea mays
catccgcgaccccggcgccgcgcctcttccccaatttctcgcggcgtcgttccgtcccaaatatcgccccgcgatcccccacctcgccgactggctcccccgctccacctcgtcgacgggcagaggagacccctcagggccgggatcggactcctctttcaccgatttttccatgcactttaggctaaaaatgctttggtctgaaacctatctgcccttttttctggccgccaacggtttcagccaacgcataccagtgatgaagatcttccgctgaagcttgctcaagctgcaataaagcatgacggttgtgcacataatgatgcttaatcattcatgttgcgaaaccctccagtggaacttccttcttctgatgcaaccatgtataggtggacctagttttgaggtggatgcgctgagttttgaaggtggcgagggatctttgctgcggggttctatttgttctcagtgatttttggcaaacactctttggttagattaagaatcatggaaaggtacaaattgatacggaagataggtgatggaacctgtgggaatgtttttatggcttctaatgtagaaactaatgaaattgttgctgttaaaaaaatgaagagaaaattttgtcattgggaagaatgtattagtctgcgagaagtgaaggcccttcagaaactatttcaccctaacattgtgaagctgaaggaagtgacgatggaaaaccatgagctgttcttcatctttgaacacatggagtgcaatttatatgatgtcataagggaaaggcaagttgctttccctgaaagggatataaggaactttatggcccagatactgcaaggtct

SEQ ID NO: 13373 - DNA, 2036 bp, Zea mays
gcacgagaccattacctagaacatcctatcttcccaaatttctcgcggcgtcgttccgtcccaaatatcgccccgcgatcccccacctcgccgactggctccccccctccacctcgtcgacgggcagaggagacccctcagggccgggatcggactcctctttcaccgccaacgcataccagtgatgaagatcttccgctgaagcttgctcaagctgcaataaagcatgacggttgtgcacataatgatgcttaatcattcatgttgcgaaaccctccagtggaacttccttcttctgatgcaaccatgtataggtggacctagttttgaggtggatgcgctgagttttgaaggtggcgagggatctttgctgcggggttctatttgttctcagtgatttttggcaaacactctttggttagattaagaatcatggaaaggtacaaattgatacggaagataggtgatggaacctgtgggaatgtttttatggcttctaatgtagaaactaatgaaattgttgctgttaaaaaaatgaagagaaaattttgtcattgggaagaatgtattagtctgcgagaagtgaaggcccttcagaaactatttcaccctaacattgtgaagctgaaggaagtgacgatggaaaaccatgagctgttcttcatctttgaacacatggagtgcaatttatatgatgtcataagggaaaggcaagttgctttccctgaaagggatataaggaactttatggtccagatactgcaaggtcttgcatatatgcataataatgggtattttcaccgtgatttaaaacctgagaatttgttggtgacaaatggtattattaaaattgctgactttgggttggcaagagaaatatcttccaatcctccttacactgattatgtttccaccagatggtatcgggctccagaggttctactgcaatcttcagtttatacacctgctattgacatgtgggcggttggtgctattttggctgagctttttacactgtccccactttttcctggtgaaagtgaaactgaccagctttacaaaatatgcactgtgcttgggacccctgattgcactatttggccagagggaatgaacctgcctcgttcatgcagctttaagttttttcagaatcctccaagaaacttatgggagcttattcctaatgcttcatctgaagcaatcgatttgatccagcaactttgttcctgggatcctcgaaggaggccaactgctgagcaagcattacaacatcctttcttcaatgtgtgcaattgggtaccaagacctgtacatgatgcttaccatacaaaaacaaacggacctaaagctgaaccaagattggaactgaacctgtgggatttcagcacagaacctgatgattgtgtccttgatttaactctcagtctgaagccaagtttttctggaacagaccttggtaagcatgttccacgacgtacagaagaggaaattctcctgtacccgggatttgagaatacccctgtgaagtccggtttttggcctctggtgccatctgatcgtcccgttggtgatgttccggccataccatcctggcagcaggcgtacatggttgacagccaaggcgcattttctggctctccgttcttgcagtcgaacctgttggagaaccgttcgttagcacctatccggcaggtgaatttcttctgacggagacaggattaacagattcatacgattcttgatacgtccagcttctcgctgtatacacactatcttgaataaagtgttgccagtagaggaaatgtatatacagttcgttcgtagctcttgagcttctttctttctagagtacctctttttttttaatcgtctgttcatattccacaccactcctatgtaaataacggcatgcatgataatctctctcccaaaaacaaacaattttgtttgtacgccggctgctttgattttagaaaactttccacccaacccacgcgtccgcggacgcgtgggtcgacccgggaattccggaccgg

SEQ ID NO: 13374 - DNA, 4156 bp, Zea mays
cgtaactttgttcgttttccttgtcacgtcatgttcactgggactggcattgacctgcaaatatgacaagtgcaagcggacgccgcacgtatatatatgcatacatttttgtcttgggcacaatgccactgtgacgttgcatgggaaagtcaacctcctcttttaaccgtctgcagcgtcatccttttatttttatattttttttttgcctttgttctttttcctcagctttagttgacagcagagagatcacagacgctaaaaaagaacgcaaaggaacaaaagaagctctctcactcagcccggcatcccttttctctgcgcaaaggtgttcaccctagctttgtcaacctacgcttttgtttttgttttttttagtaaaactcattcgtgctcctccccgtccctcatcttgcgaggagtaaaaaaaaaaccggtaacaatctcgtgttcccagtagttcctgctgactttgattctgacacgacctgtgaaagaagaaagaaaaatgtgcagcagtgccaagtaaaaacagccaagaactcgtcatccatcccccgccagtccagccactgaccctctctcttcattctccaaccaaaatttgaggagagccatgcaggggacacagtactgtttgtgtgactaatacaatctcacaagtacatagacctggttatagcctgctttggtatttggtaattgtggtagaatatgggcggcgtacactatactgtacagtgtacaataaccagtgcatgacacagagcacaagtctctccacagagaagctggagctgtacagtgtactgtggagtgaggtgagcacaagacaaaccctggaatcattcatcatccagccactgagccagcctccaagacaagggcccacctgcctagacccaccaccacacacccccacccattctgttttcttggatccctccctgccacactgccggtgccgctgctactggccagtggccactgccattgcttgcccttgcccataaattttggcacgcccccggcgccgccccgaaacatcttcttcttctccccaaattcgcccggcccgtcgtcgggagcaaggcagcaagcaatgtgccccagagccacggaccagctctgcggcgccgcgatggctagcgtgtgttcgttggtggaggaggagtacatcgacctggatctcagttcgtgcggggagctggagttccgggtgcgccggagcggcgcgtcggacgagctcctctgccgcggtagtaggctgcagccgccggcgccaccgaggcctggcggcaaggcgcaggaagttgacgtcggcggcggcggcggatgtggtggcgccggcaggaggagcgccgcgacggtggcgccgctgcagcactcgcactccgcggggttccgcgacgacacgcagcccgtggcggcgaggctgcgcaccgagtgctcccgccgcaggaaggcggcgcggacggtgcacgcgaagctgctggcgtcgcgggccttcttccggtccttgttcgccaggactaccccgtgctccgacgagcaatgccgcggcgccgaggtccgggccagcaccagagcggcgccaccacccggcgagacgaagagcgactgctgcaaggcggcgtttgcccagatcaataacggctacggctacggctaccacagcggcagggcggcgccgaccaccctgcggagcagcatcgagcaggagaagctgatggacgaggaggagctcgccgccgccgcccggcagcgcaagtccttctccggcgtgatcaagtggcggcacgcggcagcggcgcctcccgccgcggcgccggcgaagcctctgtcgtcgtcgtcctcggcgaggaggagctccggggctggcggcgggccggcgctgaagcggagcagcagcgcccggtcggagtcggaggggctgatccagggcgccatcgcctactgcaagcgctcgcagcagcagctggggctcgccaggaagagcgtcagcgacgccggcgcctccgcgccttcctggccggctcgatcggccgtaacagcagcagcctactgccactagccgtgagccccgtgacgtgtgcaaaaaaaaaaaaacaatggataccgaaagcgaagtgaccaccaccacatgagcagtaatgtgaagtttgtgctgtcttttcccgcatatatgcatccagacacgcgtgggatttcaactccagtttcttcttcttcgtccgtcagtcagtcatcgcggcgattcattcacgtatgcatttaggtttcgtagatgtcgccatcactgcaagtgttagcaacaagagaataaaaacaggaccacgggttgtcttggtcggcgttactctcctggtctgcctgccgttgctggctggctggctggctgagaggattgcctggccagctgccgctcattcagtgcgatggccagaatagggactagtctgaacggcagagcaactacgaacaacagtagtacgtactggcactagtgacacagctgctctcaagaaagacgcaggcaggggccgatgcccgccgggggaattggtggagtggatgatcggcatgatgggcgggcggatcgccgagggaaaagcgcgcaacgcgataggccgtcgaaagcgtcggcatcattggcgggcggaaaggcgcgggtcgatggaggtgcgtgcgcgcaacaacccgcattcccgcggccaggacaaggggagggagggactgggaggcgcggccgcacatgtgccctgacgggcctctgcttccttgtcacggtcggccggcaaccacagcgctgctggctggtggtagtggtactggtactaccgggagaggttcttgattccttgaccgcattcaatggcgtggcgtgacgcgggaccgtgacgagaatggcatgttccttgcttcgtccgttgggttctcgttaacatttatggttcagcagattgcagatggagaattccgttcaaaaagaaagaaagaaataaataaaaaaaagaacatgctgcagcagcagatggaggtttttttttctttcatcaaagaagaaaagatcgtgcggagagagcccatgcacggatcgccaaagcaggcctgaaacttcacgctttggaggccgggccccggggacggtaaaagcccctttgcgcgacgggcaactttggcgggggctctcctctcacacacactcctcctagttttctccaggcaacgccaaaaggcgctctactactactttactactcgagagcgagcgtaaaaaagacctttgctttgctgagcctgagcctctccctctcgtcggcatcggcatcgcgccgtgcatgtgacgggaacgagatgcgtacgctgcgccggccctgtagaaagagcagtagactagactagcgctgtacgtagtgggagtatcatgaggccttttggatctgtttgttttttttttgcatgggcgcggcttcaatggcgatagcgatcgctgctggctttgcctgcggcgtacgacgcggctgccgcatgcacctttcgctgttgttctcctacacagcctgtgctgcgctggactggagcaaaggcgatggcaaccggaccgggcggcgcgcgcgaggggggttttgttttgccgcccccggcccacacctcgctcgctcgctcgccctttgcccgacgaggataccgatgccgtgccgcacgacacactggcgtgcgtgcatgcatgcacggcacgggtcggagtgtagcctctcgctcgccgggaccgggacacagcaagcgtggtcacgatcacgacaggctttacgtctgtctgctggtgctggagcctggatggagccaggagaccgttcgttcgtccaggggagcaagagaccgtagctgtactgcgggtctgcggtggtacaaggtcaactactcccggtcgctcaacacgtattacagacaagttttgtccatctctacagcaccctgtccctgtggtgtccaccgttcactgtcgacgacgtacccatccgcaccatcgccgtaaattctctcctaccataccacaggaattttagcaactgtacgtactgttattatagcttggcgctatctccggctataacctgtttgtagaggatggagctaatttgcttctatagac

SEQ ID NO: 13375 - DNA, 3714 bp, Zea mays
  misc_feature (1296)..(1296): n is a, c, g, or t
gactctagagatccccctgcaagatcgctgcaggaatccctgctgaacggctcccctgtcgcggaagagtataaagtttctgaatcaatcgggaggcgaaagtaccttatggtgatagggatcaacaccgcattcagcagccgcaagaggagagactccatacgttacacctggatgccccaaggttctagtactaaaatatactcatacatgccactggtttggaatacttcttgttaccgtaccatggatagctaataatatactatttcaaatcaggtgaaaagaggaaaaagcttgaagaagagaaggggatcattattcggttcgtcattggccacaggtttgatggaaacagactctgtggctatccttagttgacgtttacaacgagttctggatttactcgtttcaaccgtgaaagtaactcaccttaagctccacgtgccttgcagtgctatatcaggtggaattgttgatagagcaatcgaagcagaggacaggaagcatggggatttcatgaggatagtaagttaattccttgttgctcttgcgcaggagtgatatatgtgaactttgttctgagttttgctcagatggctgggttttcctccatattcacagtggctacaatttttttgttcaggatcatgttgaagggtaccttgcattgtcaggcaaaaccaagacctactttgctacagctgtttcactatgggacgccgacttttatgttaaggttgacgatgatgtccatgtgaacataggtaatctccccgtgagaacttcacgctctttgctgatcttcagttagaattttggaactcttgtttacttttcgaatttcgataatcataggccatttcctttttttttgcacacttaaaaaactagaagtacaagctgatgtgtgaatctgcataaaaaatagcatatgataagctctggcaaagcaactaacgccaaagttcggcatttgcagcaacgctcggacagattctgtcgaaacatgcattgaagccgagagtgtacatcggatgcatgaaatctggacctgtcttatccgaaaagtaagcttatcttgtgggcagagtccaggtctcttgaggatagtaattttgctgaaagttgttgacacatgtttgtgcttccctccactccaggggcgtgagatattatgaacccgagcactggaagttcggcgaatcggggaacaagtacttccggcatgctaccggtcaattatatgctgtttcaaaggacctggcgacttatatatctataaacaagtgagtnagcaatagcatgggcctgaattttctcgagatttacagttcgttttggagccttacattgacttagctgctaataatctgaccgtaacaggcatatccttcacaagtacataaacgaagacgtttcgttaggatcttggttcatcgggctagatgttgagcatatcgatgaccggaggctttgctgtggcactccgcctggtgagttttttcatcacttcatgcccctgactgacaaactcaagcttgtttgttcatcattcacgaggccgcgccatttgaattgctcttctgaaacatggctttgggaacctgctgctgaacaatgccaactatttttcatggagcctcatcttatgacgcctttaaccacagattgcgaatggaaggctcaggcggggaacgtctgcgccgcgtcgttcgactggaggtgcagcggcatatgcaactccgagggaaggatctgggaggtccacaataagtgcgctgagggcgagaaggcgctgtggaacgccactttctagcacacacacaaaataaaaaaggaagcagcaacagaagctgctatataatagatcaaaccattttggtttgttgtctgtacattgtcccacggtttgtgtgtacgtaattcattgtaggtagctgcgggtttttttttttggttgttgttgtaacgggcgaaagcggaccaccattttaggtagtgtctgtcagccggtgccggtgaagatgatggagaaggatatggtgtgagcggtgatgtattcttttgtgcggtaaatgtgtggaggtggtcatcttgttgtgccgatctcctgtactgcatgtatggctgccgagatacgtgagaccgacaaacactttcgtgccataaaagtagagctagtaaataaatctggtaattgctgtccactctatgccgtaaaagaagctagtacttagctttactggtagaatcactttgaagctactactgattactgaaccatgtgcgaattctgagcctacgcgccggaagtttggtgatgcgcgcgcgcgccaacctggtaaacgaggcccacagggcagtgacaggaagtctggttactttcagatagaagcgccaacctggcaaacgaggtccacaggtcagcgacaaggtgcacattcgcgtgtaccaatgcgctggaccagtgccagttgtagcctttctgctcaccgtcgcctctcctacacaaaatcgcccgcgcgcggtttctgttcccgccagtgtttccctccactgcccaccgctccctccccctacccccgtccttaaaatcacctactcgtgccccgccaatcacacccccacgcaattcccacatctcagcctcgccgccgccctcgttcgcccagcccaagccgcctcctcccgttctccgcctgtccatggaccgccgccatcgagccgtaccttactccgcgcgccagcagcagcagcagcggttcctccggcccggcgcgctcgcgcggctccgggactcgaggatcgtcgcccgctccgtccgtcgtcgtcgtacctcttgctcccgcggtccgcccctccgtctccgtcccccgcgccgccggtcgtcgccgcggcggacgagctggccgccgcgccgcgcttcctggggaccacgagcggctcggggcggtacccgctccgcaggagggtcgtcgccgccaggggcgtggcgttctcgccgtcgtcgccgtagcctggcacggacggaggcgccgtagctgagaacttgtgactagatttgtgtttagttcagtattgctgtgcagatgtttttgcactttcttggtttacttaaaaaaaaagactagagatttgaggaaggaataatcactccgttttttttaaaaaaaaaaaaaaaatcaactgttcaatcttcacctcgctggcaagatgcgatctggaagcagttgctgacatatgattatgtgagactaggttgtgttatcccttttggttttgcacttccagcagggaggatttcacaggaaaacgaacctttatcatgtttagatggtggtagcgcagctttgaagcagaagtgaaggcataggcacagcttcagcagttgagcttgtggcctgatctgattgggaacaaaatccgaaggcgcctcctgctgaaaccgaaaaatgacaaattttatgtttggtgaaacgaaaacggtgtcggtccgcatagaattttctgcaccgctttcacacctatttcagcaatccatccaattatgaaatggaagggtgtttgtccgggacaacggcaacatgcaacttcttttggtagcatcgcgtcagtttaattactatctacgtgttcacttaatggtgattgacaatgccattgtgccttaggtctacatgatgattaatgaatgaatgaatgaagtcatgg

SEQ ID NO: 13376 - DNA, 2197 bp, Zea mays
tgcagctgctgctgttcactgtttactgttcagcgcgtgtccggcccggccggctggttagagtagagtgtggaactccgagccgccgctcccccgaccccgatctaccagcttcgtgtgtgagcaccgtgccgcggtgattcgattgcccgcgctcgcggtttccgtcgtcgtcgtcgttctctcatcgtacggcggccatcgctagctactgccgctggatggcggtaataaccaggcccgaggggtaggagcggtagttgtttaactgcggcgggcggaggcaagtggagtgttccggtggactggcactctgacacggtcggttgctgtgcttcgcgtcgcatctaccgacccctcacccacatggaaagcgaggaggtgagctgcagctgcgacggagactgagcgagaagccccccctccctccctccttccttcgacgtcaagctccgccccactccatggattcgatctgggaggcgaggagctgaggccaggacagggggaggagctgctggggggcagggacaggatagcgcggctaagcggcaacggcggcagccatgagctggagacgaggcggaagcggaggcgatggcggggtctcgaggaggtgggccgtcctgctctgcgtcggcagcttctgcctcggcctgctcttcaccaacagaatgtggacgctgcctgaggcaagtgagattgctaggccgaatgcgaatgtggaggaaggcaccgtgccgattgccgcggagtgtggttctaaaaaggtccaagaaaagcaggattacagagatattttacaggttcaagatagccatcatgatgtacaaacactggataagacgatagcaagcctagagacagagctctcagctgcaagatcgctgcaggaatccctgctgaacggctcccctgtcgcggaagagtataaagtttctgaatcaatcgggaggcgaaagtaccttatggtgatagggatcaacaccgcattcagcagccgcaagaggagagactccatacgttacacctggatgccccaaggtgaaaagaggaaaaagcttgaagaagagaaggggatcattattcggttcgtcattggccacagtgctatatcaggtggaattgttgatagagcaatcgaagcagaggacaggaagcatggggatttcatgaggatagatcatgttgaagggtaccttgcattgtcaggcaaaaccaagacctactttgctacagctgtttcactatgggacgccgacttttatgttaaggttgacgatgatgtccatgtgaacatagcaacgctcggacagattctgtcgaaacatgcattgaagccgagagtgtacatcggatgcatgaaatctggacctgtcttatccgaaaagggcgtgagatattatgaacccgagcactggaaattcggcgaatcggggaacaagtacttccggcatgctaccggtcaattatacgctgtttcaaaggacctggcgacttatatatctataaacaagcatatccttcacaagtacataaacgaagacgtttcgttaggatcttggttcatcgggctagatgttgagcatatcgatgaccggagactttgctgtggcactccgcctgattgcgaatggaaagctcaggcggggaacgtctgcgccgcgtcgttcgactggaggtgcagcggcatatgcaactccgagggaaggatctgggaggtccacaataagtgcgctgaaggcgagaaggcgctgtggaacgccactttctagcacacacacaaaataaaaaaaggaagcagcagcagaagctgctatataatagatcaaaccattttggttgttgtttgtacattgtcccacggtttatttgtgtgtacgtaattcattgtaggtagctgcggggtttttttttttggttgttgttgtaacgggcgaaagcggaccaccattttaggtagtgtctgtcagccggtgccggtgaagatgatggagaaggatatggtgtgagcggtgatgcattctttttgtgcggtaaatgtgtgaggtggtcatcttgttgtgccgatctcctgtactgcatgtatggctgccgagatacgtgagaccgaaaaacactttcgtgccataaaagtagtgctagtaataaatctggtaattggtgtccactttatgccgtaaaaaaaaaaaaaaaa

SEQ ID NO: 13377 - DNA, 1315 bp, Zea mays
  misc_feature (1061)..(1061): n is a, c, g, or t
  misc_feature (1306)..(1306): n is a, c, g, or t
tcagctacgtaggccccccccccatatcactgtttcagtctcttgggatcctttctatcagcacaagacgtttaaatattctaaggaccatcaagcctatgaagaggttgatcactatgctaagaggaaagcagccaatatctgtgcttccaccggtgctagagctgtcaagagaaaaatagaagcaagcaggatcccacctaatggtttagacagaagaacaggcaaggaacagaaagtatctacacatgaatttcgccagttaaccaagaacgagttgcccccaaaggtgtctgctaggaatgccatcaacggagatcattttcataggcctttaagtagcagatacaacgatctgcctgagaaacctctgcgcaccagagaagaggatgagtgctcggtggctagctgcagcgctaattactcagagcacagtaccagtgatgatgaccatgaatcagtcagaacgggcagttgtttcctgatgatgttatgtctgcatgtgagtatgggcaggagactgaggacgcctatggctctggtttgtttctgaacatccatgagctagagctgcgagcatatcgatcaaccgtcagagctctccatgctgcaggacctctgacgtgggagcaaaagtcgctcctgacgaacctccgcctctcgctcaacatctcgaacgaggaacacttgcttcagttgaggcatctcctatctttttgaaaattttaaaaaatcaatatttttttgaacacctgtagattacctccgactcgcagagaatctccgcaggcttgtagcgtgcgtaactcgagggtgtaccatatagagaagagtctagagaaattcacatgtagctgttgtacttcgctagaactttgttgctatgagtacatgagtcttgcaatttttttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccccgggggggggcccgggacccaattccccctaaaggggggcggantaaaattcccggggcggggttttaaaaaggcgggggggggaaaacccggggggtacccaaattaaaccccttggaaaaaatcccccttttccccggggggggaaaaagaaaaaggccccccccgaacccccttcccaaaaggtggcccacccggaggggaaaggggaaattggaaggggtaaaattttggtaaaaatccgggtaaatttttggtaaaaccaccccttttttaaccaaaaggccgnaatcggcag

SEQ ID NO: 13378 - DNA, 1847 bp, Zea mays
gcacgagaccattacctagaacatcctaatcgaaaaaaatttcaaacggaatccccatgacaaacgcaagaaacacgaaagcaagaaccggaaggaacagccacgccaatatacagagcgagccagcacacagtttttttttcatacggctggtctgcaattaggtgcctcgactgcttgctagccgccggattaatctttccctaccctaaggctcaggttttagtgggatatgatgaagctaaaaagtggacgacgaccgttctataaggatgttaagcttgtagactgccgttcaggctcaagtcttccacatttggctgctcaagcaaagtttgcagccatgaacatgaagactgaagatgtcaatcctcgtcgaccagttcaagtcagacgaagtagatgggctcttggtgatgtaaccgaggtgttggatcataattcgtggaggcttgggaagattacagaagtactgaagaatgactattttgtcatcaggctagtgggttgcatccaaccaagagaattccacatatcttgcttgaggattccacatgatcgcaagcagttgactgttggaggcaggatcaatgaactgaataagccgacccgatttgctgactgctcctctcaccactcaaaatttgtgatggaacaggaccatcaagcctatgaagaggttgatcactatgctaagaggaaagcagccaatatctgtgcttccaccggtgctagagctgtcaagagaaaactagaagcaagcaggatcccacctaatggtttagtcagaagaacaggcaaggaacagaaagtatctacacatgaatttcgccagttaaccaagaacgagttgcctccaaaggtgtctgctaggaatgccatcgacgaagatgatcattttcataggcctttaagtagcagatacaacgatctgcctgagaaacctctgcgcaccagagaagaggacgagtgctcggtggctagctgcagctcgaattacacaagtggaacgaaaaggccttcgagcaatacggacactgcttctagtccgccaaagaagaataagaacgcaatggttaggtgcatgaagggtttgcttgatcgattagattctggcagtagcaaagacgtagatacagctacgcagattcaagaaataattgagacaaaaagaaaggagcagcaagctgcagatttcaaggagatagacctgtgtttggcactggcaaaggaatgtggggctactgaggagacagacgagttcttcgtagcttcccaactgtttgcaagctgcaaatttcaaagacatgttttcctaggactgtcttcaaatgcaggaaggatggcttggttgaagaagcactgcaagggctggactttttaaggactttagtttatgtcataggactggcttttctatttgtgtatcatgaagttaagtctatgaactgttagttatatttggtttgtgaactgttatgtacggctgtgatgcataaactttgggaggaaaaaaaaaaaatgtggttgtgctgcatgattttgcatgatttgtggaggttgtgcatgaatcatttgcatcttagttgtcttgtgaataatttcgaagaagttgtgttgtgacctggtaacaaaaggtttgttgtcaactacttgattttactgggttacagaggtactcatttgaaagattttgttcaaatgtttattactttctttcatgatagattattaaacatcagtatattaaatgtttgtaggatgaagaagcacaggacgcacaagacgcacaatggattacacagtacatattgaagtgtcgaaaatggagaatgactatttgtatt

SEQ ID NO: 13379 - DNA, 1397 bp, Zea mays
ttgggaccctcgaggccggccgcgaaaactacatttcaaacgaaatccccatgacaaacgcaagaaacacgaaagcaagaaccggaaggaacagccacgccaatatacagagcgagccagcacacagtattttttttttcatacggctggtctgcaattaggtgcctcgactgcttgctagccgccggattaatctttccctaccctaaggctcaggttttagtgggatatgatgaagctaaaaagtggacgacgaccgttctataaggatgttaagcttgtagactgccgttcaggctcaagtcttccacatttggctgctcaagcaaagtttgcagccatgaacatgaagactgaagatgtcaatcctcgtcgaccagttcaagtcagacgaagtagatgggctcttggtgatgtaaccgaggtgttggatcataattcgtggaggcttgggaagattacagaagtactgaagaatgactattttgtcatcaggctagtgggttgcatccaaccaagagaattccacatatcttgcttgaggattccacatgatcgcaagcagttgactgttggaggcagggaccatcaagcctatgaagaggttgatcactatgctaagaggaaagcagccaatatctgtgcttccaccggtgctagagctgtcaagagaaaactagaagcaagcaggatcccacctaatggtttagtcagaagaacaggcaaggaacagaaagtatctacacatgaatttcgccagttaaccaagaacgagttgcctccaaaggtgtctgctaggaatgccatcgacgaagatgatcattttcataggcctttaagtagcagatacaacgatctgcctgagaaacctctgcgcaccagagaagaggacgagtgctcggtggctagctgcagcgcgaattacacaagtggaacgaaaaggccttcgagcaatacggacactgcttctagtccgccaaagaagaataagaacgcaatggttaggtgcatgaagggtttgcttgatcgattagattctggcagtagcaaagacgtagatacagctacgcagattcaagaaataattgagacaaaaagaaaggagcagcaagctgcagatttcaaggagatagacctgtgtttggcactggcaaaggaatgtggggctactgaggagacagacgagttcttcgtagcttcccaactgtttgcaagctgcaaatttcaaagacatgttttcctaggactgtcttcaaatgcaggaaggatggcttggttgaagaagcactgcaagggctggactttttaaggactttagtttatgtcataggactggcttttctatttgtgtatcatgaagttaagtctatgaactgttagttatattaatatatgtg

SEQ ID NO: 13380 - DNA, 2908 bp, Zea mays
tgaatttttcccttcaaaagtttccaacctgtaagattatcttctgtttctgggatctgcccatctggggaattgctcctgcttcagcctcttagcttgaggtcagagcaggaggcgatttggctaaattggttttagttgtcttgtttgcataatttgggtcacatctaataacatgcaggggattgaatctttacttccaagcttgcttcacatataggacctgatttccttatattatgtagaaattcttacttgattcacctattttttagactcactgattttgaactattttcctacatgactttgactcccacttagcgctcaacctgaatataaataaggtcgtactctgaattttgtgactgggcttgtggagcttagacgatggctagtttgtgccgttctaatatctgggttatataagaaggttcaagttctcatttttttttctcctaggctacctttgatagtaagccaagtagttttaagaatacatctcagagtgagggacaagatcttgcttctgatgctactatgaactctaccttcatttatttgctcatccagattattggattctgcattcagctcttttctgtgttcatcatccaatttttatgcatagtgctatctttgtgtcgcaccctcggcccggccggtgtggtatggtgtcaacaaacacctattattattcgtgcgcacgttctggagccgccttggcgtctctgtcccggacgacgcctcttcagaacgaactctgtgatcttcgaaggcgtgcacccctccaccacttcggtcctccgccagtgcaagatgaggccgccctgaggcgtatcagactgcaccgcgaggacaccgccgtggctaacctttggtgccgtgcattcaccacggcgatgctctgatcaaaccctcccccctctttgtatattacaaattttttcagctagcctacttttgatctgattaggcataacaccatacaaataagacttttggtttattctgatgactttaaatccttgactttcttctgtcaaatcatttattaacagtgaacttgtgttccacttgtacacttacctagaaatataatgcttggctcttaacaaacaatggtttcattttcttatccattcatgttttaatattcttccctgtgtgctagtgcttcttttgacttttgttcatggtccaccttttatgtgcatatacatttcaggctcaggttttagtgggatatgatgaagctaaaaagtggacgacgaccgttctataaggatgttaagcctgtagactgccgttcaggctcaagtcttccacatttggctgctcaagcaaagtttgcagccatgaacatgcagactgaagatgtcaagcctcgtcgaccagttcaagtcagacgaagtagatggattcttggtgatgtaaccgaggtgttggatcataattcgtggaggcttgggaagattacagaagttctgaagaatgactattttgtcatcaggctagtgggttgcatccaaccaagagaattccacatatcttgcttgaggattccacatgatcgcaagcagttgactgttggaggcagggaccatcaagcctatgaagaggttgatcactatgctaagaggaaagcagccaatatctgtgcttccaccggtgctagagctgtcaagagaaaactagaagcaagcaggatcccacctaatggtttagtcagaagaacaggcaaggaacagaaagtatctacatatgaatttcgccagttaaccaagaacgagttgcctccgaaggtgtctgctaggaatgccatcgacggagatcattttcataggcctttaagtagcagatacaacgatctgcctgagaaacctctgcgcaccagagaagaggacgagtgctcggtggctagctgcagcgcgaattactcagagcacagtaccagtgatgatgaccatcaatcagtcggaaccggcagttgtttccctgatgatgttatgtctgcatgtgagtatgggcaggagactgaggacgcctatggctctggtttgtttcagaacgtccatgagctggagctgcgagcatatcgatcaaccgtcagagctctccatgctgcaggacctctgacgtgggagcaagagtcgctcctgacgaacctgcgcctctcgctcaacatctcgaacgaggagcacttgcttcagttgaggcatctcctagctctttgaaaattttcaaaaatcaatatgttttttgaacacctgtggattacctccaactcgcagagatctccgcaggcttgtagcgtgcgtaagcgtaacttgagggtgttgtatatagaggaagagtccagagaaattcacctgtagctgttgtacttcgccagaactttgttgctaggagtacatgagtcttgcatttttttagtgtttttacaatttcgaggaaatgtaaagcttcgaaatattagtcatgctgataatcaaggtgggatatcagttccttaaatgaagctggagtatcacttgccgttactgatttcactcattgtatcttttctttggtactccttcggtcctaaaatataatttttttagattaatcatatattcattaagttacatgtgtctattaattatcatttgaacgaatgtggaacgaaaaatgttaggttaaaaagaaatatactttaggacagagagagtatcgttctgcacgttgtggctggaatggttcaccattgacaggttctgcttcagacatatctttactagttttgcattggtgctgctggtgatgtttaaacctcatgctgtgaacgcacaagatttttctgtgcagtggatgaataccactttatagaaagaggtcgctgaaagagagtgtactcaagtctgat

SEQ ID NO: 13381 - DNA, 2159 bp, Zea mays
tttccgggaagaaacaggaaagcaagaaccggtaagaaacggccaatatacagaacgagccagcactccattttctcatacggttggcccgaaattaggcgcctcgattgcttgctagccgccagattagtctttcgctaccctaagatcggtcggaagaagagcagttcaatctcggttcatcagaagtcattgaactgaatgatccaatccgatttgctgactgctcctctcatcactcaaaatttgtgatggaacaggaccatcaagcctatgaagaggctgatcactacgctaagaggaaagcagccaatatttgtgcttccactggtgctagaactgtcaagagaaaactagaagcaagtaggattccacccaatgatttggttagaagaacaggcaaagaacagaaagtacccgcttatgaagttcgtcagttaaccaagaatgagttgcctctgaaggtgtctgctaggaatgccatcaatagcaatcacttccataggcctttaagtagcagatacaatgatcttaccaagaacatttctgagataaggccagtttgcagagctcttcctttgcctgagaaacctttgcgcatcagagaagaggacgagtgctcagtggctagttgcagcgcaaattactcagagtacagtaccagtgataacaaacaatcagtcggaaccggcagttgtttccctgacgatgttatgtattcatgccaacgcagacaggagaccaagaatgcctatggatctggtttgtttctgaatgtccatgagctggagctgcaagcataccaatcaaccgtcagagctttccatgctgcaggacccctgacatgggagcaagagtcactcctgacaaacctgcgcctctcgctcaacatctcgaatgaggagcacttgcttcagttgaggcatctcctatctctttgaaaattttcaaaaactaatgtgccttttttatatctgtggattaccccgaacccgtagagatctttgcatgcttgtagcgtatgtttcccaccttgactgttgtatataaagaagagttcagagaaatccacttatagctgttgtacttcaccagaactttgttgctaggagtaaatgtcttgcatttttttagtgtttttacaattcaaggaaatgtgaagctatcttcgaaatatatttgtcatgctgataatcaaggttgaaatatcagttcctttaaatgaagctgaagcatcaattctagttactgatctcgctcattgtatctctttcttcgctttggtatcgttctgtatgtttgtagctgaaatgtttcgccattaataggtcctgattaagatctatctttaatactcctagttttgcattggtgctgctgatgtttaaacctcatgctgtgaacacacagatttctgtgcagtggatgaataccactttatgagaaagaggtcgctgaaacagacagtgcactgaagtctgaaaaccaggtgcttgggtgcctttcttctctcccgtcaggccatcatattgaaggcatgtctgggttttatgattcattgatcatggtgacggataagaccgggtacgccatcaaataacctagggaccttaaaatgtgttcatgccctcttgaagttcaaattctgtttatatatattagatgtccccaagggaccctattcttcattttaactgaaaagttatgtaaattttttcttttaatcaaactgcaattgtgtttgtcaattgttcagccaacatctgttcttgtaacttggaacctgtatctctgcaggtcgacaccggtacaggaattcaaatgagacactgaaacttcaaagatgctggaaatttgtccgtatttgacttttgttccggaacttttgatgaggctgtattttgtactccatatagttactggtttactgtcgaacggcttaagaaagctaaacagatggaaagggaaactattgttttacggcgactagccaacttattgttttttctcgaacacgcaggagaactgcgcatcattatattgaaagagagaaatgtccgaaatgaaccaaagtacaatgccaaacagacaaaaagtaaaaaggaaaaacagtacagcctcatgcactagaaatagtcctgaccctagcaaaagcagcc

SEQ ID NO: 13382 - DNA, 1305 bp, Zea mays
tttgacgcaccttgttttttattggaaacagtgtaacaataaaatggccagcctgctggtagtagtttggggaagaaataaaattgacgcatacctatctctatatatccaggccaatgtcatgcgtgtgcacagatactttccttttgacacttgcgctgacacctacttactgacgacgaaaaggaacgcgacagataatctgaaaagtcacacgtaacattgagagggcaccaatacacgctataaatttcaactatgccggccgtaccaaccatgcatatatatgctatatattatgcctgtgtgattctaatcgctttcatccctttatgatgtatatatatcacttcctgtatatacatcagctagcgccctaggccctataaatacggcaatgcacggctcgagctcacacaaaacaaacaagagagagctagctagctagctcgctcgatctgcttaattaagcctctctaaatcatcttgattatattaacagtgtaacaatgcagggcctcacgccaacttacaagctcagctcgatcagtgtcgtcatcatgttgcttgtgctgaccggcggcggcggcgtcgcccatggccgcaagaagaagctcgtctcgagctacgacgagccgtgccagcagatgacggtctactaccacgacatcctgtacgacggcaccaacacggcgaacgcgacgtcggcggtcgcggcgcagccgacgctgctgagccggtcggtgtccgtcaacgacacctacttcggcgaggtggtagtgttcaacgacgcggtgacggcggggcgcgcgccgagggcttctacttctacgacaggaaggagtcgctgagcgcgtggttcgccttctcgctcgtgttcaactccacggcgcaccggggcacgctcaacctcatgggccccgacaccatcgccgcgaagacgagggacatctccgtcgtcggcggcaccggcgacttcttcatggcgcgcggcatcgccaccctccgcaccgacaccttccagggctcgtactacttcaggctgcagatggatatcaagctctacgagtgctacgtctgaagtcctcactctagctagctgcttcaagggtggcaaagagggacaagcatgcagtaccattttttttctttttatttggatttatgtgcatctgcctcgttgttgtgtacgtatatcagaagtgcatggcatttgcacaattaagtacgttcaataaaacagatgtcttttggttataggaggattgcctacacgctttgattcatggacacccaaatcaagtg

SEQ ID NO: 13383 - DNA, 3691 bp, Zea mays
  misc_feature (586)..(586): n is a, c, g, or t
  misc_feature (673)..(673): n is a, c, g, or t
aacaagacaacgggaccatttgtggtcattaacaaatgaatataacaggaggctgcaacgcactatacgaaaggttgcaacaaggtaaatgtgaacatgactgctggtaggactgtacataaaaatgactagcaccaacattcttttgaagtcaaacatggctcacgagatgttacaatcggcaaaaaaaaaagataatatgtattaattacaattatacagcttatggcagatgcagttgtcataatcccatgtgcaagcctcaatgatgtgaccacacaccatgacaggatcaaggatgacaggctaaagtattcagttcaggttgctttgaagttcacacagtttttgtcagttgtcttcagacattcacaagatgttggaaggtcaagttctctgtacagacctttaagttccaaccaagttagggtaggctagaagttccatgtacggtagttcaagaaatttggaaggaaacttggaactagcatcatcaaatttgcatgtcttgaggttgcatagttgatatgaacatccctggacatcaaaagggtcataatagtgagtttattgttcagaccgacanaacgataagtgatagaatttgaagaaaaatcactgcttcaaaaactttgcaattgtcgtaaatcatgatcataactaatctatgacngacaatataccatgccaatattctcttacagttcaacgaagcaagcaaaatgaaaaggtcagactgcataaccttccaataatacatgtatgggaacacagcccgtgagatggcactcaccttgaccatcaagcatttggctttctcccttcaaaaaactccgagacctggttctccaaatcatcagggttgtactttatataccttgcagaacccctccctccctctagttggccatgaaatcttccaacaaatgaacggtatgctggaagaaccttctcggagatggaaatcttcagctcttctcttaactgaggatcgacaaccttccatgatgtctgagtcctgtacagctcctcaaaggccaagttgaagtttttgaatctatccttcagtgcagccttgagtgcgcctgatgaacccattgtgtgtggaagcccatcgtctctcaggcaagctaacaccctagtccatgatgaccggagataccctgtagagtattgccttatctgaccacgatgtttgcgaatccagttatcaccaagcaatgtcttgagctctgaatccttcaccttctgcacaatgtacagcagattgttcataaaaaatatgttctgcagcgcttcatcctcatacagcctcgatttctcatcaatcttgcactgtaggtgtgtgatcagcatgaacacgcagtgccccaatggagtcgtgttcggattatcaaccccagtcagctcagtatcccaatattccagaagcctatttagcgaggcattgtaatccgcaagcagacacacatagttcatgacatagcgggtaagaggatggatctccccaccaggcagcggtctccgactccgagaagtctctccctgtatggcattagcaaactcctcaatcgtgccacgcgctgcatcaccgagccgtaccagtattccctcagcctcctccttgatgaaatcctttgcgtcaccggagaacaagccctcaagctctggcagcacctcagcaagcgcctcgtacataccaaggatgcgaaacagcttctctgtggacctcttcccgatcgcaatggcgtcagcgaagttgagcatctggaggacacagcccttggccgcctcagtgaagcactcctcctcggcgttagggtcggccgcaaggatctggctgcagatgcggcgctcctcagcaaggaggccccggacaacgaccttgaacgcctggatccacttcttcgtcttgccgtcaagcacgccccactccacctgctgcacctcctcgaggctcatcttgtcgatcccgagcacggcgaggcgttccatgagcgtgtcccggcgcacctccccgtagacctggcacagctcgggcgcgtagcccgcgcgcagcatgacgtcggcgatgtccctgagggcgctgacggtgtccggggccatgaggtagggcaaggtctcgtcgtcggaggcggagctcctgccgcactgctgctcgtctccccccacggcggccgggtggtgggcgaaggagtggcagtctaggtctacggcggaggagttgaaggagggcaccgtgagcgagagccgccggaggagcgaggcctggaggtcctctggggcgagcggcggcgccccgcgcacgagcaggtggcggaactcgtcctcgagccgcgtcatggcggcctgcagcgcggcctcggcgcgcgggcccggcgcgccaacgaggcaggcgaccgcggcgaggtactcctcggcgccctcccgcgagtcgaacaccagcgcttccccggcagcgggggacacccggcgctcgaccacctcggccgccccggcagcgggggacacccggcgctcgaccacctcggccgccacgtcccactccgcctcggcccgggcagcggcgtcgtcttcgtcgtagtcggcctcgtccccctccctctgggtcccctcgtccgcctccaggatggaaccaacggcggcggcggcagggggaggagtgaagaggtcggacatgagcgagaggcggttgtcgaagccggagaggatgcggatcatgtcgtcggcagcgttcttggagctggcgagcaacttgacgatgtgctgcgccgccgcaatcaccttctcctgcccgtccggtggtgccgccgccgccatcctcgactgccgcggtatcggcggcttcttcgaacggggatgggagaaaggccgagggaggggaggagagaagaggaatgagatggacggggaagcgaaatggagtcgactaatctgcccgctgcgctgagctggcggttttaaatgcgaccacgcctggtttgcttcctcgtcagatatcgttcgctcttgatcgtacggacgatattcgttacgcagggccgtgcggaaccagatcgtctgcagtactgcaggctgctgtgcgtacgtccatcgcaaatcgatccaacggttgtccgggcgttcagtcctactcatcaatttcttgtaaaagtgcatcgtcggacgccgcagtgcgccggtgggcctctgcattttgctggacttgtattgtacctatagcccatattgtggcccaacaatttcttctattattatttgtctcctgcattatccatgctaggtgtttgaatacactagaacaaatagttaattggctaaaaaatgttattgaaattagctagctgataaatatctacctaactattaactaaattaccaaaaatatctaatagttgaactattagataggatgtttgaatgtctcaactaattttagccactaactatcagttctagtgcctttaaacacctctaagacatgctgacgcaggcgtaatagaggaaaaaggatgcaggaaagcagcatatccaagggaatatttactccgacacaacaccgattgggcagcacaaagggcgaatttggagggcaaacaaacgattcatccagttcaaaggaagatgtgagaggatgtgaatggagagccctacacgtgagtaggcacggcaacgaggaattcccatcgga

SEQ ID NO: 13384 - DNA, 2678 bp, Zea mays
taggggccttttttttttttttttttggaaatgcaatttttcattagaggttgacaaggaaacgggaccaacagcatgtcgcatcaactatgcgctttgtctatcatcaacgaatgaatataacagaaggctgcaacacactataaaaaaggatgcaacaaggtaaatgtgaacataactcctggtaggattgtacataaaaattccagggaccgaaattccattttagtcaaacaagagtcacgagatgttaccattgacaaaagacaggtaaaatgtaagaattgcaattacacagctcatggcagatgcagttgtcataattccatgggcaagcctcaatgacgtcaccactcgctgtgacaggatcaagaatgacaagctaaaccattcaattcgggttgctttgcaattcacaaagtttctgtcagttcaggagaagattatatttccatcttcagaccttcaaaagatgtttgaaggtcaagttccctgtatagtgccaagaaatttggaaggggacttggaactagcatcatcaaaatttgcacgggtcttcaggctgcatagttgatatgaacatgccttgaccatcaagcatttgactttctcccttcaaaaaattctgagacatggttctccaaatcatcagggttgtactttatatatcttgcagaacccctccctccctctagttgtccccgaaatcttccaacaaatgaacggtatgctggaagaaccttctcggagattgagatcttcagctcttctcttaactgaggatccacaaccctccatgatgtctgtgtcctgtgcaactcctcgaaggccaagttaaagtttttgaatctatccttcaatgcggctttgagtgtgcttgatgaacccatcgtgtgcggaagcccatcatctctcaggcaagctaacaccctagtccatgatgatcgaagataccctgtagagtattgcctaatctgaccacgacgcttgcgaatccagttatcaccaagcaatgtcttgagctctgaatctttcaccttctgcacaatatacagcagattattcatcaaaaatatgttctgcaacgcttcatcctcatacagcctcgatttctcattgatcttgcactgtaggtgtgtgatcagcatgagcacgcagtgccccaatggagtcatgtttggattatcaaccccggcccgcgcggccgcccacccgtccgcccgcgcgtccggcgaggcattgtagtctgcaagcagccacacatagttcatgacatagcgggtaaggggatggatctccccaccaggcagtgctctccgagaagtatctccctgtatgtcattagcaaactcttcgatcgtgccacacactgcatccccaagccgcaagagtattccctcggcctcctccttgatgaaattctttgcatcacccgagaacaaaccctcaagctctggcagcacctcagcgagcgcctcatacataccaaggatgcggaacagcttctcggtggacctcttcccaatcgcaatggcgtcaccaaagttcagcatctgcaggacacaacccttggccgcctgagtgaagcactcctcctcagtgttcatgtccggcgaaaggatctgcctgcagatacggcgctcctcagcaaggaggccccggacgacgaccttgagcgcctggatccacttcctcatcttgccgtcaagcacgccccactccacccgctgcacctcctcgaggctcatcttgtcgaccccgagcacggcaaggcattccatgagcgtgtcccggcgcacctccccgtatacctggcacagctcgggcgcgtagccggcgcgcagcatgacgtcggcgatgtccctgaggacgctgacggtgtccggggcgatgaggtagggcgagatctcgtcgtcggaggcggaactcctgccgccctgctgctcgtttaccccctcggcggcgacggcggcgtggtgttgggcaaaggaggggcagtctaggtctacggcggaggagttgaaggagggtaccgtgagcgagagtcggcggaggagcgagacctggaggtcctccgcggcaagtggcggcgcgccgcggatgagcaggtggcggaactcgtcctcgagccgcgccatggcggtctgcagcgcggcctcggcgcgcgggcccggcgcgcccgtgaggcaggcggccgcggcgaggtactcctcgccctcccgcgagtcgaacaccagcgcgtcggcggtgggggactcccagcgctcaaccacctcggccgccgcgtcccactccgcctcggcgcgggccgccgcgtcgccttcggggtcgagatcgggctcgtccccttccccctgagaggtcccctcgtccgcctccagtatggaatcgacggcggtagggggaggagggaagaggtcggacatgagcgagaagcggttgtcgaagcgagagaggatgcggatcatgtcgtcggcggcgttcttggagttcgcgagcgacttgacgatgtgctgcgccgccgcgatcaccttctcctgcccgtccggcggcggcggcggcgccgccgccatcctcaactgccgctggattaggcggctgctgcgagcttcttcgaacgagggaagagaagccggcaaggccgggggagagaagaggtaatctggagcccggccggc

SEQ ID NO: 13385 - DNA, 778 bp, Zea mays
ggggtcatagtgtcgtccacaggcgccaccatctaccagctctactgggatttcgtcatggactggggcttcttagacctcagatctaagaaccgttggctccgagaccagctcatcctcaagaacaagccgatctactatgcttccatgatgctcaaccttgtgctgcgcctggcctgggccgagagcgtgatgaagctccgtctcggtatggtggagtctcgcctgctggatttctcactcgcttcactggaaatcatccggcgagggcactggaacttctacaggctggagaatgaacacttgaacaacgctggaaagttcagggcagtgaagaccgtcccgttaccattccgtgaacttgaaactgattgatcaagtcaaagataagaacttgccagcatgttcccaggaatttaaggaggggggcaagagttccaggaatggacacactgcccctgctagtgcttgcgcaaggattggtgttcaagtgggtaataaaacaaatcagagagcataactgcacaagagcaagacgctgcagatttttaaagatggaattagctcagacggtgccgtgtagttgaggcgccagggtcaggaaaaatgatgtgcgtttactctttattggttgattgaggattgttgcatgctaatcgactaacaaatccttgacttcgtcgattcattaacctatgaatgtatctgggaactgatgactgaaaaatattgcatgaaaatacatggtggtcaaacagaatttgaaccatgtttccat

SEQ ID NO: 13386 - DNA, 1245 bp, Zea mays
ttggtgtcatgctttgggcagcatcttggccaagaacgcgctatgccatgttgcaaatggaggccttttccctgtgaaaatttatgtgggaatcctctcctttgtggcaaccattattgtacaaaatcttgccatgtgttagaagtcccattgaatcatcctgaaggagatcgtacaacatctatcagtaaagtgaacgcacttgctatgccttgtgaacaatgcaatcttccttgtcaaagggttagggagcctccttgttcacatccttgccctttgccatgtcatctgaacgattgtccttcttgtaaagtccttgttaaaagaccatgccattgtggtgctatggtgcatgcttttgaatgtgtgttttataacatcttaaatgcaaaggatcagattaaaataagatcttgtggtggcccatgtcatagaaagctaccaaattgcccccatctgtgttcagaagtatgtcaccctggtgtatgcccatcggttgatcagtgcatgaaaaaggtcaacacccgttgtgcatgcagcactctgaaacaagagtggcgatgtcaagatgtcctcaaggaataccgtaagtctggccgggatccaaaagaagtacctaaaagtcagtttggagttggcttacttgcctgcggtgaagattgcaagaagaagctgaaggctccagattcagagttgcatctccggaaaagtcaggagaacaagatccctgctgtggaagtcgtaaatgcacccaaacgcaggaagcggcgtgaccgtggacaagaagttaaaatttcgaaattccaggaagtgaagacttttgtgctgagagcgctactgattattttgctgtcaataatcgttgctgctggtctgtacctgttgtggaaaggtattttctggctttctgactggatgaacgaaatggaagagcagagggcgagtcaaaggtatccgaggggtgcaatgttgtaaaaaaaagagataaaacaattactttgagcctaataatcggtattgacatgtggattaattaatggttgttagggattcagttttgcaggatcataaacatgtcaccgttttctcactttttgtcactataaactagaaattgtatgcgtaatgtattgttgtattttcattttgctactctgcattgttaagtgaacaaacgatacaattactacatgattcatcgcttatatctgtggggcgggcgtctgtacgaggacgccaacgggg

SEQ ID NO: 13387 - DNA, 2692 bp, Zea mays
gcacgagaccattacctagaacatcctaatcaaaaacggctccacgagcccaaccggctagcttcttcttcgtccgctgttacccacaccgcgggaagcctccatgcgatcccctgggcggcgcctacggctaccagcgccgtcgcggctcgtcgcggctgccctcctcctcgcagctctcaccgggggagccgtcggcgccgatgggtacgggcgggcgaggagggtgtacatgaagaacaaggtcctggagatgttttaccatgcctttgacaactacatgacttatgcattccctcatgatgaattgaagcctcttactaaaagtttcacggactcgcttagtgagcttggcaatttaaatgtattaaacttgaacacttgccacaggattatagtggatccgcgttgacactggttgagtcattatcaagagtttgagagaggagttctctggctttcagaaaatctgacatttgatgttgatgctcggattaatctttttgagtgtaacataagacttcttggggggcttatttctgctcatattcttgcaaaagactacagcagccagtttaagcatgggctgtatcaagatcaattactacgtcttgctgaaagtttaggcaatcgttttctaccggcatttgagacacctactggattgccatattcatggattaatctgaaggttcatataccaaactttggcttttctcagactttaaaatcttaaatttttgtatgcatgaatcaatcgtaagattccttaacaacatgaaatggtatggccacttgaatgccatcatttattgtgtgtacaaatctgtgtacattcaacaggtcaaactgagaaagggtcttctgcaaagagttaccacatttgtctgaaagcagactacaacaaacattgagtttcttctccaataatttttgaaaaaggacgtgtatagttattaagacaagcatgctcatcagtacaattttaacatctatcaatgtttaccttaggaaaactgggatattacttgctatcagctaaaatgataagaatgacaaattataagcatgctatggtagaatgcagaaccacagaatgattacattgtttggaaaactcaaagttcacatatattagaactctggtactcattacttttgcaattggcatagctgttgaccttatgtttgtcaaaatatttctaccgatgatacaacaatctttttcagtatggggtgatggaaaatgaaacaactgaaacaagcacatcagggtgcggttcccttatacttgaaatgggtgtgttgtcacgtttgactggtgattctagatatgaagctgcagctcttcgtgctctccgcaagttatggagcatgagaagttcactgaatctagtaggcaccacacttgatgtttttactggcaagtggattgagtattcatccggaattggtgctggtgttgattcattttatgagtatctgattaaagcatatattcttttcggaagcgatgagtactgggatatgtttcattcagcttatcttgcggtgcagaagtacttccgacatggtccatggtatcatgaggctgatatgaggactggagaagcaacgcactggcagctaactagccttcaggctttctggccaggtcttcagacacttcttggagacgtaactgctgcaaatctatcacaccgtgagttttacaatatatggcaaagatttggtgtgctacctgaaagatatcttttggactatgtaatgttgcatcctacagagaagtactatcccttgcgtcctgagtttgctgagtcaacattttatctttatcaagctactaaaaatccttggtacctagaagtgggtgaaaccattgttaggtcacttaattactatactaaagtggatggaggttttgctagcatcagagatgtttcaacaatgaaacttgaagatcaccagcacagtttctttctttcagaaacgtgcaaatatctttttcttctgtatgatgattcattcttgaggaatcaaaattacatatttacaacagagggtcatccccttccaataagaagcacgtggcatgagaaatttcctgcagcatatgttcccagcaattggacatctgttaaggatgagatccaaccaattcgcgcgagcgcattatcgtctcaagtttgtcccgagacgattttccgaagaagtgttggtaccccatgggagagtgcgtgccatgttccagatgcgcacgctagccacagatgcaggactgacgaggactgtggaatagaagcaataacatgcaagaagaggacctgcagtatggctggctactgcggcttatggctggtgatttattagcatctcaagagcgggaggttatattgttgacattacgggaggattgaaatagcctcggcctataactgtacaatagattagtgggatcgcttgataggttgtcgcatctgtcattctaatttgcctttctgaattcgttttgtacatgcctgcattctggtgcggattttgagcattccagagtgtacgtaaaggaaataaatttaggctccaaaaaaaaaaaaaaaattgaatttcattctaataatcctaatttaggatagattgattaagctaatatgatttttagtggaatatatttgcatattattgttggccatat

SEQ ID NO: 13388 - DNA, 875 bp, Zea mays
  misc_feature (2)..(2): n is a, c, g, or t
cnctgttcaggctctttgtggtcgccaaactcatgccattctccgcgtctgttaatccgtggcttggtgcagcggttgcaggcccagagctcggtggtttctttgttgcctgggctgtttttgatgcagttgtatcggttttgttcactgtggtgccttgggtggttgtcatggaccgtgatccacggccgcctgggcgcaatgctgtgaaggaagggtgctatcttgtatctctgatggcaactgatgccacaatgctcaagtgctgggaaacagttgtttgtggcagcatggggcggctcatcatggtgacatttggtggaaaggtttttggtggatttctgcattcaattgcgcaggtctacttcatggtggtatggctgctgttctactttgcagcaaggtgtaaggaggtgaggctgggtggtcgtcaatttggactggaggatgttgcagctgctcttgatggatttaggtagtgtctagttgccgcttgccgcctggatcatacatgaagagaggtatatttcatggcccatagtgcttattgatgaaacgctgctggtcttggctaagtagaggtttttgtagttatcttgatcttctaaatcttgctgagatggtaaatgatttggatgagagagagaacttgacaatgttgtatgtacagtttttgccacagagtggtaatctgcttatagtccaccacatggcatacaaagaaaggatgtttggtccccttttccatggaaggttagaagcaagatacttggtgaaaaaaaaaataaaaaaaaaaaaaaaagtgaagtttatatacttgtgttgtgccagcaaaatttctctgggtaataggtcaaaacatgtgacgtgcatcc

SEQ ID NO: 13389 - DNA, 433 bp, Zea mays
cccgtagatgagccccgggattatgagcagcaggacgagagggaacgaaaccagggccagcctccagcaaaagtaggtggcctcggctctcgcatcgacgaagaccgtagagtgcatcaggaacagagggacctgttccagatttcatgccaatcatgctgttatttctcctcgaacgatgatccaacactgaattacattcaggtcttgtttggctacatatagtattcaacgtatcgctcttctgtttttacacattcgtttttctggatgctgggtaatcttattgtagtctgtttaatttttcaagccaggaaagagtgggtgtacgtctagatagatcattcaagtcatgttgttcggttattttaattccatgtgtattggaatgtactgaaatggattggaataaattttaacttgctatgggttt

SEQ ID NO: 13390 - DNA, 5327 bp, Zea mays
  misc_feature (5178)..(5178): n is a, c, g, or t
gtttcgggtacccattgccatccctagtgccaacgctgtttttattaaaaaaaatgatcactcgtcttattcaaaaagtaatgagttattatcttcttgtgatttattttatcacttcaaatagtttgtgtctgacttaaaatttttatattttgaataaatattttgaaaagagaattgatcaaagttttcgaaaaaaaatcaatagggtcatattcatcaacgggtgtagtatagcagcggcctgactgactgatgagtgagtggctcacatcacatggcagcagctatcagcttcgtctccgatgtcacgcagaaattttatacaagggaaaatatcccaggccatgtgttgctgttgcattccatctccatagacaagtaatcccaatcccgtcctacctggatggttcctgcctgtctgtcgcctcgtgacgtctgtccaagaacactcgctccccacctgttcgctgcttcttcttcttgccaatctgctccttcttctagctagatcttggatggagctggggatgacgatggaggtagcgaagatcatcgaggtatgtagagtacgcggctgctagttagttcaccaggccagcaagcgagctccagcttcgtccgatcgatagatgcgagctgtagcagcgtggcagccattcatcagttgtcagatcttagattccccccatccccgctactagttggtggttagcaaatcccaccaagcaggaagcagccgcgagcgagccatggccatggatcccgttctgaaggtggccctgggctcggcggcgttcgccgtgttctgggtgctggcggtgttcccggcggtgccgttcctgcccatcgggcgcacggcgggctccctgctgggcgccatgctgatggtgctgctgggcgtgatgagcgccgacgacgcctacgccgccgtggacctgcccatcctgggcctgctgttcggcaccatggtggtgagcgtgtacctggagcgcgccgacatgttccggcacctggggcgcctgctgtcgtggcggagccagggcgggcgggacctgctggtgcgcacctgcgccgtgtccgcgctcgcctccgcgctcttcaccaacgacacctgctgcgtcgtgctcaccgagttcatcctcaagatcgcgcgccagaacaacctgcccccgcgccccttcctgctggcgctggcgtccagcgccaacatcggctccgccgccacgcccatcggcaaccctcagaacctggtcatcgccgtgcagagcggcatctccttcggcggcttcgtcttcggcatcctcccggccacgctcgtcggctccgtagtcaacgccgccatcctgctcgccctctactggaaccagctggacggcggatgcaagcccgccgccggagcccaggaggtggtcgccgtgcccaccgaggtcgtcgaggaggaggacgtcacgtcgcaccgcttctcgcccgccaccatgtcgcacctcctcctccgacgcgcccagtcccagcaggtgccggccggctacgacgacgcggcgaatcaagaccccgtcaagccgcccaacggcgtccaccacagaaggaaagcagcggtgaacggcgattgcgacggcgacggcgaccgctactactcctccttctcctccacgtcgtcgtcgacggaggaggccagcgccaaacaaccagaagatgacgaagaagaagtagaagaggagtggcagagcagggtgtggaagatgtgcgtgtacgtcatcaccctgggcatgctggtggcgctgctgctgggcctcaacatgtcgtggagcgccatcaccgccgccctggcgctcatcgtgctggacttcaaggacgcccgcccctgcctggagaaggtgtcgtacccgctgctgctcttcttctgcggcatgttcatcaccgtggacggcttcaacaagacgggcatccccagcgcgttctgggacttcatggagccgtacgcgcggatcgacacgcccacggggacggccgtgctcgcgctcgtcatcctcctgctctccaacgtcgcgtccaacgtgccgacggtcctgctgctgggcgcgcgcgtggcggcgtcggcggcattattaatccatcgagatttccgcaaccgctgcacgcagtcctgctgctgggcgcgcgcgtggcggcgtcggcggcggccatctcccccgaccaacgcctggctcatcctggcatggacgagcacggtggccggcaacctctcgctgctgggctccgccgccaacctgatcgtgtgcgagcaagcgcgccgctcccagcagtacggctacacgctctccttcttcagccacctccagttcggcttcccggcgacgctcgtcgtcaccggcatcggcctgctgctcatcagaacctactgatgcgtaccggaagggatgtctggagggggaagaagaatgtggattctttctcagcgccgtgtatcgcgtcacaggtcgttttgtttttgttgttgaatttgtgcaaggattcgttcgattggggggatatcatatcatggtcgctgcctcctgtcctgtaaaatggtggagaagcgtagcaccagagatagatagatagatcagcatggtgctcgcttgctcggagctggaggcgttttgggatgcacgtacatacatacatacattcattctctgcttttagtaagaaatctgtgcattatggagtagcacaccatgtatgtatatatcagacataagaaacaaaacaacaaaaaaaggaggtgtatatcatcgtatttctacgtgtaataagccagtgtattcagatcgaataatgttaggaatcgggttaatcagagccagaaccgatggggttcttattcttcctcttacttgcataatgatggcccctgtgtcagacatggtcgaatggtccagctgctgtttgtttaggtcagttttagtagttctatcaggtgtatctatttaataaactgttgtataagttttttttctctctcgcgttatagcaacactttttatgagttcataataataaaactctcttgccactattatcaactctcttcatctcttacgatatgagggattgagtcatgcatttaggggtggtaatagattgtcattctaaatgtttcttcacaataaattagatctcttaataaattttagttcacaaataaatagaaatagagtccgatccttatctgatttgattcttaaattatattcgtaaaatttagagcttattatcatctctatgcacatttggcatttgatagttgattggggttagtcatctagtaggatgcagggctagcggggttccaacttttttttttgtaatgctgctacacgatatgactctagtggtagtggtagacttaggtatgactagagttatctgatcctcatgattcattaattcagaataagagacgacaacaaccgtaaattaagtttagtcgtacgagtaggtcttatgtgaagcacttccgtgtgattacaggttttttagacccatgtttctttacagacgtagccaattctatatttttcttaagtgaatagcaaagatctcaacgctctttgaaaaatttatctagaacgggaaaccaatgctcactttttttaaaaaaacttagtccagtttattttgtttttactttgacatgatgacgcatcagaaaaaacactgataaaatttctaaaattaaaaacacaaatgtttttaaaaactacaagggaagcatattagacaaccacaaacaatggggggtgggggggtgaaaaattcgatgtacctctagattttttgaacttagtatggtttatctcctctgccgtggcactacatcagcaaagttatcataaaaactatttaggtataaattgaacatttttaaaagtggtgataagtttaaaagtattttcgtagatcagagagaaaaatcggtgaggaaggtaaattagatattttttaattttcttttaagggccatgtctaatagaacagaactgggcctcgtgccgctcactaagcttagcccgttcggcctactttcagcacgtcctggttcaggcccatgaaactggccatgcacggaccagcgtgcgcgtgcgtgtgtgcgctgcattctctccctccccacttctctctcgtggcgacagcgacgagccgacgactgtgcggccgtcgctgccactctactcgccagttgcccggatcttcttcgtccccttggaaatcgacggccacaaccaggtaccctttggtcttctctacctgctgtgcggaactgagcactcaaagccgaacctactatttgtattcggatctgatctgattgcaactgtatatgcatgtattatgcttactaacttcgattgttttgcaaaactccgcccctgccttcacttcgtgttataatagtataagccgtttggtgccacgtgtgtatttaactatttattatgtttttgctcggtctgattgtgccagggcaaacaggaagtttcgcaaggatgccctggtgcacgattgatgagtctgaccctggtgagttttggcatcatctgtactgttccttccttacattttccaaatcatgggaagtctatctctcttcaattcttacgtatccttttccttgtgattcccattccaagtcatgggaggtgtatgtgtgagttccggtagacagtttgcagccaccgaaaataacgaagacaccatgcaaagtcaacctgattcaggctacttggacaaaccacacatacgaaagggaggaacccataacaagttcaagctaattcaccctctatagacagactaataagactccagcgagcttgaagcttaaagcgacagataactttcaaaaggtactgatccagcaaggcaaaatcagctgtccatcctcgcatcatcttcagggccccacgcttgctgcacgaaccagaagcctgaccccctcctgaagaacctcatgcagatctctcttgctgagacctgaccaagatgaaataagtgcaccggcatgacatatgatctcattaggggatttaatcagaattttgtcaaaacacattttgtttcctgctttccagatagcccagcagatggccgaaactagcacaacatgagtagcattatcgatttttaaatttncccgaagccactcaaaggagtattcaatgtcccctgaaatgtattttgtactaaggcatgtggccactacaccccaaataactttggcgattggacaagtgaaaaaaggtgattagtattttcatcctgaggacagaagctgcagcaaa

SEQ ID NO: 13391 - DNA, 1286 bp, Zea mays
  misc_feature (70)..(70): n is a, c, g, or t
ctcgaggccggctacgacgacgcggcgaatcaagaccccgtcaagccgcccaacggcgtcctcccacagnaaggaaagcagcggcgaacggcgattgcgacggcgacggcgaccgctactactcctccttctcctccacgtcgtcgtcgacggaggaggccagcgccaaacaaccagaagatgacgaagaagaagtagaagaggagtggcagagcagggtgtggaagatgtgcgtgtacgtcatcaccctgggcatgctggtggcgctgctgctgggcctgaacatgtcgtggagcgccatcaccgccgccctggcgctcatcgtgctggacttcaaggacgcccgcccctgcctggagaaggtgtcgtacccgctgctgctcttcttctgcggcatgttcatcaccgtggacggcttcaacaagacgggcatccccagcgcgttctgggacttcatggagccgtacgcgcggatcgacacgcccacggggacggccgtgctcgcgctcgtcatcctcctgctctccaacgtcgcgtccaacgtgccgacggtcctgctgctgggcgcgcgcgtggcggcgtcggcggcggccatctcccccgcggcggagaccaacgcctggctcatcctggcatggacgagcacggtggccggcaacctctcgctgctgggctccgccgccaacctgatcgtgtgcgagcaagcgcgccgctcccagcagtacggctacacgctctccttcttcagccacctccagttcggcttcccggcgacgctcgtcgtcaccggcatcggcctgctgctcatcagaacctactgatgcgtaccggaagggatgtctggagggggaagaagaatgtggattctttctcagcgccgtgtatcgcgtcacaggtcgttttgtttttgttgttgaatttgtgcaaggattcgttcgattggggggatatcatatcatggtcgctgcctcctgtcctgtaaaatggtggagaagcgtagcaccagagatagatagatagatcagcatggtgctcgcttgctcggagctggaggcgttttgggatgcacgtacatacatacatacattcattctctgcttttagtaagaaatctgtgcattatggagtagcacaccatgtatgtatatatcagacataagaaacaaaacaacaaaaaaaggaggtgtatatcatcgtatttctacgtgtaataagccagtgtattcagatcgaataatgttaggaatcggggtaatcgagccagaaccgagggggttcctattctt

SEQ ID NO: 13392 - DNA, 2298 bp, Zea mays
ctggcaattgttgctgtatcatttgaggtgatcaggaccctgaagcttggtatacgaggtttaaacagcctggctgttctgttattgacagcattgatataggatgttccgtagcatattattaaaggctacaccggctaaaccaagttacattgtgctgcagattttctcttggatggaatcatgcagctcccttcgactgtcgtcatgggatcatgcagcaagactggacttgattgctaaagcttacagtacttctcaagccgaggaatactacaacaaactacagagccctgctaccagacaagcagcatcgttccctctcctccattgctatgttatggaaagagatgtacagaaggctgaaaccttcatggcgctccggcagtcccgcggcgtccccgcggctcctcactctttcaatgaaatcatgaagctctatgttgcaacctgtcagtatgagaaggtccttagtgtaattgacctcatgaaacggaacaacattcacagaaatgttctctcctacaacctttggatgaatgcttgtgctgaagtctctggtgttgactcggtacaatcagtgttccaggtgatgttgaatgatgagacggtcaaggttggttggagcacatactgcacattagccaacattttcaggaagaatggactgaacaatgaagcgcaagcgtgccttgtgaaagctgaagcaaaattgtcacctgcagggcgcttaggatactcttttgtaatgacatgttatgcggctctgaatgacagcgatggagttatgagaatgtgggaggctagcaaaagtgtgccaggtagaattcccactgcatactacatggctgctatgtcatgttcaataaaagttggcgacatcagccaggccgagtgtatctttggaaagtgggaagcagggtgcaggaagcatgatgtgagggtttcaaatgttcttcttggtgcttatgtgaggaataggtggattgaaaaggctgagaggctccacctccacatgctagagaaaggagcgtgtccaaattacaagacatgggagatattgatggagggctatgttcaaagcaggcaaatggacaaagctgtgggttgcatgaagaaaggtttgtctctgttgaagagttgccattggagacctccagttgaactgatggaggccattggcaaacatttcgaggagcaaggaagtgctgacgatgcatatcgatatattaaggttctccagagattcaacttgacaagcttgcccctgtacaagtcattgattcgagcatatatcaatgctgacgttgtgccaccgaatgtccttgagatgattgcaaaagatcagattgatatggatgaagaaatggaccggttgatcatactcgctggcaagatagacatcacatgcaatggatagtcttcaactggaacaggtaatcaccagtcaaatgataaatatactcatttgactttgtcaattagagatgcaaagtgaagcaacaagttgaacctgcaaattactagatgcaaaaaaggcactcctggataccttgtttggtgttcatgcagtcctgctaatatgaacaactccatcttcttgtgaatcttaagtatatttggaaaatgtggaaaacacgaaaacctgaaccagcacaagaatgcttacaacttctcaaggatcacctgaacctttggactatcagaacttcatcgaacctgaatcaacattccccggtcatcacctgtaattagtggcgtaaccattcttatgatgcaagcacatagcttgcttatttgttccttaaatcatcactattcacgaaaagctggtttgcagccactaacatctcttatgaattgttcttggagaattaatcactgatcagcccctcagccccaaaatacttgcttcggcagtggttttgaacacagtgaattgccaattttggtttcattctcagaaatacttttgcatacaaattttagagtagtgtgtaactagcaaatagatgccagagaacacaaccttttgttttgtttttaagtaaggccccgtttggttttttagaattagaaaccattctaataatagtaatttagacacaaattaagctaatataattgcatgtggattctgttgtttcagcagattctgttgtttcagcaggcttctcatccttgggaggagcagatggtgccggcttcgctgctgtctgtgctgcaacttcagcaacaaaatcctggctttccttctccagcccttcacctaggttgtatcgggcaaatctcctgacc

SEQ ID NO: 13393 - DNA, 5174 bp, Zea mays
ctttttccgagttgctttgacttgaacttttacagagatcctataacttagacaaatatatctagtagctttccaactaatctaaatcattgatcttggacattttatttctctaactcatattcattcttctcacttagaaactaaattgttgaacttatgaatctgtgaatcaacgataaagcaaactagttatccgaatggttgtgatgaccatcaagcaacaaaaatcaatataagaaatggtttaagaccaatccagcatgtgatattgatctcatgagtatgatagtctctcaacaaaggctaaaaaattatagaaaactcaacatacagcttatgtataaagcttatatcacaaaagccatactttggtaggaatttatcaccatcgaggaacaccaagattttcattattttcaaagataaaaatctgatgatcatactgccgtcaagaactctgttgaatcgcagaaagtttgtcgcaagaatcgaagtctgaaagtaaccagagataaagaaagaagtcactaatcataatatgatggcataattagcaggtgagctgtggcgtgcgctgttctgattttgatgaccatccgggacccatccctcatggaccagtactaatccaactccccacttcctagcccgtgggccccgtctcccagcattgcaccaccctccagtgtccgcggcccggccgtctcgactccatcgtccaggcccccaccgtccgtctctccctccctcccccgtccgccttcgcctcgcctcaccgcgccgctcccaaaattccccgccccacggcttccccccgcaaaacccaccccacgaaacccaaaaaatcccgcgcggacacccgaatccccccgccttcccgctcccctcgcgctgcgccgatccgttcccccatggatccgcagtcggacgcgggcgcggcggtggtgctgggcgccgacccggcggcgctgacggcgctgctggcggacctcacctccccggccaacgaggcgcggtcgcgggcagagcagcagttccacgccttccgcaggtcccatccggacgcgctcgcgctgagcctcgcgcacctgctgctctccccggcgcacccctccgcgcccatcgccgccgtgctgctgcgtcgcctcatcgcgccgtcatcccagtccttcgtctaccctgcgctgtcgcccgccacgcagtcctcgctccgcgcgctgctgctctcggccgcttccgcgcctgcgctccccaggtctgtctctaggaagctctctgacgccgtcgccgagctcgcgtccttcctcctgcccgccaacgcgtggcccgacctactcagtttcctgtacaagtccatagattccacgtcctccccgccgggattgcaggagtcggcgctcaacatcctggcccggctggcctcccacctcgcggccagcttccccaacctccacgggctcctccacgccgctctctcccacccttcttccgccgatgtgcgcgtcgcggggctcaatgcggccatcagcctcatccagtcccttccttctgccgcggcccgcgaccaatttcaggacctcctcccggccatgatgcgcgctctcgccgagtcactcaactgcgggaacgagggctcagcccaggaggctctggagatgatgatcgagctcgctggcgcagagccgcggttcctgcgccgccagctgcctgacgtggtcgcgtccatgctgcagattgccgaggccccaggactagaggatggcacccgccaccttgccgttgagtttgtcgtcacccttgccgaggcacgggagcgtgcacccggaatctggcggcggctgccgccccacgttggtcggctatttgcggtgctcatgagtatgctgctcgatgtccaggatgaaccggcatggcatgccgcagtgtcagaggaggaagacgccggagagacgggaagctatgtttttgcacaggagtgtctggaccggctgtcaattgctgttggtggtaatacgattctgtccgtggcagctgagttgctcccatcgtttttctcctctgaagattggaagagacgccacgcggcactagtgaccatagctcagattgcagagggctctgctaagatgatgattaagaatctggagcaggttgttgggatggtgctgaattctttccaggaccctcacccacgggtgaggtgggcagcaattaatgcaatagggcagctttcaacggacctggggccagagttgcaaaatcagttgcaccatgttgtgctaccttcattagcttcagcaatggatgatgtccagaacccacgtgtacaggcacatgctgcatcagctattctgaacttcagtgaaaactgcagacctgatattttgacaccatacttggatgtaatagttgggaaacttctattgttactccaggactgggaaccaaatggtgcaagaagctgctttaactgctttagcatcagcagcagattcttctcaggaacacttccaaaaatattatgatgcagtaatgccatacctcaaggctattctcatgaatgcaactgataaatccaacagaatgttgcgtgccaaatccatggaatgcatcagtttagttggtatggcagttgggaaacaaaagtttaaggatgatgctaagcaggtgatggaggtccttatgacactgcaaggatctcagatggaggctgatgaccctataacaagctacatgctgcaagcatgggcaagactgtgtaaatgccttggtcaggatttcttaccatacatgagtgttgttatgccccctctgctccagtctgctcagctcaaaccagatgtgagtgtcacttctgctggaccagaagatgaaaatggtgaatctgatgacgagggtgtcgagactattacactaggtgataagaggatcggcatccgaactagtctactagaggagaaagctacagcatgtaacatgctgtgttgctacgctgatgagctcaaggaaggatttttcccatggattgatcaggtcacgactacgcttgtacctctcattaagttctattttcatgaggaagttaggaaggcagctatttcagcaatgcctgagcttctacgttcagcaaaattggctatagaaaagggccaagctcaaggtcgtgataaatcctatcttaagcaactgtctgattacatagttccagcccttgttgaggccatgcataaagaacctgagccacaaatttgtgcaagcatactggaatcattgaatgaatctatacagctatcaggaacacttcttgatcaaaatcaagtaagatctgcagtggaaggtgtcaaagaagttatagttgcaagcactaacaggaggatagaacgaacagaaagggcaagggctgaggactttgattctgaagaagaggagctactcagagaagaaaacgaacaggaagatgaaatctttgaccaaattggtgattgtctaggcactctcgttaaaaccttcaagacttcttttattccgttcttcgatgaactctccatgtatttgacacctatgttgggtaagaataaatcaccagaagaaagaaggattgccatatgcatttttgatgatgttgctgagcattgccgtgaagcagcagttaggtattatgatacataccttccttctctattagaagcctgcatgagtgaaaatccagatgtcaggcaggctgcagtgtatggaattggcatttgtgccgaatgtggtggttctgcatttaggcctcacactggggaggccctatccagattatacaatgtaatcaaacatcctaatgccctggatttggataatgcaatggcctatgacaatgctgtttctgctcttggaaaaatatgccgatttcatcgtgatatcattgatgtatctcaggtaattcctgcctggttaagttgccttccgataaaaaatgatttaattgaggccaagcttgtccatgaacagctgtgtgtgatgcttgagcagtctgagagggagcttttgggtcataataatcagtatcttccaaagattgtgtctgtttttgcagagatattatgtgcgggcaaagatctagcaacagaacagactgccagcaggatggttaatctactaaggcaacttcaggcaacattgcctccttcagtattagcctcgacatggtcttctctacaaccacagcaacagctcgctctacagtccgtgttgtcgtcatagctaacctaaaatagcctcaactgtgtaaagcatatgagtcttcacagcttgacctttcgtgttctatttatgcgcttttgagccagagccagggttcctggggtttgctttcgcgttcatgtgcccttaggttttgtacaaggggcactgcttgcatccggtgtgtaatatcggctgcagttgcagaactgcacggatgtgtacgagactgggctctctccacatcgtcgattaagttgtaaagcagtatatcttgctcgcttagtaattttagttgggttgaaagaattgtaaattaaaacaattttggtagttgattttaatgtcgtatttcttataccatcagcatgggaaattttgtgttcaaaaaaagaagagaaaaagcagcttggttatcttggggcgtgtgccttttctcgatgtgtacttattcttcgtatgtatggggatagtaacgcatttgcctagtgatatttaactttatagattaactgtctgaagaagaggaaagggaagtgtataagtgtaaaacggcaggttccagaaaattggctagtcatggcttttcaagtgaatgcaagagtagatgaattcactttgttctaaattatgttcattttaaatgaaatttatagaaagtgcgccagtgtatataaaatcatatcagttttattagttttttttttcatgtaatatgttttgacaggtcatttatcttaatttgtaaaaagttgagtttattttccccgaagtgaaccgcgacttgaaaaggaaattacttttgaagtatattttggcctttatttttataacatattatcaatagtttcgcaagtatattatgtatataggtctaatttagaactttgccgattcctggaaggggtagaaggtcgatgcaaaggttcgaactagcaatgcta

SEQ ID NO: 13394 - DNA, 3028 bp, Zea mays
attaatatggatttaggttctcaggaaatgtggggggcattatggctctagtgtgagaccacaggatgctcagagtccgctagttcgctgtttctccagggaattgatgacctgcctaatcttgcagcctgttatgaacttcgcaagccctgtgtaagttgtctgccaaagcggctgatttatggcaatataggcttcaagcattctatgggctgattaactgtattttaagttatctaatattccaattttactttctgcccttacctgcacctaagctttgttccaaatctttattttttgtttatttgtttttgtttcagctacatcaatgagttggttgtctaccttctaaatgccaaagatacaggtagcgctggaggtacaaacatggctaatacaggaacagtaacactagtgccttacaaaggaggctcacaaggttgtcaaatggaatcaaggaatttgactgtagaaactagcggtttagttccaccaaataattctgggatgagatcacttgttacttctgaatgtggaaagtcaaaagtgtcagaggatgacaatgatggtaccatccaacctcgtcagccagactgggcggcggtattggatgcagctactaaaagaaggtcagaggttcttgcccctgagaatcttgagaacatgtgggcaattggaagaaattatcaaaagaaaatggttaaattagaccactcatcaagacagaaaggctctgaaggttcagataatagtacaagtgcaggggcagttggtaaagagctatcctctaacttcaacgagagaattgcatctgttgatgataaatacatggtcaatttgatgcaaagtaaaaataggaatgctcaatctaccttcgtcacaggtagtcatccacttgctctacaaaatatgaatgaagtgaaaccaaaagaggggagtcaagttaatttcaccagcaaggaaaaaccacatgaaaccagcaacagagtaaaagcccaactaaaacggtgtaatagtactcctgatattgagaaaagatatttggcaaaaaccccccccccccccgtttccagtgaaaggctaaatgtgaggataaatcaggatgagagaggtgttggtcctgcctcacatgttgaggtgctaatgcatgttccgaagataagatgtcgggttgttggtgcatattttgagaaacaaggttcaaaatcttttgcagtttattctattgtggtgactgatgcggataacaagagctggtttgtgaaaagaagataccggaattttgaacgtcttcatcgacaactgaaggagatacctaattattcattacatctgcctccaaagagttttctttcatctagcgttgatgattatcttgtgcaccaacggtgcattctcctggacaaatatcttcaagatctcttgtctatagctaatattgcagagcagcatgaagttttggattttctgagtgcatcctcaaagacttactctgctggaaagtcctcctctgttatgaaaaccttggctgttaatgttgatgatgcaatggatgacattgttcgacaatttaaaggagtttcagatggtttgaaacgggcggttggcacatcaccttctagtgcaactgcccaatttgcagataataggatgtctctatcttggaaccaggaagagaaagataaccacaacttgcatcaaagaaacttggaaagggctcatagcctttcagatggtgatagtaactatgaagatcacatctcttctgtgaatagtggatgccattcagacaatgaggtcaataatagaggacatacttcaaatgatgttgagcacatcgaaacatgctctagtttggataaacaagccagcgaccaaataggaaaacctgcaaaggaatattctgattcttcaaacatgtcatctctaaatgcattcgaggatccaacaggaattcctcctgagtggatgccaacaaatgttagtgtgcctttattgaacctggttgacaaagtattccagctaaagcgacggggttggatacggagacaggttctttggatatcaaaacaaattttgcagttggtcatggaagatgcaattgatgaatggatcataagacaaatcaattggctccgaagagaagatgtcattgtacaaggaatacattggattcaagataccctttggccaaatggtatattcttcaccaagttggatgaatataaagggaatgcaggcacaagtgaatttgacaagcagtcattagggagtcccacactggctgttggcaataaaaagggccgcacaagctcttttgaacttcatcttgaggcatccagaaatgccagtgaggtcaaaaaacttattttagatggaactccatcggccttggtcagcataattggatacaagcagtaccggcgcagcgcaagggacatgtactacttcctccaatccaacgtctgcatcaaacagctcgcatatgcaatgctagagcaggtcctcgtgacagtcttcccagagcttcgccagctaatagaagacatacatgagaaaggccgcaaagagcaagcctcattcacataccaactctgacccaagagaaaacatgctaattcagagaggagtcgcaacaattttgaacgcacttgcattgctccacggtgagttactgaaacacaaagcctttgcaattatattttgatggtgcataagttggattgaggaagtgcttggtgcttaagaatgatctgtacagatgtatatcagaggttatgtaaattatccccctgatgtagtcaaccagatctacttacagtgagatcttgtaggtgttgaatgtaatgtatcattctttaattcccccccaagaattaagttattcacccaaacaaataaggtattctccccctgtcttatgctgaggcttgtaaagttttgaaagttccaagtgtatagctgtactgtttgtgttgctgagtaaatcaaaatgttgcgcgagaaaaaaaaaaaaaaaaaaaaa

SEQ ID NO: 13395 - DNA, 1912 bp, Zea mays
aaataaagccttattagaggagattcataggaaaataaatacattggattcaaatttcaatagaaaaaaaaccactccattttttcatttgtcacgtttcaacttaaaaataaagtaacgaacgataaatattaaaaacggatgcaacattacttctctgaccactcactcatcaaacccgcccttacagtcttatccatcgcggcctcgccgtccagcagctagctacgacctagctctgggcctctggccctgtgcctcgcccgagctgcagctccactccggtgcaccatggccgtcctgacgaaggtgcttctccgtctcttcttcaccactggcggcctcatcgtcttcctgttgtgtcccgcgtcctgccttgctcgtcctcctcattccagcagcaactccaactactactgcgactggtgccctcgccgttccaccgcctcccccgacctcgacgcgtcgttgctgcgttcttgtggaactagtagagacggcgacgacggtggcttcggctgcgggtacggggctgcggagcagctggacggaggtggagctccccacgtcgctgccgcgggcgccgactccttcagcgctggcgctggctgcggcgcctgctaccagttgaggtgcagagaccggagggtgtgcggcgacggcggcgtcaaggtcgtcgtggtagccggcttggccaaccggacggggttcgtgctcaccagggaggccttcgctgcgatgatggccaggccgcgcgtgtcgtccaatgaccaactgctgcccggcttgggtggcaatgttgttgaggtcgacttcaggaggataccttgcgagtacaagaacagaaacctgtcggtacgcatcgacgaggaagggagccggcacccggcgcacctggccatcaccttcctgtaccagggcgggcagacggacatcgcggccgtcgagctctcgcacgcgcacgcgcagccgccgtcgtggcggcccatggcgcccgtgggcaggcgcggcatcgtgacgtggcgcacctcaagcgcgccggcggggccgctgcagctccgcctcgtcgtcacggccggcgtcggcggcaagtggctgcgggccggcggggacgtgctgccggcggactggcggcctgggcaggtgcacgacacggggctccggatccgcgacgtcgccctgagctcctgcgcccgctcctgccgcggcgccgctacagccggcgccagcgaggagctcaggtagtagagtagattagatgtaggcatggcatacaatggcattgggctggaggcgagcgagattagcttgctgcttgagtgcccatgaaggatgctcgtgctcgtccattgaggaaaattaaaagcaaaccagcagagagctgatctctgatgatctgacgcagtccatggaaatggaagcaaattaagttggtttcttgctgaccaaaaaaaaaaaaaaaaggcgaccgatggatctgattcacacgtcgcatgcatggacgcattgcgctgcatgaatataaacggttgatgaatgttacacacgctttggatgggtgcgcaagattcgatgtcagtgacagtcaaatagcagctatattatagcatcagaaataggaaaaaaacacgtaaaattcgaagagttcaaaaattgtatcagcgtagtttttttttttttgaaacttggcatatgtgtctataccacgtacgggcccatgcatgacagcatctatgcaccacaccttgcatgcatggcttaacgactgacggtcatatgctggatttgtgtcatgtagtgtcacatgtgtggcaagcacgcattcaagcacttgtgcatggctccaaaagtctcttatatcctttcgaatagattgtaatagagatttcaataaaaaaaatattatccagct

SEQ ID NO: 13396 - DNA, 2314 bp, Zea mays
  misc_feature (2092)..(2092): n is a, c, g, or t
gcacgagaccattacctagaacatcctaatcgaaaacccccgtcacctcctctgctccgtagcgccgccatccgtggcggcggcaatctaccgaacaccgtgcgtgcgtgtgttgccgcaatggcctcgcaccacctcgccagccccgccgcggccgcaacctccgccgccaccgtctccagggctctcttcaagcatgcctacactaaaccctcttactcccttctccacgccccgctcctccgcgccgtcgccgcccggcccgcgctcctctccgccgccaccgcggtctccactacggcggcgcccgcggccgcagctatggacaacgtggaggagtgggggctgaggccgctggccgaggtcgacccggaggtgtacgacctaatcgagcgcgagaagcggcggcagcgagcgggtatcgagctcatcgcctcggagaacttcacctcgctcgctgtcatggaggcgctgggctccccgctcaccaacaagtactcggagggcatgccgggggcgcgctactacggcggcaacgaggtcatcgacgaaatcgaggagctctgccggacccgcgcgctcgccgccttccacctcgaccccgcccgctggggcgtcaacgtgcagccctactcggggtcccccgccaatttcgcggcttacacggggctgctccagccgaacgacaggatcatggggctcgacctgccgtccgggggccacctcacccacgggtactacacggcgagtggcaagaagatttctgcaacctccatctacttccagagcctgccgtataaggtgagctccgacaccgggtacgtcgactacgataagctggaggaaaaggccatggatttccgccccaagcttatcatctgtggcggtagtgcatgccctcgggagtgggattacgccaggttcagggccatcgcagacaagtgcggggccatgttgctctgcgacatggctcatatcagtggtctcgttgctgcgcaggaggctttgaatccttttgagttctctgatgtggttaccactacgacccacaaaagtcttcgagggccaaggtctggtatgattttctacaggaagggcccaaagcctccaaaaaaaggccagcctgagggtgctctgtatgactacgaggacaagatcaactttgctgtgttcccgtcactccagggggggcctcacaatcaccaaattgctgctctagctgtagccttgaaacaggccatgtcacctggattcaaggcctatatccagcaggtcaaggcaaacacagtttcccttggtaaccatttgatgagtaagggctacaagttggttactgatggaacagagaaccaccttgttctctgggatctgcgccctcttggcttgactggcaataaagttgagatgctatgtgacctatgcaacattacactgaacaaaaatgctgtctttggtgacagcagtgcattatcacctggcggtgtgcgcattggtacacctgctatgacctcaaggggtttggttgagaaggacttcgtgcagattgccgagtaccttcaccgagctgtgaccatctgcttgagcatccaggcggagcatggcaagattctcaaggacttcaagaagggcttggtgcaaaacaaggacatagagaacctgagggcggaggtcgagaagttcgccacttcatttgacatgcctggcttcagggtgtctgacatgaagtacacagactagactgctgctgacttgggtgcaaaccgttgctcctgttacagtaacactggcaggctggtgcaatgcaaaccgttcttctgttacggtaatattaacgcctctgaaatgtcacgtgaatggtggtaaacctgaatttcacacgactagagggatggtttactttctattcagtgctctgccattctgttggcctgctattccgtcggtctattttgttggaactgataataatatgtttagagaataatgattgagaaagaaaatggcattgcactggagataaaaaaaaaaaaaaaaaaaaaaaaaaaaaaaaaaaaaaaaaaaaaaaaaaaaaaaaaaaaaaaaaaaaaaaaancttgggggggggcccgggccccaatttccccttaaagggagtctattaaccccccttaattgcccgttttttaaaaacgtggaaattgaaaaacccttgggttacccaaattaaatccctttgaaaaaaatccccttttcccaagttgggaaaaaaaaaaaaagccccaacccatccccctttccaaaaattggcccaccttaaaggcaaaaggaaaccccc

SEQ ID NO: 13397 - DNA, 3227 bp, Zea mays
aagtttttttatctatgactggactttgcatatatatactaaatactatggtttaagattctctgtcttcaaatatatagtgctaaaagtaatataaaaatactgtagttatatcatgacattttaaaatcatattattccaaagtctttcttgatactagaagttatatccgtcccacccctctctctttctcgccggccgggtccgggtgtgtgacagcattcccaattcctcaccctcaccgccgccgccgcgccgccgccctcgcagccaccaactccaccgaatctgaagccatagctgccgactgcggccgcctcgaggagcggtgcccctatgcgccgaactccagcggtttctttagcctgttcgcgcgggccccgcgccggggcctgccatggtggggcggagctaggaaggcgtgagcttcgcgaccgcgccggcggaggaagaggcgtgagagcgcgctacaattaaggcgggcgtctcgcccgccggatggccgccgatgacgcggcgcggagcagcagacggatggatctgaacctctacctcggtctcccccgggccccgcgcgccccacgccccgatctcggctccgacctcgcgctcggcaccccgatgctgtcttcgtcgtctccctcgtcctcggccgcctccgcggacgcgccgccgctggagacggatccactccacccgccctactcgccgtcccgcgccgaactggtgcgcccgccgaccccggtgcacgagccctacagcccgttcgcgcccgaggcgcatcccccctatgtgcctccgccaccactgccggttccaggggctttacctgtgctcgctgatgagcttgagtttggtttttccgacgcgcaactcggtctggtcgagcgtttagaccggccttcgtcgtcgaccgcatcttcttccttccgcccggatcgtgccgagcgctaccgccgcttgatgtccttgggcggatctaggtacttccggccaagacggttccgctccgaccttccacctctaagctcagaggcccctagtctggagtgcatgcctgcagtgcaccacctgaacccgaagaacctgtccatgatactgtggaggagaacaaggtggctgctgagggtgcagttgtgggtgtctcagaggacgatggaacagagcatggtaagagtaccgcaatgttcgagtgtaatatctgttttgaaatggctgatgaaccagtggttacctcctgtggccacctcttctgctggccttgtttatatcagtggttgcatgtccactccagccataaggaatgccctgtctgcaaaggagaggttactgaagggaacattactcctatctatgggagagggaattcaggttcggctatggagaagaggtcgcagaggatggtaacgcatctggccccaagattccaccaaggccacatgggaatcggctagagagcttccggcagcagttccaccatttgcgacccatatctagacggcttggtgaggcacatggttttttgtctacgtggaggcgcatttttgatcagcacttagcgaatagcatgagtagatttgaagggactcctgaactatctgtttcggaaactgctcagcatgcaagccgtcttggccgaatgactactaggttgagagcgaggaggttgcaaagggaagcggaaaaccctacacccattgtttcatctgcaccagatagtgggcagcctagaaacaatacacccgatctgccaaggcgctcttcaagcccatttccctcagaagggatggatttattgcgacagattgccttcgctggtcttgaagactcagagaggtttgcgactgctgtcagtgaacttaggcgaatcgctaggccaagccactacggggcatcaacttcatcaaacccaccaaatcctgagcctattgatggaactcatattgccatggcactggctgcagatcaagcttctaattcgagcaccatggctgtcattcaggaagatgcagcttttgctgaaagtgctggagaacctagtaatgccgggtcttcaagatccctgagaagaagaagaggaagtggtgccttaggttctttggatgtggatggtggggacctacatcagaataagagaaggcgtctgaactaagctgaagacagctaaaatcaagccagcaggttgcagcgatattctaatttgctcggtgtgctcttctcagttaagcaatgttctaatgaagctagtaggtaatatctgctgtgtggtatgaagttgtttctctggtactagtttactaggcagctcctggttcgttgccttaattccttccggcctgttcaatttatgcgatcactcaagacatgtatactgcggaaacctggtggttgtcatcagatgtattttccttgatagtaaattgtatgtgcagatctgtaattttcttcatagtaaattgtatgtgcaaatctgtactcagtgaatttggtctctagctgagaaataacacatgagcggacaccagggcttatttgtggatagcttctgattccaccgaaatcatacatattctgcccctgttgctctctgcagctgcttgatggctaaccttaccaggcaatggggtacgctggttgcagcattgtcggtctttcattttcccttctcatgctcacttctgtagtctgtttgtttgaattatctttgttaccctacaagtttagtcaattttggctatgccaactgcagtcatataacggcttgcagtgtgtttgcatgctgctgctttctagtctcccattgctgtttatctgtttggcaaggtctcattgctgcacactgcctgcccactgttttatttggttaagacaaatgactccctattatgctggagaagatttttcactcgctattgtcctggagctgaactttctgttctattgtgtagtcccaagaaatatctactagcagactggtacaagagatgcatttgcactggggcttgttttgattagggagtttgggttccaattataggagttatgcaagatttggaataaataagcccgagaattcatagggcaaatcccctgcctaatgcactttgaatgtctttggttgcacatgccctttctgtgctcacttttacgtgtagacctttatatattttcgtttttctgctattttttagtttggtgtgaaattttatcagggggccgagctcga

SEQ ID NO: 13398 - DNA, 3547 bp, Zea mays
tcagcaggtgcattgacgtggcgctttgttcccgcaacaacaaaacctcgcgggccggccacgcccgccccccttctcctcgcctctctctctccaccggtccacccgcaccgttcccaattccccactctcgccgccgccgccgccgcccccgcagccagccaggcagccaccaacttcacggcataacgaagtcatagccaccgacagcggccaccgcgaggaccggtgcccccctatgtgccgaacttcagctgcttccctcacctgccgcctgctccccgcgccgggccctggcatggtggggtggagctaggaaggcgtgagcttcgcaccgcgccggcgaaggaagaggtgtgggagcgctcgaaaactaaggtgggcgcctcgcccgccggatggccgctgatgacgcggcgcggagcagcagacggatggatctgaacctctacctcggcctcccccgcgccccgcgcgcccgccgccccgatctcggcttcgacctcgcgctcggcaccccgatgctctcttcatcgtctccctcgtcctcggctgcctccgcggacgcgccgccgctggagacggatccgctccacccgccctactcgccgtcccgtgccgacctgatgcgcccgccgaccccggcgcacgagccctacaacccgttcgcgcccgaggcgcacccgccctacgtgcctccgccaccactgccggttgcaggggctttacctgtgctcgctgatgagcttgagtttggtttttctgacgcgcaccttggtctggtcgagcgtttagaccggccttcgtcatcgacggcatcctcttctttccgcccggatcttgccgagcgctaccgccacttgatgtccttgggcgggtcacggttcttccggccaagacggttccggtccgaccttccacctctcagctcagagctccctagcctggagaatgatgctgcagtgcaaccacctgaaccggaagagcctgtccatgataccgtggaggagaacaaggtggttgcccatggtgcagttgtgggtgtctcagaggatgatggaacagagcatggtaagagtgccccaatgttcgagtgtaatatctgttttgaaatggctgatgaaccagtggttacctcgtgcggccatctcttctgctggccttgtttatatcagtgacgcggggtccactccagccacaaggagtgccctgtccgcaaaggagaggttactgaagggaacattactcctatctatgggagagggaattcaggttcggaaatggagaaaaaggttgcagaggatggaaaggcatctggccccaagattccaccaaggccacatgggaatcggctagggagcttcaggcagcagttccaccatttgcgacccatatctagaaggcttggtgaggcacatggttttttgtctacgtggaggcgcattcttgatcggcatttagcgaatagcatgagtagatttgaagggcctcctgaaccatctgtttcagaaactgctcggcatgcaagcagtcttggtcgaatgactactaggttgagagcaaggaggtggcaaagggaagcagaaaaccctacatccattgattcatctacaccagatagcgggcagcctgtaaacaatacgttcgatctgccaaggcgctcttcaaatccatttccctcagaagggatggatttattgcgacacattgccttcactggtcttgaagactcagaaaggtttgcgactgctgtcagtgaacttaggcgtattgctagggcaagcccttatggggcatcaacttcatccaacccaccaaatcctgagccatttggtgaaactcaaattgccacggcactggctgcagatcaagcttctaattcgagcaccatggccgtgattcaggaagatgcagcttttactggaagtgctggagaacctagtaatgcagggtcttcaagacccctgagaagaagaggaagtgatgccttaggtcctttggatgtggatggtggggacctacatcagaataagagaaggcggctgaactaagctgaagacaactaaaatgaagctagcaggttgcaccaatattctaatttgattggtgtgctctcctcagtttaacctttttacctctttggtaggtaatatctgttgtatgtggtatgaagaagttcctctcgtactagtttactagctagagcttagtcggttgccttaattctttcctacctgttcaatttatgtgatcgttatactgaggaaacctggcggtggtcatcatgaattttccttgatagtagattgtatgtccagatctgtattttccttcatagtaaattgtatgtgcagatctgtatttttcttcatagtaaattgtatgtgcaaatctgtactcggtgaaattggtctctggctgagaaataacaaatgtacttggtaaaaattgtatgtgcttctgattctactgatcattgacccaacagctcgatgtgctattggtccaatgaatcatacgtttttttgtcggtcctagatgtggttaaatataacaagctaccaattataaaatgtcaaccataaaacgatagagtttgattaatcggtttaccttccttatctaggttgagaacttgagatgtctagattgccttatatcatccatcttgaatcttttgagtagatccttggtatacgtttcttgagtagattcttatttgttgagccaaatataatgtcatcaacacatacttgacaaatgaagatatcaccataaaaattcctagtgaacagtgtggtgtcgatcatcttgatcttaaaacccttctccttgtggaaatcacaaaggcacttgtactatgcccatggagctttcttgagttcatatagcgccttggataacatatagacaagattaggatacctagagtattcaaacataagaggttgatcaacataaacaagtcttgcacttttaacatccatttgaaatatttttatgttatgattggatatagatgcaaggaggatacaaatagctttaggtcttgcacctggtgcaaaggtctcttcaaaattccaaccttcgacctgatagaatctctttgctagtagcctcgttttatttctcacaataataccttgataatctttcttattttgaaatacccactttatgtcaattagtgtcacatcttaatcgctcttgaggtgtccatacttcagtaagggtgaagttgtttagttcttcatttatggtattcacccaattcggatccttgagagtttaatctatgcaaataggctcaatacaagaaacaagagtggtgctcaacaaataaatcaattttttagaccgagtcattagagccattggtggaccctctacgatgaaatcttataagtgagcttgtagaagtagtgtactcctttcatctgctgagtaggaggttgtggagtattaacatcttgagtttgtgccacatttgatctttagagatacaagtgtcttcattttgttgtcttccatcttcgtcatcatctta

SEQ ID NO: 13399 - DNA, 6266 bp, Zea mays
  misc_feature (750)..(750): n is a, c, g, or t
  misc_feature (5139)..(5139): n is a, c, g, or t
tgaccgatcgcctgatgtctcaatcgctcattgttgtgattgagaacgcctgactattggcgctagggccgaaaaaagctcgaggctcgcgagccggtttgggctcgctcatgctcggtttgactcggctcagagaggctcgctagcctgaacaagctcgagctgagcataatttatggttcgttcaaatagcgagccgagactagacggctcgcgagcctgcgagatcatgtagtgctatattatgaaactattatattactgtgctattgatttatttttcttacctttttcatggatctagtgttagatatagtttaaaacatgttcctaatttatcgatacatatttttgttttgtatataataaaaatatacaatttatgctctaaattggatttattatagcagctcgcgagccagcttgagagcctaagcgagcttaattagatcctgattttcgagctcgtaatatgatggaaccgagctgagtcgagacaagcctggctcggtaggttaccgagccgcaccaagatgagccgagtcggctcgtatctagtcctaaatggcgcccctggtagcgcacagcttgtgtcgttcattcagcaagctatcgttcgtttaacaagcagctctatctctatttatttattctattagatgttggcccctctcgtttctaggcctcaacggtcacctgtgttagttcggctctgttctcgagttagctgtatatcatcagttcattcgnttttatattaagaactagtttaggagcgataaaatctaagaaaattagagagactagggcttgtttggtttgtggctaactgtgccccactttgcttaaggttagtcgttcgaattgaataattaaccttatactgaaaagttaggtaaagtgtgataattggggtaacgaaccaaacgtgccctagattctcttgcgagggagtaactttccctttttttttttctggccttccccttccgctgcttacccagaagagatacggccgtgcaaccgtgacgtcagcgcacaatgacagccgttcaatacacttgtacttccgatccgacggctactactatcgaagcatcagccagccatcagtgtgtgacctttttcttcctccggaaggaggcacgacgccatcgaaccgcctctccccgagtcccgtaccgtactcttgcggtcttgccgctccaacatttcagcccccacccctcatcaatttttcctcatccgccttcgtcccgcacgcttgccgtccaaccgctcccacaggtcgaggcggggagggggaggaggaggagttgctggtgggtgtggattcgccgtcgattcgagtctgcgatggcggcggcgaagctgacaggcaacgccgtggcggcggcgatggcgggggacaccaacctcaagccggtggtgcaggtcgtcgacctccggagcatcgcggtcaccggggccccgggctccgggcccaggttccgcgccatcatctccgatggcgtcgccacggggcacgcgctcttcgcctcgcagctctgcgacctcgcgcgctccggcgtcgtccgccgcggctcggtcgtgcagctcctcgactacatcgttaacaacgtcggccccacccggaacagaaagtatctctctctcccctctcccctctcccctctcctcttctcttccgccccacctacccgactggatcgatgcgtgttccatttgggtgcgctcttgtgggtttggtttatggttcaggcctaccaggcatacgaaattgggtctaatctgtttgattatgtgcttgtttgtttgatctagtagttgcgtgagagttgcattccgttcaattggccgttggcttcggatttaccagcgtatgtattcatgcattccgttaatgtttggttcagtggatctgttcgcgccatcatttcaatccgtccccgtgaacggtgttgctgattgaattgagtgtatacttgccttttatttttttgtcagaaatatactaaaccatcataaaagttatgttcataaccaaattgaaactcgccagccttgaacggatcagaattttcatcttcgtggtgaaaacatagcatgtctgtggtttggtatctagctgtgcagccgatcagtttatacttgcctcttagtaatatatttttacagaatatgataatttgggataatggatatgttcctaagtaaattggtgttcattagccatgaatctgttagaaatttcctcttcatgataaaatagtgctcactagccatgaatcgattagaaattccttcttcacaataaaaagctggtttgtctatgctttggtatatggccttgcgactaatggtcggtgtccactactccacttatgtccgtttaatttgtcaggcattcctgtatgtgccagttttgacttttgatgtcttcaatttgttatgcatcaaatatttgctaggcagctgtctgtcagtgccctcgccgatggctacaccgacggagacgaagaacactaagaatctacgctagaacactaggaaactatactatgagtctgggaattgtattcatttccaaaactgtcttcaacttctcatacaactggtattaatagaccagcccagacttcagcgtacccactcaacggctgatacacgggaattggggcctcctctggcggcggcccaccaacatcttggttgcagcctcttgctcctttcctgcgctggccccttcagctcccgctgcatcatcggcgttgctgacactgtcatgtttggagtcagttaggtcctagtttttttgaccctgttatgcgatggaatttgaccattgtactttacctcttgcgctatggttgtgcatggattttcaggcttctatttgctgtcctgataagatgcttgttatcacagggcaattgttattctgaacatggaggttcttgttgcagagtgtgagattattgggaaatccagcactacctcctgaatctggagattctagttcaaattccctgagagcagaccagtttaatggagcacctccaaatggttcaatggcagggagtactttgaacaaagtgataaagccctctgacaatgctccagtaatccagagatcgatgacaggtaactctttgaacatggttcctaggccaagtgacaatgcacaggtcttccaaccaaccgtacagccatcctatcgccctgcacccaaatacagaagccatggcacaatcatgaaaaacgatgctcctgctagaataatccccatacctgctctaaatccttatcagggccgctgggctatcaaggctcgagtaactgccaaaggagagatccgccggtaccataatgcaaaaggtgatggcaaagtgttctcttttgacctgcttgatactgatggtggtgagattcgggctacatgtttcaatgctcttgttgatcgcttctatgaagttgtggaagttggtaaggtctatgtggtatctagaggaaacttgaaacccgcaaagaaggactacaaccatctgaataatgagtgggagattttcttggaacctcagtcaactattgaactttgtcttgatgagaacagctctattcctgcccagcggtttagcttctcatcgattgataaaattgaaaattcagagaacaatgcaattgttgatgtcattggtgttgttacatctgtcaaccctagtactacaatacagaggaaaaatggtatggaagctcagaaaaggaccatcaccctgaatgatatgtctggtcgaagtgttgagcttaccatgtggggtgacttctgcaacagagaaggctcgcagctgcaagaaatggttgaatgtggggcgtttcctgtgctcgctgtcaaagctggaaaagtcaatgattacagtgggaagtctgttggcacaatttcttcatctcaactccacataaaccctgatcttgctgaggctcattctctcaggcagtggtttgattgtggaggaagagatgcttctactcagtctatatccagggattttactccttcagcatcatggaatgaggtccgaaagacagtagcacagataaaggatgatggtcttggaatgggggacaaacccgattgggtcacggtgaaggctgctatttcgttcatcaaaaccgattccttctgctacacagcttgccccaatgtgattggagacaggcaatgtggtaaaaaggtgacaaagtctgattcaggcaactggctatgtgacaagtgcaatcaagagtttccagagtgtgattacaggtatctcctacagttgaacattcaagaccacacgggaacaacttctgtgacagcatttcaagatcgtggacaggagatacttggttgctcagctcgagagctcaacatttttaaagagaacaaagatcctcgctacacagatgtcttgatcaattgcttgtatcagaactatttgttcaggctaaaagtgaaagaagaacaatatggcgatgtacgacaagtgaaaaacactgtggccaaggtggagagggtggatcctttggctgagagtaaatttctgcttgattccatttcaaggtttataccatgagagttttgttcttacatctatcagctgctggtaagtgtgttgcccgcttagaagtggtaattaatatgtagctttccctactcacacgcccggaggtttctttctcggatagaattctatcattcagcagtaaagagttttctccacttttggtctgccagatacctgcagcttgaagctatgtgttctttcataattaactgaacgcttgtaagtgtgattatgagagttctgtttagctcagctactttgtggttactactattttggtttagtttggtatagtcggacattcctactgctccaatagtgggcatgaatcaaccattaatgcgatggagaaaccattgtcttttgtgccaaagcaatttataaagcacaagtcgaaacaagagagctgtatttacagggcaattaggggttcccataatcccatcgtaatgtacagcaaacacttttggtccagtttaaattccgtttcctcttcgtagctaccacccttgtcccaaactatagaacattttanttttagttttttagctatatagaagctacaagggctaaaaatcacctaatataaataaggatggagtagaattgcatttgctcttaaattggctgcagttgaggcgtttagcaattttttttctggacggctgatgttccagcacaagagacaacgtgcattgatcgtgtattcgagtagaggacactgatggataacgtggctacaactttctacagtatttacttataataagcatataggttgtgctaacaattctgagaagagaagggtcaacggtggcgacggcatgggtgaaggagagggtggcaagtcgcgactcgcgagagaggggagggggtgacgagttgcggagagggggaagagggtgcgcgatcgcgagtggagggggagagagaggaatgagaatgaggattgatctaaataatagtttattagatttgagtgattaatggagagagttatctagcgatctataccgttgattgattttgatgatgtgttcattctagatgtaacttttattggtagatttagtgtaggttattggtgtaggtgattcgattagttgagtacttgagtttcttagtaaaatttaaactgatggattatatagtgatataaatattgcatcgttcggaaaagattgcaggggctaaaatcacatcttagggctagtttgagagccacaaaatgagagggattgaaggagctacaatccacttttattcaaaattaaataagaagtggattctagccccttcaattctctccgtttttgtggctagggctagtttagaagtcacaaaaccggaggggattagaggaactagaatctccttgtttaagtttgtataagaagagtattctagtcacttcaatctcctctgattttgtctctcaaactagtctttattcaaaattaaataagaagtggattctagtcgctccaattctctcggttttgtagctgttaaactggtgcttggtgttttcctttaccccaccatgtctgcataacacggatcacaaaaaacctgaccttttccctatagaaccttgttgtcctgcccacagaacttgattggggctgtgaagtcatcccattgcgactgcaggcatgcaag

SEQ ID NO: 13400 - DNA, 1751 bp, Zea mays
ggaccctcgggcgtgccggcgtcgcccgtccgtctcctctccccgctccgctggtcgccttctcccctccccgcgaactcgggctcaaagcaaaccaaaccccttctagggtttgcgctccgggcatgatccccttgtagccaccgcctcccatggccctagccgtgtcctgctggccatgaccacctcggcttccccactcttccccaacccgcgcaagcgccacctcgacgcctccccccttccccgccacttccacggcccgcagagccaaacccgcctaagccagcgccaccgccgccggttcttcttgccgctaccaccgaaggcgcggtccttcgcttccgacatgggaaatcacatgtccagtgccttcggttggcccagtgatgacgggcgggggctcctctgttgctggatcggcaaggcgcggggtctcacggtggccatggatgtggaggcggggacgggactgcatttggtggaccggcggagggttacggattcgaggaagactacgttgaaggaggaggcggtgaagcctccccaatggaagaaaaggaggcccttctacaaggaggcgttggaggcagcagcgacacattacgatccgaggctggaggcaatcgggatcgagataaggctccaaaaggagaagcttgcctatataccaaagtcggataaggctgccaaggaggatatgtctgaactatttaaacctctcactgctgaggaggaaaatgatgttcatgactgtctctacagtagaggctcgagtagcaaagttctagtgctgcatgaaccatctaacattgaggttagcaaagagaaattccagtgcttgagacgtggctgctggttaaatgatgaggttattaatctgtaccttgaattgttgaaggagcgagaaaaaagagaaccaaacaggtttctgaaatgtcatttctttaatacattcttttataagaagcttgcttgtggaaaaaatggttatgattacaaatctgttaaaagatggacctcccaaaggaagttgggatatgaactcattgaatgcgataaaatatttgtccctgtgcataaagatgtacattggtgtttagcaattataaacgtgaaggaaaatttctttcagtatcttgattcccttggtggcatggatcataatgtaccaaaagtactggctcgatatatttcagaggaagtgaaggacaaaagtaacagagtaatcaacaccagtttgtggcatgaagagctagttgatattcctttacagcggaatgggtgggactgcggtatgtttatgctcaagtacattgatttccacagcagaggactgcccctgtcttttagtcagaaacacatggagtattttaggaagaggacagcgaaggagatcttaagactaagagctgactgatggatagacattcatcactttttggaacagaggctgactttttttactgcattttggggattataataaataaaagctgctaagtcaagtctatggcattgttgagcatgctcagggtggggtcatctacctgagatggttggtaatgtggccctgataatgtaaatactatagatattctgtagagaaattttgtttagggatttatttgactcggagaagcagtgaggggggaaatagatgtagctacgctgatattcgttgttggtttaaagttgtttcagattaatttgttcttgtggaattattttgcagccatggttggcatact

SEQ ID NO: 13401 - DNA, 4486 bp, Zea mays
cggacgcgtgggcggacgcgtgggcggacgcgtgggcggacgcgtgggcggacgcctcgcggccggccggattggtatcaagaaaaacttgtcgaaaaatacacagggcacaatgtgcggaggcgccatcctcgcggagctgatcccgccgacgcggcgcgtggcgtcgaagccggtgacagaaggccacctctggtcggcgagctccaagaaagccggcagcggcagggacaagaggcaccagcacgaatacgccgacgatgacttcgaggccgccttcgaggacttcgacgacgactttgacgtgcatgaagacgacgaggacggccacttcgtattctcgtccaaatccgccttgtccccagccctgcacgacgggcgcgcggcgagccagaagaagcagcgcgggcgccagttccgcggcatccggcagcggccctggggcaagtgggcggcggagatccgcgacccgcacaagggcacccgcgtctggctcggcaccttcagcaccgccgaggacgccgcccgggcctacgacgtggaggcgcgccgcctccgcggcagcaaggccaaggtcaacttccccgcagccagcggtcgcgctcgcggtcgcgcgcgcccacgccgcggcgacgacggcaacccacgaaccgcgccggaaacgcagcacccagcacagcccgctctgctgcctcgaggagagagagagacgcagaggaaggaagggatcgccgccgtgaagccagaagctacggagtcgttcgacgtgggcggcggtctcttcttcgacatggccttccccaccttcccagcctcgccgccgccgcaggccgtggatacgtccttcgccggcagcaccgccacgtcggagaccgggagccccgcgaagaggccgagatgcgacgaagactcgtccgagggcggcagcggctccgcgctggagctcgctgacgagctggcgttcgacccgtttgtgctgctgcagatgccctactcgggtgggtacgacgacgactcactggacggccttttcgccgcagatgaggccgtgcagcaggacgtgggcaacggcatggacggcgtccgcctgtggagcttcgacgagttccccgccgtcgacggttctgttttctgacgtttgcttactacgtactactactattttctgcctggtggaatcatatgtgatagtgctgcatgtgtctgcctgatcgtcagattgtactccactctggatatttgtgctacgtactcgtctggtatttcctactgtgggtcaatggttcctatgaatttgttcacgtcggcgaaactctgtattgtacggtcgtgattgatgtgccaaattaaataagcctgtgaacctggttctatgtatatatggtatcttgattatgagtaaaaaaaaaaaaaaccttcccctgccatgtttgggttggagcatcctcctgctccaatttccatgcaaggggatcatcagtttctggatccagtcacaaggtgaacagtgtttgtaggtcgcggcgattgcatttgcaaatttccttatccgtaaacatgaaaaagaaaagaaaagaaaagcgttccgatccaaatgcgctggaaactgttctttgccatttcgtttaggcacctaatcggcattgcaagtttctgggtcttctgttctgaccgacgggtgcgattgcgaaaaccgcctcgcgatccggtgggcacctaatcggcatcggcacagccggttttggactccttgcgtgggtgttattagtttaggctggcaagttgctgaaaagaaaagaatttaggctgcaatttgcacatcttgcttgtctctctctctctctctctctctctctctctctctctctctctctcgatgacagcgatctgccccgacccccgactatgcttccaaaactttgagttgcaggattctcaagcaaacatacaagtattcacaagtggtggcgaaaaggcaaacgcctcccctcatggcctcatggggccagctcgatcggcgaccgtcagagcctgcgtttgtttggctgccagttgagcgccgcgccattacattatcagtcggcagcagcgtatgctactacctaataatctttgcgcgggcctgcccgtgacgatggcctgattttgttgttccactagctagaggttgagggttctcccagcacatcctaatcctacgcaaaaagaacagaatttggtcatcgtagctccggcttgacagagagcatgcgggaccaatagaaccatgcatcaaccaatgactactattaagcatctctagcttcttcagactactgctggctacttgtccatgcatgtatgtggagaaacaaaaaaaaaccattccttggaagtaaagcctctagtcgaacaaaaaaccagatttcggatctcctccgtagttgtagaaccagaaacgcctccgatcgatcgaccattccgtggaagtaaagcctggaagaggcagcagcatgcctttttttttatttctgatgaagagttcgttgaactggctgaacgtaacatgcagcattttacctgttgatgtcgacacagcacaagaacagagacgaataggcgatccatcacttacatgcagaagggctcggggggccttgctgaattcacctcttcctgccgaagccaatacagccgacgcaggcagttcttcagatccgaggaggtatcatcagcttgcacagggtttcatctgagaactgacaagacctagcaaatgaggaaatgtgcgtggtccgggatactataagtagtaatgcctcgccatgtgtgtacgcaccaaaccaaagggctcccaacactctctgcaagatgttttttttttttggaaaaaacaagcgaacaaaatgggggtaatgacatggtcttattacacaagtgatgtggggatgatgcacctcgtggttcccttcttcctggttcctgcaaatagcggtaggcgatgcaattgtgcaagtggcaagtctgtgggaggagaggagaactggagacaacccaggggagaggggactcgcggaacgcctagtggtccgtgggccggaaactgcccatggtattgctagcaaacgatccaatcagcacgcattgagtcttccatggcgtgagcgtgaccaaactgcaagcatgagtcttccatatggcgtggcttgtccttgggggtgaaacagaactcaggtctgcgaggagacatctgatgcattgatccacgggggtggacgtggatctagggggggatttattgaacaaaggactgaaataggagatcggacaggattgaattggaggcaataaaaatcttttctacatggtaatcttagctttcttccttaatcttcacctaatcctttgaaacaccaaaactcatcaatgatattgtcattgtgcgggaaaggacatgtccccgactgctgccaagacgcgctcgaaaaccataacctaggagatttacttctggactcacaatacaaggctccctactcttaggacccgttatagtattactgtattacatgatctaagtgtgtatacttagaactccgagaatacttgattaaatagagaatggatctaaacttgtaatcactataaacacacgaacaaagatggatcaagacatactatcttgctcttcattaagggcaaggttgacgtggttggagacgtcttgagttcttctgccttgtagtggtggaggagcgttacgacgggtggagccgtggaggtgcgtcccggcgatgtggtggtggagcgtggtcgccgccgctagtgtcgcctccatgcccctgcttaggaggagtgtcctagcacggtggaggtgcatcttagcgaggttgtggtggagcgtggtcgattttattggtttgacttgatattacttattgttataggagaaaaatatcgatggctcattatcacattaaattctcagtggtctttctatgctataatcactcttaatttgggtacaaatttctttatccatatcgcctgtctaattgcctcatacgtagctatatactctgcgtgcattgttgacgatgctctcgctgtctgtttgcaactttttcaagaaatagctcccttagagagtgtaaatacataccttggagtggactttagtgtatctctacagcatccctagttagcatatgcatagctaattatctgtagagaactagatcttctgtatataagcatgagacctttagtaccttgtaattaccttagagccttttaactgctttccagtgttctatgcttatatttttctgatatcttccaagcatcccagtgataaatgctaaggtaaggcgagtataattttgagcatacataatgatttcgatagctgaagcatatgatactgacttcatcttattcttttcatattgattctagaggcactgataatccctaaacttatcacccttgactattgtcgcagctg

SEQ ID NO: 13402 - DNA, 1676 bp, Zea mays
caaaaatggtgccatgcatggatctgctgtccggagttgttacagcatccttgatatagtacacaggctatggactccaattgatggggagtttgatgactacattatcaatccttagggtagcggttaccaatcactacacacagcagttcaggcatctgatagctcaccgctggaggtccagattagaacccagcgaatgcatgagtatgcagaacatggccttgctgctcattggctgtataaggagagcaaagttgagtacagaagtagcatgagtaagagaataagacaaagtacatcatattcatctagttcttcagaagatgaaagttctatacaggatgatatcccatcaaagtacagttcaatgaaagtggggcatccagtgctaagaattgaaggtagtcacttactagcagctgtcgtagtcagtatagataaaggaggaaaggaattgattgttgctgtaagttttagtcttgaagcttctgaagctgtagctgagctaaggtcatcttttcagttgaagcgttgggaagcctatgctaggcttcataaaaaggtttctgagaagtggtggtgtgcacctggacatggtgactggtcaacaaatctggagaggtacacactatgccaggatgggatatttcataagcaagaccaatttgggagacttttacctacatttattcaaataattgatttggcggaagaggaagaggaagagtattggatggttgtatctgccatattcgagggaaaggaaacttgcagtctaccatctgaatcgagttatgctgataaatcatcatctgaacctccaagttctactccattaagcgaccccatcaacaataaggtgcatttgctcagaaccatgcttcaatgggaggagcaagttcgccgtggcgcatctttggcagagaaaagtctcagtgcaagcacctgcacaaaggcaatcctgcgtgaggtggccataatattctggcctaatggcaagattatgagaatgagcactggtagcacagctgctgacgctgctagaagaatgggcgtcgaagggaagctgctctgggttaatggccaactagtgctgccccaaacagagctaaaggatggggatatagttgaagtgagggtatagatgcaagtaccagattccagtacaccttcctcagggttattgatcatattggttcctcagttcttgccctatcttggcaatgcatcgaacctcaattgtacagtccattggtcgaaatgaatcgaagaaagaaggattaggtcctgtgtacataagaaactgcaagtataaaagctgtctgtccagctgtgcttctccttgcccatagttacagtggtaatgtaaatttccgtaagtaaagatgtagtaatgtttagttagtggtccacatttcagcgtgaagttatgaagtgcagtagcgctgcaagttttttttatatatatgtccaaagtagatgtctcatgctgcctaaaaaaatgtccatgtcccgtaatttggcaagccaagattgccagaaaactcatggaggatatggcaaccattttcaactactaatggctgtttggtctgtggagtcaacctatgtttgatgtatcatgagcccattccataaattttggtggaaatcctcatatatatatactaatt

SEQ ID NO: 13403 - DNA, 844 bp, Zea mays
  misc_feature (2)..(2): n is a, c, g, or t
gnaaaacgtggaccacatagtgccgcctaaagaactcatcagacatcagcaagctatctgactggagcaggtactctagcacattactaagcccacatgctgaagatgaaccgacgacaactctgagcttgcagaaagggaggcatgaggaggtgatgatttcttaattaaaacttgcatagcatgctctacaacacattgcgaagtcacaaaagaggagaaggtgatagcatataaggtgttcaaggcccctgacaatcgacagatattcttgagtgcatgcaatgatgatagagaggctgcattgccgcgcgtccgggatgagatggcttagcaggtgcatttgcttagaaccatgcttcaatgggaggagcaagttccccgtggcacatctttgacagagaaaaatctcggtgcaagcacctgcacaaaaccaatcctgcgtgaggtggccataatattctggcctaatggcaggattataagaatgggcactggtagcacagctgctgacgctgctagaagaatgggcgttgaagtgaagctgctttgggctaatggccaactagtgctgccccaaatagagcttaaggttggggatatagttgaagtgaggatacagatgcaagcaccagtttccagtaaacagagcttaagtttctgacctgcagaccaatttatttaagtatgttagttgaatcagtgtactgttttttttggatattctgcattcttgaagttaaaggatcagaacttgtttctgaatgcagaaatgttttctctattatattatcttcacacttgggttatgagtaaatgtttacctgcatcagtagttgttgac

SEQ ID NO: 13404 - DNA, 705 bp, Zea mays
gagctcactagtcgttggccgccccttttttttttttttttttgaagcacaaactacaggataacattaacaaatctcagcatgttcttgttgctgctacctcgcctcatctgcaactatccagtccatgccagcagacactgaatatcgacacgaatccaacagcctaattacagattacaacctctgacctaccaggttgtggcagggagatcaatggatcagcgctaccatacattaggtgaaggaaagacatgtatatgcacaggacaaacaacgattgcttccttctccttacataaatcccagctgggtgaggtcatcgtctgggatttccagggcgccagaaagatcaatgtcttgcaacgagtcgtcaaggccatccgtaaaccacgagctgatatcgttgccctgcccgtcaagcccttccgggacgtccaatatgtcatctaacccaggcaacactggcagtccagcgtccacggtaagccgctgggcagcgctgctggaagcacccctagttggatgctgggtctttttctcgcttgcaggttcagggggctcctgcactgttggagacgaaaatggctcaacgactctacccagcacgttccccgaggttgatagctgtgcaagcttttgctttggctttgtcttgtttttgcgctcgccgctcctgccgctaccacctgatgaatgacgtcc

SEQ ID NO: 13405 - DNA, 1008 bp, Zea mays
atcttgtagacgaggcagacccaagcgccgaaaaccttggtggcgtcagcgatagacaggtacacgaggacaattcagattcacgaactgtaggattccgtctggtctttccatggggcagaaccacatgataccattagcaaatctcaacatgttcttgctgctacgagaatcgaataactcatctgcaactaaccattccatgccatgcaggttcgattacagggttgtggcagggagattaaaccggttaattatatctactaccatacattaggtaagcacccaaaaaaagaacatatatgcacagagcaagcaacaagtgcttccttctcatataaaacccagctgggtgaggtcatcgtccgggatctccagggcgcctgaaagatcaatgtcttgcaacgagtcgtcaaggccatccgtgaaccacgagctgatgtcgttgccctgcccatccagccctccagggacgtccaatatgtcatctaatccaggcaatgctggcagtccagcatccacggtcagccgcggggccacgttcctagagggatgctgagtcttcttctcgcttgcaggttcagggggctcttgcgcttgcgccgctggagatgagaatggctcaaccactctacccagcacgtttccggaagtcgatagctgagccagcttttgctttggcttcgtcttgttcttgcgctcgccgccgccgctcctgccgctgccgcctgaggaatggcgccctgatttcagtccagagccctttgcagacgcatccctgctgtgatcccgttccctgtcgccctttttccatttcgcaccaccttgatcaaatggagttctggcgggcggcgcctgcgtcgccctctctacaccctccgtgaatctcgcgtcactgcttggcaagggtgcagacagcacactccaaagagaaggctcactgaagcagcttttccctgtttcgtcaaatttgggcatcgaacaagagtacgcttcccggccaacctc

SEQ ID NO: 13406 - DNA, 4153 bp, Zea mays
  misc_feature (1598)..(1598): n is a, c, g, or t
gactaaattagcgaagtttttaaaagccctaattcaccctgcctgtcggcccgtgttcttttcacgcgcaaaatgcgtgatcagacgagtgagcgctcattttgcgcgacggcatctacgatctactggaagcatgaatggtaggacgtgatcacataaaatgtgtatccacgagcatttgcgcgtgctgctggagtcatgcaaggagaagatgcacttttcacttatcatcaaagataaggagtgagaatggaacactgaacaaagaaagctgttacgaaacattaaattagaaaccttgcctgacttacaataaatctagatcatttgatccaaaccatccattgccaaaaatagagcacatccaaaaatctcaaaccaccaagataaaattataagatagaaaaacaagagtttgaatagctaaatcggcatggctcttaagattaagcccctgacagtaatattcatactccacttgaggatgtaaaagcagaaattgcgacaatatcgatacgatccttcgactgccaacagttgactcctttattatgcatccctgggagctgcaacacagagacatggaagagaaggcataaacagtaattcaaatgattaggcatccctgagagctgctgcatttatcaaaaaacagatcaagtgagttcatgtgcaacaaatggcaagagtaatcaagaaataggtagcaaaagcaaaatcagtaacatgaacatgatacaacaattgaatgcaatgttgccacctcgatcaaattatatgagagaagctagcaataatgaattccttggaaagtaggatgtattttttgtggacaaggaaataaaaatgactactactataaaataccggtttgtatggttttcaccatcatcgtgtggcaacacttttgtaaaaaacaccttatgtttctttttaatcaactcgcgatccaagcttacccatctggactccctccctactttttttttgcaaaaaactccttatatttatttgtaatcaaccagttgatctaagcttctctatttcgactcttttgtgtgccatcgcaacacacaagcattgcatagttttctattaagatcctctccaaagtttccctctcaacaccccttccactcttcagggtgtactccccctcacgagggcgagctacgctcatcacgatgtataaggggaactctaatctccttcctttagttaataagtgcttttagctacaaaataaatactttttaaaattaattacttaataacaatgtgtattataataatataaatattgtagtatttttttaaaattctaaaaaactaatgtataaaagttaaatagctcatgtataatatataggggagctgaatctcatggaggaggtatttaaatataaatagaaagtatgaatagagaatggttttggagggagaatggttggatttagcctaaggctctctccaacaataaaccctaaaagggttatgtaccctatatttagtggagatatttgccatgtatccctctatcatcgtctttcaaatggtactcggacgttggtggattatctatatatagagtttctctnttctctcctccatccattataatactttaaacaacagatttagcaaaacaaaatttgtacaatacatttgagagtatgacaaatacatacgtacaaaaaagaaaagtaaaatatgtctctgctggagaggaagaagatatagaggagtaaatcttttggaggggaccgtaaaagacagatattgaggatgaactagtcagttgtccgtgtattactacagtttttatatatcatatgagtaggttttgttttaataagacacaaaaatatatgtgttttattggttacatggttgtgagtagactttgttttaataatataaaaatatatgtgttctattggttagaaggttgtgaatgtggagtcaacgatcaatgttctgacctcatttatgcataattttactttatttttgctcaagagagaaaggtaacctaagagggagccaacctgctcgctaatcgctagtgtatgagacttggtccgtggaaattggattaaggatgagagcaacatagttgaggttgaatctaaaggatctactgcgggataaatattcttgtaagttaaacctcaaatgtgtaaatgttgtggcagaagccggatcaaatcgtcaacaggtacataaactaaggctagagactgaacccatcctttgctatcagtgggattgatcctgtaaatgttgtggcagaagaaattgatctgtaaaaaaaaatgatgtagcagttggatagttccaatcgcgtcgttgggggccacggcggtcggcgtccaccacgtcatgcacgcgggcggtgaagtccagcaccgttggaccccgccttatcaattcccaagtcagacgctgatactggctgccgcatgtctagattggtttggtgatgctgatgccggtgccgcatgtctatattgggtaggtgacgctgagggcctcgttccccaatcagacttgttcggcctcttcgacggcgtgcccgtctccccgagctcattcgccatgccttcctcagcctccgcgagaggaggacgagggctcctcttgccggcggctgctgaggcggttgtggtgctaatattgggtgcagtggcgccacggcgggttgttatccgcgcgtgttcagcttcggggactcgctggccgacacggggaactacccgttcgtctacggcaacgactctgggtctggcggggccgcgctccggccaccctacggcgagaccttcttccaccgcgccaccgggcgcgcctccaatgggcgcctcgtggtcgacttcatcggtaagctatctacactacggaggtagtgccatacaatcgatcgacggattgatccattagacatttagactgcgtggtagtactgactttgagacttgggattcacgtggccgcagcggacacgctgggcctcccgttcgtgcgaccgtatctgagcggacggagcgcggaggacttcgcgagcggggccaacttcgccgtcggcggcgccacggcgctcagcccggactttttccgtgcaaggggtttcgacaccatgggaaacaaagtggacctcgacatggagatgaagtggttccgcggcctgctcgacctactctgtcccggcaatctcgccggtatgtatgttctgcttcacctcctcgtctcctccagttccatgcttcctccccatttgacgggatcgcacgctctgcttcgtcggcgcaagggagccgaatcggtccgcccgatcttatcggcggaaacgcttgctttcacggcactgaggaatccaaacacgttgactgttccagcttcttgcccagcccagctaggcaaggcgaacgctggcaagggatccagttggagtaaaaagcaatttctagaagatacagtgctgtgcaggggagttcagatatggaagctgaaagatgttgtgtgatgcagagatggaagctgaaagctgtgtggtgctgctggtgcactggatgtttggaagttcatcttcgctacttggtttatatgaaaaacataaaaactgaaaattctgcttctaaatcgaatctgtcatttttcatttatgctctatagttataagtcacctaatatattaaatatatgtgtgacagagctactgccatttcttcaaaaaaaaatcaatgattggtagtatcagttcaaccaatgcaaatagctggccaattcatatcagtcactgtagtagcgatttcagcagaagacaatgcataatattttgctgtcattttttatttttaatttatggcacccgaacgatcaccaatgttagtgttcttccaataggcaagtttatggtcagaattgtgaaataaactgttaaataaactgtatgcattaataactagttgaactcataatttcaattgtttggaatagatatagaataattagtgaaaaaagaactgctcatgcaagtgcttttacctcctcttggcatagcctgttgcgctcaaggaatccgttgttgtgcttgaaaacatattttatgatcaacctgacttgtttcaaaccatattctacctacagtcagttg

SEQ ID NO: 13407 - DNA, 1465 bp, Zea mays
ggctgccgcatttattatattggtttggtacttggtagtttggtgacgctgaggcctcgtccccgatcagacttgttcggcctcttcgacggcgtgcccgtctccccgggctcattcgccatgcattcctcagcctccgcgagaggaggacgagggctcctcttgccggcggctgcggcggcggttgtggtgctactgttgggtgcagtggcgccagcggcgggttgctatccgcgcgtgttcaacttcggggactctctggcggacacgggcaactacccgttcgtctatggcaacgactcagccaagctccggccaccctacggcgagaccttcttccaccgcgccaccgggcgcgcctccaacgggcgcctcgtggtcgacttcatcgcggacacgctcggcctcccgttcgtgcgaccgtatctgagcggacggagcgcggaggacttcgcgggcggggccaacttcgccgtgggcggcgccacggcgctcagcccggacttcttccgtgcaagggggttccacaacatgggaaaccgagtggacctcgacatggagatgaagtggttccgcggcctgctcgacctactctgccccggcaacctcgccggttgctcggatatgatgaaccaatctctcttcttagttggagaaatcgggggcaatgactacaacggacctcttctttctggagttcccttcgaggaaattcgcgccatcactccgagtgttgttgcgaaaatttcttctacaatcagcgaattgattcagctaggagccaagactcttgtggttccaggaaaccttcctattggatgtgtcccaaaatatctgatgatattcaagagcaataagaaagaggattatgatccacagacaggttgtcttagatggatgaacgagttctcacagtaccacaacaagcttcttgtggagcagctcaagaagcttcgcaggctccatcctggagtaaccatcatctatgctgattactatggagctgctatggaaatattcctttcccctgaacgatatgggatcgaatatcccctagtggcttgctgtggtgcagaaggaccctacggtgtgtccccaactacaagctgtggattgggagaatataagctgtgcgataatccagaaaggtatggatcatgggatggcctccatccaacagaatctgcatacaaggtcatcgctatgggcctgctactaggttcctatacaagaccgccaatcgcttccaccaccacttcatgtccacagcttatggagctcggctcttctgctgaatacaaacgcctctacgacctgtaataatttatgtaattatattttattgtatgtactccctcgcccacttcaataagtcccattttgcgagtacatgtactttgtaacttttaactaataacttatcaaactagctactatataaaaaaaaaaaaaaaaaaggcattca

SEQ ID NO: 13408 - DNA, 1537 bp, Zea mays
gctgatactggctgccgcatgtctagattggtttggtgatgctgatgccggtgccgcatgtctatattgggtaggtgacgctgcgggcccggtccccaatcagacttgttcggcctcttcgacggcgtgcccgtctccccgagctcattcgccatgccttcctcagcctccgcgagaggaggacgagggctcctcttgccggcggctgctgaggcggttgtggtgctaatattgggtgcagtggcgccagcggcgggttgttatccgcgcgtgttcagcttcggggactcgctggccgacacggggaactacccgttcgtctacggcaacgactctgggtctggcggggccgcgctccggccaccctacggcgagaccttcttccaccgcgccaccgggcgcgcctccaatgggcgcctcgtggtcgacttcatcgcggacacgctgggcctcccgttcgtgcgaccgtatctgagcggacggagcgcggaggacttcgcgagcggggccaacttcgccgtcggcggcgccacggcgctcagcccggactttttccgtgcaaggggtttcgacaccatgggaaacaaagtggacctcgacatggagatgaagtggttccgcggcctgctcgacctactctgtcccggcaatctcgccggttgctcagatatgatgaaccaatctctcttcttggttggagaaatcgggggcaatgactacaacggacctcttctttctggagttcccatggagaaaatccgtgccatcactccgagtgttgttgcaaaaatttcttctacaatcagcgaattgattcggctaggagccaagactcttgtggttccaggaaacctcccaattggatgcatcccagactatctgatgatattcaagagcaataaggaagaggattatgaaccacagacaggttgtcttaggtggatgaacgagttctcacagtatcacaacaaggttcttgtggagcagctcaagaagcttcgcaagcttcatcctggagcaaccatcatctatgctgattactatggagctgctatggaaattttcctttcccctgaacaatatgggatcgaatatcccctagtggcttgctgtggtggagaaggaccctacggtgtgtccccatctacaggctgtggattcggagaatataagctgtgcgataatccagagaagtatggatcatgggatggcttccatccatcagaatctgcatacagggccattgctatgggcctgctactaggttcctacacaaggccgtcgatcacttccaccaccacttcatgtccacagcttatggagctcggctcttctgctgaatacaaacccctctacgacctgtagtaattttgtaattatattttattgtgtgtactccctcgcccagttctatcagtaccattttgtaagtatttgtactttgtaacttgtaactaataacttatcaaactagctactacatatttgttaaaaaaaaaaaaaaaaaagcggccttcaaaaaaaaaaaaaaaaaaaa

SEQ ID NO: 13409 - DNA, 1699 bp, Zea mays
  misc_feature (1420)..(1420): n is a, c, g, or t
  misc_feature (1484)..(1484): n is a, c, g, or t
  misc_feature (1491)..(1491): n is a, c, g, or t
  misc_feature (1571)..(1572): n is a, c, g, or t
  misc_feature (1669)..(1669): n is a, c, g, or t
gtccaaaccccagcagcatcgcttcattgtcggcacaaaaggctatggttgcacggacgaagcaaaagtgagcagctcgtagctccgtccaggagaggagattcagggtacggtaaagaagatggatttcataatgtcaatgaaggtcatgatgtttggtccaaagcaactattggtagtaagcaatcatgcatggccggaactggaatcacgaacctagatctgatactttcccagatgagcagaatgagaaatcaaatttccattggtagaattcaaccaccaataggtgccgagccaagtgacagtcggctcgagggcgcctacagcctgacataccagatcctgacatccctggttccaggaggccaaaagttggaggcagccctccactcaggcaaagaaatcgttcgtttgacatggcacttccttgcaacaggactgacactggaacaactgactgtgttatggaggaccagagcttggataaagtggaaaaaacgcaagaaaagccagaaagtaccccaattccagcgaagagcgtgaatagctggataggaagatggtgccagggaggccctcctgttttccatgaaggcccaggccagggaaggcaggcaacaaagcctggccggccatctgaagaacttgaaggtcggttcccaagcattgcagcgatggcgatgatggggcgagcgatgaacaagcttcggccgtgcgagcatcagaagatggggccacttgtggtgtggaagacagattgacctcgtatatatatgtttttgggtgtaatatagtggtttctttccaaaaaaaaaggaaaaaaaaaaagaaaagcacctgtgaatttttcctggtttattgtttatggtgtaataaaccatgatggctcatggtttattgttttctgaagtgaaagtagctaggtgtagtggatactggtgatgtaatggtctccatataccaacaatataataataattttactgtttactgtgtcgttaaaaaaaaaaaaatttgacgctgaggcctcgtccccgatcagacttgttcggcctcttcgacggcgtgcccgtctccccgggctcattcgccatgcattcctcagcctccgcgagaggaggacgagggctcctcttgccggcggctgcggcggcggttgtggtgctactgttgggtgcagtggcgccagcggcgggttgctatccgcgcgtgttcaacttcggggactctctggcggacacgggcaactacccgttcgtctatggcaacgactcagccaagctccggccaccctacggcgagaccttcttccaccgcgccaccgggcgcgcctccaacgggcgcctcgtggtcgacttcatcgcggacacgctcggcctcccgttcgtgcgaccgtatctgagcggacggagcgcgnaggactttcgcggcgggcccacttcggcgtgggcggcgccacggcgctcagcccggacttcttncgtgcangggggtccacacatggggaaccgagtggactcgacatggagatgaagtgttccgcggctgctcgactactctgccccggnnacctcgcggtgctcggaatgatgaaccatctctcttctttagtgagaatcgggggcatgactacacggactcttcctttctggagtccctcgagaantcgcgcatccctccgagtggtgtgcgaaat

SEQ ID NO: 13410 - DNA, 2521 bp, Zea mays
ggtgaaattttcatgatatgtataaatgtcttggcaaggctgtttcatgtcctttgttaccttatgagcatcgtcatctgaatacacagagaacggaatctgcagaaaatttgaaagtctgcacgcttcctgatcatcaaactgcaaataaattgacagaaaagagtcatggtgagctgctgacatatggaccaaagtcaaaggaaatgtatacaggttcttgtaaccaaagaaggtcttatttctttgaaaagttaacgattccttccaaatcacaaagtacatatcctaaaaattctgcgtcttcaggaaaatctagcgactttggagtttgtatgtatggcaccaatattggcagtcagttattcagagcacagaatcaatcttcagctaagactgaaacattgcacagcgatactctcattgggtccaaatccccagcaggtgaggtctaccatctctacaatacagtatcagctaagagcgtgtttaagtattgttgttagtgttaaaaggtgcttcttagttatgcaaaacatatatgctaacggagcagcatcactggactgttttgtctaatacatatcctttttttttctgttgctgatggtagcaatatcattctcagactcacatgttttcctttttctggattgttgtaggcatcgcttcattgtcggcacaaaaggtatcagtgtaccataatctgcagcaatcttatctcctgtcttgtgcataaagagtgttcctggactacttatattgcttgatactaaaaactaaacagcagcatatggtttggaactgtttttctattgtttggatggttttgaaagaaaaaaatcctgaaaagacttataaattttattgtcagaactgcattttgatgcatgggtttttagtgttagtagatctttcgtgtttacgctctttagttaaaatcttggaattttatcatatttaggttggtttggatatatgttcactggtttcacatgataattatttcaagctctgctcatagttatggacccgtatcagttgatagatctatgtactgattctttcattaccaataaatgtactacaggactatggttgcacggacgaagcaaaaagtgagcagctcgtagctccgtccaggagaggagattcaggatacggtaaagaagatggatttcataatgtcaatgaaggtcatgatgtttggtccaaagcaactattggtagtaagcaatcatgcatgcccggaacgggaatcacgaacctagatctgatactttcccagatgagcagaatgagaaatcaaatttccattggtagaattcaaccaccaataggtgccgagccaagtgacagatggctcaagcgcctacagcctgacataccagatcctgacatccctggttccaggaggccaaacgttggaggcagccctccactcaggcaaagaaatcgttcgtttgacatggcacttccttgcaacaggactgacactggaacaactgactgtgttatggaggaccagagcttggataaagtggaaaaaacgcaagaaaagcaagaaagtaccccaattccagcgaagagcgtgaatagctggataggaagatggtgccagggaggcactcctgttttccatgaaggcccaggccagggaaggcaagcaacaaagcctggccggccatctgaagaacttgaaggtcggttcccaagcattgcagcgatggcgatgatggggcgagcgatgaacaagcttcggccgtgcgagcatcagaagatggggccacttgtggtgtggaagacagattgacctcgtatatatatgtttttgggtgtaatatagtggtttctttccaaaaaaagaaaaaaaaatgaaaagcaactgtgaattttgcctggtttattgtttatggtgtaataaaccatatgatggctcatggtttattgttttctgaagtgaaagtagctaggtgtagtggatactggtgatgtaatggtctggtctcatataccaacaatataataatattttactgtttactgtgtcgttatgatgatgtgttgaggcattgtcaagatgaatttgtgaattatccctgaacagaaacatcagtcttcgtttttgttttgataggggaaccgtcatgcgccaacatgttgtagaacagctaatgatgaagcaaaatatatataaaaaaagatgatgaaatcacaatccgtgtaactgggagcaatgaacagctggcaagcaatgaactaatttcgtgtaattgggagcaaaacactgttggctcgaagaagaaaaaaaacaagtcatgcatattaccaatgtttaaattttgaaaatgtgagctattatttccaaaactaggatggctttttactgacgaccatctcgtgaaacatgcatgactaaggaggggaggaccccacatattggtaaccaagacatggaaacgtgtacgaaaggtgagactgcaggcatcctcggagctctaatccatatgatgcaacacct

SEQ ID NO: 13411 - DNA, 847 bp, Zea mays
aggaaaagaagagacactaaatacattttgccacttttacaggggtgagtggcatataaaataccatatcaataacatgtgattaagtggttttcgtaaagatggcaaagaattaagagccccccttagaagagattgtctccagcaagtgcagagatagataaactcgtacaaactacacatggtaaaccccattcaagtgcgaccttgagcagaacgtggtggcagatcatagcactccttggccaggcggacacactgcaaccaatgcagcacctccgaattcgggtccttctccggaaccacatctctaacagtaatctggatcgcaccacgatacgaggcgatcttccctcgcaccctcaagagggtgcctagacgcacctcctctgacattttcagcgccatctctgcagtaggatcatggtctgacgatggcccagaggacgtcctagcattcaagtactggtggttcagccacaggatgcacggcacacacccagtgccgtcgtcgaccaggaagcggaggaacttctccctgcggtcacgcgagacgacgactccgacgagctccgcacgcgcaaccctacggccgcagcggaggaacgtcgtcggagaggtgtgccgtacggttaaggagagaaggtccgcggcgagaatcttgacgtgcacgagatggagaggttggtccatttcagaattacacgagaggcggaagcgatggagcgggaagggcttagcatcgacgccggaccgccgcgcgcacgagaggcgcggtggcgaccgggagcttggtgaagacgcagcacgcggaccgctgcacccggaccgaggatcccaatcgccc

SEQ ID NO: 13412 - DNA, 1250 bp, Zea mays
  misc_feature (797)..(797): n is a, c, g, or t
ttgatgcatttccatctagtttaggtttggtggtaagaaatttcttgatacgtgtatcaaaagtaggattgtggtgttgaggcatggatacctgatgttcatatggatttttagttgtaaaatatcttattttggaatgaaataacatgcctggaactggaatttagcagaagttgcatatgtgccttcacatgctataccaattcagtaacacatgcatttgtgaacttgttaaccgattctttttgtttgctcggtggcgctttttttttgggtgtttgaaaacaaagttatgtgatgctaaagctgaattagcaatatattttcatttactcgagcaggtgctggacacaaatcctgtgcatgcgaaagctctttaccgccaaggaatgtcctacatgttactcggggaatttgatgatgcgaggaatgattttgagaaggttggtaacaccacgctcgagtcagtcgagtgccatgtttaaatatgcgtcaccttgtctaatctacacgtgattgcattctcgtattatagatgattaccgttgacaagtcatcagaaccggacgctacagctgccctccttaaacttaagcagaaggaacaggtacgcaagagagcaacattaacccaaaccgtttaagctttggagctaacaacaaaatggcaatatatgtaaatcaggaagctgaaaagaaggcgaggaagcagttcaaagggctctttgacaagaagccgggagagatatctgaagttggtgtagaatcagagggtggaaaggatgcgggtgatgcaangggctctggtgaggcaacaagtgctgatagaggtgcaaatacaatggatagtccgaccagagaattagagtacgcattcgaggaagagaggcctgggcttcttggccgcttgtggccttctgcgaggaggatcttctcgtctgttggcataaacaggtgcacaatactctaaggtgtttaattcctactagggtgactttggaaatcgtggcggtgaagatgaactgccccgaggtttgtggtgtttattagagtttcctgacgacgaaaaaaatggcgaggaatgtttggatgtatggaaaatgaaccgtgtgcatgataatgtaaaaaatgagaaataaattgcagggaattttattcgcagtttggatggtgcgttttagtgacggtgatgccactgtgcatgcagcgtgccatcatcaagtagcagaggacctaccattcatctcacca

SEQ ID NO: 13413 - DNA, 2409 bp, Zea mays
ggggaccggcgagtccaccatcccattcccgtaccacccgcttcttccaactccaactctccaaggcgctgtgctggctgctggcctgctgctaccgactgccgcaactgctccgcatcccggccttgattagcagcagttacgcccgcgcaggacagcggccttgattagcgaagtattcctttgccctacctctctccctaccccattccgacgcggcggccgttgagcacctgcccggaagctatagcttcggccatggccccagatgccggcgaaagcggtggcgaactcccgccgcccgtaaagaagaagtcaccggcggaggaggaggccgagaagaggaggaagaagcttacacctgggagcttaatgaagggcattataaggtctgggagcggtgatgccacccctgcagatggcgatcaggttatacttcattgcactactcggacaattgatggtatcgttgtaaattctacaagaagggagcatggaggtaaaggaatcccactcagatttgttttagggaagagcaagatgatcctaggctttgctgaaggcttcccaacaatgctgaagggtgaaattgctatgttcaaaatgcagcctaaaattcactacgctgaggacgattgtccagttgcaactccagatggctttccgaaggatgatgaacttcaatttgagattgaaatgttggatttctttaaagccaaggttgtggcagatgatttaggggttgtaaagaagatagttgaagaagggaagggatgggaaacacctagagagccatatgaaataacagcacggataactgcaagaacagcagatggaaaagaaattattccgagtaaagaagaggcatatttcttcactattggtaaatctgaggtacctaaagggcttgagatgggcatcggaacaatggcacacaaggaaaaggcaattatttttgtcagtagtacttatttgacgaagtcctcactaatgccacagcttgaaggccttgaagaagttcatttttacattgaactggttcagtttatccaggtgagagacatgcttggtgatggtcgactaataaaacgacgtgtagttgatggaaaaggtgaatttccaatggactgtcctcttcatgatagcctattaagagtgcattataagggcatgctccttgatgaaccaaagtcagttttttatgatacacgtgccgataatgatggtgaaccgttggaattctgttctggagaaggcttggtaccagagggttttgaaatgtgtgttcggctaatgcttcccggtgaaaaatctattgtcacgtgcccaccggattttgcatatgataagttcccaaggccagcaaatgttcctgaaggagctcatgttcagtgggaaattgaactacttggattcgaaatgcccaaggattggactggcttaacttttgaagagatcatggatgaggcggacaaaataaagaacacgggtaacagactgtttaaagaaggaaaattcgaacttgcaaaggcgaaatatgataaggtgcttagggaatataaccacgtgcatcctcatgatgatgaagagggaaaaatctttgctaattcaagaagttccctacatctaaatgtagccttttgctaccagaagatgggcgaatacagaaaatccattgaaacatgcaataaggtgctggacgcaaatcccgtgcatgtgaaagctctttaccgccgaggaacgtccttcatgttacttggggacttcaacgatgcaaggaatgattttgagaagatgattaccattgacaaatcatcagaacaggacgctacagccgcactccttaaacttaagcagaaggaacaggaagccgaaaagaaggcgaggaagcagttcaaaggactctttgacaagaagccaggagagatatccgaagttggtgtagaatcagatggtggaaaggatgcaggtgatgcaagaggcaacggtggtgaggcaacgagtgctgatagaggtgtaaacacaaatgacagtccgaccagcgaatcagagtacgccttcgaggaagagaggcccgggcttcttggcagcttgtggccctctgcgaggatgatcttctcgtctcttggcatgaacaggtgcgcgatactctgaggtgtccagtttgtactgaggagacatccaaaatcatggcagtgaagaggaactgccccgaggtttctggtatttatttattagagtaagtttggatgtatggaaaatgaaccgtgtgcaagatgtaaatgagaaacaatatgcagggaattttaatagctatctaggattcattatcttccacggcataaaataatttcccaggtttcttctaaaaaaaaaaaaaaaaaagccgccagagtcttctagaacggc

SEQ ID NO: 13414 - DNA, 1575 bp, Zea mays
caatactgtagttaccaaaattatttgctgtgctcactggtcagttatggagggttcatgccattttagattgcgctgattctcttagctaaatatgtagatgaaagagatttggggattttaagtattctgattcatttgcattgtctgcttgagactacaatctttcttttagatgtaccttttattctgttcttaagaaagatgtgacctttccaagtttcctgctaaactccataaaaaggttgtgtgatgaatgcatttacaggtgagagacatgcttggtgatggtcgtctaataaaacgacgtgtagttgatggaaaaggtgaatttccaatggactgtcctcttcatgacagcttattaagagtgcattataagggtattctccttgatgaaccaaagtcagtgttttatgatacacgtgccgataatgatggtgaaccattggaattctgttccggagaaagcttggttccagagggatttgaaatgtgtgttcggctaatggttcctggtgaaaaatctgttgtcacctgcccaccagattttgcatatgataagttcccaaggccagcaaatgttcctgaaggagctcatgttcagtgggaaattgaactacttgggtttgaaatgcccaaggattggactggcttaactttcgaagaaatcatggatgaggcagacaaaataaagaacacgggtaacagactgtttaaagaaggaaagttcgaacttgcaaaggcgaaatatgataaggtgcttagggaatataaccacgtgcatcctcatgatgatgaagagggaaaaatctttgctaattcaagaaattccctacatctaaatgtagctttttgctaccagaagatgggtgaatacagaaaatccattgaaacatgcaataaggtgctggacacaaatcctgtgcacgcgaaagctctttaccgccgaggaatgtcctacatgttactcggggaatttgatgatgcgaggaatgattttgagaagatgattaccgttgacaagtcatcagaaccggacgctacagctgccctccttaaacttaagcagaaggaacaggaagctgaaaagaaggcgaggaagcagttcaaagggctctttgacaagaagccgggagagatatctgaagttggtgtagaatcagagggtggaaaggatgcgggtgatgcaaggggctctggtgaggcaacaagtgctgatagaggtgcaaatgcagtggatagtccgaccagagaatcagagtacgcattcgaggaagagaggcctgggcttcttggccgcttgtggccttctgcgaggaggatcttctcgtctgttggcataaacaggtgcacaatactctaaggtgtttaattcctaaatcatggtggtgaagatgaactgtcccgaggttttgtggtgtttattagagtttcctgacgacgaaaaaatggcgaggaatgtttggatgtatggaaaatgaaccgtgtgcatgatgatgtaaaaaatgagaaataaattgcagggaattatattcgcagtttggatggttcgttctaaaaaaaaaaacaaaa

SEQ ID NO: 13415 - DNA, 2463 bp, Zea mays
gcgcttctctcggtgccctgcctcgtgcctcctactcccaccttcatcaggagctcagtcgccggccgctgcgccattccacactaccccgcgctggactggagtcgagttgagctcacgctctcgcacactcgcactcccattcccactggccagattgatcttgcttcgctaatcatcctagatctccattcccgcccatgggatgcttccagtcgaaggtggcggggcccctgccgcccaacgacgccgccgctctccccgccgacaagcctgcagatcctgaggcggcgaatggcggcgccgacggggaaggcgacggtgacgacaaggaggctgtgaagcgcgcggtgccggtgttcagggagtttgcgctggccgagctgcgcgccgccaccaagggattcagcgccgacctcatcgtctccgagagcggcgagaaggcgcccaacgccgtctaccgcggccgcctcgacggcgggcggctcatcgccgtcaagcgcttctcgcgcctctcctggcctgacccgcagcagttcctcgcggaggcggcgggcgttgggaaggtgcggcacaagcgcctcgtcaacctcattggctgctgcgccgagggtgacgagaggctgcttgtcgccgagtacatgcccaacgacaccctgtccaagcatctcttccactgggataagcagccgttaccatgggaaatgaggctgagggttgcatatttcattgcgcaagctctcgaccattgcaatgctgagaacaggaaaatctatcatgatttgaatgcttatagggtactttttgatgaggaaggtgatccccgcttgtcaagttttggattaatgaagaacagccgtgatgggaaaagttatagcactaacctggcttacactccaccagagtttctacgaactggcagagtaattccggagagtgtgatctatagctatggaactgtcctgttggatcttttgagcggaaaacacattcctcctagtcatgccctagatttaataaggggaaagaatatactgttgctgatggattcctccttagaagggcagtatgctaatgaagatgcttcgaaattggttgatcttgcatcaaagtgtctgcaatttgaatctagggatagaccgaacataaagtatcttctgtcttctgttggtcctcttcagaatcaaaaggaggttgcatcacatgtgttcatgggtattacaaaagccacatcagtactgccaaccatttgttctccactcagaaaggcctgcactggtatggatctttcagcggtgcatgatattttgctcaaaacaggttataaagatgatgagggtgcagaaaacgagctatcctttcaagaatggacccagcaagtgcaagagatgctgaacacaaagaagtttggtgacattgcatttagagacaaggattttaagactgcaattgactactactccaagctagttgcgatgatgtcgacgccttcagctacggtttttgtcaggcgcagtttttcctacttgatgaatgggcaagcagagctcgctctacgggacgccatgcaagcccaggtctgcatgcccgagtggcctacggccttctacctccaggccctggctctttcaaagctcggcatggaaaccgatgcccaggacatgctcaacgatggcgccacgtttgaggccaagaagcagaacggctggcgcagttaggagccgacgacgaacaaagtctctcttccaacgactccgtgccgttgccctttgagagaaaaaggtacaatggcgagtctcctccaaatcagttcactgggacacgcctgttgcactactagtagtgggattgaaacgcactgttttatcgtgcaatctcctctcgaatgtcggtaacgagtgatgatcatgatcaggggtggaaaaataggtcagggcctttgaacgcatagcgtactcttccgtgggttgcgctttgtgttgctggcgatggtggcaggatctgcctgattgttgcaactgcagttgtaattaaagggatgctttctaacaccttctggttttacgtggaatctttgggccccagagcacatgagcggtgtgctgtgtgcaaaaagcggagttcattgtgattcgaagaataaactagagccgtcgggattccattcgattcagccatatttatatgcggtgttatctttttttttccttttttatgatcaattctgtttgtttcttgaatcttgatcggtcgagtcgattcagacagccagttgcacatccaccgatttggtttcaaagcagcaggttaggttagagtagctaagctatttgagttgtattgctaataattagctagaccattagctgtcccgttctaattctctctagttttagcggttaactattggtttgaggtttgctaattgtcgtaaagaacttgcaaataaaaaaaaaaaaaaaa

SEQ ID NO: 13416 - DNA, 869 bp, Zea mays
cattgggtacctcgaggccggccgggaaaaagcccaaacccgcatctacgttctactcccactcgcggtcgcggtagccggcggcggcggcggaggaaagcaggcaggccatggcgtcgtcgtcgtcgaccccggcggccgtccgcgagatgcagaaggatctcgaggtccaggccaacgccctcagcaagatccagaaagacatcgccaagaaccaccaggtccgcaagcagtacaccatccaggtcggcgagaacgagctcgtcctcaaggagctggagctgctcagcgatggggccaacgtgtacaagctcatcggaccggtgctggtcaagcaggacctcgcggaggccaaggccaacgtcaagaagcgcatcgagtacatctccgcagagctgaagcggatggatcgggcgctcaaagacttggaggaaaagcaaaacagcaagaaggaatcgatattcaagttgcagcagaggatgcaggctgtacaagctaaggcttagacaactgtttgttggttgcaactagtccaaggccatgcttcatttcatcccaattccctccaggtttttttttggtggggaggaatcaggtgtctgatgttctcgtctccacaacgaaaaagaaagaaaaacggttcctagtgaaatactaggctattctgtatgccctagtataaaagtgtgcctctagtagaactgtagaagatgtagttatcagtatctcttttgtattattggcccacgtttacttctcaatcgaatatttatgcgagggatgtttgtcaacgccttaggcttcatcttgaatttatgactttcattgcttgagtgggcccatgcctaaaaaaaaaaaaaaaagcggcc

SEQ ID NO: 13417 - DNA, 2446 bp, Zea mays
ccgaaatttaaagcccggtctaagcccgtctacgggccgtggtagtccgatccatattatttcgtgccggtccatgttttgggctcctgttttttgagccgtgctcgtagtggctaaaaaaacccgttccatattctcagcaatagtcgtcagtcaaccccagccactcatgttcatgagcacgcaaactgacatcgcttccatttattattatccacgtggagccttctcattggtggtgtctcgatctgttccaaccatatcaccattgtccgatcagcatgtacataatagccacaaactctggaaaatatctttatatacgataataatgatacatagcataataatagaatccacacatatatatgcatggtgtttggtagttcctcgctgtcgtcgaaaatgtacatactgctgttgacgagccgcatgtgaacggaaatggcattggtcacttaggatatttgaccataagcggacgactaatctcaaccatttataattattggaggcaaaaatgatgatgtggtgcacgaggttaggctattattgtataggactatgtcataccgatcgatggacggagaagcggaggacctcttttttaatgcaagactatactacaataacgacacacaatgatatttgatacctataaaataataaatttaatgtgaaattataataacaaatattacattttatcttagccaatatgtcgagaaagatatgagttgaaaaagaacttcacccttttttatagctcagtcagtcgctcgtccttcttcagttagtgaggcagtactatgtgaaagcactgcgttgtatgtggctttctgtcgtagtgctttcttatgaccaatctatgatgatgtaacggctcattcttgatgtaatgaccattggtaggcgagaagcggtgaaaatgaatagatctacgtgtgaagtcgcacgtacgtgacgcgggaaactgatcctttgaaggaacagagaagtcatgaaaaaattactcgtatgaagcatctcataaagatagtttgagatcatttcaatgggcatcttcttgcttgtcgtacttcacaaagatgctctcgtcaagctctttgtcacatgcacacactcaaagataggagttgtataagacattgttctgctgagccatcgtatatacggagaggaaaaccggatggtttagtacgtcggatgtgtgatgcggatgccatcgtcaccgctgcaacgccagcaaaatgacgcggcccgcccggcgaaatcattgttcaattgttgcagtcattcgtgtttatatatgccctcccgtctgacacgcagtcagtatctgtactaactattaagggggcagtgtagactgcccccgtctacgaatcccatccgccgctccgtctcctccgctgcgaaaccagccgtcacccgcacgccctcacgctccgcgaatcccccgccgcgcctcaagctccgcgtagcccacccatcgcaatcatgttcgccttttttccgccgccaaacccgtccctcccccagcatcgcagcttctctcgcctcctaagacgcatccctcgccccccatcacagctgcgggctcgcgcaagcatcgtccctcccctccacagcatcgcagtcgtgggcgtcctcccgcttctctcgcccggccctgtccccgccgtgctggcacccgcccgaggcacccgcaggaacgccatccatctaggttcaagagggccgccgccccattatcgtcctcatcactgacgcccagaacccccaggtccgcaagcagtacaccatccaggtcggcgagaacgagctcgtcctcaaggagctggagctgctcagcgatggggccaacgtgtacaagctcatcggaccggtgctggtcaagcaggacctcgcggaggccaaggccaacgtcaagaagcgcatcgagtacatctccgcagagctgaagcggatggatcgggcgctcaaagacttggaggaaaagcaaaacagcaagaaggaatccatattcaagttgcagcagaggatgcaggctgtacaagctaaggcttagacaactgtttgttggttgcaactagtccaaggccatgcttcatttcatcccaatgccctccagggtttttttttggtggggaggaatcaggtgtctgatgttctcgtctccacaacgaaaatgaaagaaaaacggttcctagtgaaatactaggctattctgtatgccctagtataaaagtgtgcctctagtagaactgtagaagatgtagttatcagtatctcttttgtattattggcccacgtttacttctcaatcgaatatttatgcgagggatgtttgtcaacgccttaggcttcatcttgaatttatgactttcattgcttgagtgggcccatgccaaaaaaaaaaaaaaaaactcgagggggggcccgg

SEQ ID NO: 13418 - DNA, 5630 bp, Zea mays
ttaggagtagctctagtttagccccctctacctcaaatctctgtctctcttcggctctacgtcgactagaggcatcttagatggcatgctgacactaaaacacactctaggatctctcctcccgatggagtccctcccgagaggtaagatctagatctgttgtgaaaaagaccatgtgcgccattgagccctaggtgtggaccatccggacatacgcagatgaggagctgattctgcaccagatcgcagaccgttcatgccttcatagagagcactatcagacgatccgttctagcgtttggcgtctagatcggcgccaacagtaatttcttgcctcaccatgcccatcgaggccttgactttgatgtctatagtgagcttggcgcagttgatgcagccgaagcactcttatacaaggcagttagagtattaagtgcgggtagcctaatccacataagtcgtcgacgtgatttcgcagtaaaaaaagtcgtcactccgtaccaaccacgcaacgtgtcctgcatctgcaatattttattttaaataattctagtacagcagtagttatcccacgacctagggaaacacctcaccgccgagaaggagaaaaaaatccagcgagcaagagaaggatgggtggcagtggtacaccgattaaaaaaagcaaaaaacaaggagatcatcagatcaagcagggatgcgcgagcgagacttggggggcgagcccatccacccacgccggccgcaccaccccacccggcggccttcaagtctgcatctgcattctgcagcccaacgccacccgcaccgcttgctttaccagcagtccagcactggccgtctggcccgggccgtccccgtccgttccccctcgccgatgcgagttgctccagccgtcaccgtcaagtaacggcccccccaccccaccccaccccgcgtccaggctccttctgggggaggccgcggctcaccgggctggctgcgcccccccaccggcgcctcctctttaactctcctcgcctccgttaccgtcttccccctttccacctccccccaccccgctgtgctcatccatcgaccgcgacgagcccccgcccgccgattcgactacgtttattttttttatttcatttgatttgattgcaaagcaccgcagcagcaggaggaggggaagggagggatcgttggaccgtcgttcggctggatggtggaggcggttcgtcgatttgagggcaccgggtttcttggacctgcgtaggtacgtgctcctagttcggtcggatcttagatttgggtcctggatgggggtattgatccgggtttcctggacctgcgttgaaaggtaaaaaacaccagccccatttccctctcggccggcggatggacgcgagggaggtgtgaagcctggtcgctaactgatgctcgtggagagattcggaggagaggagcgcgccgtgcggaggcggtggaggaggaagcgccgacgatttggacagcgcagcgacggaaggggagcagcaggcggacgaggagcgagccgccaggaggacgacggccgtcgccgccgccgccgccatgggcgagtcgctgctcaccgcgctctccatggacaccgccacggcccaccacccgcaccagggcccctccaccttcctctccatggacaccgcctcccacgacgacttcgacctcttcctccagccacaggggcccttccgccgctgcctacatgccgcggcggtcgccccccctgacatcaaccttcccctagccgccgacccgtctccgccacctctggcgtcgctcgacgccaacgttgacatgctagatgtcggcctcggcggctcgcagcactacgactcggattcgcccgctgccgctgggccagtctcggccccggcagcagcagcgaccaccatggtcgccgtgtcccacaccaagggctccggttccagtgctgcgcgcaagtgtgtcaagaggaatgttagcatctggggagcgtggttcttcttcacccactacttcaagccagtcatgtctgcggacaaggctggcaaagcgaaggcagccaccaccaccggcgggaacggcaatagcgccacactggacgctttcctggtgcagcacgacatggagaacatctacatgtgggtgtttaaggagcgtccggagaatgccctggggaagatgcagctgaggagcttcatgaatgggcactcacgccttggggagccacagttccctttcagcgcagacaaagggtttgtgcgctcacaccggatgcagcgcaagcactaccgtggcctctctaacccgcagtgtcttcatgggatcgaaatcgtgagggcgccaaatttggcgggtgtacctgaggctgatttaaagaggtggatggagctcactgggagggacgccaatttctcggtcccaactgaggcgagtgattttgagtcctggaggaatctgccgagcacagactttgagctcgagaggccagcaaccgcggctcctgcaaagagcagttcacatggacaccacaagaagttgctgaacggttctggccttaacctctcgacacaaccatccaatcacagttctggggatggcatggagatcacagccacctgtaacaagcgcaggaaggattcctcaccgaccgcaatggaagaggactgcagcaattcgaattcggacaaggcccaagacatggatgtgagccacaccttcgagccatcatggatgaatgacttctcaggtgtgatgcgccatgcttctggaccagtaaccgctgcaaaaacaatatacgaggacagcaagggctacttgatcatcgttagcctgcctttcgctgattttcagaaggtgaaggtttcatggaagaacactctcacaaatgggattgttaaggtatcatgcactagcgttggtcggatgccactcctgaaaaggcatgatcggactttcaggttggcggatcctgctcctgagcattgcccacccggagagtttgtccgggagatcccactccctacccgaatccctgaagacgccactctggaagcgtactgcgatgaaacagggacagggctggagatcattgtcccgaagtttcgcgttggccctgaagaacacgaagtgcatgtgtccatgaggccaccctcgtcctggtgccaatgaaacctgtttccaagcttgcggggggagacacgcatacggtgtggaggtttgccgtaaggctaaggctactgcacaacaaatgcagctcagttttgctaattttgatgggaaaccagtcgttaattgattgaagcattctggtagttggccgccgcagcgtttggaacattttaggaaatatgctacgggtcgcaaggaacatgcttgcattacttagttcttgtatggggatacacctagtgtgttacatttcgtttccgttgtgtcgaaagactggttgtctgctcgatgtgccccgacacgagcaacaatctgtttgtgttgtacacagaatggcaactggatgtataggggcatttatagtcattttccatagattgaggtttgctttgtgggcatcgtgtaaaattcgtctcagattgatggaaactaggaagaaaaagaagatggcagtgtctttagggtttggcaaagttgtaatggggattaggcggtgctgtagcattctgtctagtttccaggaatttgtagaagacaaaatgtaaatctgttgttccgtcatcaatatagaaaagtggtctgtgtctaccagcaaaaaaaaaaaaaaaaaaaggaaccaaccaccccggtttgggccgtactttaatgaggcagagcccacgggtgttgttgcgttctggtctcaactcatgagatcattcagcctgaagattttggcaggtctacgtaacggggttattaggtttgctgttatgtttctgaaaccacttgcagtggatctgtttagtccgggcgcgtcctatgtttaactccacaattagtttaagttttgatacccattgagacggcataatgcttccctgaaagcgacaaagtgactttttcaccccggaagacaccgtgtctctccctcctctgccccgcttttgtgctgcttcatgcggcgcctccctccactccatcattcttatcaggtcattatcagccacgcagccaaagaacgcatggttttgaagccccacgcaagttggcgtgttgttttccttgaccctcctcccccgtcctgccagtgccagctctatgaatcactgtgattgatcggtccgtgtctggcgtcgcgcaggtatggcgaccggcacggcgttgtcacctctgctcaagtcgcgaattgttcggcctcgttttgtgacgtttttcccccctccttgttcctgtatgtgctgatgcacgtgctaggtggacgcacgagctgtatggtgtcggcatccttcgtttctccaggcgcgcggtactagtttccttggcgttgtcctttctcgctcgcagtggcaagctagctaaacaaggattaacaataacaatgtctagtttgccggccggaggaggataatattgatggattaattactcgtacgttttgctagcaatacgatcttggttgactcgagatgaggtgggcatatagtatagtattttatttgacagcgacttgcgagtgcgaagtggcaccttggcgccgtggccccatgctcgcaacgtaaggtaagggtgtgggtggccctcttatctgcacatgcacctcatgttatcatctcgataggcagggcagggcagggcagggcagcgaggtggcctctccgccacccacgggcccgccacccctgcgatcgcgatgcttgcttattggcgcgcggccgctagttgtcgtcccctgtcacacaacgctggctggataattttgtctgcaaaccttttgccgtcgattagaacaagtatactagctagctacctgttcttccatcctgccatatatggtggctttacctaaaatcttttgctttaatctgggcggtcgctttcgtcctccattggttggcttttgtgccctatgctgtacctgtacgggcaagcgtccgggtgctgacgtgttgtcctcccaccccacccccacctccgtcctccgaaggtgaaataagtaatattttgctgacgcgaccggtatactgcttatcaagcgctgcggtgcttgtagcgacgacgacaatcccagcgcctgttgattacaggaagtatagttggaaaatccatccagtagatttggatcttgttttagcgttgtcggcatatccactcaaaaaccattttaaagcaatgtgactagtataaactaataagttcttgggaggataataagcaggagatgatggcctcgacgacagcgattgcgtgatttgcgaagtggcagcttggccccgtcccgccgcagtatctgcgtctcgtcgtttcgataagtggcctctcgcccctcccaaaggccgcccatctgcgagttcgtctgctcccaaaggaagagcagggccctattattgcagcgggtccacgaaagagaacggtggctgggactgggagcaggagggagagaggttgggggtttgataagccaggtcgcggga

SEQ ID NO: 13419 - DNA, 2215 bp, Zea mays
cccctgaggagcttcatgaatgggcactcgcgccttggggatccacagttccctttcagcgcagacaaagggtttgtgcgctcacaccggatgcagcgcaagcattatcgtgggctctctaacccgcagtgtattcacgggatcgaaatcgtgagggcgccaaacttggcaggtgtacctgagtctgatttaaagaggtggatggagctcaccgggagggatgccaatttctcgatcccagccgaggcaagtgatttcgagtcttggaggaatctgccgagcacggaatttgagctcgagaggctagcagccgtggttcctacaaagagtagctcacatgggcaccacaagaggttgctgaacggttctggccttaacctatcgacacaaccatccaatcacagttctggggatgccatggagatcgcaaccatctgtaacaagcgcaggaaggattcctcaccgtctgcaacggaagaggactgcagcaattcgaattcagacaaggcccaagacatggatgtgagccacacctttgagccatcatggatgaatgacttcacaggtgtgatgcgccatgcttctggaccagtaaccgccgcaaaaacaatatatgaggacagcaagggctacttgatcattgttagcctgcctttctctgattttcagaaggtgaaggtttcatggaagaatactcttacgaatgggattgttaaggtatcttgcattagcgttggtcggatgccattattgaaaaggcatgatcggactttcaagttggcggatccttctcctgagcattgcccaccaggagagtttgtccgggaaatcccactgcctacccggatccctgaagatgccactctggaagcataccgcgatgaaacggggacaggcctggagattattgtcccaaagttccgtgttggccctgaagaacatgaggtgcatgtgtccatgagaccgccctcgtcatggtgccaatgaaacttgttccgaggtgtgtgatggatgatgcccttgtagtagttactggtccatccttgttagcgcttgactgatgttttgttttctcctaaccctatatagctcgaggggagacacatctggtgcggaggttccctgttgttaccataagggggctgaggacctactgtccgagaaaccgcagctcagttttgccaattttgatggggaacagtcctaattgattcaagcattctggtagttggcattgcagcatttggaacgtattaggtatatgctatagatcacaaggaacatgtctgcattatgtttgtctgggggtgcataatgtatcataatttgttttcacggtgtcaaaaggctagcttatctgtctgctggatgtgctgcaatccgtgcatcacctgacactagcaatctgtttattctactgaatggctcctggatatatatagggcatttgtcgttttctttagcttgacgtttgctttgtgggtactgttgggaaattcatctcgaattgatggaaactaggggaaaaaaaggagagcttgccagtgtctttaggatttgtcaaaaagttttaacggggattagtggtgctgtagcactctgtctagtttccaggaatttctggaaggcaagtgtaatctcgttggaagctgtatcttatctgtcaccaatatagaattggtcatggcctatcagcaatgccttgtatgctcttaccattcagcacattttgtactgtactgatgagccacggcccacgggtggtgttgttgggttcaatctcatgagatgatttattcatcctgaagcttttgcaggtctatggggttaggtttgctgttatgtttctcaagacttccaatcgatcccgttgagacgacaaagtgaacgctgacacaacggtttctaacgcttcccttgaagtgacaagatgtttggatactttactttaccccagagaggcagggcctagactctctccagcaaggtgcgctatatgctcctctactctatatttagcgcatggtgatcaacttttttcctccaacaacgtgcgctaaagggtccggtaaaatagaggacgtcctcaaccacctccaaatgcagcggctcctctattcgtgtctctctacttcagctccgctagaaatgtacaacaacatgcaatataataagtattgtagctgaattaatgaagaataagtagcagcaagca

SEQ ID NO: 13420 - DNA, 2046 bp, Zea mays
ttatgaatgcggcgcgcagctcgtgccgctcggattcgcccgctgccgctgggccagtctcggccccggcagcagcagcgaccaccatggtcgccgtgtcccacaccaagggctccggttccagtgctgcgcgcaagtgtgtcaggagttttttttttttctggggagcgtggttcttcttcacccactacttcaagccagtcatgtctgcggacaaggctggcaaagcgaaggcagccaccaccaccggcgggaacggcaatagcgccacactggacgctttcctggtgcagcacgacatggagaacatctacatgtgggtgtttaaggagcggccggagaatgccctggggaagatgcagctgaggagcttcatgaatgggcactctcacgccttggggagccacagttccctttcagcgcagacaaagggtttgtgcgctcacaccggatgcagcgcaagcactaccgtggcctctctaacccgcagtgtcttcatgggatcgaaatcgtgagggcgccaaatttggcgggtgtacctgaggctgatttaaagaggtggatggagctcactgggagggacgccaatttctcggtcccaactgaggcaagtgattttgagtcctggaggaatctgccgagcacagactttgagctcgagaggccagcaaccgcggctcctgcaaagagcagttcacatggacaccacaagaagttgctgaacggttctggccttaacctctcgacacaaccatccaatcacagttctggggatggcatggagatcacagccacctgtaacaagcgcaggaaggattcctcaccgaccgcaatggaagaggactgcagcaattcgaattcggacaaggcccaagacatggatgtgagccacaccttcgagccatcatggatgaatgacttctcaggtgtgatgcgccatgcttctggtccggtcctcgaggccggccgggtatacgaggacagcaagggctacttgatcatcgttagcctgcctttcgctgattttcagaaggtgaaggtttcatggaagaacactcttacaaatgggatcgttaaggtatcatgcactagcgttggtcggatgccactcctgaaaaggcatgatcggactttcaggttggcggatcctgctcctgagcattgcccgccgggagagtttgtccgggagatcccactccctacccgaatccctgaagacgccactctggaagcatactgcgatgaaacagggacagggctggagattattgtcccgaagttccgcgttggccctgaagaacacgaagtgcatgtgtccatgaggccaccctcgtcgtggtgccaatgaaacctgtttccaagcttgcggggggagacacacatacggtgtggaggtttgccgtaaggctaaggctactgcacaacaaatgcagctcagttttgctaattttgatgggaaaccagtccttgattgattgaagcattctggtagttggccgccgcagcgtttggaacattttaggaaatatgctacgggtcgcaaggaacatgcttgcattacttagttcttgtatggggatacacctagtgtgttacatttcgtttccgttgtgtcgaaagactggttgtctgctcgatgtgctgcaatccgtgcatcgcccacccgtcacgagcaacaatctgtttgtgttgtacacagaatggcaactggatgtataggggcatttatagtcattttccatagattgaggtttgctttgtgggcatcgtgtaaaattcgtctcagattgatggaaactaggaagaaaaagaagatggcagtgtctttaggatttggcgaagttgtaatggggattaggcggtgctgtagcattctgtctagtttccaggaatttgtagaagacaaatgtaaatctgttgttccgtcatcaatatagaaaagtggtctgtgtctaccagcaaatgccttgtgtacgatcttaaccatccagcacgttttgtgccgtactttaatgaggcagagcccaaaaaaaaaaaaaaaaaaaa

SEQ ID NO: 13421 - DNA, 1861 bp, Zea mays
ctcgaggccggccgggccgggagtccgcagtccgcacgccccagccacacttttgctaaaccctagtaaagatacgatacgaagcgcaaacgcttgcctcatcctcgaattcgccatggcgatgcccaccacctcgtccgcttccccatgccaggcaccgtcgcccgccgggctgcccatttcccctggcgcccgcgctaccatcctctccttcagccgccgcctccgccgcccccatggcgccatcatttctgcgcccactggttgcctgtttcttggtcttcccaagtcgtgctgttctatcacagcctttggtgatgtggcagcggtttctgatgattatgtagaaagctcgccctcaagcagtggatatctgaatagtactatggatgcttcatctcatgaagataatcaatcagaaagggttgctaaaatgaaccaaaactccagagccaataacaaaatgatcaaaatatgtgataagttaattggcgtattccttgtggataaacctacaccaacggattggagaaaattactagcttttagcagggaatgggacaacataaggcctcatttctttaaacgctgccaggaaaaagcagatacagagctgaaccctgagatgaagcacaatcttctcaggcttggtagaaaacttaaagagattgatgaagatgtacagaggcataatgaacttcttgaagtagtaaaatccacaccatctgataaacttggttctattgttgctaagcggcgtaaagatttcacagtggaattcttcaaccacctttactatgttgcagagtcttgtcatgatgaaccagaaaagcaaactgagttggcaaagcttggaaatgattgtgtagatgccctacaagctcatgatgatacaacagggagtcttgaagctttgaatgctgcagaattgaagttaaaagatatacttaattcaccttcggtggatgctgcttgcagaaagatagatgacttggctgagaaaaaagaactggactctgcactagtgttgatgctttcaaaagcttggtcagctgcaaagggcactgacatcacaaaatctgaggcaaaggatataatgtttcacctatatatgactgcggtggcgaatctccagagacaaatgccgaaggatataagaatattgaagcatcttataatgatagaggatccagaagaacggtcaagtgcacttaatgacgcttttactcctggccctgaacttcaaggggacaatgttgatacattatacacgagtccagaggcgctgcacacttgggcaagagctatagttgatgcatattataacagcagagaaggcactctcattgggcaagcaagagacatgatgaatcctaaaatcattaagagagtcgaagagatagtgaagataatcaaggacaagtacctttaagttttagtcatcataaaatgggggtttaacatttctactgattgtacaagtcttgtgcgatgatggtcttttacaggctgctcccgtcaaaactactgccatcgttccagttgaactcctcagcactgacgaaacaatcagtgtttaaaggaaatgcaagttgttgtaactcattacaatgagaaggtgtttgtagcatgtggtatcagtttagctgctacatagatattagcggagtacttgtagctgtcctgactctaacagtgttgtaactgtactagtatcgaaccaggagacatgtatgtgtccaagcattcttgtagagctagtgatctcaaacaatttcaaaaaaaaaaaaaaaacaaaccatttaagggcttgttcggttagctcctaatctatatggattgagtggaattgggtgggttt

SEQ ID NO: 13422 - DNA, 1297 bp, Zea mays
aacccaacctaacccacaagccacacaacccaagcacaaaacacatcaccgcatctttttccttccgagctgtacgtatctgcagagagagagagagatagagagagaaagattaggtcagagaccatgaagcacccgaggccgacggagcaggatgtgtcgctggcgctgtcgctgagcacggactcgtccacgacgacgtccgactcggcggggacgccaccggcgaagcgggcgcgggcgcgggcgcggcggcggggcgccgtggtggccacgtcgggggagggcgagttcgtctgcaggacctgcagccgcgccttcccctcgttccaggcgctgggcggccaccgcaccagccacctgcgcgcgggccgccacggcctcgacctcggcgtcgtcggcgcccgggcgctcaagcagcacaagcagcaggccgccaacgccaacgccaacggctgcgaaggaggcaagcagcggcacgagtgcaacgtctgcgggctcggcttcgagatgggccaggcgctgggcggccacatgcggaggcaccgcgaggaggagatgggcgccgccgacgcctgggtcaccctctggcgcaccgaggcgtcgcgcgccgccgacccgcccgtcttgctcgagctcttcgcttagatcgatccggccggcatagggtcgggctaatccctccttgttatttggggggaggctaactcgtcatctagacatctagtagcgtcggtagtttaatccaggacatgtaaatcgtattggttcgttcgttgccttttttttgtaattacgctagtatagtactagcttctgctgtgtttagcggttcggtcatggggccggttggattccgatacgaatgtcagagaactgatttcattcatactatattgctggaacatataacaggatcgatgattccttggttccaaaaaaaaaaaaaaaagcttactgcagcgcattcgtccgaaatcatcgcgcacgaatcattcgtcaatttgaacgatatccgcgatatgcatgctttttctaaaatgtcccaatggttaattaatttcgttcgcatatgttcatgagcaagttaaaaaaaaatagcggtctggttcgtttaactgattccttttttgtttacccccaacgcgatcgaaggcccatcgtcgaaacgatcgattgttcttccggttcttggaccgtgcgtacctgtcgtcatcccatccgatgatcaccagccttcaacttttagcatcaggcgggcggttctgtggttttgggagggataattattgtatcg

SEQ ID NO: 13423 - DNA, 1755 bp, Zea mays
ttttgtttccacgagcattctagctagggttcagacgaatttctaggaggaggtcgcgcgacatcgtccatccacggcgaaagcaggctcgccgccccacaacagctttgttccattgcatcctccccaactcaggttgtgctgtgcctgggccctggtggtcaggaaagaggctcctccctttccctctccacctcgccgtgcttctccagtccacctcccccctcgtcgttgcttcttccctccccttccctcgtcgtcgcgctatcccgccggtgcgcgggcgtggggccaagcgccgccgaaaggtagcagcagaggggaagacggacacggacgcaatagcgtccacccccgtaggcgccccccgcccaaagactggtggcaggcctcctacaggcagatgctagagccatgtgactccctaccaaagaatatcctggcaaaaggtgcttctcgctgaccatcgaaacacagagcttcatgtctgtccagtccaaggtggttgcgcttggtgcactgatcttcttccttgtctcgtatggctcttgcactaggattgtcaactttaatgcctcccacatcacgaccgacccctactgggtggctgccagggccacttggtacggtgcgccaaccggcgctggcccctatgacaacggtggtgcttgtgggttcaagaatgtgaacctacctcctttctcggccatgacatcgtgcggcaaccagcccctgttcaaggatggcaagggttgtggctcgtgctaccagatacgttgtgtcaaccacccggcatgctctggcaacccggagacggtgatgatcaccgacatgaattactacccagtcgccaagtaccactttgatctcagtggcacggcgtttggtgatatggcacagcccggccgcgacaatgaactccgccacgctggcatcatcgacatccagttcaggagggtgccctgcatctaccccgggcagacggtgaccttccacatcgagcacggctcaaaccccaactacttagcagtgctcgtcgagttcgaagacggcgatggcgatgtggtccaggtggacataatggaggccaactctgggtggtggatgccgatgcgggagtcgtggggatccatctggaggatggactccaagcgccggctgcaggggcccttctcgctgcgcatcactaacgagtcaggcgagacattggtggcttaccaggtcatcccggcaaactgggcgcccaacagctactaccgctccaacatccagtacgaggcttttggctctgctgctggacaggctgctggctctgctgttggactggtcattagctctgctgctcgactgcacacgttaattaccaggatcattggcttgatctgtttggtattgttgtatcatttgcaagggattgaggtgccttagttttaattagcacttgacatgttgggtgtcctacgctgtaggtggtgctgtgtgtctgctggaggcgtcgtcggtccagagtttcatcttttcgaaaaagttttgaacccaaataattttcctatgaatttcgttgattcctgtgtgacaggtagctgatgtagctctgtgggagatgtacatttgtatttggtgctggatagctgggctgtcctgtcttgttctggctgttgtaagggctcacagctttcaaatgttctagaaatcttatatagttataaaacaaaaaaagaatggaagaaagttgttacaaaaaaaaaaaaaaaa

SEQ ID NO: 13424 - DNA, 2486 bp, Zea mays
gcttgcatgcctgcagcccaaacagctgcccagaacagtgcagcccatcggctgcacccggactttcccctctcgttccagcggcctcgagtctggagaggactcgcctgttctagggttcggtgcccagtcgctgctcgcgtctccgccctccggccaggtcactggcgctaggaggcgctaaatcgagttggcgacgcctccctcacccgtccccgatcgacgtcgggaggcattcctggcggcggcggcgtcggcgtccccgcacgcgcgcactactgactcatctgtgcagatcgagccgtcagtgagcatgacagatcttcctttataagaagagttgacaatgtgtgagcatgactgcatgagaccttttactgcgtcatatattttcattgtaatttatatacgcgtcacacttatttttcaacttgacatattaggacatgcctccatatcagttcatgttaacatagaaacgtcctccatattatgagtcaatgatccactctgttttttatgcaacttcaaaaagcaatggacattcctagggggcgtttggcttgaagataatcactctcaaccagccaaacgttcaaaattccaactgattcaggtgggggcaggagagaatcatttcttcatttacactaggagctaaaaaaacattcttcaccctgctgcctattatattctggtggggatcagcagagaaattatcatcagcttaccaccttgttccctcctaggaatccaatggaatcctcaatcaaagaatcaaggagtagagctgaagaatcaggaagtggagctctcccaaagtgggtcctatgttgtcaacctaatccaagcaatagctgcaaacagctcccttgaacatatgtattcatgttgctgcatgtactaattctacttctatcttttggttggtccctgaaaaaacagcttctgttaatttcgataaccggcattcagctctagaagatagctgttgcaaggtaagttttggatccatgtattgcagcttcctttcaaactaaatggcactcctgcagaacattttgtttgcaacatttttttgctcctagagttcaattttaggccaactcaaatgtaagtgcagttccagcccgagtacaactatggaatagtgcagtgcaggcacctacggattggaaatttgtgtttgcgcatgacctgttctatcatgtacatggttttctagatacgccactggagggtgacaagtctggcttgctcctcgacgtcatcatgctctgcacctgaagtttgtggctacgatctgcatacaactccagcgaggcacatccccgtcgagacgtggcacaaccccgtcgagatggatcgatgccgtgctcactgggacgacaccaccacaagaatattcctggacctctgcatcgccgagaaggaaaagcagaactacaacagcaaggggttgaccaagatagggtggcacaatctgtaccgcaacttcaaggaagagacacgcaggtcttatgataccaagcagctgcagaacaagttcaacggcctgaagaggatgtacagcctgtggagactgcagaacgacaaggctggacctggaggaggaggcgggtgggacaagagttcgagcactgttacacaggatgctgacggatgggacaaccagatcacggagaccagtgcagcagaagacttccgtggcaaggcgctcgcgcacgaggacgcgctcgccgttattttcggccccaaagacggcacaaattcgccgtccgtcggtggtggcgccggtgacagaacaccaggcgggggcgggggaggcgaggaagagaaccatgctcgagcgtcaggggacaatgccgcgtgtccgcgggattcggctcgaggttacaggtctggccgtgcgtccccatggtcaagccaggaccaccacatccacatggtcggcagccgcccagccaagaagcctaagaacacggggtactatgccgaaggcgtgtccgagagcatgctcggaagcaggaacgagagcagcagtgccatcaggcgtgagcaagaagaggtggtagagttgctgcagctcgtagaaaaggacggcgtgtctcagggatctgagctgttcttcatagctactgagctgtttaggtcgccgatccgacgcgcggcatttaggtgcatcaccactccgaagaaccgagttgcatggctccggtggacttgggacaatgttaagatgtgatgatggcggcgttcttgcttagttttcagttgcctgtactgagaattcttcctcgggcagttcgtgagaaactagttgtattgtattataccctgtcctgtccgttcttttttatttgtcgtgttttagttgcgacaaatattcgagatcggatttagtattattgtaaatatatacagatttccagcacagcgcgttctgtcaatatatacaatgcacacataaaagtagttagggtaag

SEQ ID NO: 13425 - DNA, 1485 bp, Zea mays
gataagaaatggtgagcaggcaagcatggagtggagtgcttttaaatttgggtgtcgctgtcgttgaaagcgatgggtggctagttttacagacagacagcagcacctgctcctccgtctggactgactgactagtgactcagctccacccacatcccccttcgtcgtcttctccctccctgctagctgacctccaatccacgataaggcaagataagctagctaggaaggcaagggatccgatggacaagtacgagcccgttcgcgagatcggggcgggcaacttcggggtggccaagctgatgaggaacaaggacacgagggagctggtggccatgaagttcatagagcgaggaaacaggatcgacgagaacgtgttccgcgagatcgtgaaccaccgctccctccgccaccccaacatcatccggttcaaggaggtggtgctgactcccacgcaccttgcgatcgtgatggagtacgctgcgggcggggagctgttcgagcgcatctgcgacgccgggcggttccacgaggacgaggcgcgctacttcttccagcagctggtttgcggcgtcagcttctgccacgccatgaacatctgccaccgggacctcaagctggagaacacgctgctggacggcagcccggcgccgcgcctcaagatctgcgacttcggctactccaagtcctcggtgctgcactcgcgaccgaagtcaacggtgggcacgccggcgtacatcgcgcccgaggtgctgtcgcggcgagagtacgacgggaagcacgccgacgtctggtcgtgcggagtcacgctctacgtcatgctggtgggggcgtacccgttcgaggatccaaaggacccaaagaacttcaggaagacaatacagcgcatcatgtcggttcagtacaagatccccgagtacgtgcacgtctcccacaactgccgccacctcctctcccgcatcttcgtccagaacccgtacaagaggatcaccatgagcgagatcaagacccacccctggtacctcaagaacctgccgagggagctcaaggaggaggcgcaggcagcctactactacagccgccagggagacagcagcagcagcagcagcaataatgcgacagcagcacccgcctactcgtcgcagagcgtggaggagatcttgaggatcgtgcaggaggcgcagacggtgcccaagccaccgtccaggcccgacgaagcagagcaacaggaagaagaagacgaccatgacgatgacgacgactacgacagaacggtgcggcaggtgcacgccagcggagagttcgacatgattatgagcagactccaaatctgactcttagtatcttgcctgccattggtagttttgtgttgtaatgcgtgcctgtaacatgaatttcagtcaaactatacactatcataatggtgatggtattgatgaaaatattcagtggtaaaacgccctctaaaaaaaaaacacccccccc

SEQ ID NO: 13426 - DNA, 2182 bp, Zea mays
  misc_feature (2)..(2): n is a, c, g, or t
  misc_feature (1649)..(1649): n is a, c, g, or t
  misc_feature (2147)..(2147): n is a, c, g, or t
tnaaatctggacagaaaagtccagtctgtcgtggtccccgttcctctgctgcagaggtgcaggcaaccaacaaaagcttcccttcccctccagccctccactctcctctccttttcttccgctgttccgcatcgcatcgcatcgcctcgcctcgccgccagcgcaactccagccctggccgggatctctttcacccccccctctctctccgccgcttcgctcccccgtctcggggcctgcctcggatgctcccggcctcgcatccgctgctctacgcctgcgtcttccgcgacacccacctcgtcgccgagctcgaccacgcccactcccactcccagagcaccgccacctccgccgaccccgtcgcttccgacgccccctcccccgcccctgacgacgacctcccggcgctcgccgctgcgctcgtcgccgccgctccgccgcaccaccgccacctcacacacacagccgccgggcgtgcgcacgcgctgctcctgtccccgccgctcgcactcgccgccgtctcgcgggcgccccacctcccggcatcgcagctcctgctcttcctccgccgcctgcgatgcctccccgaggcccggatgcgggacgagatgccgcgcctagcgctgcgcttgccactcccgccgggcgacgacgcgcgcgaggcgaacgaggtcgccgccgcggaggcccacgcggaggaggaggccgcgcggagggacgctgacctagccgcgcggaccacgcccaagagggaccgagcctcgcaccgggggcgggccggacccagctggacgtggaggcggcagctctggatggtcatccttgcggatctcctcctcctcacaatcctcttcgccgcctggctcgcagtctgccggggattcagctgcattggtcggtaaatagctacacaacctccaaggtacgtacgtaaatcactaaatcaaatccatggcctttcttccacttctgttccatgatttggatcattccagggttcacactgacgctctctctctctcacacaacaccaaaaaaaaaatttgactgcttgctagagactggggatccatgtattctgttcactagtcttcaccaatccttccaacctaggacagatcttacgaaattcggattctcactacgatggttttcactcgggatcctacaatcattatcgccatcttgacaaatatgtctccttttgaatcttgaccaagcaatgagagctatggtcagtcgaccgtcgaggatccagaaggctgaggttgtctatcctgctggatgctgcgagtgcgagctgtgtccccacctccagcgcaaatgtgaaatgatgatgctttgtgcagaggctctccctccctcactctcttgtcctggcatccaacattccaactttccatatggaattgtgaaagaagggggccttttttttcttcttcagcttgcggcacagttggttaaggttgcttcttctgatggcaaaatggctgcatccatagctggacatgatgacagcaactgtgtatgatatggttcaagtgcattagttgcttgctcaacgttccaatggtaaagccacatacaggattgcaggtgttaagctcatgattactgctgcaaacaattttcaaataatagcctgngccaggtttcttacccaacatctaataagtacaacccaccctagcgacacaacttcagattagacttgccctggccttagttgcaaaacatccaagctaaagcagaaagggcaaccataacataggagatgtggagtttagtggccatctgaatcgatcagaggagttcagtggtgaggtgaaatctgggcacacatatacttgttgcattccgttagttagttctcaaagaaaaaaagtgttggtctattgtggatgcggtctgaatattagaatttagaatgctcgtgtttctaactatatggaaatagtggcagtgctatgccttgtattctcatatacttctagtattaaaaagaatacctgttctgttctcttagttgtttttatactcctatattatattgctacggttagtataaaacataaatacatgtgttttgtacttttgttgactagcaactatggtttgaatctcccatttaccgatccatttanagagcgggttgattataaagaaaaatataaggtgc

SEQ ID NO: 13427 - DNA, 5136 bp, Zea mays
  misc_feature (1831)..(1831): n is a, c, g, or t
  misc_feature (2414)..(2414): n is a, c, g, or t
cactcaatcaacagctgcctctacaatgacccccaaaagcaaaccctctcaatccatgtttttagaggtggttcaataaaaaattgcttctgcaaatgataatatatgtaagtaacagaagtactgactttctgtgaaagttggtggcagcgacaatggtatggctgctaaggacgaagatggtatcaatgatggtcgatgatgtgggcagacaaagttggtggtgatgacgatggcgaacgtgaggagatgaggttgatggagattgtttggattaaatgctttggggcattgatcagagatgatattaaagagcgctaaaggtctcgaaaatttggaaacggtaaaaaacaaaggatagaccatattttgttgagaaagaccgtcccacacactaaatggtgctctgtgcttgagatgctcgtccttaaggctaattatgattggtctgactatagtttcaattccttatatttcttctcttgtaatggttgtgttcaaaatcaaactcccaacacatataaggcgaagaaggttataagcccatcaacaacggggttgaaaaagatccatccatgaccaaaccatttattgttcaagtcattagataagtgtcccatatacgatgccatttgctataagaataataacctttatgtgaggacgaaccatatggtcgtttcttcagtgggaataagagggaaaataagggtgcaaaaaaggtggttcatgattataaaccatacattgacatgctttagtcaacaatacgaagtagaaatgaattccaaacttggtaatgtggtacctactagtcattgatcatttgaggcatatgttcctaaaacctaagaaagtttcactcatgatatggtaaaggatacaaaaaacatcaaccagctccgaaggatcgaaaatcacttcgacgtgacttggttatgatatcatctacatagaccttaattgttttgcatatatgatcacttaaagcagcatgggttggacgcatatacttaagcaagacatttttagcctattatgtctatttacataacaatgtaacacataggtagttaagaaaataagtgaagctatttctttatcttctctagccatgctaatacggtaaaaactagaatatgcgtctagaaaagattgaagctcacataagaggtgaagatataggggttgtttggtttggtgcctaagacgccacaatgtgccaaacttttctgcctaaccttagttcttcaattcgagcgcctaaggttaggcagattgtggcgccttaggtaggaaaccaaacatgcccatagatccttggcatatggtttattgaggctggtgtagccaatgtacatccacaatttttttgaaggacataggtggcttgcttttgtgtgggatatactatgtataatttacgaagaggaactcggtgaaaatgaaattagttgtaagtcatatagtggtttctaggtaagtagaagttggtaaatgtagtgtttcaagtgtagggaaaatatatataagatttgttcttagacttagggtctgttttggaatcactcaaattttaaaacttggtttatgaaattgatgtggtttcaaacatatcaatttataactcagtttatctagtttcttagaaatcaagaagctaaccactcttagctaaaaaaataaaagtagattgagttgctttcaaataagaccttagttatgtagtatttcacgtgtaagaaaaatatatataagagctgatttggtgaggatccatgggagaaatcccattgctatttaaatgggatccctgaccatcaaatcagtnctaatagttgtcctttgttttacaatattatcgttaacaccaatgctattaatttttgccggtaagtctgagttgatcagtacgaacaagtggatgtaaaaggcatgattctaacactaaatatattgtagagcagcgtgatgtttgaaacaggatcgaccagaccacccgagaaattgttgtctgttgcatcgctgtatgtcagcctgtccgttcctcccctctggtgagaagtttttgtggtcttcatcattcagctagcctctgaaaagctttgaatctgacaccaccatctcactccatcaatactgatgatcatacagttttcaactcaacaacagctggtttctggatgatatttcctctctctccctctctatttcttaaaaaaaatgaatgcaaaaaagcatcagtcaacaaaaaaaaaatgaaggttttggtatactgaactgtcaaggaccactaaatgtgtatgtatgcgctcgtgtacacatctgcatttacacggttggtgagaaactgctgaagaagaatgagctgaaggtattgttcggttgcgcagcatttcagttctcagcgtatnaagctagctaggtgctctcgaatggaggtttgggtcggacaaatcaaccccatttcttttcctggacatttgaaaatgccaatggatgagtctgtggattctaggaggagcaaagcatttagcaagcctgctgtaagttttggagaaggagagtgggttgattttaggacatttgagtcaccatacttaatgtcaccagtggtgtaattgtatactttagcccttgcagactcatcttctttttaatataacaggcaactctcttgccggttttttaaaaaaatggcaatggatcttgtggaatattgcttacttaaatagttaagggttggccagtgcatgcaatcaatcgacagatttgagcctgcattactgctagtctagtcccctagcatatgtaatgctgctagtgcaatggatcatgcctagcatatgttgtttaattggagcatatatagcccttgtctcgaggtgattagagctgtagatccttcttcaaaagctaggtgaccagtgctggaatttcatcataaaattcatctggctactgcctactggtgagggagaaccttggaccttccggttttgtagttgcgacgataaaaaattcagtcaagcaaggccaccaacatgccacacccccacccaaaaaaatatattcggagaatcgatcgagttggatgttctagaacgaactaataagctctgatggattcctgaaccctgattaggtcacctaagctaatgctaatcattcgtggtaatcagcatccgcaaatccaatccaatacttgttccaaatccagacacacacacatccatttgtttttttattcagctttttcctccctctctgtgtgttgtgtgtcaaagacaatctttttttttttgcttggcttttgcagaagcaagcagcactcacactcatctctgtgtcactctcactcagcaccacatccccccagccccatgtgatgtgaagccgcgtgcccgcgtccccaacctctctctctctcctcttctccgttggacgcagagccatcgccttatcacctccaactcacctgttttagtgcactctgtcccgcactctgtccctccctccctgcctgctttggatgaatgccttgagggttcagtcctctgtctccctcctccttccctgaactgagctgcaagctgcagccgcaggcttggctggttgggtcaactgtgccgcgcccttcctcttgttcctgctcaatctcacctctttgatggcttcatcccactgctgccagtgcagcctcttcttcactggcaggcaggttcctctagtctgtagtctcttctgaccggtggttgttgcagtttttaaccgttcttccctctgacagccaggcataggtggcaaaatccagcgccctgtagattcagctccattccctgctgcctgcagctccctgtcaatctttggaagccggccgcagagctttcagttcttgccgctctcctctgctctctcgctcgctcttccgctcacctctgcattcccccctccctctgtctctagtttccttgctggcaaacggacgaaggaaacgggccaagatgggagctttaagcagcatcggcgtcgggctggccgtggtgtcctcgctactcctgctggcgctcaccgcggagctctactacatcttcgtgcacaagcgccggcagcggcggcgcgccgcggccgtctccgacgcggcctcgtctccgtcctcctcctcccgcgagctgctccagctcttttgcttcaagaagccgccgccggagctcgcgtccacctacgccgtcccggagccggcgtccgccgtggccgtgtcagtcggcgacgacgacgacgacgacggcgagacggtggaggcgcaactgatgcggctcggcagcgtcgtcgggcccacgcggctgctgttcaccatcaaggaggagacccgggaggacctcgagtccgaggacggagggcgaggccggagccggagccggagccgcagcctcggtgagctgctgcattgcgccgagacaccgccgttcttcacgcccagggcctcgccatcgcccgtgccgacggcctcgatggacaactcctacaacccgctcttcgaatccccggcggccagcccggtccctacccatgccccgacggtgtcgccgccgccaaagttccagttcctcagggacgccgaggacaagctctaccgccgcgcgctggcccaggaggaggcgatgagggcgcggaggtcgccggcggccgctgccgaggaggatggcgggtacatcaccatcgtggtggataagaacaaccgcgtcatccccatgccgtcgccgtcgccgtcgccacccaccgccgccgccggccatcagtgagcgcgaaactgattagcagatctgttcagatggacaggaggcattcttcagtgttgtgctagtgtagtagctcttgtgatgtagtgaaactttcttctttttttgtttggcctatggtcctgtgaccatgccaaatttgagtcagtgattggatgtatataacatcaaagcgatgaggaatcgacaatttcagttcagaccaatatgtttctcttcatattatcttttatttagtatccttagaagccaatatgcgaccctgtgaggtgtcaaattattgttgtagaaatgtttaagccaaaaaaaaaaaaaaaaaactcgagggggggcccgg

SEQ ID NO: 13428 - DNA, 1871 bp, Zea mays
tactagtacaaaagtaccgtacattgaaattaaaatgtcacagaccacactgcagtaaaaaaacgtttctacacgagagagatagaggacttaatcgtatgctgagtttaagggaaaaagtgaactccattgttttttcacgctaagcagaccacaattgctgcttggtacgaaaagaaaaccgaaccctttcacccacgcacaactccatctccattagcatggacagaacaccgtagattgaacgcgggaggcaacaggctaaatcgtccgttcagccaaaacggaatcatgggctgtttttccagaaggctccgtgtcgtgtggttgtggtccaaaaacgaaaaagaaagaaaaaagaaaacccttcccaagacgtgaagaaaagcaatgcgatgctgatgcacgtaactactctactaccaggcacaccgcacacccaatacggaaagaccaccgcaaacgccaccacgcccacgcctcgccgcgcaccacatctgaaacctccagcccgacgccggcgccggcgccgctgctcgcctgctcgtcacatttcctggtgcccgccaagccccgcgacctgggctccccagctccatccatcaaccgcctgcagccgcggaaatggcagcgccgacgacgctgcgctcggcggcggcgcgggcgcgcgcgcgcgcagcggagctcgtgagagggcggtggccgcagcggcgtctggggacgacgtccgcggcggagacggagagcaaaaagaataaggaggaggaggaggagggggccgggtgggagctctcggcggcgcgggagtactacgactaccgcaagtctatctacggcgacgtcacgcaccgcgccctcctcgtcgacgccgtcggcaccctcgtcgtccccgcccagcccaccgcgcaggtgtataagagcattggtgagaagtatggagtgaagtactcggaagacgagatcctgatgagataccggcgggcatacgagcaaccatggggtggatcacgtctcaggtatgtggatgatgggagaaccttttggcagcacatagtcacttcttctacaggatgttcagatgcacagtactttgaggaactctatcaatactttatgacagaaaaggcctggaagctttgtgaccccgatgccgaaagtgtatttaaagctttgaggaaagctggcgttaaaactgcagtcgtctccaatttcgatacccgtctacggccactcctgcaggccttgaaatgtgaccactggtttgatgcagttgcagtctctgcagaggttgcagcagagaagccgaatccaataatattcttgaaggcctgtgagttactgggcgtgaagcctgaagaagctgtgcacgttggcgacgatcgtagaaatgatatatggggagcgagagatgcaggctgcgatgcttggctctggggcagcgacgttcgctctttcaaggaggttgccgagcggatcggtgttgaggtgacgaagtgactaagtgagctaggatggtgaatatacggaggcagaggtagtacccaggatcgcggtcgtcaaggaagccagtgaccccatccttgtggtgaaattcctgtgctggtttgtaggcttgtagctgtatgtatgacaacttattagggttccgttgaacctgctatgcatgcatgcttgctgccctgacagtgacaggcgaatgcgtcccatgcacttgaatatgagggtctgggttctggacttctgggactcttgagttattgaattattgtcgcctagttagacacaaagttatctgccatgcacttaaaaattgaaggtctggaattctggattgttgtctaatcagacaaagttatctgagcaacaaaaaa

SEQ ID NO: 13429 - DNA, 542 bp, Zea mays
gtgtttgtgtatactctagtaaacactgggagagatcgtgcaaaagtaagcctgttaatgacatgggcgaattctattggaggtttttcgcataattcaggaggccactacaatgagcccttcattgcggaagatggagtatcaggagtgcttctgcatcacaaaacagccaaggataatccacctgtcacttttgctgttgctgcctgcgaaactcagaatgtgaatgtgacagtcttgccagtgtttggtctttctggagaaaaccatgtttccgcaaaggaaatgtggaacaccatgctacagaatggtcactttgatcgggaaaatttcagtgctggtcccagtatgccttcttctccaggacagaaactctgtgcagctgtctcagcctcaacttgggttgagccacatggtagatgtactgttgtgtttgctctggcttggtcctcacctaaagtaaagtttcaaaaaggatgcacatataacaggaggtacacccaattctacggaacttctgagaaatcggctgttaatttggt

SEQ ID NO: 13430 - DNA, 3701 bp, Zea mays
ccactttcttcttctcttccagaaggcctagccctccaccctccgggtaccagtgcgtgcgccgtcgacttcctctcaccttctcgactccatagcgcaccacaccagcgcggcgacagccagcccgcgaggagaaaaactagaagaggaggaacagggagagccatacatactcactggttggattcggtccaatccaatccagccggccgcggcgtgaccagccgatccagagggcgccgaatcgatctgcgggggcggcgcggcgatgcggagggctaccgctggggagcccggtcgccgcgggggatgcgcatgagggcgtccggcccgcgaatcttctggtttggcgggagcccagggggcgcgcaccccggatcggcggcgcgcggcgagggcaggatcgcgtcggtggggctgcggcagtgaccacgggcgcgggggagggtgagaagcggcaactagcacttcggaggcgagcgggcgcgatggtgagcggccacatcttccactgccggaagaactcgtggccggcggaggagtacgtccgccggaccgcgctgcagctgttggatttcgatggcggggcgccgccggagcaggcgtggcggaggcggctcaacagccacgcgaacatcctcaaggagttcagtgtcactttcatggaggcaatgaggatgatgagccttggcctgagactatggtcgtatgttcgggaggaggcgtcacatggacggaaagcaccgatcgatccgttcactaaagagcgctgtaaaccgtcagcttcccagggtgtgccacttggtgggatggggagcggaagcatttcaagaggtttcaggggagagttcaagaattggcacatcatacctggtctttgtgaaagttcgccggtcatggagaaccagttctctatatttgtatctcgagacgggggtaataagaaatactcatcagttttggctcctggacatcatgaaggtctgaagaaaaatagtgactctggaatttcttcatgggactggaatttaagtggtcaacactcgacctatcatgcattgttccctcgggcatggactgtttatgatggtgaacctgatccagaccttaaaatctcatgtcgtcagatatcacctttcattcctcatgattacaaggatagcagtcttccaacatctgtgtttgtgtatactctagtaaacaccgggagagatcgtgcaaaagtaagcctgttaatgacatgggcgaattctattggaggtttttcgcataattcaggaggccactacaatgagcccttcattgcggaagatggagtatcaggagtgcttctgcatcacaaaacagccaaggataatccacctgtcacttttgctgttgctgcctgcgaaactcagaatgtgaatgtgacagtcttgccagtgtttggtctttctggagaaaaccatgtttccgcaaaggaaatgtggaacaccatgctacagaatggtcactttgatcgggaaaatttcagtgctggtcccagtatgccttcttctccaggacagaaactctgtgcagctgtctcagcctcaacttgggttgagccacatggtagatgtactgttgtgtttgctctggcttggtcctcacctaaagtaaagtttcaaaaaggatgcacatataacaggaggtacacccaattctacggaacttctgagaaatcggctgttaatttggtacatgatgccttaacaaaatataaactttgggaagaagaaattgagaagtggcaaaaccccatactgaaggatgaaaggcttccagaatggtataagttcactctttttaatgagctttactttctggtagctggggggactgtttggacagatggtcaacccccagcaatcgatgagaaaaagagtcctggttttaatcaccagaagtcctcaaagaggggtactaaagacaccaatcagggatctgttaaagatagacatgtcaacctggcagtggagcaagtacctcatggtggttacatggctaatggtgatgatcacagtgtatccaagttcgcagcagttcatggatcagaaatgcaagaacaaatcaatggactcaagtcagaagagccaattccttacttgatttcaaaggatggccctgaacacgttggcaagtttttgtatctagaaggagtggaatacatcatgtggaacacatatgatgtgcatttctacgcatcttttgctctccttgatttgttcccaaaaatagagttgagtatccaacgtgattttgccaatgctgtgctgtatgaagatcggcgcaaagtaaaatttttggctgatggtacatccggaatccgcaaggctaaaggtgcagtgcctcatgacctcggaacgcatgatccgtggcatgaaatgaatgcatataacatacacgatacaagcaaatggaaagatttgaaccccaaatttgtgctccagatatacagagactttgctgctacaggtgatatgcaattcggtcgagatgtttggcctgcagtctgtgctgctatggactatatggatcagtttgaccgtgatggtgatggtctcattgagaatgatggatttcctgatcaaacctatgatgcttggactgttcatggaatcagtgcttactgtggttgtctttggcttgctgcacttcaagctgcagctacaatggctcatcgccttggggatcggcactttgctgagaagtacaagctcaagtttataaaagccaaagcagtatatgaggcgaagttatggaatgggtcatatttcaattacgacagcggcacaagtagcaacagtagatccattcaggccgatcagctggcaggacagtggtatgctgcctcgtcgggcttgcccccgcttttcgatgagcacaagataagaactgctctgcaaaaaatatttgaattcaacgtgatgaaggttaaaggaggacggatgggagctgtaaatggtatgactccaaagggaaaggtggacgagacatgcatgcaatcacgtgaaatctggactggtgttacatacgctgttgctgcaaatatgctgctccatggaatggagcatcaaggctttacgaccgcagaaggaatttttactgcgggatggtcagaagaaggatatgggtattggttccaaacaccagaaggatggaccacagatgggcattatagatccctcgtatacatgcggcctcttgccatttgggcgatccagtatgcagtttctcctcccaaggctattcttgaggcccccaaagttaacctaatggaccgaatacatatctcccctcacatggtccgagcaattagcgagataagcattagaaaggtagcacccgacaatagatgtttccctagctctgccttccactgtgaatgctgatccgaaggtaaacatgcagctgctgagcaacttgcaacctttttcggcttttttcggtttctctccttgcccccctttcaaaggtccaggtgggggctcaggagttcttttcttggatcagagggcatatccaaaccaccaccaaactcgtgactcaagagagttcatgttgtataattgtacagcaaactgttagtcacataatctttttttttcactttgaaagttttgtgctgttcacttggaatagagctagaaatcccagaactgggaagctagctggtgtct

SEQ ID NO: 13431 - DNA, 1296 bp, Zea mays
aggacaaaacgcagtcttggctcggcagccgaggcgagaggagcctttgcccacctttgctcactcgcttcgctttccatcctgttgcgcggccgcggcgcaggtgcggttggccatcacaggccaaggacccctcttcctcttccctttgacccaccaccgcccccctcttcccttcttcccccactgtcgccgctcctcgtcttccactctctccactttgctgcttcttctcccttattaatgctcgtgggctcctatgatccgccctccgccgcgggtttcttgatccatccccggcccaaggaagcggaccccggcgaacactcctgacagattcgcccgtccgccgctccctcgattcggtcctccccgtcagcggcaggtgtttaggacctctgcagcatagcatctggtccgtccctggagatgtccggcgtacaggagcagttcgagatcaagttccggctgccggacggcaccgacatcggacccaggcggttcccgccggcgtccaccgtcgccacgctcaaggagaccatcatcgcccagtggcccaaagataaggaaaaaggtcctaggactgtgaatgatcttaagcttattaatgctgggaagatactggagaacaacaaaaccctatcagaatgcaaaagcccgatttgcgacttctctgcgatgacaacaatgcatgtcgtcatccgcgcaccgacttcaagcaaacagtctgataaaagagcagaaaagaaagcgaaaaatttcaggtgcggttgtgccattatgtgacagcattgtgaatagtagcagagagaacgtggccatttcagttttctccctttttttttcctgctctcgctggagtgttgtattatgttcgaggcgctttctcctttcattttgttttgaagtaccgcgtgcaagcttcaacagctgtcaagtgccctttaatcgtgagtgtgcatcaagcacagaattagaaggcggttggctgctaattacccttaatcttgagtttgtcaagcacacaatttgaaggcagtcattagcgtcgaaactacgatgtccaccctatccaatcttccatggtttcacgcttctcttctatatttatgctaccctgggtgacaaatgtttaatgtatgccttccatgctagatgaactttttggaacgccattctaactcatcaatttctattctgtaaaactaaaaccagttgtaatctgccatagatcagtatgcttgctatatgggagtcaaaataaaaaaaaaaaaacggcacgagaaaaactcgtgc

SEQ ID NO: 13432 - DNA, 2548 bp, Zea mays
gtttcaccgttcgatctcgctgccccccaaaacttgtttcgtaaccatcctattttttctctcgaattctttcttgtgattaaggcctggctaatttctattcttcaggtttgcagatcggcgcagttttggtcgcaaaggcgtggtcgttctcctcgagcatcgatttagggttcttcggctttctatgatcaggaggagttgctggattattttatcagggaacagaatggtgtgattcgttgattggattacagtctggatctctcttgcatcaaatggttgagcaaggcaaaccacgaagcatcccgacgaaggcgaagaaatcgccgttcgtggaggtagaggttgacgagattggccaggctagtggggtggtgtttgcaagggaatcaccgctggcgcctaagagcgaccaaggatgcagcgttagccatagtcatggcgacgacgaaacacatgaatcggatgggtgcgtgcaaagccaggggctagacgagcatgggtgggtggacttcggtcactcactgcagctggtgctgttctcgcgacagtggagcctcgctgaaagtcttgttgacctagcagatcagcagccgatgctggattatggcctgtcgattgcccttgatgccatatggtttttgcggacgaaacaggatcttgaggggctcaacagtctgatatcgaagattgtggcctcaggggcaaaggattttgcaagagcaatcctcaggacatcgctgctcgcgtcatgtgttgcagcgtgccaaagcaaggctatcactgtgggtaacagcaaggagatcgtcgcagagagattgcatgatcgtctgcgagattgtccaggtgctgagcatctaaaaatagaggcaggtgccaaggtgcagaagttcatggaatgggctttacagtgtattcatatgcatcattgttctgaagacacacatatgtacagatggaactacaatactctccaagaggtacagcttcatgtatcagcatttaggaccttcttggacatagctggtgacaacttaagtggcaagatttttactgaggcatttgatgcggtctgcttcccccttacactcttctcaagtttatttgaacctggatggtcttctgggagttcagcagtctccattaagggccttttatcatcgctggtggaaggaggcgctgacaatgtaaatcagtgttttcttgaagcagcgcgctttggaagtactgaacttgtacgcattctgctgaaggtcgcatatcagaatagcttggctgtggacaccgatctggctctggtgtatgcctcacattactgcaagttcaaaacaatggaatgcctagttgatgaagggaacgtgagttctttccttggccctctgataaaagctgcagagcgtgggtgcttgcaggttgtccactggttcgtcagtcgaggcgtctctgacattgagatgtgccttgccctgacgactgctgcctccagcggccatttcgtagtggcgtcgtacatgcttgcacatatccctcagcaaatccttgaagctctcagcacacagatcctcaaagccgcgaggggccagggcagcaggccgcttgatggtgtcaccttccttctgagatccaacttcctaagagacgcagctgcaacatatgaggccgcagacatcattgcaaccgggggcaccaacggtgagctcccggacctggttgccttcctgaaagaacactggtcccaggacgcgtttgctgaaggggtgagcgccggtgaaatgcacttcgtgaatgtcatgagggtcctcaggagaggggcgtccccgatctgcctggaggacctcccgcctgagatggtgctcggcatcacgtacctgccactgtaccgtgagtgcctgagcgcgggtgggcagctgttgccccaaaggctgaggggggagctgctggaggcggtgcaccggctcggtgagcccgttggcccggagagccaggggaaggacctcgtgctggcactagagcgccacatgccgtcgttcttggttggatcctgagatgtttccaggttgtaaaagaagcttgtgcaggctataccttgctttaaaaaattgtatggagcagtgttgattaccaacttctggctgcggtggaatcagcaatagatttggcgcgtcacatgtctcgtgatcgtgtagaaagattttgtttttgttttgtattttgcatgagaaagaagtttctttcttgattgcctattgaaggggcctgttcttgttgccagctgagctcttccaattattttccgggctgcgcacgagacgtacatgtgtgctagtggtgctgttagtctagtttgtgttgtgttgtgttgagtgtatgcgttgtgtgcgcgcgggcgcgtgtggtggtgctaagagtagtttctgcgtatactgggccttcagtggtatgcctggtaatctcaataagtatcgctttcaagacatggattcttcagcaaaagggtatttgatgcatgccttggtgggagtaatgtctaggttccgttccttcc

SEQ ID NO: 13433 - DNA, 1483 bp, Zea mays
atgaatacgccttcgtcgaggagtgacggaccacaagttctaatcgcggcggcggactcgccccgtccggccgcccctctcacgctctcgctgtctcgcttcctggccgcgaagctccagttcagtctccgccactcgtgctctcgtagcgtagagcgaggccagggcgggaccagcgtggccggcgagaggggatggcgggctcggccgcgtacgctgcatccgctaccaccgtggtggcgatggccaagggcaacggcaacagcaagggagtcagaggcggcggctccgcgggcaccaacaaggtgacacgacctcctaggattacatctaatgttaagcagaacttgaggattctaaaattttggaaggaatttgaaaggaggcaaacaagtggacctcagcctgctactaggtaccgcaaaaagaaagtaataaaagaagtgcttcctgatgacacagacttctacgaggatccttcttccactcttcacttaacaaatgagggtttggaaattgcttcaccagttattctcgtggatggctacaatgtatgtggttactggggaaagcttaagaaggatttcatgaatgggagacaagaaattgctagacaaacactcattgatgagctggtatctttcagtgcagtaagagaggtaaaagttgtagtggtatttgatgctgccaattcagggctttccacacataaggaaacatataaaggggtcgatgttgtatattctgccgacttatctgctgattcttggattgagaaggaggttgaagctttggtggcagatggctgcccaaaagtgtgggtagtaacatccgatgcactggagcaacaattagctcatggagaaggtgctcttatctggagctctaaaagattggtcaaagagctaaaggaatcggagaaggaactcgatctagaactgaaggaaaccaggtcgacatcgttgcaaggaaaactcctgcagcacaagctgaacccaaaggttgtgcgcgcactgaaaggtcttaggaacaagcttgaagaacaagagcggggaaagaagtgaacaggaaccactggttgacaggaaagagagcaggtgtacagaagtggcgtttgtgcggccgacggacatcaactaacactggaggctggatccactgaaagtttgatgcgaacatcatgtaaatggatctggcttccttttgggtgcagtcagtttggtgtaggcaccatcagagccctgtgaaaaatagaagcactcacgcatggtagcagcttgttattgttgttagctgctgacgctttgaggcatgtcaacaagtagagatggattgcaaatcctaatcaatgtatattactttgtgtgtgtgtgtgtgttgttattgcgataacagtcaaaaccttcctgtaccggcccgcccccccgctcccagcagtgtccagttcaattcacattcagctgaataacaattttttacgtcg

SEQ ID NO: 13434 - DNA, 1916 bp, Zea mays
atttctgtagtttggaatatttctctagagtgtccaatcaagcattttagatcatatttggaattgatgaatcagaaatttgtatttattgtgtacatagatttcagaactatgtacgtagtttttttatgcagatttcagaatcattcaagaataatatcatatttgacgaaaaaaatataaaactttctagaacgtgagaggggtggggtggggctacctgcaaatttgctttattttcaaatttggaatgcatgtgattgcatggtatcccaaacttatgatgagatctcaagtgtgagggggtgaggctacctgcacggcccccgcctcccacgttgtctcactgtgggggtggggctacctgcacggccacaccaccaagctgtttcggtgtttcccgtttccttcccccgtccttgtgtgtggtttaccaccaccattcagcgctactacgtgacttttactctcataattaaattaaagatgctttgacactttaaattttttaaaagtacttgtaatttggaatcgagtgagtgtttactcatatcggtcgtccacgctaccccaccgctctctctaaaacaaatatcttcttcacttcccatcccattcattcatcactcaccagtcaccaccactgccgcgaccgagagagtcagagagagcaggcggcggcaatggctggcgctggggacgagtactactacggcgggccgggccagcgcggcgcgccccacggcctgctgctggcggtggtggtgggcctcgtggtggcgggcccgctgttcctgggcggcggcggcgaggcgctgacggaagccgtggcggagctgctgagcccggtggggctcctcctcctccccgtgtgcctgctgttcctcatccgcctcctctcgtccgaccgcggcgccgcggcgctcgccgacgccttcgccttcggcgggtcccccgacgccgtccaccgcgtgggagggtccccggtcggcgtcgcgttcttgctcctcctcatcctcgcgctgctctactaccgatcctcgctcttcggcggcgacggcggcgacgacgagtaggataggagagctggcggttgcgatctctggctgtctgttgggttggtttctgtaatgcgaggtctgcgaggggcgtctgtgcaaaagtgcgtgtgtaaaatcgagcggaggcggttaatctgttgtttacttggtcggtttgtgacgctgaagcttctgtgcgtgtgttgcgtcgggccatgtgcgtgcgctgtgctcttccccagaaccacgtgtacacgctgtactatcaccccactgacccagaacgccaatgcgtgccagtgaattccacgtttaacttttacaatacaaacaagcaagggaaagggaccgctcctgtaaagtatcacgaaaagaaagcgagaaaagttgtcatgtaaatatatgtttgttagatttatggaagattttaattttttaatttaaattttgaaattattttaatattaatttttttaggttttaggatatcacaggctaatgagaccaacaagatagctagtttttctaaacaatggttttgtaatcctaaggcgctcaggctacccaagtcgcgtttacttgggacaattctccccaggcaattcacctgaagggaacactttccaatggtctacgattatttgcatacttttcataaacgggaataaacgagaacttccaaagatgttttttctttctttctatatagtgtctagcataagaactcaaacttcagaaccggaccaggattaccataagaaactcacttcattaaaacaaacataactacatatggatttccccatttgggaagctccaaacacttccaaaaaaaaaccttagagcagatacaaatcctactcttggattgcgcag

SEQ ID NO: 13435 - DNA, 2614 bp, Zea mays
taattgatttaacttttcatatatatcattgaactgtacaagttttcaggtcttggatttgtcttacaaccgctttactggaccaatcccattcaacattggtttcttacaagtggctacactatccttgcaagggaacaagttcactggcccaattccttcagtaattggccttatgcaggctctcgctgtcctagatctgagttacaaccaattatctggtcctataccatctatactaggcaacttgacatacactgagaagctgtacatgcaaggcaataggttaactggatcgataccaccagagctaggaaatatgtcaacacttcattacctagaactgaatgataatcaacttactgggtcaattccaccagagcttggaaggctaacaggcttgtttgacctgaaccttgcgaataaccaccttgaaggaccaattcctgacaacctaagttcatgtgtgaatctcaatagcttcaatgcttatggcaacaagttaaatggaaccattcctcgttcgctgcggaaacttgaaagcatgacctatttaaatctctcgtcaaatttcataagtggctctattcctattgagctatcgaggatcaacaatttggacacgttggacttatcctgtaacatgatgacgggtccaattccatcatccattggcaacctagagcatctattgaggcttaacttgagcaagaatgatctagttggattcatccctgcggagtttggtaatttgagaagtgtcatggagattgatttatcctataatcatcttggtggtctgattcctcaagaacttggaatgctgcaaaacctgatgttgctaaaactggaaaacaacaatataactggcgatgtctcttctctgatgaactgcttcagcctcaatatcttaaatgtgtcatacaataatttggctggtgctgtccctactgacaacaacttcacacggttttcacatgacagctttttaggtaatcctggactctgtggatattggcttggttcttcatgtcgttccactggccaccgagacaaaccgccaatctcaaaggctgccataattggtgttgctgtgggtggacttgttatcctcctgatgatcttagtagctgtatgcaggccacaccatccacctgcttttaaagatgccactgtaagcaagccagtgagcaatggtccacccaagctggtgatccttcatatgaacatggctcttcatgtctttgatgatataatgaggatgactgagaacttgagtgagaaatacatcattggatacggggcatcaagtacagtttataaatgtgttctaaagaattgcaaaccagtggcaataaaaaagctgtatgcccactaccctcagagccttaaggaatttgaaactgagctcgagactgttggtagcatcaaacaccggaatctagtcagccttcaagggtactcgttgtcacctgttgggaacctcctcttttatgattatatggagagtggcagcttatgggatgttttacatgaaggctcatccaagaagaacaaacttgactgggtgactcgcctacggatcgctcttggtgcagctcaaggcctcgcttaccttcaccatgactgcagcccacgaataattcaccgggacgtaaaatcaaagaatatactcctcgacaaagattatgaggcccatcttacagacttcggcatcgctaagagcttatgtgtctcgaagactcacacgtcaacctacgtcatgggcactattggttacattgatcccgagtacgcccgcacctcccgcctcaacgagaagtctgatgtctacagctacggcatcgttctgctggagctgctgaccggcaagaagccagtggacaacgagtgcaatctccatcacttgatcctatcgaagacggcgagcaacgaggtcatggagacggtggaccccgacgtgggagacacctgcaaggacctgggcgaggtgaagaagctgttccagctggcgctcctctgcaccaagcggcagccctcggaccggccgacgatgcacgaggtggtgcgcgtccttgactgcctggtgaacccggagccgccgccgcagccgcagcagcagcagcagaaggcgcacgcgcaccaccagctgccgccgcagccgtcgccgccggcctacgtcgacgagtacgtcagcctgcggggcaccggcgccctctcctgcgccaactcgtccagcacctcggacgccgagctgttcctcaagttcggcgaggccatctcgcagaacatggtgtaggggaagacgtagacgttcggtgaggcgccttgagtgaggccgattgcagggggagtagtttgactgacattttgtgggacgcagcgcaggagattaacatgggactcagtagctagggtgttgttagctgtaaaaaaagtcatgtgacgcaagagcagcggagcttcttcctcttctttatcccccctccccatttttctttggtggtctaacttactaggaggctgtattgatccatcatcatctctcccgttcctctgcttgatgatcaaataagaaaaaaaaaaaaaaaaaactcgagggggggcccggcac

SEQ ID NO: 13436 - DNA, 925 bp, Zea mays
  misc_feature (919)..(919): n is a, c, g, or t
gggcgattgggttcctcgaggccggccgggttggcaaaggtcggggcagagaggagaggaagcagcgagaggagccgaggaagaatatatccatcctaacatccacccacccacacaccagacacacataccttattctccgccgtttcttggcctccggaaatctcctcccccaagttgcaagcatgggcgggttcagcctcagcggcgctacaggtctcgcggcgtaccgcgaggaagacgacgaggagctgttcgagacgtcgtcttcgatctccggcgactccgacgatgagggccaccagctctccgatggagaggggggcgcctatgatttgtcatctgtgatggcacagctccctgtcaagaaagggctatccagatactacgacggcaagtcccagtccttcgcgtgcatgtctgaagtgcgatgcctggaagatctgcgcaagaaagagacgccctacaagaagatcaagacatcaaggagtagcgtcgcgttagacgaagagcaggactgtcatacgccgggtcgtacgaacagcagcagagcgcccggaagttgttgcgcaaacctggtggctcggaacaacggcaaaaacatgctgtacagacctcccccagtccctgtaaacaaaagtggataccgtcagtaggctctaggacattactggatgatatctatccagggtttcacctcttgttttttttccatttttgagggattttgttgacaggcgtattggcctgtctcagatgtaatgtaagagggtttccttctctgctcttagcagagttatctcctatgatcttgtccatgagacattggttcgtgtaaataatagtgatgttgtaaccaaaaaaaaaaaaaaaaaaaaaaaaaataagggggggccccggccccgtgcccccctggggnaaaaaa

SEQ ID NO: 13437 - DNA, 892 bp, Zea mays
cattgggtccctcgaggcccgccgggaaaaaggaaaggtcgtggaagagaggaagcagcgagaggagccgaggaagaatatatccatcctaacatccacccactcacccacacacgcaccagacacacataccttattctccgccgtttcttggcctccggaaatctcctcccccaagttgcaagcatgggcgggttcagcctcagcggcgctacaggtctcgcggcgtaccgcgaggaagacgacgaggagctgttcgagacgtcgtcttcgatctccggcgactccgacgatgagggccaccagctctccgatggagagggcgcctatgatttgtcatctgtgatggcacagctccctgtcaagaaagggctatccagatactacgacggcaagtcccagtccttcgcgtgcatgtccgaagtgagatgcctggaagatctgcgcaagaaagagacgccctacaagaagatcaagacatcaaggagtagcgtcgcgttagacgaagagcaggactgtcatacgccgccgggtcgtacgaacagcagagcgcccggaagttgttgcgcaaacctggtggctcggaacaacggcaaaaacatgctgtacagacctcccccagtccctgtaaacaaaagtggataccgtcagtaggctctaggacattactggatgatacctatccagggtttcacctcttgtctttttttctttccatttttgagggattttgttgacaggcgtattggcctgtctcagatgtaagagggtttccttctctgctcttagcagagttatctcctatgatcttgtccatgagacattggttcgtgtaaataacagtgatgttgtaacctcttcaaaaggtccaggtaacttgcctattttgtgg

SEQ ID NO: 13438 - DNA, 970 bp, Zea mays
cggacgcgtgggcgtttgggccgggggcaaaggtcgtggaagagaggagaggaagcagcaagaggagccgaggaagaatatatccatccacccacccacacaccagacacacataccttattctccgccgtttcttggcctccggaaatctcctcccccaagttgcaagcatgggcgggttcagcctcagcggcgctacaggtctcgcggcgtaccgcgaggaagaagacgaggagctgttcgagacgtcgtcttcgatctccggcgactccgacgacgagggccaccagctctccgatggagaggggggcgcctatgatttgtcatctgtgatggcacagctccctgtcaagaaagggctatccagatactacgacggcaagtcccagtccttcgcgtgcatgtctgaagtgcgatgcctggaagatctgcgcaagaaagagacgccctacaagaagatcaagacatcaaggagtagcgtcgcgttagacgaagagcaggactgtcatacgccgggtcgtacgaacagcagcagagcgcccggaagttgttgcgcaaacctggtggctcggaacaacggcaaaaacatgctgtacagacctcccccagtccctgtaaacaaaagtggataccgtcagtaggctctaggacattactggatgatatctatccagggtttcacctcttgtttttttccatttttgagggattttgttgacaggcgtattggcctgtctcagatgtaatgtaagagggtttccttctctgctcttagcagagttatctcctatgatcttgtccatgagacattggttcgtgtaaataatagtgatgttgtaaccacttcaaaagatccaggtaacttgtctattttgtggtcggatcgaagagacaaagtgggtaaaaaaaaggaaagcttttgcataaaaaaatgagaaaaaaatagtattcggttaaaaaaaaaaaaaaa

SEQ ID NO: 13439 - DNA, 775 bp, Zea mays
  misc_feature (513)..(513): n is a, c, g, or t
gggcaaaggccgtggaagagaggagaggaagcagcgagaggagccgaggaagaatatatccatcctaacatccacacaccagacagacacacataccttattctccgccgtttcttggcctccggaaatctcctcccccaagttgcaagcatgggcgggttcagcctcagcggcgctacaggtctcgcggcgtaccgcgaggaagacgacgaggagctgttcgagacgtcgtcttcgatctccggcgactccgacgacgagggccaccagctctccgatggagagggcgcctatgatttgtcatctgtgatggcacagctccctgtcaagaaagggctatccagatactacgacggcaagtcccagtcgttcgcgtgcatgtccgaagtgaggtgcctggaagatctgcgcaagaaagagacgccctacaagaagatcaagacatcaaggagtagcgtcgcgttagacgaagagcaggactgtcatacgccgccgggtcgtacgaacagcaanccggcccggaagttgttgcgcaaacctggtggctcggaacaacggcaaaaacatgctgtacagacctcccccagtccctgtaaacaaaagtggataccgtcagtaggctctaggacatgactggatgatatctatccagggtttcaccctcttgtttttttttcttctccattttttgagggattttgttgacaggcgtattggcctgtctcagatgagggtttccttctctgctcttagcagaattatctcctatgatctt

SEQ ID NO: 13440 - DNA, 1765 bp, Zea mays
ccacgcggctgctttttttgttgacgttacagctgcagccctgctcttacctaccaaagccgctccaatgatgaactcgcttgtatcattacttcgttagccacttccctcacacatcctgtttcttgccgcactagaaacgtcgatccagcaatggctgctaccccgaccatcgttctggtgcccgtctggggcattggccacttcgtaccaatgctcgaggtcggcaagcggctgctcgcacgcagcgcactgcccctcaccgtcaccgtgctcgtaatgccgttgcctgcagaggcgaagcgggcgtccgagatcaccgagcacatacgccagcaggaagcctccggcctcgccatccgcttccaccatctgccagcggtggaacccccaaccgaccactcgggcatcgaggagtacatatcccgctacgtgcagctgtactcgccccacgtcaaggcggccgtcgccgggttgacgtgcccggtggccggcgtcgttgtcgacatcttctgcacggcgctgttcgacgcggcgcaccagctcggcgtgccggcctacgtgtacctgatcaccagcgccgcgatgtgcgcgctcttgctgcgctccccgacgctcgacgaggaggtagccgtcgaggtcgagttcgagcaaatggaaggcggagtggacgtgccagggctgccgccggtgccggcgtcctgcctgccgacggggctggagaacagaaagatcccgacctatcgctggttcctgtacaacggcaggcgctatatggaagcagcaggcatcatcgtcaacaccattgccgaggccgagccgcgcgtcctcgcggccatcgccgacgggcggtgcacgcgtggtgtcccggcacctccggtgtactcgatcgggccggtgatcccctccaccccgcccgccgagcagcaggcgcaggagtgcgtgcgctggctcgactcgcagcctccgagctccgtggtgttcctatgcttcggcagcggtggctgcttcacggcgccccaagcgcacgagatagcgcacggcctggaccgcagcgggcatcgattcctgtgggtgctgcgcgggacgccggagcccggcacgaagttgccctcggacgggaacctcgcggagctgcttccggcggatttcttggcgaggacgaaggatagagggctcgtgtggcctaccaaggcgccgcagaaggagatactcgcccacgccgccgtgggaggcttcgtcacgcactgtggctggaactcggtcctcgagagcctctggcatggcgtgccgatggtgccatggccgcttggcgccgagcagcactacaacgcgttcacgctggtggccgacatgggcgtcgccgtggcgctgaacgtggaaaggaagaggaagaatttcgtggaggcgaccgagctggagcgagcggttaaagctctgatgtgcgacggcgagacagcgaggaaggttagggacaaggtcatggagataaaagccgcgtgccggaaggcaatggaggagggcggatcatcgaacatgtcgttgcagaggctctgtgatgcgctcgtcgaaggcgcggtgcacccgggaaagtgatgcccacagagttcaatcaggaggctctgtccaccagccatccaatggtgtacatgtattctgttatgagttctctgtttttagagcaagttaaataatattttttatgagttctcgaaaaaaaaaaaaaaaagcgcggccgctatacaagatccgagcgcgtgcatgc

SEQ ID NO: 13441 - DNA, 1968 bp, Zea mays
  misc_feature (1968)..(1968): n is a, c, g, or t
cagcccaactccatcgttactgccccctcaaaaagaaaaactctatatctttacacgccggacacacgggcacacgggccaggccaagcctgacatgccgtccgccgcgctcatatctcctttcgtctactccgtccagtcccaactctccaccggcggcaggaggcgccggcgctagcccgtggcgagatgagcggcgggagcgtaagcgccgtgttttatgcggacaagtaccacccgatccaggccggcagcatcgacggcacggacgtcgcgccccacgataacgccgtcctccgcgccctcatctgctctcaggccggcctctacgaccctttcggcgaccccaaggcctccggcgacccccaccgcacggttttcgtcggccgcctctcgcgccagaccgacgacgacacgcttcggaaggcgatgagcaggtacgggagggtgaagagcatgcggttggtgcgtgacattgttacaggtgcttctcgtggttatgcatttgttgagtatgaaactgacagagagatgcatcgtgcctatgaggatgcacaccattcagttattgaaggcagtgaagtgattgttgattactacaggcaacagcttatgcctgggtggataccaaggcggctaggaggggggcttggtggaatgaaagaatctggacagcttcgctttggaggccgagagaggccatttcgtgctcccttgcgacctattccttatgatgaactgaagaagcttgggatcccaccgccacctgaagggcgatatatgacacgttatcaggttccaccaccaccaaggcggaagagcagcaatattgacattgaagattcacctcctgggagaagatccaaggacagagccggggttagtacctacagaaggcaaagaagttctaatgacgatgatgaaacccttctcaagaggaaaagcagccgagacgggctagaagaatcacaaagtcggaggagcgcaagatcatccattaccaaggaggacaacaggtacagcagtcagaggaagtccaaggaacatgacaaaggtcatcgcaagcacagacgaagccaagatccgggcgaagtatctcctccagcagaggaagacggtagctatgaaaggcagagaactttagaagaacctgatcgcagccctgatcggtaccatcaccactggcatcacagggatgatacatatgagagcagacacttgcgccacagggatcatcgcaagcgtagacgaagccaagaaccgggcgaagtatctccaccagaggaagactgtagccatgaaagggagagaacttcagacgaacctggtcgcagccctgatcggtaccatcaccactggcatcaaagggatggtacatatgagagcagacactcacgccacagggatcatcgcaagcgcagacgaagccaagagccaggcgtatctccactagaggaagacggtagctatgaaagggaaagaacttcagacgaacttggtcgcagccctgattggtaccatcaccatcggcatcacagggaggatacatatgagagcagacactctcaccacagggatcgccgacgccatggtgaccggcatcgcaccaagagaagcgagagtcgagattacagggactaggcaactctcactcgcaccacagggatccccgacgccatggtgaccggcatcacaccaagagaagtgagggtcgagattacactctccagtttcctagactacaatgtttcattatgtaaacttgattgtttttcgtactccttgatctagtaaggtttactgttgccctgtagtctctttcatgagaatgtattcctgtaccgaattttatatgtttggttttgttgttgacaaaaaaaaaaaaaaaaaaaaaaaaaaaaaaactcgagagtcttctagagcaaaaaaaaaaaaaaaaaaaaaaaaaaaaaaaaaaaaaaaaaaaan

SEQ ID NO: 13442 - DNA, 1357 bp, Zea mays
  misc_feature (141)..(141): n is a, c, g, or t
gctggaaggatttcctggcccggaacgacaggaagtttggagcgtcggtgagcgaccagaggaagcgctctagggacgtgttgctcgccttcctacagaccttccccaaggacttccgggagaaacacttgatgccactangtccgacgagagccactggaaggcaacacaggcattcctcagtccccaaagtgagctgctgggcagctgctcatcaccaacacaattctaacccccagcaggttcaggcgattggcatacgaatcgcaaagacgctgcatgccttttatcagttctgccgaccacacacaatatttggaaccatactaggcattacttcggtgtctctcctgccagtgaagagcctggacgattttacgttgatagctatatggggatttctcgaggctttggccgccgcattatgtatgaacgtttatgtagtagggctgaaccagctatttgacattgagattgacaaggtcaataagccaaccctcccattagcgtccggagagttttcagtgccaactgcagtattgttagtagtggcattcttggtcatgagcattagcatcggaataagatcaaagtgtgcgccattgatgtgtgctttgcttgttagcttccttcttggaagcgcatactccattgacgttccattactccgatggaagcgacatgctttcctagctgcattctgcataatctttgtgagggctgtagtggtccgcaacatgttctgaagaggcccttggcacctacaaggtcggtggtctttgccaacatgtttcatgtgttgcttcgctgcagtaatagcgctattcaaggatattcctgatgtcgatggagatagagatttcggcattcagtccatgactgtacgattaggccaacagagagtgcataggctctgcattaacattctcatgacagcatacgcagctgcaattttggtaggcgcatcatctacaaacctgtatcagaagattgtcattgtgtctggtcatgtcttgcttgcctccacactctggcaaagagcacaacaatttgacattgagaataaggattgtatcacacaattttatatgttcatttggaagttattctacgctgagtattttcttataccatttgtgtagtaaagaatcatgcgaagaacagcacccgtgctatagacatgtgaaggtttattgctaatgttactctaccgaatggtctgaatgcctatgcgtcatttgtatgtaatatgactatttgttgtatcagggtaacaactggagcaaatgtaccgtgtatattaagcattaatttaactttagtcagttagttgtgggaaaaaaaaaaaaaaaaaagc

SEQ ID NO: 13443 - DNA, 952 bp, Zea mays
  misc_feature (933)..(934): n is a, c, g, or t
aaaagggttccctcaggccatttccttgagccgttccgctgccattcgaccaccaccgccacggcggcgccgacgccgactacaaccactcgcagagactaccgcctccacccccgctgcttctcatctccacgcagccgtccgatggccaagcggctcgccggcgccgacaaagaggtgctcgtcgaggtggtgaggttcacgcataagagcggactgaggggctgtgacggcggctggaaggatttcctggcccagaacgacaggaagtttggcgcgtcggtgagcgacccgaggaagcgctccagggacgtgctgttcgccttcctgcagaccttccccaaggatttccagaagaaacacttgatgccactagtctgacgagagccaccggaagattttaatgcttcaggtgcataggctctgcattaatattctcatgacagcatacgcagccgcaattttggtaggagcgtcatctacgaacctgtatcagaagattgtcattgtgtctggtcatggcttgcttgcctccacactctggcaaagagcacaacaatttgacattgagaataaggattgtatcacacaattttatatgttcatttggaagttattctacgccgagtattttcttataccatttgtgtagtaaagaatcatgcgaagaacaacacccctggtatagacatgtgaaggtttattgctaatgttactctaccgaatggtctgaatgtctatgcgtcatttgaatgtaatatgactatttgttgtatcagggtaacaactggagcaaatgtaccatgtatattaagcattaatttaactacatcatttgtaccatgtatattatgactatgtatgagatattgtctcttattagtactggatgtgatgtgtcttattatgaccaaaaaaaaaaaaaaaatgatnngaaaaaaaaaaaaaaaag

SEQ ID NO: 13444 - DNA, 3069 bp, Zea mays
ccatgtgtgttcggttaagcgagccgctaacttcctagagacggccgtaggaagttagcatgtgcagctaacttcctacggctgtctctagtaagttagcatgggcagctaacttcctatggttgtctctagaaagttagcatgggcagctaacttcctacggcctcctctacaaagttagctttcagttgctgatccacgggtgtggttaaacgatccgctaacttcctacggctgactctaggaagttagcgcatcaggatggccaacaatcaggccgaagagtaaggaccattggtgggccccccaccggcaatcgtgccattcagtcggcctcgctactttcctaagtggaaaaagggttctctccggccatttccttgagtcgttccgccgccactcgaccaccaccgccatggcggcgccgacgccgaccacaaccactcgcagagactaccgcctccgcccccgctgcttctcgtctccacgcagctgtccgatggccaagcgactcgccggcatcgacaaagaggtagggggcggcacgccaacagagcagcccacccagaccgggcaggccgcctcgttgcgctcacccatttggtcagcgccaggtgctcgtcgaggtggtgaggttcacgcataagagcggactgaggggctgtgacggtggctggaaggatttcctggcccggaacgacaggaagtttggcgcgtcggtgagcgacccgaggaagcgctccagggacgtgctgttcgccttcctgcagaccttccccaaggatttccagaaggttggtcactcttttgcttcttcagacttcagttcagcatgcccggtttcactgccagctgcagtggtcggtaagcggtagtttccatctatttcttccttcatcccagattaatttttcctttgacttctctggatacaaagtttttattatctatataaaacataccgtgttataatttagaaattaagaactgagagagtaatagctctgcttaccgtgttattatctatataaggtttgggactagagttccctaatctagccagtattgctacctaccatatatataaatcactctcttcttgtacatctatatatatgcactgagtatagtctcaagagggcatgtcttgcaccaatctaacatgatatcggagccaaaaaaatctaattccccaccatacatctttttgtatacgttactgtactgattccaaactgttattttactcaatgttcagaaacacttgatgccactagtccgacgagagccaccggaaggcaacgcaggcattcctcagtccccaaagtgagctgctgggcagctgctcatcaccaacacaattctaacccccagcagtttcaggcgattggcatacgaatcgcaaagacgttgcatgccttctatcagttctgccgaccacacacaatatttggaaccgtgagacctaatttccaagactgaaattccattctatatatgtcgcaagtttatatgcatatgtatcatgctttcatttttttctatcttatatctggaccatgtaccagataataggcattacttcggtgtctctcctgccagtgaaagagcctggacgattttacgttgatagctatatggggatttctcgaggtataaatgtataattatcgtattgaaagctatataccctgggcacgtatttcatattcttttcttcttcttctttttattcctgaaaattaccaacatatatacactatctcattttgacacttttgttcaggctttggccgccgcattatgtatgaacgtttatgtagtagggctgaacaaggtattttttgtgttaattttaatcatgccttctgtcgatgacattactgtgtatacatattcagagtttcggataaccttttgaaggtcaataagccaaccctcccattagcgtccggagagttttcagtgccaactgcagtattgttagtagtggcattcttggtcatggtaatgttatatgtttcacacagagatctacgaaccatctattctggtatccctcatggtcttatatttttctcacactgttctttttttctccgatttgttagagcattagcatcggaataagatcaaagtctgctccattgatgtgtgctttgcttgtttgcttccttcttggaagcgcatactccattgacgtaagttatccatgcctctttcctgtaatttttttcaggtggagttctaaaaattcatacgcacccccattgccttggctttgaaatttgaatctttcctactacttttcaggttccattactccggtggaagcgacatgcttttctagctgcattctgcataatctttgtgagggctgtagtggtccagttagctttctttgcacacatgcaggtagctaatgctgttaacataaatgcttatttgttccactatgtttagtgcctgatggtgttgtttgcagcaacatgttctgaagaggcccttggcacctacaaggtcggtggtctttgcaacatgtttcatgtgttgcttcgctgcagtaatagcgctattcaaggtacgggttcttaagatcaaggttccttatatatgtacatttatttgatacaggaattgaacagtttttatttttgtatttatgtatgagactttaggatattcctgatgtcgatggagatagagatttcggcattcagtccatgactgtacgattaggcccaacagagagtaagagcatgcctatccaacaataaattttttaatgtatataaactgtgcaaaattttgataaaagattttaatgcttcaggggcataggctctgcattaatattctcatgacagcatacgcagccgcaattttggtaggcgcgtcatctacgaacctgtatcagaagattgtcattgtgagtgacggcatcatctttatttctagaacttagatacgttttttttcatttcacatttcattaatcgaaaaaattattcaggtgtctggtcatggcttgcttgcctccacactctggcaaaaagcacaacaatttga

SEQ ID NO: 13445 - DNA, 1274 bp, Zea mays
ctctgccacggcggacggctcctcgatgaggtggccagggagggtaaactctcagagcgccgcgccgccaatgtgatcaaggagctcatggcggtcctcaagtactgccacgagatgggcgtcgtgcatagggacgtcaagccggagaatgttctgctcaccaagtctggaaggttgaagcttgcagattttggattggccgtgcgagttgctgatggtgtgtcaagagtcgaagtggtgctaacttggtagttgcagtcgagttgttgtcatctggaggtagttgttacttccacggagttctggatatttgggttcacagcatcaatagattgacatcatgatggtcaggtcagcaattgactggtgttgctggcagcccggcatatctggcacctgaggttctactaggaaattactcccaaaaggtagatgtatgggctgccggggtgcttctgcatgttctgttgatgggcactcttccgttccaaggaaaatctgtcgaagctatccttgatgctataaagactgctgaacttgactttcacagcagtcagtgggcatctgtgtcactgcttgctcgtgatctcattggccgaatgcttaatcgagaggtctcttcaaggcccgatgccgaagatgttctccggcacccctgggtcttattctacactgattgcccgcagaaagctgaattctctaacctatggggtactaacaaaactgcagctcccatgattcatcgggagatagtcaggtttggttactgcgagtcttcatcttcaaaatcctcaagtgacaactctgaagagcgagatgaatgcggtatagttgacgcactggcgacagcaataacacaggtgaggatctcagagcccaagaggagtcggctgttcagcctacccaacgggttgttgccaccaagcaggaacagtctccgaacatgaagaggatgaatccgtgtgtggctttctaacttgacctacctagctcccatccccatgcatgtataaacgagataaacgagctctgtgattttatagatggaaaattttcaccgtggttgatgttttgcgattgctagctcgctgaggctgcaatcctctgtaaatatatcactgttgtcatcgtttctatacatcgatgatccccgtattgatttgatttagtttttttcccatggccgtgggtagtgctggttaagaaatacttttatacttatgatcgctttagattaaagccagttattcagactacaaaatatagaaaacaat

SEQ ID NO: 13446 - DNA, 1898 bp, Zea mays
  misc_feature (960)..(960): n is a, c, g, or t
cgtagcttcgccgcgcggcgtgacacgccagtccgcgtcggttacggcgtgcggcaacgaacaatgaatccatgatagcgcagcagcgctcgtgctcgcgccccagttctccactccgatcgaccgaaccccaacaaaatcctcgtccttcgcgtcatctcgacgccacaactctccgagccccgctccgcaatagacccgtaagacgctgtctcgatccgtccccctacctcccccgccgccgacgctcgactcgatacattggagcaggaggcgccgccgccaaaacccaagctaggagtgggagattccgatcctccgcgcgcgcgcgcgcaccatggagccggtgccccggaagcgcaagggcgcgcccccggtgtgctccgccgccaggtccctccaagatttggcctcccgcaagcgcgcctgccgcggctccgtgccgcagcaatcccactgcaccgacgcccccgcccccgctgtggtgatgacggcccccgcggcgagcggcgcgtcggcgtcagcgggggtcctcccggggcgcgggctcaagcggaaggtgggctgcatcgacaacgccacgcggatcgggcggcggaagcggctggagaacgagtacgacctcggcgaggagatcgggcacggcaagttcggctccgtccgcgtctgccgccccaaggcccggacccggggcgaggaggagttcgcctgcaaggcgctgccgaagaacggcggtgacacggcccaccgcgaggtggagatcatgcagcacctctcgggccacccgggcgtcgtcacgctcagggccgtctttgaagacaccgacgccttctacctcgtcatggagctctgccacggcggacggctcctcgatgaggtggccagggagggtaaactctcagagcgccgcgccgccaatgtgatcaaggaggctcatggcggtcctcaagtactgccacngagatgggcgtcgttgcatagggacgtcaagccggagaatgttccgctccccaagtctggaaggttgaagcttgcagattttggattggccgtgcgagttgctgatggtaagtatcttgaaagattgcgacctatatgtttgtcacttcacgtgcgtcatctatatgggtactgagtagtcgatatgattctgttctggtattatagtccttcaaaatgctgccaggtaagtagatcaaattggcggagaacgagaatactcaaataggaagattacatcaaatccttatggtgttgtagtggttactctcttgtcattgtgctcgaattttgcattaggaagaatggtttattttgctaatgcacacataaactaggtctttggcagggttttccagttcatgctgcatttgaacattgccactagcattttaaaaacattttacatgggatttgaaatgtgcaagttgtgttttcagtgctgacttggtatcagttattcattcactgtgtcattttgttttgttaggtgtgtcaagagtcgaagtggtgctaacttggtagttgcagtcgagttgttgtcatctggaggtagttgttacttccacggagttctggatatttgggttcacagcatcaatagattgacatcatgatggtcaggtagtcaggtcattgttaacggtacatcggtcttgtggttctaagacatttgtgtgactaactggttttaaggccagtgaaaatttgctcatcaggaagtggtaaaatgtcaattattttgtcaagtattagcagttttcttgtgtatgtgatcagactaacactgacatgtctttgttttcctgtaaaactatgtatgatgaaaccatggtgtgattgtattggctggccttaccctgttttgtttcaatgcattcattgttgcacaagtaata

SEQ ID NO: 13447 - DNA, 1966 bp, Zea mays
tctgagatgccccctcttcgctcccccccgcgtccggtcacttacacaactctgatgaaagggtacatcaagaagaaagcttttgacaatgcctacgcccttcttaatgaaatgcgtcagaatggagtttcttgcggcgattatacgtataatattctcataaatggactttacatggtcaatcgtgtttgtgaagttgatgaaatgttgaaaagatttttgagtgaaggttttgttccgaccacaatgacatacaatagtatcattaatggatttgtgaaagctggtatgatgggctctgcattcggtatgtatcggcagatgcgcaagaaaggtataactcccaatatagtaacatataccagttttatagatggttattgtaggaccaactgctgtgatcttgcagtgaagctgctcatttacgtgaggcgcgatggcattcaacctgacattgctgcatacaacgctttcatagatacgttttgcaaacaggggaatatgtctcgtgcactccattttttggttcttctgttgaaagatggtttaacaccagatgtcactgtctacaatagttttgttacagggtacaagaatttgaaaatgatggcagaagcttcaaagttctattatagcatgatcaaacagagagttgttgctgatacagaaatctatacaaccttaattgatgggttctcaaaagttggcaatgtggcctttgctttggaactgtactcagagatgatggccaatcacgttattcctgatgataaaactttcacagcactaacccacggtctttgccgaagtggagatattgatggtgctaagaggttattggatgatatgagaagattagatgtgtctccaaatattgttacttataacatgctgataaatgcatgcgtccgtgatggtaagctgcaagaggcattccaactgcatgatgagatgctcagcagtggagtcgtgcctgatgatactacatatgacatactccctcggaccaataatagttgattttccacctgccaggattgcttgctgcttgttcaagcctccagtctgacacagtgtattaccaaccagagggaatacgagttagcttgaaacttttggaagcaagtcctgcagatgctgaaaatcatgtttcaattctgccagtaaagtatgaagaaccttaacatgcgattcagcagattgaaatttaggaaacttgcactgtaaatgaagtgaactccttgtcagttataatttttccttttcaatatatctctacccctttaaagcacgactttgacacgtcgcgcactcccatggtgctgggaactcccgcacttccctcagcctcctctcgcgtggtgctcggaagtcggaaccctcaacctcctccctcgtccctcggtgtttgaaattactgtgcttcccttagcctcctcccctggttctcgaaactactagagatggatttagatctttatttaaatgttaatttttttgtcttctttctttgattgtaaacaagtaacatatataatttactgtgtaaatttatatttttattttcaatattgaatctattaatatttataaaaagtctgtcgcatcttgatctccaacatagtaaatagaatcgcccagggctcagagatatgtgcactagacacgttgtgcgtgaccgccgaagcacacttttttatgaaaatgtctgtcgcttcacttttaatttggaccccgaccaatttctacaaaatcacatgggggctgagggctacgtccatgacttagtaaccaggttcccggatcgatgggatcgaggaacgggaacgtggtacgctacaaaaactaggatttaacactactggaacgagatggttcccacgttcccggaactgaacgaacgctcccggaaacgaggaacgtggccaagttcccagttctcggttactaaggtccatgaagcgcc

SEQ ID NO: 13448 - DNA, 852 bp, Zea mays
ccgtcccgtgaccccccggcccccccccgtgaccgccccgcaccccccacagccgggggtcgccggtttccgcgactccaaatccgcgtgcgccgcccgccctctaaatctgcctcgccggcagccgggcgggggccaccacgtcacacccagcctctcctctccgcccgcggcccgcccgcttcttcttcctcgccatcccttcttctagcgcggaggcgcagatccatcgggcttcgggggctcggttccatccctctgccagctgggattggattggagcatcttcccagcaccacccacgcggaagccatgaccattcagttgctccgctgacgactcctctgacgacagcacggctgcgctgacctgcaggcctctcgcccacgctgccctgacagggtaaagtcagggggtggcgtgtgtgggtgggggggggggggacaatcaggtgaataatcatggacagaagagctggggcgatcctagtgttcctgctcgtcgtcctggtctgggatgtggcggcggtcgccgagaccgagcctggcagcgtgcggctagtacaggaggcgccacataggaaggtggtggaggatggggccaaggcggggaggggtgccggtgtcgaccgtcgcgtggtccacgcttgccatggccgcggcgacggggttgggagcggtgcccttctttttcatggagctcgaagcgcagtgggctggcctttgcaaggggcttgccggcccggggtgatgctggccgccagctttgaccttgtgcaggaagggcaggtgtatggcagtgggagctgggttgtgttccgaattctgagtggaggtatatttatttggcttt

SEQ ID NO: 13449 - DNA, 1140 bp, Zea mays
gcacgagtcctgctcctcgcctggaaggtgctactcccaaactgtgtgttccttctccggggaaaccacgaatccaagtactgcacgtcagtatatggtttcgagaaggaggtaatgactaaatacaaagatcagggccctcaaatttaccggaagtttttaagatgttttgaggaccttcctctggcgtcgagcgccgccccgggcaggtacactgcacacggcggtatcttccgtggaacaattgtagtgccatcaaagaaatcaaaaaagggaaagaagggtcacaaatacaaggcgaattttactgttgatctgacttccatgaaacttggatccttggatgagttattgaaagcaaggagaactgttctcgaccctccttgggaaggctcaaatttgatccctggggatgtgctgtggtctgacccttccttgcagatgggtctttctccgaataaagaacgaggcataggtttgctttggggtcctgatatcactcagcagtttctgaggacaaatcatttgaagctaatcatcaggtcacatgaaggtccagacgcgagagacaagcgacacgatctcttaggaatggataaaggatatacgattgatcatgaagtagaatgtgggaaactaattactctcttcagtgctccggactacccacagtttcaggcttcagaggagcgatacaacaatcgtggagcatatattgtccttagtccacctgattttgctacccctgttttccatagcttcggagctgtaaagcctcgacctgcggcccatccgttctatgattttgaacaagtgatcgactcagatgaagaattggatttaatcgccatggacagcggcacgtcgagcctgtcatgacgactcgccatgtacctcggccgcgaccacgctaatttattattatcgctccaattgttgccatggaagcgtggcatcaaggttttttgctgtcgttgttgtaagctaatgccaacgtagtaacgttgcaggtttctggatggcctgagtcctgacatgcacacgccaaatctgatctgttggtttggttgaggttgatttgtatctaaaactaagtgagcgtgagatgtcatctaaaggctgaaggaagtcagcggttgc

SEQ ID NO: 13450 - DNA, 1929 bp, Zea mays
gtttccacccctcgcagccgtgtcatctccacgccgcggagacccaggggccacgggccacggcccacggcccacggcccacggctccgcacctacgaaagccaactggaaccagcagcagcccagccctcgtttcgtttccccacaaggcctcaagggcgcaaaagcagcacagccggcgctgccgactgtgacgacgacgatcgacgaaccctcccttgcgtttcccccaagacaacacaaacccccactcgcgcgactcgcacaaggaacagaacttcagaacccagcgaatccagcctggcccatgccatgtcgcagcccgacgccgacgccatcctcatccccatcgccgcggcgatggatccctccccagccccagccccagccccggctccggctccggtcccggcccctacggtggtcgagtggcccgagggcggcgcactgacgcgggactgggtggcggggctggcgtccacgctggactggtgctcgcggcacctccccgcggaccgcctcccggcggtgctcccgcccgcgctggtccagcgcctggtcctggccgccgccgccatcctgcaccgcgagcccaacctcgtccgcgtcgacccgcgccccggccaggccgtcgtcgtcgtcggggacgtccacgggcagctccacgacgtcatcttcctgctccgcgacgccgggttcccgtccgaggaccgcatcttcgtcttcaacggcgattacgtcgaccgcggcgcctggggcctcgagaccttcctcctgctcctcgcctggaaggtgctactcccaaactgtgtgttccttctccggggaaaccacgaatccaagtactgcacgtcagtatatggtttcgagaaggaggtaatgactaaatacaaagatcagggccctcaaatttaccggaagtttttaagatgttttgaggaccttcctctggcgacaataatagcaggatgtgtgtacactgcacacggcggtatcttccgtggaacaattgtagtgccatcaaagaaatcaaaaaagggaaagaagggtcacaaatacaaggcgaattttactgttgatctgacttccatgaaacttggatccttggatgagttattgaaagcaaggagaactgttctcgaccctccttgggaaggctcaaatttgatccctggggatgtgctgtggtctgacccttccttgcagatgggtctttctccgaataaagaacgaggcataggtttgctttggggtcctgatatcactcagcagtttctgaggacaaatcatttgaagctaatcatcaggtcacatgaaggtccagacgcgagagacaagcgacacgatctcttaggaatggataaaggatatacgattgatcatgaagtagaatgtgggaaactaattactctcttcagtgctccggactacccacagtttcaggcttcagaggagcgatacaacaatcgtggagcatatattgtccttagtccacctgattttgctacccctgttttccatagcttcggagctgtaaagcctcgacctgcggcccatccgttctatgattttgaacaagtgatcgactcagatgaagaattggatttaatcgccatggacagcggcacgtcgagcctgtcatgacgactcgccatgtaccttttgcacttagggttgtatttattattatcgctccaattgttgccatggaagcgtggcatcaaggttttttgctgtcgttgttgtaagctaatgccaacgtagtaacgttgcaggtttctggatggcctgagtcctgacatgcacacgccaaatctgatctgttggtttggttgaggttgatttgtatctaaaactaagtgagcgtgagatgtcatctaaaggctgaaggaagtcagcggttgccagaaaaaaaaaaaaaaaaaaaaa

SEQ ID NO: 13451 - DNA, 651 bp, Zea mays
cctcgcggccgtccgggaattgtgttgggctgggcatggccgcatggcccatcctctcgtcacactggcttctatgagcccaagagccgcttcggccttccgctctccgtgttgccgagctgcggcgggcgttgcgcctccctcgcctcgccagtcccctcgcctctttctcgtttgcggcggcgtccacagcatctgcggctcctgccaccacgtttcggctgcgaccccttcgcccgaaatacgaatgatgagagcaggataagataagcaaagcaaattatgcgctgcagaagtcctttgcattgcagttttccactggaaggttgtgatgcaaggtacaaagataaacttgtagacagaaaccataatgcctgaccctgcttattcgatctcaattatggtcaactagagtactcgtcgtggttcaatgtactgtacttgttataagttcatatggtgcaattgttgtaagaggtcactcagcactccagcagcgctgtccaagcttgacgagcaccagcgcctgcacctgatcgacctgctcgatgtacagaccagcggtttaagaattaaaaggcagttgaaagtttgcgcattacgatagaataaaaggggcggccataaaaaaaaaaaaaaaaaaggccccta

SEQ ID NO: 13452 - DNA, 5876 bp, Zea mays
  misc_feature (4170)..(4170): n is a, c, g, or t
cgctagatatttttcatgcttatccactttttagataaaacatatcagctaaaataccgtgctttaaaaagtatttcatgctctcctataaatcatgataactaattaaaggatgttttagtttacaatgactaaattttagtcactccattttatttttggtttccatatttaccagtttaatgactaaaatagaataaaatataagaactaaaaattagttcctacaaaccacccctaaaactcatccaatcttccaaatacacattgctatttccaaaaaaaaaacatcgaaacggattcctttcccttttctgccgtttcagccgcccgcgttgcggcgttgggttgatcccttatggcggcgtggttcaggcggggcaacgaacgacggccggcacgattcacggccacggacgaccacatgcatcagtgcatgcacgggacggcagcgttcgtgaacgacaccgtaccgtcggtacatacatgcatttgaccgcgactgcagcttggaatcggagcaatcgcgcgccatccgcagcttatagcagggtgcagcggccggccagtgctgagcgctgacgcgaccgctgcgtccgagcttgcgttacacgcccgcgaatgtatccggtcctcttgtccagactcaaagaaagactttttttcttcctttcgagaatgttttttttccctctgtagtagtagcagttgttgttgtttgtttgatggaggatttggtggctacacaccataactttgctgtggacttgtgcaacgctacagacaaagcgagtgtggagcgaccaaccgtggcccctccggaccggagcaaagcacacagactgcctcgtgcaccccgtggatgagctccacgctgtttcgtagaactctctatctcttctagtacgtggagccgtggacttgcccagaacttgtcagcgagcgagcgaggaacgggatgtgcaagtaccctccggtccgagcctgagcgtcgtcggagttgacgggcgcggggtaaagcgggtggactgtgaagcttcaccctcggtcaggcccccgcgcgttcccaccacgcgcgcgagtcgcgagaagcagagtccatgtccatgcccattcggccggtcgttcacacacaccgcattcacgcacgagcgcgtggccgcgggagaagcagagacttgcttcccacgccttttccttttggcctccgtatccatcggtatctctaatttcccccgcgcgccgcgcttttgccacacgccaaacaccttccatgttctaaacttgcagtccttcctaatcccaagaacaagcaatagcatcccccatcccccctatatataaacaaacgcacctggcacccgccacaaaaaggactcagcaacgcaaggccagctcgagacaagtcagggccaacagaaacaaccaccaccacagcagcacgcgagaaacaaacaagaagagcaagcaagcaagcagatcgcaacaaccgcgcgcggcatggcgatggccgtgagcgggaggtggacgcgggtgaggacgctgggccgcggcgcgtcgggcgccgaggtgttcctggccgccgaccaggcgtcgggggatctgttcgcggtcaagtcggcggcggcggcggcgggcgcggagctgctgcggcgggagcgcgcgctcatggcgggcctccgctcgccgcacgtcgtcccctgcatcggcggccgcgcggggcgcgacggctcgtaccagctcttcctcgagtacgcgcccggcgggtcgctggccgacgtggccgcggccaggagcggcgggcggctcgaggagcgcgccgtcgcggcgtacgcggccgacgtggccgcggggctcgcgtacgtccacgccgccggcctcgtgcacggcgacgtcaagccgcggaacgtggtcgtcggcgccgacggccgcgccaagctcgccgacttcgggtgcgcgaggagggccgcggacgacgacgccgcgctgccgatcggcggcacgccggcgttcatggcgccggaggtggcgcgcgcggaggcgcagggcccgcctgccgacgtctgggcgctgggctgcaccgtcctcgcgatggccaccggccgcgcgccgtgggccgccgccgccggcgacgtgcttgccgcggtgcgcctcatcgggtacacggacgccgtccccgaggtgccccagtggctgtccgccgaggccaaggacttcctgggccggtgcctggcgcggcgccccggcgaccggtccacggcggcgcagctgctcgagcacccgttcgtcgcctccaagagcacgctggacctggacggcgccaagggcacgtgggtgtcgccaaagagcacgctggacgcggcattctgggagtccgagagcgacagcgacagcgacgacgaccaccgccaccaccacgacgtcgacgtcgacgcggtgtcggcacagagcaccgccgacaggatcggcgcgttggcctgccctgcttcggcgctgccggactggtgggactccgacgagggctggatcgacgtgctctccgcaccagccgaagcatcgtccgacgcgacggtggacgagggcccttgcgtcggcgacggcggtgccggaacagaggaagaagagagggcagaccaggccgccgagcccctcgacacggacgccgacggcgcccacaatgcaggagaagctgacgctagcccgcctgatcgcgagtggcatctccgtgtgagttcaccctgtgatggtgaaatgcaatgtactagattgttgtgtgacacaaacaacaatgcaatggatttccttctttccaccaccccaaatttgccctgtttatcggtcggcttcatggatttcaagaatctctgttctttcctttcctcccattctgtttctggcataggatcgccgagtcgaacattctcgttagctgctacgaattcacacacgtaaagcctggatggattggtccagtcctagtaaaattcaccgcgtacaggtggaagaccgtgagacagccgtgaccgtgtgtgtgtgtcaatctccaatcccccgcggctcgagcttccccagcacggcacgcaccgaaggttccaatccagagagagagccgcgtcgacacggaaaagcgcagcgtcagcgcggacgcagaaagggtctctgccaatgccattccggagtaaacttgggcagcgcgcactggtcgaaaaccttgagagctcggactccgtaacccgggggtccaggaacggaccacgtgcgagccccgccgccgagtggggatattttttttttctcccggtgggtggggacgtcgaggagtggagagggatatcctggcgtgggtgccgatccacatccaccccggcggccagcgctttttaccctgcttgcctgccaatgcagcactagggggggctcgtcgctcgcccgcccgcgctactggctcctctgggtagcgtgtcaatgcgggatctggagctggctactggccgcgctgtagggggttcaccacacccttcaccgctgtctgcctgtgctttccagactgtgaaccagtcggttgccagccgtctcatcacgcacgcaacgcaagcgaagcgagcgccgatacgctcgatgcggcctgcctgcctctccctccctccctccctaatctttactttacccgtaataactttaacttgccagatacaaaacgctgggccgggttcggatatggtcgtcgccgtacggggacggtggtatggggcagcatcatcccagtcccaggcggcaagcgcgtcagactgagacccggcagccggcatggacgcgccgcgcgcgagtacaattggacggcaccgcaccgagcacaccgccgcgcgcacgtctgagtcggagtcgcaggacccaggaccacggtccacgagccaccggcggcggatatgcatacgggacgatatgtattggatatatggatatgcacccgcctcgcccgttcggtgcaatccgatgactgccgtcagctcatccttccgagcagtgatccggcctttttgttatctttctttctgttgctttcgccgcctttcccctcccttccaagcaacggaccgagtgaaggaatcttcaaggggcgggtagtagagtagatccggacggttaactactgatgatcaggagtgcatncggtcgctgtcacgccgcgtcgcgtcgcgtcgcgtgcgtctaataattaaaatcgccgtctcggcgatcacgcatcaagaaagagtgctgcattacgcggacggaggagtcgccatgccatgcgcctaaggatcccgtgaaacgacatgagtgagctagctatactagttaggcgtttctataatctgtatgagctgagtgcgcctaaaccgaatgcttcttgcgagccaagcaaggccaatgcaagtgcacctgggcagtaggcggactgcagcagtgggtgacttaagacgagtagttagtactcgtgtcagcctctaatcaatagccatcagtcaggcactagtagcttaatagtagtgatctacactccaaactagcaggtgcttaattaatggacgttgtgtaggagcagccatagtacaggaactcccatcattatgacaccatgtataataataataataataataataataataataataataataataataataataataatattaataataataataataataataattccgcgacggatgctgccgtcagtcaggtacgtacagctcgctgctgctgccgctcaagatagttaactctcggttattaatattacgtgttcgtgaagaacataaacatgggccggagagcagcagcagcagcagttgaccctgacggatgcaaatgtatatgcagagccaatattaaaagcagactacgtcgtcgtccaaaacgcagaacaaacaaacaatcattaggacggacgcaaaccgagagctaatgatgagctctgctagtaaacaaagccgcagccgcagctaaccgttgcgtgcccctgctccgacggacggaggctttggatcctgcgcggtgcggcgagattgaccagctcagcgcagccccatcatcatcgctaattggcgtcgatacaaggaaggatgatacgcctgcgggctgcggctgcggccgagatcgagccggcatgtggtggcagctagcgtgcagcccaccgaactcgcacttgtgtgtttttcatttttgtttggggtttggcctgccgtgtgccgtgccgtagtatctcctggatcgaccgcccgatcgatatgatatccgtgacgccagcgccgtgccaaactgccagctgggtcgtgtagctcgttcaccctcgctctccggccacatggccgcgcctcgcgctgcccacatgtggtgttctctctttcgttcacccacaacacatgttgcgccgttcgggcctggaccgcctgccgtacggggataaacaacgaccgacgcagcaggcggctgacttcacgccatcagcgatcgagcgcctggtgtcgtcgtcgtcgtagtcgtagcgccttgccgccgcaccaaattgacacgcagaggagatcacgccgacgtcggttgttcaacaccgctttggaaagttgcagatatattccacgtatacgtactagctagtactgggttcggcgatccaacaaagtgcgtgatgcgtcaccactctctctctgtgtggatgcacgttttcctttacgcgttgtttctctggtcgttgcctgctgtgtcggtcctaagcttgatctcggcatcgtgttcatttaagctggactgctcgacgatcgacacatgaacggaacggagcggaggggtctggtggcctggcctgccgtagtggcgccgtgcag

SEQ ID NO: 13453 - DNA, 1631 bp, Zea mays
gggtacctcgaccccggccgggaaaaaatacagaactgaatagaagttttcttaccttcgtgcttcgagttgcgtctgtgctcctggcgcttcgtcgccgaattggtgtggctcacgtcgccggtgaccttccggtggccaggggcgtgacaccgcgctgccagatccggcgacgtatcgactgtcacggtaactagtctccagccggggtcccagccgatgggcgccagcgggctcaccgcggtcgtcgtgctactcctcgcctcggcgctactccgtgtccctgcctctgcaggtagaagccttctggaaggcgagaaccccaactccggcggcgaggacgctcctgcacctaccgtttctgggaagtcttcagctgcggggcagcagcaggctgagagcaagcggcaacagaattcactggcaccactgccatctgcatcatcaccgccgccgccgccacccacacaggagacgaattcgcacaaggcagccagtcctcccccaggaggtggagcaggaccgaatggcgggacggacccagaggacacgggaagtcaggggaggaggatggggactgataaactgaaggaggcgatggagaagtgtgatgcctcgcataagtgttcctctggaaaggaattttctgcctgccttcaggtttctgaggacgcatcagttgggtcatatattattgtcaagaatgaaggccagcatgacattgacattaatgtcaaagaaccgtcatcaaatacagataatgataagaagtctctacatcttatcaagggtgcctttggacagatgaacataacatataccacttcagatgctgggaatattactttaagtgatggaaaggtagactgcatcatacatgttgggcagccagtagagaggaaatcggtttatgatttgcaacaacagtttcagcagcttacagcctatgcaatgcgtttgaatccagcttatggagcctctttttttgttttcactgttgttttggttgctgttggatgtgcctgttgcaagtttgcaaagagaaaaggcaatgatggtgtcccgtaccaacagcttgagatgggaggtcaggcaccaaactcttcgggggtggacaacaccgcaagcacaacagatggctgggaagacggctgggacgatgactgggatgatgaagaagcaccggcaggacctgtggataaaaagcctacgggcagtgtctcagcaaatggcctttcgttgagatcacagacaaatagcaaagatggttgggatgtggattgggatgactaagctcctaagaacttggagtgtagctgtcaaatgagggaggaagatacttccatctgtctgacctgcaggaaagacatctacagttcgaaatgatggaacttagtcttgaccaagtgacccttatcctgaggtgaaggattgcctcacgccctcacttcatacggtttgtacaatattgttccaccccccgtctgagttgatacacgaactgttagcggtactgatttagttcttttcggtttgtaatggtacagaagaattgtcagtatatatatatatatataaaaccaaagcacacatttttattctttggttgaggtaattattctttaaactgc

SEQ ID NO: 13454 - DNA, 3765 bp, Zea mays
aattcggcacgaggccgtactttactggcactggcagcacgagaccattacctagaacatcctaaatcgaaaatcccaacatcgcccgctctctcctcgctgttctccgctgtcatctcccccggagaagcgtggctcctgtagccggcctcctacctgcccctcctccgcgcgccgagcaccagacgacgcgacacggccgagcacggtcgctgcttccgcggcggcgccgctccactctcgtgctgcagctagcggaacagagatccgtggggacatgaacagggtttctcctctctgttggtatgaactaaattgatcgatggtcctattgaatatagagctactattatatggcatattctgtcatgcaaatgatggtggttgtaagttgtgattgaggaactccattgtttgagaaatggatgaaacaccaactagttctgggcaatctgaagatagttcatgtgaacctaattggtggccaccagacttattagagaagatagagtctgcttccatatcaaggaaacatgatgttttgggtaatctaaggtcctcatcctggaaggcatcacaattactgtggtcaacaggatcttattcagggttaatccctaatggtttctattcaatcatcccggataaaaagttgaaggagactctcccggccggcccggcggtagatgacctgcaaactcttgaagcagatgggcttaaggctgacataattattgtagacactgagagggataagaaggttttcatgttgaagcagcttagtgctgcacttgtgaaagggttaagctctagcccagcattagtgataaagaaaatagcaggtttggtttttgactgcttcaagcgacaaaatcctgacgccagtccagcaaaaggctcgattgaagatactcatttctttggatataaaggaccacaacttctagggcagataagacatggatcatgccgacctcgagctattctatttaaagttcttgcagatgctgttggccttgagagtaaacttgtagttggtctacctgatgacggtgccgttggatttgtggactcctacaaacatatgtctgtggtagtttcgctaaactctatggaactgctagtggatcttatgcgatttccaggccagttgattccattttcagctaaggctatctttatatcgcatatatctgctgcgggtgaaagtgactcagctgaaaatgactcctgtgattctccccttgagcccaacagccctctgtatggattgtctgataaagttgaaactgaaggaattgaatcttcatcaaatctatctggacgatcactgcgtaatatgatgttgagatcaaggacattttctgaggggaaattaagcacgtcatgtagtgaaccgaatatagcgaatgccttttggaggcacagtcaaaggagaggagttgccgaggaaccccgtggtgctagttccagtcctgagcatccattaatgagagcaaggggaagatctatacttggtggtgagaagcaatcatttcaagaatacacagaatctggagctgcttcaagatcagatggtcttgggggcacttcaacctctaatgctcgaagaataaggcgtagaagcattagcatcacccctgagattggagatgacattgtgagggcagttcgggctatgaacgaaacactaaagcaaaatcgccttcaaagggatcatgtcgaaggttcatgctcatatgttacggaagaccaaagcaacgccaatgactgcccaaataaagatgatgcatctcggataattggtgctactgacagtgactcaagaaaccgaactggtcctactcaaaaggccatgtcattgccttcttcgcctcatgaatataggggtcaagatacccaaaaaggtgatgattttataagtaaagagaagatggcattggcatggaacaaagttttccagagctccccatttcttaacaagcccttgctgccgtttgaggaatggaacatagatttctctgagataacaattggcacgcgggttggaataggattcttcggagaagttttccgtggtatatggaatggaaccgatgttgccatcaaagtatttctagaacaggacttgacaactgaaaacatggaagatttttgcaacgagatatacatcctgagccggttgcgacatccaaacgttatattgtttcttggtgcatgcattacacctccacacttgtcaatggttactgaatatatggaaatgggatcactgtattatctcatccatatgagtggtcagaaaaagaaacttagttggcgtaggaggttgaaaattattcgtgatatatgcagggggttgatgtgcatacaccgcatgaagatagttcacagggatctcaaaagtgcaaactgcctggtgaacaaacattggactgttaagatatgtgactttggtctatctcgagtgatgattgatagtcctatgactgataattcctctgctggcaccccggaatggatggcccctgagcttatacggaatgaaccttttacagagaaatgtgatatattcagccttggtgttatcatgtgggagctgtgcacattgagtcgcccatgggaaggcatctccccagttcaagtggtgtacgcagttgctaatgaaggttcacggcttgagattcctgaaggacctctcggcaggttaattgcagattgctgggcagagcctgagaatcggccgagctgccaggagatcctaacccgtttgctggactgcgaatacactgtcagctgaaatggaagctgctcgctcgtccactcaattcctgcacaggtggaaacatttcttgtataaaacctgtaaaaaaggctgccgattctgcggacttgaggtcacatatcgaagcgctgtgtttttttttaaacaatggcgaccctttctccaaaaaaaaatgtaaaaatgattccctggttatagaagaacatgtctgattcgatagacgtgccttgcatcgcagggcaagctggttgttgtaccttattctagataagtagcacgcccgcgaatgctgttcggctttcaaatagctgcagctccaaatttttacctgttgctacagtatttcctttctatataaccaggcggcagcagcagccgaatgttgccagtacgttggagatggcataagcaactccatgttgtgaactgttccctcgcgaccataaagaacatgccatcctatatttggaataaaaatattgtcaaaatttgtatatctaattagatttactatgaatatattttatctcgtggtcgggggatatttattgcatataataaattttagtattttaacatatttggtcaaatttgagatttattggcgatcattgattttggacgaggggtaggatgttagctttttagagcaacaccaaggagtactatatttgagccctaaatgttgtttccggactgatttaatttgttttaggaccttaaatatattatcatctccaacagccggccttaaatatgtgtttattaactaatccaccgtcccagggccgcgcgcacgccgtcccgcgctttttccacattgccgcacgcccaatcccttgccacctgtctctaaactatgtcgccgtcgttctgtagttgggcatgtccggcggctgcaaccagccagacaaccttcagttccacatgaacctgcatcgtgaggagcggggaccggccagagaacctgcaggcatgca

SEQ ID NO: 13455 - DNA, 1795 bp, Zea mays
cggatgaacggcttgagtacatcattcataagcgcctgaaatgtcgacggtgcattagtcaagccaaaaggcatgactaagaactcgtagtgaccatggtgcgtgcggaaggccgtcttattgatgtcctctgggtgcatgcgcacctgatggtagccgctacgtaagtcaagcttggtgaagaaccgggctccccgaagctcatccaggagttcatccactactgggataggaaatttgtccttgaccgtcttcgtgttgagctcacggtagtcaatgcagaagcgccatgtgttgtctgatttcttcacaagcagcactggtgatgagaacgttgaggtacactctcggatgataccttgggatagcatctggtcacactgtcgttcaatctcatctttgagcaactgagggtagcggtatggtcgtaccgccactggtactgtccctggcagaagccggatgcgatgatcatggcggcgaggtggaggaagtccctggggctcgacaaagaggtcttcaaaggatagcagcagggtatccagcagtttgtgtgccatgtccagagcattacagcggggtggagagccgccaatgcctgtccaacgcaccatgtgtccgtggcgccaaaaagacagcgtcaacttctcaaagttgcagatgaagggacccaaagaacgcagccattctaccccaagcaccacatcaaagccatccaggggaagagtgtagcaggttgtggtaaaattctcttcgccgacagtgagtggggtttgagaacagacgcccccactcaacaccttctcaccatttgcaaccttgacaggcagtcctgctgttggagtcacatgcagtcccagtcttggcacaatagcatcgcggatgaatgtatgggtggatcctgaatccacaagagcaatgagagccacaccattgatagagactttcagtttcagtgtgtcggcgatgtcaatcccagtgagagcatgaagtgatatgcccagctcctctgccagtgtatccgttgtcccggtatcttctccatccagttccaacagaaaaactccgcgagcagcacacttgtgatcggctgtatatttttcagagcagtggtagcattcaccgctggcccgtttggcggcaacctcctccggtgagagcctgcgcaaacgtggtctgctggtagccgatgacgagggttttgctgcagttgcagatgccgttggttttgatgtagcatatggcatccttgatggggtcgaggacagatccatacgatgttcataggtacgtgctaggtgcatggcccgctgcaatgtagttggagtcagcagttcaacatcagtccgaagcggttcacccaagcctgcagtaaacatctaagcttgctggagctatgtcatatcctcgtagcgacagagaatggacagaaactgacgttgatagtcttcaacagtgctggtgcgccgaaggtccttgagatcagccataccgttagtccgtagaggtggtccaaaccgcatatgggtgaactcaacgaagcaggaccaagtgaggacgctgcccgtgtcctgctccagagcgtagaaccattctgctgccacaccgtccaaatggagtgatgcctgccacaccttctcatcaggtagagtcctcatgcccctgaagtaagtctcacatttattgatctatgacagggggtcaaactcaccatcgtagtggggaaaggagacattgggtctttgatagccaccatcgtcgacgcggtcacgaggagcagatcatgtgctatgca

SEQ ID NO: 13456 - DNA, 1128 bp, Zea mays
  misc_feature (1095)..(1095): n is a, c, g, or t
attcggctcgagcccattactggaatcaaacccaacttcaatgctaaagtcacctgcaagatcatctctagcttcagggccaatcttccaaagatcagctgggggcatgtccggttcattacagcaagctcagttcaggagccagccacttctgggatcaacacaggatattaaggcggaaacaaatgtagctttgaaccagagagctgcaggtgcagatggatcactatttggagtaccaggctctaatcaggccgggaacaatttgaccttgaaaggatggcctctcacaggattagaacagcttcgatctgggtttctccagcacaaatcttatatgtacccggcccagccattacaacaccagctccagtttctcactcctcagcagcagcatgctctaattcatgttcaagcacaacaaaatgccacttcacctggagacatggataacagacgacttcggatgctttttagcagccgaaacttggttcctgggagagatggtcaatcaactggtttcactgaaattgttcccagtgttggccagtcattgcaaaacatgtgcttacctatgcagcgcactgagacagatatgctgatgaagaagatagctgctctacagcaacaacagccgagtaacaatctgcaacagctcctccaacatccattactgagtcagcaacaacaaagctcaacttatcttgaaggtgagcaggaaaaaatgggtgctggaattgtaacagttgccttttgctggaaatgaacaggtttctaagaatcgaaatgggcgaaagcgcaaacatcctatctcctcgtctggcccagccaatagctctggttctacaaatactgctggtgcttcccccaggtcaacaccttcaactctttccgcacattctcccggagaaacaatatcaacgccattgcagcaccaaaatgcgagctcatgtacgactgtagttgtttatggttctgagggtccagtaccaataggatcgccgaccaatcaacttgttgatatggatcgctataccgaggatgactccatggaagataatttagaaccattcttgccgcataatggcacaaatncaagagctgctggtagccattgtatcagttctg

SEQ ID NO: 13457 - DNA, 1439 bp, Zea mays
taggagccttttttttttttttttttggattttttttttttttttactcaaaccactccgaagccgaatagtagatcacaacacgaagtcacacatgacatgagttgcatattggcacaccaaaaggaaaaaaaagaagcgctatagatcatcgcggcaaatatcatatccgataccggaccaatggatccttgaactgaagccgctggttgtacaccctccacgcatagtcctccagtaggaaagagtgaaacctccatccatcctcgtcgtcggctccggcaccgtttgcctcggcctcgcggccttctccggccgcattggagagcgggaccaagggcgagacgatattgtccaaaggcagagtgataaggaccgtcagcgacagacggtcggtctcgccatgctgcgccgccatgggtggtgcggatgtggggcgagccatccctctcactttcttcaacttgccattgctccacacctgggcaatgtcgccgacggtgacaagcatcgcgtcgtcgcgggcggccactgccgtccactcgccgccgtggttcataacccagcttggcggcgcctcttcctgccctgatgcctcccactggcaatgaagcgccacgacgtacgggtacgccttcgccttcccgacggccggaggtgccgtatcggcggtggagacccgggaggcccacagcaggcaccgcggcttcctcctcccctccgcgaagggcttctcccggaagcccgtgtcggggcacccggagagaagcgcgacaacccgcatgcccacgtccttcatccgacgcgcgtactccgccgcagccgggagcgcgtccaagtccccctcgcaggcgtcgaacactaccgcgggatcgtcggcgccgccgtccacatcctgctcttccccttcctccacggagaagccgagcgtgcgaagattagactccaggcgcgtggacgcgtcgatccgggacagctcggcgagcgcggacgacggtagccccgaagggatgccgtggccggcgaggtggaagtagcccacgtcggcggcgttgcggagggcgcgctggtcgggggactcgagcgagacgagaggcggaagcgagggcggcgacgcctgcgaccgagctgcgagtggagaccgtagctgtggagccggggacgagaggaggaggcggtgcaggaaagcagagagcgaggcgtccgtggccccaccagccgcggaggacggcgccgcgtggtggttcgatggcgttggcggcggagggcctggggtcccgctccctccgagtccgacggtggtcgtgggcgtggctgtggcagcctcggaggacgaagcggccatggagacgctcggatcggcggggtcacaggcagcgcaggtcagggtcagggttgcttttttttcgattaggatgttctaggtaatggtctcgtgc

SEQ ID NO: 13458 - DNA, 1878 bp, Zea mays
attcaggatatatccttagagaggtatcttcagcccaagcaagcacaagcagtgttctgtgttgtcatttctcgtcagatggaaaattaattgctactggaggtcacgataagaaggttttcctgtggaatgctgacactctgaaacaaaaatcaatgctagaggagcattctctgctcataactgatgtgcgcttcagcccaagcactcctcgcctcgccacatcttcatttgacaaaactgtgagggtttgggatgctgataacggggtcagactcaccatcgtagtggggaaaggagacattgggtcttcgatagccaccatcgtcgatgcagtcacgatgagcagatcctgtgctatgcatgaccccaacaggcgctacggtcgaggcgtgagttgatggtggagagctgcgctaatatctgatccaacttggctgagtcggaggaggtcttcgcaggatcgtgatcaacgccggacatgttggtcgatgcgtcggaggaatctgataccaaattgatatgtcttgggcgcctaggactgcacagtggtgatcgcagcaaggcttggaactggggaagggatctcagtgggtatggggatcgaccagaggaggagctgattctgtcagctggcgcaaggtgcgccaggatgaccaaggaagctccaccggccagcatggttattcaattcgtacgttcactgggcactcagcatctgttatgtcactcgatttccacccgaacaaggatgacctcatttgttcttgcgatggggacaacgagatacggttctggagcatcaagcatggaaatgctgtccgaattttcaagggaggttcgacccagctgagattccaaccacgttatggaggactccttgcaacggcttcagacaatgtagtctctatcctggatgtggagaggcaagcttgcgtgaggagatttgagagccacactaagggcgtcgattccgtgtgctgggatcccaccggcgagtacgtggtgtctgtcagcgaagacacggtgaaggtgtggtctttgaacgacgagagcttcgtgaacgagcttagctgcggcgggagaaagttcagttcgtgcactttccatcctacgtacccatccttgcttatcattggctgttaccagtctctggagctgtgggacatgtccgagaaccggagcatgaccgttgcagcgcacgacagcctcgtctcggccctggcatcgtcgagctccggcctggttgcttcgactggccatgacaagcatgtcaagctgtggagatgagctctgcctttcctgccctggcatggcatgttaactacggttgtggacgcgccccaacccttttggcaccattagctatctgcctgcattgcagtagcgctcaggagttaggatggtgactcgaccgcctgactgaacatgtgtccgctgaagtagcgtgcagtaaaaccctgaagaagtgggtttagcgctagcttttgtataggaaattagaacacgggttatgttaagtatccaatgtctgtcactaccttgacatctgacatggcttgaaagcttttgctgctgcaactcggcttccgaaagggatcacatttctgtgctcgtgggtggcgtgtgtggtgtggtgttgtgtacaaggcagatgcaaggctagaaagatatggcagtcccaagtcagaagaaaggaacccttgtagcccgtgatgcctagctaacgcaacgagattcccgtgttcaattctaattcgcacgtaggagtagcagatctgcggatctgccgttccgattcctctacgaagaagaacagctatgcctccggtcatacaagttctgtggccttgtttggtatacctgcgtcgaatcatt

SEQ ID NO: 13459 - DNA, 3207 bp, Zea mays
cttgcatgcctgcagatgattattaccctaaacacttcaaatcagctattatttttaaattttagatatattttacataactactgaagctgctctaattataggttgtagcagtacaagaaaagcttttgtttccgaaagcactgacctctttcttgcctctgctttagtactgctcatgaagcacagtgtggtttccaaaaggcacatatatatagtttgatgcacatacatacaccgtgttgaatcatgagccaaatctttaagccaggggaccatgcactttatttagggagaagctagcacggcgagacaatgctttgcgtgtgaagttcttttttttttttttggtaacgagcaactcccacttggctttgttgggcctttaccggaccaaaaagatgcaacggcagcagcgagagagatttgccggacaatagcatctcgtctaatggttaaaaaaaaaaagaggccgggggaagtggagtcgtagacgacgagagcggtgccgaaagggaacgacgacgacagctcatagtaatgcttctccgatctctctaatcatcaacacaggattctgcttctgtcttgcgaacctcagatgatatagattaacaaaacatatccaactaatacatatgataaagtcggatcgccaaataaatcgtacaaattaacccaacccgtgacgagcgacaacccgttaacacgccatgttctccgctggattggaaaaaaaaaaaaccaaccagcctgcccgggagcccgaaaaccgcgtatgcagccacccattttggtccaactaatgaaattatgaaagccaccacccggcgtgtagttttttctacatataaaaatctgtaccctagagatcggtatgatatgtgtatccctggccacatgggctgcctccggatccgatggccgtgaccccgtcgaccgaggaacccatgtcgccggccgacccggcaggccgctcgtgggtgctgcccgcggtcaccctcgcagcacagccagcctagcccacgccccggccgcgacgtcgctgcgtgcatgtgtatgtgtctctacaggcagcccggctgacgacccactccttcgtccttcctcttcctcctataaaacatgcgccccgcccccgagaggccacacacacacaacaccagctcatcacatccatctcattctactactgcctcagagaccaagctgctgcaaccggagaaggagatctattctacaaagtgaagtacttagcttgggacatggaaaccgtcgtgggagacctcatggcgaccgagctgaggcttggcctgccgggcaccgtggacgactgcagccagcaccagcagcagacccagctgaaggtggccgcgccgccgtccaaccctactaggggcaagaagcgccccgccgccgaggaggaggaggcaaacaagcgcgacgcggaggcagcacccccggcggccaaggcgcccgtggtcggatggccaccggtgaggtcgtaccggaagagctgcttccagcaggcaaagcagcaggccgtcagcagcagcagcaaggcggccgacaaagaggatgctgcggcgccggcgcccagctgcacggcgtccgcagccgcctcaaacgccaccgccagcgccggggccggctcattcgtcaaggtgagcatggacggcgccccgtacctgcggaagctcgacctgaggatgtacaaggggtaccgggagctccgggaggccctggaggccatgttcgtctcctccggcagcgccaacaacaacaacaacctgtcggagttcgccgtcacctaccaggacaaggacggcgacctcatgctcgtcggagacgtgccgttcgagatgttcgctagcacctgcaggaagctgaggatcatgaagagatctgaagccacaggcctgggatcggcgagacaatgaagaaggtctgacgacgaccgagggcccgacaacgttcatgtcgatctcttctttttttttctttttgccccattattttattttgttcttcttgtccgagagaccccaagccaaaaggatgagcttggtgggtggcgcatcaatctacaaagcgcatgcatatacgcggatgtgtgtgcggctttggttctgtaagacgacgactagtagctaggtcttttttagcagcagcacagaagctaaggagatgcatgctgatgacgagcggttgtttcggcttagctctccgtatgctgtgtttgtacaaaccaaacaatacagttatcttcaccgtcgttgatcccttactaattgcttgtggagatcgaggcgatggtcctcttgagctttcagcttgttcagcgtttcgatgccttcgttttcgtattccgtatgtgtgagttcatggcgttatatatatgacatgtgatcccttactaacagttgggattaaccccaagcaagaagaagtcatgttacgaggcaaagcaataaagggcagcaacatgttctaaacgatccagttttggcttgaaactacggcaagtctgtgatgcatatatcgcgctgtgacatgcatgcccacatatgcatgtgcgatctcaagatccagaaaacaataaaactgacccagctcagtcaaacgagaagaaaagaaggttatcatcgagatcgatcggcaaaaggaaattaacacgccgcggacacatattaataacgccgacgacgacctgcctgcgtttcgttgctggcaacacatgcgtcggttgaggcaccggcgggcatgtggccgcacatgagagagctgcactgcatcgccgaagcctccattagttggcatcagaagattaaactggttaatctatagccgattggttgccaggtccatccctgtgtcccttaaatgaatcatataaatttgagatcactagcagtatatattgttctattcgcctaccttctggttggatgccgtatgctggttggtggcgtgcatgacgcctgctctgctctgctcctcgacgcgtagaaaatgcttcggcacagattcattcagaccacgtcgtccgaccgacaacaagcaagaggggccatcgaccgtgtccatgatgatagtggtatgagaaagaaatcagtgaaggtgcgtgatttgggtgtaacaatatgacatgggcctgctgcgttttgggtctgagaccaataataataatccgtagagagagctgca

SEQ ID NO: 13460 - DNA, 1205 bp, Zea mays
cgcgcacaccagaccagctcatcatcacattcgcatacatctcttctagcacgcaaagatcgagctatagctagctctgcaaccagagagaaggaggactacccttcgccggccggcctaaggaggagtacgtacagaacttgggacatggaaaccgtcgtgggcgacctcatggcgaccgagctgaggcttggcctgccgggcaccgtcgacgactgcagccagccccaactggtgaaggccacgccgccgtcgacgccaaggggcaagaggcgcgccaccgccgatgccgtggaggaagccgccggcgccgaggaggcaagcaagcgtgacgccgagacggcgcccccggcagccaaggcgcccgtggtgggttggccgccggtgaggtcgtaccggaagagctgcttccagcaggccagcagcaagcaggcggcggcggccaaacaggaggcggcggcggcggcgcccggctgcacggcatcgtcagcagccgccacaaacaccaccagcagcagcagcgccgccgtcgtcgtcggctccttcgtcaaagtgagcatggacggcgccccgtacctgaggaaggtggacctgaggatgtacaggggctacagggagctccgggaggccctggaggccatgttcgtctcctccagcagcgccaacaacctgtcggagttcgccgtcacctacgaggacaaggacggcgacctcatgctcgtcggagacgtgccgttcgagatgttcgctagcacctgcaagaagctgaggatcatgaagagatctgaagccacaggcctggggtcgtcgtcagcgaggcagcaatgaagatgatcccatctgatcgagaggacctgcatgcccggcaacgttgaacaacatgtcgatcgaacgtcatggtggccttattaattgtttctttcttttcttttcttccttttgtttaattatttttgctgttctggttggcgccgccgtggatcggagggatccccaagccgaaggatgagcttggctggcgcatcgaagcgcatgcaacggatgtgtgcggctttggttctgtaataggacaaccagtggtccttttttcgatctattagcggcacaaaaggagctagatgcatgctgaggttgtttcaaaaaaaaaaacaaatgtgtctgtacaaacgaaacaatacagttatattgatcgttgatcccttatt

SEQ ID NO: 13461 - DNA, 1459 bp, Zea mays
cggacgcgtgggcagctcatcatcacattcgcatacatctcttctagcacgcaaagatcgagctatagctagctctgcaacaagagagaaggaggactacccttcgccggccggcctaaggaggagtacgtacagaacttgggacatggaaaccgtcgtgggcgacctcatggcgaccgagctgaggcttggcctgccgggcaccgtcgacgactgcagccagccccaactggtgaaggccacgccgccgtcgacgccaaggggcaagaggcgcgccaccgccgatgccgtggaggaagccgccggcgccgaggaggcaagcaagcgtgacgccgagacggcgcccccggcagccaaggcgcccgtggtgggttggccgccggtgaggtcgtaccggaagagctgcttccagcaggccagcagcaagcaggcggcagcggccaaacaggaggcggcggcggcggcgcccggctgcacggcatcgtcagcagccgccacaaacaccaccagcagcagcagcgccgccgtcgtcgttggctccttcgtcaaagtgagcatggacggcgccccgtacctgaggaaggtggacctgaggatgtacaggggctacagggagctccgggaggccctggaggccttgttcgtctcctccagcagcgccaacaacctgtcggagttcgccgtcacctacgaggacaaggacggcgacctcatgctcgtcggagacgtgccgttcgagatgttcgctagcacctgcaagaagctgaggatcatgaagagatctgaagccacaggcctggggtcgtcgtcagcgaggcaacaatgaagatctcatctgatctatcgagaggacctgcatgcccggcaacaacacgtcgatcgatcgtcatggccttattaattgtttctttctttcttttcttttctgtttaattatttttgttgttctggttggcgccgccgtggatcggagggatccccaagccgaaggatgagcttggctggcgcatcgaagcgcatgcaacggatgtgtgcggctttggttctgtaataagacaaccaggggtccttttttcgatctgttattagcggcacaaaaggagctagatgcatgctgaggttgtttcagttcactctccatgtgtgtctgtacaaacgaaacaatacagttatattttgatcgttgatcccttaataatttgcttgagcgcgctggtgtttctctctcgagctttcccgactagctagctagctagctctagttcagcgttttaatgccttcgcccgtttccgtactatctgatgccgtgtcagttcatgtcatcgtcgtaagattgttcatcagggtgaaccccgattaaggcaaattattatacaggagtacgtgaaggctaccaacaatataatgctgcaagctagccatacaatattgtagcatgtccaaattgcaaaactgcag

SEQ ID NO: 13462 - DNA, 1167 bp, Zea mays
acacacaacaccagtcaccagctcatcacatccatctcattctactactgcctcagagaccaagctgctgcaaccggagaaggagatctattctacaaagtgaagtacttggcttgggacatggaaaccgtcgtgggagacctcatggcgaccgagctgaggcttggcctgccgggcaccgtggacgactgcagccagcaccagcagcagacccagctgaaggtggccgcgccgccgtccaaccctactaggggcaagaagcgcgccgccgccgaggaggaggcagacaagcgcgacgcggaggcagcacccccggcggccaaggcgcccgtggtcggatggccaccggtgaggtcgtaccggaagagctgcttccagcaggcaaagcagcaggccgtcagcagcagcagcagcaaggcggccgacaaagaggatgctgcggcgccggcgccgaggctgcacggcttccgcagccgcctcaaacgccaccgccggcgccggggccggctcattcgtcaaggttagcatggacggcgccccgtacctgcggaagctcgacctgaggatgtacaagggctaccgggagctccgggaggccctggaggccatgttcgtctcctccggcagcgccaacgacaaaaacctgtcggagtttgccgtcacctaccaggacaaggacggcgacctcatgctcgtcggagacgtgccgttcgagatgttcgctagcacctgcaggaagctgaggatcatgaagagatctgaagccacaggcctgggatcggcgaggcaatgaagaaggtctgaccacgaccgagggcccgacaacgttcatgtcgatctctctctctctctctctctctctcttctttttttttttgccccattattttattttgttcttcttgttcgggagaccccaagccaaaaggatgagcttggtggcgcatcaatctacaaagcgcatgcatatacgcggatgtgtgtgcggctttggttctgtaagacgacgactagtagagctaggtctttttttagcagcagcacagaaggagatgcatgctgatgacgaggttgtttcggcttagctctccatatgctgtgtttgtacaaaccaaacaatacagttatcttcaccgtcgttgatcccttataaaaaaaaaaaaaaaa

SEQ ID NO: 13463 - DNA, 679 bp, Zea mays
  misc_feature (475)..(475): n is a, c, g, or t
  misc_feature (482)..(482): n is a, c, g, or t
  misc_feature (493)..(493): n is a, c, g, or t
  misc_feature (546)..(546): n is a, c, g, or t
  misc_feature (552)..(553): n is a, c, g, or t
  misc_feature (655)..(655): n is a, c, g, or t
attgggtacctccgagccggccggacacacaacaccagtcaccagctcatcacatccatctcattctactactgcctcagagaccaagctgctgcaaccggagaaggagatctactctactcttcagagcactgtgcattgggacatggaaaccgtcgtgggagacctcatggcgaccgagctgaggcttggcctgccgggcaccgtggacgactgcagccagcaccagcagcagacccagctgaaggtggccgcgccgccgtccaaccctactaggggcaagaagcgccccgccgccgaggaggaggaggcaaacaagcgcgacgcggaggcagcacccccggcggccaaggcgcccgtggtcggatggccaccggtgaggtcgtaccggaagagctgcttccagcaggcaaagcagcaggccgtctgcagcagcagcagcaaggcggccgacaaagaggatgctgcggcgccnggcgccngagctgcacgngcgtccgcagccgcctcaaacgccaccgccggcgccggggccggctcattcgncaaggnnagcatggacggcgccccgaacctgcggaagctcgacctgaggatggacaagggcttccgggagctccgggaggccctggaggccatgttcgtctcctccggnagcgccaacaaaacaacctgtccg

SEQ ID NO: 13464 - DNA, 1172 bp, Zea mays
gcacgagaccattacctagaacatcctaacgaacacaccagaccagctcatcatcacattcgcatacatctcttctagcacgcaaagatcgagctatagctagctctgcaaccagagacaaggaggactacccttcgccggccggcctaaggaggagtacgtacagaacttgggacatggaaaccgtcgtgggcgacctcatggcgaccgagctgaggcttggcctgccgggcaccgtcgacgactgcagccagccccaactggtgaaggccacgccgccgtcgacgccaaggggcaagaggcgcgccaccgccgatgccgtggaggaagccgccggcgccgagaaggcaagcaagcgtgacgccgagacggcgcccccggcagccaaggcgcccgtggtgggttggccgccggtgaggtcgtaccggaagagctgcttccagcaggccagcagcaagcaggcggcggcggccaaacaggaggcggcggcggcggcggcggcgcccggctgcacggcatcgtcagcagccgccacaaacaccagcagctgcagcagcgccgccgttgtcgtcggctccttcgtcaaagtgagcatggacggcgccccgtacctgaggaaggtggacctgaggatgtacaggggctacagggagctccgggaggccctggaggccatgttcgtttcctccagcagcgccaacaacctgtcggagttcgccgtcacctacaggacaaggacggcgacctcatgctcgtcggagacgtgccgttcgagatgttcgctagcacctgcaagaagctgaggatcatgaagagatctgaagccacaggcctggggtcgtcgtcagcgaggcagcaatgaagatgatcccatctgatcgagaggacctgcatgcccggcaacgttgaacaacatgtcgatcgaacgtcatggtggccttattaattgtttctttcttttcttttcttccttttgtttaattatttttgctgttctggttggcgccgccgtggatcggagggatccccaagccgaaggatgagcttggctggcgcatcgaagcgcatgcaacggatgtgtgcggctttggttctgtaataggacaaccagtggtccttttttcgatctattagcggcacaaaaggagctagatgcatgctgaggttgtttc

SEQ ID NO: 13465 - DNA, 6368 bp, Zea mays
  misc_feature (4550)..(4550): n is a, c, g, or t
  misc_feature (4554)..(4554): n is a, c, g, or t
  misc_feature (4710)..(4711): n is a, c, g, or t
tgcctcgcctctctccggccgcacaggaagttcctatgagcccctattgttgttccgttgcccaaaccctaagattgattttctattcgtacctactggtttggatgcagcatatgcaggatgaggatgtcgggcggccgtacaggaagttcctctgagcagcgtcacagcctgcaagaggattccattttctgtatgtgttgtggaaatcatttgataggattagtgtcagtatattggttcctgcgatgctggtgttcgtttctgggattatcaagtatggggagagggtgtgggctctgaagagtgcgagccgaaagggccttgacaagacatcagctaatcccagttcacatgaagacacaatcgatgatgtattgacttgtaccaaggaatcatatgctctttggacggtgcttatagctcgaggattttttgtggggcgaactatgctcctgatgggacaggggcctgcatcaacactatggttttatttcaagacaaagtatcaaggtagagaagagaagctgaagatggtaatgatggagcttggcatgatgttcgatctcctctacaccaaagccaacgtgctccagagaaggattggtgtcctattcctgtgtgcttcccaggccttgatggtcgttgccctggttctcttcatgatacgacgtgaggaaggcgcccacaataacaaggttaatgtcgcgattacctacacattattcagtggcgccatttttgtggagacctgctgtgttgctgcggcgattgcgtcgccttggacaagggcacacttgaaggagagcagctgccttcatggtctcagtgactccttgtttgaggctgttcatctgtgcaaatccaccgctaataacatggcacagtttaacttattggatcactgcatctctgtcaactccaaaccaagagttttctcaaaggccctcagtgctattggtctggataagcaatggtacgtccaccacatggataagcaatgctactggtggattatcaaccgtgttttggaacatttggccacattgcccgacgaattctcaggtctagcaactgtacactttacaattaatgcacccactgaacatccagtatggttcaaccagctgagtacatccttcgagcaagtcctctacggcttacacctatacactgacctacatctaagcaggcacttcaacaactgcagcactggtagcgtcgtacaaccacctccacctgagattatgcgacttaaggaagaatgcgagacactatcaaactacatgatgtacctgatggtggtgcatccttccatgttgccagtcaacacggttgcggcaggagatcttgttcaacaacttattggctgggttactaaccaccctggacatggggcgacgacgaccaagctagcaattctgcgagggtactcaaggaccttttacattctggtcatagacgaaccaggccaacacagatcattttattatttgcatcacttacttacgcagatcaaggagatgtgggtgaggcttctcatgtatgctgctggcaaatgcagcggagaggtgcacgcacgccaacttggtgaaggacgtgagctcatcacctttgtctggctactcatgctgcatcatggacttggagacatggcagctgagttcaagcttttaagatctaatgatccaaatgtagccgagcggggggcgtggattgtttcacctccaggaaattatcaagagccgacttgtgccttcaaccacgtgacctttgtagtccattgtaaaagaaatgtctctatgctatttactcatacattacaacagttttttttgtaagtttacacttatgcaagtaacctagagccttagcaactgaaatgttttaggttaggttgcctagatacagtggagggtggaactggaaccaatatgtgatccgttatatgtatactgccgcaggttgccatttattcaatacaacagtacatgtgtacataataaagataaaagaatatattgatgattcaaacaagcgattctgatattaatatcaattttggtttagaatattgctatatttgagaaacaccctgagttttgttgcctctttccataacaaactcttcgatttttaattttgtttttcaaaaggtagctgcaatcggttatcaacctttaagtcctggtttattagtacgtttcttttttatcattccaagtgcacatgagttagtttatcctttttttattttgcactctaaaaatgcactacttatcatattatctattcatcaacttacacaaagaagaaagacctatgatgtcatgacaaatttggttataaagtggttaacaatgagacaagacaaatatctattctatttaaataaggtctatctatatgatatagataaaaaattgtagaagtgcacatgctgtttttctttctataatgattctttagaaataattttacaatattataatatttgttcgacataagttcaatttatttgagtcaaagtatttataataatattgtatatttatatcgtcaatataatattagtcttacggtgatattatatcatacagattttgcatatcataatgatgtttgtcgttcaatacctatgttttaaactaatttttaacttccgtagcaacgcacgggcgtgtacctagtacctaattaagcctcctattcagcttatttgatatcataaatattatacttttattatatacatttgatgagagtcgagatgttttgtctcttaaaaagttaggataataatttatagtttaggccggccgcgccggagagagtacgcagcccattattcgcttgcttacattacaagtctatcgtgatcttgtcattggatggtaggctcactgaatactttgtagagggcaataatgcctgattctgacgactgagctttgagatatctcaggatccagggccaaagattcttttctgttgttttatcatctcccttgcctaagctctatatacatagtggaccaaggacccaatgcaagtcacccaaaaacatattcttctgttcaattctcaagcctatctcgaagtgctatagatatgcccaaactgccctgttgctgtcactacaagtgctactctctgaatgtaattgtttcacatataaaaattaaacctatttggctaaaaaaatactgcctccagttaactatttaaaattcgactgctgatttatgtgtactatgtacacgtaaaatatagctaatgtctattttcataattttttttaataaaaacttgacctgcgcgggtaagacaaccctggacattatattaagacgaccttcccacgtaagtcgagaaaacctctgaatctctgtcccacacctatacagtgacaccgtagctcatgtgagaaatggtcgcgatcgggtcggagccttaggctgtctccagcagcgtcccctaaattccatcccctaaaggaatattctctgtcctttacagcacactctaaaagattctgtcctctatatattctcagtctccagcaacgtcccctaaattcggtcccctaaagctacagtgttaacagattcccttttttcatttctttttcagttttctttattttcttcccaattcacgctatacaaatgatgcgcaaaaaatgtatttattaatttttcgaattgatattttcgaattgtctaaattaattatcattgcctgttgttttgtgtgtaattgttctcgatagaacgtcgcatagaagcaggtcaagctagctttgcagaggatgcaagatactaagagagcgtcattggaaaagggcgtgtttcatttcaagaaagtattatgagaagtttatcatggaagagtgaggtcttgagaatctgcacagatgttcaagcagtggctgcaagatccccaactgtatgtgatcaagtggtcctgtctgtcaaacacaattgacaattgtatagctgacacgcattaatcttcaagaagtattaaaatgcctctatcgaaaacataattgggcaagaagtccttgaggcctgtatcccctaattgtctcctaatagttcgctcataaaggtttaagcatgatataaaaatgagaataagcaattagaaaaatattaagagaagataggcactggatcaggtgtctatgaagtacaaacgaatgttcatacaaagatacaatagacaccgacaatttttatcatcatccagatacacacctccacatcatgcaaaagaatcaaaccatcttctgtgccaagtgctattattttaccatcagggctccaacaaattgatgtgatgcacttccctgaacaattataaatactttagttcccagttcctcactattttttataagttcaaagcagacatgatcttataaatcactataactaaaaggtataactgaagggcacactggaattgacagattgtacatattgattgtaatgacaaggaacattcaaagtgggcaaaaacaacaggcaactgagggtaatggngtangggtgtatcaacctggagagattgtccaaagcctttgccaattgaagcgatggaggagaaccttggagtcatcagtaaccatagcaagcagatccttctctggattccattctgccatttttatctacaagtatgaaacacaggcacgtcagtacnngatgccccatttagcatacattaagaaataggaacaaagaaacaataggaaattgaatctcactgtgctcaatcgattctgaattacagaaaagatataaagcgacaaaaggtgaaattcagtatcagcaaccgtatgatatatgtgcttgctattaacttctctgttacttaagaattgtttggtagcgaattgtaaacatgatacaaggtgaatgagactgattaagcatgaacaagaggcaaacggtgtagttactaaagtgcatttgcaaaacaaaaaatagcattcaaagctgaaatcagtgctctatatcagtgatatactgaaatggcacctcacaactcacagttcagaccaacaagttcccaccgaacccaactgcatccctgtcaactctgcacagcgacagtaggatccgacttaatcctcgtaggaatttcaacaaaacaacagcagggacgcacgcaacgctcggcggcagcaacccaaggatccagcgcgtgaaccaggcattgccctggacagcgtgaacccaagcggccgcacactattttgcagcctcagcacatgttgattaagaatcagcacagcacgaacttgcacaacagcgtttgcctacgcagaagggagaggcaggggaggagatcgcagactagacctggaacgggatgggcttgtcgaactggagctggaacggcgtggccgccgccgcggccatggacgcctcttcgatctgctcctccgccatgctccgcgtccagcgagggccgtgcaggcgggagggattttttgtttgggggacactcgaagcgggcggtcgcgaggggggggaaggggacaaatggcgacggcgaaccggcgattgcgagcggcgagccggcgaggcaccgagacgcgtagagaagggttttggacaacaagattttggggggcaaaaggccgtcagcacctatatgcgggattatgatgatcggattctaaccgtcagagtcaacttttgtcagccatgtttcgtttctgagattacttctgtgagaatggcttatataaaaaaactcagaaatcaacatctctactacttattaaggccctgtttgtttcaacttatagattatataatctaaattataatctagattatataatctggattatttgctctggattaaataagctaggtgttgctgtttgttagctcggattatttggatttggcttattattcatatgcatgcaaatacaataatacccttggctgttttacttgtctggtttcatcagttggcactacgcagtttatacacaacaatttatacacgtttatagatgcttttttttccaaatagctcatacacgttttgtccaacaattgtttaatgcgtaattttaaaaagacaaataattcatacatgttttgtccaaaccaaagtactcaatataaaattacattctcatatcaaatagtgcattggcaatttgatctcgaaagttattcatgtctccctcttcttctcccaaatgaccttcagcattgtgatgacttggaggaatcggcatatagttctcgtcttgatcacaacgatcaaactcatcatcggccattttactatctcgaatgaaattatgtagagcccatgcatgcatgtattatttt

SEQ ID NO: 13466 - DNA, 2322 bp, Zea mays
tgcacttcttgtaggcttgcattgctagctatagctagctaacccgtcccgtacgtgtgtgtgtgcaggggtgcgacggctcggtgctcctcgactccacggcgaacaacaccgcggagaaggacgcgaagccgaacctgacgctgcgcggcttcggcttcatcgagagggtcaaggccgcggtggagaaggcgtgccctgacaccgtctcctgcgccgacgtgctggctctcatggccagggacgcagtgtggctggtacgtcgtactacgtaccaaagcatgcatatacgtacgttattatgagaatctcttcttactggctacctgttgttgttctcactcgctcagagcaagggcccgttctgggcggtcccactggggcggcgggacggcagggtgtccatctccaacgagaccctccgcctcccgccgcccacgggcaacttcacggagctggcccagctgttcggcgccaagggcctggacaccagggacctggcggtgctgtcggccggccacaccatcggcacgtcgcactgcttctccttctcggaccgcctctacaacttcacgggcctggacgacgcccgcgacaccgacccggagctggaccgcgcgtacatggcgcgcctccgcgccaagtgcgccagcctggacgacaacaccaccctggtggagatggaccccggcagcttccgcaccttcgacctgggctactacgccaacgtggccaagcgcaggggcctcttccactccgacgcccagctgctcgccgacccttccacccgcgcctacgtgctccgccacgccacgggcgcccacagggacgagttcttcgccgacttcgccgcgtccatggtcaagatgggctccgtcggcgtgctcaccggcggccagggcgaggtcaggaagaagtgcaacgtcgtcaactaacttattatatggcctcctgaggagtcatgtctttctcttcttcattttttcgttcactgcattattgattgattgattttttttttgttcctctgtcgccatgtatgtaatgtaaatctctgcccctcatcttcagttgtccatcaggatctcatgataatgcatgcaataaaacatttttgatttagtctgtccattactggctctgtgttctgtctgccgagatgccattgccgtgcgcatactaaaatcaaatgagcctgtctgtctgtcgtccatgcaacatcatcagcgatccagttgtgacgcacatgcacggcatacaaggcgacacgcgtgctcgatcagtatacatgtctgttgacggcggcgcggccgtggccggaggagaacaccaatcaatcaataataatgcactcatcgcccattcatgtgtttcagttcagggcatctgcaatagtatgcggtgtattgttttgctagggcctagtggcagagacgcagaggtgccccacccccaccccacgccccatgctgctggcgccatttgtttactggtacgggcagctctcctggatgtctgtaacgggccggaggggacggcttcttgcgcagcagctcacatgccatggcatgcatggatgcgccgcagggcgtggactgttgccgatggcatctcgccggagcgtcgcagacttgcagtgcagcgggtttctttttgtatgtgtgtgtgttccagatagtttttctttttttgaacaagtagtgttccagatagtttgtcagatctaatagcagatttgatgctgccgcgaggccgcgacgccttaaggccagttcggttgataggaaatagaagaccggaactgttaccacccagattacttctctaatttatataagttttgatcaacagtaacaaatcttgatgtattcctccataaacgaacggcccttatggaaaaggctggttgggctcttagatttcagaccggcgcggctcgctgccccggaaaagactccagcaggccatggtccatccttttgattcgtgtcgaggcccgttagtacaaggcggctcgtgaaacgctgaaacctcatctcaaaattgtgaccttgtcggcgacgacagatttaacatggtgagatacattcgcttttgatttataatcgtaattatttattcgtttattcctaacctatgcatgtgtcattgttgtattattaattatttaatctttgaagttgtcgtaattgtatatcatcgacgtatgggctctgttaatttattgcttagagagtcttttagaaagacttgttcggtttggagggataaggtgattagaggggattaaattcctttctaatcaaaatgaataaaaaagaa

SEQ ID NO: 13467 - DNA, 2182 bp, Zea mays
agcagaaccagcttattactggtgatgtatttcaacaatggaatggtgtaagccaagaattgagtactaaccccgaagcttgtctgttcagcaatatgcttcatctgagaaaactagatctcagttgaaatccttcataggtcacaaggcagaacagctatacgtgtacagatcgctaccccttggacaagatcggagacggaaccggtattggcagttttctgcatcttcatcatcctatgaccctggttcgggaagagtcttttttgaatctagagatggatattggagggtcattgattcatctgaggcgtttgaagctttggtatcttcccttgatactcgtggcatccgtgagtcacatctacactcaatgttgcaaagtatcgagccaacttttagggaagctgttgagaggaagaagtgtgttagtttagaacacacaactgggtggactgacaatggaagtaatgaaagtccaaactgcaacaatgagtttggaagtccatgcagtaccctttctggtgttgcttctgataatcttatggcatattcagatactttcaagatagaaattgggcacaacgaagctgagaaaagttctatctcgaaaagggcttctgtgtttctgaaatggatgtggagagagtgctactgtcaccaatccacgtacaccatgaaatatggaaagaagcggtgccctgagttgattcaatcttgtgaccattgctaccagatatacttagctgaagaacaacactgttcttcttgtcacaagtcattcaaacccattcacaatttcttggagcacttatcacaatgcgaagataatcagagaacaaatcctagttggaagacacaaattgtgggcctttctgtacccgtaggattgagattgctgaggttgctcttagctaccattgaggcttcagtaccggcagaagctctcctacctttttggacggatttgtatcgaaaatcttggggtgtgaagttgtattctgcatcatctgctgaagaagtcttgcagatgcttagtgtgctggaaagtgcaataaagcgagattacttatcatctaattttgaaacgacaactgagttgcttaattcaaacacacaagatgctacccagaattcagttggaggttctggatctgccactatacttccatgggttcctgacaccaccgctgctgtcgccttaagattgttagacttggatacttccatctcatacaaacttcattcaaagttggtttcaaataaggagcaagaagctggagatttcatgaagcttccactgagatacccttctattaataagaacaaacaagaaatagaacagttcatacctattggttttgatcaacaggatggaacattgctaactaacagcaatggccgtagaggtcgtggacggggaggtagaggtggacggggaagtagaggaggtagcaggggaggtagatctcgtggtggtggtggtagggttcccaggggtattggtagctcatccaggattcagttcagggatgacaatagtgtgccctatgggagagccgctcgaaagaatgtacgtggtgggcgtacgcgtggtcgcggccgcggccgtggacttcgaactgtcagacctcggcaaccatctgaattcagtgccacatcaattccaaagttaaacctattgggcagctttagcatgttaagtaaggcaaatcacactggcaatatgcattctccagagagcttgggtgcagaagagtgggtcttggagagaagggaatatgtcaaggatgatgatgacaatttggtctctcgatatgatgagtcagaggaggaaaatggtgagcctatgaatgaggaatatgatgagcagatctcaggctatccaagggacaattctgagttcagccccatacagatgatgggtgatgtgagccacgatgaggatgctgaaggggatgagggcgaggaggatggagaggactatgaaactgaagatcctgctggtgatgaggatgatgacgttgagatggattgggatgatgacattcgggacaacgatgatggtaatggagcagccaacgcagatgaggatgaaggtggtacgtgccgggcggccgctcgaacctgccggcgccgctcgaatgccggcgaccaaggaagaccccacgcgtgaagcaag

SEQ ID NO: 13468 - DNA, 1778 bp, Zea mays
cagcactcagagcctaaagtccttagaaacagcccttgcatctcagtcttttctccagctgggactgcttacaggattgcctatggtgatggagctaggtttggaaaagggtttccgtgcagctctgagtgattttatcctcatgcaattgcagttagcatcagttttcttcacattctcacttggaacaaaagcacactactacggccgtactattctccatgggggtgctaaataccggcctacagggcgtaaatttgttgttttccatgcaagctttactgagaattatcagttgtattccagaagtcattttgtcaaaggatttgagttgatcttccttttgatagtctaccacatctttaggagatcttatgttagcaatgtcgtgcatgtgatgatcacatactcaacatggtttatggcagtggcttggctgtttactccttttctttttaacccagctggttttgcttggcaaaaaattgttgacgactgggctgactggaataggtggatgaagaatcaaggaggcataggagtgcaaccagagaaaagctgggagtcatggtggaatagtgagaatgcacatctacgttactcagtattgagttctagaattcttgaagtgttgctctcactacgcttcttcatatatcaatatggacttgtttatcacctgaatatctctcaagacaacaagaatttccttgtctacctgctttcatgggtcgtaattattgccattattggttttgttaagcttgtcaattgtgctagccgtcgtttgagcacaaagcaccaactcgtcttcaggctcataaaacttttgacattcctctcagtggttacttctttggtccttctctattgtctctgtcgattatctatcatggatttgatcatctgttgtctcgcattcataccaactggctggggtctcctccttattgttcaagttttgagacccaaaatagagtactacgcagtatgggagcctattcaggtcatagctcacgcttacgactatggaatgggatctctgcttttcttcccgatcgctgtgcttgcatggatgcctgttatctcggccattcaaacccgggttcttttcaacagagcattttcccggcaactacagatccagccttttattgtaggcaaaactaaacggagatagcataaccgatggttttacatcgcatattggggatttgtgaatatgatctattggttggtcatcagagcaataagtttctgtactctggtagcataaatgtcgtgtgcagtgtgatccatgattctttggcctaagcctgtgccacatctaacatagtaataccttggtttcggtttttattgccgtgtaactttacatatcatttctgtaaaaaagaaacagctctagcattgctcttagatgagttgagactgatgaatctcatgatacctacacagttacaaaggtactaccttattttcatgtgaaatacgacacttattgtactagtgtattattatgctttaacgtgcagtaccaaatcatttgccactgttagattcttgtgtttgattattttttcgaaagcacagcaagagagttgctgaggcaaaaattattagacagggaagggaagaaaaccacatgcaaggaggacgagtggggatgatgaggggaagagcagacaatgccgcccaccccaaacaaaagcgctaaaagagaaaagataaaaagtcacttagacaaaattacacacgctagccctcaaaacgctgca

SEQ ID NO: 13469 - DNA, 2528 bp, Zea mays
cgattgggtccctcgaggccggccgggattccattccaaaagctctcgagacttcctcagcaatcaatcagctttccagcgatcggcagctcctcgatcgtttcgaagctccaatccgcccggccgcctccgcctgttgccactagctaggtgatcgatcgaatggactgcggtggcgcgctgcagctcccgcctgggttccgcttccaccccaccgatgacgagctggtgatgtactatctcctccgcaagtgcggcggcctgccgctcgccgcgccggtcatcgccgaggtggatctctacaagttcgacccatggcagctcccagagaaggcgttcggtggggagaaggagtggtacttcttctcgccgcgcgaccgcaagtacccgaatggctccaggcctaaccgggcggccgggacagggtactggaaggccaccggcgccgacaagccggtagggtcgccgcgccccgtggccatcaagaaggcgctcgtcttctacgccgggaagccgcccaagggcgtcaagaccaactggatcatgcacgagtaccgcctcgcggacgtcgaccgctcggccgccgcacgcaagaagaccaacaacgcgctcagggtaattcactacaccatgacctttctcaggagaacatatttatctccccgaaatactgacacttgcagttagagggaaaaaatatagagagaagtaaaaaaaaaaagattgatgtttgattttaccaatgctgcaacaagaaacagtggatcgaatcgaaatgtgttgttaggcttgcaactatatatgcagattcttagttaagaggaattgaaaaaggctctagagacatgtaaagcgcgggcggcgtggcgtcacggctcacgcacgccgcgatagagacaagcgcggcaaccatggtccatggccggcgcagagccgccgcctgatcttatcgcccgcgcacaaattaccacatgcgcggcgcgcaccggatccgacgtcacgtcgacctcatctccaagcctcttccaaacactccaatgcgtactggatgactgggtgctgtgccggatctacaacaagaagggtgttatcgagcggtacgacacagtggacgacgacgacggcgacggcgccgtggccgaagacgtcaagccggtgccggcgccggcggcgtcgaagaacccgcgtgccagtgcccgcgtaggggcagcagcggcggcgccgatgaaggtggagctccccgagtacggcggcggctactacgactacgacgacctggagacgccgtcggcggggatgctgtgcttcgaccgcccgtcggccccggcgcccgcggaccgcgactcaaacaactccgtgccgtggacgacgcaccacacgcacacggacaactccagcagcggctccgagcgcgtgctctcgccgtcgccggacctgcccgaccgcgaccacgccgagagccagcccgccgccgccgccgccgccgccgggtggtggcctgtcggaggcgactggggcagcgccgccgaggacgggttcatggtcgacgtcgacgtcgacgacgggagctcgctgttcgggccgcagtggtcacaacgcagcgtacgcggggacgccgccgcgttcggcttcggcgacatgctcgcgtcgtacctgcacaaaccgttctgatgcaacgcgacgcgacgcgacgcgagcgcggccaccccgcgcctgcgtgctcctctaggccactgaccactgacatggacattctggtcgtcgtgtagctcggttcaggacgaatcgagagccggccggtctaggtgtagtgctgcgaaaccaacaccaccgtgcaggcacactctccgcgggcggcagatcgacggacaatcctgcgcccgtaggtatataccggtcgtcgatcaggtgttcatcagttcttcattcattcaggtcgacgtgcaactggtaattgtacaagatcttgggcagctgccgtatggagatcgatgagtgccgagttagcatggaggacgactggtggtcatggttggtacagagctagctagccgtccgatcgggtatcggattaatctgattgccagttttgtttttttttggtcgcgtcaagtagctgacatcttaagaatgaagcctactggattcagaggcctgttgatggtaatggtatggtgtatgtatatcgtctagtttagtctagcctagctgtacttagaattggttcaggttggtggcaagcagagcgctgtaatttttgttgagtgtttatgcactataattgcaacgtcatgtattagagtcgctctcagcggtcgctttctcgtgatcgaaaattttgcgatgcaaattatcctaataaagttgttgtaagatgtaattaaaaaaaaaaaaatcgaagcggccgcatttgctggcctttctgcctaatctgaacgaatgttctggtgcacggagttaaccccccaaaaaaaggcgcctttcagaaaccaggagtgctcgtacacgctagaagctgcaggcatgca

SEQ ID NO: 13470 - DNA, 1806 bp, Zea mays
cattgggtacctcgaggccggccgggcggcgatttcaaaagctctcgagacttcctcagcaatcaatcagctttccagcgatcggcagctcctcgatcgtttcgaagctccaatccgcccggccgcctccgcctgttgccactagctaggtgatcgatcgaatggactgcggtggcgcgctgcagctcccgcctgggttccgcttccaccccaccgatgacgagctggtgatgtactatctcctccgcaagtgcggcggcctgccgctcgccgcgccggtcatcgccgaggtggatctctacaagttcgacccatggcagctcccagagaaggcgttcggtggggagaaggagtggtacttcttctcgccgcgcgaccgcaagtacccgaatggctccaggcctaaccgggcggccgggacagggtactggaaggccaccggcgccgacaagccggtagggtcgccgcgccccgtggccatcaagaaggcgctcgtcttctacgccgggaagccgcccaagggcgtcaagaccaactggatcatgcacgagtaccgcctcgcggacgtcgaccgctcggccgccgcacgcaagaagaccaacaacgcgctcaggctggatgactgggtgctgtgccggatctacaacaagaagggcgttatcgagcggtacgacacagtgaacgacgacgacggcgacggcgccgtggccgaagacgtcaagccggtgccggcgccggcggcgtcgaagaacccgcgtgccagtgcccgcgtaggggcagcagcggcggcgccgatgaaggtggagctccccgagtacggcggcggctactacgactacgacgacctggagacgccgtcggcggggatgctgtgcttcgaccgcccgtcggccccggcgcccgcggaccgcgactcaaacaactccgtgccgtggacgacgcaccacacgcacacggacaactccagcagcggctccgagcgcgtgctctcgccgtcgccggacctgcccgaccgcgaccacgccgagagccagcccgccgccgccgccgccgccgccgggtggtggcctgtcggaggcgactggggcagcgccgccgaggacgggttcatggtcgacgtcgacgtcgacgacgggagctcgctgttcgggccgctgtccccggggctgttcgcgcgcgtcgacgccgccgcgttcggcttcggcgacatgctcgcgtcgtacctgcacaaaccgttctgatgcaacgcgacgcgacgcgagcgcggccaccccgcgcctgcgtgctcctctaggccactgaccactgacatggacattctggtcgtcgtgtagctcagttcttcattcattcaggtcgacgtgcaactggtaattgtacaagatcttgggcagctgccgtatggagatcgatgagtgccgagttagcatggaggacgactggtggtcatggttggtacagagctagctagccgtccgatcgggtatcggattaatctgattgccagttttgtttttttttggtcgcgtcaagtagctgacatcttaagaatgaagcctactggattcagaggcctgttgatggtaatggtatggtgtatgtatatcgtctagtttagtctagcctagctgtacttagaattggttcaggttggtggcaagcagagcgctgtaatttttgttgagtgtttatgcactataattgcaacgtcatgtattagagtcgctctcagcggtcgctttctcgtgatcgaaaattttgcgatgcaaattatcctaataaagttgttgtaagatgtaattacgt

SEQ ID NO: 13471 - DNA, 686 bp, Zea mays
acccaatcagcttcttttgacttttcactgggatttcgcgtcctcctcgccgcccggcgaatcgagagccggccggtctaggtgtagtgctgcgaaaccaacaccaccgtgcaggcacactctctgcgggcggcaagatcgacggacaatcctgcgcggctgcgcccgtaggtatataccggtcgtcgatcaggttcgtcagttcttcattcattcaggtcgacgtgcaactggtaattgtacaagatcttgggcagctgccgtatggagatcgatgagtgccgagttagcatggaggacgactggtggtcatggttggtacagagctagctagccgtccgatcgggtatcggattaatctgattgccagttttgttttttttttggtcgcgtcaagtagctgacatcttaagaatgaagcctactggattcagaggcctgttgatggtaatggtatggtgtatgtatatcgtctagtttagtctagcctagctgtacttagaattggttcaggttggtggcaagcagagcgctgtaatttttgttgagtgtttatgcactataattgcaacgtcatgtattagagtcgctctcagcggtcgctttctcgtgatcgaaaattttgcgatgcaaattatcctaataaagtttttgtaagatgtaaaaaaaaaaaaaaaaaagcggcc

SEQ ID NO: 13472 - DNA, 2133 bp, Zea mays
  misc_feature (1648)..(1648): n is a, c, g, or t
cccctgaccaggcataatagtataaacagcactccgatgaccaggcataatcgcagccacgctcgagttgttccagcagccacacgagctgcagtataatccgtctctctaatcatctctggtacgcctgagtgagtgagtgagtgctcgacaagtcgtcgcgtacgtctggatggacagagtcggctggagtgacgcgagaaggaccgggatcttccgtgctggcgctgggatttccaacggattacgccaccgggaaggcctaaagaattccggtggcggtggggataaccaatcattgtcggctcggcgaattccggcgtttggggttccctttcttttgcagcaggtaggtgagccgtatgcttccgagagttgaatttcagaaaaaaagacatccctgcactgaaactccaccgcgcgtcgctgtccacttgtaaaactcgccttctacgactgagcgtcccttgcgttcaagtctcctccctggatggacctagctggaaccctacaacaacgagccaggcaccacaactaagaacagttacaagaattctaacatcccattagcaccatcttaattatcaggacatatattattagatagtacagttagaaaccaaaccactccatttggtctccatctctatccattccccaagtgtccaagtcatgcatctctgtctccccttttaaagcccaccacctctctcccgccatcgtcttcccgtctcccagtccgatcccagctgcgcgcgcccgtggacttgtcctgccatggaaggcctcatcccgttcatctacagggccgtcgtgcggtacaggaaggaggaagggcgggtctccctcggcgacctcttcttcgacgagccctcctcgccgacgtcctacttccgtctcccgggcggcgccgactccggccggtaccagcaggtgacgtcgagcgacctgttgtcatcccagacgactacgtcgacggccagctccggtgcagccggcgtggcgcgacgacgctctccgatgaggtgcccgtcgcaccgccggcgcccggtctccccggacccgtgactcgatcgtgaagtgaagctagccgcccgtgaggcaaaaaaagaaaagcaagcgaaggtttgtttgctcatggcctcacgtagcagatggagcgtgtggtatacgtagtatgaggatgatgctgagtaattgtgaatattagcctctaagtagctgcgtgtaagtgtacataaattcttcatctttttttactgtggtcatctgtaatgtaatgtaatggatggatgggtgcaggaggtactccaaaaggagaggctttgtgccttggagtgaaaactgtgtgtaattcgttggaataaatatgccaggcaaacgatgaaacgcatggattttaattcagaaatccatgcttttttccaaacggtggtacgggccggcccaatttcatgatcccttttcaaaagcggttctacatgataaactagaatctacagtgcctcaatttatttggacgcagctcctagcccatccattttgtttttctcgagccgtccgatctcggcgattaacaggacagagaaacaaggcataccatctcaatcgcggcggccttgatgtgaaattggccagcttgtttcgntttgtcaacagcacgtgcccatttgtctagttgagctcgattgctcgagtaaaagaaatgcatcacacaacataaaagtcatctctatcaaaaaaaaaaactaacagcttgcttggtttgaggaacgggcagtctatcattgtttgatttgtggaatagaactagtaataatatgattattgtttgatttgtgaaatagaattagtaataatatatgaggatgaactcatgagtcatgatacaccatctcatttaaaatgaattgttttttcaaaccaaatactccctgaaagtccaaggtcttgcttcggattgtttacatagacctgcttgatttgcagtgtgcgaggtcaccttgcatcaaagatagagaaaaggcatataactcagtagacatggagagatctagtgaatttcttccattagtaactgttcacttcaaggactttacatgatcccaacattccttttttttgggggggggg

SEQ ID NO: 13473 - DNA, 1148 bp, Zea mays
cattgggtacctcgaggccggccgggaaaaaaaaaaaaagcagccaacagatgcaacaaacaacccaagtctggttttttttttacccctggtgcagggctctctgggctcgagtgtagtcatctcctctgcacgctgtttcaacacaatgatcatggcatcagccttttacaagtttgggtaccagtcgtgtaaactgagtggtcctggtgcatgcaaacaacctacagccaccgccgctgctagcggcggcaacggtgtccatgccctagcgacaatcacgcgcagcaactggaggtgccggaatatggctaccacagcaagtggaacgacgactatggccgtggccggacgccggcgagagaagaaggacgacgtggtcgagggggaggacgaatggcgcagctacctggctccggagaggctggaaatgctgagacagatggagccgtgggtggaagagcacgtgctaccgttgctcaagccggtggaggcgtcgtggcagccgtccgacctgctaccggacccggcgactctgggcagcgacggcttccacgccgcgtgcctcgagctccgagcggcggcggcgggggtgccggacgacctcctcgtctgcctcgtcgccaacatgatcacggaggaggcgctgccctcgtacccgagcgggttgaaccgcctcgaggtcgtgcgggacgccacgggagccgacgccacggcgtgggcgcgctggatccgcggctggtccgccgaggagaaccgccacggcgacgtgctcaaccgctacatgcacctctcgggccgcttccacatgcgcgaggtggagcgcaccgtgcagcgcctcatccgcgacggggtcatagtgcacgcgccggcgagcccgttccacggcttcgtctacgtcgccttccaggagcgcgccaccgccatcgcgcacggcaacacggcgcgcctcgtgggcgcgcgcggggccggggacgccgctctcgcgcgcatctgcggcaccgtcgccgccgacgagaagcggcacgaggcggcgtacacccgcgtcgtgggcaagttcttcgaggccgacccggacgccgccgtgcgcgccatggcgtacatgatgcggcgccggatcgacatgcccactgtgctcatcaacgacg

SEQ ID NO: 13474 - DNA, 3248 bp, Zea mays
atcaagcaagtagagtgaaacttacataaagatcctgttcatcatcactctcaaaatcatcttcaaagtcatagtcgtcctcatactcttcgtcatcatccattacatctgcatgatttggtgaacgaagtaactttatttagtataacaaagtactgcttggcttatatatgaaactaataatactaactgagcaggggacatcaaaagtcatgagcagacaagtatgctggttgctgaaacactgtatgttttagagcacacaagttcagacaaacgcattgtaaatcagaaccgctacataacctaagaccataaatcattattgatgtttgcaatagaaggaaatacatcactacatcagccctgtcccaatttactaacaagactgtagtgttgcacctccaagtgttcgtgctagaaagcataaaccttgacaaggtaaggactaatgagttacgcaaatgatcaatgacatctttccctcaatttcgtggtgattgtaggtcccaacaatgtgcagtgcaactgcatcttcttctgaaacaaatggaagagtctgcatattgtaggataactcgtagtcatgtgtgtagatgatcgtaccacacaccttgctagcatggatgattcatagtgaacgataagacacaagcacatgaaaaggaacagatgcgcaaaacgcttctcactaaaattttagaggggatgcatcacagtgcgaacaatcagatgaggggagcatataaatggagcaaactgcaggcaccccaatccccagtcgtcccacaggaagtcagccggaaatcccaaacaggaaaaacaaacatcaccgagttcacaaaatccattaccgccttcgtcttctttggcgtcgtcgaagtcctcctccatctcgtcggtgaaatcatctgcgacctcctcatctggcggatcttcgatatattcattcctcttcttcttggcaaatggcaccaccgctggggcattccgacgaacaatgggtgggcatggacgtccggaaaaggcagcactcagtgccacggtagtggagggcaacgagccgggcagaagaggaaaccttgatggcctgacgggtaagcgcccatgaacgacgctttcgacgaccaaatccatcggttaacagatgacttcagagccaccatggagcgtggtgacgaggccagcttatccttttaagctggtaacggcgtacgccaacaggatgcggaaacgtctttctgaaagtccgccataactgacacgtcctcaccctccttcggtccttcccggttaccaatggagacgaaacggtcccctccggcccccatcgaagaacacaacgcgaactagtgtcgccacgccgcctccgctccgacgcgcgtgtccgccaaatgccgcgcggccacccccacccgctcccacgccgcggtcgcctcctccagttcgccgcggcggcgtccgggctcctgctccttacgctgctcgtcctcctcccggccgcgccgccctgggagcacaccaccgcgcccgcctcgctcctccacgcggccatcgctgcgcacccgtcgccgaattcctacgcgcggccctgcgccgaccacctcgccctctcgctgcaccgcctccgcgcctcgttgtcgtccctggagtccggcgacgtccccgccgcgctccacctcgcctccggctcgctccagtgccagtacgactgctcccacctcctctcgctcccggccttccgctcccaccccctcacgtcccgcttcctcaattcccttgccccacaaaccctaaatgccgccctgaaacctcctccctcttccgcccctgccgccgcattccctgcgaggatccgccccgacgccacggtgtgcaaaccgaattccggtgtgaagccgtgtggctactcgaccgtgcaggccgcggtggacgcagcgccgaaccacaccgctggcgctgggcactccgccatcgcagttggtgcaggtacgtacaaggaaaatgtcgtgattccgtatgagaaggccaacattttgctgatggggcagggtatgggagctactgttatcactgcgtcccggagcgtggggatcgatgggctgggaacttatgaaactgcgacggtggatgtgatcggtgacgggttccgtgcgagggatataacatttgagaacagcgctggtgctggagctcatcaggctgtagcgttccgttctgacagcgatcggtcagtgctggagaatgtggagttccgtggacatcaggatacgctgtatgctcacacaatgcggcagttctaccgcaggtgccatattgtagggacagtggattttatatttgggaatgcagcagcagtgtttgaggaatgtgtgattaagaccgtggtcccggccgagggagctcagaagcgcgcacgaaacgtggtggcggctagtgggaggattgatccggggcagacgacagggtttgtatttgtgaattgcactgtggatgggaacaaagggtttgtcgaattgtttcggagaaagccagattcatacagactgtatttggggcggccatggaaggagtatgccaggacattgtatgtcagctgttatttggggacagttgtcaggccggagggatggcttccatggcgaggtgattttgctctcagtacactgtattatggagagtttgacagtcgaggccctggtgcaaaccacacagcaagggttgagtggagcagtcagacaccagaacagtatgtcaaacacttttcaaccgagaacttcattcagggccatcaatggattgcgtactaactacagtgtaaattgttgttcttggatcagtgacttattggcaccttaagactgtctctagtaaactatgcagaataggagatacggaactatatatgacactgagaggagtttgaaataaggaatgtgatagaggatgagatagtgaatctgctggagatagcctaacagcacgatagtgaaaattttctggaatggtaaatacattcatccattattccaaggatctcgagacacatgtggttcctgttagaaaatccaaactgatgtggttcgtgttttgttttcttactatatatgtacctattttttagtaataattctgtttttgtaattaaactgtcccttgtatatagtaaagattaaaattgttttctctaaaaaaaaaaaaaaaaaaaaaaaaacaaaaaaaaaaaaaaaaacaaaaaaaacggggct

SEQ ID NO: 13475 - DNA, 1561 bp, Zea mays
agtccccgtgcgccacgccacctgccagtactagctcgcccgctcgatcgcgcccatcaatcaatcaattctcgacctcactactcgatctcgtctcatcagtgtgagtgtccgagcacggcagcacgcgcaatggacgctctgctcgtgactacgaccttcctcgtccccgtgggtggcgctcctcctcgggtccgggtccgggtccgcggcggcgctgccgcgcgccttcttcgtgttcggtgactccctcgtggacaacggcaacaacaactacctgatgacgacggcgcgcgccgacgcgccgccctacgggatcgacttccccacgcacatggccacggggcggttctccaacgggctgaacatccccgacatcatcagcgagcacctcggctcccagcccgcgctgccgtacctgagccccgacctccgcggcgcccagctcctggtcggcgccaacttcgcgtccgccggcgtcggcatcctcaacgacaccggcatacagttcgtgaacatcatcaggatcgggcagcagctgcgcaacttccaggagtaccagcagaggctggcggcgttcgtcggcgacgaggacgcggcgcggcaggccgtcagcgacgcgctcgtgctcatcacgctcggcggcaacgacttcgtcaacaactactacctggtgcccttctccgtccgctctcgccagtttgccatccaagactacgtcccctacctcatctccgagtacaggaagatcctcacgcggctgtacgagctcggggcccggcgcgtggtggtgacgggcaccgggatgatcgggtgcgtgccggcggagctcgccatgcacagcgtcgacggcgagtgcgcgcgcgacctcacggaggcggccgacctcttcaacccgcagctggtgcagatgctctccgagctcaacgccgacatcggcgccgacgtcttcatcgccgccaacaccaaccgggtcagcttcgacttcatgttcaacccgcaggactacgggttcgtgacgtccaaggtggcatgctgcgggcagggcccctacaacgggatcgggctgtgcacgccggcgtccaacgtgtgccccaaccgggacgtgtacgcgtactgggacgcgttccaccccacggagcgcgccaaccggatcatcgtcggccagttcatgcacggatccaccgaccacatcagccccatgaacatcagcaccatcctcgccatggacaacaggaactaggccctgcgcgtggcgtgcctcgacctcgatccatccatctctagccggctgggattgagatgccaatctgcactgccatggatccgtcccgacactggcagctataatactacgagacgacacacatagctactgcatgcatgcgtaatactactagtataagttcgtgtcattggtaattggttatgttcatgaagcttcttttttgtggtttagattgacgtgaattgatggtgagaaattaatcctttattagagatgcatgggttcaatataatacagctgtatgtcaagtttcttcgaaaaaaaaaaaaaaaa

SEQ ID NO: 13476 - DNA, 2043 bp, Zea mays
ccggccgggccgggcgctctccctcccgtccgtctattctctatacaaaagcgggactccgcgccgccccggccgacctggccgctccatctcgcgtccaacaatcaattcggcgtcgctctcgtctcatcagtcatcactccgcgactgcgagcgagcgagcgaggcccttccgcgccacgcgcaatggacgctgctctgctcgtgaccgtcctcgtccccgcggtggcggcgctcctcgtcctcgggtccggggccgcgtccgcctcgccgccgcgcgccttcttcgtgttcggggactccctcgtggacaacggcaacaacaactacctcatgaccacggcgcgggccgacgcgccgccctacgggatcgacttccccacgcacctgcccacggggcggttctccaacgggctcaacatccccgacatcatcagcgagcacctcggctcccagcccgcgctgccgtacctcagccccgacctccgcggcgaccagctgctcgtcggcgccaacttcgcgtccgccggcgtcggcatcctcaacgacaccggcatacagttcgtgaacatcatcgggatcgggcagcagctgcacaacttccaggactaccagcagaggctggccgcgttcgtcggcgacgacgcggcgaggcaggtcgtgagcaatgcgctcgtcctcatcacgctcggcggcaacgacttcgtcaacaactactacctggtgcccttctccttccgctcccgccagttcgccatccaagactacgtcccgtacctcatctccgagtacaggaaaatcctcacgcggctgtacgagctcggggcccgtcgcgtggtggtgacgggcaccgggatgatcgggtgcgtgccggcggagctggccatgcacagcatcgacggcgagtgcgcgcgcgacctcacggaggcggccgacctcttcaacccgcagctggtgcagatgctctccgacctcaacgcggccatcggcggcgacgtcttcatcgccgccaacaccaaccgcctcagcttcgacttcatgttcaacccgcaggactacgggttcgtgacggccaaggtggcgtgctgcgggcagggcccgtacaacgggatcgggctgtgcacgccggcgtccaacgtgtgccccaaccgggacgtgtacgcgtactgggacgcgttccaccccacggagcgcgccaaccggatcatcgtcgcccagttcatgcacggctccaccgaccacatcagccccatgaacatcagcaccatcctcgccatggacaacaggggggactaactagtcccgccgcgtgctgcctccacccatctcgtcattggttggttcacgccaagaggttttgctgcattgcatgtgtcatggagctggtggataacaagttttcgttgcacctttttgtgatttattagatgacgtgaattagtggtgaattgagccttattagagtgggttaaattaatacagctgtcccaagtttctttgctccagcagattgtttggggacagggctagctaggaacttcagaaattgctaagcggtactacctagccagtccgtccgatcatttcaagaaaattctcttgcactttgtagtgtgatcctgaacttttgggtacaaggtaccgacgattcaatgccaatgtatattttggtggctggggcacagtgaaaaaaaaaaaaaaaagctggcagcgaagtaggtaggagctatgaagatgacgctggaaaatgctaccacacagaacggatctcacccgtcgcaatggggaccgagtaaacgggagaaccggagggtagaggagaggactgcacgcagttttactgagggggaaaaaggattcagttcagagcaaatgagcaacgcggtgaaaagctggatgtcagttctgggcaaaatgggcaacgcacagtgaaaagctgaaattcccacatgctctcagacattgcaacgcataattaataagaacctttgaatgctcccgcgctgtagaacaacatgccggtgtaatctgcaggcatgcaag

SEQ ID NO: 13477 - DNA, 1421 bp, Zea mays
gccggcgaacatcctaagctcgcccgctcgatcgcgcccccatcaatcaatcaatcaattctcgacctcactactcgatctctcgtctcatcagtgtgactgtgtgagtgtccgagcacggtagcacgcgcaatggacgctctgctcgtgactaccttcctcgtccccgtggtggcgctcctcctcggttccgggtccgggtccgcggcaccgctgccgcgcgccttcttcgtgttcggtgactccctcgtggacaacggcaacaacaactacctgatgacgacggcgcgcgccgacgcgccgccctacgggatcgacttccccacgcacatggccacggggaggttctccaacgggctgaacatccccgacatcatcagcgagcacctgggctcccagcccgcgctgccgtacctgagccccgacctccgcggcgcccagctcctggtgggcgccaacttcgcgtccgccggcgtcggcatcctcaacgacaccggcatacagttcgtgaacatcatcaggatcggacagcagctgcgcaacttccaggagtaccagcagaggctggcggcgttcgtcggcgaggacgcggcgcggcaggccgtcagcgacgcgctcgtgctcatcacgctcggcggcaacgacttcgtcaacaactactacctggtgcccttctccgtccgctctcgccagtttgccatccaggactacgtcccctacctcatctccgagtacaggaagatcctcacgcggctgtacgagctcggggcccggcgcgtggtggtgacgggcaccgggatgatcgggtgcgtgccggcggagctcgccatgcacagcgtcgacggcgagtgcgcgcgcgacctcacggaggcggccgacctcttcaacccgcagctggtgcagatgctctccgagctcaacgccgacatcggcgccgacgtcttcatcgccgccaacaccaaccgggtcagcttcgacttcatgttcaacccgcaggactacgggttcgtgacgtccaaggtggcgtgctgcgggcagggcccctacaacgggatcgggctgtgcacgccggcgtccaacgtgtgccccaaccgggacgtgtacgcgtactgggacgcgttccaccccacggagcgcgccaaccggatcatcgtcggccagttcatgcacggatccaccgaccacatcagccccatgaacatcagcaccatcctcgccatggacaacaggaactaggccctgcgcgtggcgtgcctcgacctcgatccatccatctctagccggctgggattgagatgccaatctgcactgccatggatccgtcccgacactggcagctataatactacgagacgacacacatagctactgcatgcatgcgtaatactactagtataagttcgtgcaaaaaaaaaaaaaaa

SEQ ID NO: 13478 - DNA, 4626 bp, Zea mays
gattcggctcggtcccttggcctttgttctactgatactactacagtgttggacaatctaggcgagagtgcaccatttcttgtaggcacccagcaggccgtgtgtgtgttgatactgatgcccaacaaataagggacgccacccgcgctgtctgaattcggaaaaccctgaacacccgtcccgtccgcatccggccgggaaagggggattattcccttctatggcgccggctttgatgccccagcgacccttctctgccgccagcagtggcagtggcacatgatccgaggcaaacctaccccattgtcagccatgcatgtcacgtacgctcgctcgggcaggcacgggcgccgccgccacgcctgtctacgcgccaaagccaagcgccgcagtctagctgccacccaacccaccgactgcgacgcaaccctagcttgcgttccgtccctgtatgcccagcatgcaattgctccgcctgccgaccccccgcccgctgctaacccaacccaactggcccgcgtccgtctttaactcgcgcccgggctcgggctctctctctctccctactctatctctcttcgtctacaagagggacaccgccgcgccacctttcagtccccgtgcgccacgccacctgccagtactagctcgcccgctcgatcgcgcccatcaatcaatcaattctcgacctcactactcgatctcgtctcatcagtgtgagtgtccgagcacggcagcacgcgcaatggacgctctgctcgtgactacgaccttcctcgtccccgtggtggcgctcctcctcgggtccgggtccgggtccgcggcggcgctgccgcgcgccttcttcgtgttcggtgactccctcgtggacaacggcaacaacaactacctgatgacgacggcgcgcgccgacgcgccgccctacgggatcgacttccccacgcacatggccacggggcggttctccaacgggctgaacatccccgacatcatcagcgagcacctcggctcccagcccgcgctgccgtacctgagccccgacctccgcggcgcccagctcctggtgggcgccaacttcgcgtccgccggcgtcggcatcctcaacgacaccggcatacagttcgtgaacatcatcaggatcggacagcagctgcgcaacttccaggagtaccagcagaggctggcggcgttcgtcggcgacgaggacgcggcgcggcaggccgtcagcgacgcgctcgtgctcatcacgctcggcggcaacgacttcgtcaacaactactacctggtgcccttctccgtccgctctcgccagtttgccatccaagactacgtcccctacctcatctccgagtacaggaagatcctcacggtaaataatttaatcattcctctccaaaacaaaagacattaattacttgaagcaacaagaagatatgggtcggtagttagcccactgttggcgttggattccgggaagagctgaggtggtcgacgcaaaacaatgtagctgatgaatgcttcttggtagtgcgtaattttgggcagtatgtgctccgagtaactggcatggcatggccatcacggccacactaattgctccatacttctgcaagacagttcctgcagagtttcaggcatcagccagtttgggtggcagcagcctgatatatatgttccctaggaagcatttgcagccccccagtgtcgcatggtagtactcactctcattccagtgctgtccgtccagcagaacaaacaactaccgtactacctagtatatatttatacgaagcttaatatagtaaagtagttattagggtttagggtcaaaaatccgaagaacgtacacaaaacacaattggaagtactaatgaccatgcatgcactcttcttagagtaagatcgagtaatgcatgtaaaacgttggcctactcccttaaccagcaccacaaaaatggcccacaatttaatcccagcccacgtcacagcgatgcactgatgaaacagaaacgacacacgaacgtgacatttactgttgtacccgtaggctaggtggttgggttgggtgtcattcatcaattactgtggccactcggcagccaattcgccaacttgcaagaacagtcgtcgtccctcgtcgtgtcgtgcatgcatgcaccatatatatgtttttcgtcatgggcagcagatgggctcgcggccgtagtatatatatttgtgacgacgtgccctctgacaaatcggaacactgtaccgtgtgctgtgtggacggcgggcgagcgcagcggctgtacgagctcggggcccggcgcgtggtggtgacgggcaccgggatgatcgggtgcgtgccggcggagctcgccatgcacagcgtcgacggcgagtgcgcgcgcgacctcacggaggcggccgacctctccgacccgcggctggtgcagatgctctcggagctcaacgccgacatcggcgccgacgtcttcatcgccgccaacaccaaccgggtcagcttcgacttcatgttcaacccgcaggactacggtacgtacgtacgcgcgcgctgtgtttcttctgctagctgtacgtacgtgtttgtaaatgatattcagacgaccctaactaaaccctgcctgtgcagggttcgtgacgtccaaggtggcgtgctgcgggcagggcccctacaacgggatcgggctatgcacgccggcgtccaacgtgtgccccaaccgggacgtgtacgcgtactgggacgcgttccaccccacggagcgcgccaaccggatcatcgtcggccagttcatgcacggatccaccgaccacatcagccccatgaacatcagcaccatcctcgccatggacaacaggaactaggccctgcgcgtggcgtgcctcgacctccatccatccatccatccatctcaatcccagctggctagctgctaatctgccattgatccggatccgtcccgacactggcagctataatactacgagacgacacacatagctactgcatgcatgcgtaatactactagtataagttcgtgtcattggtaattggttatgttcatgaagcttcttttttgtggtttagattgacgtgaattgatggtgagaaattaatcctttattagagatgcatgggttcaatataatacagctgtatgtcaagtttctttgatccagcagattgtttggctggcaggggctagctataggaacttcagaaattagcaagtactggcactaccacctagtccgcccgatcgattaattcaagaaattaaatttgttgcactttgtagtgtgatcccgaacttttggtacaattatatgtaccgtgaattcattgccaacggcgtatattcgttgggcacagttatgtgcgtgtgcgcggtgcaccatgggccatggcagcggagcgagtaggtacgagctatgaagacgacgctgacaaatacgtacgtcctgtaatgggcacccagtagaacagatctcacccgtcggcatggggaccgagtaaacggagaaccgtacaaatgatcgagccatgcggtgaaattaaaccgtgaaaggctggaatttcccacatgctctcagacactgtaacgaaccggcagtgctctttagaccacatgtcggtctaatctgcactggcacgcgcatcagcgtatacgtttcggtccatctgattatggccaaaacgttgatgcactacagaagcacaggctcaaacagcagactatacaagggcatacaatcagctaaaatgatgaagaagaaccatacacagctccagttttctttctgtattctaccgtcgagtgctactaataggttccccgtaagccctcaaggcctcaagccctcaaccaagctcataaagcttcgctgcacagaacccagcttctctggctaatttctcccactcttctcctaaaaaagaaaagacaataacagaagccacatgtaattccgtgctggggaagggtcactaaccacaccttctctgtctcccccttcggcgcggccgtgcggcttccctgtctcccctgcgcagccgaccccgatccctcctctgaccgcgcctccgccggctctcctccccttcccgctgcccccctgcagcactgggagcgctgccccctgacagcggcccctgccggcgtgcccatagccggcgagcgcccatggtggccgggttgccgacgtgctcttccccagtgccggcctcctcctcaactacgagtttgcgacgacctcccctgctgcattcgccgcgacctctcctttggccggccatatctaggtcggtggcgccgccaacgtccccctgcccggccgcaggcgccttcggtgcttaggctgctgtttgtttgccctcgcctgagacgcccaacagtgtcccccgtcctccaagtttcttgagttgtcggcgtcaaaccctttgtgctaggcccaacgcaggctcctgcttgtctggaaccgccgcatcgccttcccctttcatcgtcactttcattggattcgtcactgcacggccttttcggtcggattcacattgttgcgaccctccaggttggatctgtcatccctttagctggatcactgtgttccatggctggattg

SEQ ID NO: 13479 - DNA, 564 bp, Zea mays
  misc_feature (523)..(523): n is a, c, g, or t
  misc_feature (527)..(527): n is a, c, g, or t
  misc_feature (548)..(549): n is a, c, g, or t
  misc_feature (551)..(551): n is a, c, g, or t
  misc_feature (557)..(557): n is a, c, g, or t
  misc_feature (562)..(563): n is a, c, g, or t
tgaaattactggacagagaggtatcattaacaagggttggggcgggcttggaaacttggaagaatcaaaggaatttgtgtatgtacttgataatgttccacatgattggctctttttgcaatgcaaagctgtggtacaccatggtggtgctggcactactgctgctggtcttaaggctgggtgccccactaccatcataccattctttggtgatcaattcttttggggcagcatggttcatgctagaggattgggtgcatcacctatacccgtggagcaattacaattgcattcgctgattgatgcaatcaaatttatgattgatcctaaggtaaaggaacgagctgttgagctagcaaagtcaatcgaatcagaagatggttgatggggctgtaaaatcctttttaaaacatcttccacagaaaagggattccgagacgacaccaactgcgccagagccaacgttcgtgcaccggctgcttcaccctgtaaacagatgctttggcatggcatcctaccccgntttnagacccccgtttattttgggnncnccgganaattnnc

SEQ ID NO: 13480 - DNA, 1442 bp, Zea mays
  misc_feature (7)..(7): n is a, c, g, or t
  misc_feature (14)..(14): n is a, c, g, or t
  misc_feature (26)..(26): n is a, c, g, or t
gttcttnaatatgnaaggcaatgggnaataaatgacctgttatcctttgattttatggaccccccagcacctcaagcattgattgcgtggtcgcggccgaggtacagccttggtgctcttgatgaagagggccttctaaccaaactcgggagaaaaatggcagaatttccattggatccaccactttccaagatgctactagccagtgttgaccttggatgcagtgatgagatactgactatcatagctatgattcaaacagggaatatattctacaggccacgagaaaaacaagctcaagctgatcaaaagagggctaaattttttcagccagagggagaccaccttactctacttgctgtatatgaggcctggaaggctaagaacttttcagggccctggtgttttgagaactttgttcaatcaagatcattgaggagagcccaggatgtgaggaaacaacttctcactatcatggacagatacaaacttgatgttgtctccgctgggaaaaacttcacaaagataaggaaagctatcactgcaggcttctttttccacgccgccaggaaggatccccaggaaggatacaggaccttggtcgaaaaccagccagtgtacatccaccctagcagcgcattgttccagcgccagccagactgggtcatctatcacgagctggtgatgacgacaaaggagtacatgagggaggtgactgtgatcgatccaaaatggcttgttgagctggcgccaaggttttacaagggtgctgaccccaccaagatgagcaaaaggaaaaggcaggagaggatcgagcctctatatgatagataccacgagcccaactcttggcgtcttagcaagcgccgagcttgattgtaactcactgtaactgtgcactgcatgctcttcatggccagttgatactccataatgtaaatgtttgtgagttgtcacaaaaaaaaaaaaaaaaaaaaaaaaaaaaaaaaaccgagatgtagctgcagttgaacaaatacagagagaaggtcttgtctgagagacgggatgcgtggaaacattgtagccttaaatcaccaattgaatgatgtgcaaaatagctaatagtacctgtatcataaatacatacctgtatcataaacacataccgctcttttgggtaatcccagcgtgcaatattagagattaatacagctacctgctgtgcaatctacaattacagcatttagaaaatagtctcatcaatacacatcatgtgtttaccatcatatgactcaaactggatgcatattatctagtgcatacctggctattcccatgtgtgtgctttgcaaaaaaaaatcccaaaggtggtgctcctcattacaaattccactgcaccgaagaaattttaatctggtaagtgaaatgccagactattatcatttgagtgtgccactgca

SEQ ID NO: 13481 - DNA, 957 bp, Zea mays
  misc_feature (113)..(113): n is a, c, g, or t
  misc_feature (152)..(152): n is a, c, g, or t
ctgacccttacgccttcgctcgcgccgccgccgccgccgccgctacgccccgcacctcgcttcatttcgtgtcgccaagatgacgaagcgcactaagaaggcaggaattgttnggcaaatatggaaccaggtatggtgctagcttgcgtaanaaattcaagaagatggaggtatctcagcattccaagtacttttgcgagttctgtggggaccctcccgccgggcggggcgaggccaaagattaaccccttggccacaacactcgcatccagctcctctgcttctggcgaccaaattctgccgtctccaccgccgccgcagccagcgtcaccggagggatctgccgtctcccttgctccacgcgatgaacaccgacatcaccgcctcgactaagccggagtacccggtggtggatcggaacccggccttcaccaaggtggtcggcaacttctctgcgctcgactacatgcgcctctccaccatctccgccgtctccgtcaccgttggctacctctccgggatcaagccggggatccggggcccgtcgatggtcacgggcggcctcatcggggtcatgggagggttcatgtacgcctaccagaactccgccgggcgcctaatgggattctttcccaacgacgccgaggttgcgcgctacaagcacaagcttcattgaggatccagctccattccgtctctcttttcgcaaccgtttcgcctgttcctttcctgattccgtgttaacttcagtactttatctgggcactctatggccttggttaaataaaagtggtatgttgttgcacggttatgaggattcgatgatacaattcacctcatctttatgttgtttggtgagaatttcgtcgccgtttgggtgaatttatgaatactgaagtgatttctgctctaaaaaaaaaaaaaaaaaggcccctagggcccgcgcccccctcgtgc

SEQ ID NO: 13482 - DNA, 3425 bp, Zea mays
gatgaaaatacgtttttttttatatttcaaagtttatggcagggaataaccaaacgaaagttgtcctgattggaacggacagttgggaccgtgctgattggaacggacagttgggacgagatgagagggagaggtactggtctactggaggttagtttgtcctgatgtatgcagtagaccaagaaagggtaggcacgaaaagcccctacccacttcactggtcattcggagacggacggagaggcactagctagtgtgcagagtgcagtgcagctgctgcgcgtcgctgctcctgcctggggaacccaaaaagatgttggagggaagcccgaaaatcaaaaagccatggactggacacaagctcggcccctctccctctccacgccgcggcaataaagaagccgctgtgcagcatgcgtgtcacactctcccgctcgtccctcccgcattctctctctatctcttgtcttcctttcctcctctcgaaccccaataaaacctcactttccctccttgccacttcggattctcctcctctgcctttcgcttcgtcactcgccacgccacgccaaagaccaagaaaaaaaaggacgattttttcctagctgcaacttccctcacgccatggaggaggagatgccgctgcagctgctctccgcttcctccgccgccgtcgctgtctgagctcccccttcgctcgatctctccatcgggccgggcctacctctcctagcagtgaatcaaaccatggcagctttcgccgcgctgttcgaccccctgtactgcccggaggagcacctcgatctgtaccgcgacgaacccggcgagggtgcggacgagcagtggccgggccagcacggacagcaggagccggctgtcctcgacgacgagctgccggcgctgttcgaggcacaccgggccaaggagggggtggtgctggcggaggatggcgggtacggcggcgcagctgggcgtgaggccgcggtcggctgggtttcacgcgccgcggcgcggctaggcttctccgcgctcaccgccgcgctcgccgccgcctacctcgaccgctgcttcctccccgggggcgcgctccggctcggcgaccagccctggatggcgcgcctagccgccgtcacctgcttcgcgctcgccgccaaggtcgaggagacgcgcgtgccgccgctcctcgacctccagctctacgccgccgctgacgccgcggatccgtacgtattcgaggccaagacggtgcgccggatggagctgctcgtgctctccgcgcttgggtggcggatgcaccctgtcacgcccttctcctacctccagcccgtcctcgccgacgctgcgacgcgcctgcgtagctgcgagggcgtcctgctcgcggtcatggccggtgcgtgctcctccattgtgcgagttccagatttccagccagtggtagtgtagttgcatttccgtgccaaagacttgatttttatgtgttcgaaaaacatggcagactggaggtggcctcggcaccggccttcggcgtgggccgccgccgcgttgctgatcacagccgccgccggcgacggcggcgacggcgacggcgacacggagctcctggcgctcatcaatgcccccgaggtcagcgcagcacaatgccattgcatcagcacaatactgtaggctgttgtgagactgcgttgataaccaaccgctggacgcgtcgcaggacaagaccgccgagtgtgccaagatcatctccgaggtgacgggcatgagcttcctcgcctgcgatgtcggcgtgagcgccggaaataagcgtaagcacgcggcggcgcagttgtactcgccgccgccgagcccgagcggcgtgatcggcgcgctgtcctgcttcagctgcgagagctcgacgtccgccaccgctatggctgcggcggtcggcccgtgggcgccgtcggcgtccgtgtccgtgtcgtcctctccagagccaccaggtcgggcccccaagcgcgcagcggcggcgtcggcgtcggcgtcggcgtcagccggggtcgcgccaccggtccaggtcccgcatcagctaccccccgacgaggagagccgcgacgcctggccgtccacctgcgccgcgtgacgcaccgtgccggaaacggtgcctatggcgagaccgccgttcggtggcggtggagaatggagaacaaggagcatcattggctcgcgtcggtgagcaggagaacgaactattttgcccattgccgtgacagatggggggcaagagagataagaaaagatgtccttgtttgcatgcttatggcgggagtaatgtttgcatgcttgtggcagcacattttgcaatgatggttctcagagaacttagctggaggtggaagatgattagcggataatttgccgtcgagatcgatggcgatttagtatttgttgcaactgtagtgatgctagttcttgccgtgttcttgttaaaaaaaaaaaaaaaatgcttggaaggggcctccgacctccgttgtcctgtctgctgcagcggccactactgtagcagcactgctctcgccctgtggctgcgcctgcctcgcgtttccctccactactgtctcgatttcatttccctcctctctctctctctttatctagacctcccttcgatgcaaatgctgcagctccccgctaccccccacgaaaatgaaatgaaatgcaacgctcgggagatgagcctccatttaatgtcaaccctgcctagttttgtggtactactaccagctcttcaaatcttgtttcattgtaacgataaatcaataaatgtagcaccccacattaaaatccttgtttatttgtcctagcatgaattgaatgttgctgggaatgttgtctctgaacttgaagagtgtatgtgctgggcgtattaatgagcggggagggagcgaaattaaaactatgacacgaggcaaatgtttcttgtgccattaggtcagctgtgttttgaaaacggtgcaaaaaagttttattaaccagcttttttgcttgactttaatctctacctgcttctattaattatacaatgtttttgtctctataaattaaaggtgcagcagtacaaacaatttaatcctccatacgaaaacgattcacgcgctcatacattttgaagtggcattagagtaggtcgtgtaagagacatgttctctgcaaaaggacagtctcctctttttataacatactcccttagagaccttttaagaaatagagtattgaattgtatatgcccttatatcaatctcaatgaacgtttcattctcatttgatgccgtgaaacaccaacaaatatatggggtggctagaatcttgctcgtttatttgactcctcttgtggcaccgggtaagaccggacggtccgaccatgcggctcagatccacgccccagacagccc

SEQ ID NO: 13483 - DNA, 562 bp, Zea mays
cccccccccccccccccccggtgtcatgtagggatctaggagtgagttcagtagttaacctcactagggaagggtgttggttggttaagtttagattgtgggggtaggttggtctagtttgctttctttcttctcctttttctttttctttttctttatatttctttttctgttgtgtttgtaattggtctaatttttagacccttcttcttaatacaatgatacgcagctctcctgcgtgttcgaaaaaaaaaaaaaagtttacttatttggaactcagtccagtggtagtggaagtgaaagtggcattcagacgcagaagtgtaccaagtcaaaaggtgccaatgaatccggtaacaacagtggtagcaacgacgatgaagctggcatgggacttaatgcaagggatgacagtgataatggcagtggcactcaagcacagaactcatggactaagcttgctgtggagatcgacagtccacaagctatgtctctggaccagttagccgatccagccaatagcacctgtgcacaagtaatccactcaaagtcagagatatga

SEQ ID NO: 13484 - DNA, 4284 bp, Zea mays
  misc_feature (3888)..(3888): n is a, c, g, or t
caagtctccaacaatacaattttacaatattacttctttatataacacaaatagatatgtgctatagtggtagaagctggatggttcgagctaagagagctgactttaaatccctggccacgtatccttttttgcttattccgcgatttaaaagacgccaatgtatataatatgcgcggcgatcatgaggttgtctcacaacatactgctgtcattttgaagtgatgcctatctatatatcttcttctggattagatacagtttgagctgagctgagcactagttcacttaaatctgttgcaagaactatattaccctctcggttgttatgtatctcaatctcttatcacacatgattttagttggtttattatattactgtatatacagtaacaatttctttcatagatattgttgaacggagacatactttgttgctcgtgtattgtcaaggtttatatattattatattagtatactttgttttaataagacaaaaaaatttaccaacaaccaagatttaaacctataattttacttcatttttgtattaaatgagaaggatgacgtcaggaccgcggactggccctagaccacatgctactaggctgagctgagctggagggcaggcgtgagacctgagaccggaccgggagcgcacgccacggattttgatttcatcgtatcgtatcttgagagggagcggggccggcgggccccaggcaacctccttttgctccacctcactcgccacctcctggcctggcttccttcgcctccctcccttgggaccggtatatctactacctctgttccttcacctctccttcgccgccgcttccctcctcctcctcctccacctccgccctcgatccgaccgcgggccctaaaggtaaacccaactccttactatccacctgcttgcttgctactggtgtagtcggcggccgatttagaacaggcaaacactctgcggtacggtgcagaaataaatgggttcctgatttgtggcttcctaagctcttgcagcacttttcgcctttttcggaggccacgggtcaccaccgacctccattccattcatttgccgattcacctacacagacacacacaggtatgtcgtctctctactcctgtcctgcctccctctccgccccgcccgcatccagttcttcttcttttttttttcctttcttcagagccaggacacgatttgttttgtcgctcaagctctcagcaaccacattggtacatgcagaaactttggatgcaaacgaggagggagcccttgaaggcaaaccaatgcgcaccgccgcttattcattaaccaaagacttgcatccaaccaatcccaccacttgtgtctacctcttcgagtcaggctgatgggacccccccccccccaactctccgtggacggagatgcgaggacgcctgcgaatgaccgcgatccggccggcctgctccagcatgatgatacggaaaaccagcagcagcagcaggcctgctgggagcgcttcctcctcaaggagactctcaacgtcttgcttgtggagagtgatgattcaaccaggcaggtcgtcagtgccctgcttcgttgctgcatgtaccaagttatctctgccgaaaatggccagcaagcatgggcttatcttgaagataagagaaacaacatagatcttgttttgactgaggtttttatgcccggtgtatctggtatttctctgctgagtagaatcatgagccacaatatttgcaagaacattccagtgattatgatgtcttcgagtgatgctatgagtacagtctttaaatgtttgtcaaaaggtgctgttgactttttagtcaagcctatacgtaagaatgaacttaagaacctttggcagcatgtgtggagacaacggtgtcacagttggtcctgcgtgttcgaaaaaaaaaaaaagtttacttatttggaactcagtccagtggtagtggaagtgaaagtggcattcagacgcagaagtgtaccaagtcaaaaggtgccaatgaatccggtaacaacagtggtagcaacgacgatgaagctggcatgggacttaatgcaagggatgacagtgataatggcagtggcactcaagcacagaactcatggactaagcttgctgtggagatcgacagtccacaagctatgtctctggaccagttagccgatccagccaatagcacctgtgcacaagtaatccactcaaagtcagagatatgtagccacagatggctaccaggtagcagcaacagaaactgcaagaagcaaaaatacactaatgatgactttaagggaaaagacttggagatagatggtcctggaaatctatatatggatcaccaatcttccccaaatgagagacccatcaaagcagcagatcatgaaaacaattccaaggagtcaatgatgggaaatttaggggatgcaactgttcgagctgctgacctaattggttcaatggccaaaaacatggatgcccaacaggcagcaagagctgcagatacccctaatttctcttctgaagtgccagaagggaaaggtaagaatgatgactttaagggaaaggacttggagataggtggccctagaaatttatatatggatcaccaatcttccccaaatgagagacccatcaaagcagcagatcatgaaaacaactccaaggagtcaatgatagaaaatttagaggagccaactgttcgagctgctgacctaattggttcaatggccaaaaacatggatacccaacaggcagcaagagctgcagaagatacccctaatttctcttccaaagtgccagaagggaaaggtaagaatgaccagcatgataattatgttttgccatcacttgagctgagtttgaagaggtcgagatcatgtggagatggtgccaacgatacagtcaatgacgatgaacagcggaatagtgcattaaggcgatcgaatctctcggcttttacaaggtaccatacatctgcggcttccaatcaaggtgggacaggattggtaggtagctgttcgccgcatgataacagctcggaggctgtgaaaacggattctacttacaacatgaagtcaaattcagatgctgccgcaataaaacaaggctccaacggcagtagcaataacaatgacatgggttccactacaaaggatgttgtgacaaaacccagcacaaataacgagagggtgatgttgccctctgctattaaggctaatggatacacgtcaacattccatcctgtgcagcagtggatggttccagataatgcgacagcagggaaagcgaaggctgatgaagtggccaacaatgcaggcagaaatagtcatcctggtgacgtgcagagcaacctgacgcaacaacatcgtccaacccttcattacgtccattttgaggatagtggatcaggtgccctgcaatgtggttcctccaatgtatttgatcccccacttgagggccaggctaccaatatctatggtgtgaaagccgggagcaactcaggcagcaacaaggggcagaataatgggagtacagctggtgcgagcacggctgctgcaaatgctggacggacagatacagagatacgggctatcgataaaagtggaccgggaggtggcagtgggagtggcaatgacacatatgtcagacggcttgctgcgagcatgacaccacgacaagaacagctaaagaaatatagagagaaaaagaaagatcggaactttgggaaaaaggtgcggtaccagagcagaaagaggctagccgaccagcggccaagggttcgtggacagttcgtgaagcaagctgtgcaaaatcaagagggagatggagagagatgaccccccccccccctctggcttcagcntcatggttgttagacgtggcggttgatgattcttccttctctggtgtgatctgatatgatcgacaacacaccatccttccttttcttcattggtttcttcacatctagaatttactgcctgaccgggaaaaaataagctaggaacttctatacatgtgtatgcatttctaatcatgtagaagaataagtgtgtcttgactctagataattttaggtagagtcatgctcgctctcctacattatgtgatgtaactgaagtgttgttgtgttgtcatgtatggtcttggatcactttctgtcaatatattactagcccaccaactactattaatttgatgagatgtatataatcaaaaaaaaaaaaaaaaaaaactcgagggggggcccggtacccaa

SEQ ID NO: 13485 - DNA, 2910 bp, Zea mays
agctccccgcggtggcggccgctctagaactagtggatcccccgggctgcaggccccccccccccccccatatgaatttcatgatttaaatcatattatttttcattaacgggttatgaacaaggtgatctattcttataattcgagatgaactgaattttgtttttctttcttttactttagttacatagtcatgtatcaattatttttgaactaagccatacctattttctgtctctggtttttctgtggtaaggtatcttactgacaggtgggtctaagcccatgtagcactgaaagatctcagtggtgaagttgctatatatatcggaaattaaagcaatgttccccagtggagttgctatgtatatatcaaaattaaagcatgggcacattataacttgtttccttgttaatatttcataaggcacagaactcatggactaagcttgctgtggagatcgacagtccacaagctatgtctctggaccagttagccgatccagccaatagcacctgtgcacaagtaatccactcaaagtcagagatatgtagccacagatggctaccaggtagcagcaacagaaactgcaagaagcaaaaatacactaatgatgactttaagggaaaagacttggagatagatggtcctggaaatctatatatggatcaccaatcttccccaaatgagagacccatcaaagcagcagatcatgaaaacaattccaaggagtcaatgatgggaaatttaggggatgcaactgttcgagctgctgacctaattgattcaatggccaaaaacatggatgcccaacaggcagcaagagctgcagatacccctaatttctcttctgaagtgccagaagggaaaggtaagaatgatgactttaagggaaggacttggagataggtggccctagaaatttatatatggatcaccaatcttccccaaatgagagacccatcaaagcagcagatcatgaaaacaactccaaggagtcaatgatagaaaatttagaggagccaactgttcgagctgctgacctaattgggtcaatggccaaaaacatggatacccaacaggcagctagagctgcagaagatacccctaatttctcttccaaagggcccgacgggacagtcaatgacgatgaacagcggaatagtgcattaaggcgatcgaatctctcggcttttacaaggtgcaaaacataatatcagtgtcattagtgagttatgaaagcaacagtatgttgggtactaacagttaccacttttattgcaaggtaccatacatctgcggcttccaatcaaggtgggacaggattggtaggtagctgttcgccgcatgataacagctcggaggctgtgaaaacggattctacttacaacatgaagtcaaattcagatgctgccgcaataaaacaaggctccaacggcagtagcaataacaatgacatgggttccactacaaaggatgttgtgacaaaacccagcacaaataacgagagggtgatgttgccctctgctattaaggctaatggatacacgtcaacattccatcctgtgcagcagtggatggttccagataatgcgacagcagggaaagcgaaggctgatgaagtggccaacaatgcaggcagaaatagtcatcctggtgacgtgcagagcaacctgacgcaacaacatcgtccaacccttcattacgtccattttgagaatagtggatcaggtgccctgcaatgtggttcctccaatgtatttgatcccccacttgaaggccaggctaccaataactatggtgtgaaagccgggagcaactcaggcagcaacaaggggcagaataatgggagtacagctggtgcgagcacggctgctgcaaatgctggacggacagatacagagatacgggctatcgataaaagtggacctggaggtggcagtgggagtggcaatgacacatatgtcagacggcttgctgcgagcatgacaccacgacaagaacagctaaagaaatatagagagaaaaagaaagatcggaactttgggaaaaaggtagcctgttttcaattgcatattaatatttattctttatttgttttcaattgcatatgtttaagaagagagagcattggatagaaggactggtttctttctgatggctgtctgccatttccaggtgcggtaccagagcagaaagaggctagccgaccagcggccaagggttcgtggacagttcgtgaagcaagctgtgcaaaatcaagagggagatggagagagatgccccccccccccctctggcttcagctcatggttgttagacgtggcggttgatgattcttccttctctggtgtgatctgatatgatcgacaacacaccatccttccttttcttcattggtttcttcacatctagaatttactgcctgaccgggaaaaaataagctaggaacttctatacatgtgtatgcatttctaatcatgtagaagaataagtgtgtcttgactctagataattttaggtagagtcatgctcgctctcctacattatgtgatgtaactgaagtgttgttgtgttgtcatgtatggtcttggatcactttctgtcaatatattactagcccacaactactatcaatttgatgagatgtatataattaaaaatattgtaatagtccttcctttggtaggtagacaacaaacaatcttgaattcagtgcatacataaatcactgtatagatatatacacgttggggtctgctttagatgaaggtcctcaaaacattaactaatcagttattttttgagtctgtttcaagtgtaacagggtaaatgctaaaggacaccttcgttcgaagatgatgcgcggtgaacacggttgccaagacgaagctacaaacttcagaccg

SEQ ID NO: 13486 - DNA, 2219 bp, Zea mays
atttttttgtgaattaatttgtttgctgactaattaatttgcagtgcccagggtaggtgagccgtcatcctcatcttgtccacctgctcaggatgatgaagtgcaggaacaggtcgtagttactcggactcttgcaagcttgaaccaggcaaatagtggcaaggtgccacatcagaaggaaaaacagcaaagcaataaccgcccatcatcacggagatgttatcctaaaccaaatacaccattctaccgaccatttatgcaaaatcaggcttatcctagcgttccaccagatcaagctatgtaccatctgtggcatcggatgcaagtgacagccaacgcctcgctttccagtggtaccagctatgggcaatacaagtttttgcccaccagcagctatgctccccatgtaccctccttcacctcaagggcaattctccaatccggctaaccaggatgctctaggccttcttccatgttttcctgatgcttctcctgccatgctacggcacttctcaccttaccctgtctcctatgtgccaagaagtcctctgccggttactgttcacaatgttcatgagagaaggcatgaccatactgaaacagttgagcttcctgatgctgtggtgttctcccaatgcacgaccctagattcctttaggacatcagaatgtggcggtccaccactcaaggttcaagaaccaaccaaaaatcggaaagaaggctgtattgggtcccctgagaaagaacttgacactctcgccctctcaagctctgccgcacaagcgtcgtcgcaaaagttggaagcaaatgaaggtaagcaaacagtgcaggcaggtttgaagcaggcccatgaacagcagctgatgtcatcctcgtcttgtgttagttcttcagttgtggcacagagctcgcattacgctagctccatccagcatgaggagtctatacatagaaggaatcctcctcctcatactagttcgcctgcattgcctgatgtgtggtcttcccgctcgcaagctctgcccagatttggatcaccaagttgggtgttccagcagcgaccttggttggctgcacccgtcacagttcgaaccgctgttcctgtctgctcagccaggccaaacgtggtgaattctaccactggaacaagacctgctgcccagagccatgatggagagagagatctgaacagcgccgcagcagcgagttctggattcaataaactccaaatttgagctgcggttttggttctgctgagcttttcatctcagttttgtttgcttcttggcttgaggtttattttttagttagatataccagataggctcttaggttttcattttacatttaccagatgtccagttccttctgaagataaatggacgagaactgtaatataaaaaatgcagaggcctttctcatgcgatttgaattcagtttcagtatgcaatcgatgtagttccagcagtgtatggtacaaccgcctggctgctgagctttcggcagctgtagtcacagccaatgcaatcgagcgcagagacatagcttttacactgtacttgggttctatattcttatattcaaatctcactctgtcagtgtaacatggtcttcttgtggtggttagagaatttagtgaagttagtcaacactcctgtaatcttaggccctgtttagttcctttagtcactagactaaattttagtgactaaagtttaatcgctaaaatagcctgtttggttccagtgaataaaccggactacagagcattaattgctgtgaataatgactattttacccttattaattaatggatgtttgctataagaaggaagtggagagggcaaataaggtaaaaatactactttagtcccttttagtcaccccttggtgactaaagaactaaagtttagtcaccccactttagtcaccatgtttgtttatttagagactaaaagtgactaaactttagtcactaaactttagtcaccccaaaccaaacgggcccttagtatacttcaactccctcctctcaaccggctcctagaatatagttgttggaagcaaccgccggtgttaagacctgcaccctctttcacttatcttgatagattgtttaagtacttattaactctattggtcggttacctgtgcgttgcgacggctcacaacaatacccatataaattatccacaaaaagatctcaagattttttatta

SEQ ID NO: 13487 - DNA, 1367 bp, Zea mays
tgagaatggtgaagctgatgagtgtgatggaacgcctacaagtgtagctgaaagttctagttcggtatctgttggtgaagtagtttctcatggtaagaggatcaatgatattgcagaggacaacatgagagcacataacatattgtatgaagctgttggtgaaaatatttcaggtccttcattccatttgaatgaatattctagtggaaccatacaagctactggcaagccaaacgattgtcgacgtattgattcagctgtgcggaatttgttgctcaaaggattaggtcagccgtttagtgaggaagatattattggtatctatagaacaccactgctagatcagcgagggcaagttcgttgtggtctcttccagaaggagatcgaagagaccaggagtcgtcgggggaatgcaaatgtacgttatgcttggcttccttgctcaagatataccatggagcagatggcaatgcggggtgctctggaaatcgcgaagcctcataaggggtccatttgtggtgttgggacttggcttgctcctgcaaactgtacaaattcatgtgccagatattctgattttcatgaagatggcatcatcagaatgatgttgtgccgtgtaataatggaattacatcgtatgggatgctaatgtgcataaacaccatatatgctgaatatgctgttattgtccaagcacctctcgtgaccaatgaatgttcgggcttgaaggatagcgtgcccaacatatctgagatcataagttctcggcctcgggactccgttgctgtcgaggataggttcgcgccttgtggtgttgaacaagaagcacctaagctggggcgtgctccaagggccccctcctcaccatggatgcccttttcgatgctttttgctgctatttccacgaaagtgcctcgttcggacatggagttggtcatcagatactatgaagaattcaagaggaagaggatgagccggagcgatctggtggtacggatgaggcaaatagtcggtgataagatattggtttctacaataatgaggcttcaccaccagaagaagcccccatcgatggcagcagcagcagcagcagctgggctagcaagagcctcgcaggggggaagagggagggggagtagccgagtaagattagtttaagccgccttgtcttttgagaaatttatggagcacatatgctttgtcgacatggccagactcaaggtgtcaaaagggagggagatgagctgagcaactgttgtagtgtagtctcaaactcaaagcgtttaggtcttgacatttgacaaactaaaactcagaaacattatcatgagtagtgttttttttctggtgcgggggcccggtaccca

SEQ ID NO: 13488 - DNA, 8255 bp, Zea mays
  misc_feature (55)..(55): n is a, c, g, or t
  misc_feature (1781)..(1781): n is a, c, g, or t
  misc_feature (2282)..(2282): n is a, c, g, or t
  misc_feature (2336)..(2336): n is a, c, g, or t
  misc_feature (2363)..(2363): n is a, c, g, or t
  misc_feature (5344)..(5344): n is a, c, g, or t
  misc_feature (7875)..(7875): n is a, c, g, or t
  misc_feature (8159)..(8159): n is a, c, g, or t
tgatgacaactatatcttcttgtttacaaattgcaagagagatggatgctacaanaaataacaacaaaaataggaacagaggagtgaaaagtaatgagtatatatcaaggatggacataaaaaaggtttccattcaataaccctaccagttttcgtgtcataggatttttgtatatccttgccctagtgatgctcatatactgccgtcttacgtcacacctaatttgtctagacgtccaaaaggtagtaggtcgttgtgtcttgtcttatcgccttaataactttgatatataaaaaaataattgtgacacatccatataaaaaacctagtttcgccactgatcatgtgtattgtagacgggcacaaacctcagccctcgggtaagcagagctaagcatgttggtcggtgaagaggacaaagggtttggatgctacctcgccacgcgacacctccgtgcccctggctcttcacgtgtgtgcacacctccctttccctctacagtctacactgtcttcactcgtcccctccacactctccagatgccaaccaagcattactatggtagaatctcatctgacgggtacgaggagatgctaggctcacggctagccacagttgtgcattgctcgagtgcatgaccactgaattgctcgagtgcatatatgatcggatcctccagtgatctgattgatgctcaaagaatccatgcactatgcaggtaggtggatcgatagctgggaggcattaaagcggacgatgacgccttggcctcgctgcaatcttgcagattgctgctgcagcgcttctttaagagccaaccatccacatataccttgcttgacgccaagccaccggcattgtcggcaccgtgccctccgctccgctccccttcctcttggttttcggttccttcctccctcaaccagtcatctgctgctatttatgccacagccactcccagcagcggtgggaacaaagagtgccagcgtctcacccctgaggccgcgcagagccactgcttgcgtctctgtctctctgtctgctcgtttttctccttctgcgactcgtaggagggtgaggtcttgcctcgcggaatggcggcgtccggggcatggctggcccgtgcgacggcgacggcggtgctgggtttcgtcctggcggtggcgtcagctgaggcggcatcgggggacgtggagatggtgttcctcaaggccgcggtggccaaaggcgcagtgtgcttggacggcagcccaccggtgtaccatttctctcccggctccggttctggcgccaataactgggtcgtccacatggagggaggagggtggtgcaggaatcctgatgagtgtgctgtccgcaagggcaacttcaggggctcctccaaatttatgaagccactctcgttttcagggatattaggcggcaaccaaaaatccaatcctgatttctacaactggaatagagtaaagatcagatactgtgatggttcatcatttactggtcacgttgaggctgtcgtcggactgggaggagggtggtgcaggaatcctgatgagtgtgctgtccgcaagggcaacttcaggggctcctccaaatttatgaagccactctcgttttcagggatattaggcggcaaccaaaaatccaatcctggtatgccattttgtttttctctccctttcaccgttcctcagatcagagagagagagagagagagagagagagagagagagagagagagagagagagagagaagtgcgctgcacctttgatcactcntgaaagctgatgctatgatgtgttgcagacttgcagtacatttataatgtagcaatatcttctgttgactgcagatttctacaactggaatagagtaaagatcagatactgtgatggttcatcatttactggtgacgttgaggctgtggacactgtatgttctgaactgaacttatggattcattgtacgatcagctctgcagaaacaaaaaaaaaaagaggagagattaataccatgttttcaatttaggcgaaagatctccgttacagagggttcagagtctggcgtgccgtcatcgatgatctacttactgtgaggggaatgagcaaggcgcaaaatgtatgttcctggcttcctgctggcaactaccattctgttgcggcagttcaaaagaaaaagaacaaaaaaaatacggtcatggatgggtgatatgtaactcaatttccacaacagtgtggttagactttatatccatgaaagtagagagaattggcatcgancaaactggaaagtctgtccattccaactactaggaacataaactgaacctacanaaactcctgtcacatttgactttcatnctgttaggtatctttcacctcctgaataatgcttatgaacctagaaaaatgacccatcgcatcgcacgtattacaggctcttctttctggatgctcagccggaggtctagcagcaatactacactgtgacagattccatgatctgtttccagcgaaaacaaaggtcaagtgtttttctgatgctggatattttttcgatgggtaagttctgcactttcaagttgttgtcaaacttccagtacgcatcatactaggtaccatgttttgttttctcttggccattcttaaatatttgtcacccgagttcatttttgaactaaaatgtgatagacaaaaaaatcagtagaactgagaaccgttttttgtcattgcaggaaggatatctccgggaacttttacgctaggtcaatctataagagcgttgtgaatctacatgtacgtttctttctgatgatgcagtggttttgattaaagaaatcgaatgtttaaatttgcatctaccattgttcttaattcagaaaaaaaaaactttcatcgttgtttctttaatacaagattcaagcctaatagttttccaatatctttcagggatcagccaaaaatttaccagcttcatgtacctcaaagccaaagcaatcacctgagctggtcagtttcgttcatttacctcccatctggtatgaagcatagcattcagactaactttcaaaacaaacgcagtgtatgttcccacagtatgttgtcccgacaatgcgcacaccattgttcatacttaatgcagcctacgattcgtggcaggtaattttcatatattccacgttccaaactgtttaagataaattgtgtcaactaaccttagcatgataaaaaaaattaacaagttttcccctgcatttcctacaggtcaagaacgtcctagcacctagtccagctgatccgaagaagacttgggcccaatgcaagcttgacatcaagagctgctccgccagccaactcacaaccttgcaaagtcagtactttggctctttgcattctctattttatagcagagcagggcatagctctcctaaacaagccctcggtaacattgcctatcttacccgtttggttattttggcacagatttcaggacagattttctggcagcactccctaaaacgcagtctgtaggcatgttcatcgactcatgcaatgctcactgccaatcaggatctcaagacacgtggctagccgatggttctcccacggttaacaagacggtaagtctaatgctgcatcagttatgacttatgagagaatcgagatactgaacggtttattctgttcttcagatttctagtagtcatctacagattcagacatcagaaacaaaaaaaaaatatgaaacttgttctgctgttcaggcgtgatgtgtttctctttctgcagcaaattggcaaggcggtgggggactggtactacgatagggaggtccctcggcagattgattgcccgtatccctgcaacccaacttgcaagaaccgtgatgatgattgagcaattgtataagtagttcatgttatcgaaatgaaaacaataaaggatcacaacgcgcgcccgtagttgtagatgatgaattataaacacatatgactgagctcaaagttgtttaatcatcatctgttgcgaaatgaggaagacaattggtgtcttgaagctgtgttttcgactgtgtctaaagcgtaaatgtaacgtatattgtgtcttcgcctatgcttaagacattggactagttgattggtcaatttaatttattaaatgttttgattggtgtaatgaatataataagtcgtgcatgccgcatgactaggcttccagtcttccacttacaccggctaagcactgtctatatatatgtagtcactttggatcaatgaatcagctgttttttccagtttaggttttctttttcacttcttgttttgccatggctgagactggccgcagcgcttcccgccagtagtcctctcctctatcactgttcctgtttagcgtcactctactgctgcgtcagtcgtctctacacttgcctctacgcgctacagctctagaggaatacataggaccacgctagatgtggcgggctgcaagctgtcccctgccctcgaaaccagtgcacgacgtgggccctcttctaattgttagtataagaaaaattgataatagataaaaaatagtatatgaaatgatattttatggttgtagtgaggtattgggggagaaaatatagaaaactgctgcggaagatgaaaaggtaggagatgaaatattgatgatgtgacgcaaaaaagtgatataaaaagagaaatttagaggtaaccattgccatcctgccactatggctgccgccgatgctgcgcgcctggccgaggcagcgcgccatgccggttagcgtcatctctactttaatcagggttgtttctgagtttgaagggggctagaacaaaattataaatggagactctaatctataagaactattttttaataatgtatatatcaactaattaaaataatttaatgtatcgtggaaaaacttgaacggtgaaaaagaagtaagatcattactaaaagtatagagaacacctaaaatatgtttctggaatctcgcatatcactctcgagaaatttatccatggttcttatccaaccgtcggtgatcctagtagcctcgcgcctgttgcctgtgctggcctcgtgccttgcgtcgtgccactggccaccgccctatccgtgaggtgtgagcggtgagcctggcgtgatggcgccttgatgcctgagtagctgagcctggtgaacgatcgagtgatcgacgatcgagtcacgcgtgtgtagcagggtgcgacgactaagccctagcgtttttcaatgttgcgtccttcatgcagcctggctcatggcctccagtatggtatggacttatagttgccaaacgggccgtncggtccgacccgacacgggcctgttacgtccgatagctaatcggggcgtgcccgactggcccgcatgtcgcagtcgtggtccaggcacggcatgccgacctgctagctgtgttggaccggcccgtaatctgtccaggctatctgattaaatcaggaaaatagcaaaaatccagcgtgagagggggttctaactcgtgccctcatggaccaaggctgggagacgctacatgcatgaacgaagctaacccgtagaactccagtgggactgcctcgcctgcagtcccgacccagcccgatacaataaaatgggacgtgcttcgggtcggcccgtcagacacgacccatttggacatctataaatggattacactaggctagcgggtgggacccctaggaagtgggggtctaggtcgggcgcccccttaggcacgggtctgactttaatacattactatctccctgcaaacagtttttcctatgaaggatctcgttcctcttctgcacttcatgtgtgtcgtcgtaacccactctcatgtttggatggatttgtctcaacgacagtcgacaatacacttggatattctaggtcgtgccgggatgacagagtgcaagacgtgcaacacccatgtcaatacacataccaaggtactgtgcgaccctatggctaacgccactatctattgtagattggttggggtcttgcagcacctcactttcactcgcccagatattacctatgcggtccaacatgtttacctacacatgcatgctcctcgggagtctcatgtgatggttgtgaagcacattctgcgctaatcgtgtgtcatagctaatcttaggcccttccttaggtgctccttgccttggtccttacgatgtacattgatgctgactagacctgttatcttgacatgcgtaagtctatctcggactacgttgtgttccttgatgttagtctcggcccttggtccagcaaaagccaacaagcagtctcctgctccaacatcaaggttgagttctacgccatggaagcatcctggttgcgaaaactaccccaagagctccattagcccctacgacgttccactcgtttactgcaacatgagtgtcgtcaatcttttggcgaacccggtgcagcactagtgcactaaacacgtagaaatttaccttcacttcatctaggaacgagttccgatggcgttgttcacattattcatgtatccacgacctcacgggttcaccgacatcttcacgaaatgcctatcacatgtggtcttcaaagaatttcatttcagcataaatgtttggtctactgacactcctattgtgagggtcttatgttgactccagtagattgtgtaatcgacctcgaatgtgtatttgtgtgtgcagccgcgagctgctggatggatccacttttctcgttgcgcaaaaattgtcgccacacgtagcatacacattcgcatgcagaagacgatgggcacaaacttatagactccttgtattcagtactcttcattctccaattagtgtttccttgtatccagtactcttcatttctccaataagttgcacatggcgtatagctatgctcctgatcttccactcacgctgactgagcactgcttatacatttataattgctttgggccaattaatcatttgttttatcatttcctctatgcttttagaggagacaataccacgaacgtcgaggtttccactaatccatggacacgaaggtggtgcgcctgtttgggtgcacgaggcttgagtcgaacaaggggcagattcaacgagggggcaagggaggctctagcccccctacccccttagatccaatggagacctctttgggatccctatgatttttgtgatatttgatgaagttctgaagagttgaagcttgttggacgccaaaggttaaagaaagagtttaaatcacacatttagactgacaaatggtcatttgtccctaccagcactcccatggtgtattgagttttttaggccaagaatttagtctcctctatattttttaatccactctgagtcgaacgtcggcgatggctcgacgctggtataggtctctaggaccacaagccctcggtgtgggcagtggcttagccctgagcacgtttgatgaagtcatcgacaaacgttaggagattttcaccaactgaggcatacacaggtctctggatgatggtcgtgtggctcgacgggctagggtacaccatcaccccgagagtcttgggacactagggctagattcggaaggatgcattggcgaaggcaccgtttggccagcccgatcacatgcccaggctatattagtatttgctccgagacttgtccagcgggccacaactaacaacaactatagtagaatcagagtagcttgctaggagctctctataatatcagatatacttggaatcttatataacattaataaattacacaggtgaaaaaaacttatagctttataaacaaaatacatcgagagagtagaccgacagttccgcatnttgggcctttaacaatcatgctcatgctatgattttgggctagctttgccacgagagggatgcatcaccatgatcttggtagagaatagagatgttgtaccctctcccccagtcatccaacacgagtagagctgttgtcagtgagtctgccgccgccttgacatgccaaattcaatcaagcggctagaacagtgacgcgacaacgggcccatgttgatgtgttcgccacctaggctctcgtgttgtctccaacagatcattcatagattatgtttgtagagtanagtttaaaatagtggataaaatataggataatatagaagagtcgctggagatagcatcattcgtctccaaactctttggtatgtttaattgctcat

SEQ ID NO: 13489 - DNA, 2115 bp, Zea mays
ccgggcaagcattactatggtagaatctcatctgacgggtacgaggagatgctaggctcacggctagccacagttgtgcattgctcgagtgcatgaccactgaattgctcgagtgcatatatgatcggatcctccagtgatctgattgatgctcaaagaatccatgcactatgcaggtaggtggatcgatagctgggaggcattaaagcggacgatgacgccttggcctcgctgcaatcttgcagattgctgctgcagcgcttctttaagagccttccgtcccccgagccctggctaccccccggcccaccggcattgtcggcaccgtgccctccgctccgctccccttcctcttggttttcggttccttcctccctcaaccagtcatctgctgctatttatgccacagccactcccagcagcggtgggaacaaagagtgccagcgtctcacccctgaggccgcgcagagccactgcttgcgtctctgtctctctgtctgctcgtttttctccttctgcgactcgtaggagggtgaggtcttgcctcgcggaatggcggcgtccggggcatggctggcccgtgcgacggcgacggcggtgctgggtttcgtcctggcggtggcgtcagctgaggcggcatcgggggacgtggagatggtgttcctcaaggccgcggtggccaaaggcgcagtgtgcttggacggcagcccaccggtgtaccatttctctcccggctccggttctggcgccaataactgggtcgtccacatggagggaggagggtggtgcaggaatcctgatgagtgtgctgtccgcaagggcaacttcaggggctcctccaaatttatgaagccactctcgttttcagggatattaggcggcaaccaaaaatccaatcctgatttctacaactggaatagagtaaagatcagatactgtgatggttcatcatttactggtgacgttgaggctgtggacactgcgaaagatctccgttacagagggttcagagtctggcgtgccgtcatcgatgatctacttactgtgaggggaatgagcaaggcgcaaaatgctcttctttctggatgctcagccggaggtctagcagcaatactacactgtgacagattccatgatctgtttccagcgaaaacaaaggtcaagtgtttttctgatgctggatattttttcgatgggaaggatatctccgggaacttttacgctaggtcaatctataagagcgttgtgaatctacatggatcagccaaaaatttaccagcttcatgtacctcaaagccaaagcaatcacctgagctgtgtatgttcccacagtatgttgtcccgacaatgcgcacaccattgttcatacttaatgcagcctacgattcgtggcaggtcaagaacgtcctagcacctagtccagctgatccgaagaagacttgggcccaatgcaagcttgacatcaagagctgctccgccagccaactcacaaccttgcaaaatttcaggacagattttctggcagcactccctaaaacgcagtctgtaggcatgttcatcgactcatgcaatgctcactgccaatcaggatctcaagacacgtggctagccgatggttctcccacggttaacaagacgcaaattggcaaggcggtgggggactggtactacgatagggaggtccctcggcagattgattgcccgtatccctgcaacccaacttgcaagaaccgtgatgatgattgagcaattgtataagtagttcatgttatcgaaatgaaaacaataaaggatcacaacgcgcgcccgtagttgtagatgatgaattataaacacatatgactgagctcaaagttgtttaatcatcatctgttgcgaaatgaggaagacaattggtgtcttgaagctgtgttttcgactgtgtctaaagcgtaaatgtaacgtatattgtgtcttcgcctatgcttaagacattggactagttgattggtcaatttaatttattaaatgttttgattggtgtaatgaatataataagtcgtgcatgccgcatgactaggcttccagtcttccacttacaccggctaagcactgtctatatatatgtagtcactt

SEQ ID NO: 13490 - DNA, 2262 bp, Zea mays
aattcggcacgagggctgtatccagagatggtgtgaagcacacacaattctactctgcgcagggtctgtttcacttgccattttggataggatcgctcgttttggaattaactttatgctaacagaatctaggtgtcattaagctagattaagcttgctgcttgacttagtagtgtaaatctgtaaagaaaattacctggtttgggtttagtctctataaaagaaatggaacagaggaatgttctggcattgggtgaacatgttctaaaagctactgtttggaagcggaagcataagactgctatggagcaccctgaaggcaatgatgtgatggtgttctctcagcatgatcaaagaaagcaccctgtgatatttgacgacagagctaaatgtaagaagtctaaattaatttcctgtgggagtggagttatattggagtcatattggaactttaagacaagtgggctgcctgtgcgcgtgcttttctaccaacatggtgactggagtgattttccagaggatgttgtaaatctagcacaacaggacttccagttgaagaagccaattacaactgctgtgttccagaacaagcacatcctgttggacttcattcacatgatttgcatagattatgagatgaccatagacaaaccactagcatgggttgatgataatggcaaacgcttctttccagatttatctgctgggctctacacatctaaaccatctcagcatgagaatggtgaagctgatgagtgtgatggaacgcctacaagtgtagctgaaagttctagttcggtatctgttggtgaagtagtttctcatggtaagaggatcaatgatattgcagaggacaacatgagagcacataacatattgtatgaagctgttggtgaaaatatttcaggtccttcattccatttgaatgaatattctagtggaaccatacaagctactggcaagccaaacgattgtcgacgtattgattcagctgtgcggaatttgttgctcaaaggattaggtcagccgtttagtgaggaagatattattggtatctatagaacaccactgctagatcagcgagggcaagttcgttgtggtctcttccagaaggagatcgaagagaccaggagtcgtcgggggaatgcaaatgtacgttatgcttggcttccttgctcaagatataccatggagcagatggcaatgcggggtgctctggaaatcgcgaagcctcataaggggtccatttgtggtgttgggacttgtcttgctcctgcaaactgtacaaattcatgtgccagatattctgattttcatgaagatggcatcatcagaatgatgttgtgccgtgtaataatgggtaatgttgaggttgttttgcctggatcaaagcaatttcagccatccaatggaagttttgataatggtgtggatgatcttcaaaatccacagaattacatcgtatgggatgctaatgtgcataaacacatatatgctgaatatgctgttattgtccaagcacctctcgtgaccaatgaatgttcgggcttgaaggatagcgtgcccaacatatctgagatcataagttctggttctcgagacaatctaaccaaggaggataggttcgcgccttgtggtgtcgaacaagaagcacctaggctggggcgtgctccaagggccccctcctcaccatggatgcccttttcgatgctttttgctgctatttccacgaaagtgcctcgttcggacatggagttggtcatcagatactatgaagaattcaagaggaagaggatgagccggagcgacctggtggtacggatgaggcaaatagtcggtgataagatattggtttctacaataatgaggcttcaccaccagaagaagcccccatcgatggcagcagcagcagctgggctagcaagagcactcgcaaggggggaagagggagggggagtagccgagtaagattagtttaagccgccttgtcttttgagaaatttatggagcacatatgctttgtcgacatggccagacccaaggtgtcaaaagggagggagatgagctgagcaactgttgtagtgtagtctcaaactcaaagcgtttaggtcttgacatttgacaaactaaaactcagaaacattatcatgagtagtgttttttttttcgtttctctttcctggatttaactattgttattgctatttcgtggatatctgggcactgaaggccgtgctattgttggtttatgatggtatgatt

SEQ ID NO: 13491 - DNA, 772 bp, Zea mays
gggcgattgggttcctcgaggccggccccggcccgcaaccatcccgacccgccggcaacctcacccaacgactaatctccctccacccacccaaccaccaatcaataccgcaaaaatggccggcggagttaccgttcgcgatgtcgatgcgcagaagttcatcactgcctactctgctttcttgaagcgtcagggcaagcttcccatccctggttgggtcgacaccgtcaagactggtcctgccaaggagctccctccccaggacattgactggttctacgtccgcgctgcctccatcgcccgccacgtctacctccgcaagactgtcggtgttggccgtctccgcaaggtccacggtaccgccaagaaccgcggcagccgtccctccaagcacgtcgatgcttccggctccgtcgaccgaaaggtcatgcagtctcttgagaagatcggtgtccttgagcaggacgaggagaagggtggccgccgcatcacccaggccggtcagcgtgatttggaccgtatcgcccagaccaccgctgaggccgaggaggaggaggatgacgagtaaatttagtcctcaatcaaattaactccaaaaaaagtctggacggttctttacccggtcaatggtagcaatggcaatggatttgggcgttgggtcatagattttgtcatgtatgaatgagattcccctgactctgggtcattcggtttggtcaaattgcacccgtccaacttgtcgtccaaaaaaaaaaaaaaaaaacccgcggcc

SEQ ID NO: 13492 - DNA, 2161 bp, Zea mays
cggccgcgtgggaaagtatcgcatactggtcaagatgcagccactgcatgttcagcatatcttcatctcaatggattttgccttctgatgattgcacatgatgaagcaaatattattttgagagaatccaaggttcatgatgctatccgatgctttttcagggctgcatccgggtatgaagctccaaaggctttggagaacttttcattggaaacagggtttcaagtttctggggaatctagatctatttctttgtggagacttaactactatgagtgggcaatgcaaatttttgagcaacactccatgagcgagggggcgtaccaatttgctcttgctgcactagaactagttgatatcgtcgacgggatagataatggaattgaagctgagggtcttccagagaccgcagcaatgattaaaggacgactatgggctaatgtattcaagtacagcttggatttgaaacactttcacgatgcatattgtgcgatcgtctcaaacccagatgatgatagcaaatatatctgtttgaggcgtttcatcatagttctttgtgatcttggggagacaaaggttctttgtgacggagagattccattcactggcttggtagagaaagtggagcaagagctcttctggaaggctgagcgctcagatctgtcgtctagaccaaatctctataaggttctttattcatttgaagcacataggaacaaatggaggaaagcagctgcatacatgtacagcccgtgataaaatttctccaagtaaaagaccccggaatcttttgatggagaactcggcttttggcacaaactcagaactttctagattgcaattttgtgttgacattgaaatccttgaaaaagaatacatattaacagaagcacagtatatgctcagcactttgaaatcaagttttgatttttcagaaagccaatctattgagtccctgatggatattcttataaatgagaaattgtatgatatagccttcacaattgtgctaaaattttggaaggagtcagaaataaaaaagcaattggaccgtgtattttcagtcattgcgcagcaatgctgctcgaacagatcagacaacaaatcaagtaaacaagtgccacttctgccttcttctgagaatgatgcatgggagatcaacaataggagtattgctgtgacccaacaattgcaggggagcaaccactgggaaacccttgaactatatttggataaatacaaagacctgcatcctaggttgccagtcattgttgctgagacgcttctttatactgatcctgagattgagctaccactttggttggttcagatgttcaaggctaataaggcagggaacaagatctcatggggcatgtctggaaaagaggcagatcctgctgctttattcagactgtacataaactacggacgccacgcagaagccaccaacctgctggtggagtatctagagtcgttcgcatcgtcgaggccagtggacgtcctccaccgcaagaagatgtccgccgtttggttcccctacaccgccgtcgagaggctctggtgccagcttggtgagatgcaacgggcagggcacagcgtggatcagtgcgaccggctcaagaagctgctgcacggagccctgatgagccacctgcagcaggtcgtggtcgactcggatgatgtgctgtcgtcagttggagatgggcaggggatggaggaccagagcagctgaagtcctgaagatcgtgttgttggcatgtgtagaaaacgatgtgccaccgctggatactgtatgtgattgtttgtgtggtcagctgaccaagagttacgcctgtgtcttttatatagaattattattagatgaaaacaaagacggagcgatggctccatttgtaacgtgagcatggaactgtcgctgatgacgagctgttcacttcccatgtgtagatgtagaaggtggattgacgcatccattacagcactgctgcactggtattgtatcggttctgccttcggggtgtgtaatggggttgttgcgatcgggttcagattagtgttgagcgtcgtggcattagggcatgtacaataccattcaatatatggtcttttaaggggtttctaaagagttaattaaaaaaatacaacagattacccctttacc

SEQ ID NO: 13493 - DNA, 845 bp, Zea mays
cctcgaggccggccgggccgggagaccgagacaagcgccgcagcccgcagcagaaggctcgcgacatcagctcgagccagctgcgatcgatttccagaccgagacaagcgccgcagcccgcagcagaaggctcgcgacatcagctcgagccagctgacgggatccacacggtgccatgtcttcccggcggccgtcgcatccgtcccaccggaatccacggcgattcccgtccgcctgctatcttctagtactcacccttgccctcctcgtcgtctccgccgccgccaagtcctcccgccgccccatctccgacaacgagatccggcagaagaaggaggcctgctacaccgacgtcgagaacgggctgtggggatgggtgtgcaggtactcgccgacggagaaggagaactgcgtgctgcgctgcctctcgccggagtgctacgacctcatatacggcggggatccgcttgaggaaggggagttggactatgttcgaagccaggagtacaagtattgtatgcacaaatcatcccttggagaaagcttggatggtgtgaagggatccttcagctactcatgaaggaatgagaagaaaaaggttctgttagtctgctgtaaattttatttacaatcttgaacagacatgcatctttttagataatggaattgtaattccagactttgctttttctcaaagcatcaccggtgcatcatcttatattaaacttacaaatgcaaattaaacattggattcatttgttggccaaaaaaaaaaaaaaaaaagcggcctatgtcccgtgcggtgccacgaagaacacatgaaatcgttatataagtggtactac

SEQ ID NO: 13494 - DNA, 723 bp, Zea mays
tcgaggccggccgggacggtgccttccctccccgccggccgtcgcatccgtcccaccggaatccacggcgattcccgtccgcctgctatcttctagtactcacccttgccctcctcgtcgtctccgccgccgccaagtcctcccgccgccccatctccgtacgtctccccgcctgacccgaccctgccatctctcctccgcccgcctctctagtctctatccatcccatcgcgcttaccgaactccgtggcgcaggacaacgagatccggcagaagaaggaggcctgctacaccgacgtcgagaacgggctgtggggatgggtgtgcaggtactcgccgacggagaaggagaactgcgtgctgcgctgcctctcgccggagtgctacgacctcatatacggcggggatccgcttgaggaaggggagttggactatgttcgaagccaggagtacaagtattgtatgcacaaatcatcccttggagaaagcttggatggtgtgaagggatccttcagctactcatgaaggaatgagaagaaaaaggttctgttagtctgctgtaaattttatttacaatcttgaacagacatgcatctttttagataatggaattgtaattccagactttgctttttctcaaagcatcaccggtgcatcatcttatattaaacttacaaatgcaaattaaacattggattcatttgttggccacaccaagcggcc

SEQ ID NO: 13495 - DNA, 3015 bp, Zea mays
ttgcctgttttggtttttttttcagttcttctgatttggtcatgatttatattcggaatttaatttggaatttgtctaattattcaacacaaccaaactggcgcgcgcacgatgtatcgccaaacatttattcagctagctagttgagtaaaattcgtcttctggagagggaaaattggagctgggcctacggcaagcccgagcccttctccctggcctccctcatgttccgctcccgctctaccctgtccacatcccgcgcgatccggtcccgctccttcacggcggcgtccacgtcctccgcgtcggggaccacgcgctccttgacgccgtgcgcggtgtccttggccgcgtcccaggtgctccgcgccgcctgcttcgccatgtccccgatggcctgcgccgtctcggccaccttccccgcgccctccttggtcatctccaccaccttctccccgtacgacgcggtcccctccacggcccggtccttggcctccccggccctgtccatggcgcgccccgccgcctccccggtccggtccttggccgccttcgccgccccctgcgcccggtccgcggcctcgtgtcccgcctccttggcccgctccttcacgtgccccgccctgtccgcggcctcccgcgccgcgtcacgcgtctcgttcttcgctcgctccgtcgcccgggacgccgtgtccgcggcgtcctccgccacgcccttcgcctggtccttggcccgctcggccatgcccgacgcctggtccgccacgcggccggccttgtcctgcgccctgctcttcgtctccccggccatcctcttggcgtgctccttggcgtccccggtggcgtccttcgcctcctccgccgcgtccttgtacttgtcccctatttctctccggtcttccggcgcgttgtcgtatgcctgagcaaacatgcgtgtcagattcgcacaattacgtaccgctaggcgcctagcggtgacccggcagtgagcatatacctgggacgatcttggcgcagcctgcaagcagaggcgggtccaggtcgctgcctgcgggcgcggcggaaggaagcacgccggcatgggaagagcctgcatgccagcagcgttgccgttaccggtgagctttgcggcgccggcgacgcgcgcgcctccgagcagcatggcagccatcagcctggacatagacgacgacgtcgacgactaattaacaggcgagacagtgcgttgacgtgaggtcttggatttggatcaacgagctaccaattgtggatgggtttcagggatcaatgagcttgcaagcggagactgtgcgctgtttataaaggagccaaggaggtggagctgacgagacgaggggaggtgacacgtccaaagacacgttgcggtacaagctccggaagaggacacgtgccgacgcatccggcgctctgctgtgtgttgctgtcccgccgcgggaggaacagtcgcgccaagtcaatccattcagagcttgcgcggcgatctgtaagaaagttcaggaaggtatgcacttcctccgtttaaaaccagcagtcgtccttcatttcgtcaagaatttagtctattcactattgtttcttggcgtcttggcacaaatgtaaagtatggttgctcattcttaatttcttgtccattttttatcagtataatggttaagttttgttgcggcagaagaatctgcttgagtttagctctgagaatttcaacttggtatgggaatacggatacgtatctgcggctaattattctgaaagaagcgcccgtcaatgtgattagcgtctgtactacactttttgaagacagagaaaaagttcagatcgttttgccagctcctcggttaataccaaaccggcgagttattcagacgaagaacaatctctcaactgcaaaaccaactggacgttcgaagataaccatttccgtcgcctcctccaccattgcatgcaacgatacagcaacccacttcgccggcggccggcgccaggcgccacaacaacacaatgaatcgtgaacgaaaatctcctccttccacctccataaaaagccctcccgagctcacatttcatttctgggagcagaagcacatctgatcggccacggccagaagaacgcgcgcggcaaacgttagcaagcgctggctcggcgtgagctagcggtcgccgcgcgcgcgcaagcacaatggagcctacgacgacgatgacgatcagctgcaggagcaggacgcagccgccgggcgataggtggagcaggtgttcgagggggagccggtgccgacaccgtcggagatgttcacggcgcggtcggtggccgtcggcgctgtcctaggcgccacgctcagcgtcgtggccatcaagctcaccctcacctcgggggtacatccagttcctcaccgtccccgcagggctcctgggcttcttcctctctcgcatctggacgcgcctgctggacggctgcgaggtgccgcagctccccttcacccgccaggagaatgccgtcatctagaccttcgtcgtcgcctagctgcttgttagcagaggcaggggagagagatttcgtggagcagaagaagaagaaggatagcggggaagcagacagtggtcttattatatatatatatatatatatatatatatatatatatatatatatatatatatatatatatatatagtcgattgctcgtgcgttgcgacggcttacaacaatatccacgtaaactatccataaaaaaattcaagattttttattgattgtctccgctctctgtacaatattttttttgatttggctaactgatgttattgtttactccatgcaatatgttttggtacaacacggccaatgaagtgagcgattagaaaagagttcacaacgactgactgaataaacagagattataaaatgacataattccatcatacagagaccaaataagacaaagtttgtgagctcaagtttctaaaataagtccaatgaagtcaaacttataaaaaaag

SEQ ID NO: 13496 - DNA, 1179 bp, Zea mays
ttttttttattcgaaatttaatttggaatttgtctaattattcaacacaaccaaactggcgcgcgcacgatgtatcgccaaacatttattcagctagctagttgagtaaaattcgtcttctggagagggaaaattggagctgggcctacggcaagcccgagcccttctccctggcctccctcatgttccgctcccgctctaccctgtccacatcccgcgcgatccggtcccgctccttcacggcggcgtccacgtcctccgcgtcggggaccacgcgctccttgacgccgtgcgcggtgtccttggccgcgtcccaggtgctccgcgccgcctgcttcgccatgtccccgatggcctgcgccgtctcggccaccttccccgcgccctccttggtcatctccaccaccttctccccgtacgacgcggtcccctccacggcccggtccttggcctccccggccctgtccatggcgcgccccgccgcctccccggtccggtccttggccgccttcgccgccccctgcgcccggtccgcggcctcgtgtcccgcctccttggcccgctccttcacgtgccccgccctgtccgcggcctcccgcgccgcgtcacgcgtctcgttcttcgctcgctccgtcgcccgggacgccgtgtccgcggcgtcctccgccacgcccttcgcctggtccttggcccgctcggccatgcccgacgcctggtccgccacgcggccggccttgtcctgcgccctgctcttcgtctccccggccatcctcttggcgtgctccttggcgtccccggtggcgtccttcgcctcctccgccgcgtccttgtacttgtcccctatttctctccggtcttccggcgcgttgtcgtatgcctgggacgatcttggcgcagcctgcaagcagaggcgggtccaggtcgctgcctgcgggcgcggcggaaggaagcacgccggcatgggaagagcctgcatgccagcagcgttgccgttaccggtgagctttgcggcgccggcgacgcgcgcgcctccgagcagcatggcagccatcagcctggacatagacgacgacgtcgacgactaattaacaggcgagacagtgcgttgacgtgaggtcttggatttggatcaacgagctaccaattgtggatgggtttcagggatcaatggtcccgtac

SEQ ID NO: 13497 - DNA, 955 bp, Zea mays
  misc_feature (714)..(714): n is a, c, g, or t
  misc_feature (738)..(738): n is a, c, g, or t
  misc_feature (744)..(747): n is a, c, g, or t
  misc_feature (759)..(759): n is a, c, g, or t
  misc_feature (768)..(768): n is a, c, g, or t
  misc_feature (785)..(785): n is a, c, g, or t
  misc_feature (797)..(798): n is a, c, g, or t
  misc_feature (801)..(801): n is a, c, g, or t
  misc_feature (810)..(810): n is a, c, g, or t
  misc_feature (814)..(814): n is a, c, g, or t
  misc_feature (827)..(827): n is a, c, g, or t
  misc_feature (830)..(831): n is a, c, g, or t
  misc_feature (842)..(842): n is a, c, g, or t
  misc_feature (844)..(845): n is a, c, g, or t
  misc_feature (847)..(847): n is a, c, g, or t
  misc_feature (855)..(855): n is a, c, g, or t
  misc_feature (858)..(860): n is a, c, g, or t
  misc_feature (867)..(867): n is a, c, g, or t
  misc_feature (870)..(870): n is a, c, g, or t
taccctcgaggctcggccgggacaaggcctttcttcctcctgtgaagccaactcgtcccctcgggccaacgcgaggccaaaaccaatctcacatctcctccccctcccaccaccgaggacccttccccaagaactgctccgagtcctggagcgggagagaggtcgagggaggagcccaataagagtttctcctcgcctctctctctctctttctgctcgaaaaattattgtcgcattggtttggttcccttgccaaaggaggcggctttctgtcctccctgatctaacatgatggcgagcaccgcatcagcgaccgccgccgccgccgccgtggcattcggggcagccgccaagccgcggggaccggcggcggcggcgctccgcgcaagggtgcctgccggcggcaggcggcgctccggcgtggtggtgcgctgcgacgccggcgtggaggcccaggcgcaggcggtggccaaggccgccagcatcgccgcgctcgagcagttcaagatctccgcagaccggtacatgaaggaaaggagtagcgtagctgtgataggtctcagtgtacacacagcaccagtggagatgcgtgaaaaacttgcggttgcagaggaactatggccccgtgctattcaagaacttactagtctaaaccatattgaagaggctgcctgtcttagtacttgtaatagaatggaaatttatggtggtagncccctcatgcatccgaggtatcanagaagnnnntgactggatgtnaaaggtganaacgaatcgatcaactntttctgctcagnnttntttccgcantttnttggctgctcaanganngattaggaaananncnttaatgantgnnnctttttngcnatttcacagaaaagtggtattcctgcttctgagcttaaggagcacctattcatgctgcgtgacagtgatgctacacgccatctgt

SEQ ID NO: 13498 - DNA, 1937 bp, Zea mays
ccacgcgtccgcatcaataaagaggagcttgggaagttgccaaggcctccgatttcgctaatgcgacgataatggcgaccacgacgtcagcgaccaccgccgccgcagcagccgccaccaccgccaagccgcgggggtcgtcgtcggccctctgccagagggtggccggcggcggcaggcggcgctccggggtggtgcggtgcgacgccgccggcgtggaggcccaggcgcaggccgtggcaaaggctgccagcgtcgccgccctcgagcagttcaagatatccgccgaccggtacatgaaggaaaggagtaccatagctgtgataggcctcagtgtacacacagcaccagtggagatgcgtgaaaaacttgctgttgcagaggaactgtggccccgtgctattcaagaactcactagcctgaaccatattgaagaggctgctgttcttagtacctgtaatagaatggaaatttatgtggtggcgctatcatggaaccgtggtatcagagaagtagtggactggatgtcgaagaaaagtggtattcccgcttccgagcttagggagcacctgttcatcttgcgaagcagtgatgccacacgccatctgtttgaggtgtcagctggccttgactctttggttctcggtgaaggacaaatccttgctcaggttaaacaagttgtgaggagtggacagaacagtggaggcttgggaaagaacattgataggatgttcaaggatgcaatcactgctggaaagcgtgtccgctgcgagaccaacatatcatctggtgctgtttctgtcagttcagcggcggttgaactggccctgatgaagcttccgaagtctgaagcactgtcagctaggatgcttctgattggtgctggtaaaatgggaaagctagtgatcaaacatctggttgccaaaggatgcaagaaggttgttgtggtgaaccgctccgtggaaagggtggatgctattcgtgaggagatgaaagatatagagatcgtgtacaggcctctctcagacatgtatcaagctgctgctgaagctgatgtcgtgttcaccagcaccgcatctgaaacttcattgttcgcaaaagaacacgcagaggcactcccccctgtctctgatactatgggaggtgttcgcctgtttgtcgacatatctgtccccaggaatgtcagcgcatgtgtgtctgaagttggcgctgcacgagtgtacaatgtcgacgacttgaaagaggtggtggaagccaacaaggaggaccggctcaggaaagcaatggaggcgcagacaatcatcacagaagaactgagacggttcgaggcatggagggactcgctggagaccgttccgaccatcaagaagctgaggtcgtacgcggacaggatcagggcctcggagctcgagaagtgcctgcagaaagtcggtgaggacgccctcaccaagaagatgaggagagccatcgaggagctgagcaccggcatcgttaacaagctcctccatggcccgctgcagcacctgaggtgcgacggcagcgacagccgcacccttgacgagacgctcgagaacatgcacgccctcaaccggatgttcagcctcgacatggagaaggcgatcatcgagcagaagatcaaggccaaggtggagaagacacaaaactgaggccaggaagcaatttttctaccaccattatctatatatatagcgtctccaatctcattccatttttttatcctttcactcagtgagcccttcccctgctcactgtgatcgttaactgtgtctgtgaattagagccatggcagcgtgttgtcaataacagcaatgtgtcccaattccccacagaagaaagactatatttatatgcatttattggagcaaatagtttacttatttattatggcgagagactaatctaaattttaattttct

SEQ ID NO: 13499 - DNA, 2528 bp, Zea mays
  misc_feature (4)..(4): n is a, c, g, or t
cggncgcgtgggcttccccccccgcggccaactcgtcccctcgggccaacgcgaaaaccaatcacatctcctccccctgaccccctcccaccaccgaggacccttccctaagaactgccccgagtcctggagcgggagagaggtcgagggaggagtccaataagagtttctcctcgcctctctctctttctgctcgaaaaattattgtcgcattggtttggttcccttgccaaaggaggcggctttctgtcctcgctgatctaacatgatggcgagcaccgcgtcagcgaccgccgccgccgccgtggcattcggggcagccgccaagccgcggggaccggcggcggcgctccgcgcaagagtgcctgccggcggcaggcggcgctccggcatggtggtgcgctgcgacgccggcgtggaggcccaggcgcaggcggtggccaaggccgccagcatcgccgcgctcgagcagttcaagatctccgcagaccggtacatgaaggaaaggagtagcgtagctgtgataggtctcagtgtacacacagcaccagtggagatgcgtgaaaaacttgcggttgcagaggaactatggccccgtgctattcaagaacttactagtctaaaccatattgaagaggctgctgttcttagtacttgtaatagaatggaaatttatgtggtagccctatcatggaaccgaggtatcagagaagtagttgactggatgtcaaaggtgagaacgaatcgatcaactctttctgctcagtcttctttccgcagtttcttggctgctcaaagaaagattaggaaagattccttaatgagtgtttcttttttgcgatttcacagaaaagtggtattcctgcttctgagcttaaggagcacctattcatgctgcgtgacagtgatgctacacgccatctgttcgaggtatcagctgggttggactctttggttctcggtgaaggacaaatccttgctcaagtcaaacaagttgtgagaagtgggcaaaatagtggaggcctggggaagaacatcgacagaatgttcaaggatgcaattactgctggaaagcgtgtgcgctccgagaccaacatatcatctggtgctgtttctgtcagttcagcggcagttgaattggccctgatgaagcttccaaagtctgaagccctttcagctaggatgcttttgattggtgctggtaaaatgggaaaactagtgatcaaacatcttattgccaaaggatgcaagaaggtggttgtggtcaaccgttcagtggaaagggtggatgccatccgcgaggagatgaaaggtatcgagattgtgtacaggcctctttcagagatgtacgaagctgctgctgaagctgatgtcctattcacgagcactgcatctgaaaccccattgttcacaaaagagcacgcagaggcacttcccacaatttccgatgccatgggtggtgcccggctttttgtcgacatatctgtcccaaggaatgtcagcgcgtgcgtctctgaaattggctccacgcgagtatacaatgtcgacgacctgaaagaggtggtggaagccaacaaggaagaccgtctcaggaaggcgatggaggcacaaacaatcatcgccgaagagctgaaacggtttgaggcgtggcgggactcgctggagaccgttccaaccatcaagaagctgaggtcttacgccgacaggatccgggcctcggagctcgagaagtgcctgcagaagatcggggacgacgctctcaccaagaagacaaggagagccatcgaggagctaagcaccggtatcgtgaacaagctcctccacggcccgctgcagcacctgaggtgcgacggcggtaacagccgcacccttgacgagaccctcgacaacatgcacgctctcaatcggatgttcggcctcgacaccgagaaggctatcgtcgagcagaagatcaaggccaaggtggagaagatccaaaactgaggacaggaagcagtttttcttccccgtgtatacataccataccctccaatctgattccattttttttgaccctttcacttactgagctcctcccctgctcgctgagacgtggactgtgccgtgaattagcgccatggcagcagctcaatctgttgagagagagcggcaaattgtctctactccagctgcttttctttcttcatttttgcttgagctgctgtggcaagagcccccattcttaagctatatacttcattcggacggaacaggaatgtatcaatgtgtcagctgatgccgttttcatttgtcattatacttgtaaggtttactgatactgtaatacattttacgctatccctaaaaaaaaaaaaaaaagcattatcttttccagagagtttaactttgtttagcggttggatcggttcatatgaactttaatttcttctgttcatttaatgttaaatcaacaaatataatgccataattggcatgttcttgcactaatggcctgaacttgcaagatcaatctagcatacgcgtactac

SEQ ID NO: 13500 - DNA, 3696 bp, Zea mays
tatcagacccctttagtcagaaaatctgtgcctgcgccactgcgaggagagtgtggtcaccacgtcgacacgattcgccatcaggcgcccgcgcgtgaggtagccacgggcgctcatgtacggagtaccagtccccacgtcccgtcgcaggccatgccatacagaagcgaagctgctgcatctggtgtcagtgacgagggagataagggttgcggatagaacgctgccggccgggtcagccaatcacaggccgcagcacatcacactccgctacgctctcatcctccggctcatctcctttctcctccccgatgccaccgagtccaccgccaccacgcccaacacgcgtcataaaaaatgggtacgcatcaataaagaggagcttgggaagttgccaaggcctccgatttcgccaatgcgacggtgaaatcccgcacctacctccttcctctctcaccgaggaccctcgcaccaagaactgagcgggaagagaggtagagaggcaagcgcacgagagtttctgctcctagtctcgtctcgccccgcctccgtctcctttccctctctggttctctctctgcgattctcgtcgcattggttccgttccctcacgaaaggcggtagctttctgtcttccctgatctatctagataatggcgaccacgacgtcagcgaccaccgccgcagcagcagccgccaccaccgccaagccgcgggggtcgtcgtcggccctctgccagagggtggccggcggcggcaggcggcgctccggggtggtgcggtgcgacgccgccggcgtggaggcccaggcgcaggccgtggcaaaggcggccagcgtcgccgccctcgagcagttcaagatatccgccgaccgtgagtcccttgcccctcgcctctggaaatccgccgccgttgttgcctccctgtaagctgtaaccctgggacgcgggggattgtgctttgccggtctggtgtgtgcgcgatttgaggaaccttttgtcgcgggcacgcctgcagttgggattagttttgttttggtacgggccaaaacatgtgggtggtttgcggaagagtaaggaataggtgtgaactttgcattgccctgttgaaattttgccttaaaccaagcgttttaactttcatgttattgcttattcacttaaaatttggacagactaattggttggttcctgagtaagattagtatgtggaggaggacaccaacaggtgacatggcatcagagaagaattattattggtcgtggggatgaggaaacttcttggttccgcaattaaaacattgattagttttctgaactgagtcgggcatacgacagggagtagcaagttacattttggggatttgttgaagtgtttaattggctgtggttgtggagatataagtttcagagacttgtggagcttttgtttgtatgtgtatgttcgttggtttaaaattaaacggttgtatttatctatatacaccaaaacaacattttgtaagaagccaaatgatagtgtatgcatacagaaccgttagtcctttaggaaggataaatctaatttgacaaagatgcgaaagaattatattcatgtacaatttgacaaaggataaatcatattgttcgctttggcatcggctattggccaaacattttgcacgattttttttttggggaatctcttgttcagtcatactcatctagtgtatctccccttagaattttctttgataaacttctccaatcgaattgtctcctgtgccttacaaaattgtctctgtgcaagtgtgcatgtttgacaatgttttgactattatattctctaccagggtacatgaaggaaaggagtaccatagctgtgataggcctcagtgtacacacagcaccagtggagatgcgtgaaaaacttgctgttgcagaggaactgtggccccgtgctattcaagaactcactagcctgaaccatattgaagaggctgctgttcttagtacctgtaatagaatggaaatttatgtggtggcgctatcatggaaccgtggtatcagagaagtagtggactggatgtcgaaggtgagtactgtttgatcaaccttctctgttcagtctgtggtagtctttttgcccagctttttggttgctcaaagacgcagtttaggaaaggttccctaatgtgtgtattttttgtgattttgcagaaaagtggtattcccgcttccgagcttagggagcacctgttcatcttgcgaagcagtgatgccacacgccatctgtttgaggtgtcagctggccttgactctttggttctcggtgaaggacaaatccttgctcaggttaaacaagttgtgaggagtggacagaacagtggaggcttgggaaagaacatcgataggatgttcaaggatgcaatcactgctggaaagcgtgtccgcagcgagaccaacatatcatctggtgctgtttctgtcagttcagcggcggttgaactggccctgatgaagcttccgaagtctgaagcactgtcagctaggatgcttctgattggtgctggtaaaatgggaaagctagtgatcaaacatctggttgccaaaggatgcaagaaggttgttgtggtgaaccgctccgtggaaagggtggatgctattcgtgaggagatgaaagatatagagatcgtgtacaggcctctctcagacatgtatcaagctgctgctgaagctgatgtcgtgttcaccagcaccgcatctgaaacttcattgttcgcaaaagaacacgcagaggcactcccccctgtctctgatactatgggaggtgttcgcctgtttgtcgacatatctgtccccaggaatgtcagcgcatgtgtgtctgaagttggcgctgcacgagtgtacaatgtcgacgacttgaaagaggtggtggaagccaacaaggaggaccggctcaggaaagcaatggaggcgcagacaatcatcaccgaagaactgagacggttcgaggcatggagggactcgctggagaccgttccgaccatcaagaagctgaggtcgtacgcggacaggatcagggcctcggagctcgagaagtgcctgcagaaagtaggtgaggacgccctcaccaagaagatgaggagagccatcgaggagctgagcaccggcatcgttaacaagctcctccatggcccgctgcagcacctgaggtgcgacggcagcgacagccgcacccttgacgagacgctcgagaacatgcacgccctcaaccggatgttcagcctcgacatggagaaggcgatcatcgagcagaagatcaaggccaaggtggagaagacacaaaactgaggccaggaagcaatttttctaccaccattatctatatatatagcgtctccaatctcattccatttttttatcctttcactcagtgagcccttcccctgctcactgtgatcgttaactgtgtctgtgaattagagccatggcagcgtgttgtcaataacagcaatgtgtcccatggtgccgcaatgaagtgtgaaacttggggagcatgggtaggcgctgcttgtactgactaggtaggcgaatatacaatgtcgctgctgatgtgacccaaacgtctgaatgcatgcactgattaagtcgtggtcaggcccttcaatttctgggcaggagacagacgcttctggtctaccagtgcacggatttg

SEQ ID NO: 13501 - DNA, 2134 bp, Zea mays
ctcgaggccggcgggattcactactcctccccctccctccctcccaccgaggactctttcccaagacctgccccgagtcctagttcgggagagaggtcgagggaggcagcccataaattccttgcccgcgaaaatctctcctcgcctctctctctatatatttccgcttatctgcccgcgcaaatttcttgccgcattggtttggttttccggctcggcaaaggagacggcttttctgtctcccgtgacctacatgatggcgagcacggctccagcggcctccaccgccgtggcattcggggcagccgccacgccgacgcccaggtgcgggcggtggccaaggcggccagcgtcgccgcgctcgagcagttcaagatctccgctgaccggtacatgaaggaaaggagtagcatagctgtgataggcctcagtgtgcacacagcaccagtggggacccccgggccgcccgcggttgcagaggaactatggccccgtgctattcaggaacttactagtctgaaccatattgaagaggctgctgtgcttagcacctgtaacagaatggaaatttatgtggtggccctatcatggaaccgaggtatcagggaagtcgtggactggatgtcgaagaaaagtggtattcctgcttctgagcttagggaacacctattcatgctgcgtgacagtgatgctacacgccatctgtttgaggtatcggctgggttggactctctggttctcggtgaaggacaaatccttgctcaagttaaacaagttgtgaggagtgggcaaaacagtggaggcctgggaaagaacattgatagaatgttcaaggatgcaatcacagcgggaaagcgtgtgcgctccgagactaacatatcatctggtgccgtttctgtcagttcagcggcagttgaattggccctgatgaagcttcgaaaatctgaagcgctgtcagctaggatgcttttgattggtgccggcaaaatgggaaaactagtgatcaaacacctgattgccaaaggatgcaaaaaggtggttgtggtcaaccgttcagcacaaagggtggatgccatccgcgaggagattaaagctatcgagattgtgtacaggcctctctcggagatgtatgaagctgctgctgaagctgacgtcgtgttcacgagcaccgcatctgaaaccccattgttcacaaaagagcacgcagatgcacttcccactgtttctgatgccatgggcggtgtccggctctttgtcgacatatctgtcccaaggaatgtcagcgcgtgtgtctctgaaattggctccgcgcgagtgtacaatgttgatgacctgaaagaggtggtggaagccaacaaggaagaccgtctcaggaaggcaatggaggcgcagacaatcatcaccgaagagctgaaacggtttgaggcatggcgggactcgctggagaccgttccaaccatcaagaagctgaggtcatatgccgacaggatccgagcctcagagctcgagaagtgcctacagaagatcggggatgacgttctcaccaagaagatgaggagagccatcgaggagctaagcaccggcatcgtgaacaagctcctccacggcccgctgcagcacctgaggtgcgacggtagtaacagccgcacccttgatgagacgctcgagaacatgcatgctctcaaccggatgttcagcctcgacacggagaaggcgatcatcgagcagaagatcaaggccaaggtggagaagacccaaaattgaggcctggagtcaatttttctacccgtgtatacttcaccctccaacctgattccattttttttatcctctcacttactgagctcctccccgtcttgccgagacatcaaacgtgtcgtgaattagcgccatggcagcagctcaatctgtcgagagagtggcaaattctctctactcgagctgcttttctttgtacatttttgctcgagctgctgtggagcaagagccccattcttaagttatatactttattcggacgaaataaacaggaatatagcaatgtgtcagctgatgccgttttcccttggcatcacacttgtaaggtttactgataccgtataccttttaatgcgttaacatttccggacgcgtt

SEQ ID NO: 13502 - DNA, 845 bp, Zea mays
gggccccgacccggccggccgattttgccaatgcgacggtgaaatcccgcacctacctccttcctctctcaccgaggaccctcgcaccaagaactgagcgggaagagaggtagagaggcaagcgcacgagagtttctgctcctagtctcgtctcgccccgcctccgtctcctttccctctctggttctctctctgcgattctcgtcgcattggttccgttccctcacgaaaggcggtagctttctgtcttccctgatctatctagataatggcgaccacgacgtcagcgaccaccgccgcagcagcagccgccaccaccgccaagccgcgggggtcgtcgtcggccctctgccagagggtggccggcggcggcaggcggcgctccggggtggtgcggtgcgacgccgccggcgtggaggcccaggcgcaggccgtggcaaaggcggccagcgtcgccgccctcgagcagttcaagatatccgccgaccggtacatgaaggaaaggagtaccatagctgtgataggcctcagtgtacacacagcaccagtggagatgcgtgaaaaacttgctgttgcagaggaactgtggccccgtgctattcaagaactcactagcctgaaccatattgaagaggctgctgttcttagtacctgtaatagaatggaaatttatgtggtggcgctatcatggaaccgtggtatcagagaagtagtggactggatgtcgaagaaaagtggtattcccgcttccgagcttagggagcacctgttcatcttgcgaagcagtgatgccacacgccatctgttttgaggtgtcagctggcctttgactcctttggttctcg

SEQ ID NO: 13503 - DNA, 969 bp, Zea mays
cacaattccatttcttcttcgtcctcgcaccagtccctcctccttggaagcgagggaggagagtggagggagagggaggagcgaggcaccggtgagctcgggaggcggcgtggggcttgcacgccggccctacccccagctcactcaccacgctcttctctcaccaactctctctctctcttatctccttccaagattcccccatttttttgttgttgtcccccccattcttgctaggatcattccttgatctttcgctcgctccagtacgcctgttttccagctccggagatcccatctcggccacctcctgcggtctccaagctccaagaggccagattccagcacaaatttgaggtcaatttgcccgctgagctcgaatcaatccgctcggcaacaagtgtcctttgttcccccgatccccgggcttcgattcgatcgaatccgacctaattttattgtgtgtgtgtgtgtgttttaaccttctctcgctgcacttttcctttctcctccctgtcgcaaacgcaaagtgggttccatcgcgtcacccgcacggctcctctgatcgggcggagaaagaaagcgcataaaaggcgagctcttgatgcggtcttggtcgtagcaacagcagctccactgctcccggcatcgcctgctgttgtttatccatatacggacggagcagcgggcgctccggcagaggcagtggcagcgcgctccccccgtcagcgcgtgctgatgcttgcccccctgctcgccgccttcgctgtcgtcttcctgctcctcctgtccaggccatgcgcccgtgacatgagactgttcctcgcctccctgtgccagcagctcgtgctgtccctgctcgggttcctggcaggcctccgcctgctcagcggcgtcgcggccgccgccgcggcccccgagaccatgccgctcatgccctccttcaagaggaagcgggcctcggccacg

SEQ ID NO: 13504 - DNA, 1203 bp, Zea mays
acggcacgccaaaatactcctccccatcccctcatcgtcctcctcggctcggctgggctcctctcccagtccggcaaaatacacctcccgctcacgcgtcccgttcctgtcccgtcgtgacaagcacaaacacgtagtaggcagcaaaccgaagcggcgcgtgcccgtcccgcgatggccacggcggccgcggccaggcaccagcagcaccagcagcgccggggtgcccagcgggggcggcgccgcgggagcgggatacggtgctcgtcgccggcgcaggagttcgcgtcgctggccgcggtgttccggcggcggctggtggtcggggccaccacggcggcggccgcggcggtgggggccaacttcggcggcgtcaccagcttcctgctgggcctgtcgccggagctcggccgctcgctccgcctcgacgtgctctaccccgtcggcggcttcacgcgctgcctcgactccgacaatgggttcgaattcatctatccatcaagttgggttggagaccagacgctactgtacagagaagcgaagaaggcagaattgcaaagatcgctagacccaccgccactgccaaacggaggatctccatctgggcctcggaacatcagtgaacctgtggcagcatttggcccccctggatccaatggggagctcaacgtcagtgtcatcgtctccactgtgccacgagacttctcgatcgagacgttcggcagcccaaaagacgtgggggaagtggtgctcagaaggatcgcgaggacgaggcgaagcccggacatcaacgctacccttatcgacgccgccgtgagagaggacgcgggcagggtgaagtactacaagctggagttccgagtcgagagcccttcgttccggcggcacaacgtcgcggtctgctgcgtgagggacggcaggctctacaccatgaacgcgcaggcaccggagtcggcgtggaaggcggtccagaaggagttcttggcgatggcggactcgttcggcttagttagcgacgcttgattgacatgcagttaggcacgcagttttggttttgtacccctgagcgttttgtcccctagtttgcaaggtctcggtaacgagatgccgtggtttggtgtagagaaactaggacatgatgtttctgtttctgttatccttacaatcatgtctgaagctttcttctgcgaaaaaaaaaaaaaa

SEQ ID NO: 13505 - DNA, 923 bp, Zea mays
ccggaaccaaaacccccggtcgacccagcgtccgacgacatggcacctttgcaccacgctactgccctgcctactactagtactgtctctttgaaccactttggtggcctaatcccgggcccctctgatgatggcttatgagccccagctttgcgcttgcaggcactgcacggtctggttcttgttcctgagcagttgagctgcgcacaccgacttcttttgcacaaggtacagcagcgcaggcgcagcggcagcccgccgctggatctctcccgaggctccggcgatggagcggtcctgctacttcccgctgcggtgggagagcacgggcgaccagtggtggtacgcgtcgccgatagactgggcggcggccgacggccactacgacatcgtccgccagctgctgcacctcgaccctaacctgctcatcaagctcacctccctccgccggatccgccgcctcgaggcgctgtgggacgacgacgcccgcttcgccgacgcggcccggaaccgcgcgtccgtcgcccgcagcctgctgctggagtgcgagtgcaggaaccaccgccccggcgccggggagaacacgctgctccgggccgggtacggcggctgggtgctctacgcggcggcggcggccggggacgccgcgttcgtgcgggagctgctggagagggacccgctgctcgtgttcggcgagggcgagtacggcgtcacggacatgttctacgcggcggccaggggcgggagcgcggacgtgttcaggctgctgctcgaccacgccatgtcgccggggtgctcggcgaggtgccggaacggcgaagccagcgccggcgcagcttcgtgtttccggcttgagatgatgagccgggccgtcccgccgcggcgaggggcggaagcgtggaaatgctcagggagctgctcga

SEQ ID NO: 13506 - DNA, 2667 bp, Zea mays
ttccgggtttgtcttcggtgttgcagacgtgttcttcccacgcatgcttttaatctttttaaaatctccatttgcgtaagctcagtctgcagtttacaaatgctttgagtcctgcgctcctgtcctgctgttcttgtctagcagtaaacaagtcatttcctttgttgtcacatggtggctcgccgagtgctggtgcacacattctctcctcgttccaccttgctgctgctgctgcagttcttggcacggccttgtattgtatgaatatgattgtatcacatgccatgtgactatgtgagtagctgaccacggctcaccgcgaggcgcacaggtacagcagcgcaggcgcggcggcagcccgccgctggatctctcccgaggctccggcgatggagcggtcctgctacttcccgctgcggtgggagagcacgggcgaccagtggtggtacgcgtcgccgatagactgggcggcggccgacggccactacgacatcgtccgccagctgctgcacctcgaccccaacctgctcatcaagctcacctccctccgccggatccgccgcctcgaggcgctgtgggacgacgacgcccgcttcgccgacgcggcccggaaccgcgcgtccgtcgctcgcagcctgctgctggagtgcgagtgcaggaaccaccgccccgccgcccccggcgccggggagaacacgctgctccgggccgggtacggcggctgggtgctcttacgcggcggcgtcggcccgggacgccgcgttcgtgcgggagctgctggagagggacccgctgctcgtgttcggcgagggcgagtacggcgtcacggacatgttctacccgccggccaggggcgggagcgcggacgtgttcaggctgctgctcgaccacgccatgtcgccgaggtgctcgacgagttgccggaacggcgaagccagcgccaggcgcagctccgtgttccggcttgagatgatgagccgggccgtccacgcctcggcgaggggcgggagcgtggagatgctcagggagctgctcgacgagtccagcgtgtcgacgtatctcgacatccgtggatccaccgtgctgcatgccgccgctgggagagggcagctgcaggttgtcaagtaccttgtggcctctttcgacataatcaattcgactgataatcacgggaacacagcgctgcatgtagcggcctaccgagggcaccaacctgtcgtggaagccttggttgctgcgtctccatcaaccttgtcagttgtcaacaacgccggtgacacgtttctccactcggcagttacaggattcaggaccccaggattccgacggctcgaccgccagttggagctgatgaggtacctcatacgcgagagaaccgcggatatccagaagatcatcaacctgagaaacgacgcgggccttacagctcttcacctggctgtggttggctgcgcacacccggatctcgtcgagctactgatggccaccccgtccatcgacctgaacgctgaagacgctaatggcatgaccgcgctggcgctgctgaagcagcagctgcgctcagcgacgtccgaccggctcatcaagcagatcgtctctgccggaggggtcttgaactccagcatcctgagaacccggtcagccatcgcttctcagatcaagatgcagggcgggatcgcgagcagccccggcaccactttcaaggtatcggatgcggagatattcctgttctccggcatgggagcggcggagtctctgaggccaagctcctgctccagcaacgggaaggatgatgaccctactcacgcagacgcagactgcgccgagaaccgtggatcgtcggagaagaggctgagctccgcgagccgggccaaagaccgcctcaagatgatgctgagatggcctcgccacaaggacaagacgcccaagaagtcagaggacagcagcccgctggggtcgatcagcaggctgaacgagcacggggccgagacccctgctccgctgaggcagaagtttaccaagacgacggcgctcaacggcaagcggaccctagcggtgaagagctccaccccgagctcctcatccaccaagaagaagctcaacacgaagctcatccacggcatcatggaggccatgccacagctggcgccatctacggcgcggtccgcgtccccgacggacactttcctgaggtcctcggtatcgtccacgccgcagccgctggcgaagctgaaggacatctgcctcgacgacgagatctccatggtgacgccgcccgccggcaggctgaaggatagtgacgacgccatggaggacccctcgtgctccaacaactcgtccatggacgacggctgtggcgccgggacggcagagagcgcggcccggaagcacgggtgcggcaacgggaggctcatcaacatctgctttggcgcgcagggcctcaccgtggaggactcggcgagcgggcagcagacgagcaagatgttcaagcagcagtgcctcagggtgtcctgattgacggcgtggtgtctcgactacaacagcgtggtgtgattggtttggtgtctcgcgtgcagctatgtgtgcttgtttgctttgctccttgcacagccagcggtgaactggtgatccaatgaacttgtgcttgtgttaactgtgacgttgacg

SEQ ID NO: 13507 - DNA, 2497 bp, Zea mays
  misc_feature (462)..(462): n is a, c, g, or t
gcaggcactgcacggtctggttcttgttcctgagcagttgtccgccccacgccgccgcctggcgcacaaggtacagcagcgcaggcgcagcggcagcccgccgctggatctctcccgaggctccggcgatggagcggtcctgctacttcccgctgcggtgggagagcacgggcgaccagtggtggtacgcgtcgccgatagactgggcggcggccgacggccactacgacatcgtccgccagctgctgcacctcgaccccaacctgctcatcaagctcacctccctccgccggatccgccgcctcgaggcgctgtgggacgacgacgcccgcttcgccgacgcggcccggaaccgcgcgtccgtcgctcgcagcctgctgctggagtgcgagtgcaggaaccaccgccccgccgcccccggcgcccggggagaacacgctgctccgggccgggtacggcggnctgggtgcttctacgcggcgggcgtcggccgggggaccgccgcgttcgtgcgggagctgctggagagggacccgctgctcgtgttcggcgagggcgagtacggcgtcacggacatgttctacgcggcagccaggggcgggagcgcggacgtgttcaggctgctgctcgaccacgccatgtcgccgaggtgctcgacgagttgccggaacggcgaagccgccgccaggcgccgctgccgtgttccggcttgagatgatgagccgggccgtccacgccgcggcgaggggcgggagcgtggagatgctcagggagctgctcgacgagtccagcgtgtcgacgtatctcgacatccgtggatccaccgtgctgcatgccgccgctgggagagggcagctgcaggttgtcaagtaccttgtggcctctttcgacataatcaattcgactgataatcacgggaacacagcgctgcatgtagcggcctaccgagggcaccaacctgtcgtggaagccttggttgctgcgtctccatcaaccttgtcagttgtcaacaacgccggtgacacgtttctccactcggcagttacaggattcaggaccccaggattccgacggctcgaccgccagttggagctgatgaggtacctcatacgcgagagaaccgcggatatccagaagatcatcaacctgagaaacgacgcgggccttacagctcttcacctggctgtggttggctgcgcacacccggatctcgtcgagctactgatggccaccccgtccatcgacctgaacgctgaagacgctaatggcatgaccgcgctggcgctgctgaagcagcagctgcgctcagcgacgtccgaccggctcatcaagcagatcgtctctgccggaggggtcttgaactccagcatcctgagaacccggtcagccatcgcttctcagatcaagatgcagggcgggatcgcgagcagccccggcaccactttcaaggtatcggatgcggagatattcctgttctccggcatgggagcggcggagtctctgaggccaagctcctgctccagcaacgggaaggatgatgaccctactcacgcagacgcagactgcgccgagaaccgtggatcgtcggagaagaggctgagctccgcgagccgggccaaagaccgcctcaagatgatgctgagatggcctcgccacaaggacaagacgcccaagaagtcagaggacagcagcccgctggggtcgatcagcaggctgaacgagcacggggccgagacccctgctccgctgaggcagaagtttaccaagacgacggcgctcaacggcaagcggaccctagcggtgaagagctccaccccgagctcctcatccaccaagaagaagctcaacacgaagctcatccacggcatcatggaggccatgccacagctggcgccatctacggcgcggtccgcgtccccgacggacactttcctgaggtcctcggtatcgtccacgccgcagccgctggcgaagctgaaggacatctgcctcgacgacgagatctccatggtgacgccgcccgccggcaggctgaaggatagtgacgacgccatggaggacccctcgtgctccaacaactcgtccatggacgacggctgtggcgccgggacggcagagagcgcggcccggaagcacgggtgcggcaacgggaggctcatcaacatctgctttggcgcgcagggcctcaccgtggaggactcggcgagcgggcagcagacgagcaagatgttcaagcagcagtgcctcagggtgtcctgattgacggcgtggtgtctcgactacaacagcgtggtgtgattggtttggtgtctcgcgtgcagctatgtgtgcttgtttgctttgctccttgcacagccagcggtgaactggtgatccaatgaacttgtgcttgtgttaactgtgacgttgacgaatccacagctctttaacttcctcaaaaaaaaaaaaaaaaatcgacgggcgaatcaccgttgatcaaaaaaaaaaaaaaaaaaaa

SEQ ID NO: 13508 - DNA, 1008 bp, Zea mays
  misc_feature (26)..(26): n is a, c, g, or t
  misc_feature (28)..(28): n is a, c, g, or t
tataaataaaagggggaatttttttnanaaatatgttcccgttgcaacgcacgggcacacacctagtagaattatagagcaattacatctgaatttgaatgcacattacatcccgtaggcatagtagcatccttctccccttcgacgcctacacacgtacgtaatagtattatacatttatactcgggtctcgaggggctgtcaagaatccgaggcatgcaaggcggccggggtgtcgtgctggtgctgctgctgttggtggtggtacacggcgaacgagctcgaccgcgacacgggccgggagtagctggaccggcggaagctgccggcggcgatctcgtcggcggggtcgacgggctcgccggtctccgcctccctctcgcccgggatcctgcacttctccccgaggatgatgcccttcttccacagcgtgtcctccgactccaccttgtggtggtggtccttgtgctcccgccggctcagccgcagcttgtccgggatgttcatgctcagcttcttgctcacgctgatggacaggcgccgcttcgacgtcgacgacggcagcgtcaccgggtcgatggcgccgtgcatcgccagctccggtgacagtctcaccacttcctcctccgcctccgcggcgctagcctcctggcttccgccgccgccggagacggagcccgagcccgtcccggtggactggtccgaagcggccgggtctgcacgggtggccgccttcggcttgcgaccgcatgccgagcacatggacgacgcgagcgcgacggtggcggccacacacgccacgaagaaggacaaggcgacggcgtcgtgtccgaagggtatctcgccgtccgctggcggcggcggcggcagccacctcaccattgtcaccggcgggatcccggcgacgggagagagagttattcctctccccggaaggaatgaggcccgcggccgccccccgggcacccgcttcccttcccgcggtgcgggggcgacctccccggccgg

SEQ ID NO: 13509 - DNA, 1019 bp, Zea mays
gtccggttctagatcgcgagcgggccgccctttttttttttttttgatatttaaatttctttgtttccaaactggggcttgggtcggtgactgtccatgcatctagaccagaccacacgatgacacaagaaaattttagagcaaacatctgaatctgattatctgaatgcacttcacaccacactagcatagtagcatccttcgccggttttgacgcggtgacgcctacacgtacacctaatctcgggctgtcaagtatccgaggcgtgcaaggcgggcccgggggcgtcgtgctgcggctggtgcatggcgaacgagctcgaccgcgacacgggccgggagtagctggaccggcggaagctggcggcggcgatgtcgtcgtcgtcggggtcagcgcactccgcctcccgctcccccgggatcctgcacttctccccgaggatgatgcccttcttccacagcgtgtcctccgactccaccttgtgatggtggtggtccttgtgctcccgccggctcagccgcagcttgtccgggatattcaggctcagcttcttgctcacgctgatggacagccgccgcctcgacgtcgacgacggcagcgccaccggctcgatggcgccgtgcatcgccagctccggcgacagcctcaccacctcctcctctaccgccgcctcctccgcgccagcctcctggctgccgctaccaccggagacggaggagcccgtccccgccgggtccgcgttggtggccgcctttggcttgcggccgcacgccgagcacatggacgacgcgagcgcgacggtggcggccacgcacgccaccaagaaggaaaacgtgacggcgtcgtggccgaagggtagctcgccgtccgctgtcaccggcggcggcagccacctgaccattgtcaccggcgggatcccagcgatgggaaaggaagttatttggctagctgctcgccggaggcttttcccgcgttgcgggggcaaccacccgttttcaaattggaaaccggctcgtgc

SEQ ID NO: 13510 - DNA, 3377 bp, Zea mays
accctgtgtagccccatttcagtgctgtgcttgaactccctcctccctgctcgcttcctagcagtgcccggccccaccggatcaatcacgagtaacggcgaccagcagaccagacacagccgtgtccgtgtccgtgtccgtggacgcgtgccccactccggcccgggtctctcgcccactcccctgccgccggctcccgaaactaccccgggtcggccgccgacgccccggcaccaggcgaggggcagcgccgtaacctctctcgctcgctcgcccgccccccgcgtcgcgtgcgcgtgtgctcggctacccacgcggaccgcgtccgccgcggtcacagtgctggttgctggttgctacctcctcgacgacacaaacaactcggtttcttttactaatcctatccacaattccaaatcctctccctcgtcctgttgatcgctgaaccctgaccagacctggccgtgcggaggatttttagactagtcggattggtggtctccaccgtccatagcgatcccgtcacttcagatagtttaaactaaaaccaacactttatcttttatatcaaagaagaagcaaacgagtagaataatgctccgtctgcaagcacgagctgcacggcacgatgtgatcgcggcctgctgcttgccactgcgcccaatagtctcgtcctcacgcttctgggcttgtggttaaaggtcgcagggagggcgcatttacttagcgcttattaatcactctgccgtctccatctctagctctctgcacggttaaagaaacaaatgtcaaatagtgcgtcaagtttcattcatgaaaatacagcgagtatactgctacaccatatagtagatccacacaaggagtcgtgagcagcggccatagcaagacctccaaacaaaaaaaaaagaaattctaaacaaaaaccggaaacattccgaaaccagaggaatatttgcgcccacaaaaataatactactccaaccgccatgattagccctgacgatgacagcttcggaccctttcttccccaaccttcccaaaccaataaactaatctcccctcactgatcgcgctatcccccacttatatacgtacccaccacgccaccctccccatcaccattcactcatccaccaccaccaacggcgccgcaacccccacgcaatctcaccggaaaaacgcctcctccagttgagctgagcctgagctgcagctgagccgccatgtgcccgcggacccactgagccaaaacccctcgaccccgcccccactgcaggccgttccctttccaagatccgcgctttgatccgtccgccgccgcccgagaccatgccggccacggacctccagggctcctccccgttctcctccttcggccgcaccctcctctccctccgccgcgacgccccggcgtccgcgtccgcggcggctgcgatgccgccgcccggcgtcgacccggagctcgaggagttccacgcccacgtcgccgcgcacctcgcggacctgagcggccccggcgctgctggggaggaggagttcatgtccatcgcgtggatccggcgcctgctggaggcgttcctgctctgccaggaggagttccgggtggcggtggccgaggcgcgccgccgccgcgccggggccactccccccgccgccgagaggctggtggccgagttcggcgaccgcgccgtcaaggtcctcgacgtctgcaacgcggcgcgcgacggcgtcgaccaagcgcgccgctgggagcgcctcgcgggcatcgcggcgtccgcgctgctggcgcccgccgacggccagatccacgagggccagctccgtcgcgcgcggaaggcgctctcggacctctccgtgctcctcatcgacgacgccgcagccgccgccgccacggggcccgccggcgggctcgcctcgatcctcgcgtcccaccgcaaccgctccttcggccgcgcgcgggcgtcgccgtcccgcgcctcctcctcctcctcgtcgtcctcgtcgccctccgcgcacttccgctcgctctcgtggagcgtgtcccgcacctggtccgcggcgcgccagctacaggccatcggggccggcctggccgcgccgcgcgccagcgaggcctcctggagcctcgccgcgccggcgtacgccatgggctgcctgctccacctcgccgcctgggcgctcgtcgccgccgtcccctgcccggaccgtgccgccgcgctccaggcgcaccacctgccggccgcgccgccgcgcgccgcgttcccctgggcgccgccgctcctcgcgctccaggaacgcctcgccgaggaggggaagcgcaaggaccgccgcaattcgtgcggcctgctcagggaaatccacgcgctggagaagtgcgcgcagaggctcgcggaggccatcgatgccgcgccggtcccactcaccggcgagcgggaggccgaggtgcgggaggctgcagcccaactcgccgccgcctgctccgccatgaaggacgggctggacccgctggagcggtcgcgtggggaggtcttccaccgcatcgtgcgcagccgaatggagggtctcgattcaccgatgcccaatgccgattgagctcaatcaacatgatcatcatcatcttgcctttagatttcccaatgtggcggtgctaggtagctatcttttttcgctcgctcttgtgatcagctagtggtaagtataaaatgtgtgtccttgtgtaaaggattacagaaaaagggagagggaaggtgtcatctttaggtaaagatggttcctttattcccatgttttgatgctgcatttggtgtatatcgttgtgtttttttgctagtgtcacgtctgttcgctgctaattctcgagcaacttgtgtcactttgggaatgtgactatcattgacaatgctaacaagcaggaaaaaaaaatgtaaatatgtactgtagtttaactttgcacactcccttggtttttcattccatcaatatcattgtgcaaagaaatgggacaacaattgtcgcaaaaatgcgggcggatcgaattgtgacacaataacaccaacaaagccttggtggtcagtattctaaatggtctcaattgggcaatatgtggcatattttggactgctcgtctgcattatgaattgaattgattgacctttgtggtaaatcgattcatgagttgcaaagtgaatagatgaagaacgggagcaactggatgtaataactattattatgaaataaactgagtacaagcatatttcagaatagatgctgcaacctgcaaccttctctgtggaggaaaaggaaaaccaagttgcaggatatttttgaaggcattgaaaaggtcctggtatcattacgaactactgtacttgacg

SEQ ID NO: 13511 - DNA, 1562 bp, Zea mays
  misc_feature (55)..(55): n is a, c, g, or t
gggtacctcgaggccggccgggcttacagatacgaggacccgcgcgtccggcacnacttatctaaagaggaatttgggtcgtccaaatagggaaaatactatgggaatgcgccatgggtcatatgataaactagatgatgatggccttgcaccacctggaacaagggtctcaggggaagatgtcattattgggaagacatctcctattccacaagatgacgctcaagggcaagcttctagatactcaaagcgtgaccatagtactgctctgcgtcacagtgaaagtggcatggtagatcaggttctgttaacaacaaatgcggatggtctaagatttgtcaaggttaggatgcgatctgttcgcataccacaaattggcgacaagtttagcagcaggcatggacaaaaaggaactgttgggatgacttacactcaagaggatatgccatggacaatcgaaggcattacacctgatattattgtgaatccacatgctattccatcccgtatgactattgggcagctgattgagtgtattatgggtaaagttgctgctcagatggggaaggaaggcgatgccactccattcacggatgtgactgtggataacatcagcaaagctcttcataaatgtaattatcaaatgcgtggatttgagacaatgtacaatggtcacactggaagaaaactgactgcgatgattttcctgggccccacatattaccaaagactcaagcacatggtggatgacaagatacattcgagaggacgtggtcctgtgcagatactcacccggcaaccagcagaggggcggtctcgtgatggtggtctccgctttggagaaatggaaagggattgtatgatcgcacatggagcagctttcttcctgaaggaaaggctgtttgaccagagtgacgcatacagagtccatgtatgcgagaaatgtggtctcatcgcaattgctaacctaaagaaaaactcgttcgaatgcaggggctgcaagaacaagactgacattgtccaagtacacataccctatgcttgtaagcttctgtttcaggagcttatggcaatggccattgctcccagaatgcttacccatgatatgaagacagggaaggatcagaagaagcgctgaacgtgtatcacgtgagatgtaaccagaactcatgccccgttgctatattcctggatcctggttcacacaatagtaccctgttgaggaactttgtggtcacttcttttctgatttggacttcggttcttcgcgatcgatggagggctgttactatctcttgatggattatcatcctatctgtgctcgtgttgcctgaagatcagtgctagcagatcgtcgagttaattttgtacattaggaatgtgttgtaatgtattaatctgtgcgagtagaaagatttttgactaaaggtgtcaatttggaggtgtaactgtacgttaatactaaacgcgatgccattgcaatttcagttttattttgaaatacatggggttttagtggcatgtctctaaactatcacaatcttaatggcatggttctaatt

SEQ ID NO: 13512 - DNA, 1050 bp, Zea mays
cttcgactttacacggattatggacgctgcagtcgtccattatttattgttgagggccagaggctgctcatcaagaaggcgcacatccgagccttgcaacaaagggtccggcattgatcaacatgtgctggcttccacttaacttcacatgtgcataatttttctcataagcttcttctatccttttgtccacttatccaggagactcctgatgaaggctggcatgaattggtctcaaaaggatatatagagtatatagatactgaagaagaggagactaccatgatctccatgaccataaatgtaaatgcgatacacatgtgtacccaattgaagatattctgaggcccttgtctataccattctggagaaatggaaagggattgtatgattgcacatggagcagctttcttcctgaaggaaaggctgtttgaccagagtgacgcatacagagtccatgtatgtgagaaatgtggtctcatcgcaattgctaatctaaagaaaaactcgtttgaatgtaggggctgcaagaacaagactgacattgtccaagtacacataccctatgcttgtaagcttctgttccaggagcttatggcaatggccattgctcccagaatgcttacccatgatatgaagacagggaaggatcagaagaagcgctgaacttgtatcacatgagatgtaactggaactttgctccattgctatatttctcgcgtgcacacggtagtacgctgttaaggaacattgtggtcacttgttttccgacttcgactctggtttgtcgtgaacgatggacaggccattatcgtatcttgatgggctatcagcccaatctgtgttagtgctgttagatgatctgtgctagcagatcgttgagttaattttgtacattataggaatgtgctgcaatgtattaatctacgaatacaaagactttggcgcgctaaggtgccttgtagaattaaatgccattacaatttcagttttatgccgccccgttcccagttttattttgaaatacatggggttttagtggcatgtctc

SEQ ID NO: 13513 - DNA, 3609 bp, Zea mays
tacaaagacatattttacaatggtactttaatattattcttgtccactatcatgttttaacaagtctgggatagccaccacaaaaattttatatgagagttcaagtatgctacttgacacacggttaagtaaaacgtaggttgtcggcaatcactaaataatcaatttcaattcagtaagagcaagacaaaatctgaatgtctgaagtggctcatagcgtaaaaatttaaaaacacaaataggaaaaaaaagtgacgataggaaacatgataatttttattggccctagcaacttccgttagcttaagggaatgcttatggtaattattaatttcaaccgagaaaagttagtatcaatttccatccaccttttcataagccaacaaaagttagcatattatatagagaacatatccactgcaataaagatttagtgcacataatgcatatattaaatcctcataatccatattacatccatagtcttcccatgcatttctactgtgcactgaatattttacggaaaatagcctccaccaccctcgccttctctgttttctttttatcataaacccccctccttcatcaccttgcctacccgctaaacctattcgacccatcaacgaacagatccaccctcaccagccgcctgacgttcgagccgcaccagccctaaacccttccacctccagccgccataactgtaatcccttccaccatcagctgcccctccgttcgagccgtcgacgccctaatcctatcaccttctggccgcccaaatccctttcggctcctgccgccctctgtttgaggcgcaggccatggagtcgtcggtcttcgagtgccaggccatggagttgtcgatcttcgagtgccaggccatggcggcacagaccatggagtcacaggctatgatggcgcaggtcttagtctttaggccatggagtcgcaatcaggcgttcaagatgctctgagacttgagtcaggtttttccaacatgcatgatggattcagtacaccaaaaaaatgaatatccttctgacatcagtgagctgctctttgctttggtttgttctgctgccatattgataaattcatgtagtgcctcgttacagctgtccatctgtgtacttgattgtgatgataaattgaagccagtaattagatagtcatttggttctctaaaaaaaaaaaaaaaaaaaaaaaaaaaaaatgctcttgagaattttattggctgcaacattccagaacatatcgaaatccatccaccatccgatgttcactcccagtaaaaacatcaaaaaatccaaagaactatttaaatcgtgtaaagggaaaaatagtaaagtgagacgaaggtagtcaaacagtcatattgctaaagtattacaggtaggagaaagaatccaacagcatgttgaggagcttctacagtgttattggcatgggaattttgttagcttctatagtgctattggtatgtcgaggagcttcaaccaggtatggactttttaactctagcgagagtttttagttgtcacacactaatggctgaattggggttagttgttactgaaaatgagagtaaccagcatcaacaatagtttgctttcaaaattcaggaggatagatccttgttttgtacaacatttttttaagtataagagttttaaaatagaacatagcagcatgaaaggcttatttcttccagaacatagtttaatagacttaataagtttaaacgacccataattctggtgctctattctgtaagtataagagttttaaagtagaacatagcagcatgaaaggcttatttttttccagaacatagtttaatagacttaataagttcaaacgacccataattctggtgctctattctgtcttttatctgctgggtcattaaaatctatagactttagcgtcctatcttgtcatgtgttagtgacgtatggaatcatttggagtcgatgggaagattaatagccaaaaatgttagaagatcatgcctggttagacctctatgttgtacggaccagcaggtttgtaatgatgttgtcactgttccttgttctcaactgttgtattaagcaagtactaccatggggatgtggggtgggactagtccaaatgttgtagttactagttactagagttagcaagcagaggaattggtaatggtgatgcgttctcaacttcttatgtgtgcttgtcgttcgatcgtccatcagtttttagatgtacaaaacatatcaccgcattgacgtccatggctgcgagtacagtacagtggtcggccggttccaagtttacaaacagcaagcagtactagtgagtaggtgacattagcagtacaaacccttaaacctgcaactaagcacgacagagagtaggggcggagctcaggcccgtccatctcggttaggtggaagaaatggccggcatatgtgtttctttcatgctttactgcatcctgcatttttattttgttgcactggcacgaccgcctggcactggcaccccctcgtactgatctgatgctgtaatagcaattagcatgcgttcagattagttaggatagggagctgagctcgctgccaacaaggtcaatactagcatccatttttttgcaaactaggacacaatcaggtgaaaagcttgagctgcattctttgtctatttaactttactagttctgtttgtttcatggtatgctgttatttacaagtaagcccaggagattcttttattgatgttaaacaattacttttggatgctcctgaaacatgcttctatgcatgatacaatttgatattgcatactaaagatgggttagctcatcagttagaagactacaaggaaatatctgaaatagcagatataacttctagtggatgttcactggagatggttgctagtatgtaacaacttctagtttcttctctattgtcatatatagtgcttattttctggagctaaagtaaaagttctttcagcaacatacgatgagaggtctattaggtcacatctccgacgtgtgaaggggctactatctctgtctagtctttagggcatgtttggtttactaacctaagttgccacactttgcctaacttttctgtctaagggtagttgtttaattcggacgactaaccttaggcaaagtgtggcacatttagccacataccatacatgccctttatgtttccctatcaacgtccttagctctgctttaggagtccgctcaaggaaaatttgcaggtacatcaggtctgatgttttttgatctgcagttgtacttataacttatatttggtgtaatcgcctcaagtaatgtttatagttctatatgcattctgtttttttgaatggtttggtgcaagtatgactcgactactgcctaaaattagttttgccacacttttgtggaaagaataattgctagatagactcaggtgatctctagctaaaactctagtctatattaagtgctccatgatgctaaacaaattatatcgatgtgtttgtcttgtttaaacttgtcctattggcttcattgaggttgttttagggtttaggaaatgaatgcttgaatgtttagtcctt

SEQ ID NO: 13514 - DNA, 1189 bp, Zea mays
ttgggtacctcgaggccggccgggagctctcaccacgccactgccgtgcgcccgtgccgtttcatttccccgtcacacacctttcgctttctcccagtccacacccccaactgcctccccacttcgcaccgccaccgtctcccgaccgcgacgccggcgacctccgcaccgcatcgctccagccgatcgttccgagatttgttgatcaaagaaccatggaaggatcgttccagttgaatcccaacgccagtcctttcatacctggattgctgggttcatctgcacaaaaagccccagaaaaacaaggagggtcatcatcaaagggagagccttctggtagcacctttgatccttctgagtatgaggaaaatgacatggatgaacttgctctagtcaaaatggtcttttcaatgttcccaaatgtctccacggacttcattgatgagttaatcaaggcaaatgattttgacatgaatctgactgttgatatgctttatgagctgaactcacaagatatggttcatgatgattctgaggttatcaatcattttcatgatgattctgaggctaccaatgaccttcatgatggcaagggcgtacctggtgctgattaccacaagactgtggtgcccgagagtagcagcaacatgaatcaagacctgcagaacgaggagtcagcaacaacttctgatgtgaaatctgtgctgccaaagttctcacagatcaatttgcttcacaatgacctgggcctgcctgatgatgataagtcagcggggacttctattgcaaattgatctttcatatcaaggcgctccgtttgacccgagttagtgggttatggtgtacatactagttgcacccagaagtagaagtgtggcttggaaggtcaaagcagcggaagcaactgtcccatttccgtttgccggaccagttaactgtttctggtggttatcctgactttgaaatcccctgttcagctccttttgggccgagtagttaggtatttctggtggtggttgtcatgagtttttacatctagttcgctcttcaagactgagtagtacttggtggtcatcctgattttgcatgtcagggttagctgtgttgggtttggtacccagttagtacaaacaatccaagttatggcgtggctgtccgtgatgtgtgatgttgtgggagggttgcatcc

SEQ ID NO: 13515 - DNA, 3558 bp, Zea mays
caacccacctaacaaaaacactctcacacgcataacctccactaaatccatcaaacagatcgcactcagacttaacataccagtaaaaccaatggttcagatcgttagataactcctctcccttactcactaaaaaccaatggacaatattattttggatcatcaatgactcctcattccttcccccaccgtcccgagcgtccccctcccccgcgccccccccgcctcgagcctaccccgccgcctccccctcactcgcgcttatcaccgctgctcttgtccaccattctcctcgtgctgtcgtcgtcgatctctaaaagagatcatagacgttagcacggactatacactagttttgttaaaagactcactattcgtgacaacttcacgagaaattaccaacaattgccactctttacaaaaaaatcatatatttttctttgctcccgttacgtaacacatgacaaaaatcaataatcaaaattatattacaataagctgggttgacaaacagctacgttcagattatttaacctaaataatataatccagattatttaatcttatgtataagattatataatctataagctgaaacaaacaacccttatattatatccttatatttactggtcctgtgcaaattatttaaaccaccgacaacgtcgcgaggcactgagcggcaccaactaattaatcaagtcagctatatcgctttcacaactactttcttcatgatggtaggtcagcaacgagatatatgcagtgcgtgcgtcatcggagaatacttagctgaggtcattattgctcattacatgctgtagtagaacatcctaacatgcatccagctgataatacatggtgcacgttcggttgaatagcaaactgatggatcggagcagtgagagacttattgtgcaacgcgatcagcaatcaatagagatcttagatccaatccacacatccagtgtgagcttggacacagccatgagatgccatcatccgaatgcatgtcagagatataaaattcatgcagataagaaatgctcgctcctgctccatgtgtaccacgagaagtactcctaattcaaactcgatcacgacgagttgagatttctcgagatctcgatcgaacggatctcagaataaaaatggagacctcgttagttaatttgacttcctgtgccgcttcatcgcggtttctaactatttattaggacgagcagaggatccatcaactcagctttgcagagaagcagccgcaagcaggagcctttccgagtgtgtggagcagcagcagccgtaaggtatgcatgcctgctcctagcttgatcaaattgtatccatagcaagctaacgatatgcttggtgtttttgttgtgattgcatgcagaaaggggagtgcaaagtaagcttcatatattttccatggcaaagtaagcttcatatctacctatatgcatgcatgcattttggacaactgaatattatttcaagtcttctccatgcatatgggatgttttgatgcaatgcaggctcttcggaaaggtggcgatcgtcacgggcgccgccagcaaactgggcgaggccatcgccaggaagttcgtcgacaacggcgccaaggtcatcctcgccgacatcaaccgccactcctgcgagaacatagtagcggctctcaacaagaccaaccacggccccgcggtggctcacgcgatgcgcatcgacgtcagcgaacccgacagtatcctcgccaccgtcgaggaggcaaagaaggtctacaagcaagacgtcgacatcttctacaacaacgcgggggtcagcaacgtctcctccccggcctcctccatcgacatgatgagcttcccacgcgtccgggccgtcaacgtcgagtccgtcatagccagcatcaaccacgccggcgccgtgatgcgcagcaacaagatcggcggcgggtgcatcctgtgcacgggcagtcccgtgggctcgctcggcgacgtggtgccctcggcgtacagcatctccaaggccgcggtcgtgggcgtcgtgcgcgccgccgcggccgagctggggggacacggcgtcagggtcaatgccatctcgccgtacggcgtcgccgccaggtttgacaagggcgtgctgaggcacatcttccctcacgcgactgaccagcagctggatactatgatcagcagctacggcacctacacggtgaccgaggacgacgtggccaacgcggcggtgtacctggcgtccgacgctggcaagaacatcaatggccaaaacatcgtcctcaatggcaagttcggtctttagaagtgtggccgccaacggttctgttggggctcattagcggcaacttcacacaccctgggcgacttccattcatgccccgttgtttcctgaataaatagtgtggctgtcagtgagccacgtaacgtgtgtttccatttctctttttatttgcgaaatttcgatgtttcaaagtttggcaacaagatgtacttcaaatccatttgtcctcccatttaattctcataatgaataaaatcgtcgtctttacagtcccttcatctttccgcaatctttaggctatgtccagcaggccatgtaaacgtcgttgtaaaatactattttacactgtagattgcaatggttgtaagtgtagtttgaaataggaagtgcgatagggagtctgttgaagatagtattagcacatatggtgccctcgagtcccgtgcagcgagtggagcataaatgcggcgtcgaagtgaccatacgagagtaccaacaagcgtctgagcacttgcactctccatgcaatcgagccttcagccttccaaaaattcttcttcatccaagcacttcacccccatgtgatgactaccttctccggcgatggtgatggtgccatcaacaaaaaagcttacactctagcgatcgagggtgaccaacgagaacaccctaggatgtatcggacactgctaaggtggacgagctcgaaggagcatggcaaggtgtcgccaaccacctggccaatgcagacgacgatggagtcggggaagtttgttgtcttcggcacatacatgctggtggggtaggggtttctagcctcgccctttctggtcatgctgctggagttctataacatccaattgactcacctctccccaactccatcatgatgctgtcgaccttcgtccacctctactagatgtttgtcgagttgcacgtgactttggcactgtggcaccacttcttcgtcctccgatagactggagggggagccatctatggtggctgctacttctaggggcgcatcggcgaccctaaaggtacatcaggacacaaggagaagtggaagaactcctagttctatccccagacagacgaccaagagcgcttcgtcctcaccactaatccaccagtctccaactctaggacctaggaggtgctgccgaagctagacccgacgttcgccctagtattaacgagcatcagggagctggcgactgtaggggtgaagatgacgatggtgcttgcaaacttcctcaacaggcg

SEQ ID NO: 13516 - DNA, 2015 bp, Zea mays
gcacgagaccattacctagaacatcctaatcgaaaagcagttcttcgtatccacaccgcatctagctagcttgtggccaagtgttcgagatagcattgccggccggggggagcaagagatatgggtagcttgggagagtttgatgatggcaaggagatgttccatggccatggccatggccattctgaccctgtcgtcgacgagctcaaccgtctgcagaatctcctcagagaaaaggaaagagagctaggacatgcatacagtgaaatcaaaggcttgaaggtgacggaagctctcaaggacaaggctattgctgagctgagcaaggaactaaagagacaggacgagaggatgagaagtatggagaaacaacttgagcagaagaatctagaagtgaaaagactacataacgagcgcaaagaagcattgtccgcacagttcgctgcagaggcaacacttagaaggatccactcttctaaaaaagatgaggaatcagttccattcgacgccatcatagcgcccttggagtcagacataagaaaatacagacatgagattgcagtgctacaagatgacaagaaggcactagaacgacatctaaagttgaaggaggtggcgcttgttgaagcaggcaacattttgcacaccgcgcttgaaagggcactcatagtagaggatgttcagaatcagaacattgaattgaagaagcatatggagatataccatgaagagaataaattgttagagaaggctaacagacagaaggtgctagaggttgagaagctcacacaaacaattaatgagcttgaagagtccattctcgcaaccggtgaggttgccaatgtggtccacttctaccagaatcaagctacaaagttgaatgaggaaaagaggacccttgagagggagctagctcgagcaaaggtttatgtcaatcgtgttgcatccacagcagcaaatgaatggaaagatgactctgacaagctcatgccagtcaagagatggctagaagaacgaaggctcctgcagggagaaatacagcgattgcgtgacaggataacagtagcagagaaatctgcaaagattgaagcccaacttaatgataaactcaaaaggaggctcaagtcgcttgaagaggatatgagaaataaaacatccaactcgtctacaaaagaaattaataaacaagccactcctaaaagatcattgtctcaaccaaaacaacctaaaacaatgagagtgttacctcaactatattcacctgaagtcgttgacaagagaaggcctatatctcaaccaagggcatcaatggtagggaaagtattgaagcaacctaattcagaaatcgagcctacaaagaaaagtacagttgttaagcgatttgatagccctggaaggagaacaatttctagtaaagaagagtgtcccatgaaaaatcaactatgggcatcaaaaaccaaaacagatgttattgttgggaaagagaacaaagtacaaaagccaaattccaaggcacgtttaaatgcttcacattcacaaggccatgtggacacaaaagtatttgatggaaatgatgaatatggacttcaaaatagtgaacatcatgaagccatggcaaatgagagaaatgggaatagctcgagtgatgaaagtagcccttagaacaacaagacaagttggagtgttggggtttacttttgcatgaagacacaaaatggaagcacaaataacattattatgtacagatgtagcatgacttattttaaaggaagcgtgtgcccatctacatctattttattctgcccgggagattgcttgaacaacaaaactagttgtggtgtcatcattttgttttgtctctttgttctctcatgtacatacaaactatacctcaaactttacaaatgtaattttgtgcgactattgaaaaaatcaatatgtgcttttttgaggaaaaaaaaaaaaaaaaaaaaaaaaaaaaaaaaaaaaaagggaggccgctcgcgatctagaac

SEQ ID NO: 13517 - DNA, 3044 bp, Zea mays
gcacgagaccattacctagaacatcctaatcaaaaagatttctattttcttcgtatccattttccatccttttcccctctcgcgggctcgcggccacgaccccgcttccctaaattattaccacaaaaccctctgtcccggctatggccaactccgtctccccgccgcgccgccgccgccacagccaccacgatgacgtctccccgcgccgccgcaagcgccgcgcgtccccgtatccacctcgctcgccttccctcggcgtcgacgcggaccgccgtcgcagatctagggctttgccgcccgattccgacagccgcggccgcggccgagacgccaagccctctgaggagaaggagaacggccacgccaagcccggaagggatgaagacggcgacaaccgatctccccggcgcgacagggtttcagacggggaggaaggtggcgaacgccggaggatgcgcgatagggtttccgacgatgagaaggaggaaggccgtcgtcgcaggcgggctagggatccggatgatgagccggacgaccgccgtggcaagcgagaccgggagaaagacagacggcgccaccggcgccggagccctagctcggagtcagggtcctcgcccgacggccgtcgccatcgccgccggcgccgagacgagggttcgaggcggcgggacgaccgtaggcaagggaggacgagggagacgagcgccgtagaagccctgtgaaggagctgaccccgccactgcctcccccaccgcccctccttccggagatgatccctgggcgcacgggtgggatctacatcccgcctttccgcatggcgcagatgatgcgtgatatggaggacaagtcgagccctgagtatcagcgcctcacctgggatgctctcaagaagagcatcaatgggctggtgaataaggtgaatgcgaccaatatcaagaatatagtgccagagctctttgcagagaaccttgttcgtgggcgggggctcttctgtcagtcttgcatcaagtcacagatggcctcgcctgggtttactgatgtatttgctgcgctagttgcggttgtgaataccaagttccctgagattgggaagttgcttcttgttcgtgtcgtgctccagctcaagagggcatataagcgaaatgacaagccccaattgcttgcagcaaccaaattcattgcacacttggtaaatcaggtggtggcacatgaactcgtggcgctggagcttcttactgtactcctggaaaatccgactgacgatagcgtcgaggtggctgtgggttttgtcaaagagtgtggggcaatgctgcaggacttgtctcctcaagggcttcatgctatttttgaaagatttcgaggcattcttcatgaaggagaaatagacaagcgagtgcaatttttgattgaaggcctttttgcaattagaaaggctaaattccagggtttcccagccatccgtccagagttggatctagtggagcaggatgaccagtttacacatgagatatcccttgaagatcacctagaccctgagaccaatctaaatgttttccaggcaaaccccaattttgttgaagatgagaaggcatatgagaatctaaagagaagcatcctgggagcagagtcttctgaagatgaagaaggatcagatgctgcttctgatgatgatgatgaagaagaagaagaatctgatgaagaggatgaggaacaaatggagataagggatagaacagagacaaatcttgtgaatcttagaagaacaatatatttgactattatgtctagtgttgattttgaagaagctggacacaagcttatgaaaattaagcttgagcctggtcaagagatggagctgtgcattatgcttcttgagtgttgcagtcaggagagaacatatcttcgttattatgggctgctaggacagcgtttttgcatgatcaataaagtgtaccaagagaacttcgaaaaatgctttgtgcaacaatattcgatgattcatcgtcttgaaacaaacaagttgaggaatgttgccaagttctttgcacatttgttggggactgatgctctcccttggcatgttttggcttacatcaggttgacagaggaagacacaacatcatcttctcgtattttcataaaaatattgttccaagaattatcggagcacctgggcatacgcctactcaatgagaggctgaatgatcctaacatgcaaggttcctttgagtctatcttcccaaaggatcatccgaagaatacaaggttctcgatcaacttcttcacgtccattggtcttggtggtatcacggaaagcctgagggagtacttgaagaacatgccacgtctaataatgcagcagcagaagccagaatcatcagagtcagattcaagtggatcagaatctggttcggaaagctctagttcaggttccagttctgagtctgagtcagaatcaagccctgataagcgtgacagaaggcgaagtaataagaggaagaggacttgagagcacttccaactatgccttttggaattcatgtatttggttttgtttaaatgtgcttcttcagtatacatgtgcagtatgtgatctagctcttgatgtgttagtggtaatcagaaagccgtaacagtaagatactatccgaacttgtacgtggcaggttggtagtccagcaacaaagggccaacagagatcttctttatttttcataacttccaatgcagaacaagttctgtacgtgggtatttgtaccattgcgacatcacactgctagccatgttctgtatcctgtagtgtggtaactggtaagcatcaaatatggacatcggttttgatttttaaaaaaaaaaaaaaaccccagtatatagacagtcaaagctataggcttctgtggccttcacaatttttgttcgtattggtacattctctctctgaagcgataagacatgaagagcacatacacgtggcttgaaaatgctccaaaatgcgtcatttctatattttctgtcgtggatttagagatgtcttataagca

SEQ ID NO: 13518 - DNA, 1984 bp, Zea mays
  misc_feature (770)..(770): n is a, c, g, or t
cgaattgggtaccccccgggcgccccgggtgcccgacaagatacaccttccttcggttaactagctacctaattaccagctgccagccatcttgtgtcagcacactgcagtgttcgtttctgtcgggaagagagagaagaggcagcgacgatggatgagcctccgccacagagcgacgacgaccggaagctgtcggccatggagcacgtcaagaaacgccacgaggagaagggattcctctatgcctgcgccttcatgttctgctgctgcttctgctgctacgaggcctgcgagcactgcctggagtgcttctgctgctgcggcaagaaggacgagtgattaaggccggtccaaccagttccgcccgcccaccaatgatgaatgatcggtttgtaattcgtcgtggatttgatttgtttcggttgtgatttgtgaagaactgcgatcaatctggaactgttcgtcgtgatagaacatgcatgttgatgctgtaaataaatgcgattggtttggagcgttaactctacgttaaccgtacgtactcgtagtgagctagcttaggtaccccagtacgtatctgtgactcgtgagcgagttcagtgagacgctgtgcttgtaactgtaaatctgtgaattgtgattgcatgccaacgcactggtactacatgtattacagcccttaattgtgtatatataagtttcttgtgaattgtaaaaaaaaaaaaaaaacgcactctcatcaacttccttatgagatagatggttttgcntattgaaaagccgtccactgttcctggcaagtattcccgatatcaatcagaagtcagagctatctgaatcatgcaaggcagcaagcaactggagtaaggttgcaatgggggaaaagagaataaagacgtgacgcccaaccggtttcacatgaagcgtttctcacaggtcacgagaagaagggctagtaactatttattcagtttgtttggtctttcgacactttcagatgatccggttcagtacttgcgggagcagaggatctttttttttttgaccggagaaacttcatttctattacttgcataacagaaatacaaagtacggaccggctgccacagcaaccaatcaaccacacacatgaagaaaaacataaccgacctgattcaggtcaaggaaatctaccagacaacgtctaaattcacgacatcaagcagaaaagatattaaccaaaaggagccatagaacatcatcagactgcgacacagcgcacacaaaccataaggcagtcaagacaggactgacaataaaaaaagggacccaagccacaagacagccatctcgcatccagagaccgacggttactccaaatccatcttctggacatcatcaacagcttgcccttgaagttctctcccaggattcctcgcatttgcagctttcagcagaaacttggccccgtcctgaagtaaatcttgcagctctttcttgttcaaacctgcccagttaaagatcaatgcacaagcatgacacacaatttcaacaggagagctgaccacaatgtcttgaaggcacacattattcctggctttccaaattgcccaacaaatggcagcaacacaaacagtgctaatctctttagcatcacccaaattactatcaagccaaaaccagcattgatgcaagtttccaggaacaacattagaattaaagcatttagcaaccattccccacacacatttggctatatgacaattaaaaaaaaggtgagaggtcgattcaaactcatcacagaaaccacatgaagaatttccattccaatttctcctaaccatattctctttggtcagcagcacattattttcaagtaaccacatgaaaaccttaatttttggaggaatttttcttttccagatatgtttcagatatggaccatatgtactacaagtaatattatcatataaagatttcacagaaaattctttactttacccca

SEQ ID NO: 13519 - DNA, 1365 bp, Zea mays
aggttcccgcaaggaagaagacgaccttacgccatcgctgaccgtccggtcttatgcacgaaccgtcggactcgacacatggaagaagtcgcttctgtcaccaggtagcataccgtccgcgtcgccgtaggaagcactgccagacggcccagtgactcgcggaccgtagtcgccgtccacctcgtagagccgaacgtaatgtattgctcatcacaagaggacctagggttcgttgtttagacttaaataggtggtggctatcatagagtgtttccatttgctgcaacttgcaagagcttctttttaggaatcagaaacttgttccagtcacggcctcacaagcttgcaagagcgaacgcactgtcaggggcctaaaacatccccatctcacagcgacatttttgagggcatcttctcccagcgagcagtctgcgcgtaagtgactatcgcttgaagttggtgggggagcacgatgatcgcgatatgatcgagcattcgagcttatcgctacgataaacggagagaaggaaaataaagataatggcgctcgttgctcgatcagtcggcagatgctatttctgcaataaaaaaaaacagggcactgtcaatggatgttgaaacagtctgacaacgaagcatagcaagcaagaggctgtaagccgcatgatgctctaaggcagccttcttatataccacatccacaccacaaggggtggtgcaagtgcaagaacaaggtacaccttccttaggttaactagctacctaattaccagctgccagccatcttctgtcagcacactgcagtgttcgctcgtttctgtcgggaagagagagaagaggcagcgacgatggatgagcctccgccacagagcgacgacgaccggaagctgtcggccatggagcacgtcaagaagcgccacgaggagaagggcttcctctatgcctgcgccttcatgttctgctgctgcttctgctgctacgaggcctgcgagcactgcctggagtgcttctgctgctgcggcaagaaggacgagtgatttgaggccggtccaaccagttccgcccgcccaccaatgatgaatgatcggtttgtaattcgttgtggatttgatttgtttcggttgtgaagaactgcgatcaatctggaactgttcgtcgtgataaaacatgttgatgctgtaaataaactctacgttaacagtacgtagtgagctagcttagctaccccagtacgtatctgtgactcgtgagcgagttcagtgagacgctgtgcttgtaactgtaaatctgtgatggcatgccaacgcactggtactacatgtattactgcccttaattgtgtatatataagtttcttgtgaattg

SEQ ID NO: 13520 - DNA, 723 bp, Zea mays
gcggtgcggcgctcaggcggcggttccaaaagtgcagaacagatacaccttccttaggttaactagccacctaattaccagctgccagccatcttctgtcagcacactgcagtgttcgctcgtttctgtcgggaagagagagaagaggcagcgacgatggatgagcctccgccacagagcgacgatgaccggaagctgtcggccatggagcacgtcaagaagcgccacgaggagaagggcttcctctatgcctgcgccttcatgttctgctgctgcttctgctgctacgaggcctgcgagcactgcctggagtgcttctgctgctgcagcaagaaggacgagtgattaaggccggtccaaccagttccgcccgcccaccaatgatgaatgatcggtttgtaattcgtcgtggatttgatttgtttcggttgtgaagaactgcgatcaatctggaactgttcgtcgtgatagaacatgcatgttgatgctgtaaataaatgcgattggtttggagcgttaactctacgttaaccgtacctagtgagctagcttagctaccccagtacgtatctgtgactcgtgagcgagttcagtgagacgctgtgcttgtaactgtaaatctgtgatggcatgccaacgcactggtactacatgtattactgcccttaattgtgtatatataagtttcttgtgaattgtgagattgctctcccccgcactctt

SEQ ID NO: 13521 - DNA, 976 bp, Zea mays
  misc_feature (976)..(976): n is a, c, g, or t
agggtttcatgatcgaggctcccaccgagacagtggaagcttgaacgtcttagtttactgttccaagtgtcgcgaaaagagttttctgtactagctacatattttaaatgttattttgaattatgatgagaaaccaaggtatgcacccaagataattgatgtcctgttgttttcgtaaaaaaaaaaaaaaagggcggccgcccttttttttttttttttttttttttttttttacacaggcatgaccaaatatgtattgtagtatataattggtcgagtacaaacaacacacaagtcaagtttttatgagtgtgattggggatagtcaagtaacacactccctcgattttccaaaacaaacatatatatagtagagtaggcttacataacgcatccaattattcactttcattaggcttacaaataagagtcaaccttatatatactagtgatgatgtaatgtaactctagcaatgtccataccgtaccacacactccatgtatcgctttttaatttcatggcatgcacgcactcaacgtgcgcgcgccgagctcccgccacctctagagtccaccaccgatgccaccacccgaacctccgccacctccgaagccaccacctgcacctccgccaaaaccaccacccttgcctcctccaaagccaccacccgcacctccgccgaaaccacctcccttgccaccgccaaaaccaccacctttgcctcctccgaacccaccaccggcgcctccgccaaaaccacctcccttgccaccaccaaaaccgccacctttgcctcctccgaacccaccaccggcaccaccacctgcgcccccgcccccgccaatcccaccaccaaagcctccgcctttgcctcctccaaacccaccaccgacaccactgcctgcaccaccaccgagaccaccgccagctccagcaccaccgccagcaccgcctcccgcacctccaccaacaccn

SEQ ID NO: 13522 - DNA, 754 bp, Zea mays
  misc_feature (696)..(696): n is a, c, g, or t
  misc_feature (716)..(716): n is a, c, g, or t
tttttttttttttttcctttttttttttttttttttttttttttttgaaaaaatatgtattgtagtatataattggtcgtaaaaacaacacacaagccaagtttttatgagtatgcttggggatagtcaagtaacacactccctcgattttccaaaaaaaaaaaacatatatatagtagagtaggcttacataacgcatccaattattcactttcattaggcttacaaataagagtcaaccttatatatactagtgatgatgtaatgtaactctagcaatgtccatatcgtaccacactctccatgtatcgctttttaatttcatggcatgcacgcactcaacgtgcgcgcaccaagctcccgccacctctacagtccaccaccgatgccaccacccgaacctccaccacctccgaagccaccacctgaacctccgccaaaaccaccacccttgcctcctccaaagccaccacctgcacctccgccgaaaccacctcccttgccaccgccaaaaccaccacctttgcctcctccgaacccaccaccggcgcctccgccgaaaccacctcccgcgcctgggctggaggcgatggttcggcgggggcggcggcgcggagccgaggcgggagcggagagaggagaggaaagcgggctgggccatggcggaagggaagaggagacggggggaatgggaangcaggcaaaggcggtcgagncggagcggcgtaggtaggttgaggaacaactgaacgag

SEQ ID NO: 13523 - DNA, 1238 bp, Zea mays
cggacgcgtgttcggacgcgtgggcaggagaaggaatgggatgaacttcaagcaatggcaggagctttgtgttacaaattgatcactgtagatggtaatactgccatttggaagaaatctactgaggcttcatgtcttcctaaccaaaatggatttggccttgatctttgtagcaccgactatgatccagatgaagcatggtacttcaagttgaataaaggtgtcagtaaaatttcagtggcggaagagacagctataggttccattctcaagtggccagataggctgtctaaaccttctgctagggcatcagttatcaacaatggagcaaacttgtttgaagtagatagtcagaagtgggttaggagagtgtcatattataagaaatcgcttggtgtgaagcttgggagcacaaacatacgcaatgtcatggacatgaatgcattctttggaggattcgcagccgctataatatctgatcctgtatgggttatgaatgttgttcctggtcagaagccattgacacttggagttatttatgataggggccttataggggtttatcatgactggtgtgaaccattctcaacgtatcctcgtacctatgatcttattcatgctgatgcaattgactccttgataagtggcccgatttcaggcactagcagatgtgacctgtttgatgtcatgttggagatggatcgcatactgcgcccagaaggaactgccgttatacgggcctcgccagacgtagtagccaaggcagcacagatcgctcagtcgattcggtggaaggcacaggtgcatgacagtgaaccagaatcaggcagtaccgagaaaatacttgtggctaccaaaacattttggaagctgccactaacaaaacaataggctaatgcgagtttgaactttgaacccttttcacttgcgctcccttaattttgtattcttttggggtgcgctgaagggatatagcaggctaatgggattgctggagtagtttagtcaaggtggtcattctttccttcatttctttatagcgcaaagttaggtgtggtgtgattctcgttgtggctccattcccttgattctgattgatgttgttatagcctatgaacattactttaagccatctggtttattcccgtggtggttacagcaccctatgatcaagagaccaaccgatctagctgtataagagatttttttagttcaaaaaaaaaaaaaaaaaaaaaaaa

SEQ ID NO: 13524 - DNA, 887 bp, Zea mays
ggccgctttttttttaagtgacatatgttctgacaaagaaaatttatttgaccaatcacatgtgtgcggattcaaggagcaagcaacaacgcgagacggccggagctcaggacgccgagcagcagaggcacggatccgctggagacacggagcagcagaggcagcggagtcgctggaccgcggatccgtccgcccggagctcaggccgcggagcagctggagatcgaccggatccgtccgcccggtaggccgccgcgccgatgaagaagagcctaccgggccggtgaagatccacccgcctggagaaagaccggcacgcctgcctgctccagctcgaggagcgctggagatccacccgcctggagaagatcggtaggctgccgcgtctgcctgcctgaacaaaaccggcaggccgcggtgctgtcgaagaatcaggctgccgtgctttcgaagaatcaggccgcggcgccagtgaagaagcaagccgcgacgccgaggatataccagggcaccaggcagcggagatccgtccacaaccggtaggccgtgcgcggaagatctgccaggcgccggagatccgttcgtccgcggatccgtccgcttggtaggccgccgcaggcctccgcgtcgtcgaagaagcaggccgccgcgtcgatgaagaagcaggctgccgcgccgccgaggatgtgccaggcgaaggagagagggagagttggagtcgggatcggagaagaagaggctgcgcaagcgcaggagagagtgaaagtttgtagtgggtccatcatgtaagtaacgttaaagtgggcggagatgacgttccggcgcatttctgagcaaacggaatgggcgttgggtaaaactgagtaagaagaaaaaaaaaaaaaaaa

SEQ ID NO: 13525 - DNA, 790 bp, Zea mays
ttttttttttttttttggttacatattttttgacaaagaaaatgtatttgaccaatcacatgtgtgcggattcaaggagcaagcaacagcgcgagacggccagagctcaggacgccgagcagcagaggcacggatccgctggagacacggagcagcagaggcagcggagtcgctggaccgcggatccgtccgcccggagctcaggccgcggagcagctggagatcgaccgcggattcgtccgcccggttggccgccgcgccggtgaagaagaggctaccgggccggtgaagatccacccgcctagagaagatcgacacgcctgcctgctccagctcgaggagcgctggagatccacccgcctggagaagaccggtaggctgccgcgtctgcctgcctggacaagaccggcaggccgccgtgccgtcgaagaatcaggccgccgtgctttcgaagaatcaggccgcggcgccggtgaagaagcaagccgcgacgccgaggatataccaggcagcggagatccgtccacaaccggtaggccgcgcgctgaagatctgtcaggcgccggagatccgttcgtccgcggatccgtccgctcggtaggccgccgcaggcctccgcgtcgtcgaagaagcaggccgccgcaccggtgaagaagcaggctgtcgcgccgccgaggatgtgccaggcgaaggagagagggagagttggagtcgggatcggagaagaagaggctgcgcaagcgcaggagagagtgaaagtttgtagtgggcccatcctgtaagtaacgtt

SEQ ID NO: 13526 - DNA, 860 bp, Zea mays
atgcaaaagtttataggggaatttaattggacaaattgcaaaaaatagaccctagaaggatcgaacccaacaccctaaacaccttaccactgacacaatccactgcgccatatgtaagtgacatatgttttgacaaagaaaatttatttgaccaatcacatgtgtgcggattcaaggagcaagcaccagcgcgagacggccggagctcaggatgtcgagcagcagaggcacggatccgctgtagacacggagcagcagaggcagcagagtcactggaccgcggatccgtccgcccggagctcaggccacggagcagcagaggcacggagcagccggagatcgaccgcggatccgtccgcccggtaggccgccacgccggtgaagatccacccgcctggggaagaccggcacgcctgcctgctctagctcgaggagcgctggagatccacccgcctggagaagaccggtaggctgccgcgtctgcctgcctggacaaaaccggcaggccgctccgtcgaagaatcaggtcgctgtgccttcgaagaatcaggccgcggcgccggtgaagaagcaagccgcgacaccgaggatataccagggcaccaggcagcggagatccgtccacaaccggtaggccgcgcgccgaagatctgccaggcgccggagatccgttcgtccgcggatccgtccgctcggtaggccgctgcaggcctccgcgtcgtcgaagaagcaggccgccgcgccggtgaagaagcaggctgccacgctgccgaggatgtgccaggcgaaggagagagggagagttggagtcgggatcggagaagaagaggctgcgcaagcgcaggagagagtaaaagttt

SEQ ID NO: 13527 - DNA, 1065 bp, Zea mays
ctgacacaaaccgctgcgccatatgtaagtgacataggttttgccaaaaaaaatatatttgaccaatcacatgtgtgcggattcaaggagcaagcgacaacaagtttcagttaaagtctgcgagcacaagcaacagcaagtttcatttcaagtctgcacaccgagcacaagcaacagcaaactgagcactttcagttatttcagcaaattcagttatttcagcaagtgacttcagttatttcagcaaaccgagcgcttcagttatttcagcaaattcagctaaacttcagcgcgagacgaccagagctcaggccgctagaggcaaggacatcgcgagatggttggagctcaggccgccgagcagcagaggcacggagccgctggagacacggagcaacagaggcagcggagccgctggaggccgaccgcggatccgtccgcccggagctcaggccacggagcagcagaggcacggagcagctggagaccgaccgcggatccgtccgcccggtaggtcgccgcgtcgcgtccgccgcaggccgccgcgccggtgaagaagaggctgccgtgccggtgaagaagtaggccgccgcgccggtgaagaagcaggcctccgcgctggtgaagatccacccgcctggagaagacccgcgcgcggccgcatccgcccgcctggagaagaccgccaggccgccgtgccgtcaaagaatcaggccgcggcgccggtgaagaagcaagccgcgacgccggggatataccaggcaccggagatccgtccacccggtaggccgcgcgccgaagatctgtcaggcgccggagatccgttcgtccgcggatccgtccgcccggtaggctgccgcgtcgcgtccgcccgccggcctccgcgtcgtcgaagaagcaggccgccgcgccggtgaagaagcaggctgccgcgctggtgaagatccacccgcctggagaagaccggcaggccgccgtgccgtcaaagaatcaggccgcggcgccggtgaagaagcaagccgcgacgccgaggatataccaggcaccggagatccgtccacccag

SEQ ID NO: 13528 - DNA, 717 bp, Zea mays
aattcggcacgagcgtcgagcgattacaactgctgactatcagattcagctcacacacctccgttcgtaatagcatagtagccacgctctactcatcttaggtctcgaagtgccactgcagtcttcgccggccagctcgatcgccgcacgatggcgtcacagcagcaaaccaggaagcagcaggccaccaagggccaccaggagaccgaccaaggccaggcgatgaacctggaagagatcggcaagtaccgcgccgaggcgcagcagcggtcggcggacgccatccgcgccgccgaggaccggttccacaaggccaataaccagcaggcgcgcggcgccggggcgcgcgggactgtcaccgtggcccaggcgcccgtcgccactgtggtcccgtatcaggagagcgtgaagcaggcggagacggagagccacggccgcggtagccacggctctgaggcgcagcagtggctagcggacgccgcggccgatgccagggagaggtgcaacaaggccccggggacgagcccggccgcccacgcgacggctggcgcggctccacaccagcaaaccaagaacgagcgggagggtggtcaagtccacggccatctaacaaggcaggacgagatggggaagcacggcagcgaggcgcagaagaactcgaccgcggaggccgcacgtgccgcggtggagaagcacgacaaaggtagggagaccggc

SEQ ID NO: 13529 - DNA, 2276 bp, Zea mays
ctctcgctctggccattggccgttcggccacctcttcctggccgctcgatccctggctgctctcccacgccagccggctgggctgctcggcccatggcccttgaagtggcccagctcggctggcctttccttcctttttttttcttattcatttcttctattttccataaagaaaataaagggaaaattcccttaaatgaacaacagatcttaagcaagagctaaacgatgtcgacaacctgacggtagagaggctactagatgagatgtcggagttgttcctgaaagactacaagaacgggcagctgaaatctcgtgcatggatggcatgccgattctgagtacctggcctacaaggcatccaagcctctggctatacgactgaagatactggcgaaggcgcacccggagttgcgcaccaacatcgtgcaccctggctttaattttgcaggaccgatcaacttcgacacccggtgaatacaccgctgaagacggcgccagtttgcccccgctgccatggccgcttttttttttttttttttaaggacaacattgttaggaacaatatatagcagttctgcttacacagttacagtttttccgcgaggctaacacaactccatgccaaaatcgccattgtcatgagcctcatcagacgtaacgaaggcatctggtacacttacagccagctggacgacaaaccgagttcacggagagatagatgaaaggagggaataacgaagtcgtagagaaaaagaaaagaaaaatggcaaacgcagacttgagtgtgagaatgtgtgagtgtgtgtgtgtgtgtgtgatatatattggtggcggtcccttcctcctagttgtcctctccttccccgtcttgcggtggcgccggttccggcggttgctcgtcggctgccatgtccggcagcgtatcctgggacgggctcttcttcatcatgtggctgtagctccccttctccatgaacagctgcgcgaagtggatcttgcagtacagaacgccgttgagcgcggcgtaggaggaggtggtgaggatgcagcccccgtgcgagcacttgaagcagctcttgtggtaggactcgccttccagagttaacttctccagcgggtacactgttttctggcaagctgcacacttatcctgagtaccagaaaacgcagatgatagcttgctgggggcccttgtcagttcacccttgtctgaagacttgccacctggccggtcgtgttattaggtcttgggaagttcttaaagatcatcatttctgtaccttctccagcgggtacactgttttctggcaagctgcacacttatcctgagtaccagaaaacgcagatgatagcttgctgggggcccttgtctgcaaagtgcaaatggattccaacagtttgtttggcaaacaatgatccagttattactacaatatagaaaccaagacatcccagaaacaatcacgacgagatactagtttccgtgaggctaggctgtatgtaccagttcacccttgtctgaagacttgccacctgaatgaagcacacaagaaagctttcagacagagcacacactgctgtgggaactgaacgccacgcccacgtcgtagcgtagctacattacctggcgtgaagttcttggagaagctcccggtctccttgaagagctgctcgaagtgggtcttgcagtacagcacaccgtccatggaagagtagctgcacatctgcaggcggccatcaaacggtttatttgcagcgtcagaaactctttaactcggccgtttttttcttctttcccatggcatgcagacatggcatttggatgcacgcacgtagcccggcacgacgtagctgcacatcgcgaggatccctttgcagtggctgcacttgaagcatgtcttatggtaggtgacgccgtcggccgtgaggaggtcgatgaagtggacggtcttgtcgcactccgcgcacttgtcctgcgtgccggtgaaagaagacatggtgccgacgcctgcctgtggctgcacgcacgcactctcgcctcccgatcccaatcgcggttgcccgcctccgctcgggcgagcgagtaaatagacgaggctcgcatcggggatagcaggtgatggatggctacgcttacggagaagccgcgggcgccagggacgaacgagagctccggagcaagcatagggcgcgggcggtctctgcgccgcatagatttcggtcaagcgaatgcttcatttagaactatgagcgctggcgcgtcagtcatctcg

SEQ ID NO: 13530 - DNA, 1157 bp, Zea mays
  misc_feature (7)..(11): n is a, c, g, or t
  misc_feature (24)..(30): n is a, c, g, or t
  misc_feature (93)..(103): n is a, c, g, or t
gcttgtnnnnntagggatctggcnnnnnnnccataaaaggttgtcaaggcaaggcttttagtatgcgcctagcattggccaagatccccatgnnnnnnnnnnnggccgcaaatttttttttttttcataagtattaagggcagcgttgttaggatcatatattcaaagaagtggctctgcttacaaagttacaatttttttccgcgaggctaagacaggtccatgtcagattttccattgtcgtgagcctcagacgtaacgaaggcatctggcacacttgattgcagcgtgatgataaaccgggttcacagagagattaagaggaaaaaaaagggaggagggaataaagaagcgtcgtcgtcgtaaagaaatatggcaaacgtgtagacttcagtctgcgtgatatatatgcatgggtggttgttggtcgctccgatcctagttgtcctcttctttctcatcttgcggtggcgctggttccggcggttgctcctcgtcagccacgtccggcagaacctcctgggacgggctcttcttgttcatgtggttgtagctccccttctccatgaacagctgcgcgaagtggatcttgcagtacaagacgccgttgagcgcggcataagaggaggtggtcaggatgcagccgccgtgcgagcacttgaagcagctcttgtggtaggactcgccttccagagttaacttctccagcgggtacactgttttctggcatgctgcgcacttatcctgggtaccagaaaatgcagacgacagcttgcttggggcccttgtcagttcacccttgtctgatgacttgccacctggcgtgaagttcttggagaagctcccggtctccttgaagagctgctcgaagtgggtcttgcagtacagcacaccgtccatggaggagtagctgcacatcgagaggacccctttgcagtggctgcacttgaagcatgtcttatggtagatggcgccgtcggccgtgaggaggtcgatgaagtggacggtcttgtcgcacgccgtgcacttgtcctgcgtgccggtgaaagacatggtgcccggacgcctgtctgtggctgcacgaacgcacgcactcgcccacaatcccgatcgcttctcccccccggcctgaggaacccaatcgccccatggagtgg

SEQ ID NO: 13531 - DNA, 1047 bp, Zea mays
tttttttttttttttcccttttttttttttttttttttttttttttttttttttttttttttttttttttttttttttttttttttttttgcgaggctaacacaactccatgccaaaatcgccattgtcatgagcctcatcagacgtaacgaaggcatctggtacacttacagccagctggacgacaaaccgagttcacggagagatagatgaaaggagggaataacgaagtcgtagagaaaaagaaaagaaaattggcaaacgcagacttgagtgtgagaatgtgtgagtgtgtgtgtgtgtgtgtgatatatattggtggcggtcccttcctcctagttgtcctctccttcccccgtcttgcggtggcgccggttccggcggttgctcgtcggctgccatgtccggcagcgtatcctgggacgggctcttcttcatcatgtggctgtagctccccttctccatgaacagctgcgcgaagtggatcttgcagtacagaacgccgttgagcgcggcgtaggaggaggtggtgaggatgcagcccccgtgcgagcacttgaagcagctcttgtggtaggactcgccttccagagttaacttctccagcgggtacactgttttctggcaagctgcacacttatcctgagtaccagaaaacgcagatgatagcttgctgggggcccttgtcagttcacccttgtctgaagacttgccacctggcgtgaagttcttggagaagctcccggtctccttgaagagctgctcgaagtgggtcttgcagtacagcacaccgtccatggaagagtagctgcacatcgagaggatccctttgcagtggctgcacttgaagcatgtcttatggtaggtgacgccgtcggccgtgaggaggtcgatgaagtggacggtcttgtcgcactccgcgcacttgtcctgcgtgccggtgaaagaagacatggtgccgacgcctgcctgtggctgcacgcacgcactctcgcctcccgatcccaatccccccgcccgccggctcggccaatcgcccttaggagt

SEQ ID NO: 13532 - DNA, 1257 bp, Zea mays
ctgaaatctcgtgcatggatggcatgccgattctgagtacctggcctacaaggcatccaagcctctggctatacgactgaagatactggcgaaggcgcacccggagttgcgcaccaacatcgtgcaccctggctttaattttgcaggaccgatcaacttcgacacccggtgaatacaccgctgaagacggcgccagtttgcccccgttgcgatggccgcccctttctgctctttttttttgggataggacaacattgttaggaacaatatatagcagttctgcttacacagttacagtttttccgcgaggctaacacaactccatgccaaaatcgccattgtcatgagcctcatcagacgtaacgaaggcatctggtacacttacagccagctggacgacaaaccgagttcacggagagatagatgaaaggagggaataacgaagcgtcgtagagaaaaagaaaagaaaaatggcaaacgcagacttgagtgtgagaatgtgtgagtgtgtgtgtgtgtgatatatattggtggcggtcccttcctcctagttgtcctctccttccccgtcttgcggtggcgccggttccggcggttgctcgtcggctgccatgtccggcagcgtatcctgggacgggctcttcttcatcatgtggctgtagctccccttctccatgaacagctgcgcgaagtggatcttgcagtacagaacgccgttgagcgcggcgtaggaggaggtggtgaggatgcagcccccgtgcgagcacttgaagcagctcttgtggtaggactcgccttccagagttaacttctccagcgggtacactgttttctggcaagctgcacacttatcctgagtaccagaaaacgcagatgatagcttgctgggggcccttgtcagttcacccttgtctgaagacttgccacctggcgtgaagttcttggagaagctcccggtctccttgaagagctgctcgaagtgggtcttgcagtacagcacaccgtccatggaagagtagctgcacatcgagaggatccctttgcagtggctgcacttgaagcatgtcttatggtaggtgacgccgtcggccgtgaggaggtcgatgaagtggacggtcttgtcgcactccgcgcacttgtcctgcgtgccggtgaaagaagacatggtgccgacgcctgcctgtggctgcacgcacgcactctcgcctcccgatccccaatcgctcccggccgggctcccaatccgcccccggccgg

SEQ ID NO: 13533 - DNA, 1583 bp, Zea mays
gtataattctaatctatatattctatattatcttcacatttacgattaatttgttctaactgttttcaggacattcttttttcacactcgactgttcagaaggccataactcaagcgccagtcatgacaaacaaaattgtataatactatataatatatatagcaagtacaaaatcgacgaactaggaaataactcattcctggccaataaaaaataatatggctagtttagcaactctatttttctaaggggttctcatttcccaaaaaaaatgaactaattttccttgtaaaatggatatctcttgaaaaaattgggttgccaaactagccctaagaaggaattcaaacatgagcagctgcccctcaatacttgaagatatgcctggctaaaattttgaaactaaatcataataagcacatcacatataatccactcccgcgccctacaatgctatcccgctttttttttttttttttttcaacataaacacatatttcatttattcaaagagggtcgccaagcttacagcactcaacaatctgcttgtaaaaatagggatctggcaaaaaaaccataaaaggttgtcaaggcaaggcttctagtatgcgcctagcattggccaagatcaccatgaacaccaagcatcccagagagactgtaaaaaagatgcaaccctacatgacccttacacaccatggagaacatgaacagcacacaacacatcaagactaaaaacaaactcaaaactcgacaaccaaacacactgcacaaatccacagacgctccagcatcagcagccctggaaaagatgacaccagcatctggttcttgagttagaattgtgatagtccagagctgccaatggatcacggatgcctgcaacttcataaccaggaagcagtaaaacgaaaaaggacttggacactatggcaacctaaaaaaccttatatgactataaggcaaggaccagtgtctggatcgaggggcaggatgccagtgatggcagccaaggctcaaaaaacagataaacctcccgagaggtgatctgtgaaaaacgagcacttgactagaaagcaccccctaaaacaactggtccttgaacaatgcggaagcccaccatcatcactcgcatcgcatgcgagccaaaaacctgaagatcacctggttgtgctactgctacggtcgtatatctgcatctggaggtggctcccagtagactagacatgagcccttccagcaatggaccatcttgtctgcctatgcaaggatgtcacaccaccagagcttcttctccagcgatgcaatgttgtggttgccaatcatgtcacagaactgaagattgaggccctctatagactggccaaggttgcccaagaacagcacgctcttctgagtaaccttagagcagcctgacagtgagagaacacggagcttgaggtgccttgcagatgccaggatggcaacaccgtagtcactaaccatgcagtttgaaagattagctcccgcagctcggtgcagctctcagacatggtgaagagatagcatctggtatcttgctgcaaccctcagggtgattttc

SEQ ID NO: 13534 - DNA, 1052 bp, Zea mays
ctgaagccaaatgtttacacccatatactcatttcatcgtcatgaatccaaagcctcataatacataacaagcaattcaacatgcacttgttacaatcccagactgaaccaagctgccaaggttacaaaataagaacatatacttgtgacgactacttactaataatgcagggttcgtatatatagaggagatagacacgtacggctctatttctctttgcgttgctgctaatctttgtacgttctacgccgattgcgcgggtgcttccggctcagccgcgcctgcgtccgccggtggctccggtccggcctccgcggcctcgttcttcttggtctgcgccgtctcgatgaggtggttgtagctgcccttctccttgaacagctgcgagaaatggatcttgcagtagaggaccccgttgagcgcggcgtaggaggacgtggtgaggatgcagcccccgtgcgagcatttgaagcagctcttgtggtaggattcgccttccagagtcatcttctccaatggatacactgttttctggcaggccgcgcatttatcttgagttccagagaatgcagatgatagcttgcttggagcctttgcctggtcgttcttgtttgaagatgctccaccttgaaagttctttgagaaggtccctgtctccttgaagagctgttcaaagtgcgtcttgcagtacaggacgccgtccatggaagagtagctgctaatcgagaggacgcccttgcagtggctgcacttgaagcatgtcttgtggtacgagacgccgtcggcggtgaggaggtcgatgatgtggaccgtcttgtcgcaggctttgcacttgtcctgcgtgccggtgaaagacatggcgatcgagctctgtgcttgcacctgccaatcaggactccagcctcaaacgaagcccgtacgtctggctagccgctgctcgtgcaggcggtcccccaccggcaggcaaaaccgatgagcaaacgggcgcggacggaggagaaagacgctcgttcgcgattagggggaggaagaagcaaaggttcccggccgg

SEQ ID NO: 13535 - DNA, 1060 bp, Zea mays
cttttttttttttttttttaaacttcatgaatccagagcctcgtaatacaaaataagcaattcaacatgcacgtgttacaaatacaatcccagactgaccaaaaccaagctgcagcataacaacaacatatatagatttgtgaaaactacttactgaatgcagagttcgtataattaggagatacacacacggctactcttcgttctacgccgattccgcgggcgcttccgcctcagccgcggcgcctgcgtccaccgatggctcctctgcggcctccgcggcctcgttcttcttggtctgcgccgtctcgatgaggtggttgtagctgcccttctccttgaacagctgcgagaaatggatcttgcagtagaggatcccgttgagcgcggcgtaggaggaggtggtcaggatgcagccgccgtgcgagcacttgaagcagcccttgtggtacgactcgccttccagcgtcatcttctccaatggatacacggtcttctggcaggctgcgcatttgtcttgagttccagagaatgcagatgacagcttgctcggagcctttgccgggtcgttcttgtttgaagatgctccacctccaccttggaatttcttggagaagttccccgtctccttgaagagctgttcaaagtgcgtcttgcagtacagaacgccgtccatggaagagtagctgctaatcgagaggacgcccttgcagtggctgcatttgaagcaggtcttgtggtacgagacgccgtcggcggtgagcaggtcgatgaagtggaccgtcttgtcgcaggctttgcacttgtcctgcgtgccggtgaaagacatggcgaccgagcgagctctgtctgcttgcacacctgccaagacctgacgtcgtctgtctgtgggctgtggctagccgctgctcgtgcaggcggtagtacccggccggcagccaacaactgatcgacgggcaaacggcggaagcggacggagaggaacgctcgctcgcaattcggccggaaggaagaagcaaaggttcccggccggcctcgtggtgccctttcgcccggccgg

SEQ ID NO: 13536 - DNA, 3818 bp, Zea mays
cctggcactgcccgtcttgctgaatttatcaaggagaagtttggcaggctagatatcctggtgagatctcttttttccagataaaacagaattgatttgatgcggtacggtcgatctattgccgagccttgtgaaaaatcacatacaagtacatttcatagagggggcgtagatagaaagcgtcccttaaagatgagacaggttgatcagatagcaaacaatcctcaagagacaaaaaaaaaggtcaaaaagaaaatagaaagaattacacaatggcttctagccataaatctatgtaggagtggtaattttctttagctcttaggataactagaggaaactgtttcttcaagacaatcttgcatctttaatttacactgaatgtggcatgttgcttaaaatggtgtcattgcgcattattgcccaaatagcccaacaaattgtgattgcaatctccatgaagaaggggagttgttctttgaagctttccaagatatcgaatggatcactgctactgggcacaatcaaattcgaagtgaaccagaatgctgagggaaagagtagtccaacataagatgaaaaaagaacacaattataaccatcaagttgcatattcttgggttcaaggagcgttatggtacttagtcgaccatttaagttagtgcttggttctactatgcaagattagaactagcagtagtagtggtctctttgtagtttcccttttcttggtcccttgagctgaagtggtaaacttggcttaacccggtgcatcaaacagctcgtaggcaagaacgccatggagaggctacaatggttggtgcagcactccacggagagttacgaggaagcaagagaatgcctgaaaataaactacttcggcaccaaatatgtgaccgaagcactcctcccaatccttatatcctcctctgacggacggctcatcaacgtgtcatccaactatggactactccaggtatacctatatatctgaagttctgaacaatcatacaacaatttaatctgcaggcactaatcctcagatggaatggaactacaattttcgttatccaattcttcgtctttgttttccagcatttcagtggcgaagatcttaagcaagagctaaacgatattgacaacctgacggttgagaggctagatgagatgccggagttgttcctgaaagactacaggagtgggcagctgaaatctcatgggtggcctgccgactctgagtacctggcctacaaggtatccaaggctctgaccaatggctacaccaggatactggcgaaggcgcacccagagttgcgcatcaactgcgtgcaccctggcttctgcaagaccgacatcaactttgacaccggcgaatacaccgcggaagacggtgccagttgcattgttgcggtggcgctattgccggaaggaggcccaactggcgtgttcttcttccgcagagaagaagtaccctttgtgtaacttttcaagggttactctctctctctctctctctctctcgcgctctctcactctcacacgctctctctctctcacacacacacacacacacacacacagtgatgtaacggatgtggtggcggcttttttcgattatattatttttttaagtattaagggcagcgttgttaggatcatatattcaaagaagtggctctgcttacaaagttacaatttttttccgcgaggctaagacaggtccatgtcagattttccattgtcgtgagcctcagacgtaacgaaggcatctggcacacttgattgcagcgtgatgataaaccgggttcacagagagattaagaggaaaaaaaagggaggagggaataaagaagcgtcgtcgtcgtaaagaaatatggcaaacgtgtagacttcagtctgcgtgatatatatgcatgggtggttgttggtcgctccgatcctagttgtcctcttctttctcatcttgcggtggcgctggttccggcggttgctcctcgtcagccacgtccggcagaacctcctgggacgggctcttcttgttcatgtggttgtagctccccttctccatgaacagctgcgcgaagtggatcttgcagtacaagacgccgttgagcgcggcataagaggaggtggtcaggatgcagccgccgtgcgagcacttgaagcagctcttgtggtaggactcgccttccagagttaacttctccagaagagcgggcgtgccaccataatgatttggtcatatgattaaaacagatctctcttttttttcagatctttggcacacggtttaatgctgtttggcagagtaacagaatttctgtaccttctccaatggatacactgttttctggcaggccgcgcatttatcttgagttccagagaatgcagatgatagcttgcttggagcctttgcctgcagagatttacagattggcatcgtgcgtaagtagtcagctattaccgatgatggcatggccaataaagttttagaacttattgagcatttgagccatatttgtgtagaagatttgaggaaccgcacctggtcgttcttgtttgaagatgctccacctgagtaattaacacaacgaaattaaagggtccgaattgcattgcattgcatcaggcaccagagttgagcgttacagcatcacgcgctgtggacgggttcagaaacatagggggcacagtattcagctgtagattaccttgaaagttctttgagaaggtccctgtctccttgaagagctgttcaaagtgcgtcttgcagtacaggacgccgtccatggaagagtagctgctaatctggaggagacgcatgcagaaatgaaaaaatgagaccgtatttctacatgttcatctgtcgagatgatctgaaccgaatcaaacaaagcttcgtttctttcgatgcaaatgagcattagcgcattgccgcacacatcgcaagcagggcgaatgcgcatgcggagttgagctcaggccacgcatgcataccgagaggacgcccttgcagtggctgcacttgaagcatgtcttgtggtacgagacgccgtcggcggtgaggaggtcgatgatgtggaccgtcttgtcgcaggctttgcacttgtcctgcgtgccggtgaaagacatggcgatcgagctctgtgcttgcacctgccaatcaggactccagcctcaaacgaagcccgtacgtctggctagccgctgctcgtgcaggcggtcccccaccggcaggcaaaaccgatgagcaaacgggcgcggacggaggagaaagacgctcgttcgcgattagggggaggaagaagcaaaggttgacggctcgtgagcgagacggatgctccttaaaggacagggcgtgagctcgggagcaaagataggaggcgcgcgggttctaaaccgcacaaccaaattaggacaaagatagtttttttagcttcgatcggggagcggtggcgacgcccttctcctatttccgcgcccgtgcctaacggacgaaacgctcgttcctctgaaggttgtgcgagccatgaacagacgtggcgagatgttacccatctcggctgcaggcgccccccgtcgtgttagcaagttcttcccgctcttaatttagtttgaataagtccattttgctcgtctcaacctagactatgtttgaaaccactacatctaatagttagccagtaaataaattattagttaggttaaaccaactaacgaactaattgttagttgtaaagtagctaatactttgttatggtattcattgagagtgtttgaaaaccaacaaatattttttagtagctaactattagttc

SEQ ID NO: 13537 - DNA, 6130 bp, Zea mays
  misc_feature (1278)..(1278): n is a, c, g, or t
  misc_feature (4918)..(4918): n is a, c, g, or t
  misc_feature (5119)..(5119): n is a, c, g, or t
cagactggtagatttgggaaactaaataagagagttacattccctatggagttagatctgacaccatacatgagttgcactgatggaagtgacctgtatgatctctatgctgtagtcgttcatctggatatgctgaacgcatcattctttggacattatatatgctatatcaaaggttatcaaggaaggtggtataaaattgatgactgcaaggttatggttgttgatgaggaggaagtacatgctcaaggcgcttatatgcttttatatagcaggagaacagctcgtcctaggtcacttcttacagttgatgagtccgtgaaacagcaacaacagtgcaaatcgctcctttccaatgggcaaagccacatgatactagcagatacaacattgaactgtgaatcatctttgaagattccagaagatatgttacaacaggattgtgaatccaataatgaatccttgcatgaaatgggtattaaggaccaggagtcagacatggatctacgtacaagcattgaagatgacaaattcattagcaatggaaatctacgtttaccaggttcactagtatcacatgttcttgaagatactagagctccagattctgtattagaaggctctgtgcaacttggccctcctttagaaggtggtcctactacgatgagctctgtgcagtttggcaactgcacaagtgaagcatcttcggaacattcctttgcagagcaatgtgaggtgcctgcctcatgtattgattcagttgactatatggatgttgatactgaagctggtgcagaagttgagagatgcgacgaacaaagacctgtcttaaatgattcagttggaaggccgaataataacacagcaaccccaactgcgaatggggtgccaggagaacccaaaccatcattttcctctggtttttttgataagccctcaagaaaaagatcttcctttgggcaggaagagggagaaggagaggcaggtggggtgggcgagcgaccccgttgaggcgcttggggaagatgtgatggggcgggtgatggagttcctggacgcgcgcagcgtggcacgatgcaccgcagtctcctgcgcttggcgcggggtagcggcagacaaccgcctctgggcacctatggttcgggccttcttccactgtcctctcgcactcctttatatttcgcgttcgttggcctgcgtgcgtaggttgtgctcctgctccagttcgacgatttgctctgcggtgacgagaataggaagccttacaattccctcgancaatcgatcgagcaccttggtgctcaagtttgctgggataggaatgagactgacggcactgctggactggggtgaaaatccctaaatttcgtagctaggagcgcagaggcagaggacatgcattattaactgatctgcccccctgcttgctgacatggccaaaggcgttatttttggccttgcagtttttgtgtaggccccccctcctttccggggatctactttccatgacaatatcattatatggtttccaaaaacgttgatgctgattcagtccccagtggtactaataacgtgacaaatcaagcaagctatgtatgtttcgttaatgtatccaaagaaagaagcttttagtggcactgacatgctgcagaaacaattgtttgtttcatggaccatagctgttcggctcttataaagtgacggctgcagcagccacccacagctgctagcacagtgttttgtgagcgagctcatagccacagccacagcttcaaagtttagctgaaacgaatatagacataagaaatggtacaaaaaagaaatatatccattgattctatctttacggtttttttttgtttcatgtgtaaatttctgtttttggcctcattgtaatattttctgaatcatatgggttttcagcaaaatgtgtgttgtccaagacattaatcacgtttataccactggcagttaaaattgatgctatgaatggacccgtatccacagctttgttaaactgttcatgggatgtatttaaatgactaatacaccaatgaggccattaatagtatttaaatgactactttcatttgaccatcccaaataatttgtatttcttggttagcttggtgattatgaaattttggcatattaaaattttaaaatctctgcttccctaaaaaagactggaaatcatataaaaaatggaatatgtttttcagtgtcttgaattttcactctcacgaatgggaaaacagtcactgatgttaacagaagtcgaatatccaatataacatactagggttgaaaaatatactatttgattgcatctccttctagatcaaggaaacaaaaatggtaaataccaaaactgagactaggcagaccatattggaggaaaaggagggggcagaagaaaactgtggcaatatgtatatagctgtatttttcgttcatgatacacagcaggtcctaatcattttgcttgtagtgtactgaattgatggcgggaaaggctcatatcccacgtttaacatcgatccgcactggatccaagttgtctacatattcaatggtcattatggatgggaaacgggtgagtacaagcatttttttcatctatgggatcaacagtgcagtggatgaacatcaatagaatgcataatgtattgtgctgatgtactcttgtagatcatttatattgcagattctgggaataatgttagttatattgtttaggcatctattttattttgtgccattcatatatacagtggtaatattggggaagttctctttggttatctatttgatttatcctgaagctgaaagtaaactcttaagtacatacatttcactcctccatcactctcagcataaagtacatcattcttttgttcagagtcggatcacaaaagaggatctctgcgatcatgcgtgggaatatcgtttcaccatagtaagttttattttggttaaattgcctccctttttcttttctttttacgggcttatatggcattgcatatttaaattctttttgtggttgctactgtacagctgactctgctagttttgagttcaacttgttttagtcggtaacaatctgatggatgcatgggatcatgacaactgtcagcatctctctagcttcttcagaggttgtagcttctgagcgcactgaggtagagtcgatgcatatatcttaatggtggcaattaaaggctataactttgatatactgatttggtcatagtctcaatgataagttttgattaacacatcttgttgagatccatacaacaaacatatgtatcttatgaacacagatttgttttttggtctgtcactttgagaatatgtgtgcacatttgtcaagtatgtaatctggttaaattgttgatgttttcatttgaattacagctttctttttgtccaaaataaatcacgattttttctgaaaaaaatgctttaaaaacataggaattccatgctacagttttagtagcatttcaatatgttttagagagagaatcataagcttatgacaaggtgcatagatgaggaacatctcaaccggctgcattccttcagcgcttactcttttctgctcctgcaggcagcacctgattactggaggaaccttgatccatcatggaagcacactggtccacctatgcgacgctacttccaccccgatggctaccacagtgcagaccctcatgacgccgtgtggggtggccatgagtgcacctacaccgtcataacgagctttgtcgacgatggccagatcagggagcactacgtgaggatcaaccggtggccgccgatgaaggtgtcaaggaaggacgactggagctgggagctatcgaaccacctgtaccgctataacagcatacctgattcccacaggaaaggatgcactggtcctctgttcccagtttggtgaatgcacttctacggtagtaatcagcggctacggttcatgctgccgccgcatcttatctgctagtagaaatcaagcttgccatacgttcgtaactgaggacaactgaaaaatggaatgtggcatcaggaggttgtatttggtacggctgccgagggtcaaggctaggtgtgtatgcaatatacataaacaaggtatatatatgtattatatgttttgtacttttgtggaaaaaagatgatgatgatacccttcgtgatggtttggtagtagacttgtgccgtcgcctgaacacttacatgcctgtggggcgtgttgtaaaaataatgtaagtatgcagcaaatgcggttggttttggtgtttgtgggcttggcccatgtatatggttacggagaaggtttttggtcgaagggcctaagatgttttctagttcttgtgctaggataaggagatcaaaggggtgtttgatttctagagactaatttttagtctctctattttattttattttagtctctaaattgtcaaatatagaaactaaaatagagttttagttttcgtatttagcaatttaaggactaaaattgaataaaataaagggactaaaaattagtctctaaaaccaaacaccctctgaaataatttgaagggctgtgattttcgtccttagatctccgtcagtctgtctgctttgtatgattgcttcgtccagactaggaaagcagatgatgccgaagaataagatgtagtgaagcaaacttcagcgacaacataaaatgcaaagaccttcatttaaaaagcatcgtccaaaggaaacctcgaccagagagatgtgtgtgattgtacgtatagagaaatatcggaaatgtacaacagcgaaatatcgggaatgtacaaccagaaatgtgaagcgttactctataaaggagaggagtaaaaatgtaattctacataatgttgtatagtaactnaaccctataaatagaacaatcggtcattggcaaaatttgcatctgcgtcattatgtatcatctgagagcttctgaagctataatcccatttctggagcttccgtctatattcgagtatgtctctcgttgttccatcgtattccaagcatatatacatattcttgtgctatatagtttagctttgattcactacttgccttnaagattgtgctcttgaatgaagataaccatgagaacgtattcgaaagtgacatatgatgggtcccgcctctaggcccacggctcctaagaaataaaagcaccccaaaaaagtcatagtcgacccctaaggcatggacgaaccttagctaaccccatgagataatctccgccccgtccgagggtggaaccttggtgcgagatgagaacgtccgaaggtagggcaagacggaggcgtacctaggggttagccgaatcgaacatggtttcgagagtcgggtgaatcggacatgacccaaaggtcgacagtacaaagtctgaccgctccatacctagcctccactatcgcaatagttaccacggcatggtgcggaatggggaccatccttgtttttcctaaccccatatcaattacatctaaatcgattgtagactttacgtccctcgtacagggatgagataggacgcaacagaccaactacaaggtatggaggatcgagggaggtggagagtacgatcgacccttccatcgtgctagcccactctaggggtgtgtgccaccactacgggtgacactgtgctgacaactccaacatggacccccatcggagctagggacgtacaccggtataggacactacacctgcacgcacggtatgggaccgccttgaccgagatgaatcagcatatacaagattgtaggacaaacacgatgaggaggaaagatgtgatcaatcggaatgtagggcttctacccttttgacttatttttccctccttttcaatagaggaacggttgtaactcaccctgacctttagatataaaagggagggcaggtaactaagggcaggagagatcgaaccagagacttgggagcttttccctctcttgcctagcttgtaacccatactacgagcaatcgagtgttggtagcacaagccactgaagattggagtagggacgttccgtccgaaccagtataaacccttgtgtcctactcgcacaccaaggcg

SEQ ID NO: 13538 - DNA, 1779 bp, Zea mays
ggaagtgcagcgtctagccccacagcaaacgcctccaacatggcatcatcaacaatgtgcagaacttcgcgcatatggcgtatgcgcatggaaacggtatgctccataccttgcaattgatttgcagatcgaagttgatgttctttgcaagaacatcaagagttcttccctccttttttctgatttctcccttgagacagtgatgataacgtgttgaactctattgcagtgctcagtggcaaatggagaaagacaaaagagagagacaaatgatagggatagttatttattgcagtatactgtagtatttatacaaaagttcccaaggaatatgtcctttgggaaataactgtcatcatgacagatggatggattagatcacatttacaaaatgttttgtaacaagaaccagctttacttacatgagcccatccgacgtggcagggaaccaccccgctcccagtcgcgcccgatgcctcccagtccaagaaagaacggagcaggccgcaggcgatacatacgacgcgatgacggcacggtcccaccaggctgatccctcacggttctttcctattcctattccgctgtaccccagtccccacacacaaagcaccgactcactcggagtcggccactctcaccggccgcggcgcccgcaaccgacctcccctccaggcgaccgcatggcggagcgggagcggaagcggaagcgagcggcggaggagtgggagaggcggaagaggggcaggaagagggagaaggagaggcaggtggggtgggcgagcgaccccgttgaggcgcttggggaagatgtgatggggcgggtgatggagttcctggacgcgcgcagcgtggcacgatgcaccgcagtctcctgcgcttggcgcggggtagcggcagacaaccgcctctgggcacctatgtgtactgaattgatggcgggaaaggctcatatcccacgtttaacatcgatccgcactggatccaagttgtctacatattcaatggtcattatggatgggaaacggagtcggatcacaaaagaggatctctgcgatcatgcgtgggaatatcgtttcaccatagcagcacctgattactggaggaaccttgatccatcatggaagcacactggtccacctatgcgacgctacttccaccccgatggctaccacagtgcagaccctcatgacgccgtgtggggtggccatgagtgcacctacaccgtcataacgagctttgtcgacgatggccagatcagggagcactacgtgaggatcaaccggtggccgccgatgaaggtgtcaaggaaggacgactggagctgggagctatcgaaccacctgtaccgctataacagcatacctgattcccacaggaaaggatgcactggtcctctgttcccagtttggtgaatgcacttctacggtagtaatcagcggctacggttcatgcatgctgccgcatcttatctgctagtagaaatcaagcttgtcatacgttcgtaactgaggacaactgaaaaatggaatgtggcatcaggaggttgtatttggtacggctgccgagggtcaaggctaggtgtgtatgcaatatacataaacaaggtatatatatgtattatatgttttgtacttttgtggcattgtgatgatgatgatacccttcgtgatggtttggtagtagacttgtgccgtcgcctgaacacttacatgcctgtggggcgtgttgtaaaaataatgtaagtatgcagcaaatgcggcaaaaaaaaaaaaaaaa

SEQ ID NO: 13539 - DNA, 4041 bp, Zea mays
  misc_feature (318)..(318): n is a, c, g, or t
  misc_feature (3147)..(3147): n is a, c, g, or t
gagatatatcaaacggacctaaatccttttgtatgaactatcaactgtgataatgcgcaatgtgacaagcacatagctcaacctgctttccctatgtttattattgattgttatggtttctgccaaacaactaaattgctatcataattgtctaatcatcactcttttgggacactattgttttcattctaaaatttacatattttctccattgtgtcaattttttttattatatattgaacaagttcttgtcaggttgctgtaaagtgtgctatctggactaaagaactgacaaacttccattaccatttgactctncaggagaacagctcgtcctaggtcacttcttacagttgatgagtccgtgaaacagcaacaacagtgcaaatcgctcctttccaatgggcaaagccacatgatactagcagatacaacattgaactgtgaatcatctttgaagattccagaagatatgttgcgtcccgcgtggccggccgggaatgaatccttgcatgaaatgggtattaaggaccaggagtcagacatggatcttcgtacaagcatggaagatgacaaattcattagcaatggaaatctacgtttaccaggttcactagtatcacatgttcttgaagatactagagctccagattctgtattagaaggctctgtgcaacttggccctcctttagaaggtggtcctactacgatgagctctgtgcagtttggcaactgcacaagtgaagcatcttcggaacattcctttgcagagcaatgtgaggtgcctgcctcatgtattgattcagttgactatatggatgttgatactgaagctggtgcagaagttgagagatgcgacgaacaaagacctgtcttaaatgattcagttggaaggccgaataataacacagcaaccccaactgcgaatggggtgccaggagaacccaaaccatcattttcctctggtttttttgataagccctcaagaaaaagatcttcctttacagaagaggctagtgctggttctcctcgaaagttaaatggctattgcaatggacatatcagcagtctagagcaagaagttctttgcaactctggaagtgaaaagtgcaatggagatgcacccgttacatccagtaatggcaaattctgtgcagctaatgttgatatgcaatctatcgatgattcgttgcatgaagacaagcgagatgtgccttctgtttctcatggctttgagccaagaccttacaagctacaatcagacagcaacaacaattgcggtaggacatgcaatgggaaacctaaagcttgccaaggggacatgtcatttttacctcggggcttccttggaaggcctagttctagaggaatttcagtcaaagcagatgatagcttgccatttagcactgacgcatcatcatcctttgggaatggaaacagtaagtcaagtaacaactcatcttctatgggtggcttgtctcctggtttccttacaagacaccgcagggaatccacagtcataggcacaagctctgacattccaatggataaaaaatctaatggcgccacagtagtgccagatcatgcaggaaaaaaggtttcagattgtacgacgaatggctcttcattccaaataagagcagcctccgaccaccttgattgaaatggccttgcaattttgaccacaaaaaacaacagctgtggacaagaaaatgacagtaatggagccccaggcatgagttatgatgggtctgaacatgatggactgagccgacgaataacctcaatttttttagctggatggtattgatgcccaataaaagcatgactgcattgttatagaatagaggccatttcgagcacacaagtgagaactgagagcctgtgtgatcatgtcatggctggtatataaactgatgaagggctgtgagctacgaagtaaatgctatgcaattagggcaagcattgtttgcttgatagaaatttttcctctttcgccacgtggctccctcatatcagatgggtagaggggtatctgggtttccacacaatttgcagaaacccagatgctcccctaatgccacgctattttgttggcattagcgttaggtacatagctgagcgtaggcctactaccgtccccttaattcatagcttaaataaactggaactgctgactcctccggtgtcctgaaagctgaatcaattgcagagtgataagaggaaattctcatggctttcacctttatattttacattcctttgcctcgcatgatatattttgctggtgtttactgtgcgatgatggatgaaactctcaacgtgagttcttctgttagcttcaaaatacataagtttctagcgactcaatgatttcctcgcattggcatgagtgtgtacattgccttattttgttcctgttcatgtattttgaaactgtgaattgttcgaagttacctacatcctcatgcattgtgtagccattagatggtgtttttaaggccagttttagttcgttccattctaatttattttagcaagttctaggctgacctatagacccaaaccacgtgggatttagggatttgcaatttcgcatcatccttctggtcttctggtctgttcatggcatttctacacgggattgttcatgtcatttttaaaagggatacaataggctgcatttgttgcatcctttccgttcacgtcgattataggcaatttaacagtatattaaacttattagctttgggcaccttagtcgaactgtgggaatacttagtaatataaaactgtatattcgttttatgttgttgatactgtagaggatgcattttttgtacgcaattcaattgttaaattgatttggtagggaataatgtaattatcatgcattaattgttatacttgtagtgcgatattgttaatatatatctcatccgtccaaatataaatccttttaactttaatcaaatatatataaaaaaatattaatatttaaagtatgtgataagtgtttttttcttgaaaagtgcaggagaactaagtactaatcatatattagaaggaaaggaaaaagtctaagaagacctaaaatataaaatacttctcacggaggccagaaagacctatacagatagagatccntaacacatcaaaaaaactaaaaccaactagccgaagcccctaatcagtaggagaagcggtagcaaaaaaaggaaagacctttggcaccaacaatctttcatttttgtattttcttaaatccatctcgaattaatcatcaacttaggactccctgacagcttgtattgtgattgcgagtgagactcttgcgtggctacttctccggactcgcgacggcgactcaggactctctgaggagctgccgctcgtattgcgattgcgagtgagactctacttctccggactcacgtcgacgccgtttccccagccctgccgccggtgtcgacattgcctcactcgtaattctttgctgtgatttaaatagttttaaaaactaattttaatttaaataataaataaaattagttatctaaatgccttctaaagtattataacctgactctacgattttctgaagcacctaataatctgctccaccaactccacatttactcgagttaaagcttcccaaataacgccttagttagaacatgtagtttatttgagaagttcgtgaaaaacattttctatatgtttgacacaacttctatttaaatatatgaagaatctgcgaaaataaattatactaaacaaggtcatagaatttttaatatttcaaacggtctacctttattaaaatcaaaatcatttgtaattagtaaatagtggtaaaaataagtttgaaatagttttgcagacataaataaaaatactagaaatctaattcggctacctctatttgctatttaaattaaattaaaatattaatacggatattcatattaaccttttagctcggataatttagttttctaaacatatatattaagcttcctctatttactatttatatcg

SEQ ID NO: 13540 - DNA, 2445 bp, Zea mays
caattgcgacgcgaatggtatgcatgggcgacctaatttcattatgtggcttcgggaccctgtaagtcttaattatgtggctccgagagctaatttcagttaactaatattacaaaatttgctaatgctttgtggcataattgacagtttggggaggaaatgaatttgaatgatgacttacgtcagttagctattggaagcataactgccaaaagctatggacgttacgacgtcaatggatatctctttcgagagctgttgagcgcggtacatggagatgaggtaacatatcttgtacaaataaatttctttacatatttacaaataaatcttgagttgtatgtaccaggatgagcagcacactgaggagcagcacattgaggaggagcagcacaatgaggctgagcagcacaatgaggaggtggagcacaatgaggaggtggagcacgggacatgggaccaggccgcacagcatcaccagccatgggaccagtgggaccaccagagagagcagcaacaggcgtgggaccagtggggccaacagggcgaaccggctgacaacccgatggatgatggctcgggaggctcttcagcgacacgcacacgtcgctcaagaaaaagccactcagtaaagcctcgtcacgcgatagagcgagaggctgataggactttaatcatgccacatggagatcggtgagtgtaatatattaacttatctcatataactattatgtgtattgttaatgtttttgtgtaatgcaggaattgggaggacctgtcctttgacggcaagggacaccacactcaggttaaccttacgttgggttctctttgccgccttcactaccctggtatagtgaaggtgtcaaacggtgataccgaggatgaggtgctcgtcagtacctgggacgagtacaagtttaaaaaggaacgaaaccacaccgacagacagggacttgtgcgtaatgacttttgggtatgaattctttattatttttgttatgtttcttaatattgtaaatctatgacttataccattgtatttgtattctttatgttgtagcttcgatatcggttgcctgacggagaggattacatggggcacgctgaacgtgtcttccaaaacaatgcaaagaagctggtgaaggatgccatatactatgcgagaattcaggctacaaacctgtattttcaaaagcatccggaagaagcaggccccttgaataaaaaggaagggtcctcaaagatatatttgactgaggatcaatatcgtgaggttagtattcaatttgttttaccctttatattgattgttgtgattgatataatatgtaacattgtgtgtgtgcaggtgatggttccatggatggcgcccgtgcctgatgcgtactatgcttggtgtcgatattgggcttccgaaggcttccagaaagcgtcagcgcatcacagacaatgtcgaggaaccaatcctaaccacaagtttggcggtgacgacatgatacgaaaagctaaaagaatggtaagtttgatctatctatgtcgatcaacaaataatacgattgcttatgaatgttttttgtttatacaggaagctacgagtggccaaaagcctagtgacattgaggtctaccaggagggccacaaaggaccagacccgaacaaccctgaccagctctgcagccagacagccacggatcgcttggtgagttttggctcaaaagttcaaacgttcaaagtatataaattcctgcatttgtaaggttgtgaatgatgtataggcggcatatggggaggagatggttcgtcgccatggccctgacttcgactggcgccatgaaccggtggatccctcggtggtgtacgcaagtggtggtggcaaagcgcatggacggtaagctctaacttatgaaattatatggttgacactaaattgattatgcagtaataactttttttgaatcacttatagatacgcactcttcgacggattcattgactcgtcgtcggtgagatctcagaggacgggttcgtcttcccgtagctcatgctctcgtcgaccgaacgagcaggagttggagattatgaggatgcgtgaagagatgagacaacaacgcgaatttatggaggattgcaacgctcataatcaagcgatgtatcaagtgagtacacataatccaaaatctaaattattatatttcaatacaacatcttcaatagtaacacatatgtttaacaattaatgcagcaatagggcatgacaccaaatattccaccgccaccacaatggagccagtttgcatccacaccagctccgggacgttaatcttagcaaattcagttaataacattgtctaaactagcaattcatctagttagtgcagtagcaaaacatgaactgtgtacttaacttgttgaatattcattaaatagggagtggggactcaa

SEQ ID NO: 13541 - DNA, 2535 bp, Zea mays
  misc_feature (2535)..(2535): n is a, c, g, or t
ttcatgaaaattcatctctggaatatacagtgcatcactaccaaaacggatcctaaaatggactggaacctgtataagaatttcgaagatggcagatgaacttctgtggcgtatccaggtgaatgcatactgcttttaaccatataaaacttaaatattgcttggattgtctattctggcaacaacattatttcatccaacagctacatttgccatctacaataaccaagtacaatcatgcagaggctcttttttctaaatggtgatcaagatctttcttcatttctatcagtggaatttggtatagtgaagtttccagactatgtttgcagcatctcccatcgcatttttcaagaaagaaatgatctacttgagtacgaagacgtaagattttgaccccttttcaaaaagaacagtgagccactcattgatcatgtttaatatcttacattgcaaacaggctattcgagttgctcaggtgatggatgaatcccttgataataataaaatggacttggtgacaagatgcatcgatttatctgagaatcgattatgcattatgccaaaacgagaaaacgcgattacacctgaacgtctcccatcattcttttctcgcttttcagcgtcctgggtctattcgaaaatactcacattaggtgtctctgtttatgaaagagaccgcaggtaagttgcaataactgctataattacggatcggatcaaacactctcattagatgcatggttttcgtgtttcatagaattttggttgaaagtggaaaccttagccacacaagcattcttttctgatgtgtttcactttcacacgccttctggtttatagtacatattgggacgttttaagtgtgatatgtgatagatacttgaacatgtgacgcaatggtaatttgttgcacttttacaggcccttctgttaaagggctcataaattctttgctcacaaacaatcttataaatcttgttagtttctggggatccaaatttcatgccaaccaaatttatataggtatgaagatgcagtcaggattctaaagacactacttagcacagttgcttgtgatagacggcgaggatattgggcattgaggctatccattgatttggagcatatgggtcgtccaaatgagagcctatccacagctgaaggaggggcaactgatccatgggtccgtgctggttcaaagttcgcgctgcaaaggagagttctgcgtttaagcaaacctccacgacgctggaaagttcccagttacgctgattatgttaagagaaatataagagaggtatatatcaccctcactgtcctcattgatggctaaacttcacttttttggtctggtgcatttccatgctaaataatctatgcttgttggtcgtcgattattaataggtaagcattgaaggaaggccattgaattgcgagacaggagcaaagaatgtattttacggttacgatggggaactttgtggggtagaacagttggctttacaatattatgctgatgaaggtggtggttggcaaggtacccattcggaaggtagcatttggatgactatctttggccttctaatgtgggatgtgatgttttcagacatacaagatgttttccagtctaaattccaggtatgtgacctatgaaccatgtttttattttgttctgaggcgcataaccatattccctgcaaagtcatcagaaacccaccctgtagcgtaattccttactagatctctgttgattttgtatgatatatagattgtttgttggaccttgtcaagatcttttttcttcgttccctactgttcttctcaactcttggtaccctacagtacgacttctttgttctcttgcagacagccccccttgatctgggaacagacgatttttacaaatctagagagaacattgcagaatctcagttgaagaggatacgggacggaatggccgaagagatgctaatcagctcatgggagctacatcaggggacatcctgccagggtgttaactgggcccgttattcgttaactgatctacgggctgttgttgcatgcgttggtggccaccgtttggcatcgctcctccgccatctagccgttgattacaggagctggtcgagtggaatgcccgatctgctgctatggcgtttccttgatgaaagaggtggaggtgaggctaaacttgtggaggtcaaaggacccagggaccagctgtcagagcaacagcgtgcatggattcttgttctcatggattttggatttgacgtggaagtttgcaaagtaagcccggtcaccaagcggagatagttcgcttgctaaatttagtctgattattacgatgcaaaatgtatttggttgattagatagaagggcaaatctgtaacgcataagcaatggcattgttgtcgtgttgcactgaagtaacagtcaagctctacttgacatgctatctataactttgagagggaaggatgcatttagttgtccgaatcggcacaagttagaagaggaaattctgataan

SEQ ID NO: 13542 - DNA, 1872 bp, Zea mays
actcttcctttcccgccgtataaattcgcccagccattgggtacctcgaggccggccggaccaacccccggcgccgagcagccatggacgcctccctcctcctctccgtcggcctcgcgctggtgctgatcccgctctccctctcgctcctcaaccggctgcgcctcggccgcctgccgcccggcccgcggccgtggcccgtcctgggcaacctgcgccagatcaagcccgtccggtgccggtgcttccaggagtgggcggagcggtacgggcccatcatctccgtctggttcgggtccggcctcaccgtcgtcgtctccacctcggagctggccaaggaggtgctcaaggagaacgaccagcagctcgcggaccggccgcggaaccgctccacccagcggttcagccgcaacgggcaggacctcatctgggccgactacggcccgcactacatcaaggtgcgcaagctctgcaacctcgagctcttcacgcccaggaggctcgaggcgctgcgccccatcagggaggacgaggtcaccgccatggtcgagtccgtgcaccgcgccgccactgccccgggtaatgaaggaaagccaatggtagtgaggaagcacctttctatggtggccttcaacaacataacaaggctggcatttgggaagcggttcatgaatgcaaacggtgacgttgacgaacaagggcgtgagtttaagactattgtgaacaacgggatcaagattggtgcatctctctccgttgctgagttcatttggtatttgagatggttgtgtccacttaatgaggagctttacaaaactcacaatgagagaagggaccgcctgacaatgaagatcattgatgagcacgctaagtctctcaaggagagtggcgccaagcagcactttgtggatgcactcttcactctcaaacaacagtatgaccttagtgaagacacagttattggacttctatgggatatgatcactgctggaatggacacaacagtcatctcagtcgagtgggcgatggcagagctggtcaggaaccccagggttcagaagaagctgcaagaggagctcgaccgtgtggttggccgtgaccgcgtcatgctggagaccgacttccagaacctcccctacctacaggccgttgtcaaggaatcactccggctgcacccgccgacgccagctcatgctcccgcacaaggccagctcgaacgtcaagatcggaggttacaacatccccaagggcgccaacgtgatggtgaacgtgtgggcggtggcgcgtgatcccaaggtctggagcaacccgctggagtacagaccggagcgcttcctggaggagaacatcgacatcaagggcagcgacttcagggtgctgccgttcggtgctggccggcgtgtgtgcccgggcgcgcagctcggcatcaacctcgtggcctccatgatcggacaccttctgcatcacttcgagtggtccctgccggagggcactagaccagaggacgtcaacatgatggagtcccccgggctcgtcacgttcatgggcacaccgctgcaagctgtcgtcaagccgcgcctggagaaggaggagctgtacaatagggtcccagttgagatgtgaggtgcctgcagccgctttgaattcactgctcgatttgtgtttttctcgctgctgcagctgctgcttctttcagctttaagctgttgaactgagttgttcgtgttgtaaaatatgaggtgctagatgcatttcgaatctcataaaattgttacatgtagtttgtcatagacttgcacaatgtgtctttatacaatagtataacacgattcaacaattccccttcaaaaaaaaaaaaaaaaaaaagcggcc

SEQ ID NO: 13543 - DNA, 3195 bp, Zea mays
gagtggcatgtaaatttggcatctttttaattgtatgatgaccattctttgtggtaatagcccaccttattggtctaccaagcattttctgttggcattgtaccagcttgaccaaaaacctgcaaccttaatttgatttgtcatcagctgtatctcataaatcatgttagggatcaactcatgggagttgggatagtataaatgtggtgacaacttacaaatgtacaaaatttaggtgtccattaatgcaaaattatgtagttcccttgtgcaatctgagaggttgccttgtggcattttgcaaaaatgttacctggatttgtctgatattctgaaggccagactatattaataccaatggagttctaaatgaatcaaacttgctgactttgagctcagtcaaaatggggactagattttaatccttaagcagactttaatataatattatcatttgattattgaaaaatcaatatatattgttatttcaatgcaatcagtgagtggatctaaactgattgctgcagcaatacagcattacccaaaaaggaggagttcaggtagtaaattgcatgggaaccatgtttcaggccgtggtattattctgaatggataatcagcactagtattagtttttattttctggtattcacgagaaaatattagtatcatattctccatccttgacatgttagctgcaaagcaaaccacttgctgatatttgactttatttagcacaatattgattgttccggtggctattgatgtaattcattaggcacccgttgtccttattctccttccctgttttgtaatattagatagcatttttacattctttagcaaacattctgctccattaatgtatttcatggaacagtctacagaaatggaattacaacatatttctgtggatgacattagtgaagcagtcagctatctactctgttagaacccaaaatcatagttttaaactgttacttaatcttatgttgtattcaggtaatgaaggaaagccaatggtagtgaggaagcacctttctatggtggccttcaacaacataacaaggctggcatttgggaagcggttcatgaatgcaaacggtgatgttgacgaacaagggcgtgagtttaagactattgtgaacaacgggatcaagattggtgcatctctctctgttgctgagttcatttggtatttgagatggttgtgtccacttaatgaggagctttacaaaactcacaatgagagaagggaccgcctgacaatgaagatcattgatgagcacgctaagtctctcaaggagagtggtgccaagcagcactttgtggatgcacttttcactctcaaacaacagtatgaccttagtgaagacacagttattggacttctatgggtacgttggatcacttttctcacagattactcatttgtagctggatttcttcttactagacaggatcccagtgaaaacctaattttttctataatgcacacatgctgcataccattgaatacggttattgatttataaaagttactgtatagttcagtatcagcttgtagtttgtgtcagagcgagacatcagtcttagggtaggtgcaaggaggtgggatttggaaactatgtatgtttattttgtagttggaaatggttgcactctatgttcattttacttttacctgccaccaacacgtggaatgtgcaaaggttaggccagttagctaatatgccactaggtgactgccaattgatttgtaaaaacaatcgatcctggtaattcttgatggtgctgcgagtactagtcttcctccgtttgttcatcatgttcaggatatgatcactgctggaatggacacaacagtcatctcagtcgagtgggcgatggcagaactggtcaggaaccctagggtgcagaagaagctgcaagaggagctcgaccgtgtggttggccgtgaccgcgtcatgctagagaccgacttccagaacctcccctacctacaggccgttgtcaaggaatcactccggctgcacccgccgacgccgctcatgctcccgcacaaggccagctcgaacgtcaagataggaggttacaacatccccaagggcgccaacgtgatggtgaacgtgtgggcggtggcgcgtgatcccaaggtctggagcaacccgctggagtacagaccggagcgcttcctggaggagaacatcgacatcaagggcagcgacttcagggtgctgccgttcggtgctggccggcgtgtgtgcccgggcgcgcagctcggcatcaacctcgtggcctccatgatcggacaccttctgcatcacttcgagtggtccctgccggagggcactagaccagaggacgtcaacatgatggagtcccccgggctcgtcacgttcatgggcacaccgctgcaagctgtcgtcaagccgcgcctggagaaggaggagctgtacaatagggtcccagttgagatgtgaggtgcctgctgccgctttgaattcactgctcgatttgtgtttttctcgctgctgctgctgcttcttctttcagctttaagctgttgaactgagttgttcgtgttgtaaaatatgaggtgctagatgcatttcgaatctcataaattgttacatgtagtttgtcatagacttgcacaatgtgtctttatacaatagtataacacgattcaacaattccccttcgaactgaaatttagtactgcgtttatatccatttacattgtggtattacatttaaaaaaaacatgggggagaccccctactaggatttatgagaaagcgaaagtggttacagagaaaatcaagaaaactacacctaggcttctagccatcaactaagaagataacgaaattagacttttgcttggagactgactcctgcaaactcttctgcaaagatgtctttacaccgctccaaggttaccggtctgttcttgagttatgggacaatccacattgtccaggacatcgaagttagaatctcactagtatctaacgcgcgccctgcgcgccgtatttttttatattcttatcaaaatttatatataaaataaaaggaagaatgatatatatataggtattgttataacataactttgttaattttttataattaaactgaagatacgatgatatgcataccaatttgaagttatgcattatgaaaatatat

SEQ ID NO: 13544 - DNA, 1772 bp, Zea mays
agcaaccaaaatcaaaccaagcaaagcgcaccgcaggcggcgccagccagcggcagtagcttgcttacctggtccccgcccccacacctcttcccttcccttctccctcccatcacacaactccatctccaccccgtgaccgacccacccatccatggcggcggcgcccaagtccatcgagcggctgccggcgcgccgggtggtcccggccgagcccacgccagccggcccgctccgcctctcctggctggaccggtaccccacgcagatggcgctgatcgagtcgctccacgtcttcaaggcggcccccgaccggccggccgccgccggaggcccagcccggccgggaccatcgagcgcgccctcgcccgcgcattggtccactactaccctctggcgggccgcctggtcctgtcggagtccggcgcgcagcaggccgtggactgcagcaacgccggcgtgtggttcacggaggcccaggccgcctgcacgctcgaggacgtggactacctggaggccccgctgatggtgcccaaggacgacctcctcccgcccaccccggccgccgaggacgagcgcgcgctggtcctgctcgtccaggtcaccgccttcgcgtgcggcggcttcctcgtgggcttccgcttcagccacgccgtcgccgacggcccgggcgccgcgcagttcatgaccgcggtcggggagctggcccgcgccagcgccggaggcgccggcgccggcgcggtgtcggtggagccgcagtggggccgcgacgcgatcccggacccggcggcggcgctggtggggcggctcccgacccccgacgccggcaccaggcggctggcgtacctcgccatggacatctccgccgactacatcgggcactacaaggcggagtacagcgcggcgcacgcggcgggcgccgggtggtgctccgcgttcgaggtgctcatcgccaaggcgtggcggagccgcacccgcgcggcggggttcgagccggacaccctcgtccacgtctgcttcgccgtgaacgcgcggcccgcgctgcacggctcgctcccgcgcggaggcgccgggttctacggcaactgctactacatcatgcgcgtgtcggcgcccgcggggaaggtggcgggctcctcggtggcggaggtggtgcggatcgtcaaggacggcaagcggcggatgcccgcggagttcgcgcggtgggcgacgggcgaggccggcgccgccggcgtcgacccgtaccagatcacggccgactaccgcacgctgctggtgtccgactggacgcgcctcggcttcgcggaggtggactacggctggggcccgcccgcgcacgtcgtgccgctcaccaacctggactacatcgccacgtgcatcctggtgaagccgtgggcgcacaagcccggggcgaggctcatcacgcagtgcgtcaccccggaccgcgtcgccgccttccacgacggcatgctcgacaccagctgctgagctgagcagctctgcctgcctgtgctggattcgaggaaggcaggattggtattggattggatggggggtgggggagcgtggatgcattggttggtggtgattgtttgtcagtgtgtgtgtgttacctgctgaataactcccagaccccctcgattcagggagtttgggggagctgagctgtgttacctactcgcaccaatattgaattattcatctccgaaaaaaaggagatcaattaaccgtatgtttggttgtggaaaaaaaaaaaaaaaaaaaaaccgatt

SEQ ID NO: 13545 - DNA, 8589 bp, Zea mays
  misc_feature (2730)..(2730): n is a, c, g, or t
  misc_feature (3583)..(3583): n is a, c, g, or t
  misc_feature (5857)..(5857): n is a, c, g, or t
tgaagatctggtttacattttttttttcagctgaacaaatacagctccatagactctactcgaaagaggccacggccggaagcaacataaaaactgttgctgaaactttagattttagtgaaatggagtttgtgcaacaatccatactgacacttgtttcagcagtacttaatcagaaaacatgcatatcagtactttttgatcggttgttgcagtacaactacctcatgcttttccggatttccagctggttggttgaccccgtgcagcaatgtcagcaaatcagactatataatttttaatgttgctgggagaatgtgcagaagcagggatcccgtttttttggttttgtttcttcattttcattgcaaagagaagacgagcaaacagaagagatgagagacgtgtgacgtgagtggcgtgaccgggtcatcatccaccgatccacggcacacgcaaacgtaaaaatcgtgccgccgccgacctgacgagacaggtttggcggacgcgctccgaatccggcacgcgtacggccggtgcctcggtctcgactctcgccgccgcgcgtgtggcggacgagcgcgcacgcggtcgagcgcgtcgtcgctgcgccgtgccgtgccgtgccgcatttgcgcggtcgcgcccgcagcggatcgatcagacgtttttctcgcttgcagacagccaccgcgtcacccaacacataccaaagcatgacgcgatcacgagcggccattgcaaggacgtgactcggactcactctgacgtcctactcgttggcagctccccgtcgaagcgtcgacagcatcctaggctcctagccactatagtcgtcacggccgcgtaagtgagtatgagtctgtttgagacagctcagctcaatgatttcaattcttcgtcagagtgattttaagtaatcatctagtagaattaaatctaattggcgtaaaacattcgataaatagccgagaatgatttttaaggggttggagagtaaggaacaggagcacgtcgggagcactgtaagtacaaaacagataatattcgcttccaccacagagcatgttagctttttgttgtctgttacttgagagtgattttcgctgtaaacggagctacaatatatttcgtctgttggtgggtgttgaaaaccaaaattatctatcttataaagtatactcctactttgttccagtgtaatacctagaacgaactttattttctgattatgcgtgcaaaggggctacgagcctatacttcgatgatacttttaaaaaaggcagatatctcacataagtccgtaaaaagtttattaggactagtttataaatccataactttctataattgaaggatattattaaggggaagtaaacatttcccccctaaaccccaacggatttaagtttcaaactagtcctaatgtagaggctctttatgaacatgtagactaatccattaccgtgtactgcctgtccaaagtcaaaatttgttttaggtaattcattttgatttatagaatactggatacatgtgttttatttatatgtctagatctcattatatgtatttaagtgtacgtataaaaaccaataggtaaaatgaatactatgttggaacaggatgatgtaatataaataaacatcatttaccatttagtacaataccaccagcagtattagttagtgtaatggaaatcgctatcttcatcgcacgtacgactcgtgtctccgtcatcacgtccatctgataggtggttgagacatccagtgctcctccccccggatggtgacgtggtgactgtgcgccgtccatgcacgtagccctacacttgcatgtctaggtgacgtgactcgtgtggtaatggagtttttagtttccaaatactaatatttagtcactctatttccttatgttttagtttgtaaattgataaatatgaaaattaaaatatagtttagctttattaatttagagattaaaattaaataaaatagaatggctaaaaattagtgtctagaaacggacacacacctcctaaatgtgtgtgtgcccaagtttccgaacggcgtgtttggtcgtccgccacgcaggttcagtggttctcgagcaaacgcagagacgaatgatttgttgaattgttgctcttctttttctagaagggagaaagtatattttgaatgctgggatgaactgcgctagcgtgaaacccgttgtctctagaagccgccgccgaacctgctaccgcatatatatggcggtacgaaaatttgccggtcgattagctacgacagcctacagcctacaccagaggacgaaaatttagagagaccaaaaagtccacgtaagagccatgattttctagttcgccaagtccaccgatcgcaggggataagtcatatcgttgcgacgagcgagatctagcttatcgagtggatcgacgtcacgagaaaaataggacaagggacggaggcgctaggaagtggcaaagtcgggtggcgttacatcgggaatgggtcggcggcagaaatggggcagcgaacagactgatttaggtggtatcggaagattatagtcagattggtaaatataaagactgaaccgagaggatccagcgagcagtctcataacatggtgtagctacagccgtacacaaggtttaatttcgaaaagaattgttgaagctaacctaaagctagtatacaattctccaaagtacggaatttngcacaagacacgcagcatatttcacgcggcaagcagctcgatctccctcgagtgtccgaaccagattacaatacgcgacagtttatccggacgagagaatacaggccaacacatccaacccatgcgacacgtcacgcgtgatcgcggcacgtatgcttgatacgcttgccatgcacacagcgtcagcgatctcgtagtagactgctcgtgtttgagttgatcttgtccgttttcgtcctgttccagacctggatggggagtagcgcccacagatagctcgccagctcaaaaaaccgacttcagcacataccccatccatcctaggataaaagaaagcactggtctcgtttttttactttttctttaatgaacagccaattaatgtttaactaagggctagtttggacaccattttcccaagaaagcttctagttttcaaacggaaaatgaactaatttcccttttaaaaatgaaaatctcttgggaaaatagtattcccaaactagccctaaatatactattctaccaattgacttcgcgccatttgatggatgattatatggaatatacgtatctaacacgtgaccggccgcgccgagagcgctcggtcagcagtggagagcctggaaatgttcagccaggaaatcgcgcgcggccggccggcgaccacctcggagggaaacgcgggcgccgctctgtgacctgccgacggccgacgcggacgccatcatttgcgaggaaaaattctggtggctccgacgccgctctctctcgccggtcgtcaccctgtcatattggcctcggcctcgaccagatttcacgctaatctgaaaggtatgtaaatttcttcatnaatccgctccaattccgaagggtatttaaatttctaaactagccctcattgttgtactgctcgctccatttcaaatggcgagcgcagatatatatgctcgttttctacgtttgacatagcttagaagtttacatgctatacagtactaattttttgtttagtttttttttatatttcgaaatttaaaattcagaattttcgaatggctcaatatcaaatttaaaacgtcttacagcggcggagtcagagcagtgtatagcagcatatcctgacgatatttccattccaaccaactcgtccaagccagcagggcagcagctgccgtcacgagggccccgcagcgtggccgcagtatcgtcaccaaccgcgtcacctcccacgcccccatcacttcccccgccccacgtgctgccgtcacggactggccgtcacgactcacgaccagtgacctggggcgtgacgggcccaccgaagcacctcaaccgcggctgacgccccgccacgccaccgcggctcgcgcgaacaaacgcggtcaccgtcgtcccctccgccaccaccagattacgccatccccgtcccccgctgacctcaccacccttttatatatcaggatctgccagcccgccctgcccatgcccatccatcatcacacgacgacgcacacaagtcgcagctagctagctcccaaccgagccaggaaaacggacgccgtgcagctcgctcgcgcgcgccccacggaaagagagggcaggtaggaataatgtaccaggccatcccgtacagcgccggccagccgtggccgcggccggccccgacgatcggtcctgacgtggcggaggaggaggggttgctggcggcttcgcagcagcaggcgtcgacgccagcggaggcggcggcgagggtggaggaggaggaggtgcggcgcgcggtggcggagtgccccgtgctcgtggtgggcgtgcgcgggtgctgcctcagccacgtggtgaagcggctgctgcaggggctcggggtgaaccccgccgtgcacgaggtggccggcgccgaggcggacctcgcggccgccggggtcgccgccctcccggcggtgttcgtcgggggcaggctgctcgggggcctcgaccggctcatggccgcgcacatctccggcgacctcgtccccatactcaaggacgccggcgcgctgtggctctgacacgagcagccaccaagctagccgccctctgattgcctctccgtcgtcagctgctttgctttgaattaaacgatggtggtgttgtcaactcgtttttatttactcattgactagagatagacatgcacataggacttcaattcttgtacttgtactactagggaaaagagagtgaattatagtactttaatattatttgttacttgtattttccatcctgtgaatacgaaataccgactccagcttctgtttgttctggacgtgtgccatagacagccgtacagtagcagtcggtacagtgcacgaacggtacaggccgtcggcagccggctggattgtgtgatcgatcttcctccatacaaacttccgtagtggccgttcggttattacggaagggagctctggaacaatttctatctcaattatttctctaatttatataaatttttattagctggaataatttttggtatattcatgtgtaaatgaatagagccttactttttttttgttcaaaaaaaaacacacaagtggtggacaatgacgcgcgtgtgaatgagtgatcatcattacgtaccgcgacgtacgtgccagctcagcgtgatcacaaatggatttcgttttgaatttcctagtccagacatcatttgccgacgaagcacctgggacaaaacttgcacgagatcaacaaccgcgctggaagaaatgatccggaaaggatgagctgtatagctgctgcctgctggggaaagaaaagtcgagaaaatactggcccggacacgatcgcagagatcgacgtgatgtggactttgctccgagctagcagaaaacactcgtcgtcgaaattataaagagagttaagatgtcaggatccccgcagtgaggtcagcacgaatcacggacggcagagcaagcaattaagcaaatcctaacaacccgagatacacgtggcccgacaaaatcgagaaaacgacttaggaaaatcatatctggagagtttcattttcattattctagtaacattagtctttagaaaccatacatccctataactataaaccaccgcctccatggccgcnggttgtttatatttccaacgcgacgcaccatggatggattcatgaatcgtgatggtggtggtcggtggacgacgactttttgttcaccctgcgttgttgtcagcaactgttggccacgatcagataggtattgtttttcttttttctagagagacacgcggaggcaaagcatttctcaaagtgcagcacagtcatgatgccaacgttgcacttttagcaaagttaacatcagaactaacggtaatctaatgtagagaaccaaatttacatctagtgtcaaattaaaaagatacattttagagacctaaaataaactacaaactttactagataaattatctctatttttccccaggcgttgtaactagtttttggtccacgtaacccttgggttgatgcaagagccacttcgttcccagcctcttgatactactactagtacaatattacatcacgacaaatactaacacgaggttttttttttttttctgacgtggatagcgcatcaatatccgcttaattggctcgctgcaagcgcacagctggcctgatggtgatggatagttggatacggccgtttccctacgcagtgacaaatgtagacgagaatatagtcaggatcggtattgctaactttgctatatgatacaaatttcttaaactttaacattgctttgttaaaggatttttaaattttactagggtcggctaatcacaacaaacctacctaaattcgtccatgttcctgcatacgtgccacctataaatggccttaaaatgatttgttttgtatcgtctatataatccacatcttctatatatatgcaaccaaacaggtattcagatatagttaacgcacgtgatggtgcagggtgagagtgcgaacaaccaatcacacgggtatatatatgcactcatgcctctgaatcctgcgtgcgagtggaaaacaacgagcttagctttttttttttttttttttgaaacgctaaatagatggcattgagtcactctgatcgaatctttgtagcagtaccaaacattgcgttttctttaccctttccaaaacaaacgaacacactaacaaaagcatgagcactaatgactaatgagcacgagtgacgcgtcgaggtggccttcggctccaaaccagtggctacctacccacgaagcagcagcacacagactaaacatctggatctaatcatagagcagagccgctagcaagaatcatgaggtgttcgttgcacttgcacatgcgtgaaagttgggcgcttccagtcctcccatgacgtcgtcttgtttctttctccttacagcagacttgatcataagcatgggctttttttttctgtccgatttgttagttcaaaaggcgttcggtgggaccgtggtattcccgcgttctccatcgaagatctcgtcgtaggaggccttaaagctggctcaacatctgaatcggagaacagatgtagcagaaggcaagaaaaaagttacttttaacaaagagttgggaactgcgaggctgccaggtgggggggggggggcctacgtagctgacgaacatttgccacgagcgagtgcgtcgagtcgagagcttaccgaaggaagaagtacggcaccgtgaaggacgaggagtggcagtccggcgcccgcccgcttcttcctcttgtcttctcttaaaataaagagcttttgtcatctctcaaggaaaaatatattgttatctagtggctgctctccatacaaagatgctaacactgaaatcaagttcgccgtactgttacgaagtttaattcagtaatggagtacataaaggccaaaggtactatgcttgtccgagaagatgccctgaagccagccattacttcctcacggcaccgaccttcttctgtcctatagagaatcaaaccatgaatcaaaatcttccgatgcagatgcatttgatggaccataacggatgggtacgctatcaagcggggtgctgttcgatgcttgtgcagttgtagtttgtttcggctcatttaagcatggtgaagtgtcttcgagcaaatcatccaccgaatcatgaattgatggtgtcacatcaattttcttagtgtatctgaagtcggtgttctggccagaatcagccgtcggttgagaagttatacattgcgtagcaaagccttcgttctgtgcagcagtatgagaagtctctgaaagcaagtcatctagagcatcgtcgagaggtgcaagcaaaggtggtccggaagacaagctaggtccaaccttctcattggaccgactgatctcttgcaaagttgaaacgggctcaaatggttcgtccaagttggagctggaaaggtgagttccgccaaatgaatcgaggagcatgtcaagttcttcttctgcagcgcccacctcaaacatcaaccctttgctatggcttgtaccaggatcagtatccatgacttgcttgtagctcttgtcttcactatctgaattcactgaatgagtactaacctttgtagatgctgtattttctcgtgcaaaacattgcggctgacgttctgtttttatctgatcatcagcacagatgttgctggcagactcatgatgacttgtatcttttctgggttcaaagttcaagttatgtccaactgaactgcctttagcgtcaatttccacagaggtgtcaagttcaatcgctatttcattgtcttctgatgcatcagccatagcctcaggaaata

SEQ ID NO: 13546 - DNA, 1716 bp, Zea mays
  misc_feature (16)..(16): n is a, c, g, or t
gcacgagaccattacntagaacatcctaatcgaaaagtggtgaagagagcagcagacacgggcaacggcaatgatgggttggggtagagggagacacggagagggacacactgctccgcccactggccactgccaatcatggatccatccgccgctcccatcactcgctctcgcgcgcgttccaatctcgatatcttctctttttttttcgcgcgcgcacggcgatggccccagcaatcccggtatcgcgccgcagacgacgagcggcgacgggatggcggcgctgctggccggcggcgagggcgagcacaaggaggtgcgcggcaggctggccgcggcgtacgagcggcacattgcgccggcggtgaagctggacgtctgcgcccgggaggcgacgcccggcgggccagcaggcggcgtcgcggcgcgcgtcgaaggcggcgtcggagtggacgacggggtggtggacgcagttcgcggtgctggtgcagcgcgggctcaaggagcggcgtcacgagtcgttcaacaagctgcgcgtgttccaggtgctgagcgtggcggcgctggcggggctgctgtggtggcgcacgccggcgtcgcacctgcaggaccggacggcgctcgtcttcttcttctccgtcttctggggcttcttcccgctctacaacgccgtgttcacgttcccgctggagcggcccatgctgctcaaggagcgggcctcggggatgtaccgcctgtcctcctacgtggcgtcgcgcgccgccaccgacctgcccatggagctgggcctgcccacggcgttcgtgctcatcctctactggatgggcgggctggacccgcgcccggggcccttcctgctctccctcgccgtcgtgctctacagcgtgctggtggcgcagagcctcgggctcgccatcggcgccgtgctcatggacgtcaagcagggaaccacgttggcctccgtcatcaccatggtcttcctcatcgccggcgggtactacgtgcagcacatcccgcccttcgtcgcctggctcaggtggctcaactacagcttctactgctaccgcctcctgctcggcatccagttccccgacggcggagggtactacgactgcggccacggcgcgctctgccccgtcgccgagttcccggccatcaaggccgtcgggctcaacaaccattgggtcgacgcctgcgtcatggcgctcatgctcgtcggctaccgcgtcgtcgcgtacattgcgcttgaccgcctcaagcccaggtgaaacaagataagagaagagaagagaagggatcaattagtttagtgctctatgcataatacaaccagaggggatgaaatgaatacgatacaaacctgcagcagctgagctctctgttttactccattcacaagggtttccagaactcgtaagctttccttcggctcctacccagcttcccacagccatcgccgaatctcattctccggaacaaaagctccgcgtcgaatagaaccgaatccggtcgagctccgcgtgaccgagactctagactctggtctctggtgccctacccaccatggccatgccttgcagctctcaaacagtgttacgacagggcacgaagagacaatgtaacagaaatagattttctttccgtacaggagaatgtctatatgctcaaaaaaaaaaaaaaaaacatatgctgctagctgctctgctctactcaact

SEQ ID NO: 13547 - DNA, 897 bp, Zea mays
ggatggtgggcttttacccccggatgatagatggcaaccctctgcaatacaggaacgagaggtatgctaggggtaagaacggctacaatctgattctcacaggtgctgccttcatggacagggagtttgctttcaagacttactggagcgagaaagctcgcgaagggagggactatgtgcacaagaacttcaactgtgaggacttgctcatgaattttctgtatgcgaacgcaagctccacaaggactgtggagtatgtccaccctgcgtgggctatcgatacatccaagctttcttctgtggccattagccgggacacccagaaacactacgatatcagaacagattgcttggcaaagttctcctccatctatggccccctccctcagaaatgggagttcggcatgcgtgaagatcattgggacaaataggatcgcaatggtggtacacaacggattgtttaaaccttttttgttaatcccctagaaagttttgtagcttggggtctacggtgaagtttgtaggtcctttgggcagaagtgcccttggtttgtgatgtacctattatattcgcctagaagcttagaatctgatcaggaattcaggatagaccattgttcaaaagtttttgaagttaatgctgaaacagaccaaaggcagtgcagtatctgtgaattgtgaaaggcagagacagagagggaatttggagactgcatagggattagtgggtaggaagttcagacttcagattgttgggttcccttgtctctgcagtttgtgtacatgtcttcctttctaagattggactagcgtgttgtgtgattttttaccgaaagaaatctttttacagctcgtagtgtttttttatttcggtctaatgaggactttctgaaaaaa

SEQ ID NO: 13548 - DNA, 609 bp, Zea mays
tgacacccagaaacactacgatatcagaacagattgcttggcaaagttctcctccatctatggccccctccctcagaaatgggagttcggcatgcgtgaagatcattgggacaaataggatcgcaatggtggtacacaacggattgtttaaaccttttttgttaatcccctagaaagttttgtagcttggggtctacggtgaagtttgtaggtcctttgggcagaagtgcccttggtttgtgatgtacctattatattcgcctagaagcttagaatctgatcaggaattcaggatagaccattgttcaaaagtttttgaagttaatgctgaaacagaccaaaggcagtgcagtatatgtgaattgtgaaaggcagagacagagaatttggaaactgcatagggattagtgggtaggaatttcagattgttgggttcccttgtatctgcagtttgtgtacatgtcttcctttctaagattggactagcgtgttgtgtgattttttaccgtaagaattcgttttacagctcgcagtgttttttttttatttcggtctaatgaggactttctgaaccattggcttttttagctccgcgttgtcgtccactgg

SEQ ID NO: 13549 - DNA, 4204 bp, Zea mays
  misc_feature (4033)..(4033): n is a, c, g, or t
aatactaactctctctctctctctctctcttcttctctctctctctctctctctctctctctctctctaagatttatatgatgccagagggaaacaagaagaaggagctgcgcctttatcgtgctactaaggtttccctcgaatggacattggagaaggttcttgtcaataagccacttattgatgcctcgttagtccaatttgagggatactggtggctatttgcatctgattttacacggtatggtgttgagaagaatgcggaccttgagatttggtacagcaattctcctcttggtccttggactgagcacaagaaaaatcctatctacaaatcagacaaaagtttgggagctcgaaatggtgggagactcttcatttttgaagggtcattatatcgccccggccaggattgcagtggtacttatggccggatggttaagttgcacaaggttgaaaagctaagcaaggaggaatacaaagaggtccctgtaaatcttgggatagatgagccaaagaaagggagaaatgcatggaatggcatgaggtaccatcacatggatgcacaacaactcgcatctggtggatggattgctgtaatggatggtgatcgagtcccttcaggtgattcaaccagacgctctctcattggttacttagctttcctgttggccagtgcccttgtcgtttttgtgggttttatgaaaggtgcaatcagttgttacgttcctcccagtttatgggttcctctcacaaggagaacagaattatcccgtatcttctacgtgcaccgcttcaaccagaaagtccgcagatattctaccagcatcagcagatatatctctgctgctaaaaccaagctcagcgaaaagacttggtccaacgtgcttttcttctgtgtagttgctctatttggtgccataaatgtctgcattgccgtgcatttcttatgtggcggcaatggcgctgaagaggcgtacacatatcaagggcaacactcccagtttacgatgatcacaatgacatatgaagcccgtctctggaatttgaaagtgttcatcgaacactactctagatgtgaatcggttagggagatagttgttgtttggaacaaaggtaaccctccaagcagtgacgcgtttgactccactgtgcctgtgaggatacgggtcgaggagaccaattctcttaacaacagatttagggtggatcctctgataaagaccagagctgttcttgaactggacgatgatatcatgatgacttgcaccgacttagagaaaggatttagggtctggagagaacaccctgagcggatggtgggcttctacccccggatgatagatggcaaccctatgcagtacaggaatgagaggtacgctaggggtaagaatggatacaatctgatactcacaggtgctgccttcatggacaaagagtttgctttcaagacttactggagtgagaaggctcgtgaggggagggactatgtgcacaagaacttcaactgcgaggacttgctcatgaattttctgtatgcgaatgcaagctccaccacaaggaccgtggagtacgtccaccccgcatgggctatcgatacgtccaagctttcttctgttgccattagccgggacacccagaagcactatgacatcagaacggattgcttggcaaagttttcctccatatatggccccctccctcagaaatgggagttcggcatgcgtgaagaccgttgggacaaataggatggcgacggtggtacacgacggacaaacacatgatggtgaaaccttctctttttttttgtcagtcccctggaaagttttgtagcttcgggcgaaggtataggtccttcgggcagaagtgcccctggtttgtgatgtgcctattagatctggctagaagcttagacctgatcaggatagaccattgttcaaaagttgaggatagaccaaaggcagtgcagtgtatgtgtatgtgaattgtggaaggcaaagagggaatttgagaattgcatagtgggtggaaagtttagactgttgggttcccttctctgtagtttgtgtacatctcttcctttctaagattcagctagcatgttgtgtgattatttaccgtaaggattctttttacagctcgtagtgtttattatttcagtctaatgaggactttctgaatctttcttttctgagatccgcactgttgtctaaatagaatgatgtttgtcgtgctcagcggcttcatctgctgcgaccgtgtcaactgtcaatgttttgccatttcaattctgtaaccagttcacctcatctcctgtttccacttgcaaccgcttgtggtgaccactttctcaccgggaattcccgtttcgctgctgaccgagatgcgaatttcggctccaaattcaaaaatacaaaagtaaaaaattagtaaaaaaacgaaatttgatgcagtaaaaacgaaatggtgaacaccggtggtgaccattctccgcagacaggcgccctagcacgcacttcgcacatttctccacaggcaacgctggatcgagcacattaccgggcaaagtgcaggacaacaacataaccgccttaattttgcaacatagatacttcaaagaacaagaggaagatgtacaggcacgaacgaagactatcaaccgtgataagttttgttacttggtacaccactctcttcaaacacagctaattttcccaagcttggaacatgggaaaactttccacaaaggtttgagttacaacaatgacttaaatctaagtgaagtcatgacgccacacagctttcacagcctatttgtctgggttttatccgtactggcttttactgcctctctatataatgaaagcggcagcagactggctttaatctgaagcttatttcttctttcaggtaaactaaagggggcttcagaaacattctaaatcacctcgaattctgctgctggagtacccgtgaacttttcaagtaaaccataagctattgactggaaaagaagaaatcacctttacagtcctcttgctcaattttcaatcgcatctttatctccctcctgaaacatcagggaccattttccattaggattcagaaatagaagaattgacaaatgattatggtaccaaaaagtgagcaaacttggagcaaggcaattacctctactgcctcagtcagatttttggttgcatcttctctttttgagtatctgaaaataatagtacactctagcaatgagagaagactttgaagcaaagatactatataagtgtgtcaaataacacaggaagaatcaaaggatgaaataaaaattcaaatatatcatgccttttagcaagctcttgtttcttcatatcaggaggcttgccatcaaaaacataactgcacaaacaatgaagcaatccatttagaaggcaatatatttgtttacacatatttatgtcttacagtggcaacaaatggatggaagtcatgtttacactggcttgattcccgcttccaataaccttattgtccggttgaacattccttgcaaatgactgccgaacaaacaatttttttttcaaaaaaaataccagcactaggaatatagcgagtgcagcttcagatattaaacttgcttgaaacgatatatttatctgtacctagtgacttcaccagcttcatttgtgagagtttctatacctgtccttccaactacaatctgttcaagaaagtataaaaaaacccaacccaacccatggcagtaggtaactagcacggtagcatctcaagacgcacagaacacatgcaatgcaaccaatgcaattagttttcatcttttattttacttgagcaaaccaaacacgccaatcttgaaagtcgacccagttgaactaaaacaaaggagggtaagaagaatgcaagggctctgctttgataactttgccagttcattcagacattaaggaaagaaagaggatgtagattcctcatcgtacccacgggtaacccaccccaccaccacccaaaggaaagagcnataagaacgttccaaggtttaactatggtaaaccctagacccagttcaatttgaagagcaacagttccaagcaactcctatactaagcacaagcagaaaacaacgtgtgatggcccgtggccgccggcgagttgtggatcgccgcgacgtgagcgtggaagccgtcagaag

SEQ ID NO: 13550 - DNA, 651 bp, Zea mays
attcggcacgaggcagaaattgcttggaatgctggagagggaactggaagaccaaacggccgcgcgggtgcagaatccagttggggtgaggaagataagatggagtctgatgatcatccgaaagtcccaaaagaatcagacacatggaatacagggagatcaaatgaaagtccatgggataatactgatgcaccgcaggattcctgggttaagagtgcagctcgcaataacaacactcaggatggttcatgggataaagtagtatctatgaaggatcttgattcactccaagattcatggagtaaggcgacaatccagacgaatgatgcacagaatgattcttgggacaatgtggccaaaaatgccccggattctgccgcagaagactcctggggggctgcaacaccagcggagacaactgattctggtaacaaggagtggaaatcagatggatggggggcaaaatctggtaactggagcagccaaagaaataatcctgggagacccccaaggagaccagatgagaggggtccacctccaccaagacaacggttcgaactaacagttgcggagaagaacattcttcctagaagttgaacccattaaattacgtgtgaagaagcatcttccgtgaagcattgaacggtgtta

SEQ ID NO: 13551 - DNA, 3997 bp, Zea mays
  misc_feature (2082)..(2082): n is a, c, g, or t
  misc_feature (2142)..(2142): n is a, c, g, or t
  misc_feature (3119)..(3119): n is a, c, g, or t
  misc_feature (3126)..(3126): n is a, c, g, or t
ctgcagctttatggctccaatctatggagacagtcctcggacatacataccccttggcaataactttgctctgctgtctgtgctcgcttcgagcgagaccaacacaatcaactgatacgccaagtttttcatatgcaaaaaatcgatatagttactgagtatatcgaccgttttgataccttgatgcatcatattttagctcatgacccacattatagtgttacaactaatgtgaaatttataaaatccataaaaacaattgaaaagtccgtgagttatatagttttttttttaaagaacataggtaatatattgctcctttccttctttatgtttctcgtggacatcttgtgccgctttttatttcatataatttgagttactttgccaacttttttcaaagccaatttgtatgaattatcggcgtcggagtgatccaaacagtttgttgcaggcgcacaagcatgttgtgtacaatatcgataatgtttcggtttcgcaagaaacaggcccacactgctggaacatacaaaacctaggcagcatcgcgcgcgcgcacacacacgaagagcagaggatgcgaatccgtgacccataggaagcgccaagcggccatcaagttggtcgatcgcctccgtaaatccatgagaacgctagctgcaaaacccaacccaaccacaagtctcgtacgcgcagctagctagctggccggagatgccaaaggcgctagctttgcgagagatggaaacgcgactcctgcggccgcctgtatttctggtcggattcctccggtcgatttccgcaccctgcatcgccagatttcacgcgacgccgagcctggcgcgcaagaaaggaataatcgtttcgtttggacgacagcggcatgcacaaggaaggaggggctggggccggtgtgtggggaagaagaaggggagtgcaagtgcccgggggcatggatggaatggaatagaaggaaggaatcggccaatcgggggcgaagagccaaccgaaccggcactccaagtcaaagtcccaaggcccccggacgcccacgcggtttccattcccatcgcacccggtgccggtgggtcagtgggtggactggaatggaatacacaacacacggattgaatggaatggaatagcatgtaaaacggacggacgtcggaggcgaggcggcgtccgcctgcagcctgcctgagtgcccgtcgtgtcctgcgcacatgcaccagcgcacggcatggcatggcatggcatccaaaggagtgccgagcaagctggcggcgggcggcggcggaacagaacgccgcacccgaaccgtgcatcggaacgggacaaacgggatgagcggaggagctagctggggcgcggcggcaggagtgcaggacaggacacgcacgcacgcgatgccccgggcgatgtgtgtaatgtagcacagctgacagatcgcttgcgtgtgcacgtttccgttcagaacaacgcccagacagctcagctccgaacagcagcatggagcagcacggtgtcgacgtcacgcgctctcgcaaagatctctgtactgctctgctgtagtagcagcgcaagcaccgcatggcgaaccaatacatctccattctccaaggttgattaaactaatataataataataatgaattaatgatggcgatgatgacatgatcctagtagtacgttaccaccctactagctaaggtagtagcagtctgtctctgttgtagctcgcgcgcgcgcgttgctgttctccaatcatgcatgcatggcggtcagcattccgagccagtacgccggccgcacactactacacgggtggcggcagcgcctccgcggcggcggcggcggggtcgggctgcttggtggcggcggcggcggcggcggccgcggcggggccgacgaggacggcggcgcggcacatggggcaggtggagtgcgctcggagccaggcgtcgacgcagtcggcgtggaacgagtgcgcgcacttgggcagccgccgcagcttctcgccggcctccacctgcgcgaggcacacggggcagtcgagcgccgccccgccggcgtgcgcgaacngtgggcagcgcggcgatcgcggccgcgctcatgccgcggtccccctcctcttccgccgcngccgatcccgggcgcggacggatggctgccgcggccgcggccgcggaggagcaggcggcgccggctgctgcagatgtaccagatggcgaggtagaggaggaacgtgaggatgccgatggcgaaggagagccccatgaagagcagccgcgcgcgggtgctgtagcgcgagttgtccgaggcgaagagccacgagttgggcgtgctcatgctcatttgcaggaagagcggcgggggtggtggtggtgtttgctttgcttggcggcgggtgctagctacccgcggtggcctggctggccctctgccctttttctttctttctctagtgagtgagctctgatgaggagggagctttactctttgcgcttgctgtgctgttggggcaacggggcgccgtgcggcaatatatataggcggtgggccgtgggccgtggtccgctcctctgtttcttgaacctggctggcgacgggcagaggtgcagtgggcgcgcacggcgtcgcacgtcatcagctgcggagctgggcggcagcatcgggcgcgagatcgacggtgattggggaggggacgccctgtgctgtgtcggttatgttttttggaccgcgcacgacgaaaccacgggaccccgagccggacgcgggggtgcggtgattgattacacatgccaccggtcatttcctttttttggttttcgtctcttcacacttcacacagaccgaacccttttttcccccttgttcgcactacaatgactaccttggcaatcatcgaggcccatcacgataagattgtgatgatgatcacaattcacagcgctagtttttaatctacgagtgatcggtggccgtgatgattataggcgcaatatggttatgtgagtgcctgcgtggtgtggggaaatccatctcagcactagctagctaggtcacccgtttcttttctaccagccggcccacagaattggtaaagcgcaaaggcgggntgggggnagattctgctgccacttcacctgaaaaaaagaacaagaacctacaacacaagtgtcaagtcggcactgcgaagggtgcatgcatgcatgcatggacgggtcgggcagaggcctggccaccaccaccaccactggcatgcatacgatacgacgcgtacctttccgtgcctctctgtgaagcgactctgacggcgagaagcgatcgaacaagcaagcaggcaagcagcaggtccatggctacatccgcctgcgttctttctgttggaacaaggggcgatgtaggagatctgcccttcccatgctttttcctccaggttcggaatcgaaaggccctcgctttcttttagtttgccctactagtagttttagactagaaaaaacaatgggtgtccatccagaatccaaggcccccagtttcggaagcagctgccaggcactagcccagtagtagtgggtgagtcagtgagctgaggtttgttgacgtctgatttcctctccacttttgtttgtcggatggatcacgaaaaatctccactgcgcaacacaacatttggtgcccatttttgacggcggcgagggtttagccgtttagttactggctgcacaggcggcctacaaacactgcatcaaaaaaaaaaaatctacaactacgtagtacagtacaatggatgctacaagcccttgggcgttggggactccacagctgagagcagccgttgttagttctatcaatcatcaggcgcagccacgcgtcgacgcctgcgcgcagcaggggaaccacaccgcgcactccgccgcacaaatggccctgtttggatccaagtgctagagctagtttgggctagtttgtgccaaactagccaaaaaattgc

SEQ ID NO: 13552 - DNA, 3188 bp, Zea mays
agtcagctgagatggcaactaagatactgaagcagcttgacacattagtaccttcacagaaggaaaacacatcagaaacaaagcagaaacatgagagtgccatatatttcgaggaagatgtttctcgacaaaagaaagtacaagcagagagagatcttttggaaccttctccatcagaagtacctgatggtattgcatcgaacaaatcaatctcacaaattaccttgaacaaggaaaagcctccagccttttcttccagaggtaatgcccccaatctggtattatctgatgaaattggacgaagcaaaatgtccactccaggaaatggcttcaccttccctgccccgactgtcaacaatgcctactcacagggccctccaacacctacattgacatctcctatactaacagttgaaaagcagccttcagtattctgcagtgcttcagtcacttctgcacaaagtgaccctaggttagttcctgattgataatgaaatacagatcaaactttttctggcactgaatagtacttcaattttgctgatacttaaaagtgccaataacacaacctgtcatttgttggaacatgaatgaccacatttggttaatctgtttattagtcggagctatttggctggaccatgctgtttttgtttgccactctattttgtaatctttttaagcataaaatgaagtacattagattctaatattgatgtctttttctttccaggatttcaaaatcagttttgggaggaccagttacacagaaattagaaagcaagttaaatggagataatcaacgagtgccttccaagaattctggacaagttgcatctttcacaagtaatcctgtatttaaggttgatggccctgggcatgcgtcaaactctgttctctcagctgtacaatcttataatacatcaactggctcagtttcatttcaaagtgctggctcttctaccatctccactaacttaacttcaaacattacacagagctgttcaactggaggcagtttcactttctccaatactcgttttggtagtttatcggcaacctcaaatatgtttgcagcaaaatctttagcgttgtcttgtacagcaagccccggtgcttctttgggtttccctccagttcatactgcaagttctccagctgctcaccgcaaatctgaagcagcaaatagcagtatcagttttagttccatgcagcagtttggcattgcaggttcttccacagtgcaggacaaatccaaggcagtagacagcagtaccccttttggctttccccagaagtttgacaccgtgagttccgcttcagaggatatgtccaaggcagactctcctgagccgacatttttttctgggaatcataatgtgcaatcagaaaattgcagttccctgttcacacagagtccaggaaataatttgagttccaaatcttcagaaaatttgaactctggaagctcgcatagttttgcagattcaccagttggttcagcaacaatgtgctctagcccttcgaattcaaactctctgttttcttgggctgctggctcaggtgcaagaagtgctccaccatcttcccctgctacaagctcatcttttgcttttagttccagtccagcattttcagcacaaccagtattcgccagcaaattgactacacctgcttcactttcatatggctcaccaaatactggccctgctacatcaccattcagctcaatgccaagcgctgtattttcattcacgtcagctactccttcaataccaaatccatcacccacaacaccaatatttggtgaccctactgtacagatgaatggagggaacatagttattgacaggaatgggtccccttcccctgcaacgtcgccatttggcttgccaagcagctctccatcgactccaactttcagtacgcctgcaactcagtttgcttctagtacatcaggctcacctggagtttttgaaattggcaagtatagtcaagcttcttcaggtgggttctcaatgggccctagtggtggcaacgacaaatcaaacagaagaattgtcagagttaagagaaggaaatgaaataccaatatttttcaagttgctctgagcatttataagactaaggcaatcagcacgtagaactttttgtttcacatcatttgtctgcggtggcaatgagaatgagatgccattcttaaattgatgatcacaattctggcacagtagcagcaatggaactagccttttcgcgatacggtcgcccatgacattttgttgtacggtttgccacaacaatgctataatgaaatatataggtacttctccaacttgtattaaacatgttcagcgatcaagctgccctttttttgtgcaattggatcctgaaactaaatttcatcctaataataataatttaggcacgccaattattattattgattatgcaggtgagatttatgtactatatttttttactgtggggagcgagtcaaataatgaacaacatgttataatgttataagttataaaaaagtagaaacataacatggtgatgcatataaattttaatctattatctgataaatttaaggaagaaatatctgaaatcttgaaagtatggatttttttatcaagtaaaattttaattcctctatagtgtaaaagatcgaaacggcccttcttttcccttttttgtttcgtatatagttttttttttcagttgagttcgctgtgtctgtgttttgaaaagcgatgtaaccttcaaagtaacatggcggttccgaatgatttcagtcatctgtataattcctaagttttttttaatatgcctttgttatgaagttaaatatatatactatgtctaaatagataaaaacctatctagaaaaactaaaatgtctcataagttattttgatttttaggtatattatgtttgacaagtatgtatctagatttttaggtatattatgtactatgtctaaatatatgataaaactgtatatgtagaaaaaacaaaatacttcataggctacggataagttttttttagtctttcatgttacattctgaattactatttatagagctatttaaataaaaattacttgccatatctttgaaccctgtacacctcttctataaaaaaagtgggcgtatcagaagaaaagaatggtttcctgcag

SEQ ID NO: 13553 - DNA, 924 bp, Zea mays
  misc_feature (7)..(7): n is a, c, g, or t
gccgggnaaaaaaaaaaaaaaaaaaaaaaaaaaaaaaaaaaaaaaaaaactcggtcccgagagtcaccgggccgagccgaacgtggctccgctcgccgatgggtgcccctgcccctcgatagtcgcgccgctctcctgccccgttcggccgttccccatttgcctcgtcgcccaccgccccattagcgccgccctcccttatccgacccaacgccgccgccgccgccgcatagacctcgccggcgcctctgcgccgccccgtggcctccggaggtgctattcgcgcgcgatccgccgctgcgtccgtcgctctggcatcgattcggcggcgctgggagctgtagaagcgagttggttggagatcagaaacaggctacccaacttgaagatggcactgcgacgggctctaggatggtcggaaggggaggttatgcgaccagagtcaaagccctgctcccggttaatgcggcagactgcgggcatcttctccgtcggtggtggtctggctttctgggtgctctgccgccttcactatggtccaagaatcactgttccaaggagtctcagatgggcgtcatgcggagcagtctctatgagcgcgacatcagcattgcttgtgcggctctttagcccagagtgtgagcctcaaaacatagctgccttcgacaaacctgaactaaaggcccaatagcataaccgaaaactggtgttaatctaccaagacccatgcaagtttttgttaatctgccaagatctatccaagtttctgtccttataatgatccaggcagttcctgtaagatacttttgcgtggtacaaccagccattaattgtttgtttgggactgctacaggtttcagtttcagcatggaagctgtggtttataatgaaaatctaaatagtttaataaaaaaaaaaaaaaaa

SEQ ID NO: 13554 - DNA, 4200 bp, Zea mays
ccacgacgggcccgagcacagctgttgttcctactgcatctgcatccatggaggccgacggagcagtctgccagtctcttctccatcggtagtcggtaaggaagatggagcgaggtcagaggcgacaacgacgtgtgtactgcatgccggctgccgttcgggtcccacaatctcgaaaatttatagcggccggggcgtggaatctgagccccgcggccggccagggcacctcaaaactggggaggattcacggccgttccgggcacctgtctactctgtgtgactgtgtctgtcctgtcgtcgcgggccgcagcctcggcttcccagttcccacaccccacgcggccacccaccccacccgcacccggcgcctcgcttctttattccgctccgctcagcccgcccgccagagcatcacatgccattgccaacctctcactgctcgtaccgcctctccactccacctgctgcccctgcgccctgaccgcgaggggagggcgctgagctaccaaggaagccaaccggcgcggaccgggtcggtcaacgcttgctgtgcacccgaccgaggaagctaggaggatcgagcacggacatgttggcctcggcgtcggtgccggccgtctaggaaaagctcgcccgcagaggtaatggatgggcggaggaggggcggcggagctatggcgtggctgctgctgcttctcgcctcgctgtgcaccggcgcgtgcgggctcaatgcggacggggtgctgctcatgtccttcaagaacacggtcaccgcggacccgctgggcgcgctggccggctggagctacagcgacgccgcgccgtgcgcctggaacggcgtcatctgcaacggcttcccgcaggacgacaccgcgccggcggcggcgaacgtgacctcggcctccgccgacggcaacggcaccgcgacggtcgcgcgcaacgccaccggagcaaccgcggcggccggcctcggcgcgtcgctggcggcggccacggtgtcgcgggtcatcagcctcgtcctacccaacgcgcagctctcggggacgctgccgcccgacctcggccgcgtcgagcacctgcgccacctcgacctctccgggaacggcctcagcggcagcctgccgcctacgctgctcaacgccaccgagctccgcgtcctctcgctcgccgggaacgcgctgtcaggcgagctcccggacgcggcggcggcctatgcgcgcggcctgcagcagctcaacctctcgggcaacgcgctcgcgggccgcctccccgccgcgctgtgcaggctgccgagcctccttgcgctggggctcgccagcaaccacctcgccggtgagctccccgtcggaggcctcgggacgttggagcttgttgacctgagcgacaacgacttcaacggctcgctcccgtcggacttcggtgggaccgcactccgcctcctcaacgtttcgtccaacaagctcgccggcgctgtgccgaccgagctggccgccgtcgtccccgcgaacgcgacggtggacctgtcgcggaacaacttcaccggcgcgatcccacaggccggcccgtttgccgcgcagccggcggcggcgtacgagggcaacccgaacctgtgcgggccgccgctgaagcaggcgtgctcgatcccgtcgtcgctgtcgaagcctcccaacgccaccgactcgccgccggcgttcgcggccatccccaagaaccccgctcgcgccccgccgcaagcccaggggcagccgccgagcgagcaggataagcttcgtcccgcgtccattgtggccatcgtcgtcggggacatcgccggcgtcggcctcctcttcatgctgttcatgtacgcgtaccacgtcaggaagaagaggcggcagcgtcgggagcaggacccgacgccgccgctgcacctgcagcagaagagcgcgcgaggtttcgacggcggcgtagtcaagacgctcgacatcgccggaggcaaagaagagaaggcgtccacgtcgacggggcccggccgtccccgcgggcgcgacagctcggccagctccgagtactccgcgtcgtcggacggcgagtcctccgacgaggagggcctcaagaagaggggaagcttcatcggccggagcaccccgcaggagcacggcagcaagaagcacaacctgccccagcagcagcagcaggcgccccccgcgcctgcgacgctggtgacggtcgacggcgacggcgagctcgagatggagacgctgctcaaggcgtcggcctacatcctcggcgccacgggttccagcatcgtgtacaaggccgtgctcggcgacggcaccgcgctggccgtccggcgcatcggcgagagcggcggcgccgaaaagctcaaggacttcgaggcgcaggtgcgcgccgtcgcccggttccgccatcccaacatcctccggctgcgcggcttttactggggcgccgacgagaagctcctcatccacgactacgcccccaacggcagccttgccaacatcgcattcagcaggcgcttcgggtcgtcgtcgccgctgcacctgagcctggaggcgcggctgcggatcgcgcgcggcgtggcgcgagggctggcgtacatccacgagaagaagggcgtgcacgggaacctgaagccgagcaacatccttctgggcggcgacatggagccatggatcggggacctgggcctggaccggctggcgtcgggcgaggcggcgccgcactaccgcgcgggcgcgtcggcgcggctgttcgggagcaagcggtcgatgcactcgacgagcagcctgccggacctgtcacagatgcccgggccgggcgcgagcccgtgcgggtcggcgtccgcggcggccgcggccgccagcgccgccccggcgccgtaccaggcgcccgagtgcctgaagaacctgcggcccacggccgtgtggggcgtgtacgccttcggcatggtgctcctggagctgctctccgggcgggtctactcggaggtggagctgtgccagtggcacgcggggctggtggccgccgaggagcacggccgcgtgctccggatggccgaccccacgctccgcggcgaggccgacggccgggaggacgcgctgctggcgtgcttcaggctcgccttcgcgtgctgcgccatggcgcccggcaagcggccctccatgagggacgccgccatggtgctcgagcgcacggcggcggcggcggcgcccgccgccgccgcgagcagcagcggcgccgctgtgccctgagggggaaaaaacaactgaccttgtagcgcttggagccgttactgatcgcaataatcttactgcaagtgcacggacggtggtggcggcgtcggcgttgatcgccggtggcgagcttgtgtggtagggcgtgtacgtagatctgttactgattttggaggtgctgcgagaattaattaacctactaatcatctgtgtttgtgattgtggatttgaaagcgatgcatattccttttttttcgatcttgcgtctcggtggatctcaagatgtgtacttactgtgacagtgtcagtgtctgatggccacacgatcaatgggttcttctgaatctgatcgaccaaatcgggatggttcttgaacctgtcgtgccggttcagttcagtgcaccggagccggactcggacaagaattcaacaaggcctgctgctgctgctgctgctttgacaggcgctagccgccaccggtacaactctccaagtctgttttgtccggcgcgcgcacgcgacgaaacgcggtgtcccgccatgtccgttccagcgctccgcagcgagcagggaatattgtagtggtcttcctcatattccttccaccgtgccgtcactctcctcgagacggagacggagacggagacggagacggaccacgggcgacaggccagggcaagcagagagagtaacttctctgggcctctgagggtttgggaagatgccgtgttggccggggtttttttttctgccggccgcgtcttcctgccctgtgctcctgctgctctgcatgtcggtaccaccctcgcctcgtgacacgtgatcgccagagcttagccagtaagcacgggttccttaattaggtctaacccagacccagcaagtgacaggttaacatccagtccccagaaataagctgacataaactactgtgtatgtgagtgagataaaggtcaagttcttg

SEQ ID NO: 13555 - DNA, 2226 bp, Zea mays
  misc_feature (948)..(948): n is a, c, g, or t
cccattctatgtcctccaatcgcgacatgactctgacagatattgaataagttgatgcatatgcaatgttgcttaatgcttatgtcaaaaaaaaatccgcatcacaggcgattagaatcccacgcgaggccccaacagagggtaaatgaaccgtttgagctgccaccttttcaaattaaaaaacggcaatgaagagatatcaataccgtgccgattggggaaaaaatcgataatcataaatcagttgtgaagatcagttctttagctgtgactggcacggcctaaactagctgtactatagcttataataccacgtttaaccaggtcagcactcagcaaacacctttttggtatgcacagcacactgtactgttattttatatttatgaagctaacattatggatgtactcacattatgactcagcaaggtcgcaaggcgggcacgttccgcgttctggtggtgctctcgttacatttgccaagctcaatcattgattattgaaccggtagccgaagccaagaatataaaaccctgcagcctgcacgcctagcctcagagcccagcgtccgtctcttgctcatcagcatcagctagccacccgaccaggcttcagaaaacaaaaaaatgaagctctcggcggcagtcctctgcgcgcttgtggctgttcaggcggcggtgcttctcgccaccgtgccgacggcgcaggccagcgagctggaggtcgggtactacagcaagaaatgcaagggcgtggagaacgtggtgaagtggcacgtcatcaaggcgatcaaggccaaccgccgcaccggcgccgctctcgtccgccttatcttccatgactgcttcgtcagggtaagggcaccaccatgcgtccatgcgcatccatctacatatatagccagtaaatcttaatagattaattaaactgggcatgcaataatcatgnagggatgcgatggttctgtcctcctggacgcttcctacgacaaccctcatccggagaaggaggcgccggtgaacatcggcctcgccgccttcgacctcctggaggagatcaaggccgctgtcgagaagaggtgccccggcgtcgtctcctgctcggacatcctcatctacgcggcccgcgacgccgccagcgtcctcagcaacggccacgtccacttcgccgtccccgccggccgcctggacggcttcgtctccaaggccgaggaggcccaggcggagctcccggactccacccacgacgtgcagcagctcatcgacaacttcgccaggaagaacttcaccgtggaggagctcgtcatcctcaccggggcgcactccatcggccagggccactgctcgtccttcactggccgcctctccgagccacccagccagatcaacccggcgtaccgcgacctgctcaactacaagtgcccccaggggtccaaccctcccgtggccaacaacgtccgcgacgaggactacggcgtggtggcgaggtacatgccggggttcaccagccgggtgcgcaagatccccgacttcctggacaactccttctaccacaacaacctcgccaagatcgtcaccttccactccgactggacgctgctcaccaacaaggaggcgttcggccacgtcgtggagtacgccgagaacgccacgctgtgggacgaggacttctccgactcgctgctcaagctcagcaagctgcccatgccagcgggaagcacgggcgagatcaggaacaagtgcagcgtcgtcaaccaccgcctatactaagccagctcccgtacctgcaacaatggaaatcgaagaaagaggtcgatcgtgtccgcacaaccacatatcaaacattgtaaatcaaaatgagccataagatttttgttgtttttgtttcatccattcttttgattctcattcgttttactacacactcatcttttttgtgtatctctcgtatctgtcaaactgcaataaaactttgttactgacattctattggcaaatgtcattgtcgtgtactcgtgtacaacatacgagtggtcaacctttcattatattagagaaactaagaacttcacctacgcgttgaagcttgttcagtactgccacaaaagaaaaacgcccactttgcactacaggaattcacttaattcccctaggccagaaaccgacgggaataagcctaaacagacgagaataagcctaaacagacgagaataagtattcccgtcgg

SEQ ID NO: 13556 - DNA, 3932 bp, Zea mays
  misc_feature (628)..(628): n is a, c, g, or t
tataaaatactctagcaaacaatattagtgcaaatggtcatgtggatcatcaaacaccaaaacatgttgatcatcaaacagcaaaaccaaactataaaaggaatgagatccatttttttacaaagctccatatccacctccaactgatacaatgtctatgtctctacttcatcaccttatccaccaatgcacacatatgcacatgtgcatcgctttggtgaagcattgctcaagtcatgctcatccatccaagcatccaacatgatcacaagtggcattatgggactaaatctaggggcagaggccagagaatgccaaagctaggcatgcaatgttatgtcgaccatcctgctctctatgccctgcatggatttctgctgccaaactaaagccctagatgagaatgggagagagacagatagattaaggataaataaggagaggatatgactcaatccacgtgatgtggatgtagctttttgcctagatcaagcctatagggagtcatgtgaggctatatgggtccatcacggatccaaggctatagccaaccaatgtgtcatgcgctattgtggcaatggtcactgccaaaagcaaggaggtcatggtgagtctcaccttctatgcnggaaggccaacaacatggaagaggaggagaccaaccaagtccaagacctaagaatgggaaatgggggtggggtggcaatggaatgagcagctaaggtgtcgtaatggagaggagtaaaaatagggacaacatcttctattgatgggtggaagggtttgtttccctaggtacctaaagagtcaattatcataatcgtagcggatacttattaaattgtctctctaaatagcatattttttcccaaattcattgatttttttgaagacaaatatttttaaacatcttgtataaatacaattgtttgccttctaggatcaattttatagcactgtcactaaccatctgattgtgaattctttactatgtgtacaaaatttcgtctacatgtctagtatgcagtgttattaattagctgctagtagagttttttgcgtataataatagtaaaagagttctgcctctttatactaaggcagagtaaattgtttggatatacacacagtgaaaacactagaggcctaatggtatgtttggaagcaccacagtatttaagaaactagtttctatccctagtttctagaaactagtttatggaaaaaaaatgggtgtgcttatttggaatccagttagtttctagtttttcgatacacaaagacaagtctacccttactctattttaaagtaattgattcaattattctctttattttactttgctgccaattttaaatatagattgaactcatattttttaattctattatttccaatgataattaaacattcgaatcgggcaaagcggacatcaagaggatcacatgcataggcctgagaacgtgtcaagtgccataatttctaccaaactagctaaagacactataatttatcaggcaaataaaatctgattttagtaagagaagaccaacttctttgttattttaggaactggaaattcagtttatagaaaccgaagcatattgtgacctgtttggaagcgctctagtttctataaaccagttccttaaaaaccagttactttcaaacatacccttagtagcctaacagataagaccatgaaaacaagaagaacattgagttttagaagacaggcctatttgtctgtacatatatcaacctataatatctcgtttaaccaggtcagcacgcagagcacatgctatcttttaggtacgcactatatattatatgaagctaacattatggacgcattgtggtttagcaaaaacgccgcaaggcgaccacgttccctccctattctctcccatctcattatcggcggcaacctcaatcattaacagttaaactactggccaaacccggcaatatatacccctgcaggcccatctcctaagcacaccatcacggtccctgttcctgagccagcagcatctgtctcttgcttcatcagctaggcgcccggccgcgcggaccaggctccaggagaccaaaaatgaagctctcggtggcagtcctctgcgcgcttctggctgtccaggcggcggtgctcctcgccaccgtgccgacgtcgcaggccagcgagctggaggtcgggtactacagcaagaaatgcaagggcgtggagaacgtggtgaagtggcacgtgatcaaggcgctcaaggccagccgccgcaccggcgccgctctcgtccgccttctcttccatgactgcttcgtcagggtaataagagcagcagcatgcgcattcatgtacatactacttggccgtatattagttgattgattgattgaactggacatccatgcaatgcagggatgcgatggttctgtcctcctggacgcttcctacgacaaccctcatccggagaaggaggcgccggtgaacatcggcctcgccgccttcgacctcctggagcagatcaaggccgctgtcgagaagaggtgccccggcgtcgtctcctgctcggacatcctcatctacgcggcccgcgacgcggccagcgtcctcagcaacggccacgtccacttcgccgtccccgccggccgcctggacggcttcgtctccaaggccgaggaggcccaggcggagctcccggactccaaccaagacgtgcagcagctcatcgacaacttcgccaggaagaacttcacggtggaggagctcgtcatcctcaccggggcgcactccatcggccagggccactgctcgtccttcaccggccgcctctccgagccatcgcagcagatcaccccggcgtaccgcgacctgctcaactacaagtgctcccaggggtccaacccgcccgtggacaacaacgtccgcgacgaggactacgacgtggtggcgaggttcatgccggggttcaccagccgggtgcgcaagatccccgacttcctggacaactccttctaccacaacaacctggccaagatcgtcaccttccactccgactggacgctgctcacgcacaaggaggcgttcggccacgtcgtggagtacgccgagaacgccacgctatgggacgaggacttctcggactcgctgctcaagctcagcaagctgcccatgccgaaaggaagcaagggagagatcaggaagaagtgcagcgtcgttaaccaccgcttatactaagcctgccagatgccgtggaaatcgaagaaagaggtcgtgccagcacaacacatatatatcaaccatcggagatcagaaagccataaggttgcgcttttttgtttcatccattcttttgattatcattcgtttgtgctacactcatctttttgtgtatttctcatgcatatctgtcaaactgcaataaaactttgttcctgatatgtgcaacaacaagtgaagtgctacttctattggcaaatgtcattgtcgtgtacaacatatgagtggtcggataaaacagctaattgctacgatatatactaaatctatactatctattaagccaataatatagaccacggcactaccataactacagcctcccacaagcccacaccactaccggactcaccttttttgctgtgtgtcctatacactcggcaaagaccattttacactcggcaaacattttatcggcaaagaattctttgccgagtacttattttcggaccgagtgtcgtaaagcactcggcaaattaaaagtcgcacccccacaaaacagcaattggtacagtatatactaaatctctactatttattaagccaatagtgtagaccacgacactaccatacaacagcatcccataagcccacaccactaccggacttgtcttctttgtcgtgtgtcctagacactcggcaaatgtcata

SEQ ID NO: 13557 - DNA, 1377 bp, Zea mays
  misc_feature (1216)..(1216): n is a, c, g, or t
  misc_feature (1219)..(1219): n is a, c, g, or t
  misc_feature (1376)..(1376): n is a, c, g, or t
agagcccagcgtccgtctcttgctcatcagcatcagctagccacccgaccaggcttcagaaaacaaaaaaatgaagctctcggcggcagtcctctgcgcgcttgtggctgttcaggcggcggtgcttctcgccaccgtgccgacggcgcaggccagcgagctggaggtcgggtactacagcaagaaatgcaagggcgtggagaacgtggtgaagtggcacgtcatcaaggcgatcaaggccaaccgccgcaccggcgccgctctcgtccgccttatcttccatgactgcttcgtcaggggttgcgacggttctgtccttctggacgcttcctacgacaaccctcacccggagaaggaggcgccggtgaacatcgggctcgcagccttcgacgtactggaggagatcaaggccgctgtcgagaagaggtgccccggcgtggtctcctgctccgacatcctcatctacgccgcccgcgacgccgccagcatcctcagcaacggccacgtccacttcgccgtccccgcaggccgcctggacggcttcgtctccaaggccgaggaggcccaggcggagctcccggactccacccacgacgtgcagcagctcatcgacaacttcgccaggaagaacttcaccgtggaggagctcgtcatcctcaccggggcgcactccatcggccagggccactgctcgtccttcaccggccgcctctccgagccacccagccagatcaacccggcgtaccgcgacctgctcaactacaagtgcccccaggggtccaaccctcccgtggccaacaacgtccgcgacgaggactacggcgtggtggcgaggtacatgccggggttcaccagccgggtgcgcaagatccccgacttcctggacaactccttctaccacaacaacctcgccaagatcgtcaccttccactccgactggacgctgctcaccaacaaggaggcgttcggccacgtcgtggagtacgccgagaacgccacgctgtgggacgaggacttctccgactcgctgctcaagctcagcaagctgcccatgccagcgggaagcacgggcgagatcaggaacaagtgcagcgtcgccaaccaccgcctatactaagccagctcccgtacctgcaacaatggaaatcgaggaaagaggtcgatcgtgtccgcacaaccacatatcaaacattgtaaatcaaaatgagccataagnatnttttggttgtttttgtttcatccattcttttgattctcattcgttttactacacactcatcttttttttgtgtatctctcgtatctgtcaaactgcaataaaactttgttcctgacattctattggccaaaaaaaaaaaaaaaaaagcccctagggnc

SEQ ID NO: 13558 - DNA, 3875 bp, Zea mays
gttattcatattccatatagattaagtgtattgaaatgaattttgacttgctataaatttaaaccgattcaataccacccaatccatatggattaacgataaaaacgaacaagcctagctgggtcagcttttataccacatttgcacggtaagatagcacccaatatatcagcatagtaaggaacaagttgttcccaccaagttttacaaacttgttgatctgcactttgaacgatatgccataagtccagcatttttacaaatattttgtagactaaattctaggttttacaatcacagaaaaaacatgaaagataaatttttatctccacaagaaaatagagatgtagaaaaaatatctcaagcgttcgtcgtcgcgcagacgagacgaggacgtggagctatttcccacaatttccgttagccatggctagaccttgatccagcgttagtggatccagaaccgctagtgggcagaaagctcggcttccacaattttcagagttgagctccgcctgcctggttggtccgtcggatggtgcaaaactccagatcgcatcgcccccaacccatgatcagcagtcagccaccgcccactagcagtagcacaccctctgccctcgtggcaagctgcagtttttctcactgcagaagggccccactcgtcatccaaagattgattgaaggggaaaatttctcgccgacggcaggtgcctgatagatctatatatctatccccgacgccaccgccgcccgccttgtcctcgctcagatccaaatccgaatcccgatccgcgcgcgcgtggatttcttcagctccgtcttctctccccctgccaaggaggatggtgaggagccgcagcaggagggcgaggaagagccggcggcccaagagtccggcggggggtggattttcggcagcctgatcgatacgctcaaggaggagatcgaggggcagcggaaagtgaacgagtcggccgccgtcgccgcggaggcggaggaggcccagaggggtgccgatggagaggctgtccccggcagcgggtggatcttcggcgggctgatcaagacgctcgcggaggagattgaagcccagcggaaagagcaggaggccattgcagccgccgcggagtcggaggagctcgagcggggagcggaggctgatgcggcggcggctgcaacggcaacggcaacggcagatgaggagggagaatcttctggcggcggctggagctttggcggcctgatcaggacgctcgcggaggagattgaggcgcagcgcaatgagaatgagaaggaggctgcctccacggcggaggaggacggagagcagggaatcgatgcggaagtggcggcggtggatggggaggagggggcgccggctggggaaagctcagacggcgggtggagcttcgggggcctggtgagtacgttcgcgtcgcggtcggagtcggtcctgggaggctaccgccgcgacctcgaggacctcggctcggggctccgcctcgagacggccgcgctccgggccgccgccgcgcgcgccgcctcagcgctacctggcgcgctggaggccggcgcgtctgtcgcctccgacaggcttgagtctgtcggccaggccgttgacgacctcggtgccgccgccgctgggctcctctcgcatgccaacgaggccctccggtccgctgaagctgacggtgttgatggtgaccgtgctgcccgcccctccgacggctctgtttccagtgcgtcctggcgcgcttccttgccgaccaagaagtataccaggttcgaggcccaggtcttggcgttgcgtgcggaccctgccacgttcaccgaggagcctgaagattctgagggctttggtaaatggagtgccttgttctcaattgacgagatggaggaacagatagagacggtgctccatgaaagccctggattggagagctttgtggagaggcttgtgccgtcagttgtggattacgagacattctggtcaaggtatttctttgctgtcgataagctcaagcaggcagaggatgtccgcaccaaacttgtgagcagggccatgtcaaaggaggaggatgaagaactcagctgggatgtcgatgatgatgatgttgaagatgccaatactagtgatcacaaagacagcacaaactcgttggtagataagaaagaggagcaagcagcggagcctgttaactgtgaaacagagggcagtatggaacaagaagcagcagctgaaaatgatttggcagacgataaggaggttgctttggctgcagccaaggatggtaacggtgaatcaagttttgaagcatcgactccaaaggcaagcaatgggaccagacaagaagagaagattgaggctgctgactcatctaaggggggtgatttctcagtggtgcctcaaccattagtgcaggaggaagatcttagctgggaggagattgaggatgttggcgatgaagatcagaagaatggggttagcaaacggtcaagctctgtcagcaaagtggaggatctccggagacgtcttaattctgtggaagatgatgatgaggacctaagttgggatgtcgatgagtagaaagaacgtgtggagccctgcactgagttgtctgaaggacttctaaattagagagactgccatcctaagcataaattgaatctgtatggtgccgatgaagaagctttgtggatggattgccacaatgtgaatattgtgatggacactggtgattcaaattcagtgggggctcattagtttccttgcaagaactcgatagaatggtagtgttttttctgttagtgttggtaatttgtttccagttagcatacgtttgttgcaagtccaacatgtaccaccttcctgtttgaatatgacacatagttcatttcagattcacaaagtaaacatcgaaattgtgaaactattgatccaatgtgcttgcagttcatgctgtgttattagcggataggtagtttttcagcctttttctgttattgtcactggttatttgagcttttaagatcaccatgggatgtcaagggcgttgagccctcgagcggctggaccgcgactacgtagttcgtagctgctgttcgtcttctccggcgaggggttcctcagccgcaggcttagagaatgcagggagataggagattagagataatacttttcttattcctcatgtctcacggttccactataaataggccacctgaccaactaggcaacaactaattaggtaactaacttatttggaaaccaatccgaccaactaggcaacaactaattaggcaattacttatttggtaaccaatccccctgccattaaggcctatcaatttagccatcaatctagccacttgccttagtcgtgccttccttatgcgcactgctgtgggcctgctgttggcgcgcataggtgtggccccacatgacatgggatgtgttctgtttggatataaatttcaaatttgcacagaatctctaacaagggtgttagtgccaccctctttcagaatgtcttttactccttttctgtttaatatatgggtatccacttcgcagttgatgctacaatgtagaactgcactttctggttatctggacttgacaacagtgagttgcccaagagatttgtgtttctttctggcagtttatgtaccttctgttacggttacatgacctttgggtgtgagcctgtgaggctgccatcgagccctggttcttcagaaagagagaaagaaaagacttgctgcatgttccgctggtcgtggtgtcgttgtcgctgaacgatggatgtggtagctggtagtggctgatctcaaggtctttcttggacatatcatgctttcggccggaatat

SEQ ID NO: 13559 - DNA, 1095 bp, Zea mays
tcggtacccttgagccgtcagatccgcatgcacacgcttgcccaaattaaaccagctttcgcgacgtcgcccactaccgtcgtgttctcgtcgccgccacccttcgccttcgtcgtagaagcgccaccgccggtcttgacggtccctgacgctctctctttcaactcccctgcctcctgctcagcgcgccaagtgacgtcctccgccttgtcaccggcctgggcaccggtgtctctcgacctctgcgccatgccgccggccgcatcccacgccgtgtccttggcacgtacggcggtgtcgcccgccttctgaaccatggatacggccgtgtccctcaccttgtccttggcctgtacggccgtgtccgcggccttacgcgccatgtcgccggtggtgtccttgtgctgtccggtgatgtcgcgagccttgtccgccgtctgggacgccggttccttggcctgcgcggttgcgccactccctggctcctccgcctcgtcggcggcgcgggccgcgcgctccttgccttgctccgccttctccttgcgcgcggtgtcggctgtcacctccttggccttctgcgccacctgcgcgcccgtggagaccgttgcgtccttggccttcacagccgcctgctgcgtgtacccggccatcgtcttcctcgttgccaccgccgactccttcgccttctcggccgcggccgtctcaccggtgctcagcctggctcctccgcctcctcaccactacgccgttgatcccggctccggtaccatgtagaggtttctggaagagtacagcagaagtgtccagactacactgccacacacacgaatatgtacatgttaatgggccagacactagtcacatggcccaacacttagataactacagctaatcaatgctgtcactcaccttgcatttttgttgacacaagattttagcacaccagcatgttgtctctctctctatatatataacaatatgtgtcaaatgccttctattccccatgccaatgatacatgtgactggttctaacttcgccttctttgttgattaatgtgtcagctggtagcgaccaagaagatcacccacctgccc

SEQ ID NO: 13560 - DNA, 1713 bp, Zea mays
ggggggggcgggggggccaaagggacccgggccccctttatacggggtttggggcctccgcacccccccaagggggccccccggtcccccgcttaccgtgggtccccctggcttcccagggccccccaggggccccccaaaacccccccccaaccccggggaaaggtgtttcccaaggggccccaaaaccccccccaaaagcccaggaaaaggggggcccaaaggccccaaaaggttttcaggaccttctaaaccccagggccccggggggcccgggggggaaatggttgggttttcttggggggagccctggtgggcccaggggtcggaaaagaccgctttccctggtttttccggtgttaagggtcccaaaaacaccggggggttccccccggaagggggctaaaaaggccttgggcacaatagggttcctgcccgttccccggggtttggggggggttggggcggggttcccttgggggggcccccccgggccggggggtggggtggcaacgggggccccttgtggtttttttttttttttttttttttttttttttttttttttttttttttttttttttttttttttttttttttttttttttttttttttttttttttttttttttttttttttttttttttttctacgataaggcacacaaactctcaagccatacgttataaacacactatattatggatagctgcactcgtacgatcgcggttcacaccggcaccgcacggccgcaccggacggacacacacacaccgaccgacaacattattctactatactatatacagatggacgtgtcttaaaagcagtacagggcggaacccatacaggcgactgaacccagagacttccccgccaaccacccaaagaagcactccatcacgcgagcttggtcttctcctccggtgacttccctttctcacctccgactgggacgagctcctcctcgccggccacgatccccttggtgtgcttcgcgagcccaaccaccgtcgcgcccaccgcctccaggacgtcgcccactaccgtcgtgttctcgtcgccgccacccttcgccttcgtcgtagaagcgccaccgccggtcttgacggtccctgacgctctctctttcaactcccctgcctcctgctcagcgcgccaagtgacgtcctccgccttgtcaccggcctgggcaccggtgtctctcgacctctgcgccatgccgccggccgcatcccacgccgtgtccttggcacgtacggcggtgtcgcccgccttctgaaccatggatacggccgtgtccctcaccttgtccttggcctgtacggccgtgtccgcggccttacgcgccatgtcgccggtggtgtccttgtgctgtccggtgatgtcgcgagccttattgtccgccgtctgggacgccggttccttggcctgcgcggttgcgccactccctggctcctccacctcgtcggcggcgcgggccgcgcgctccttgccttgctccgccttctccttggcgtactccgccaccttgcgcgcggtgtcggccgtcacctccgtggccttctgcgccacctgcgcgcccgtggagaccgtcgcgtccttggccttcacggctgcctgctgcgtgtacccggccgtcgtctttcccgttgccaccgctgcctccttcgccttctcggccgcggccttggcgtactccgcggccgtct

SEQ ID NO: 13561 - DNA, 1312 bp, Zea mays
aagctggagctccccgcggtggcggccgcgtcgccgccctgcccaaggcggcctgcctctgcgtcgacgaggacgcctgcgcgcacgtcggctgccgccccgccgtcgccttcatggcgcaggtcctcttcgccgcgtccaccttcgacgtcgccgagctcaccaatctcttccagcggcggctccttgatgtcctcgataaggttgaagtggacaacctcccattggtcttatctgttgccaacttatgtagcaaatcttgtgtgaaactgcttgagaggtgccttgatgtagtagttcgttcaaatcttgatatgattgctcttgaaaaaaagttgcctccagatgttgtcaaagaaattgttgatgcaagggtaagccttggattagtttcaccggaagacaagggcttccctaacatacatgtaagaagaatacacagagcactggattctgatgacgtggagctagtccggatgctactcaaggaaggaaaaactaatcttgatgatgcatatgcattacactatgccgtcgaacattgcgactcaaagatcacaacagaacttctggatctcgcgcttgcagatgtcaatcataggaacccaagaggttatacggtccttcacattgctgctatgagaagggaacctaaaatcattgtctctcttttgaccaagggagctcggccatcagacctcacatttgatgacaggaaagcagtgcagatctctaaacgacttacaaagcatggggattactttgggcctactgaggacggaaagccttctcctaaagatagattatgtattgaggtactagagcaagctgaaagaagggacccgcaacttggagaagcatcagtttctcttgcgatagaaggagactctgcgcgtgggaggctactctaccttgaaaaccgaggtaatctttgttttaggaaatgtgtatagtgtcatggtttccagaataatttgttcaggtgtggctggtggtatcgaacagtgttctttggcaatgattatttgagtgtatcttccatgcttacttctgttttaatgctatgcagttgctctagcaagaatactgtttcctatggaggcaagggtagcaatggacattgctcaagtcgatggaacactggaattcacccttgtttctagtgtgaatctgcctgccgagatacaacggacagttgacctgaacgatactcctttcacaatgaaggaagaacacctggctcggatgagagccctatccaagacaggtgacgctcagcttccctctttgtttaaccacagcactttatttt

SEQ ID NO: 13562 - DNA, 633 bp, Zea mays
  misc_feature (20)..(21): n is a, c, g, or t
gaacacctggctcggatganngccctatccaagacagtggaagtcgggaagcgtttcttcccgcggtgttcgaaggtacttgacacgatcatggacgacgaagccgagatggcttccctcgggcgagacacatccgcggagaagaagaggaggttccatgacctgcaagacctggtccagaaggcattcagcgaggacaaggaggagaacgacaggtcggcggcgcggtcgccttcctcctcgacgaggacgacgacgtcgatcggggccgtccggcctcggaggtgaaagggaaaacatgcatgggtcctgtttccgtcccgccattttggtagccgatgcggtggccacatagagaccgtaaccgtaatcatgctcacttttgctggcgtatagcattaatacagaacacgtatactaactaactatatacgagtaggtgtagatcggtactggaggttgtaatggcagtagcgaaacatagtgcattctggcgggcgtgtgtgtcgagcaggtagctggctgctcttgattgtaatggcgttttgagcagctaactaggatccctcttcactccaaaaaaaaaaaaaaaagcatggcttgtggaaaaaaaaaaaaaaaaaaaaaaaaaaa

SEQ ID NO: 13563 - DNA, 2338 bp, Zea mays
cagcggcggctccttgatgtcctcgataaggttgaagtggacaacctcccattggtcttatctgttgccaacttatgtagcaaatcttgtgtgaaactgcttgagaggtgcctccctcgggccggccggtcaaaccttgatatgattgctcttgaaaaaaagttgcctccagatgttgtcaaagaaattgttgatgcaagggtaagccttggattagtttcaccggaagacaagggcttccctaacatacatgtaagaagaatacacagagcactggattctgatgacgtggagctagtccggatgctactcaaggaaggaaaaactaatcttgatgatgcatatgcattacactatgccgtcgaacattgcgactcaaagatcacaacagaacttctggatctcgcgcttgcagatgtcaatcataggaacccaagaggttatacggtccttcacattgctgctatgaggagggaacctaaaatcattgtctctcttttgaccaagggagctcggccatcagacctcacatttgatgacagaaaagcagtgcagatctccaaacgacttacaaagcatggggattactttgggcctactgaggacggaaagccttctcctaaagatagattatgtattgaggtactagagcaagctgaaagaagggacccgcaacttggagaagcatcagtttctcttgcgatagaaggagactctgcgcgtgggaggctactctaccttgaaaaccgagttgctctagcaagaatactgtttcctatggaggcaagggtagcaatggacattgctcaagtcgatggaacactggaattcacccttgtttctagtgtgaatctgcctgccgagatacaacggacagttgacctgaacgatactcctttcacaatgaaggaagaacacctggctcggatgagagccctatccaagacagtggaagtcgggaagcgtttcttcccgcggtgttcgaaggtacttgacacgatcatggacgacgaagccgagatggcttccctcgggcgagacacatccgcggagaagaagaggaggttccatgacctgcaagacctggtccagaaggcattcagcgaggacaaggaggagaacgacaggtccgcggcgcggcccccctcctcctcgtcgacgacgacgacgtcgatcggggccgtccggcctcggaggtgaaagggaaaacatgcatgggttctgtttccgtcccgccattttggtagccgatgcggtggccacatagagaccgtaatcatgctcacttttgctggcgtatagcattaatgcagaacacgtatactaactaactatataatatacgagtaggtgtagatcggtactggaggttgtaatggcagtagcgaaacatagtgcattctggcgggcgtgtgtgtcgagcaggtagctggctgctcttgattgtaatggcgttttgagcagctaactaggatccctcttcacttcactcgaaaagggtctggcatggcttgtggaattgtggtgtgctggatagtgtcaggttcagtgtcgcaaaccctgaagaaatgcaaacatgtagtgctgcactatctaccaagagccaaggggaagtgtttgtcagccgttggtgtatgaatggatggcacaccttaatttcacttttctactacgctaatagctaatgactgagactgtaattttgacacctgtaattactaccggaagtagcgattcggtgcgccggattataggaagaaaaaagaagaaggaaaattcacatccttaaacttgcactgctgtgtcatcctggtcataaacagtgaaagtgcgctagagcatcttcaaataagaaccttaaaacgagggttctatcttgaaaatataggggctgatttaaaaatagctttccagcgggaagacctatttttatcaaattttcatcaaaattggtgtaggactcaatgattcaggtcctaaatatggtattaggctatttgggtccaatatttgccacactgcctatcttcaatgaaacttcacatctgcctatggtgaaacactgtgttcacatcacctgccgccgccagtagcttcatatacgtgacggcgtgccagcacgtgttctacatagtcacaacgtgccgatagtacacctcgtccgcagtacacgtacgagttgctcaccgtgtgcacggacgtactctctagaagagactctgtacgcacgcacacagttgaagagaaacgagagagtagtccatgtcatcgtcagctcaatcaaatcagcaaccttcatcgttcgagcacgattgcaattgaactccagttcttaccc

SEQ ID NO: 13564 - DNA, 2823 bp, Zea mays
cagcaccgtgcgctcgtcctcctccctggcagtcagcacgctcatcgtcctgcgtggcactcgaggcacacgagcatagcagtgggctggtggtttcgacagatagaggatctatatgaaatctccaaatatagcgaatgcatgacaaacgctatattttagcggcctcggtagcggatgctgctggacaccttccgaacgagaggaaacgttaaatataaaggacatgaagtctaagggagaatatacaatgttatttaatatagaggctcttgagttgtttaaatgagtattgggaaaaaaaccgtctctccgtgaaaaaacgtctatgacttgtaacctaagtaacaacagacacatcacttcccattttacgaattcgtcgtctattctatcaatccgatgttgtaaatacgcatttacttctgtatttattaatatactatatttataaatatttcgttgtataataatctcttaactgtttcttttgtttagagaactgttttgatgtatcttcattatacatgccctaatttatatctataccgtgcaaacacctgtattagttgccctgggtacatttttaaaatttttcgtaattttagtcgcagtttatatgctttgcttatgtaaaaaaaagttagaatcactctcgagagacagagagagtataaactaacgcctaccataaatataatttatacctatactgtgcaaacacctgtattagttgccctgggtacaattttttaaatttttagtaattttagtcgcagtttatatgctttgcttccgtacaaaaaaaagttagaatcactctctcgagagacagagagagtataaactaacgcctaccataaatacaaaataaagaaagcctcgaggccgaaatccctattcctcctcagaataccccctcttcctccgtccccattgatccccttcccccctccactcgtctcccaaatcgccagcgagcgccatgccgccgcctcccctgccctcgccgcccctgaccggctgacccgacctccccactgttctttcccttccacctgggcgccacagcgtttcccttcccgtcaccacgaaatcccggagggacgaggagggagttcgtcgcctgatcgatcggccgatccacgccgccggcctcccaatccttcgctgccgccatgttcaacaagataatcaagaggggaaaccgcaagggcgcgcgcggggacagcgcggaggtcgccgcgcgccccgcagcgccctcgtcgtcctccgggagcggcggcggcggcgcggggggagccgcgcccgtcaccgtcaaccacgcctcccgggccacagcgccttctccgtcgtcgcccacttctccgcacgtcgcgccgtccgcgtttgcgaccaacccggcggtgggggcggcgtcaccgccactcctcgagccgctcccgctcctccgcgacgtcgccgccgcagaccgtccgggcctcatcctccgcaagctccgcctcgtcgcggcgctcttcgacctctcggactcgctcaagcacccgcgagagaaggaggccaaacgccaggcgctcctcgagctcgtagattacgtgcaggctccagctcaggccgcgggcgccaacgcgcccacgcgcctcccggaccacgtccaggaggcgctagtccttgccatctctgccaacatcttccgcccgctgccacccgcgctgcacgagtccgccgccgcgatcgaccccggcgccgcgcccgacgacgacgaggagccatacctggacccctcctggccacacctccagctcgtctatgagctccttctccgatacgttgtttcgcctgacacggacaccaaggtcgccaagcggtatgtggaccatgctttcgtcctccgcatcctcgacctctttgactccgaggatccgcgtgagcgggaatacctcaagaccgtgctccaccgcatctatggcaagttcatggtacaccgaccattcatccgtaaggccatcaacaatgtgttctaccggttcatctttgagactcagcgctacaatggcataggggagctccttgagatccttggaagcatcattaatggatttgccttgccaatgaaggaggagcacaagctattccttgcccgtgctctcatccccctgcacaagcccaaatctgttgtgatctaccatcagcagctatcctattgtattgttgagttcgttgagaaggactacaaattagcagatactgtgattaggggtctgctcaagtactggccagtcacaaattgccagaaggaggtgttgtttctgggggagcttgaagaagtgctcgaggcaacacagcctgcagagttccaacggtgcatggtgccactgtttaagcagattgcccgatgccttaacagttctcacttccaggttgctgaacgcgctttgttcttgtggaacaatgatcacattgtaagcttgatagcgcaaaatcgtggtgttatatttccaattatatttgaagcgcttgagaggaatatacatagccactggaatcaagcagttcatggtctcactgcaaatgtgcgcaagatgtttctggacatggacagtgaactatttgaagagtgccagcagcagtatatggataaacaagcaaaagccaaagagatgcaggagcaacgagaatcagcatggagacaattggaagctgttgttgctgccaaggctgctggggatgacatggataagaaaactaggtaatataaccaacctttccacttcatttatttgttagtgcttgttgtttttagtcttgtaacctaaaattgta

SEQ ID NO: 13565 - DNA, 748 bp, Zea mays
caaaatcgccagcgagagccatgccgcctcctcccctgccctcgccgagcctgaccgactgaccccacctcgccactgttctttcccttccacctgggccccacagcgcccccttaccgtcgccaccaaatccccaaatcccggaggcacgaggagggaattcgtcgcctgaccgatcggccgatccactgccgtcggcaccccaatccgccgctgccgccatgttcaacaagatcatcagtgcaaaaaaatgcggaccgagtttgaacacattggcggcagcgaaagccaattcatgcagaatttctttgcctagtgagatcctgctgtagttctgagcccttgctttattcagcccctccttttctgttgtgttaatttatgaataattggactcttgtgttaatccttcagtgtctgccctagttacggacccacaattgggaaaatccaagtagagaaaattactgagctagattgaaatcttttcaatttatttttccttttttacttcttttctccttgttgggagttaatttcagttcatgttgttgtatggaggtaacagcacaaatgcagataaaagctcatctgtagtaggaactgtttcgacgttgctgtggttgttttagcaatataatggctcactggtacgcccgattaagttctggtacctaaaaaaaaaaaaaaaaattgttttcttatgcacgctgcattattttcttcacggtcatatattttctgattc

SEQ ID NO: 13566 - DNA, 2360 bp, Zea mays
gcccatgtcccacgacgccgtgcatcacatgtccacagtccttcgtctataccgcatcataatgtaccctttgcctaacaagatatgctttatgttgccacttctgatttctagaaagtattttaccgtgttgttaagttggtagttcctgctttgtaatttctagaaagtcatcgtgccgactgtttttgcagattgcccgatgccttaacagttctcacttccaggttgctgaacgcgctttgttcttgtggaacaatgatcacattgtaagcttgatagcgcaaaatcgtggtgttatatttccaattatatttgaagcgcttgagaggaatatacatagccactggaatcaagcagttcatggtctcactgcaaatgtgcgcaagatgtttctggacatggacagtgaactatttgaagagtgccagcagcagtatatggataaacaagcaaaagccaaagagatgcaggagcaacgagaatcagcatggagacaattggaagctgttgttgctgccaaggctgctggggatgacatggttttggtcaactaggtaatataaccaacctttccacttcatttatttgttagtgcttgttgtttttagtcttgtaacctaaaactgtactacttttgttctcggctttgttctagcatatctgtgagatgcattgccactttttgtactgctcaccttttgttttgagtcatggcagttcacaaaaagatgggatatatctgtaccaaagtttcaatttattatggacaattgatttttagtaatgtcagtaaaaaaaaaatccataaggccgccaacatcgtttgaaaggatgtttatgctttctcagatgattgctgctcacttatttcttgagcgcggtgctagttgcggtcctcttatatcaactttgttggccggccgcgctccgatccatgttccttgcatcagtgaaaaacatgtgggccgagtttgaacacattggtggccgcgacagccaatccatgcagaatttctgtgtctagtgaggtcctgctatggttctgagccgttcctttattcagcccctccttttctgttgcgttaatttatgaacaattggactcttgtattaatccttcattgtttgccctagtttcgtacccacaattgggaaaattcaagtagtgaaaatgactcagctagattgtaaggtttcttttatttgtatttacttcttttctccttgggagttatttcagttcatgttgttgtatggaggtaacagtacaaatggcagataaaagcctttttaacctcgtgtccggcatggtagcaatacaatgtcagatcttctgtaggaactgtttcgacgttgctgtggttgtttagcaatataacggctcactctgtggtgcccccgattaagttctggttacatgttaattcgtgggtaaatggcagggggctcgccgtatgcaatttctaaatttagatctcatatttcatgtggtgtaagtgtaatgctagctgtgagtttcctagttacgacatatgcgcaagccatcggttcattaatggtcgctcgcctgtgacattcatttttttcttatgcccgctgcattagtttattcacggtttaaatgttctgattctgctcttaatcagatgatgccatcttggccggctttttttttggcagttggcacgacagtttgcaatctgagacttggcactcgtgagtcgtgagagaaacaagtcgatgtctaggcactcacgtgaaagctttccggtcggcggtgaaatagcggagtactcgttagacatcatgctcacgtgcatggcagtgtgtccctgccaaaaaagaatggcggagcatcctgcttttctatgaaacactcggtaaaatttcatactgggatgcagatggaccacgcgttatcgtcttataagtgcctgctaaaaaaatgttgaagataagtatggtgtcaccgctcgccagctgccgccgcatgctgacttgcatcatgtacgtgtccctggacagctagagttattttttacaaaaaaaatcttttaatcaatattttaatattaacctgggataaaaaagatgcaacttgcatcatgtacgtgtccctggacagctagagatttttttttaaaaaaattcttttaatcaatattttaatattaacctgggttaaaaaagatgcaacttgcatcatgtacgtgtccctggacagctagagttttttttaaaaaaatctttaatcaatattttaatattaatctgggttaaaaaagatgcagtttttgttttgttgtgttgatccattatcgctcgtcacggtaggaagacactgctgcaacaaggac

SEQ ID NO: 13567 - DNA, 2412 bp, Zea mays
tctcaggcttccccttcttcctccacatcgatcccctcccccctccactcgtctcccaaatcgccagcgagagccatgccgcctcctcccctgccctcgccgagcctgaccgactgaccccacctcgccactgttctttccctgccacctgggccccacagcgcccctttaccgtcaccaccaaatccccaaatcccggaggcacgaggagggaattcgtcgcctgaccgatcggccgatccactgccgtcggcaccccaatccgccgctgccgccatgttcaacaagatcatcaagaggggaaaccgcaagggcgcgcgcggggacaacgcggaggccgccgcgcgccccgcagcgccctcgtcgtcctccgggagcggcggcggcggcgcgggggcagccgcgcccgtcaccgtcaaccacgcctcccgggccacagcgccttcgccgtcctcgcccacttcgccgcacgtggcgccgtctgcgcttgcgaccaacccggcgggggcggcgtccccgccactcctcgagccgctcccgcttctccgcgacgtcgccgccgcggatcgcccgggcctcttcctccgcaagctccgcatcgtcgccgcgctctttgacctttcggactcgctcaagcacccacgggagaaggaggccaaacgccaggctctcctcgagctcgtcgattacgtgcaggctccagctcaggcagcgggcgccaacgcacccacgcgcctcccggaccacgtccaggaggcgctcgtcgccgccatctctgccaacatcttccgcccgctaccacccgcgctgcacgaatccgccgccgcgatcgaccccggcgccgcgcccgacgaggaggaggagccatacctcgacccctcctggccacacctccagctcgtctatgagctccttctccgatacgttgtttcgcccgacaccgacaccaaggtcgccaagcggtatgtggaccacgccttcgtcctccgtctcctcgacctctttgactccgaggatccgcgtgagcgcgagtacctcaagaccgtgctccaccgcatctatggcaagttcatggtacaccgaccattcattcgcaaggccatcaacaatgtgttctaccggttcatctttgaaacgcagcgccacaatggcataggggagctccttgagatccttggaagcatcattaatggctttgccttgccaatgaaggaggagcacaaactattccttgcccgtgctctcatccccctgcataagcccaaatctgttgcgatctaccatcagcagctgtcctattgtattgttcagttcgttgagaaggactacaaattagcagatactgtgattaggggtctgctcaaatactggccagtcacaaactgccagaaagaggtgttgtttctgggggagcttgaagaagtgctcgaggcaacacagcctgcagagttccagcggtgcatggtgccactgttcaagcagattggacgatgccttaacagttctcacttccaggttgctgaacgtgctttgttcttgtggaacaatgatcatattgtaagcttgatagcacaaaatcgtgttgttatatttccaattatatttgaagctcttgagaggaatatacagagccactggaatcaagcagttcatggtctcactgcaaatgtgcgcaagatgtttttggacatggacagtgaactatttgaagagtgccagcagcagtacatggagaaacaagcgaaagccaaagagatacaggaacaacgagaatcagcatggagacaattggaagctgttgttgctgccaaggctgctggagatgacatggttttggtcaactagatgatagctgctcacttatttcatgagcgtcatgtgcgcttatcgaggcaacaaggtatcggtgctagttgcggtgctcttatatcaacattgttgacttgggactatcagatccatgttccttgcatcagtgcaaaaaaatgcggaccgagtttgaacacattggcggcagcgaaagccaattcatgcagaatttctttgcctagtgagatcctgctgtagttctgagcccttgctttattcagcccctccttttctgttgtgttaatttatgaataattggactcttgtgttaatccttcagtgtctgccctagttacggacccacaattgggaaaatccaagtagagaaaattactgagctagattgaaatcttttcaatttatttttccttttttacttcttttctccttgttgggagttaatttcagttcatgttgttgtatggaggtaacagcacaaatgcagataaaagctcatctgtagtaggaactgtttcgacgttgctgtggttgttttagcaatataatggctcactggtacgcccgattaacaaaaaaaaaaaa

SEQ ID NO: 13568 - DNA, 1755 bp, Zea mays
ttttttttttttttttttgctccaagacaccgaaatgtctagatgaaacctgaagggctacagcataatcaatttgtcgaaacgaaagtaacagcacaggaagcctagcctcagttttttttttttttttttgcaatctaaatttatctttccataacagccgggcacatgcgtttacatacaattggtggaacaggcgcagtacaaccaaaccaatctttcagggatgtctggacacatttattttcgacgtacagagcacggatgcggggtagcaaattcttaccgctccaaggagggaagattttgcggcatgcagtcacttcaataagaatgacatgtattatcgggatggccagagccttgtgtttatttgcatggtgcgtgtttgttcaggtactccatagccaaggcggcgtgcaacgcggctccgacggggagcgcggcctcgtcgatgtccaggtgcggtgagtgcacgtggtggaccttccccgtcgcctcgtcgcggacgccgacgctgaagaaggccgccgggatccgctgcgcgtagaagccgaagtcctccgccgccatgaactgggggcacagcatcacgctggcctcgcccagcatgctctccgccaccgccttggcgtgggagtacatggcctcgtcgttcacggtggccgggtacggcctcatcctctcctccatcaagtccaccgtagcggcgcagcggctcacggcggcttgtccttgtatcacctctctgattcttttcacgagataggacatgccatcgttcgtcatgctcctcaaggtgccgcccatggtgacggattctgggatgacattgaaagctccgcctcctcctttgatgaaggtcaccgacacaactgcgccctgtagcgggtcggtctcgcgggcgacgagctgctggaggctgagcacggcggaggacgccgcgacgatcgggtcgacgacgtgctgcggccccgctgcgtgcccgcctttccccgtgatggtcgccgtgaaccgcgccgatccggcgaggaacggccctggcctggacccgacgagccccaccggcaacgccgtgtccacgtgcacgccgaagatggcctgcacgttgtccaggacgccttccttgaggacgtggtatgcgccggcgtgtccctcctcggctggctggaagacgagcttcactgtaccctttaaatcgtccctccgagactgaagcaacctagctgctccaagaagcatcgccacgtgggcgtcatggccgcacgcatgcatcttcccgtcttccttgctcttgaactcccattctaccatttcctggatggggagcgcgtccatgtcggcgcggagcgcgaacacggggcccgcggcggggccggtgatggtggccacgacgcccgtctgcgcgacgggccaggcgtacgggacgccgatcgcgtcgagctcggcgcgcacgagcgcgctggtgcggtgctcctggaaggccagctccgggtgctggtggatccggcgccgcacgccgcgctgccactccgcgaactccggctcccgcgccgcgtccagcagctcccgcgcgagcgctggcgccgccgccatcggcgccgtgctccaacggacagacgaggaagtggaggcagagtcgagtgagcctcccggccggcaagcaggggcgtcgcgtcgggagtgccgccctgctggggcttctgtttcgcgtgggagtggcaaactgctggggcttgtcctattttttttttc

SEQ ID NO: 13569 - DNA, 1683 bp, Zea mays
attcaagccatagcaagcatgctcctcgggatcgaatcaatcaatcaatcgtaaaatgatcaaaaggcgaggcacacgaacctggatggggagcgcgtccatgtcggcgcggagcgcgaacacggggcccgcggcggggccggtgatggtggccacgacgcccgtctgcgcgacgggccaggcgtacgggacgccgatcgcgtcgagctcggcgcgcacgagcgcgctggtgcggtgctcctggaaggccagctccgggtgctggtggatccggcgccgcacgccgcgctgccactccgcgaactccggctcccgcgccgcgtccagcagctcccgcgcgagcgctggcgccgccgccatcggcgccgtgctccaacggacagacgaggaagtggaggcagagtcgagtgagcctcccggccggcaagcaggggcgtcgcgtcgggagtgccgccctgctggggcttctgtttcgcgtgggagtggcaaactgctggggcttgtcctattttgacaactgtagctacaaatcaaacttacttctaataactcgattaaacgtgaaacttttctaaatttaggtgtggcaaactatgaataagtgggggtgggcccgtttccttacgagttccgatgctgaaagcccggcccaacaaacgcagcagcaatgtgagaccggcccagccagtgacacggctgcgcgaggaattttacgaacagggaaaggaaaaagaaattcacaaccaaaataggacgaagaaaatctaagaaactgaaatccaacaggggaatttccctttcggctgctgcgaaactgcagccaaccaaggagtggaggagtaggagtagcggcagtcaaagcgtggcgggcggacgggcgggcaagctggaacccattggatcggtggtatcaaggaatcggaagagggacccggctctcccctccccaccccgcgtcccacgtcggttcccctaatctgcgtccgcggcgtgatatgagacggttctgtaattgctgatcggcgtgatgaattttaggccaatagttcttatcttcctcctgctcgtgctcattgtcacatcacagtttgagtggaagcagcatattggtgaggctgaggcgaatccaacagctacacgaaggaggcaacaggcgcttggaagggaggatgctgttaaagagaaagtaatattggcacaagagaaaaacattcagcagcttaatgagcttattcagagccttcagcttcagctattgcattgccggggcagtaacagttctgctcagaccgcctcaagccacagcgaagtggagggacatgaaatgattggtgactgataacctctcatcccctcccctctgttgacataggtagtttgcttcagagtataaccaagacaagaacagaagctcttcaggcaatggaaactcttgttgtcgccttacggtgggccggtagagttactggtattatgtgctttacgttatcagtatcacctccttttgcattctcacccagcgtgtacagggttttagtatgttggtctaggttactttgctgatcaaggttcgaatgtatttgttcttttaaacatatgcactccgatctttatatgatggaccatttctttgtgtcaaaaaaaaaaaaaaaaaaagggcgccgccctagttctctctcgtgc

SEQ ID NO: 13570 - DNA, 2442 bp, Zea mays
aaaataggacgaagaaaatctaagaaactgaaatccaacaggggaatttccctttcggctgctgcgaaactgcagccaaccaaggagtggaggagtaggagtagcggcagtcaaagcgtggcgggcggacgggcgggcaagctggaacccattggatcggtggtatcaaggaatcggaagagggacccggctctcccctccccaccccgcgtcccacgtcggttcccctaatctgcgtccgcggcgtgatatgagacgtttgagtggaagcagcatattggtgaggctgaggcgaatccaacagctacacgaaggaggcaacaggcgcttggaagggaggatgctgttaaagagaaagtaatattggcacaagagaaaaacattcagcagcttaatgagcttattcagagccttcagcttcagctattgcattgccggggcagtaacagttctgctcagaccgcctcaagccacagcgaagtggagggacatgaaatgattggtgactgataacctctcatcccctcccctctgttgacataggtagtttgcttcagagtataaccaagacaagaacagaagctcttcaggcaatggaaactcttgttgtcgccttacggtgggccggtagagttactggtattatgtgctttacgttatcagtatcacctccttttgcattctcacccagcgtgtacagggttttagtatgttggtctaggttactttgctgatcaaggttcgaatgtatttgttcttttaaacatatgcactccgatctttatatgatggaccatttctttgtgtctgtgacggcgtttttttcatgctcggcatgttgcagagctcttgtttctgtgcaagattcaaaattttacccagcaaattttgttctttgccaactacgggtgacaggtgacagtgtgctctaaattttacactataaacgctagtttgggagccacaaaaccggagaggattggacaggctaaaatttatttcttatttaaatttgattaagaaagatattttagtccctccaatcctattcggttttgtagctcctaaactagctttaaaatttaagaatcgagccttattttatttatttttgaattagaaataattttggactaacaaaattgtgaacaagcatttggattgtaaaccattaccaacgctgtactcatgccctgactcccttgtccttcgtgtacgttggacagcggagcgaagaggagagggcaagaaagagataaaagcggcactctccagtttgaagcaagggattgaattccacttcgctgcaatgaagagatgtgtaccaagcattctcttgctggcgcctttgtgtgcttctttttgcagagtgtgtgtttacataataatattaaatggtcacagaataagtaaaaaataattttcatatatatggccatagaatacagtacttgtatgcatatggtgaaattcgtttgaaatttaatttgatttccgggtctcaaacaagccaagcacaaccccaaacatcgcattacgcttacgcatgatgatcactccaaactttcacgaagaaagggaaaaaaataaacaaagcaagagcaactaaacaaaaaaaaatcacagcgacggctagcggcgaacagcttagcatcccttctgcgatgatcggagcacctcgcaggttgtcttctggaagacgacggcggcgccaccgtccggcgacccgagctgcagactgagtgggcacttggcctccagcctgcaccacgtggtgtgcagttggtacttgacctcgccggagagcttcgcctcgacgtcgaacacccccttggcgctctgcctcctgtacgccctgacgccggcgctcccgagcacgacgctgacggcgtcggcgccgctggagaggcggaacacggcggtcttcctggcggacaggacgtaggggggcgcggagacgacgtcgacgcggtcgaagcgctggtcctcgaagaggtagtcggcctcgagggaccggaaggtggcgcccatggcccagttggggttgcgcacgcccagcgtgagcgtcaggttgtaggagatggcggtggcactgcccccggacggcgaggtggcgacggtgaagcgcgcgagcgaggcgtcgtcgacctcgaacctgggctgcgccgcgtggccgtagccgaggatgagcacgacgatgacggcgaccaaggcgatgacgacgaggccgatgcagaagccgcacgcgaagcgctggtacggggtgcagcaggagcagcagtactcgcagtcgtcgcacatggtggatcggagatgaagtcgaacgaaggtaccttgcttgctggctatggcgaagtcccaagtgtacgtcgtgtgtgtgacggttatgacagttttgtgaggaggcctgggccccccccccccgcccgcctcgagggtccc

SEQ ID NO: 13571 - DNA, 1636 bp, Zea mays
ggccgcttttttttttttttttttcgagaaaaatctactgcacttttgtcatatatatattgagcgaactaagatgacatcagacattgcagttatctgaaagcatcattgatcacccaaccaaatattacttttggagatagttgttccccattactaggtctagcagagaataacggaattatacggcacaataggttactaaaagtcgtatttggaatcaagttgactcaagtatctaggcatgtggcttagcacgcactcattttttttttttttttagtttgcttctctcgcttgttcacagtcttatcataaaaagcacagtaggaactcatgtaaccttctatgaattgcaggtgaacaatgcacttatggatctgataaaggccaccggatctgtgatgaaacctgaagagtggtcagcccagcctgagaacacatcgggtaagcttaagaagactaaacacctccgatttctcttcaaggctaactgttccggatcaaatctcttacgctgcatcctcatcagagactggggcactcatttccgcgaggcccattaccgtcacgatgcaaacagatgaaggtgcaaatgctgccgtagcagtctataacttgcttggcaagctgcaactaagctttctttatctcataggggtgatagtcatggggtttgagcacatcaggaacattgtaaggataatgaagccagcaagggttgcaccaattgactcatgaggtaaataaaaggatacacatcctgctccctcgattgcaataccagcgaaacaaattattatctgccttgtggcttcgcacctactgaacttcctctgattctgcaggaccaaaatacgtgtaaattattctttgagaccttgttgtgggagtcgagatgatactttttcacttctcccccatacctggagatgatgattttagagtagcatctccaacacatgtgaaactcttcggaggaaaggcctgctcatagtggcagaataatccgacacggataacactgaacaaacagtgaccgcctggacagaagtgtctgggccacggttggtgtatgcacctgtacctgtataaagagtatctgtaacttgctgcttctatttcacggccacatgctgcgctggtgctgtccaccatgcttctgtaccatactgaaatttcaaaaccattctttgttgctcatttccgtgtggcttgctccgctgtctgttttctgcagtagcagatgtaggtgctctgagtctgttttccgatcgagctgacatcatcatctttcttgcaaagacatacactgcgcttaagcggccgaaacgctgcaggtgcaggggcagtgcgtcggcgtcgatgatgatggctccatttgcctcgccggcggcagcgcaaacacgaaccgttgccctgctcggcagactggtcggtcggcggcaagtccttagtctgtcttggcaaaatcagggtggacggctgcgctgccgcttgccgatgcctggcgtccggcgacgatccacgggccacggtgtagggtaagcacttgcgacacgcgaggggaagccggcgaggaggaagaagtgcctcttctcttctacgcgcgccgagcgagagagaataggtaggt

SEQ ID NO: 13572 - DNA, 2257 bp, Zea mays
atttcagtaaacggtcgattcaaaatggggcgagacggagtgcagcaaaaaccccaagccccgcaaaacccctaaaccctagctccccacccccagcctccccgcggcttccagcgattggaggcgaagcagccgccatggcgatcctccttaggcgcgcgtcgctgcggcgcgtcatcgccttcgccgccgcctcctcctcctcctcttctttgcactctgagatttataagcaaggggtttgtggatccatgtttcattgccgagagttcgcatcaaaagccaaaaaaaagaagtcaagtggaacagactccgatgaggagagtatgtcaaagaaagacttggctttacaccaggctatcgatcaaataacgtctgcatttgggaagggggcaataatgtggcttgggcgttcgcaaggccttagagatgtacctgttgtgtctactgggtctttcgctttggatatggctctaggaactggtggtcttccaaaggggcgtgtcatagaggtctatggtccagaggcttcaggcaagacaacacttgctctacatgtcattgcagaagcacaaaagaatgggggttactgtgcctttgtagatgcagaacacgctttggatccagctcttgcagagtcaattggtgttgacactaacaatttgctcgtctctcagccagactgcgctgagcaagcactcagtcttgtggacacactgattcgaagtggatctgttgatgttgttgtagtagacagtgtagctgcgcttgttccaaagactgagcttgatggtgagatgggtgatgcacatgttgctcttcaggctaggttgatgagccaagctcttcgcaagcttagccactcactttcactttcgcagacagttttgttatttattaatcagatcagggccaaggtagccacatttggatttggaggaccaactgaggtcacttctggtggtaacgccttgaagttttatgcttctgttcgcttgaacatcaggcgtattggttttttaaaggaaggtgaagagacaataggtagtcaggttgctgtgaagattgtaaaaaataagcatgccccacccttcaagactgcacagtttgagcttgaatttggaaaggggatatgccgcagttctgagctttttgaacttgggttgaagcacaagcttatccaaaagactggcggtgcatattatagattcaatgatatgagtttcaaaggtaaaaataaccttaaatcttaccttactgaaaacaagagtgttgcaaatgatctggagacgaaactaaggagattgatgggaaccgaagcacctaaagagcaggaggcagaagacagttcgccgagtgatttgcctgaagaggttgtcacacctgaagcatcctcagaagaggatatgggagtcgtaatcgaggcttgaccagtgatctgacgtgctggcaagcgagaccagaatttctggagctgttcctgtaaaacaatattttgggtcctgaagtcaccaccgcttggatcgacatgaccctgcggtgttctggtgattccattgtaacagacttcagcccttaccgtgcttttacagtagtgtagcatgaagagaattggcattgtgtgaaatcatgctgatagctgagaggtggaagttgaaggcggtaaggttgtggtctctggctatctgaactctagtgtagtatatagtgtaggcgacggtaaaatgtagtggcgtggtcgtgtatacatgatgctcacattttgagctcctggtttcacgtcgaagccaatttcaaaaaaaaaaaaaaaagagcgcagctagaattacatcgaattcccccctcttccggtacttgcctggtttctgctttgggatagctgttgcttggttattctgatctgcgctgatccgtgtttgccgatcaggcccgttggcaggtcctttatactggagtatctctttacaggcacattttctttgaggaatggtagacagtctgtggatcaagcaaagtgtcaatttttggaatcgaagtcatccccatttccattattaaagcaatggaaatacagcggttttgaaagtttagacagcaaaagaaacgctggaagaagctagagcgaacgaaccgttcatgcttcttgtcagcttttcaaccagtagctgaaacaaaccgccagcttgttgaagctcagttgtcagttggcatacagattggagttgccagcaaacagccggggtgcagattgacgcag

SEQ ID NO: 13573 - DNA, 1982 bp, Zea mays
gcacgagggtcggtcaagcggagtgtacacagcaagcgccggcccgcgggcgctctcccgaatcccgacacccggagttggagttggagttggaggagcccggagaggcggcgaccggactcaaaagagggcggacgcaaccaaaaaaaccctgagtcccgcaaaacccctaaaccctagcccctcacctctcgcctccgccctcatccgcgcgacttgcagcggttggaggcgaagccggctccatgacgaccctcctcaggcgcgcgtcgctgcggcgcgtcattgccgccgccgccgcctcttcttttcaccctgagagctataagcaagggatctgtggctccacatttcattgccgagagttcgcatcaaaagcaaaaaagaagtcaagtggaacagactctggggaggagaacatgtcaaagaaagacttggctttacaccaggctattgatcagataacgtctgcatttgggaagggggcaataatgtggcttgggcgttcacaaggccatagagatgtaccagtcgtgtctactgggtctttggatttggatatggctctaggaactggtggtcttccaaaggggcgtgttgtagaggtatatggtccagaggcatcaggcaagacaacgcttgctctacatgtcattgcagaagcacaaaagaatggaggttactgtgcctttgtagatgcagagcacgctttggatccagctctcgccgagtcaattggtgttgacactaacaatttactcctttctcagcccgattgtgctgagcaggcactcagtcttgtggacacactgattcgaagtggatctgttgatgttgttgtagtagacagtgttgctgcgcttgttccaaagactgagcttgatggtgagatgggtgatgcacatattgctcttcaggctaggttgatgagtcaagcccttcgcaagcttagccactccctttcactttcgcaaacaattttgttatttattaatcagatcagggccaaggtagccacatttggatttggaggaccaactgaggttacttctggtggcaacgccttgaagttttatgcgtctgttcgcttgaacatcaggcgtattggtttggtaaagaaaggcgaagagacaataggtagtcagattgctgtgaagattgtaaaaaacaagcatgccccacccttcaagactgcacagtttgagcttgaatttggaaaggggatatgccgcagttctgagctttttgaacttggattgaagcacaagcttatccgaaagagtggtggttcgtattatagtttcaatggtaaggctttcaatggtaaaagtaaccttaaatcttaccttactgaaaacaagagcgttgccaatgatctggagatggaactaaagagattgatgggaactgatgcgtctaaagagcaggaggcaggagacagttcgcagagtgatttgcctgaagagagtgtcacacctgaagcatcgtcagaagaggatctgggagccataattgaaggttagccagtgatctgatgtgctggcaagtgggaacagaatttctggagcagttgttcctgtaaaacaatatcttgggtcctgaagtcaccaccgtttggatcgacatgccctgtggtgttctggtgatctcatcatagcagacttcagtctttactgtgcttatacagtagtgcagcaggaagagaattcacattgtgtgaaatcatggtgatatctgagaggtggaagttgaagtaagccgggaagggtgaggtattgtggtccgtggcatttaaacttcagtaagcaaacgccgtgtatatatgatgtgcacattttgaaaccgggcattctttattgactgctgctagatttacattgagctccctccacttccaatacctaccttttttttgcgtggagctagttttttggatggtgccgccccggaagcctgttgctggaagatccaatgtcgtagag

SEQ ID NO: 13574 - DNA, 1487 bp, Zea mays
tgggtaccgggccccccctcgtgttttttttttttttttttttttttttgaagccggagaagacattatttcatcgcagagctgacgagtcaaatcagaaatactactacatgatataccatcataaggtaacagtaccagcacaactgttttaactggaacctcagaactgttactgtctataggaacctacatccgagtttcaaccaagagagctggtcaggaagtcgagcacgcatcggttcagctcctgaaattctgtttcagaaagagctgcttcaaccaaaaacctgcgtatgtttgcttcagaggcctcctcgtagtccttcctccgcttcagtaccagatgaccactgagctcccagattgctggattgattctcatgtcgaggaactcttggctcgcctttccgagaagctgcttctccgcatagcactgtggtagaaggaaaattctcttgccagattcagagatgaggacattgaaaggtctgttgttctcttgcaggaagatgcagactttggagaccacatctgacaaatcttccaggctcgcaccaccttcgaacacaaagccattgactgggtaatccaccaggtgaaaaatgctcacgctattccctagggtcttgagcttctccgtgattgccttttcaactggatactgtactttcaggtagtatgcctggaagtgaaggtggttgatagttgcaaagccgcccaggctgttataaccaactctgaagaagggagtccttgcttctcttgcaacatacatggctattaagaagctctcttgatcaatcctttgcggcaaacagtcctggatcttgggagtcaatagcacatggcagtagccaattgggctcacattaatcaagatggcactagaagaagctgaaacagtatcaggaacaccatcaaaatattgtgcagggtctttctcagtgtcattgaatctaaagatcacctccaacgggctgacttttgtgaaattgaacttctcactaacaaatggctggagaacttggttcattgtgaactcagttggccgcttcttttggtcacgtccttcaattaatgttgccacaaaattatgtactccaggtagcacctttgtttcacaggaactgatgtcatggtgaaacaagccccttgtcttgcgatcatcccactcattaaaaagtttgagtagaaacggagacagatttgaaccttcgtgctctgtcaggtcaaagctagtgccatccatggttagttttgttgcagctgaaagcattgccaaaataaatatacaggaatcagacagcgcctttccgagcacaaaaaacaggcggcaatggcgcccaaggattggagtctcactcaaagcaggttcccgaacgaggtttcctactttcctctgagatttcggttggatttcggagcgaagacagcagtagaaactgcaaaactgagatgaaagggatagacgaagatggcagatt

SEQ ID NO: 13575 - DNA, 3747 bp, Zea mays
cgccgcgacggtgggtcaccgcggcggtgtgggcgggcgcgggctccatgtcgagggaggcgtgcacgggcacgacggcacgcgcccaggacccagaccaccaccagtttcagactttcagttgggttcgatcggctgacggcacccccgtccatcggcgccacgtgagcgatcgggccggtgtggccgcgcgagcgcgatgcctctggctggctggctggtttgcgagttggtctggtgcggacactggctggctgccagttgctcatttgcacgtcagacgtgtgcgtgacgtactgatgcagtacgatatttggggcgcgtgacgtattttccgggactttttttttgtttgtgtgtcacattggttggacttggtcgccgcccccgcggtgtctgtgacgccgacgtgttgctcccgcaccgcaccgctggaatgcaagatacggcagcgggattctgggctgctattactttctttttctagcgccacagtccacagcaacaagcacagtacgagacagagatgtccgccgtgaactcgacggagcagagcgcaccacgccggtgtccgcacgccgacgcggagagcgcgcggcgggcacggtgcatgcatcagcacaggagtccaggacagacagacagcgagggggctgggcgtggccgtggccgtggccgggggcccgtgcgcgtggtgacgtgtccgcgcccgtccaagtgtcgcacgcgcgcgccgcatgggccgggcccggacaacgcgacaccaaccactcggttcttccactcccggcccgctgccggtggaccgcagcaagagcaacagaggtggtagctcccggcccccctgacatgcatgcacctaacaattaccacctctgggcgggattatctttactttatctcgagaggcaaaaaccactgtgaaaatcccgcttgtcagtacttgcaaatcatgccacgccacagcacggtctcaaaaaaccacagccgaccatgtaaatatagaaatattaacaacaatagaatgatagatatattaacaatgtaatgtaaccacgcggtaaaccagcaaaaaccgcgtagagatttttctccgcgcgggcgatggcgaccggccggcgtctcctccttgctgactggaaacggagaacaggtggcgtcatcgcggcggacgggacgagcggtggaggcgcacgtgtcgcgcatccgggacccggggttcgacgtggcggcgtggcgtcggtgtcagtccctttcgtgctcgccagtggtgtcaccggtgcaagtaaagtagcgcgcaccaccggcggcgagcgtgtgcacgcacgcatccgaaggagaagcttccaaacagacagactctgctagctactcaaacgtggatggccatggccggcaccgggctgggtggtggagctcggcgagaaggaaaacaaaaacaaaatatcagcaattttacatcagctttaataatgttttattgaaatggttccatttgctttgttgcagcgggccttggtgtctggtctcctttagccatgccctgacgatcttatccagtagcagctgcagtgaatgcatgttctggaccattgctttcctcctcttcttcattttttttcagcgttatcgacttggcggcatgcatgtgtggaccattttgattttcgatctgaactggttataaagggaaacaaattatttgctatattttaaatgcttaaaatataatgtatttttagatattgtaactctaaaattcatcttaaaatacaaaattctaagaaaataagtggattcatagaaaacaagttatggctgtctctagccccctttcactctatttaaacttcgcttgtagaatagtatggactacgagtttaaaaatagtattttatatgatcatatgtacaagcgcaaccttagtccatctccgataacttactcatttatatctattatttacaactctattttatataaatagtgcaatctatagcgtaaaataatattttagacgatcgtatatatattattagttgtctatagccctattataaataaaaaaataagcgttgcatccaggggtggatttagaaagggcgaaggaagagcctaaatcctcgcttatttctatattacaagtagtagattttaaaaaattatcataaatatctctcaacctaacttaaatgttttcactctaatattttagtgattatctctgtacttccactgttatttgtgttggatctgcctctgggccgccaccacgcacgcaccggcaccgcctataaatacttgtggcagccctcgccgagctgctccttccactgcaggttcctaacccccacccacctcgcccaaattgcaaccttccccgagtgctccaggtcccgtggccggcccccagatcctctccaatcccaatccaagtatcgaacggatcccatcggtggcgctcgagcgagcgagtgcggccggaaccgagcgaagatgggcatctcgagcatgccggcgcccgaggacagcctgctggggttcgtgctgtacaacacggcggcgtcggtggcgatcctggcggggctggtgcgcgccgcgctgctgttcctgggcctggcggcggcggcggaggacgaggagccgcggcagcaggcggaggccgtgacggtcacggccgtggggcccagcctcgcggaccggttccggagcaggttccggccgtcgcgctacgggcggcgccggggcggggactgccgcgtgtgcctggtgcggttcgagacggagtcggtggtgcagcggctcccctgcggccacctcttccaccgcgcctgcctcgagacctggatcgactacgaccacgccacctgcccgctgtgccgccaccgcctcctgccccccgccgctgccgccgacgaggtgccccggattgcctgattagcgccctaggaattgagagtaggcgtagcactctgcacctcgcagcagcagtgtctctgtacaggttttttttttcttttcctttttgttcgggggagagagaggacagaacggagattgaaggaagaaaatggtggcaacaaagctgttccccctttcgtttctccgaagctctctgttgtctttattcattccaaaagtataatctactcgtatgaaccaagtactaaaatcctgcttgcttacgcaccaatctaacaagagaaatctggagttggttgcccttgcctcttctcttgatctgagcaaggccccccaaaaaaggatactagtggtatttattgtatttatatgtaatcaagtaggttgggcaaagagaaggtaacgaaacggaggaatgttctagcggcgaggcgaggcgaggcgacggctgatattttgggcgaggaggcgacggctgccggagggagacgcggcatctcacgctgttctcttctttattatagatagatagagacgcgaccttaccaataatatatttcaaatcaaataatagtattgatgttcacgaataattaatttattcctaataaaataagggtagctgtagtgtagtattataacagatgctttagcaaatactcctagctaatagtctctcctaacacattacacataatatgaaaacagaagacgtgagaggaggaaaaagctaacggcggctgtgatttttggtggaggagctatatttgtaatttgtctaaatcacacacgtgtgtgtgtgttttggaggactagaacactcgg

SEQ ID NO: 13576 - DNA, 2443 bp, Zea mays
gccggccgggttccgatttttatgaaaaaggcataaaaaaatcggacgaacctgtcccgcgaggagtttagcgaagggcttttaaaaagagaaaaagggagaaaataagggcgagagaaaaaaaactgcggagaggtagcggtggatcgaaaccctaggcgcggtcggcggcgatggcggcggcggcagcagcggcagctgcagcgcctgagtcgtacatcgggagcttgataagcctcatgtcgaagagcgagatccggtacgagggcgtcctgtacaccatcaacaccgaggagtccagcatcgggctaaaaaacgttcgctcatttggaactgaaggtcgtaagaaggatggccaacagattcctgccagcgacaagatatatgagtacatactctttcgaggaagtgatataaaggatttgcaagtcaaatcatctccaccatctcagtcggcaactttacacaatgatcctgctattattcagtcacattatcctcatccagcttcgctttctacaagtttgccttctgctgcaagcacaataggagccaaccctacttcacagaatgctccatctttgattcagatgccaccgccatttcaagggaatttgcccccttaccagtctggcaccagcttacagtcatggaactcagcacctatgccatcatctgcaaatggcactggccttacaatgccaccaatgtactggccaggatattacacaccaccaactgggttttctcatctgcagccaccactcttccttaggccaccccacagtttggctgttccacaggtcctgcagcttcctgtacaatatcctggacttggatctttacctgctggatttccaaatatgccggagcttccttctttccttcaacctggtaacagtaatagtttaaatcaaacttcaggtgtacctacatctgtgtcaacgcctgcttcattgagtacatcacaaactgaatcatcaagaagccaactgccaaataagttttcatctgattcagcttctgtattttctgtgggttttactcctccatctgtgactccttcagtttcgacagttgaaccttccattcctgtgtcagcagtcttgccttctctggtgaacagtaagccagtagctctacctgactccaccatgccatctctctccactgccaagcctgtgattgtacctgatgcttcagtgcttacctatctatcatctcagccaccatctgctaatgatgtttctccagtcaatgctgcggagcaggttccattggtaacccctgggcaacttctgtcaactacttcctctacaattatatcatctcatgccttgcaaactgcttctgctgtggatctgtcctctaaggctgccccctctacagttccatcttctcaggctacattgtttgaaggttcaaccacacaggttgcctcctcttctattttgtcacaacaggtggcaatgacaaatgaaagtaaagtagccaagcagcgtgagtggaaggcaaaacaaactgtggttggtagacccggaaataaggagcccctattgcctgaaccaaagtcggtgtttcaaaagcctgtaggagtttcctcatatgtccggtacaacagtagaggtcgcggaagaggaagaggccgtgggcaatcgcatcccataaccaagttcacagaggactttgatttcatggcaatgaatgagaagttcaacaaagatgaagtatggggccatcttggtaaaagaatagggcagttaaatgatgaaccaaatggttacgaagatgatgttatagaagatgatgagatatctcctagaaagccagaagctaaggctgtgtatgttaaagatgacttctttgattcactctcttgcaaccaaattgacaatggagggaggaacggaagagtgaaattctctgagcagaggaaaatagacactgagacctttggtgactcagcaaggcatcgaccaatgggcatccgaggtaggggcccccgtggcggcgctcgtggtcgtggctattatggtattagaggatatggatatacgggtagggggcgtggctactcttacccaaatcaccagccgtgatacctcggtgtctggaagcacactgaatggcaatggtaaattggccaatttgcgtggtaaaactgagatttatcgcagattacagtgctgctgttgtaagcgtcttattagtttgtttactgatgtggttggtaattcaagaatcaacgtctcttttattgatggcagattggtgtagaagctttcacatctatatcttgttagtgtcgatggtcatttatttccttttggaggtagaagctgttagcagattgctagatgatgtaacacagatctgtccaagatcaacggaaaaacaagcagcagtattgataatctgaacaaaaggggatggagttcagggt

SEQ ID NO: 13577 - DNA, 1051 bp, Zea mays
ggaccaccagagtgaacggctgtactatttttttagctgcctagttttttagtcgtttactcttaaaaaagttgttgtgcttctcgtttcaccgtgcgccacaagcacacaactagggcgaccgccgccgacctacggccagctgtgcccatgtcttcgtcgggccctttgctggcgacgggaacccaccacaccggccgccaacctgaggttttgtgggctcagcgctccgagaagattttcttgactatctcattgccagatgcgaaagatgttgtgttaaagaccgatcctaagggcctctttaccttctctgctgttgtccatggggaaccttttagcttcactttggagctttttgattcaatactgtcagagggaagtaaaacgaagacaaagatgggcctgcgaaacataatctgttcaatccagaaagaaaagaaaggttggtggaagcgcttgctaaagtcagaggaaaagcatccatacatcaaagttgactggaacaaatggtgcgatgaggatgaagagtctgagttctctggggattcagatggtggctttgatgaggcaaatgaaggagatgaaagtgatgatgatgatgggatgctttatctccccgaccttgaaaagctaaggggcaagtgatctggctgcttcggtgaagggagtagggttgatgtaacaagttaccgttgacgtgacagagtaggcttatcatcgacgtagttggggtcttacttgctgagcatctgcgacggcttgagacttttaggcatgtcttctatctccgaagcactctttcggtctttcctgatcagtgagctagcgctctgaaaacgtagcgatgagctgtcccattttcgactaactatttagtgccagtgaatggcctaattctacaactatcacgatgtgcctatatgttaggggattatggattctgtggtccgtctttgtggtatgggatttccgttggcaggcaggccagtgtgatatgcagttcacttcgtttaaaaaaaaaagcaaaaaaaaaaaaaaaaaaaaaaaa

SEQ ID NO: 13578 - DNA, 1153 bp, Zea mays
tgggaattgttaagaaaacatccggaggaggtgtttctgcggtggatcagaatgtctctggttcagccatcactgagagaaatgatacggagcatactgattctgatggagttaaatcggaaaataaaactcctgtgcagaaaccactactgtctgttggtgcgaagattgttgccagcaagaagaggatattggaagcagagcttgataaatccactgggagatcaccaattgctttgccatccatgaaaaagacaagaaatatgtcttctggtcctgagataaaccaacctgataagtctactggagataaacttattgagaataattgtgattcgggcaataagcgtgttctgagggaacggcagcatcgcaatcaaacaaatttgtcaaccagatattctaatcactctaatcaaaatgatatggagcagacacaggatcaatctgatgatgatgagatcagcagcgatacttcctacaggagaactcgtagcagacgtcgttgtggtgctgcccgtcttgctgtgccaaaacaagaggactctagtgattctgaagattttattgctgtgaaaaagaatcggcggaaacggaagaaatctgtgcataaacaaagggctggatctaagttgaagcatacttctggtccttccaaagcaggtcgtttgggtagacctcctctgatcaaatctgaatctagttccttatctctgcagccaggaaaaggggaaaggaaggtgcctgaaggtacaggaactcttcgcgaagaaaagcaaaaaataagtgatcagataaaagccatgcttctagatgctggttggacgattgatttaagacccaggaatggtagaaactacatggattctgtgtatatacctcctagtggcaaagggtcttactggtcagtcacaaaagcatattatgcgtttcgtgcaggtatggaatctgagcagaaggaaagtcctaaagaccagtctttgtcaacaaaatctgttggtagccccgacaaaaggcaggtctctagttcttcaggttgtactttaacagaggatatccttagcaaattaaaaagagttgttgtaaacaaacgaacaaccaaattagagattcaaaggctcacccagaaaaggttcaaaaaaaaaaagagaaa

SEQ ID NO: 13579 - DNA, 875 bp, Zea mays
tttttttttttcctgtgaaggaaagcttttgcgggtcattatactagagcgaaaccatataatcgtttgagatgtgcgttgcatgcaatgcaatacaatgtccctgaggagaagcaaaatctacaggtaggcgtctgcggcgctgaggtcatcgaggatcttgttcttgacatcctgtggaagcgaggcggacggccctgccttggagtagaactcggccagcgacctgatcgccttctccagcgcgacgtacgactcctcgtcggtgacggcctgctggcctctccacccgcccaggaacgccctgatggactccttggcggcgtcggcgttgcggcggaacctggccatgtcgccaccgtcgtcctcctccagcgactcgcggagcgtgcgcaccacctccctggccgccttgaggtacgccttgggcagcaccttcccggccttggtcgtctcgttgggatcgaagatggacttgatggcgccgaggacgccctcccctccgctgctcccgtcgtcctccgccgccctgaccggcgccggcaccgcagcgcccgccaggccgaggaggaggagggaggcggcgtgggctctcctggtgatccgcagcctggctccaccgcagataggcttgtgcctgctttccgcaggtcgctgcagcttaggcagtgacggcgacgagcagcacttgtgaagaggcggcggagggggaggcattgctgatccttgctactacctctgcaatgcagaagcaacagattctttgggttgctcctacgtaccttgttcttggttcaagtcgagcctatgcttcgctcaatccaaaaccttatctgcaacactcacattcgcttggcttatacaaccgttcatat

SEQ ID NO: 13580 - DNA, 2313 bp, Zea mays
tcggtacccctggtatgtctaacgtcgacctgcagctatgagactagcatagctgttctgtctttacacctcacattgatgatgaccatagtaggttagattatctgatctgatatcttgattagttgcacttttctgatggtgtttagtttttgcaccttgttttctatttcagatcctcagctctctcaatattgagaagctgatcattcctgctctcacagaacttgtggacacctggacatctaaatttggatttagtccactggacgattctgagaagcaggaagtgaaatccgttagcatgttagtttttcctggtacaggtcttctccaaaagccattgctgaagacctcaccatcggaagatcaatgctcccaaggaggtcagaacaaacgccatatgccttgttgatattccaaaaaaaaatttccttctatataacggttaccatacatttatacggctggtgctgtctcttctgtagacaaaactgaaaaatcatctgatgtagtcaatgaagattcgctttgctctggtgcaagtgccgaccccctaggttcggtggtcaaagagcatggggacaccagcaaagatgccgatggtacttgcaacggtgatgtttcacagcgatctcctctttcctggtacgtgcaagtaaagcttacatgtctggttgagatatcgacataaattgcgtaatggacgttacaatgttgagaatgtcacctattttgatttcgtaatctagttaaagaaaaatcctgctatatagggtggtgtgtcgtagatatctttgtcgggctgccacaaactagctgcaaatgttagtcattccaccacaattagacgtgtctcatgacctttttaatctttgttgcagatggtaagatttggttgcagctttctgggcccccccaagctttatatggacgaaacctccgtttgtttttgtacctctcgagttttgactcagcagccagcatgacaaccatccgtttggcagaaagaggcttccggttttttgcagattagttgccggggcacccctgtagttgtactcagaatttgaccattgactcgtcggcctgggaaaagaatcagcccgtgcagtactgaaaagcgtttactccaaccaggaaccagctaacttactgtgcagctgaaaagtcagtatgcagaatgtggaggataatatcacttcttttgtttttttttggtcgttaacttagaactccgagggcgagtcgtcgtaaatgttacaccagttgttattttgttaatagctttttttttaaaaatgttttcgctagcgcattcctagaaccttctcatttctgtaagatagttctcgcctctgtaagataaactaatgtatgcgcaagctagaaatagtccgcctgatccgtcacgcggaattggttacctaaaccctgttaatgtttcgttttgcatcgtgttggaatgtgtgtgttcttcctgtgaaggaaagcttttgcgggtcattatactagagcgaaaccatatcatcgtttgagatgtgcgttgcatgcaatgcaatacaatgtccctgaggagaagcaaaatctacaggtaggcgtctgcggcgctgaggtcatcgaggatcttgttcttgacgtcctgtggaagcgaggcggacggccctgccttggagtagaactcggccagcgacctgatcgccttctccagcgcgacgtacgactcctgcagtgcagtgccagtgcagtgaagcaggcgggtaactaaaaaagaatcaggtcatcggcggagcctcacgatcacgtacctcgtcggcgacggcctgctggcccctccacccgcccaggaacgccctgatggactccttggcggcgtcggcgttgcggcggaacctggccatgtcgccaccgtcgtcctcctccagcgactcgcggagcgtgcgcaccacctccctggccgccttgaggtacgccttgggcagcaccttcccggccttggtcgtctcgttggggtcgaagatggacttgatggcgccgaggacgccctcccctccgctgctcccgtcctcctccgccgccctgaccggcgccggcaccgcaccgcccgccaggccgaggaggaggagggaggcggcgtgagctctcctggtgaccgacagcctggctccgccgcctgctctgtttgcgcggcggcacgcgaggaagttaaccaaacgccagagcaccgaggaggaggagcgaagagggggcaagaacgatggtgatgaggcacgtacagataggcctgtgcctgctgtccggagctcgctgcag

SEQ ID NO: 13581 - DNA, 3149 bp, Zea mays
tagacattgaccttttgcactgtctcattaatgcatgggggatgcaatctgatgttgaaaggcaagatttctttccagttagcattgagggcgatgaccccaatgatgacacgtgtggtatttgcggcgatggaggcaatttgatctgccgggtcggcccccccgccccatttcactatgagttgtctaggactgcaggcacttccctctgattattggtgttgtgcaaactgctcatgtaaattttgccacgaacattctagtgatggtgctgaagacaccgctgatgttgattattcattgcatacttgttcccagtgcgaagagcagtatcatgaagcctgctctcctgagactgattccataagtaacctttccagtcagacaggcaatttattctgccaacaaagctgcagactgctgttcgaggaattgcagaatcttcttgcagtcaagaaggatcttgaaccagaatattcatgcagagttgttcaacgcatccatgaagatgtaccagaagaagtccttgctttggacaaaagagttgagtgtaactccaggattgccgttgcactttcattaatggatgagtgcttccttccgattattgaccagagaactggcatcaacttgatacgaaatgttgtgtatagctgtggatcaaattttgcccggttggatttccgtggattctatatatttattttagaacgtggagatgaaataatagctgcagcatctgtccgaatacatggaaccaagttagctgagatgccgttcattggtacccggaatatgtataggcgacaagggatgtgccgccgacttgtagatggaatcgaaatgatcctcagctctctcaatgttgagaagttgatcattcctgctatcacagaacttgtggacacctggacatcgaaatttggatttagtccacttgaagattctgagaagcaagaagtgaaatctatcagcatgttagtttttcctggtacaggtctcctccaaaagccattgctaaaggccttgcctaatgaagaacaatgttcccaaggagacaaaactgagaaagcatctgatgtagtcaatgaagattctccttgctctgatgcaagtgctgatcccctaggtttggggttgggggtcaaagagcatgaggacagcagcaaagacgctgatggcacttgtaacggtgacgtttcacaggaatgtccccattcttgatgggaagatttggttgcagttttctaggccccaagctttacatggactaagcctccatttgtttttgcacctcgagtttttgatccagcagttagcatgacatccatccgttggtgagaaagaggcttgccgggtttttttttggcatattatattagttgatggggcaccccttttagttttactcagaaattgatgattgacgcgtcggcctgggaaaagaatcaacccgtgcagttctgaaaagcgtttactccatccagccagctaacttaatgtgcagctgaaaaatcggcatgtagaagaatgtggaggataacgtcccttcttttgtttctcgtcgttaacttgagactccgagggcgaatgcagccattgaatcgtcgtaaatgttacagcagttgttgttttgttaataggtttttttatgtcttcgctagcgcattcctggaatctaatctcattcctgtaagataattcacatgtctgtaagatcagctaatgtatgcgcaaagctagaaatgatccgcctcatccctgtgttcgttcctgtggaaaggattcgctttgctggaatgtgtttgtttgttcttcctgtgaaggaaagcttttgcaggtcaaatcatcagttcatcaccattaagatgtgcatgcaatacaatgcccctggagaagcaaaatctacaggcaggcaggcgtctgcgatgctggtgctgctaaggttatcgaggatcttgttcttgacatcctgtggaagcggggcggacggccctgccagcctgccttggagcagaactccgccagcgatctgatccccttctccagcgcgacgtgactcctgcagtgcagtgaatagcgtcggcacggcgttcctgtaactgtgtcgactatattttgtcaattcgctacccaagacatttggaacctgcttggaacagctttttatgaatagcttttctgagaatctagcgcatgttcgtttctgagtattttgtctctgtagattagtagctacggctacaaaacagctaagattctcgatattctacctgtcaaagagaatcctagatgaataggtatgcaggtttagggctaggaaatgatgaatttctctcgtcatgacgacaaaaaaattctgcatttccgttgatttggcgatgtgtttagcggtcagaagctgattccaacagtcaaaatctgggcagaacccgaaaccaacatgccactggtatcgccactagccactgtttatgggaagcagagcactctagtttacttatcctaaaagaactgagaatgtggaaattcattatcatatcagatgtctaaactttgcattcctctcgacgtagaggacgtgtgtagaaaggaagaacaaaaaaaaaaaaaaaaacggcaagcatgaacagaaaaccaatccacaaaccacttcaatacttcatcccctattcgtttccgtcgattgggtcgtgggctgggcctggcccccgatccggcgctttttaaaggcctcgtggtcgtggccggatatttgcgcgttatttcggcgaagaaaacgagcgcacgtctttctgtatcgagcgacgagatattttcagccgcgcccgcgcgccggatgccggaagcagatcgagagacgaaccaaccagcgcgacaaaaaccaaacacggtcaggatcaggaaggagagagaaagagaaacctctaggcggcgttccgacgaccgggaccactcgctttcaccttatccagggagcctgaggtagaccaactcttgttcaaagctcataatactcgcatgtcataaagctttcaaattttacctacactatatatggctacacatccatgcgtttactactgtcgtcaccatagccagtcatatatgataattttgaacatatgagtagatataggttaataaca

SEQ ID NO: 13582 - DNA, 3271 bp, Zea mays
cattgggtacctcgaggccggccgggatagatagggggcctcccgcgggccgggcgggaggaagccaagtcgcctgacttgcgtcttcttgcttcctcctgtgccgtgtttcatttctttgacacaacgacgtccgggcagccgcctcctgtcgccagttcgccactctctggttgctgcacgcctctagtcggcggggccaagaggtggaaaagggcaggatgaagtccggcgagcggccgaagcagatgcggggcgtccggcaggaatctcggcggttccggcttctggtcatcgtcgccggcttcttcctcgtctccctgaccttcgtcgtcatctccaagcccgattccatcctgtccagcctgaacggcaagctgccggtggaccaggcgccgacgtccatcctgatccagcagaaggttaactcgccccccgccaccgcacttgagacctccaccgacgcactgcgtggagaccctagagtggtcgatgacgaagccgatccaagaccacaggggttcaagggcgaggaggaagagagccgggtactgagcgagccggacgcgaccagcgggatgacggagctgacccccgacaaggacggcagcggccgtaaatccaacgaggaggtgctaggcggcggaggtgacggcgaggggaaaagtaaggaggaccgcggccacgggccggagaagcataaagtgacgctcccaaccgtttccaactacactattcatgacaccgaggacacccaaaatgccaagcaagacgatacaagtaatgaccagcaggggagcaagcccctgtgcgacttctcaaatttcagagcaaacgtgtgcgagatgcgtggtgacgttagagttcacccaaatgctgcatcaatcatgttcatggagcctgggcattcgcagagagatgagctgtggaaaatcaagccgtaccctcggaaaggggacgagttctgccttagccatatcacggagctgacggtgaaatcaagcaaagtggcccccgagtgcagcaagtaccatgacgtgcctgctgtgatcttttccctgacaggctacactggaaatctgttccacgacttcactgacgtgatggtccctcttttcacgacagcaagcgagttcaacggagaagtccagttccttataacggacatggcgctctggtggacaatcaagtaccataccgttcttgagaaactgtccaagtaccctgtgatcgatttcagcaaggacggcgaggtgcactgcttcaagcatgtcatcgtcggcctgcatgcctacatggagttcacgatagactcgtccaaggctccgcacaactactcgatggttgactttaacagattcatgcgcggcgcttactcgctgggcagggacagtgtcaccgtgctgggagagtaccctaaggtgaagcctaggctgctcatcatcaagaggcaccgcacaaggatgttcctcaacctggacgagatcattgcaatggctgaggagctcggctttgaggtggtcatcgacgaggccaacgtgagctctgatatctccaagttcgcggcgctggtgaacacggtggacgttatgatgggcgtccatggagctgggctcacaaactgcgtgttcttgccgcagaacgccacgctgatccagattgtgccgtggggagggttggaatgggtgtcccgcaccgacttcggcaaccccgcggagctgatggggctgcactacaagcagtacagcatcggcgtgcacgagagcagcctcacggagcagtacccgagcgaccatgagatcttcaagaaccccatttctttccacaagaaagggtttgacttcatcaggcagaccttcatggacaagcagaacgtgaagctggactgcaagaggttcaggcctattctgttggaggcactggacaacctcaacgcgtaagaccgtaaaagcttgtgcttgtgctcaattggtactgggcatggcaatagagattccttcctgtatacaattccttcttttttttttacaattcgttccttttagtaaaatctattgttcgttctgtccctccctgagaaggttcgcattgtggaaaatttaggagaaattggcttataaaagttgttgtatacacactgtataaattgctgccactgcatagctttcgttctaatcaatcatacatagctcccgttccaggaaaaaaaatagtataaattctgccggcgatccactcttgttgccaggtggcagccgcagtgccatgtgcgacatgtcttctttcatcctgcaacactacagtattttgggctggtaccagcaaagcgatgtgctgaggcgcatgcagtttattagttaactaccctggctcccacatggtcagcatgtaagtacaccaggtctatgataacaataagatttttaggaaacatgtgattatatatgctttaagcatgtgatggtacaggggacaagctagttcaactaccaaactttggcatccccctcacggcaaatcgcgacttcttttagttagacacggccggtctatgtggggagtgtggtccaaccacgaacgaagtctacaagcttgtgatatgcctctcgagagtcatattcacaaattttacacattattggtcctcgactccaaaccgtgctgtcttttttctagggctcttttgaaggattattttatgaatcctatattttttctaaattttttgaactatttttttttcaaattcatgtattatttatgtgaaattcccgtgttcaaaggaagctcttagaaaggatggccctaatatagcactgatgtgacattgattctgctgccatatgagtacgatgacgttaatatggtgcgacagctcaataatatattgagattatattggttctgccatgtggatataaaaataaaaataaaatcattggacgcaagtgctaattgtggatttgacaccaatcccagattatcttggatctagggatgtgaatgatatgagcattattcgttggtattcaaattcgattcatctaagtgatacatattttagtccaggttactcactatctgatccgtatctgatttatattcgtatcggtatactcaaagtcagatatttaagatattgatatgcatttaaattttatccagcacaactcaacgatccaaatttaaagaaaaaaaactgaaaaaattatagtcgaagcaatatcagtctatattgatacaattacaactctaagggctagtttgggag

SEQ ID NO: 13583 - DNA, 977 bp, Zea mays
aaactaatattcttgcaaacaaagggagtagataggtcgcactcgcgtcataagagagagcgtcagagcgcctgcgaggcccagcctcccactcaccatacgcctcctctcgatcttaccttcgcacacacctttctcgatcgtacgcagtgtgtgtaagcctagttctcctacctaggtacccagctcagctcgccgcccgggcggtgatgggaggacgaaggtcatcagtggctccggcagccgtcctcgcgctggcggcggtgaccatcgccatggcggccgctgcggcgaccgagggggaggtgaagtgcggcgggtgctccccgtgcggcggcgccgactgcccggtgctgtacccgtcgccgccgccgccgcccgcgctgcctcccccgccgccgtactactactacagccctccgccgccggccaccacctaccccggggactcgtcctactgcccgccgccgcccggcgcgtacatccagatcgggagcaccccgccggggaagggcccgctgtacccgcaggacccggggttcatgccgtccggcgcgccggcccgcgccgcgccgctcgcgctcgcggtcgcgctcgccgcgttggccttcttgtgatctctgcatgtgacgactggacggcgagcttcctcggtgtagtaagtagcgcgcgcgacggccggagggagtcgtcgacacatcgtgccgccggcgttccacgggttcattcatttcccagtgtacttatgcatgctccttctgtgacaataattttcacgtactggccatcatatgggctactctatgtctctatctagttttttcttggaacgtatgaaagttctcttttgttgctttggtctttattttttcaaatctgataattttagaacaatccttgtaagaaatgggaacgcagattcaagaagaatttgtaagtgtaatcagctgcaggtcattccagatttaaaaaaaaaa

SEQ ID NO: 13584 - DNA, 2127 bp, Zea mays
gcacgtcaagatgaaaaaaatgcagtgggaactgggaagtacgtagtgtggcagcaatatgcggggggagggataaataggaaatcgatggaagggatcaggtgagtggtcaccagccaccacacccacatggcacaccgcaggacaggccggacccagatcatagaagcttctccccttggcgctttattctactttattatttacgacgtaggggaattgaagccacctttacgcgaccccgctcctacttcaatgatatgagcttcaactcaactcccgcgacgacgctggctaatacgctcgccgcactacttctgctcaggatcggacgccgtcacgcaggcaggcgcacatgcggcggccgcggcaacggcgtcggtgctcccgcgtggaacgcgcaccccctcgagttcgaccgcggtggctttggcttggacgggctcgcgatcccgcggcgcattatttgtgcgtgtggccttggccgcgccgcgcccgcaccgcaccgaactcgcccccatgatgccgtgcggacgccggccgggcagcgacagcgtagtcatgcatgtggccggccaatttgacccccgcgccatgggacccccgccgcgccgatttacgggccgccacatgccccgatcgcccatcgctgtcgagcatggagtgctgggctagcggaaggtatagcaacccccgccggcctcatgcctcggccacgcagtacaattcctcttccattccagtcccgctgccagcctataccttcttctctccgatccaacgaatccaaactaatattcttgcaaacaaagggagtagataggtcgcactcgcgtcataagagagagcgtcagagcgcctgcgaggcccagcctcccactcaccatacgcctcctctcgatcttaccttcgcacacacctttctcgatcgtacgcagtgtgtgtaagcctagttctcctacctaggcagccagctcagctcgccgcccggccggtgatgggaggacgaaggtcatcatcagtggctccagcggccgtcctcgcgctggcggcggtgaccatcgccatcgcggccgctgcggcggccgagggggaggtgaagtgcggcgggtgctccccgtgcggcggcgccgactgcccggtgctgtacccgtcgccgccgccgcccgcgctgcctcccccgccgccgtactactactacagccctccgccgccggccaccacctaccccggggactcgtcgtactgcccgccgccgcccggcgcgtacatccagatcgggagcacgccgccggggaagggcccgctgtacccgcaggacccggggttcatgccgtccggcgcgccggcccgcgccgcgccgctcgcgctcgcggtcgcgctcgccgcgttggccttcttcttgtgatctctgcatgtgacaactggacggcgagcttcctcggtgtagtaagtagcgcgcgcgacggcccgagggaggagtcgacacatcgtgccgccggcgttccacgggttcattccctccccgccggcctggcccggatgctccttctgtgacaataattttcacgtactggccatctatgggctacacggtagttctttcttgtaatgtatgaaagttttcttttgttgctttggcctttaatttcttaaatctgatggttttagaacaatccttgtaagaaatgggaacgcagattcaagaagaatttgtaagtgtaatcagctgcaggtcattccagatttcgtacgttttcccaggcccctcgggccatgtgtgtgtgtgtgtcgtcaatcggtgtgatctactacaacttgccgctgtaagcggccgggatcagggcgatcgagccggttgaccatgcgtgtcatgctcggttttcaaatattttcaatgcaagatgccaagattcgtctgcatgggtcaggattgtgcgtagtaaatacagcagtcgccgccatcccaaggactgcgaccaattcacaacaatcatatatacatggccatctgaggctctgagctagtgagctgctacagttagcagtagctgtgattctgtgaatgcaaatgcgtgtgccactgtgccgtgcgcggtgcgcccgtgccatgatccggttagttac

SEQ ID NO: 13585 - DNA, 2221 bp, Zea mays
ttatgttgtcatccaaaacaccaaaactcacaaggtagctttcaacatgattattatgaagtggggtaaaatgcttaacaacattgattaatgtatgttaacaacatggctgagcattgtacgaattaacttgtatcgatacttaacgatacatatatatgaaaaagtgttatcctaatcaccttgtatttgtatggccccctagtgtatttaacatcttcagtgcaaggattcgaatttccctctttagttgacacactatcatggtaagtccctattaggctacgaccaacagagtgtatatagtcacgcaaaacactgttttgcactgtagactactctatatatataaagtgaagtttgaatttgaaattagatataagacaataagttgttggagataattatgctatgtttttatggctttggccgtgctgttagcacgttatgggtgattggaatgtgatgcttagtgtgactgagctttacaactatgtgatcatggacgatatgatttggtagatcctttttcccctgaaaaaaagtttatacaataattgtagctctccctttatctgaacacctaaaaactaaaagaaaaatggtccgttgtatactttcaattggcatgtatctgtttctccgtatgcagttgcagtacattggctacagtgtcacggactcgcggtgagccccacggaggaacgggctacccaaactcgccggattcctacctgtcccggccaacccacctcgccgaaccactccaccaaccacgaacctgaaaccctagccacgcccatgagcgacgacgcgaccgccgccgcgccctcttcgccgtcgacctccccttccccatcctctgcttcctcatcaggcgcctccccgtcgccttcctccccgcgcgccaagcgccgccgcaccgaccggtacgctctcggtttcgagttcgccccgcgactcgcgccctacgaactccctgaggaaccgctcctcgacaagcacaagcgcgcctggcccaactggacggagcgctccaccttggctctcctcgacgcctggggcgacagcttcgtccgcgcggggcgcagcatcatccgcgccgacgagtggctcgaggtcgcccgcctcgtgtgcgccgccgtgggccgtcccgcggggtatttctctgatgcgcagtgccgcaaccgagtggacacgcttaggaagaagtttaagaaggagagggagagagcgcgccgtgccgcgcgccgctccggtccctccccttccaaatgggtttattacgacaagatggtggcaattctgtgcccgaccccgcctccgcctccgctgccgaccctgcctccgcctgcccgtccccctccgctgcctctccagttgctgcctctggtcgcaaagcgccgccgcgacaggcagccagcgcggcgctttcagtgggggatgaaagctcctgagcgtcttcttggtggtgccggagacgtcgtaggtcccagggtttcagggtcaggtgcgaagttgggtgaacttggaccgcagaaaaatagtgctgttcaagggaagcggaatggtttcatggccctcacagagtcaattcagaagtttgaggaggcttttgcgaggatggagagtagcaagaggcagcacatggtggaggtggagcaaatgaggagggatttgcaaagggacctagatgcaaagtggagggagatattggagaaggcgcaagcggagattggtcgccttagtaatgaggatggggatgaacatgatgtggacgaagatggggatgttggcgatggtaagagattggagggtggtgatgagcaaaacaatggtgctatggatgcttctccttagcatatagcctagatgcttacaaaatgaggttggtttacttatctcagcagctccagcttatgctaaatgtcatttttttgctaaagcaaaacgtcaggccatttttactgtaacctttatgtttatcattacattttgatgcttgagtaaactaaagctgaatcattcttttatgtgtctggaatgttaattcgagtaaactaaagctacatcatccttttatttctgtctggaggggcaattcgtgaaggatcttggtccttatataagtactcctatcattccatgtctgcatacaataagttggcatttagagtaatgttgggattcagccatgttttgtcattgtattttatgtaag

SEQ ID NO: 13586 - DNA, 1458 bp, Zea mays
gtcgcggtgagccccacggaggaacgggctacccaaactcgccggattcctacctgtcccggccaacccacctcgccgaaccactccaccaaccacgaacctgaaaccctagccacgcccatgagcgacgacgcgaccgccgccgcgccctcttcgccgtcgacctccccttccccatcctctgcttcctcatcaggcgcctccccgtcgccttcctccccgcgcaccaagcgccgccgcaccgaccggtacgctctcggtttcgagttcgccccgcgactcgcgccctacgaactccctgaggaaccgctccccgacaagcacaagcgctcctggcccaactggacggagcgctccaccttggctctcctcgacgcctggggcgacagcttcgtccgcgcggggcgcagcatcatccgcgccgacgagtggctcgaggtcgcccgcctcgtgtgcgccgccgtgggccgtcccgcggggtatttctctgatgcgcagtgccgcaaccgagtggacacgcttaggaagaagtttaagaaggagagggagagagcgcgccgtgccgcgcgccgctccggtccctccccttccaaatgggtttattacgacaagatggtggcaattctgtgcccgaccccgcctccgctgccgaccctgcctccgcctgcccgtccccctccgctgcctctccagttgctgcctctggtcgcaaagcgccgccgcgacaggcagccagcgcggcgctttcagtgggggatgaaagctcctgagcgtcttcttggtggtgccggagacgtcgtaggtcccagggtttcagggtcaggtgcgaagttgggtgaacttggaccgcagaaaaatagtgctgttcaagggaagcggaatggtttcatggccctcacagagtcaattcagaagtttgaggaggcttttgcgaggatggagagtagcaagaggcagcacatggtgaaggtggagcaaatgaggagggatttgcaaagggacctagatgcaaagtggagggagatattggagaaggcgcaagcggagattggtcgccttagtaatgaggatggggatgaacatgatgtggacgaagatggggatgttggcgatggtaagagattggagggtggtgatgagcaaaacaatggtgctatggatgcttctccttagcatatagcctagatgcttacaaaatgaggaacaaaattggggttatcatgtcgatagatgaatccacatgatagacatgtggttatgattaactccgtagctgctgatattagtattattgtataattctcatatgtgtttctttttttttactccgcaatgctaagcaaaagattactgctattttggttactgtacatagctatttgcttaccgacgtgtgttttcaagataataatatcatttggtagctcttagtaaaaaaaaaaaaaaaaaaaaaaaaag

SEQ ID NO: 13587 - DNA, 1494 bp, Zea mays
aaaggccttttgtggccatcaaagcggttttaaatatccatcgctcctctccccttcaccacccccccccccatctctctccgttcattccctctctcatgcgtgcttgggttgggttgggtatagacagttcttgcagtccacaccacctcaagtgagggggtgaccccccaccctcctccctagcgctcctcaccgccatgctgccaagaaggcagagcatcttccacctcggggaggagggtggcgccgccgccgtgcaccaccgcgtcagcgtcgtcggcgcggcgtcgtcgtccatggccatgggcgggggcggcggcggccggcgtgctcgcgagcgtgagcgcctcgtcgtggggctccagatcctggtgcaccaccacggccggcacgggcacgggcacgcgcacgcggcgaacgtagtcctgaagcagatggtgaggccgcgcgccgccgctggctcgcgccacggccacggcagccacgccttctcgtgcagtttcctcaaggcctgctacctctgcaagcgggagcttagccctgacaaggacgtctatatgtataggtatatatatatatatgttgatcaagattcaaggagagctcgctcgtcggatcggaaagattgctccttgtgcatgtgcgtatatatgtgtctgtgcgtgcagaggtgaccaggggttctgcagcgaggagtgccggtggcagcagatcctggtggacgaggcgcgcgagcgcgaggcggcggcggtgatgagcaacaaggagctgcagcggcgagcgcaggcccgccaccacagcccccaccgcacgcccatgcccatccgtggcaggccgccgaggaagacacttgccgtagcctagctagcaggtcctctgtctgctgaggaggacaaaggaatcaatcatggcgcatgacgaggagcactggtactactagctagtacgggtctactggactgcgtgggtaaaaaaaaattaatcatctcttctaatcaccgagtggactgctagagaccagacgacttgcttgtgttgtcatcatcaaccaataatcaatcaagctgcaagtatatattatataccagaatggcatttcttgtgcgtgtcactcagattcgttaggtttgagttgtgtccaacgttgccgcgcacgtgaccggccgggattgattctggtcacttgttgctaaagacgatgcctgttttttaattccatcgatacctatatagcgagcaaaaggaatttaggaaccggaacaggacaataattgccatatggcatctccaactttttgcctggaggctccaacgcgtgtgtggaatggaatctctcttgcattccacgtacgtgtttcacgaactaaagaaaaaaggttcggaattggaaccggcccacataccctgattctgtttgcgaaccaaatatcaggatgggcagatttcaaaccagtgtgtgtgtatatatatatatatatatatatatatata

SEQ ID NO: 13588 - DNA, 981 bp, Zea mays
cattgggtacctcgaggccggccgggacttcccccctcatctctctccgttcattccctctctcatgcgtgcttgggttgggttgggtatagacagttcttgcagtccacaccacctcaagtgagggggtgaccccccaccctcctccctagcgctcctcaccgccatgctgccaagaaggcagagcatcttccacctcggggaggagggtggcgccgccgccgtgcaccaccgcgtcagcgtcgtcggagcggcgtcttcgtccatggccatgggcggcggccggcgtgctcgcgagcgtgagcgcctcgtcgtggggctccagatcctggtgcaccaccaccaccacggccggcacgggcacgggcacgcgcacgcggcgaacgtagtcctgaagcagatggtgaggccgcgcgccgccgtcgccgccgccgctggttcgcgccacggccacggcagccacgccttctcgtgcagtttcctcaaggcctgctacctctgcaagcgggagcttagccctgacaaggacgtctatatgtatagaggtgaccaggggttctgcagcgaggagtgccggtggcagcagatactggtggacgaggcgcgcgagcgcgaggcggcggcggtgatgagcaacaaggagctgcagcggcgagcgcaggcccgccaccacagcccccaccgcacgcccatgcccatccgtggcaggccgccgaggaagacacttgccgtagcctagctagcaggtcctctgtctgctgaggaggacaaaggaatcaatcatggcgcatgacgaggagcactgctactactagctagtacgggtctactggactgcgtgggtaaaaaaaaattaatcatctcttctaatcaccgagtggactgctagagaccagacgacttgcttgtgttgtcatcatcaaccaataatcaatgaatcaagctgcaagtatatataccacaaaaaaaaaaaaaaaatcc

SEQ ID NO: 13589 - DNA, 978 bp, Zea mays
gccggcccgcccgggccctccccccctcatctctctccgttcattccctctctcatgcgtgcttgggttgggttgggtatagacagttcttgcagtccacaccacctcaagtgagggggtgaccccccaccctcctccctagcgctcctcaccgccatgctgccaagaaggcagagcatcttccacctcggggaggagggtggcgccgccgccgtgcaccaccgcgtcagcgtcgtcggcgcggcgtcgtcgtccatggccatgggcggcggcggcggcggccggcgtgctcgcgagcgtgagcgcctcgtcgtggggctccagatcctggtgcaccaccaccaccacggccggcacgggcacgggcacgcgcacgcggcgaacgtagtcctgaagcagatggtgaggccgcgcgccgccgctggctcgcgccacggccacggcagccacgccttctcgtgcagtttcctcaaggcctgctacctctgcaagcgggagcttagccctgacaaggacgtctatatgtatagaggtgaccaggggttctgcagcgaggagtgccggtggcagcagatcctggtggacgaggcgcgcgagcgcgaggcggcggcggtgatgagcaacaaggagctgcagcggcgagcgcaggcccgccaccacagcccccaccgcacgcccatgcccatccgtggcaggccgccgaggaagacacttgccgtagcctagctagcaggtcctctgtctgctgaggaggacaaaggaatcaatcatggcgcatgacgaggagcactggtactactagctagtacgggtctactggactgcgtgggtaaaaaaaaattaatcatctcttctaatcaccgagtggactgctagagaccagacgacttgcttgtgttgtcatcatcaaccaataatcaatgaatcaagctgcaagtatatattccagaccagaaaaaaaaaaaaaaaaaaccggcc

SEQ ID NO: 13590 - DNA, 2215 bp, Zea mays
ggaagtgttagtggcaaaatggatatattgaagcaagatgctaattccagccaaggggccctcgtgcccggccgccatgagattatgatcactcctaacaaacgagcaattgagaaagactctcgggttggtcaggcttcaaaaacaatttcgaagactgtcaaggtgacttctagtaatgtttctgatcacacatacgtttccaagggaccctgttcaggcgagcctagtgtgataaaccagatggcgaaaccagaaaatatcctgtcattgcggaggccaagagaagcaaccagtgatttagttggcaccacagcaagaagtggtattacaggtgtaagaagaccttcagcagcattacaacggccctctaccaaagaacggcgacctgtcacaaaagatgcttcaaggaagcatgctgaagttaccaccccatgccgtccatctacttctgaaagacgcacggtgaccggagagtcggcactaaagcctgaaaacaatgctattccatgtcgacctgttaccgctcacagacgccctatcaccaaagaatcagcaacaaggcaatgcagcattgctacaccacgccggccttctactgctgacaggcgccctgccaccaaagatctaacaccaaagctatccaacattgctgccccacatcgaccttctactgctcacaggcgccctatatccaaagagtcggcaccaaagcatttcaatgttgctagcccacatagaccttctactgttgaaaggcacactagtggcagagatatgacatcgaagtatgttggtattgctacctcatatctgccatctgctgtcaaacagcgccctatcactggagagggtgcacataagcatgctgatgttgtcaccctgagctgttctactgctgataggcgccccattagagacgttgcaccaaagtatgccactttagctctgccaaggagaccgtctactgccgagaggcaccccattgctagagatattgcaccaaagaatggtttatcactcagaccttctactgcagagaggcgaaccattgctagaaatgttgaaccaaagcatgcaccggcacagaggccttctactgctgagagacgtcctgttaccagagagactgtactgaagcaagctaatgttgccaactcatgtttacctttgacgccagatagacgcctcaccaaaaaaggtgacatttccacccttgagtgcccttctacaggaggaaggtgccctatcaccagtggtactgcactctggtcaagaacaatgccgtactattcaaagggtgctttggtcacagaagttactccccagaagacaataactcccagggttgttagaaacagcaagctagaaaacctaagctatgcaaaagaaagggtggaacttcaagtggatagaaagcaaaagtcaagtccttttaacctgtcctcgaagaaaacattgacttccaacgttagagatgaccaaggtcttgaaatgttcaaaaagccaaacaaggaggggggagttcgggctcatgcatacaaatcaaataatgcaactccttcacggaccggaaatgtaaagataaaggctcctgtgcctccgcctctgccaccgcaccgaccgtactgcactgagaagaaaccgaatgtcaacagttcacctgttggtggaagaaagacaaaggcctcagctccacactggcactgaccccattgtctaggatcctgcagcataactctgaagccgtgaaggtaaaagctatgcgtctgacgtgacctagaagccgcatccatcaagcaacgattgatgttatctattttagcttaccagcagtcttgtgacttgtcacctgtgttagaataaccgtagtagttagtgtatgtagcaacgcgtagcatatatatatatccactaatgtctaattgaaccgtagtagaactgccctggatttaactagaacattgtatatacctggaataattggagcttgagtatcgaaccaggaattatccgcacggttttgcaggtcacatcacatgctgctttgaaccgttgagagatgttcatctgtttgctgtccgcgtacctgtcttcgtcctgcacgtctcttctggaactgattgccagccctgtaataaccagcggatgaaatctgatgaaaagttgggattttgctgatgttcggctccagaacaagctgcaggcatgcaag

SEQ ID NO: 13591 - DNA, 3929 bp, Zea mays
cggatcagtgtgaacttttggaggacggtcgaaacgagaatggtgcagtgcacggcgtcgcgagcagataactaccgcatctaaagttttaaaaggcacttgggtttgggctcctccccgcaatcgacggatgcgcgcgccaccagcaatctgacgtgtgtccggacctgacctactttttcttcaatccaacatagccatgcgcgacgtccgtccctcactctcttcaattctggactgctcgcgcctctcgcctccgtgttcacatcgccctacccgccgtaccacatgccagacgctggccaccggctccgccgccgcagcgactacatcgggggtgtgcagcctcccatcagactcccgccagcgccaaacccttcgactcggcgatggccacaccggagaagaagtcatacccacctgccatggtcgcggaggaggtgagggtgtgaggctgactggcgattggacccgtccccccattccacccgccgtcgccgacgtgtctgtccaaggtgagtccgccaacgagtacatataaaattcatcagggaaggttgttcgcccaaagccttaccagactcgtgactatccacaaaagaattatttttatataactgaattttgtgttgtattttgtactttgtagtaatgacagagggaaaacaatactaggattagagatcctaagctactaactgatcttataaaatatcagtctgtgtacatttgtctcagtgttgctgaattttgcttaacttggcatccggaaactggttcgtcccttcttatattaggccagctattttcaactcaactctgaatgaagcttcagaggcaggaacacaagcacaaactactgtccagattgacgaggagccaggttctgatgaagacgacgatcttccaccacttgaagcaaacaccaacaggaatagaccatatgaactaatttctcaacggaataactaattgaattttttgtccagtgcaagatattagttgtgtaacaaattgttaaattctcacatgtcagatagtggtgcatttcatggcttgatctgtctctttttactctaggccagcggcagacgcgccgcctgcctcccctggcttgctcctggccatctagcgtctgtcatgtgttctgcctgatggtttttctccttttttgcatatgccatctgttctgcccatctgttaattgccgccactgttttcaggaaggtttagagattgaggctgagtttgggcagacctcatcattgttagtttgtttggtatggagtaagctagcccaggggaaaaatagtgaacctggcagatgatggtatggagtaacctgttgttccatgcaataggacaatctgagatggtagagatgtggtttcagcacttattttttgggcgacaatttcaggggagtaatgtggcagtgatttctctccctttattatgatgaagttgtggcttgtatcaatgttgtatctgcaatttgaaatatgtatatatgccatgtccgattagcaacacaaggcattgggatctccaaatttcacggcattgattcaggtgtgtgcacttcttttcttgttccgtgcttgttttataccttctttttgaattgatgatttttcataggatatagttctctggccagtagactggcctactaacttcatttatggacaaaaatcaagggtgtacatcatccttatggcttatctggaaatggcttgccatgtttctcaattctctcccagctgctacaaccactgcttgtacccttcacgctttcctcaagagtacgaatctgctttaggacctcctatttatgtgccatattggttaattagagttcttatgttcttttagatggctggttctgctttcctgtttacgaattatgtgtcgtcgatagggcgcccgtaagggcgcctcatgttctagtataactataaatattctcggggccacaagttttgaggagcacgatgaggcggcggcatgccagtgaatgctggctgcatacctgaactgaacagttcatcagccaacttttcatctgtacgccttcacaggtcaaatacaaaaatcagagactgcatacaattcagccattttgggcgcaatcaagcatcgatggagcgccatcatcagaagaaagaatggcaaggtaactttccaggtgaattagtagccgcgacctaaataaatcacattataaaaaattacaattctctacaggcttacagtgccgggggaatccactagtcggcggagtatcaaatatacaatagagtgaattcaagcattcagacgactgttctgctctttagcagctgtaccggcatcgtagaagcatgtacgccaaggatcatcgtctattctcatcttcaatgacctcatgtccctcgacttcactcgcttctgtggcaacggcggcagcagcatgaacagtgttattgctaccacggcagtgcagtagctggcgctgaaggctctcgataagctggttgagctgttggatatttttctcctgggataatatgatctgcagatggcatgcaaattttctgtgaggaaatagaagtgggtgtttaggcatgaaaggcttagcaaaaccatgccctcaaaaaaaaatgtggactaaaaggcaaatgaaggactcatttcccaatcacaggctcacagcacttcacatggttaaatgttgtgtatcataattttgcaaacaaaatggaagtggttcatgagtaaccaggtattttacaacaagaatcaagtggtcaagcacaaatcctataatatgatgtttatgactttaaagcctgtgcgactgattgcaatgatctgacccgaaggtagggtctcagtttggtagaatccaaatatttggtaggactgtaggagcaggaacaaaattttcatatacaagttacttttcataaaaaattcacagcagagactattagtgacaggtatatcttgttccaaatttggcagacccatgtctcgcctggacacctagtacgcttgaagccagttgctgtggtgacctcgcctggccttccggccgggtgacgtggatcccctttccagcaattttcttttctcgctttatttcttttcccttgttttctctatcgcattttttttgttttctcactttctttttccttaattttcttttgtctttcatttgttcgttttttcatctcaaacattagttttcatcatcgtacatcacacgcaaactacctgcgtctgtttctatttcccgcttctcaccttactgcagataagattatgatcagataaggacagtaaaaataggatatagcgactaacagtcctatagccggctacaaatagaggcctgtcgaactggcctaaacaaccaaaaaaggcgtacagtggctatggcaacgctgtcgagcagcctacgcactgcacctgctccctcctctcctcggattgcgcaaccaacacccttttgtattagtgtgtgacaaaggagtgtatttcgatatccagagtgagtacaataaggagtgtatctaaagtcttgtatcttatataatgcttcgtaatatttgtattaaaggatggtatactgaccaattccatcaagaaagccatctccagattcttcttgagaaagaaggtcttctaatgtgtaaataaacatcatcagccattttgcatggtcaaacgtcgccgcagtggggaattaataatggtgctcggcaacatgcaaatgatgaattgatgacgacgtaccgtattataggcttttgcggcgtcgcggattttgcctttcccggcccggatgtgtggtcgtcactagtacaaaaagactcaaagcctgcggggacgatatatttttacaggcggtttcggttatccacccgacttgtgttatttct

SEQ ID NO: 13592 - DNA, 1875 bp, Zea mays
cattgggtacctcgaggccggccgggggcatttcgccccattctcgacggcttcccttcttagttcttccccttcatccgaaaccctcgcactctagcggcccgcacaaagccgccggagcgccgcgccaccatgtaccggcttttccgccgcagcttctccatggctgccgagggttccgccgccgccgcctcttcctctccacccccctccacctccatgtcctcgaccccgcggcaacatctgccggacgagctgtaccgccgcatcatgaatgtcgggcgcccaagcatcccgttatcccccgtcctggagcaatggaatcaagaaggccataccgccaagaagttcgtcatccaggccatcgtcaagaagctcgtcggcctccgccgcttcgcccacgcactcgagctgtcgttctggatgaccgaccgcaggcacctccacctttcggtcggtgacgtcgcgtaccggctggacctaatcagcaaggtgcacggccttgagaaagccgtcgagtacttcggcatggtaccgaagcagctgaggaagccgcagtgctacggctccctcctgaaatgctatgtggaggcgaaggccgtcgacaaggctgaggagcacttcgcgaagatgcaggagatggggatgacgagttcttacgcatacacttggatgatgaagctttacctacagactgggcagcttgaaagagtgcacgccatgttccaggacatggaagagaaaggtgtgaagcctgatactttcagtgtggaggctatgttagctgcgtacattgctgctgaagatgtccagggggttggtaaggtgctcgacaaggccaatccacacgagaagcttgtgacttggcatgggcatgcttcggcagcgagcttgttcatgaaatctgggatgcaggtgggggctgtcatggctctcgtggaagccgagaggcggatatctccaaagagcagtagaatcgcatacgctttcttactcaagacatatactgaactggggatgcatgctgaggcaggacgcatttggagtgtctacaaatccaaagtgccgccgtgcaacacgatgtacatgtcgaggctaagcgcgttactcaggacgaacgacactgatggggcagaagcgacactgaaagagtgggaaacggtgcctcttcgctatcatgatttcagattaatcaacgtaatggtcgatgcctactgcagagaaggtctcgtggagaaggcagtagctctcgtggatggcgccatcaagaaagggaggacaccttacgctaatacctggtataagttggctggtgggtttttcaaaactggtcaggtaccagaagcagtggacatgacaaggaaggctcttgattccgcgactcctccatggagacctgacctcgccaatgtgctgatgagcctgaaccactttgtggaccagaaggatgtaggagcagctgaggagatggtgagtacgctacagaagctggttcctttgactagggatgtttaccattgcttgctgaagacctatgtccgtgcgggaaagccgccgtccgatctgctggagcgtatgaaggaagacggccttgaggctgatgaggaaacagagagaatcctcgcgggagaatgcgagcgagtagacatgcacccgttgtcaatcactaaccatctgattggttagtcgcaccgtctcatcctgtatcagtgcatgcattgattttatttaagtctttgtttggttgcctgtatacttaaagcgtgagctgcatgagtggatgcaaactaatttattttgagaccgtttgactgcatctgctcatacgtcaaaatcttcggtttaaaaaaaaaaactcgagggggggcccggtac

SEQ ID NO: 13593 - DNA, 7381 bp, Zea mays
  misc_feature (1240)..(1240): n is a, c, g, or t
  misc_feature (1250)..(1250): n is a, c, g, or t
  misc_feature (1317)..(1317): n is a, c, g, or t
atgctggggaacttgggatctaacctgcaaggtgactcaacttaaggcttgttcggttagctcttaatccatgtggattgagtgagattgggtgggtttaaatccaaagcaagttaaatttcttcataattttttcgaatcccgtccaatgcatagataaagggattaaccgaacaaggcctgatggagatatagaaagacctctgatgggactaatgctcttgacaatcccaatttcagcaggacatttgctttctcgtttttttttcttctcaaagtgtatgcaaaaactcaatactatcaaatccattttgagttcaaagcacgagcaagggaggctttgatccttgacaatactcgtcactcaggtatggaaggagagaaacaacatgttatatagttaagcagactgaatccacaaactatagcgttatgcacaacattaaatacagtatgaggcaggcttttgatcacaacggaagcaaaacagctttctcgtctctttcatcttgattgaactgagatttttattttacttttaaggctgaggtcttgagcttcattgttgtttagttttgttctatgcttcagttgtgcctgtacagtacccatctatatttaactttcttatttttaatatcgtgggcagctctgtccgtctcgtttgagaaatagatgatccacataaaaattgaaatttggtgcttaatgtgctcttttttctttctttctttctcttttgtaccatattctttctttgttttgtttttctctgtcttttcctcctgggtttagtcctcacgttttgcattagaatttctctctaataatttaatgttcaagtgtggatatctacttttgctttatagcatcctcgtaaacacataatgctatcttagaatagcggtgtcgtggttttggaaaccgagagacaatatattcgtgctatcttaaaatagaaatttcttggaaaaatgggatttccaaattagctcttagaattgagaaactgattgagataaagacatgccaatatgtggagaatgagaaaagaggttgggtagcactcagcgagatgtttgctcatacgtttggttccagttgtccatcagaaatgaaggcacaagcataagggcggtgttttcctctatggatcggaaactaaacagagttcctagtagagaaagcaagaggtaaggcagtcctgcatcgtcagttcgccactgatagtgattttcanagggcgtcangccatgttcttttcaggcacaaaattcttactccagcgttcgtccccttatgtccacatcgtcacgnccgttgccgcatgtatggcaggggtttccgtcaagcagagtggcatcgattgcatgtaggagtatactgtatacatgcatgacggagtaggtgtgttttttagttctctgcgtgcaagcctgaaagagcgaggaaacgtttaccacgccagagacgccaccaagaaattgacttgtacgacttgcaaacgggcatcataaacaggtaacgcgctacgacatatactcgcatacgtggtgcatctacacaacagtcccgcacccgataatgaaatgagagtaattttatcgacgcgcattgagagcttatttggatactctattattcatccaaatacacatgagttaaagacaattgaggcgtaaattaaactaatttatatataatctatctcaaaccatatgtatcgtggtgaataatagactcttcaaacatagccggctgatctgatttcacccgctttcattgtcatgcttgccatatcatagcaaatccgaagcgagcacgaaaagaatggcgatcactgtggttgcagcccttacacaggctgctttaccacttcactgacagaccgcaggctcgcccgcctgcagcgaccactctattaccagtacgtacctggtagtacgtacatgcgccgagctactgtgtacggttaccaaccaaaatgacgcgtgttcgcggcgccgtggaagtgcgcgccggcccgagtttcccccataccgaaccgagccgacgagcggtgactcagcatgcaccagctgccccccattcggcgcctgcccgcatgcagtgcaccgggccaccgccgctcggcactggcaggcaccagcaagcccgcaacgtgcggcacaccgcacaccggactgtcagccgcggccggccgcgccccctgcatcttgcagcggcagttctctcatctctgcacggcgtggctcctatctgcgtgcgcctcgctttttcccaggttcacctcccctcgcccccatcgtggccacgccagcgcccaaccaccgctcgccggcccgcctccccccacgcaagccctgtacacgtgtccaccggtaccgcgaccgaccaccttcccactgattgcgaccgccccaaccacgtgtcccttctccatcactacacccgttccctcgtgctcccgccctgagactctctttctcgctggcaggtgggcgacgcttcagccagtccccacatgtcatcgaatcctgaacaaagagcggtagggaagagtacgtactactgtggagtccggatatttttctgggcagcccgagagacagaacccatgtggtggggaccgcaatagtaggcatcaataaatcagctgccgaggcggactgccccacccaccccaggagcgccacgtgtgtgcagcacagggattaggcgataaacacaccatcaaacttcctcgtgggcccgcacctcgcccgcctcggtggccgatgcacaccacgtgtcgatcgcgctgagcaagataccggcacgcgtccggatcctgccgggacggacggccccggtgcgccggaccaggagcacgtcgcaacagctgtacgtgtcgaggcgctgcccgtgacggcgacggcccccctgcccggctgcccctgcccgcctcgcctcgcctctcttgtactgcccccacgaagcattcgtgctcgtttcgcctcgaggcgcccgcgctgctgtcctgctgctgctattttgccattgcatccatttccgggggacggagtggaggaggagggcgtcgcctgcgttgcttcgcgtgggaagcgtagcgtgcttcgtttaggcctctcgccaatatccgagggttaatctagagaggcctttggctttgccagacgcgcctgtacgcgcctttctgggaggcagccgcttgctctcgcctccaatggccgagatctgctgcgaagaagccaagtccacgccggcgaccgccgtggctgcggcttcagtctccgccacggccgctgcggccgccgccgtggcagtggcctcgtcggcgttagagaggaggcgacgcaggttggagatgaggaggttccgcgtcgcgggcgatcccgaggcgccggtcgcggaggacgtccgcgccgccaagcggcagaggctggcgcgcacgctgtccagcacctgccccgacgcgggctcaggctcgggctcggactcggactccgacaggcctgccctaccggagcggttgcccaggtacggggtcacctccgtctgcggccgacgccgcgagatggaggacacggtctccgttaggccggacttcgtgcccggcaccagcaaacagcacttcttcggcgtcttcgacggccacggctgctcccacgtacgccatactcgtacacgacgcgcgcgcatctaggagtttaaatcccttttgcggagttctgtatgctgatcgcagtttcgcgcttttgctgtaggtagcaaccatgtgccagaacatgatgcacgaggtggtcgcggacgagcacaggaaggcagattgttctggcgaagagacggcgtggaaggccgtgatggagaggagcttcgcgcgactggacgagcaggccgccagctgggcgaccagccgcagccgcgacgagccctcctgcaggcatgcgagcagcagaagcccttgcgttgcgatcacgtggggtccaccgccgtggtcgccgtcgtcagccccacccacgttgtcgtcgccaacgccggcgactcccgcgccgtcctatcccgcgccggcgtccccgttccgctgtccgtcgaccacaaggtctgtatactcgtgcatcacggggctgagggcgctgcgcctcctcccctgtcccctccccgcgtcttcgtcgcctgtccgtgagcctgacgtgctcaacttcctgattcgttcagcctgaccggcctgacgagctggcgcgcatcaaggcggcgggcggccgcgtcatttactgggacggtgctcgtgttctcggcgtcctcgccatgtctcgagccataggtgagctgggctcattcggggtcgttttgggtccactcgttggacttgaactgacgggtttatgcgcgcgcgtgcaggcgacggatacctgaagccgttcgtgtcgtcggagccggaggtaacggtgacggagcgcaccgacgacgacgagtgcctgatcctggccagcgacggcctgtgggacgtcgtgaccaacgagatggcgtgcgaggtcgtccgcgcgtgcttccacagcaacggtccgccggcgccggccgctcgggcgaacggcgcggccctccgggcagccgagaacggatccgcggccgccaagggcgtgagcgtggaggattccgacaaggcgtgctccgacgcggccatgctgctggcgaagctggcgctggcccggcggagcgccgataatgttagcgtggtcgtcgtggatctccgccgggggatatgatttgccttccttcctttttagccctcttggaatccaagctaatttctcccccgttttcttccatacttttaggttctgttttggtttagtattaatactgtagtagttaccaaccagacgcttttcttctctcaaacgaggaattaaaagccagtcggaccaaggaaatagaacatcgaattgcacagaaaaaaaaaacccacagatccacaaggtagtggtaatcgttaatcatagctttttttggccgtcgattaacgcgctaaaaagtgctgattccattctttgactgaagtagattaacggggcgattggtgtagaaattggcgctaagaccacgtttagcgggagcagattgcgattggttggcccaggcaggcggtaggattcggagacggattaacaaaggcacggcaagatgctgatctatctgtggggtgtgggcccgtcgtctatcgagtgaagggaaatgctccgaagttctcgtttacggaaatgagaaacgggcatctttccacaggggcggcctgggcctgaatgatgcgacgacccacgatcaatggttacctttcgcccgcggcgtcgtgcgtgggcggcgaggcgacagagcatttgcctttgtccgactgtccgttgggcgatcgaccggtcgggtcaggcgctgttgaagccattatcgaggcctgcgccgcgccttttggtactcctctggagtctggagtgctacggcggggcgcgccgctcgcacatggcgcggctggttgacaggagctgggtgttccggggtgtcggagaccccgtagcgtagcacggtgccatggtcggcgagtgactgtgttcaattattggttgatgcccgtatccgttacgcgtcctcccgcaccgtgccggcgggccgcatgccaagctcccacgaatatcggcggttgccgttggcgcaggggcaaggcgagccgccggggagggagttatggagacgcaaacgcaacagcccctctctccggtagttcggtcgtcccacgaagtgccgggcacgtctgggctgggccggcgagccggctgtagaattgacacaacagcgagcgcgtccccgtcggagatctagcaagggaagatatcccatgatatgtgcggctatgggctatcggtctactccatctcgaaggaactgtgacgggaaagagaggagagccatcgactatcgtgctatcgaaaagcggcggaccttgaacgctcctggcgttgctgcatgctcttttgcagcatgccatccgagcgtccgctcccgtccacatccaatcctttaggacgcgtttaaaaaacaaagtaaattttatagtttttaggcaatattctggtttataaaaatactgtagtatttttgtaccataaaatgttttactgtattcttttaaaaaaacattttcaaacccagcatttccagggtaatttcgttccatattttagtcttcacttttgtaattagttttataactagactatatttaatactcattattgaaattcaaatatccgacaacgtaggaggcgaaccttgagccgatgcatccgagttggtagggcgacgtggtccaatggtgaggagttcaactgcggagaataggtttggtcatttggcagcgcgttgaagcagcctcctcgatgtgtgggggacagggggagtgacgatccgacgacgaagaagcttgtgtcacgcctaccttgatatgcaggaaaagagagaaaaaagagcacgccaggtcgagctatctcgctgcgccggaaaggggggaaaaatgagcatgcggtgtgaagaaaacaacgccaaaccgtttttagagtgtcgatcgatttgacaaatctagaaagcaaatgaggttgaatagcaagttactaaatttaataagtttatttggagaactattgaagaagcatttttttcatttctaaatttaaaatttaggtaattatttagaaaaccattgaaattgctctagactttaattaggaaagcaaacaccggaaaagtctgacagctcaaaagaagagaggtagggctcgagggaaaatggctatggacgaaaacgagaaaatattgaatattagatgtacatatagattaggggtacttatattagcatgactgttgaattttgtggccccgactatagatggcaatggatacccgaaatctaaatacccaacgggctttatccgatatgaaggtgggtacgagatgatttctctacccacgggtatgttaataagcaagaatttctatctgttgggtagacgggtatgggttggtattacccatacctgtctacctataggtaaaatatactcgtatcaatgccttggccatggaggacctaatcatcaaagtctccacagtaacctacataccatgaaggacatgaccatacaccataccaggtgtatgcctacgtatgacggagggtgatgcagggttcatgacgaaagacaagactgcatcgcgcacggcctcgcacacataccatgagtctacctcgtgggacccatcaggcgtcagtacaaggacatcagcatcgaactcgctatagggacctgtataccagacgaaaagaacaaaa

SEQ ID NO: 13594 - DNA, 3315 bp, Zea mays
cccttcataagctgcctaccactgcactgacagaccgcgggtgcttcacgcctgcagctgccactcttttatacctggaagtacgtacatgggccgagctacggtgtagtacgtgtatagcgtgtttggtttaaggattgaattcttctccctactcattttcttatttggttgttaaaataaaataagttgatctattactattttattttttatagactaatagttagtaatgttataaaaaatatttctatcttattaaatttaagaaatacactcacaatgtactatcttattttaaataaagtgatttctcacaccaaacaatctaaaatctaaggtgattcatctggacgcgtggtcgcagcaccgtggatgcgcgcggcggcccgagtttcccccatgccgagttgccgagtcgacgagcggcgactcagtcccagccgccccatggccgccgccgctcggcacccacagcgtgcttgcagcggcagatctcggcacgggacggcgcggcttctctctccgtgcgcatcgcttttccccaggtgcacctcccctcaacaccaacgtggccacgccagcgcgcaaccaccgcctcccgcccgcttccccaacgcaagccttctacacgtgtctccctccgtgccgcgaccgaccgcccacggccctcccacagaatgcgaccgccccaaccacgtgtcctttctccatgactacacccgttctctcacgctcccgccattgagattcttctctctggcgggtggacagcgctccaaccagtcccacatgtcatcgggacgaatcctgtgggcttcaacaaagacgggtgaaatagagcccagatattttaggcagcccaagagacagagcccatgtggtggggaccacactaggcatcaataaatcagctgcggaggcggactgccccaccggggagcgccacgtgtgtgcggcacggggattaggcgataacaccggcgtcgtggtcgccgttaccatcaacctcctcatgggcccacgcaccttgcccacctggtaggccatggacaccacgtgtccaccgcgccgagcaagagagcaacacgcgtccagatcctgccgggacggacgggcccgatgcgccggaccaggaccacgtcgcaacaactgtacctgtccaggcgctgcccgttacggcgacggacacctgcccctctgcccctgcccgcctcgcttccttcctcttcttccctctatctgtattgccccgaaaccttcgtgcccgtttcgcctcgcgcctgcgttgctctgctatttccatttccattgcacccatttccggggtcgcctgcgttgcttcgcgtgggagcgtgattcgtttaggcctctcgccaatttcggagggcgacggcgacgtgctttcggcgggcgggcagagaaaatctagagtcttgggtttgccagacgcgcctttgtgggagacagacacttgctctcgcctccaatggccgagatctgctgcgaggaagccaagtcgacgccggcaaccgccgtggctgcggcttcagtctccgccacggccgcagcggccgcagccgtggcagtggcctcctcggcgttagagaggaggcgacgcaggctggagatgaggaggttccgcgtcgcgagcgatcccgaggagctggtcgcggaggacgtccgcgctgccaagcggcagaggctggcgcgcacgctgtccggctcctgccccgacgcgggctcggactccgacaggccggccctgcccaggtacggggtcacctccgtctgcggccgacggcgcgagatggaggacacggtctccatcaggccggacttcctgcccggcaccagcaagcacaacttcttcggcgtcttcgacggccacggctgctcccacgtacggcatacacgacgcgcacatgcgaccatctaggaattttagatctctctgcggagttatgtatgttgatagcagtttcgcgctactactgtaggtagcgacgatgtgccaggacaacatgcacgaggttgtcgcggacgagcacacgaaggctgcctctggcgaggagacggcgtggaagggcgtgatggagaggagcttctcgcgattggatgagcaggccgccagctgggcgaccagccgcagccgcgacgagcctgcctgcaggtgcgagcagcagatgcccttgcgctgcgatcacgtggggtccaccgccgtggtcgccgtcgttagccccagccacgtagtcgtcgccaacgccggcgactcgcgcgccgtcctctcccgcggcggcgtccccgttccgctctccgtcgaccacaaggtctgtataacactgctcccgtgcatcaggcttcacggggcgcgcaacttgtctgagcttgacgtgctcaatttcctggttcgttcagcctgaccgacctgacgagctggctcgcatcgaggcggcgggtggccgcgtcatttactgggatgggtgcccgtgtttctcggcgtcctcgccatgtctcgagccataggtgagctcaagtttgtgcccccggtgtcgttttggggggccagtccactcactggattttaactgaccggcttatgcgcgcgcaggggataggtacctaaagccgtttgtgtcgtcggagccggaggtaacggtgacggagcgcaccgacgacgacgagtgtctgatcctggccagcgacggcctgtgggacgtcgtgaccaacgagatggcgtgcgaggtcgtccgggcgtgcttccgtagcaacggtccgccggcgccggccgctcgcccgaacggcgtggccctcccggcagccggcgcgggcgccgaggacggatcggcggttgtcaagggtgtgggcaaggaggactccgacaaggcgtgctccgacgcggccatgctgctggcaaagctggcgctggcccggcggagcgccgacaatgttagcgtggtcgtcgtggatctccgccggggcatatgattctcggagcgaagcagagcagggcaaaatcatatgctccatgcttgaaactagctcttctgaaatccacgctaatttctcccccattttgaccatccttctattttgatgtagtattagtagtagatcctgatcagatgaatataatagacgcttttcttctctcaaaaaaaaaaaaaaaaccagtcaggcaggagcaaggaacaagaacagcgaattgttggatcatggcctggccacatacgcacaacgtagtgcagatcgttagccccaactttttggccgttgcttaacttgctaggactgctcgttgcgtccttcgactaa

SEQ ID NO: 13595 - DNA, 1715 bp, Zea mays
  misc_feature (1666)..(1666): n is a, c, g, or t
  misc_feature (1668)..(1668): n is a, c, g, or t
  misc_feature (1675)..(1675): n is a, c, g, or t
  misc_feature (1699)..(1699): n is a, c, g, or t
gcacgagaccattacctagaacatcctaatcgaaaagtttcgcctcgcgcctgccctgctgtcctgctgctgctattttgccattgcatccatttccgggggacggagtggaggagggcgtcgcctgcgctgcgttgcttcgcgtgggaagcgtagcgtgcttcgtttaggcctctcgccaatatccgagtgctaatctagagaggcctttggctttgccagacgcgcctgtacgcgccctttctgggaggcagccgcttgctctcgcctccaatggccgagatctgctgcgaagaagccaagtccacgccggcgaccgccgtggctgcggcttcagtctccgccacggccgctgcggccgccgccgtggcagtggcctcgtcggcgttagagaggaggcgacgcaggttggagatgaggaggttccgcgtcgcgggcgatcccgaggcgccggtcgcggaggacgtccgcgccgccaagcggcagaggctggcgcgcacgctgtccagcacctgccccgacgcgggctcaggctcgggctccggactcggactccgacaggcctgccctaccggagcggttgcccaggtacggggtcacctccgtctgcggccgacgccgcgagatggaggacacggtctccgttaggccggacttcgtgcccggcaccagcaaacaacacttcttcggcgtcttcgacggccacggctgctcccacgtagcaacgatgtgccagaacatgatgcacgaggtggtcgcggacgagcacaggaaggcagattgttctggcgaagagacggcgtggaaggccgtgatggagaggagcttcgcgcgactggacgagcaggccgccagctgggcgaccagccgcagccgcgacgagccctcctgcaggtgcgagcagcagaagcccttgcgttgcgatcacgtggggtccaccgccgtggtcgccgtcgtcagccccacccacgttgtcgtcgccaacgccggcgactcccgcgccgtcctatcccgcgccggcgtccccgttccgctgtccgtcgaccacaagcctgaccggcctgacgagctggcgcgcatcgaggcggcgggcggccgcgtcatttactgggacggtgctcgtgttctcggcgtcctcgccatgtctcgagccataggcgacggatacctgaagccgttcgtgtcgtcggagccggaggtaacggtgacggagcgcaccgacgacgacgagtgcctggtcctggccagcgacggcctgtgggacgtcgtgaccaacgagatggcgtgcgaggtcgtccgcgcgtgcttccacagcaacggtccgccggcgccggccgctcgggcgaacggcgcggccctcccggcagccgagaacggatccgcggtcgccgagggcgtgagcgtggaggattccgacaaggcgtgctccgacgcggccatgctgctggcgaagctggcgttggcccggcggagcgccgataatgttagcgtggtcgtcgtggatctccgccgggggatatgatttgccttcttttttagccctcttggaatccaagctaatttctcccccgttttcttccatacttttagttctgttttgatttagtattaatagtagttaccaatcagacgcttttcttctctcaaacgaggaattaaaagccantnggaccanggaaaaaaaaaaaaaaaaaaaaanaacaaaaaaaaaaaaa

SEQ ID NO: 13596 - DNA, 3237 bp, Zea mays
  misc_feature (2)..(2): n is a, c, g, or t
gnccgcttttttttttttttttttagagaaaataggttgggtagcacccaacgagatgtttgctcatacgtttggttccagttgtccatcagaaatgaaggcacaagcataagggcggtgtttttctctacggatccgaaactaaacagagttagaaagcaagaggtaggcagtcctgcatcgtcagttcgccactgatagtgattttcaagggcgtgtcagccatcaggccaaaattcttctccagcgctcgtcccctttgtccacacgtcacgccgttgccgcatgatggcagttgtttctttcaagatgataaaatttagagaatgctgatggagacaactcttcactgacagaccgcagggctcgcccgcctgcagcgaccactctattaccactttaccagtaccaggtagtagtacgtagtacatgacatgcgccgagctacggtgtacggttagtcggttaccaaccaaaatgacgcgtggtcgcggcgccgtggaagtgcgcgccggccggagtttcccccataccgaaccgagccgacgagcggtgactcagcatgcaccagctgccccccattcggcgcctggccgcatgcagtgcaccgggccaccgccgctcggcactggcaggcagccgccgcaagcccgcaacgtgcggcacaccgcacaccggactgtcagccgcggccggccgcgccccccccatcttgcagcggcagttctctcatctctgcacggcgtggctcctctctgcgtgcgcctcgctttttcccaggttcacctcccctcgcccccatcgtggccacgccagcgcccaaccaccgatcgccggcccgcctccccccacgcaagccctgtacacgtgtccaccggtgccgcgaccgacccaccttcccactgattgcgaccgccccaaccacgtgtcccttctccatcactacacccgttccctcgtgctcccgcccactccctttctcgctggcaggtgggcgacgcttcagccagtccccacatgtcattggagatgaatcctgcgggctccaacaaagagcggtagggaagagtacgtactactgtggactccggatatttttctgggcagcccgagagacagaacccatgtggtggggaccgcaatagtaggcatcaataaatcagctgccgaggcggactgccccacccaccccaggagcgccacgtgtgtgcggcacggggattaggcgataacaccggcgtcgtggtcgccgttaccatcaacctcctcatgggcccacgcaccttgcccacctggtaggccatggacaccacgtgtccaccgcgccgagcaagagagcaacacgcgtccagatcctgccgggacggacgggcccgatgcgccggaccaggaccacgtcgcaacaactgtacctgtccaggcgctgcccgttacggcgacggacacctgcccctctgcccctgcccgcctcgcttccttcctcttcttccctctatctgtattgccccgaaaccttcgtgcccgtttcgcctcgcgcctgcgttgctctgctatttccatttccattgcacccatttccggggtcgcctgcgttgcttcgcgtgggagcgtgattcgtttaggcctctcgccaatttcggagggcgacggcgacgtgctttcggcgggcgggcagagaaaatctagagtcttgggtttgccagacgcgcctttgtgggagacagacacttgctctcgcctccaatggccgagatctgctgcgaggaagccaagtcgacgccggcaaccgccgtggctgcggcttcagtctccgccacggccgcagcggccgcagccgtggcagtggcctcctcggcgttagagaggaggcgacgcaggctggagatgaggaggttccgcgtcgcgagcgatcccgaggagctggtcgcggatgacgtccgcgctgccaagcggcagaggctggcgcgcacgctgtccggctcctgccccgacgcgggctcggactccgacaggccggccctgcccaggtacggggtcacctccgtctgcggccgacggcgcgagatggaggacacggtctccatcaggccggacttcctgcccggcaccagcaagcacaacttcttcggcgtcttcgacggccacggctgctcccacgtagcgacgatgtgccaggacaacatgcacgaggttgtcgcggacgagcacatgaaggctggtcctggcgaggagacggcgtggaagggcgtgatggagaggagcttctcgcgattggatgagcaggccgccagctgggcgaccagccgcagccgcgacgagcctgcctgcaggtgcgagcagcagatgcccttgcgctgcgatcacgtggggtccaccgccgtggtcgccgtcgttagccccagccacgtagtcgtcgccaacgccggcgactcgcgcgccgtcctctcccgcggcggcgtccccgttccgctctccgtcgaccacaagcctgaccgacctgacgagctggctcgcatcgaggcggcgggtggccgcgtcatttactgggatggtgcccgtgttctcggcgtcctcgccatgtctcgagccataggggataggtacctaaagccgtttgtgtcgtcggagccggaggtaacggtgacggagcgcaccgacgacgacgagtgtctgatcctggccagcgacggcctgtgggacgtcgtgaccaacgagatggcgtgcgaggtcgtccgggcgtgcttccgtagcaacggtccgccggcgccggccgctcgcccgaacggcgtggccctcccggcagccggcgcgggcgccgaggacggatcggcggttgtcaagggtgtgggcaaggaggactccgacaaggcgtgctccgacgcggccatgctgctggcaaagctggcgctggcccggcggagcgccgacaatgttagcgtggtcgtcgtggatctccgccggggcatatgattctcggagcgaagcagagcagggcaaaatcatatgctccatgcttgaaactagctcttctgaaatccacgctaatttctcccccattttgaccatccttctattttgatgtagtattagtagtagatcctgatcagatgaatataatagacgcttttcttctctcagacgaggaattaaagccagtcaggcaggatcaaggaacaagaacagcgaattgttggatctaaaaaaaaaaaaaaaaaactcgaaggagggcgccggtac

SEQ ID NO: 13597 - DNA, 847 bp, Zea mays
  misc_feature (797)..(797): n is a, c, g, or t
cattgggtacctcgaggccggcaaaaacaacttcccacagatagattccgcgggctgcgagcatcccccacctcatcggcccccgcgtgcggcggcgggcgactctacctgacctggcctgcgtcctcccgctttccagccagcaagccagactccgcccctctccgaaggctccgatcgtctggtttcgtccagatccggctccgctgaggctctagatcgcgtcgcgcacgatgcaacgcgacctgtcgcggtcgctgtctccgccgcgccggcgtcggcggtcgccatcacccgagcggtaccgcggccggaggggccgtagggaccgaagccctagccgtagcaggtccccctatcgcccctcgtatagaaggaggagccctttcccatccccgagaaggcgtgagagctgttctccatctcctaggaggcgcaatagtccacctccatcacggaagcgttacagaagaaagagcagtccgagtgtcattagctctccagttactgcatctcaaagttcccaccttgggttggaagagaataagaatgctattgatacgcaaaggctagaagaagaaaagaaaaggcgccggaaggaagttgaacttagactaatagaggaggacacagctaaaagagttgagcaagctattaggaagaaggttgaggagagtctgaattgtgatggaattaagcgtgaaatacaacgtcggattgagggaggacgaaaaaggatacatgaggaggtagcaattccagatggagagaggaaaggagtcagcctttaatgagcnccagctgaagtggaaaaaaaaaaaaaaagcggcctcgagctcagctttgt

SEQ ID NO: 13598 - DNA, 1484 bp, Zea mays
cattccggcccgcgaggccggccggcaacttcccacagatgcattccgcgggctgcgagcatcccccacctcatcggcccccgcgtgcggcggcgggcgactctacctgacctggcctgcgtcctcccgctttccagccagcaagccagactccgcccctctccgaaggctccgatcgtctggtttcgtccagatccggctccgctgaggctctagatcgcgtcgcgcacgatgcaacgcgacctgtcgcggtcgctgtctccgccgcgccggcgtcggcggtcgccatcacccgaccggtaccgcggccggaggggccgtagggaccgaagccctagccgtagcaggtccccctatcgcccctcgtataggtgaccacatctcccgacacacgccacagaaatctggcgagtcttcgttttatttttttggggtttgtactgtaaaaaatttgaggcgatgctgatcgccttcattcgaattttgtactatagcttggtttgtgactgttagaggtggatagtgtggtagtatattgtgccatatcatacttgaattaaatatgattatgaacgtcaaatttcataacaccatgatttctgatttccaagggggaaatgatttggatgcttttgcattacagagttaaaataaaaatgcttcgatgcagcatggaatatatcagcagatgaagcttagatatagttatgccatggtttgcattacctgcctatacagactaacaagagttgctttcgtaaaacgcatggaatctacaaagattttactctgtgctgtattgctgtggaatgctctacccctgtaacagtgtctaaggtaactgcttttgcccatgttttagggcttcaagagataatggtaattccttgtctattgttgtgatgatcctaattttatccttacagtgctcatctttgtcttgcagaaggaggagccctttcccatccccgagaaggcgtgagagctgttctccatctcctaggaggcgcaatagtccacctccatcacggaagcgttacagaagaaagagcagtccgagtgtcattagctctccagttactgcatctcaaagttcccacccttgggttggaagagaataagaatgctattgatacgcaaaggctacaagaagaaaagaaaagggcggccgccgccgcggggaagttgaacttagactaatagaggaggacacagctaaaagagttgagcaagctattaggaagaaggttgaggagagtctgaattgtgatgaaattaagcgtgaaatacaacgtcggattgaggaaggacgaaaaaggatacatgaggaggtagcaatccagatggagaaaaaaaggagcggaatgagctagagaaaaagcttgaagaagaacgaaagaaggctgaagaggcgttgaggaaagaggcgatggaacagcagcagaaagagctagagcggtatcaggagctggagaggcttcaga

SEQ ID NO: 13599 - DNA, 2257 bp, Zea mays
ccgatcccggcaggcagggatgttgagcagcaggaaggaggcaggaataggtgaaaagagggtggtgatggggacgtggcgggagcagtgggcgccagtgccggtggcggaggcaggggcactgagtttggtagcgggggaggcagggacgggggtgatggcggtggtagcagatgcggccggaaggaggcagtcagtggtggaggtggcaggcatggctggaataggcaggtggtgctggaggcagcagagaggaggctggcggtggtcaaggtggtagggaggaagtaggcgcctgagagcagaggaaggtgcgacagggcagagagcggatggataagctgggaaggtataaggtgggctaggctgtttttgatggactaggctgcttttgatgggcctttctatccaaccctaggcctgtaatctcctgttttttcttttcctttgaggtaatatttgtatatgtttgtctatttgtgaaacacctaggcttgcctcgcctaagctttaggctgaaggtcactgcctagcacctaatgtaacattgttatttagttagcgctcttttttgtcggttcacttggtgtttgtggactgtaaggatggtatcatattaactaggcagtagaatgatagatggaggatatctgagttagtttgacctctgcgctgtaatgttatttttagaaggtaaggaaaccaacagggctaatttcaattatataacatggtgtcattgaaattcaatttattgtgctctaaatttgtaataaagtgattttagtttgtttcttatcgcagttctcctgcgtacttgaggaaaaaggaacttgtcaggataaattgtccacaaatggttcctgcttctgcagtttccactaattagcagtaggtagtttattctataattgcattgaagcttgaacattgattttggttgggcatgcagtaagtagcttacaagaacatggcttagttgggatactgaaatgcttcatcaatagctctaaacctgccacaaattacttgacattcttctctacaggcatttccgaagaaagatactgctgtagttccgcttgttatatttgatgatgcaactggtgatcctttatctactcttgatcagttttgataattcgtttttggatctggaacacactagaggtatgcctgaaatgcattagcttgtagtcactatgctgatgaaaggcatagtggatcatagatagtatttagatcttagatcatgtgctttgctttttgctgcttttatggccttgaagggtttgaataaaaaaaatcggctttggtcacgccttgcctttggtagtacatttcgttaacttgctgttcccactgctggcgccggtaggaagttgtacttagactaatagaggaggacacagctaaaagagttgagcaagctattaggaagaaggttgaggagagtctgaattgtgatgaaattaagcgtgaaatacaacgtcggattgaggaaggacgaaaaaggatacatgaggaggtagcaatccagatggagaaagaaaaggagtcagccttaaatgaagccaagctgaaagtggaacgagaaaaaaaggagcggaatgagctagagaaaaagcttgaagaagaacgaaagaaggctgaagaggcgttgaggaaagaggcgatggaacagcagcagaaagagctagagcggtatcaggagctggagaggcttcagaaggaaagagaggaggccatgaagcggaaaaaaatggaggaagagcagcagaggcaaaaccagatgaaactgctgggcaagaacaagtcgcggccgaagctgtcatttgcttttgggatgaagtagcgttcgagtcaccgaacgaaattagtgttttagtttcctgtaaccctgtatttcctgaaaccaccattgtctaactttggcagacaaattgggacgtcttaaatcctcctgatctgctttgtaagttgccgtctctcggtgatgtggttttctctgctcctttgctgttcactgttgagttgacgttgcgagaagactgccaaagaagaatccggttggtccatagggatggatagtcgaatgccaacacgtttttactcgatactggattatcttgtatgttagaaattttgatcttaaaccatcgcgttttctcgttggctgtaatcgcatacatatttgttcgttaaaaagaaacagactagttgtacgaaataatttcaaaaatggactcgatttgtg

SEQ ID NO: 13600 - DNA, 2492 bp, Zea mays
  misc_feature (854)..(854): n is a, c, g, or t
gaaagcctctggcaaatcgaaggaaatgatagaaaaagaaatcgtggagcttgttgatgcgcacagtggctttgagaaaaaaaattagcagtggtagggaaaggatagcacggagaagagcaaatgctggtgatgctacagataagcacaccaacgaacccagggagaattctaatgcttcattgcagaaacatcatggaaacaggggtaaatttgctgattcgagtttgtatgaactttcggtaatgtgtgtcaagcagtgccatgctgataactacaacaatgttagtcaacattctagccaaactaaattgaaccagagctccaatttgacatcctttgtactgaaagcctttcttgaattgttgaaatcacttgcatcaaagcacagtagggacttcacaataaagctgcatggagattttaaaaagttaagccagccaataatgcagctagtatggtgttttctgttagacccaattcaagaaaatggtggaagcaagaagaacatgacccaaggaaagaaaaacactgagtgcaaaaaggatcagttatatttggctctgacatgcctaaaaaaattccttgagccaagtgtttcaggagaacactctagtgatatcattgattttctaatatctttggctccacctaatatagaggatacaatgggtactggggatcttgacaataatgataccactatggttgaagatagaagcacaagaaatgtccatgtgattttgaacattactgaagacgttatatgccagacttcttacccaatcagttttacgtgaatctgaggctgtaattgaattgattctgggtatttcaagaaaactgcaacttgnaacgaaggcatcttgttggaaaatgggctacagatctatgtagaaagaaaaccatgcaaagtcctagaatggcacgagagatgttaaaactagctatacatcttacaccagctccagatgacatgattcttgtttatgaggtgtctactgagttgatgaatttaatgacctctggagatgatggagattcttctgatacatttcatatcattaactgtaaaacaaagagctcactcgctgctctctctcttcaaatggttgagtcatctcttactgaattggattggggctttggaaagcttaaagcaatgcttacattaggttatgattgtgctaacattgatgaagatcaaccagcagatgaaataatgctaaggttggctttggagaaagcactctactcgagatcaacattagtagttcaagtgctctcttcctttgcacatatgagccctatggatactcaagcagaacattttctgaaattgactgtcaagttctacaagcttttaactcgcatgtcaaagtcccagattgcacctaaaggctacagacaatccattccaagcctcaagtttcagaaactggcagaagtaacttgcaaaatgctcaccgctcccctttatgattttgtgtttcaacagaatcagcagatacccataaagggaaacctcgccaaaattagaagagaaaccaaatgtatccctgatcttatttttcagattgaggattatgagaagtatttaatacagctaagcaaactaactaaggtaaaccttttgaggcatgccaaacgcagtgtagcaagagacttccagataaaagataaatctgggggacaacaggaagatgatcacattccagacaatgctgcagcatctgataacgaggctgataaggacgcaatgggtccaaacgcaccagttgaatcatgtgctgacgatgctcaaaaatcatacgctgacgaaaatgcatcatgtgaaagtgggcatgatgaggatgcaggaggtccaaacactccagcagaagcagatgctgatgaaatcattaggtctagcattccatatggtagtccagtccaggagtctgaatctgatagagaagaggaagaattattagcacggacgaagagagctaagacaaaacaagttgtgcaggattctgatgaggatgcagatgagtaggtttttaaacattatcaatagttcaattttcgaagcgtctattgtgggcaacatcatgccaaggtgtatatacataagtttttatgggttatcttgctgattatagacgatgaacacatgagatgtaaaatatatggttttgcaaaaattcttgtgggccatcatgttgattatagaccatgcacagaacatatgtaaaatactttattgtaaattataagttattctaattttctttaagtgaaaacttcttaaatttagtaagattatagaaaaagtataaagatctatgaaatcaaatagatatactaaaaacataattaataaaagaatctaaagatatttatcagtttttattattattgttgttggtggatatataatttgattaaattgactgttaaaaaattacaattacttataattttgaacaagggtaaaactaaacgttact

SEQ ID NO: 13601 - DNA, 3237 bp, Zea mays
catttttgtttggcgcgcggggttagtggcgtggtgggtacagattcatttttgtttaaaagaaaaaaacaatacaccctctattctaaattaaaattaattttaaataattaatagattcatacaatatttaatatatatatctatatttatcgatcctttaagtatagatataaaaataaaagctaaaatgattactattttagacagaaaaggaaagaagaaaaatactagtatattactattttacaacagaagaggaaagaagaaaaatgagataattggatttttatcactcacaacgttgtcttcttgttataattatcaatgtgtttatgaattgtgggtcaagctgagtatatgaaatatggccctgatgacaattttacaaacatattttttgctgatggcaaatatcagaatctctcgaagaaaaatactagtataatctagcaccgcgcatctgtctgcgtctcatgtcttactatgttcatgataaggaaaaactatgtcttgtaggtaattccttgtttttttttttctttcatttgccaggaaaagatccgggtcgccctctacgtgcagcaggccgcgctccacttcatcgatggtacggccaagttgcgcttcatcttctctacgcatggtgcgccttgctactaataaaaactcgatctaaccggccaagcatctgacgtacgtgaaggtggcaagcacaaagactaccggctaaccgacgacattatgaaggccgggttctgcatcagcccggacgagctggcgtcgatcacgagcaagcacgacgcgaaggctctgagcatgcacggcggggtggacgggatatgcgcgaaagtacgctcgtcgccagaccgcggcgtgtccgccgccagcgacgacgatctggacgcgaggcgagccgtctacggcgccaaccggtacgcggagaagcctgggcgaagcttctggatgttcgtctgggacgccctgcaggacgtgacgctcgtcatcctgatggcctgcgctctgctgtccgccgccgtcggcctggcgtccgagggctggcccaggggcgtgtacgacggcctggggataatgctcagcatcctgctggttgtcgtggtcaccgctgtcagtgactaccggcagtcgctccagttcaaggagctggacaacgagaagaagaaggtgtctgtgcatgtgaccagggacgggtgccggcagcaggtgtcaatatacgacctggtggtcggtgacgtcgtgcacctgtcgatcggagaccaggtgcccgctgacgggctctacgtccacggatactccctcctgatcgacgagtccagcctgtcgggcgagagcgagccggtgtacatctctcgagccaagccgttcatcctggcaggaaccaaggtccaggacgggtcaggcaagatgctcgtgaccgctgtcggcatgcacaccgagtggggcaggctgatgagcacgctgagcgagggaggcgaggacgagacgccgctgcaggtcaagctcaacggcgtcgcgaccgtcatcgggaagatcgggctgctgttcgccacgctcacgttcgtcgtcctcatggtgaggttcctcgtcgacaaaaccttcacggtgggtctctccagcaggtggacttctgcggacgcgttggctatagtggactacttcgcgacggcggtcacgatcatcgtcgtcgccgtccctgagggcctgcctctggctgttactctgagcctggcgttcgcgatgaagaagctgatgaacgataaggcgcttgtcaggcatctctcggcgtgcgagacgatgggctctgccggcactatatgcaccgacaagacggggactctgaccaccaaccatatggtggtcgacaggatatgggtgtccgaggtttcagaatcagtttccagcagtggcaacggtctggaagatctgagctccgccgccgtctctcggccggccacactgggcctgctcctgcagggcgtgtttgagaacaccagcgcggaggtggtcagagagaaggacggcgggcaggctgttctgggaaccccgacagagagggcgatcttggagtttggactgaagctagaagcacgacgtcgtgatgctggagacaggagctgcaccaaggtcaaggtcgagcctttcaactcggtcaagaagatgatggcggtgctggtatcgttacccgacggcaggtaccgctggtacgtcaaaggcgcgtcagagatcatcgtgcagatgtgcgacgccatggttgacggcgacgggaacggcgttccgttgtcggaagctcggaggaaggacgtcttaggcaccatcaactcgttcgcttcagacgcgttaaggacactgtgcctggcgtacaaggaaggggatggtttcggtgaggatgcagatagtccggcaggaggctttactctgatatgtatctttggcatcaaggatcctgtgcgcccaggagtcaaggacgctgtcaaggcctgtatgtctgccggtatcgtggtacggatggtgactggtgataacatcaacacggctaaagctatagccaaagagtgtgggatactgactgacggcggcgtagcgatagaagggccagagttcagaaacaaaagcccagaggagatgagggacctgatacctaagatccaggtccaattcgatttttcatcagttttctcatatctaccatcaattttctcaactgtatgtacctttcgacactggcaggttatggctcgttctctgccgcttgacaagcatacccttgtgaaaaacctgcgaggtatgttcagggaggtggttgctgtgacaggcgatggtaccaatgacgctccagcattgcatgaagcagatattgggcttgcaatgggcatagcaggaacagaggtactaactatacctcgcaatttctactgttcttactgtgaatgtaaaaacctcttgcaaggccatcagaagctaagaactcctcacttgcaattgcaaggccatcatgcccttcggcaattctgtgcgtcccttgaaaagataaataacagtataagcttacatacttgcaggtagccaaggagagtgccgatgtgatagtgctggacgacaacttcacaaccataataaacgtcgcgaggtggggccgcgcggtctacataaacatccagaagttcgtgcagtttcagctgaccgtcaacattgtggctctggtcatcaacttgtctc

SEQ ID NO: 13602 - DNA, 1305 bp, Zea mays
cagggctcaaagacgtcctttcgcagttggcacacatcagagtcctaccaagtggcaccaaagctcgttctcccgaccccgactgtccccaatgcgcagtccgcgaggcctcctcaccgcctccggctaccttgcgggccggcacgctccgtcgccctccgtgtccaccactggccacaactccctactcgctcgcaccttccaaatcctagcccagccggagtccgtccgtctgcagaagcacccggcacccaactccgggatcttagagctgaggctggagcggccggaagtcaagaacgccattaattgggatatgatgaggatgctgcggagcgccatagagaagattcaggccgacacgacggcgaaggtcgtccttgttgcgagctccgtgccgggggctttctctgcaggcgccgatctcaaggaaaggaggctaatgagttcttctgacgttggggggtatgctagatccttgaggtctacattttcgtcttttgaggcacttcctattccaacaattgctgtcattgaaggagctgcccttggtggtgggctagaactggctttggcgtgcgatcttcgaatatgtggagaaaatgctgaacttggactgccagaaacaagccttgctattatacctggagctggtggtacgcaacgccttcctaggatcatagggaggtccagagcaaaggaactgatattcactggccgcagatgtggtgcagctgaagctgtaacgatggggttagcaaactactgtgttccagcaggagaggcttaccagaaggctcttgacattgcctgtgagataactcagaagggtcccatggggataagaatggcaaagaaggcgatcaatgagggggcagaggttgccgacatgtcctcggcgctggctatcgaaggggagtgctacgagcagctgctttacacgcaggatcgcgttgaggccctagctgcatttgctgagaagaggaagcctgtgtacacaggaaagtagtagtgtcagaaaggatgataatcgtcttgagagtctgctacaagcagagatggtggcaatggataccccaaatccatacatccaatagccgggtgtggaataaattctttatcatagatacgttaatgggtacaatattatacccatcggtagacgggtgcaagatggatgcgggtatagatatgtattagctatctatgggtaatttttacccacctcatctatatatataatctactcaaaaaaaaaaaaaaaaatatatattagctaaaaataaaatcaacttacatatctct

SEQ ID NO: 13603 - DNA, 1202 bp, Zea mays
caacatcatataacaaagtttgttgtgtttgctgtactacttattttaaacattgtttgcaggagcatttgctgatagtctgtgaacttctgaaggcaaatctgtacgagtttcagaaattcaacagagaatcagggggtgaggtttacttcacaatgccaagactgcagtcaatagctattcagtgtctggaggcgctgcagtttctgcatggtctcggtctaatccactgtgatttgaagccagaaaacatattggtaatgagctacagcagatgtgaaataaaagtgattgatcttgggagcagctgttttgagactgatcatctatgttcatatgtgcaatcacgatcttaccgtgcacctgaggttatactgggcttgccttatgacaaaaagatagatatatggtcacttggttgtatattagcagaactttgcactggaaatgttcttttccaaaacgattcgcctgcaacattacttgctcgtgtgatgggcatcattggcgccatagaacaagctatgcttgcacagggacgggacaccttcaaatatttcactaagaaccacatgttatatgaaagaaatcaggaaagcaacaggcttgaatacttgattccgaaaaagacatccttgcggtaccgcttgcccatggctgatcaagggtttatcgagttcgttgcgtgccttctagaggtgaacccgaagaagcgcccaagtgcctcagaagcattgaaacatccatggctttcttttccttacgagccaatatcttcatgacacaaattgctattggatcctgggtggcttaacatatgcgacaacacctaagcaccatgaaattttggtagatcaaggcgaaagattttctaccacggctgagccatggcaaacccagattcggtttgatcacgcgtggtgccacaatcagctggtctttgacgctgtgtgcaatcaatccatgccctgtgttgtgcttgtaatataactttgtttttttctctctttctagccccgatgtaacaggccattttgttttttaggtactttgtgatgcatttttagcaatagggctgtcatgttgtacatggtgtgatcattgttgaactccgtgccatgctgtgcacatgttagggttctaacccaagcccagaatgtcgatttcattgcattgccaggtctttaggagataaaaaaaat

SEQ ID NO: 13604 - DNA, 2656 bp, Zea mays
  misc_feature (2565)..(2565): n is a, c, g, or t
gttggctacacccggcaaccaattgaggatgaaacctggtttttagcacatgagattgattatcctagcgacaatgagaaggcgactggccacacaagagggaacgatcgtcatgatcgccctacaaaggatgaagatgatgaccagtcatttgttgaggaagattcctacatatctggtgagcaatattttcatggaaagaatattgcacaaataggtacttctgagggcccaatggtccatgggattcctgataatgatatgatagctcagtatgatggccaacttttagattctgaagagcttaatttgatgcattctgaaccagcctggcagggctttgtatcacagaacagtgagctaggtatgctaggcaatgggaaattccttaatgattccgaacgacctcatcctgatgacctttttgtggaggatgatcagcatggctctgttaggtcaattggtgttgggataagcagtgatgctgctgacattggcagtgaggtgcgagaaagtctgattggaggtagcagtgaaggggatattgaatacttcaatgagagcagcttgagcgtgagtggaaaaagacatcctcagcaggatactgaaaagaagagagtaggtgctaaaggagtaaaacatgaccaaatcatttacgctgctgatatccagaagggcaatctaccaccaggagcggctgatgtagggttttcttttcctccacctttgcattctgggaaaaatcatgagtctgatgctaaatctttgtggtcaaagaaggatgaaatgtattgcattaatgatcctgatgactgtcaaaatggcatggtatcagatgatatgcttgccacatggaggaaaaagaacagtgagtcttctctaaggagctctagagatgaaatgacgtctgatgttgttagatcaagaaattcaagtgcatcctatggcgaaacagaggacacgtcgaatgctcggcatcacaaactagatgacgcacaagaagacactggaaccaacttggatgatgaggaagcagcagcgttgcaagagcaagtcaggcagataaaggcgcaggaggaagagtttgaaacattcaatcttaagattgtgcatagaaaaaacagaactggctttgaagaagacaaaaacttccatgttgttctcaattctgtcattgctgggcgttatcatgtatcagagtatttgggttcagctgcattcagcaaagccatccaagcacatgatttacacacaggaatggatgtatgtgttaaaattataaaaaataacaaagattttttcgatcagagtcttgatgagatcaagcttctgaagtatgttaacaagcatgatccagctgacaaataccaccttttgcgtctgtatgattacttctactatcgggaacatttgctgatagtctgtgaacttctgaaggcaaatctgtatgagtttcagaaattcaacagagaatcagggggtgaggtttacttcacaatgccaagactccagtcaatagctattcagtgtctggaggcgctgcagtttctgcatggtctcggtctaatccactgtgatttaaagccagaaaacatattggtaaagagctacagcagatgtgaaataaaagtaattgatcttgggagcagctgctttgagacagatcatctatgttcatatgtgcaatcacgatcttaccgtgcacctgaggttatactgggcttgccttatgacaaaaagatagatgtatggtcacttggttgtatattagcagagctttgcaccggaaatgtccttttccaaaatgattctcctgcaacattacttgctcgcgtgatgggcatcattggctccatagaacaagctatgcttgcacagggacgcgacacctacaaatatttcacaaagaaccacatgttgtacgaaagaaatcaggaaagtaacaggcttgagtacttgattccgaaaaagacatccttgcggcaccgattgcccatggctgatcaagggtttatcgagtttgttgcgtaccttctggaggtgaacccaaagaagcgcccaagcgcctcagaagcattgaaacatccatggctttcttttccttacgagccaatatcttcatgaggctaactgctattggatcctgtgtggcttagcatttgtctcaacacctaagcaccatgaaattttgatagatcaagacggaagattttctaccacgactgagccatggcatcagccgaagtcccaaacgcaaatgcagattcggttcgatcatgtcttggtgccacaatcagctggtcttaggcgccatgtaaaatcaatgcatgccatgtgttgtgcttgtaatataacttgttttttttacccttcatttccagccccgatgtaacaggccattttggttttctaggtacttggtgactcatttctagcaatagggctgtcatgttgtacatggtgtgatcattgttgagcggccccgtgccatgctgtgcacctgttacgcttctaacccgtcaaaaaaaaaaaaaataaaaaaaaaaaaaaaaaaaaaaaccatcnagctccaactatatgaacccttctccccaagattaaaaagaaagctccccccaaacatccacatttgggccccttgagggaaattgatttc

SEQ ID NO: 13605 - DNA, 3053 bp, Zea mays
ctgactttggtgcggctgtgagcacgatgatgcgttgcgcggttcggattcgtgagagctgtagtcaaaaggctggaacggatggaattatccgagcagattgggtgggacggcggagggagccctttgcgccgtcacaaatcgcaaccaatcgccgagttgcttgtgttaaatagctcttcgcgtacgacacggcaagcgggctgcgacggcgactttctcatctgctcactgctctgcttctccactccgctccgctggcagcgcaggccatggcgacacaggcgctggcgccctccctccgcctcctcctgctgctaccgctgctcgccgccgccgccgccgccgccgcgttgtctcacccagcgcacgagttctgcgcggtcgggggtgacgcctccggctgcggcggcggaggagacggcacgaggatcctgatcaagggcgggacggtggtcaacgcgcacctcgcggaggaggccgacgtctacatcgaggacggcgtcgtcgtcgccgtccgcccagacatcccggttgatgttgataatgtcagggtaatcgacgcaacaggaaaatatgtcatgccaggtggaattgaccctcacacgcacctggagatggagttcatgggcaccgtgaccatagatgacttcttcagcggccatgctgcggcactggcgggtgggacgacgatgcatattgactttgtcattcccgtgaacggcaacttgactgcagggttggagtcctacaagcacaaagccgcaaaagctgccatggattatggctttcacatggccattacaaagtggaatgatgaggttgcaagggaaatggaagtgatggttaaagaacatgggataaattctttcaagtttttcatggcatataaaggctccttgatggttactgatgacctcctcctgcaaggcctacggaaatgcaagtcgcttggtgcccttgctatggttcatgcagagaatggtgatgctgttgccgagggacaacagcggatgattgaccttgggataactggtccagaagggcatgctctctcaaggcctccaattttagaaggagaagcaactgcacgggcaatccgtttagctaagttcatcaatacgccactgtatgttgttcatgtgatgagcatcgacgcaatggatgagattgccaaggctaaaagagaagggcagagagtcatcggtgaacctgtggtttctggactagtgcttgatgattcttggctttgggatcctgacttcacgattgcttcaaagtacgtgatgagtcctccaatccgggaagcagggcatggtaaagcactccaagctgctctttcatcgggaattctacagcttgtaggtactgatcactgcacattcaactccacacagaaagcttttggttctgatgattttcggaagattcccaatggtgtaaatggtcttgaggaacggatgcatatactttgggacagcatggtggagactggcaagatttctgtaaccgactatgtcagagtgacaagcacagaatgcgccaagaccttcaacatattccctcggaaaggagcaatcctggaaggatctgacgcagatatcataatcctgaaccctgaaaggagctttgtgatgggtgctctcacacaccattcgaggtccaacaccaatgtgtacgagggcaggaaaggaaagggaatggtggaaataacaatctcaaggggccgagtggtatgggaggatggcgttctgaacattgcacctggttcaggacgatacgtcatgatgccacctttcggctacgtctttgatgggatcgagaagtccgatgcgacctacagagcttccctccgagcccctgtacagcgtggtaaagctgctgcatagctatgacagctgctgatgccattgacagggcagtagccccccatctgattcaagaacgagttgctccaaggtgaacaccgcatcgttccatgcgtattgtctatacagaacagtttatttaagatcagattcaggataggtaaaggcctcagcttgcctatgtacatcaaacacatttgttactagttctggtcaatttgtgcaactagcaattcgctgttccaataaatcatattatcacattcaaaaaaaaaaaaaaagcacagaccattttcagcgccaagaccttcaacatattccctcggaaaggagcaatcctggaaggatctgacgcagatatcataatcctgaaccctgaaaggagctttgtgatgggtgctctcacacaccattcgaggtccaacaccaatgtgtacgagggcaggaaaggaaagggaatggtgcttctttcctcccctggggccccagtggttggcgtggaacttgcaacttgcgggtgcatcatgtactaatgttcatttcgtgtagggaatggtggaaataacaatctcaaggggccgagtggtatgggaggatggcgttctgaacattgcacctggttcaggacgatacgtcatgatgccacctttcggctacgtctttgatgggatcgagaagtccgatgcgacctacagagcttccctccgagcccctgtacagcgtggtaaagctgctgcatagctatgacagctgctgatgccattgacagggcagtagccccccatctgattcaagaacgagttgctccaaggtgaacaccgcatcgttccatgcgtattgtctatacagaacagtttatttaagatcagattcaggataggtaaaggcctcagcttgcctatgtacatcaaacacatttgttactagttctggtcaatttgtgcaactagcaattcgctgttccaataaatcatattatcacattcattactcgcattgtaatgttaaacccttcttcctattcatcatgagctatccccaaacatgctaaaagaacatggttactgattgttcatgaaaaggatggcctatgcagtactgtgattctttggaagaacataactttgcaaacagatatccagctgtttagttcagatataaatcgtgtcgtatcacccaacagtg

SEQ ID NO: 13606 - DNA, 1560 bp, Zea mays
attgggtacctcgaggccggatcaaaccatcaatcacagagcaactcgaatagcagctccaacaaaagctcaacgcaccagcagcaatggcgtctcgccgtttcttctacgacgacccctacgactactactacacctccccgtaccactacgcctacccctattaccggtaccagcaccccgatccgtcccgcggcgtcggcgggttcttcccggccgccgcagaagccgcgccggaggcggtgaaggtggacccgcggcccagggtcgagtcttcgaggtcggtctccgttcccgtccgcttcgtcggttccgacccggagccggtgcgcggggcggccaggatgccaccggcggcggtgccgaggaagcgggcgccgtcggcggaagcggcggcggtgctgctgcaggccgcggtgcgcgggttcatggcgaggaagtcggtgcgtgctgttcgcgaggtggagcgtgaggcggcggaggtcggcgagaaggttgcgcgcgaggcggaggcgctgcgcggagacgcgagggcgcggatcgccgtcggggaggcgctgatgaagatgctgctgcggctcgatgcggtgcgcggcgcgcgggaataccggaagagggtcaccaagcgggtcctcgcgctgcaggatgctgttgacgccctcgaaccaaagccggcgccggattcggaggtcgtggcggaggagagcgagtctgaggtgacgtccgagatggcggacgacagcgccgaggcgacggagatgccggtcgccgcggagcacagcggcgggattgaggtgaatgcggcggctgagacggttgccgatatggaggtggacgggggcaaagctgacagcgaggcggtgccagaagcggtgaaggaatccgaaaataagcaggacgacgggcacattaacggcgaccagacggaagtctccaatgagggcgaatgggagatggtggcggatgaagcggagcctacaactgcggcgacgggttccaccggggcgcccccgcagacaccgatgacgagcgaggtgatgaggccgacagtggaggccggagctgccgacagcgccctggacactcggaaggttatggagatggtcgcggccctgtgcgagcagaacgcgcagcagtgcgcggtgatcggggctctggcggagcgcgtggacgcgcttgagcgcgccgtgcggcgggtggaggacgccgagcgccgccgccggcggggcaagaagctgaagaaggatgggaaggggagcaataggtgctacaccgattgaggacagctctgcttcttatttgtttttacatggttagaccaggaaccttcacgagctgtagaatttagttcttgttggccaaaaaaaaaaaaaaaaaaggcttggcgataccgacgaccctcgagggcgagcccgaacaccgggcggccccatagagcataacagaggcgcgggggctcaaccggcccctcacaccactagacacccagggccacgccaattcgccgccctccccggcccccccccccaccgctccccccccggcccctgccacccccgg

SEQ ID NO: 13607 - DNA, 3286 bp, Zea mays
  misc_feature (1834)..(1834): n is a, c, g, or t
caagccaccatcgccattgccagagccacagccacagccaccacagatgctgatgacgtcaacgaaaaagagagggggcaaatggaagtttgtattgaccggggtccttggtggtgctgcaattgtggtaacacttggccttagcgttctggtattttgcttgttgagaagaaaaggaaggaaaccgagagggagaggagtggagcagactgaggagggcattcggtctgggcggagaagtagtagtgtgaatcccgtcacaatgtcacccatggcatcccccagagccagtggttcaccaaagggcgttcctattatcacagatgaattcacctatgagcagttgcaccatgctgcagggggctttggggatgataacctcgtcaagcatgggcactccggtgacatgtactatggtgtcctggagagtggctttcaagttgtcataaaaaagattgatctgaagaccaggaagaagtgccagggcgaattgagcttccttacaaagcatacccatgggaggatcgttccattgctgggccatttggctaaggatgaagaggaattgcttgtctataagtacatggcaaaaggtgacctcacaaccgcactgcacaagaagtcagtggaagttgaacaggggttgcgctcattggattggataacgaggctcaagattgcaataggtgtggctgaggccttgtgcttccttcatgacgaatgcaatcctccgttggtccacagagatatccaagccagcagtgtgcttcttgaggacaaatttgaagtgtgccttgggagtctgagtgaaatatgcactcaacaaagtgcaggaagccaaagtttcttctctcggattctaagatcatcgaagtcccttgacaagaacataccaggtccaccagctagctgctcatacgacatttactgtttcgggaaggttctactagagctaatcactggaaacttcggtgcgagtggctcaaccaacgcagattcagaagagtggttagcaagaacattagattacatcaacgcaaatgacaaggagggtgtctcaggtattgtggatcccacccttgttgtggatgatgaccatctagaggaagtgtgggcagtgtccatcgtcgcgaagacatgcctgaatccaaagccctctaggcgtccactcgctcgatacatcctgaaagcactggagaacccactaagggtggtgcgggagcaggaagagttccaatccagtccatctcacctcagaagtaccccatcccagggctcttggcgtttcgctttccatggaaacaagtaccacagctgggaggccatgccaacgtcggggcaagcacttgctcggaaaaatacagcgaagtctcaggggaccgaggggagtgacgaggacgaagagaactcgttctcgttcaagagggcttctcgggacgattttccggatcccatagagtttgaaggaggtgttgttgtgaaggagtacccgcagactagctagcgatacttgatgtgcatctctttgatgtctctaggtgaaaagctgtgtatacagaatagataaatttttcccctcttttctctttacttgtttatctcagtcgattgaaatggaataaatggcgcactgggtgtgccatccttgaaatgcaagccagtaaagttctcagatagagccatttgccattcaaaaactgttatgaaattttagtggttgatccaaagtgaattgtagtggagagcagtttaagccttgacccggcaggtggttctggtcgttggagtgaatgggatcatacttctgcagctgaaaacttttgagcatggccantggtgcgtactgagtgtgatagagcattcatctgcagctgcagtttcatccggtgagcttgaacaccgaagacgaaatggagggcacctccatggtctgttgtagcttctgttgagtttgaaaaaacggacaaaagaagcaatctgaacattatggagatcggtgataccagactagtgccatggacggatggcacgcagttatggagatcggcgacagcactgcccgccccctccgcgaggcagcaccagttacgggaggttgacttcaattatttctgacgtaaatccgcccggaattggagttgggttttttctgacgtaaatccgcgcggaattggagttgggtttaacccgacgctggatcagctggtccaggacatcggtgactcgttttgccttcaggctctggtgggacagtcagactcgagcccgagcacgggaagttaagcctcgcaaactcaattttgtttgaagatgtctgaaaaacaattttgtttgcaaatgtctaaaaaaactttgttgcagacccacatcaggagcagcaccgttttatattccttcgtaatggtaaaaaaaattgtggatgagagggaacaaaatacaaaaaatgaggtcccaccgagatttgaactcgggttactggattcagagtccaatgtcctaaccactagaccatgggaccatttgttgtgaaaaagcgcaaactcatattatttaaatataatactacctttagtcgattgcatcccgattcccaagcactacggttttactcagcagatgataagagccactgttaccatttgtttatggtgactatatgagattatgagaccgtttgatttatacctatgctacatgattcttatttagggcacgtgccgccgttcatgtttccaatgcacggttttgaactgaactcttccagctagcctagtacttctattgcatagtcaattaaattttctttcctctaataaatttctccggtcctttgttaatctcccttctttttttaaacaatggttataaatatatacgattggtttattctcttgactagttttctcacgtggctgagcttcatttgttgctactccctccacatgagtttgtctttctaggtttgtagtcaaactattttaaactttgaccaacaatatatatcaagttaaattattttaaactaaaacaattacatattatgatagttcaagtcataataaaatttttacttttatgttgtaaaacctaatgacacatctggtacaaccggttaaagttgataatgattgacttagtacaaacccaaaaagacaaactcatttggacgaagacaatagtatttaaggccttctcaaatggcgcattgtaccactcccacaccacaaaataccatgtatggtgtccaccccacacgatccaacgatgctccccatctgctctccct

SEQ ID NO: 13608 - DNA, 523 bp, Zea mays
ggcttaccacgcatcagtgatcgccgagtcactgacgccttgcccgaaaccaaattattgaccgacaacgcgatgctccaaggggtgctgtcccgcgcgcccgccaccgacgctgcggcagcaatgaaggccaagcgggcgggcgcgtcccccggtgaagaggaggaaggggacggccgttctgcgcgggggaagcggcagcagctgctcgggcttggccccgccaccgctttggcgtcggcggcggcggcggaggaagggccggagacgcgaggcctgcggctgctcagcctgctgctgcggtgcgcggaggcggtggccatggaccagctgacggaggcgcgggagctgctccccgagatcgcggagctggcgtcgccgttcgggtcgtccccggagcgcgtggcggcctacttcggggacgcgctgtgcgcgcgcgtgctcagctcgtacctgggcgcctactcgccgctcgcgctccgcccgctggcggccgcgcagagccgccgcgtggcggtggcgt

SEQ ID NO: 13609 - DNA, 1776 bp, Zea mays
  misc_feature (15)..(15): n is a, c, g, or t
agattgacccatggngaaagtgccccccgccgccgcgcccgcgtgggtggcgattgttgttgaaaatcttagtatgaagcaaacagaggtagaggtggaactacgtggcccaccagttgcgaaggcatttgacgaagaaggaaaccccactaaggccgctgagggattttgtcgaaagaataatgtctctgtcgatcacctatatagaagaatagatggtaaaacagaatatatctacgctagagtcagagagtctgctcgttttgctgatgaggtcctaactgaagatttacctactattgtttctggtatttcatttcccaagtcgatgcgctggaactccaatattgtttttagtcgtccaatacgctggatcctggcacttcatggcgattttgttgtgccattttattttgctggcatctcaagtgggaatcagtcatgtggccttcgtaactcttctttggctaattttaaggtggaaactgcagaatcatatttaggtactgtggaaaaagctgggatcttgattaatatgcaggagcggaaggaaaaagtcttacatgcctctactgtattggctcaaggtgttggtggcgatttcattgcgcctgatagcttgctgcaggaggttgtcaatcttgtggaggcacctgtgcccatccttggtcgatatgatgattccttcttagaacttcctaaagatgtactgattacggttatgcagaaacatcagaagtattttgctgtaatctccaagtccactggcgatctgctaccttattttattgctgttgccaatggtgcaattagcaaggaagttgttcgcaaagggaatgaagctgttctcagggcaaggtatgaggatgccaaattcttttataagatggatacacaaaagaaattttctgaattccgaggccagcttagtggcattctttttcatgaaaaacttgggacaatgctcgataaaatgacacgtgtcgagaataccgttgctgaattggcccttattcttggaataaatgagagaacggtcccaattatcaaagatgcggctgcattggctatgtcagatcttgccacttctattgtcacagaatttacttcacttgctggaattatggcacgccattatgctttgagagacagcatccctgaagagattgcagaagcactatttgagataacactccctcggtcttcgggtgatgtgtttccaagaacagatgctggtatagttcttgcggttgctgatagattggatagcctagttggattgtttggagctggatgccagccaagttctaccaatgatccatttggactgcgcaagggtctcttatggattggtccaaatattagttgagaacaaaaagagctttgacctcagacgagctctcaccttattggcaggggtgcaacccatagcaatagagagtgatgttatagatgaggcagtacagttcgtcacaaggagactggaacagcttctggtacatattatctatcttgatctttaatgacagttgagtatacacatattaggtttttcattgtgggtgttagctagggatagagatacagtggtacacacactggtatatttttcatggaaacaaaaaaaaattgttgggatggttatcattatttctccaactgttatggggcagacccagtgccggaacggatacatctgcatttcatttagaactcattttgctccatgtcatcaaactggtcgatggaatccattgcccttttgaaagtggcttt

SEQ ID NO: 13610 - DNA, 3293 bp, Zea mays
  misc_feature (61)..(61): n is a, c, g, or t
gtccgatcagtgcttatgaagcgtgcaaactgcccttatctagcagcacaaacagcgacgnaaatggaagcattttcgagaacagactcgtggccggccggcgttgaagcgtattcaaggccaacaaggatcatccgtgggaaaagaaattgagtctgctttggaggttgacccacacgtatttgagaaagatgaagagaaagttttgtggagcgcccgcggggaggttgctgataagatccatcctggtgttgatattaagacctttgtggatgcttctcttatcctgatacaacccctagaagatttcttcaatagtgtcttcgtgatggcggaagacgagagagttcgcaacaaccggctaacgttgctgaggaagattgagagtttgcccaaggggattgcggacctgtcagttttacctgggttttaagctgcctattccagccagggggtgtgagcaatagccgtagcggagagatgattttgattttacaagtatttctgattaaaggaaaaaaaaacgtcgtcgcagtagggcacggcaatcccagtaaacgctgtacttgtaattctgattaatacagtcaacaaacggaatcatatctcaaatcttgtgtcgacaaacaatacagacctaaaaaaagagaaaaaggttacagcatccacctgtaagttatcagggttattgcaaaatcagtctacaaagctcgtcaaatgtgccctcacatacctacctagctagatattaattgtacctcgcccgcggccacgcgtctctcccttaggttcagatagatacttatctgcgtagtgtagaagccgccgcatccttaggaccatgtcacagtgaaagggcagtgctgtgcgcctttctgtgtacaccgggcttactgtcaaccaagacagagagtgaagctccgcggccacagcttccaacacactatgcatctccatctcacactcacgacctgttgtctcctgactcaagttccttgcctgtttgctgccgccgccgccgccgcctcctcggctcatcttctcttgaacagtcccaatgctgcctccatagtgatcgatgatgctgactgagagaacagagggctgttcatccttggtgagttgtgcagagtccctcctaacaggtgggacggctttcgagacgacatagcccatcgctaagggaatcgcagtccctttgctgtgcagtagatgggcaagcggcggtgactccgatgtgaggcatgtcgggagctgtaatgttgcaggagagaggtatctcatacttggcgaaggaactagaaggtacgagtgtgacgctgacattgacccaatggacttcactggagtgaaaccttccaggtaactccaagggccactgctgccttgactcccttcgccagctgaagcaggtctgctcagtagatctgcttggcatgtgagatgcaacgaatgatcttgggaaactgcaaccaaactgatgctacgaactaagtgcagtgatccccttgaagtgtccattccactttgttccacaaggatctgttttttgttgccagattgtccaagtgcacctttcatgaagcttgattttggatgagggctatacagagggtttggtgaggaaggcatgtttctatcttgaattaaggccatgtcttgctgctgctgctgctggagcgtaggaccatttgaactaggtggaataccctcaggtatggatcgccgtaactgcacaggccacttcttcacttcattgccaccataagagtatattgccttctgccattcttggatttcaagctcaaggaaacctccgatacgagttattatgacatctcgtggtctcatattgctagcctcaggtgaagacgacattatttgacagccttgctgtagaatttggatgaaaaggctttggagaactttagtgtcttggcggctactaataccaccaaaaggaaatattaagctgtccaataattctcctctagcatctgtccaaatgcacactagccatcgccagtcctcagtccaaccataacagcaatgaagacttgctgcactgtcactctcagatacgtcgagtagagggctcactccactatcagagttacttcctgaaattgagccatataccctgctgccagatgcatctgctccagattttgatggttccattaaagcattaagatcggcagacccagggtctgctagtatgaaaagtggctcaaaggcatatttcctatcatcctgagcacataaatcaggcagcttacttgggtccagaagtcctcccgaacgagcaggctgccatgagttatcccatgttgccgacctcatggatgcatcaaaatcggtttctcgagagagagttggcccagacattcgaggaactaaacattccttccaaagagtaggagcaggagatgtaacatgcatcattgtggactgagatctacccaaataagttggtgactggaacatatcgcttgtggagacagcccgtgggattcgtcgtgccttgttgtacactgtaaatgctatgtccttcaaaacagcaagctccttgtttggcttatccattctcagtacagtttcaatagtaacaatctgcaagacgagcttgggtatactgaacccggatagcataacgacatttgatgctgatgcttcatctacagaagcactgctgtttagggctttggcaacctgtgaatatagtaactttctttccctttccggggatgaaataacatacccaagagcaacagaacattctactagcgtctgtagaattgcacaaggttctggaaatgggcaaactacataaattactgtgcaaggtccactactgctctctttctgatttgtagatatgtttgaagtcagctttatatccttaagtatccttgaaatagatgttacaaaacttttcacgctccaatgttttgaaaaagcttgaagacagtcacttgttgaactgatgggacctaagtggccacagcgaaccttcttcaactgctcaggacaatcaactagaacaagtcctgaaggcaaatattttccaggagatagttccatttgtcctccattgttttggggcgaatgagttcccagtttgcaaacttcataaactgttccaagctgcatgaaaaaatcagctaccgccgaagtcaacatatcaatatcagggcaaagtgcatagtaagtaacaggcttcggcaaggcataaggttcaaaaggagctttctcccatgttttaagactattcaccgaggccttccccgcgt

SEQ ID NO: 13611 - DNA, 7279 bp, Zea mays
  misc_feature (134)..(134): n is a, c, g, or t
  misc_feature (5789)..(5789): n is a, c, g, or t
  misc_feature (6179)..(6179): n is a, c, g, or t
ggcgaagccccctatttcattaagaaataggaaagtttgtaacaaccgccatcacacggtaagaccaccaaaagaccaaccacggccagaacgctatctagactctaaacactatcactagatcagtgaagagnctacgataacaggagaagttttgcctacaaaggactacataagactttcttatttacaaccaacaagacaggacttgtcttagcattctgttggctgattacatattcatgtcaaagattgcagaagcactatttgagataacactccctcggtcttcgggtgatgtgtttccaagaacagatgctggtatagttcttgcggttgctgataggtacttgtgcatgcaaatgtagcttactcaggtcttgttcggttatttctatcctatgtggattgggatggattaagagagattttgacttgctatggatttaaacccactcaatcccctccaatccacatggattgagtgctaaccgaacatgcctcagttataacttccgggtagtactgcatttcatttgtccgagaatttattcaagctaagctgctacccttttctcatttgtttcacagattggatagcctagttggattgtttggagctggatgccagccaagttctaccaatgatccatttggacttcgaagggtctcttatggattggtaagggagttagataaaggcccaaatatcatcacatgaaactttctcacatgtgttttatctaggtccaaatattagttgagaacaaaaagagctttgacctcagacgagctctcaccttattggcaggggtgcaacccatagcaatagagagtgatgttatagatgaggtcagtatgcatttcagataatgtttatgtactatgtttgtttagtatagggttcctgacagatttaaaatcctttttaggcagtacagttcgtcacaaggagactggaacagcttctggtacatattatctatcttgatctttaatgacagttgagtatacacatattaggtttttcattgtgggtgttagctagggatagagatacagtggtacacacactggtatatttttcatggaaacaaaaaaaaattgttgggatggttatcattatttctccaactgttatggggcagacccagcgccggaacggatacatctgcatttcatttagaactcattttgctccatgtcatcaaactggtcgatggaatccattgcccttttgaaagtggcatttcttcttgtcattgccatcaggtggatgagggaattaactgcgagatagtccgatcagtgcttatggagcgtgcaaactgcccttatctagcagcacaaacagcgaccgaagtaagatgttatgtgccccacacacctatccgtccccaaagattctacaaaatacaaatagtttttgtttgtgcggacacttgcagatggaagcattttcgagaacagaaacatttcaaaaaatcgttgaagcgtattcaaggccaacaaggatcatccgtggaaaagaaattgagtctgctttggaggtactgttttaaacatgtaccatcataattcataaactgtgatttcagttcaaattatggtgaagtttttgactcgcaactaccccatcaccagtcttgactatgcggtatttctctcctgcctctgattttatgtgtaggttgacccacacgtatttgagaaagatgaagagaaagttttgtggagcgcctacttggaggttgctgataagatccatcctggtacatgtttttcatatccatttttcatttcaatttaaatgttcatttgtctgattcctccaactacccattctgtaggtgttgatattaagacctttgtggatgcttctcttatcctgatacaacccctagaagatttcttcaatagtgtcttcgtgatggcggtgagttttgtgaggcccttgaaaaacttaacttgtgctgatgagtgagagtgatgatggtgtatattatgcgcaggaagacgagagagttcgcaacaaccggctaacgttgctgaggaagattgagagtttgcccaaggggattgcggacctgtcagttttacctgggttttaagctgcctattccagccagggggtgtgagcaatagccgtagcggagagatgattttgattttacaagtatttctgattaaaggaaaaaaaaacgtcgtcgcagtagggcacggcaatcccagtaaacgctgtacttgtaattctgattaatacagtcaacaaacggaatcatatctcaaatcttgtgtcgacaaacaatacagacctaaaaaaagagaaaaaggttacagcatccacctgtaagttatcagggttattgcaaaatcagtctacaaagctcgtcaaatgtgccctcacatacctacctagctagatattaattgtacatgacaattagtgagttgtctctcccttaggttcagatagatacttatctgcgtagtgtagaagccgccgcatccttaggaccatgtcacagtgaaagggcagtgctgtgcgcctttctgtgtacaccgggcttactgtcaaccaagacagagagtgaagctccgcggccacagcttccagcacactatgcatctccatctcacactcacgacctgttgtctcctgactcaagttccttgcctgtttgctgccgccgccgccgcctcggctcatcttctcttgaacagtcccactgctgcctccatagtgatcgatgatgctgactgagagaacagagggctgttcatccttggtgagttgtgcagagtccctcctaacaggtgggacggctttcgagacgacatagcccatcgctaaaggaatcgcagtccctttgctgtgcagtagatgggcaagcggcggtgactccgatgtgaggcatgtcgggagctgtaatgttgcaggagagaggtatctcatacttggcgaaggaactagaaggtacgagtgtgacgctgacattgacccaatggacttcactggagtgaaaccttccaggtaactccaagggccactgctgccttgactcccttcgcctgtaaaaagtgttccaagtttaatatcttttaccattgatctccttgaaaaacattgaaatgaatttttaatctgtgttggtctaggtgcttaccagctgaagcaggtctgctcagtagatctgcttggcatgtgagatgcaacgaatgatcttgggaaactgcaaccaaactgatgctacgaactaagtgcagtgatccccttgaagtgtccattccactttgttccacaaggatctgttttttgttgccagattgtccaagtgcacctttcatgaagcttgattttggatgagggctatacagagggtttggtgaggaaggcatgtttctatcttgaattaaggccatgtcttgctgctgctgctgctggagcgtaggaccatttgaactaggtggaataccctcaggtatggatcgccgtaactgcacaggccacttcttcacttcattgccaccataagagtatattgccttctgccattctgcggacaaaacatattagatcatcgcgttagtctcgaaacagaaggtatctcagttcctgataaaaacaagtgagtaccttggatttcaagctcaaggaaacctccgatacgagttattatgacatctcgtggtctcatattgctagcctcaggtgaagacgacattatttgacagccttgctgtagaatttggatgaaaaggctttggagaactttagtgtcttggcggctactaataccaccaaaaggaaatattaagctgtccaataattctcctctagcatctgtccaaatgcacactagccatcgccagtcctcagtccaaccataacagcaatgaagacttgctgcactgtcactctcagatacgtcgagtagagggctcactccactatcagagttacttcctgaaattgagccatataccctgctgccagatgcatctgctccagattttgatggttccattaaagcattaagatcggcagacccagggtctgctagtatgaaaagtggctcaaaggcatatttcctatcatcctgagcacataaatcaggcagcttacttgggtccagaagtcctcccgaacgagcaggctgccatgagttatcccatgttgccgacctcatggatgcatcaaaatcggtttctcgagagagagttggcccagacattcgaggaactaaacattccttccaaagagtaggagcaggagatgtaacatgcatcattgtggactgagatctacccaaataagttggtgactggaacatatcgcttgtggagacagcccgtgggattcgtcgtgccttgttgtacactgtgaatgctatgtccttcaaaacagcaagctccttgtttggcttatccattctcagtacagtttcaatagcccggccggccttctatagtgtcacctaactgaacccggatagcataacgacatttgatgctgatgcttcatctacagaagcactgctgtttagggctttggcaacctgtgaatatagtaactttctttccctttccggggatgaaataacatacccaagagcaacagaacattctactagcgtctgtagaattgcacaaggttctggaaatgggcaaactacataaattacctgcatggataaagggctagtggtgttaaaatagggtgaataatttaccatgttgtgaatatcatttatatccactactgtgaatattaaatgttaagttacatgaatcagatcaacggcaaaggaacaaaaaggaaaaagatcttactgtgcaaggtccactactgctctctttctgatttgtagatatgtttgaagtcagctttatatccttaagtatccttgaaatagatgttacaaaacttttcacgctccaatgttttgaaaaagcttgaagacagtcacttgttgaactgatgggacctaagtggccacagcgaaccttcttcaactgctcaggacaatcaactagaacaagtcctgaaggcaaatattttccaggagatagttccatttgtcctccattgttttggggcgaatgagttcccagtttgcaaacttcataaactacaggaacacaaaattaatgatgacaaatgctattaaaaacactttgcatcataatgaactggaacaaaggtttggagattaagaacatgctgaagtacataaatctgctggagtggcaaaagtatttcttgcctacatcaatcgttctgtactgttgtaaaaaaaagggggggatacgtgaatcatgtttatggtgacatctggtttatgtttaaaatatagtgttatgagccatattaaaagcatataagcttatgtacttacgttcagctgcatgtactataaattggcaattatttagggatagactcaacgcggggaatagattatatcagcaatattattcatgagaaataactaaagaaaatacgaagcaagaaaaacatcacttgcctgttccaagctgcatgaaaaaatcagctaccgccgaagtcaacatatcaatatcagggcaaagtgcatagtaagtaacctaaaagagaacagatgacaaaatcaatgaaacgaatatatagtcactaactgtatatgtcggagggggggtgctgctgcggcatttgcgctatggtggctttgctgttacaaaaaaatattcacgaacccggctaaaagcagtgctaaaaagatagtttcaagtagttagaccctgtttgnagaggaggaattccccagaagcagcatgaaaggaaaggagcaaaagaaggtagtgacagaacactgccaaactaatcttacaggcttcggcaaggcataaggttcaaaaggagctttctcccatgttttaagactattcaccgaggccttcaaccaatcatcctggtaactgcagttttaatgcttgcatcagtaactcatgcaaatacatatgcttaagcaggataaaacaattcatggaaaataaaagatacattacccgactagcatagaaggtgaagggaggacagcaatggttggtctgacacggtgatatcccttttggaactctaattctgaaatgcctgcagtgacacgcaaatctcctgtgatacaatcatcgtctcttcntccctttggcaatattatttttgcagcagaattatcaagttcagagtgcaggtcacagcaggtatacctcgattgctactggttggctggggtgggctcattgaatctccaccaatggacaacgaacttgacggctccaggatatcaccactggagtactgaaaagagtatgcatctcccgtgcctgcagactcagcagcattgcctcgacccctgcaccaatcaattactgataacgggccatccatgtttgcaaaggcagctttaagagctactcttatatctgactgcaacaagctaatcatggatggctctgaaacctgtacaaaggggactgaacatgaatactggaatatggagaaacaatgtaccacacaagtaccagtgataataaaaaaaaacttgacctgtgggggtaggacagcccccgggcatcatatatagagaagaccttctcacgcaggtcaagaaaatcccccgaacctttgccccactcatacaccgtagcccatgtaagaacacccatgaccagggtcaggccttagacatgtgctttgatgtggggcagccgaagggattttttaaacgggtacatatttagtgcaaccatacaaattggcgcaaccatacaaccaagacacaaacatggaagtgggaaggccttcttttttttctcgaactcgcaagaggattgcgtgttatattaataagagaagaagaaaagatacaaagaactagggggggtggggaaaaccccagcaaccccccctaggaactaaacaacatcagcctgcgccaaaacagacaacacaaggagccctctgcctcctgcagcaccccatgtttgtgtcttggttgcatggttgcaccaatatgtatgattgcattagatatgttcccttttttagacctagcctgaaattcgctcctagaagagccaaacttagaatctgaagagtgctagtcacaccacctaaccaactcagccctttcgcaagtaccagtggtaataaaaaataaaaaaaatgaagcaagcacatccagcctaagattttacctctgcagaaagtggatcgactaaatcaacaccagcgcaatcc

SEQ ID NO: 13612 - DNA, 2282 bp, Zea mays
gcggacctgtcagtttacctgggtttaagctgcctatccagccaggggtgtgagcaatagcgtagcggagagatgatttgatttacaagtattctgataaaggaaaaaaaactctcgcggtttttttttttttttttgtttatcccagtaaacgctgtacttgtaattctgattaatacagtcaacaaacggaatcatatctcaaatcttgtgtcgacaaacaatacagacctaaaaaaagagaaaaaggttacagcatccacctgtaagttatcagggttattgcaaaatcagtctacaaagctcgtcaaatgtgccctcacatacctacctagctagatattaattgtacatgacaattagtgagttgtctctcccttaggttcagatagatacttatctgcgtagtgtagaagccgccgcatccttaggaccatgtcacagtgaaagggcagtgctgtgcgcctttctgtgtacaccgggcttactgtcaaccaagacagagagtgaagctccgcggccacagcttccagcacactatgcatctccatctcacactcacgacctgttgtctcctgactcaagttccttgcctgtttgctgccgccgccgccgcctcggctcatcttctcttgaacagtcccactgctgcctccatagtgatcgatgatgctgactgagagaacagagggctgttcatccttggtgagttgtgcagagtccctcctaacaggtgggacggctttcgagacgacatagcccatcgctaaaggaatcgcagtccctttgctgtgcagtagatgggcaagcggcggtgactccgatgtgaggcatgtcgggagctgtaatgttgcaggagagaggtatctcatacttggcgaaggaactagaaggtacgagtgtgacgctgacattgacccaatggacttcactggagtgaaaccttccaggtaactccaagggccactgctgccttgactcccttcgccagctgaagcaggtctgctcagtagatctgcttggcatgtgagatgcaacgaatgatcttgggaaactgcaaccaaactgatgctacgaactaagtgcagtgatccccttgaagtgtccattccactttgttccacaaggatctgttttttgttgccagattgtccaagtgcacctttcatgaagcttgattttggatgagggctatacagagggtttggtgaggaaggcatgtttctatcttgaattaaggccatgtcttgctgctgctgctgctggagcgtaggaccatttgaactaggtggaataccctcaggtatggatcgccgtaactgcacaggccacttcttcacttcattgccaccataagagtatattgccttctgccattcttggatttcaagctcaaggaaacctccgatacgagttattatgacatctcgtggtctcatattgctagcctcaggtgaagacgacattatttgacagccttgctgtagaatttggatgaaaaggctttggagaactttagtgtcttggcggctactaataccaccaaaaggaaatattaagctgtccaataattctcctctagcatctgtccaaatgcacactagccatcgccagtcctcagtccaaccataacagcaatgaagacttgctgcactgtcactctcagatacgtcgagtagagggctcactccactatcagagttacttcctgaaattgagccatataccctgctgccagatgcatctgctccagattttgatggttccattaaagcattaagatcggcagacccagggtctgctagtatgaaaagtggctcaaaggcatatttcctatcatcctgagcacataaatcaggcagcttacttgggtccagaagtcctcccgaacgagcaggctgccatgagttatcccatgttgccgacctcatggatgcatcaaaatcggtttctcgagagagagttggcccagacattcgaggaactaaacattccttccaaagagtaggagcaggagatgtaacatgcatcattgtggactgagatctacccaaataagttggtgactggaacatatcgcttgtggagacagcccgtgggattcgtcgtgccttgttgtacactgtgaatgctatgtccttcaaaacagcaagctccttgtttggcttatccattctcaagtacagtttcaatagtaacaatctgcaagacgagcttgggtaggccggaggcatgcgtaaacccaaaaatgccaaatgcccaatgcaaagtgcagttcagtt

SEQ ID NO: 13613 - DNA, 5808 bp, Zea mays
cctctggccgagtctcatcaagtgccttgcgccctgtaatcagttccatcaagatgacaccaaagctgaagacatcagcttttgtggtcactcgtccagtaactgcacataaaaaatgttcgctttttgttagacagatgttagcgagtagcatatttaaattcatcagcacacttttcaaaaaaaaggagcatggttgaaattatcatttaggaaaaatgcacaacagatgatatagctaacaatttaggttactggtgtagaattggtgctccattgatggccttgggctattgaaaatgtcttaatggtacaagggaatggtccagcgcgcaaaagatattttaagtttatgttcaatttcaataggtaatccaaccatggatcgtaatgcttgagggtgaaagatcagttaaaattttaaatggctcttactctgcaaataaacttattctagttgatcgcaaggtcaatcaaagcttaagaccttttcaggtaccacatttggaattccaattttcttattgagcacctaaagtatctcttatggaaggtagagaagcaagtcacaaccaggagcgatgccagagtataataagggtctgcacatgcaccagggtccagggaagaaaaatacagtagtaagttagttgatttctaccatataatcatcacacctaaaaagtcattttggaagaaaaattgtaatatgcaagttttcatgatattattatgcaattatgtacatgactttgctcaaatgtattgggcatttgtgattgaccgcttggtcgttgaaatgaagtcatttcagatgaaagctattagtatttaaccatcaaattatattattacaggttgctgtaggtttagatgtaatgtgcttgtcaattgaactgaacatggcatctataaacttggtaaaaagaaatataggatgctcgtaccccgcatactctggtgcaaggtacccaaaagtgccagcaagtcttgtctctatggagacgcacttcccatcatctggtgcaagcctgaccaatccaaagtctgccaccttggccttcatgtcatcaccaagaagtatgtttgatggcttcaagtctctgtggataaaggtctgctgggcaaggctgtgaaggtactcaacgccccttgcaacatcaagtgcaatactaagccgctttttccattccaatggtcgcaaattgttctctgaccactcaaacaggtgttggctcagtgtcccctgtggcatgtactcatacactagaatcctctcattgccatcaaggcagtagcccagcagtgaaacaagattgcggtgtcggaccttggtcaaaacagcaatctctgatttaaactcatttagccccttgttacccataacaccagcctccatccgctttacagcaattttcgtgccatcatgaagctcacccttgtaaacagtgccaaaccctcctcgaccaaggatgttgtcctcgctgaagttgttggtcacattgcggagaacttggattgaaatgaccatatttccactttcaacaacatggatgtcccgtggaccactgctcgcttggctatatgtctcacttgcgcgagcaccaccattagcatttccccctgcaactgtgattttaaccatgtcatctgaacctgagtgcctcggatggataaccatggcatgtggactctgcacccttccgaaaggcttctgttttctcttgtaacaatagaatcctaatgcagcaacaaggcctagtccagcaactgtaccagccactgagccagcaatgactccaacagaagatgaagaggagcccccattcccattgttaccactgcttccgctactgcttcctcccgatggactgttgttgctactacctggtcctgcagttggtgcaggagcatccttgcctatgttagggttaccagcagtattcaccgccacattcttggaagcaaaggtaggaagtttcccatagagattgttgtttgacaaatcaatttttgtcagcaaaggcaacacggcaacctcctcaggcacagtaccagtgatgttattgttagcaagatctagcaccttaagtgagctaatcttcccaatggccggtgagatactaccactgagacccttgttggcaaaagtcagcccagtaatgttaccttggatgcaagtaacacccggaaacatacatggatcattccccctccaatcctcagcaagtgcctttgggtacatgaacccagccgcaacctcaagcagcaggctcacaaggggattgcacggcttcccggcttcctgcacacagaaccgctctgtatctgcttcgatatcagcatgaagtccattgggaatctgaggcatcggaccctgcagcaaattattcgtcagggtcacgttcttcagagccttcagcttgaaaagactctcaggcaccggccctgtgagcatgttgtcgcgaagttgcaaatcccatagatcatcaaaccccgcgaagtccggcaagggcccagtgaattcgttagaatgcagccacagttgctccagagacgtcatgttgctgacaaagctaatcgacccattgaggtgcgcgccgttgagccagagctgcaccagcggcgcgccggccagcgacgccggtacgggtcctgacagctggttaaaggaaagcgacagccgctggagcgccggcatcgcacccaagaagtccgggagcgtgccagagacgttggcactgatggccgagaagttggcgagggaggcgcaggcggcgagggaggcggggagcgtccacgacgcgaacgggttgtagtcgatggcgacggcggtgagcccggtgaggcctttgaagaagtcggcggggatggaggcgaagctattgttatgggcaagtaaaacctgaagcgaggagagccccgggagcaagggcagcgggccggagagcttgttgtcgaaaacctcgaggcgggtgagctcggtgaggtcgcccacctccggaggcagggtccccgtgaggccgcgcgcaccgacctggatcgcggtgacgcggcccgacgagtcgcatgacaccccgtcccaccgcttcggcgagcaggggtcgccggcgacgtcccatcccagcgtcttgtccgcgccaagcgccttcgccacagcccgcatcgccgccacgtccgacggcgacgtctccgccgccgcgccagcctcgagcgccatcagaaccaggaccacgagcccgcaccaacgacccgcggcgccctcgtgccgccgccgccgcgcggtgaaggcggtggggaacggcattgcgtcagagaggcagagttagagaagagaggagaagagagagagactggactagttttggaggtgagattttaagtggagagagagagagagagagaggtagtacagggcacatgggcaaggggagagggccggtggcacatgcgtgggtcccgcccgccgtgggtggggaagcagattttagctagggctgcagcctccccggcgtgataatgacgggactaccccctctcggttgcgccggtttgaacccggtctcgcacagcggcgagggcacgagaagccggggcgaggaagacgacgccagctgcccagctcacgcccgccaacgcgtggggaccacgcggcggtggctgtaaagcgccgcgatccctgcaccaaaaggcggggcgatttgcgtctgtctcttctcttctcgcctgtctccgcactggagcagagctggacgggccgccaggggcccagaggccagcgtcacgggtattcacgaatccaagggacgggtaaggtgtgggaccgcaagattgccgggtcgaatcgccacgccgctgggctcagcgcgggcccggtgtgtcagtggcaaggtacggacgggtagccacggccgcgttggccggcgtgcgcgtccggctccggaattcaatggacgacggcacgaacaggttgggatcctttgtggccggaaacgctactgctgctgtaccagtggtaccacgttcatgttgtgttgtacccgctcctcgcacggcgcgtaggcgtagggaaatgctactgctgctgtacgtacgtgcgtgtggcatctctatgcgcggctggcgagtaatgttggccggggcgggggcagccacgggccaccaggcaccagctaccgaagcggtggactggtggagtggcggagacgcaagacggtttagttggcgttgtccacggcgtcggaactcggaacagtaaagaggcattgccccgcaacggaggcaaaggtagtgttggtgacttggtgtggccagagtccccgaattcgacgatacagacaacactatatagaaattctcggttaacggtaatttttaggatttcggggtgtgtcagcatctcagacaggagcaatgagcatacagcgagaacaagtcacgggacacgagagtccatcgtccaaacgctaaggttactgagacaatatgggccaagtagtgggtcggctatctatgggtcgcttgatattctagcagtactatataaaagacaaacacttgtgtaatagggcatgaacaatttagctatcaaacatcagacaaactcgtctttctcccagatattcccttctccaagtctcattctcctctgagctcttcctctcctatccccctttccaggtgttgctaacatttggtatcagactaagaatcgatcttgatggagaccacgatgcaggatattctagacgcactggcgcgcatggaggcacgcttgaccgatgcactggtgggtcgctgcggcgagcagtacgcacgcgagcacacttcccccttcgatggatccgcgcctcctccttccatcttcaacacacagtaccgcgacgaggcaatccttccgcctctcgtccacgacgacgctgcgaaggtggcgtccttggattcaggaaacgactttggcctgcagcagaccgccacggtgcttgcgtacctggggtccgacgagatgccttcattgaccacgctcctcgccggctcggtattcgaccacttcatcccgccactctacgacgacgaccgctacaccacgccacaatcgtctgtcggtactatcgccaaccctgacgacgacctcctccaggagctcgacgggttggacgaggacgccgcgagcgccaacgcggctgacgacgattcaggcgctgtccacgtccatgcgccgctcaaccccgacgcgacgctcgactcgaacgtcgacaccagtggatcaccgcgctacccgtgcctccccgagggcgcgacgttgttccgtcggaacccggataagaagatccacgatgggctcatcggcggcatcagccagcacatctggagcatcgtggacgaggtcgaacacacgacctcagggctggtccagacgctcatcgccgtcgacaggcacttcgacctcatcatcaaggcgaggatcaagcacttggatccgttacctccgctcgtccccaacaccgacgcagaggaggaggaggttctcacgaccacgtccaccaggtgttcgagaatgggcatcaaccgtggcgcatactccgtccccaacctcctcgtggtctgcatcgtgggcgcacccaaattcaacgaatacagcaccaaccgcgtcctgcaccgcacgcggctacagcgccctccgctctagcaactgatcgtcgaccctgtcagcgccgtccacggcggcgacgactatgagctgtcccacagcgaggcaggcagtgttctcgcgaccgccgcgcttcccaacccgcgcgagaagatccg

SEQ ID NO: 13614 - DNA, 4056 bp, Zea mays
  misc_feature (1832)..(1832): n is a, c, g, or t
  misc_feature (2036)..(2036): n is a, c, g, or t
  misc_feature (2642)..(2642): n is a, c, g, or t
tcaaaccaaacatgccctaagtatagtatagataaatgattaaataaatcataacaaaataaaaacgataactcatgattttttaaaataagacgagtagttaaagttttgtaagaggacaactgctatgtaagcatcaatgcgcccgcgcgcgcacacaaatacggaaatctaacgaccgctccaccgggaaaacgactgttcccacatcgccagcgcaggcagcgcttgcattgcattgcatggtccccggccacgggcgtcgaggccagccgaatctggctcggcgctttcccacgcgacagagtccactgtcggatcacatatataccacccagacccagttacgtgcgcgtgtgcatcttctgaaacaaagaactttgctgctgcgtattgccaccctggtgggtttgagatggacacaatttggaagaagctctactctgaagataaggctctgtagttacgccaggcacagcaaacaccaccgcacacgactggattgcgccgccacaaaaaatacgagtagaaaaagagtatccggcagcacgagtgcgtaatccaaaggaatagggccatgcactggagtcacgatcagacaactggatcgcaaattccagcctcgttgtcaccagatacacacacacgggtcacatcgtttttccgccccgttgtattgcctccgtttcaggcgggcagcggccagcggataagagaccagatcatgacaaatagttgagttctcacagtagatgacagtaagtacagcgagtgaaatgatcatagcttaggcgttggaaaagcttcaggcctgggcctttcttctttttgacgaacacagggtcaccttcctttgcaaattgtcagtacccgatacaaccatacagctctagcattcttctactttaatcttagcaaacgacatagaccagttagcaaagtcttcgaacttccaggcaattttcgggacaagatcacagcatacacgaccaaagagcagctacacggcagtacagagacgaataaagagacatggaaagattggtggcgggggtgaagagactaaaagaatgaacaaggatcgcccgagcttccatttcaacggaaacataaggtttttgcacacccttactagcagcgctaaatgtctttatcttccgtcggcagaggtgaacgagtccgcgaacccaggaggcctcgtagggatgctggtctgagtgttatccaggctcgcaacaaacgacgaggtcgcaccgtcaaagtggctgctgtcctcgaacgcctgccatctcttcagagcctgaggcagggacatgttaaggtcgataccgtagctgtcatccgagtccggatcggctggtttccaaacttccgaaagggtagagagcacattgacagcatggcccatgtcaggcctctggtgcgcttccctagcgcagcagtggccagcaagctctgagacggtactaacactagcgtaggtttccttcgtcgagctcaatgacaggggtccattgctttgcggaatgtttccttgttgagctgcgtcctccggaaccatgtaactaaatgcatgctatcctcgggctgagtctcatcaagtgccttgcgtcctgtaatcagttccatcaagatgacaccaaagctgaagacatcagcttttgtggtcactcgtccagtgactgcatataaaaaaaaaaagttcattttttttgttagacagatgttgcgagtagcaaactgaaatacatcaaaaggcttttcaaaaaaggagcatggaaaaaattataaattaggacaatagaggaaagatgatatagataacaatttangttactttgtttcctaacaggaagatgaagggcaaaacgctcgttaccaaaacttaaaagatcttttcaggtatcacatttggaattccaaatttcttagtgagcacctaaagtatctcttatggaaggttccagccagaagtaagtcacaagtcacaaccaagggcaatgccaatgcccaagtataataagggtgtgcacatncatcaggcaaaatacattagtaataattagctgattctaccatataatacatcattcacaactaaagagtcattttagaggaaagatggtaatatgcaagtattcatgatgctgttatgtatatgccacagctcaaatgtattttgcttggtcgttgaaatgaatagtcatttcagaggaaacctattaataataaaccattaaatgatattattacaggtagctgtaggttagatgtaatgtgcttatcaattgaactgaacacacagcatacttggtatgaagaaatataggatgatcacctgcatactctggtgcaaggtacccaaaagtgccagcaagtcttgtctctacggagacacacttcccatcagctggtgcaagccggaccaatccaaagtccgccaccttggccttcatgtcatcaccaagaagtatgtttgatggcttcaagtctctgtggataaaggtctgctgggcaaggctgtgaaggtactcgacgcctcttgcaacatcaagtgcaatgctaagtcgttttttccattccaatggtcgcaaatttttctcagaccactcaaacaggtgttggctcagtgccccctgtgncatgtactcatacactagaatcctctcattgccatcaaggcagtagcccagcagtgaaacaagattgcggtgtcggaccttggtcaaaacagcaatctctgatttaaactcatttagccccttgttacccataacaccagcctccatccgctttacagcaattttcgtgccgtcatgaagctcgcccttgtaaacagtgccaaaccctcctcgaccaaggatgttctcctcactgaagttgttggtcacattgcggagaacttggattgaaatgaccatatttccactttcaacaacatggatgtcccgtggaccattgctcgcttggctatatgtctcgcttgcgcgagcaccatcgttagcatttccccctgcaactgtgattttaaccatgtcatctgaacctgagtgtcgcggatggataaccatggcatgtggactctgcacccttccgaaaggcttctgtttcctcttgtaacaatagaatcccaatgcagcaacaaggcctagtccaacgactgtaccagccactgagcctacaatgactccaacagaagatggagaggaacccccattgttaccaatgcttccgctgctgcctccccccgatagactgtcgttgctaccacctgatcctgctgttggtgcaggagcatccttgcctatgttagggttaccagcagttttcaccactgcactcttggaagcaaatgtaggaagtttcccatatagattgttgtttgacaaatcaacctctgtcagcgaaggcaacgcggcaacctcctcaggcacagtaccagtgatgttattgttagcaagatttagcaccttaagtgagctaatcttcccgatggacggtgagatactaccactgagacccttattggtgaaaattagctcagtaatgttaccttgtatgcaactaacgcccggaaacacacacggatcattccccttccaatccgtagcaagtgccttcgggtacatgaacccagcagcaacctcaagcagcaggctcacacggggatcgcacggcttcccggcttcctgcacacaaaaccgctctgaatctgctttgatgtcagcatgaagttgattaggaatctgaggcatcggcccctgcagcaaattattcgtcagagtcacgttcttcagggccttcaacttgaaaagactctcaggcaccggccctgtgagctcgttgtcgcgaagttgcaaatcccatagattatcaaacctagagaagtccggcatgggcccagtgaagtcgttagaatgcagccacagttgctccacggctcgagtgttgctgacaaagctaatcgacccattgaggtgcgcgccattgagccagagctgcaccagcggcgcgccggccagcgacgccggtacgggtcctgacaggggtaccgag

SEQ ID NO: 13615 - DNA, 4411 bp, Zea mays
tgggattcgtacgcggcgacgccccgccccattgttatggacttctctatcatccattgtcgtgtcgtggcgtcatcccgagtaatggaagtgcttaatgttgcctggttaatggaagtgcttaacgatagagttaatagggcaaaatggtactatataaaggttagactgttaaatagatgacattggtgtgttgggctccattgtagtgacgtttgatgggacccatgtgccatagttagaaggcgttgggattcgtacgcggcaacgccccgccccattgttaaggacttctctatcatccattgccgtgtcatggcgacatcccgattaatgaaagtgcttaatgttgcctggttaatggaagtgcttaacgatagagttaatagggaaaaatggtactatataaatgttagaccgttaaatagatgacattggtatgttgggcttcattgtagtgacgtttgatgggacccatgtatcatagtttgaaggcgttgggattcgtacgcggcgacatccccatcccattgttaaggacttctctgtcatccgttgtcgtgtcgtggcatcatcctcgttaatggaagtgcttaatgttgcctggttaatggaagtgcttatcgatagagttaataggtgtaaaatggtactatagcaatgttagactgctaaatagatgccattgggtaatctagcgagtaagacatgaattgtagggtattttagctattgataatattaaagcatatccaagggtcattctaaatttcactctctaaattatcatatggagagtcatttacataaaaaccactttctataaattttcaatctccaacaaccttttttatatattatttacactctagagagccattcacactttttatatttggctagcgagaaatccgaaatagaagatggctatatttggatatccgttcagatcagctgttgtaaaatactttttgtaaaaaaaattatttagatatattaggaagaatataaaaaatcttttggagttgctatttaaggtattttgatgagccacaatttattgtgatctaaataaggacttatttagttcgctctcaatctatatagataaagtaagattagatgttcttattttttataatcaagtcgtaagcaaatttggcctggccgccagcccccgcctccgcctgggtggttgggttcgtctggcgctaggtttcggcgagcctggaaagggaagggcccgtgcggcgcggtccacgcgacgtccctggcggtcacgggccaccgcgggagctgcgcacgcgcgagtcgacagcgcaaagtccgccgatgggtcggcaggccgggccctcgcggtccaagtgtccaaccgcgcccggccctgtgccctgcccactcacccgacgacggactgtgctcccgccagtttctcgccgtctcagatctcacaaagcgattacattccatccctagcagcggacgagcggcagggcctgctccgaccggccgcggctggagctgtcgcgatcgcgttgctggcaagaccagccgcaccgttagcaggccacaggttttagagaactccgatacgcgtctttaggctcctctcggaaatgctgtgccctctgttcaagaacgaaaacaccgtgtcgttgcaaccctgcgagaatcgatgcgctcccacgcgcgcacacacacaaatacggaattctaacggccggtccaccgggaaaacggctcttccggcatcgccagcgctggcacaggcagcgcttgcatcgcatggtccccgatcacggcatagtctagagccgtcggaggccagccgaatctggctcggcgctttcccacgcgacgaaggacgctgtcggatcggccaggccgcgtccggtaacagacaagacaaaccagatggaacagtcgagaccacagattggcgctgcagaggtcccgaaatatataccagacccagttacgtgtgcgtgtccatctcgtgaaacgaagaaaaaaaaatgggaggcttggccattggggttgcagctgcagcggatctgggtgggatgggcacaatttggaagctactacatttctatcgctgaagtccaaacgccattacgccaggcgcaacaacagtagtacaccgcaccgcacacacccccacacgccggcgcacaaggctggactggactgcgccaccgccaaataaaataccaggcggcaagaatgcgttcacaaactgataaatccaatggaacagggccatgcgctggactggctggagtcacgatccgacaactggatcgcaaaccccagcctcgttgtcaccagatacacacgggccccatcgttttcgtccccgttgccttcgtttcaggccagtaggcgggccgcggacgcttctccaggcaaaccagcaccagcagtgcatcggcatcgctgtctgtcccgggttcctaccggtggacaggttgttagcgtggggagttcagttagcgccctagttttgttttgcaggatccacgatctggaccctggagctaaagcttcggggtccccctgacgctagtgcgttgtttagtgacgagaactccagtttagttgaactgcttcacatgaattaggtgcaccagcacaacaggcacttgcgcctcacatgagcatggctgattagttggagcctctgctctggagatttgacgctcaccaggtcatttcaatgtccaggaaaccaaaagccagaacctgtcagcctctgctctggagcatggctgaggcgttgcttcagaagagcatggaaaaacttcaggccagggccatactttttgacgaatacaggatcaccttcatttggaaattgtcagcatccgatacaacccaacaaccctagcatacttctactttaatcttagcaaatgacataaccggttagcaaattttttccaacttccaggcaatttttgggacaggatcaaagagcagctacacggcagtacagagccgaataaggggacatgaaagattaggagcgaagagactaaaagaatgaacacaaggatcgcgtgagccttctatttcaacggaagcacacaaggtttggcacgccctagcagctaacccgtctatcttccgtcagcagaggtgaacgactccgcgaatccaggaggccttgtagggatgctcgtctgagtgttatccaaacttgcaacgaatgaagaggttgcgccgtcaaagtggctgctatcttcaaaagcctgccatctcttcagagcctgagggagggtcatgttcaggtcaataccgtagctgtcgtccgagtctggatcagttggtttccaaacttctgaaagggtagagagcacattaacagcatggcccatgtcaggcctctggtgtgcttccctagcgcagcagtgaccagcaagctctgagacagtactaacgctagcatatgtctcctcatcaaggtcaataacagggtcgattgctttgcggaatgtttccttgttcagctgcattctccggaaccatgtaactagatgcatgctatcctctggccgagtctcatcaagtgccttgcgccctgtaatcagttccatcaagatgacaccaaagctgaagacatcagcttttgtggtcactcgtccagtaactgcatactctggtgcaaggtacccaaaagtgccagcaagtcttgtctctatggagacgcacttcccatcatctggtgcaagcctgaccaatccaaagtctgccaccttggccttcatgtcatcaccaagaagtatgtttgatggcttcaagtctctgtggataaaggtctgctgggcaaggctgtgaaggtactcaacgccccttgcaacatcaagtgcaatactaagccgctttttccattccaatggtcgcaaattgttctctgaccactcaaacaggtgttggctcagtgtcccctgtggcatgtactcatacacaagaatcctctcattgccatcaaggcagtagcccagcagcgaaacaaggttccggtgacgaaccttggtcaaaacagcaatctctgatttaaactcatttagccccttgttacccatcacaccagcctccatccgctttacagcaattttcgtgccatcatgaagttcacccttgtaaacagtgccaaaccctcctcgaccaaggatgttgtcctcgctgaagttgttggtcacattgcggagaacttggattgaaatgaccatatttccactttcaacaacatggatgtcccgtggaccactgctcgcttggctatatgtctcacttgcgcgagcaccaccattagcatttccccctgcaactgtgattttaacaatctctatgggaaacttcctacctttgcttccaagaatgtggcggttaatactgctggtaaccc

SEQ ID NO: 13616 - DNA, 2085 bp, Zea mays
  misc_feature (16)..(16): n is a, c, g, or t
  misc_feature (29)..(30): n is a, c, g, or t
cggccctaccctcctntttttttctccannaccactttccctttgggacgaacacagaatcaccttcctttgcaaattgtcagtacccgatacaaccatacagctctagcatccttctactttaatcttagcaaatgacataaaccagttagcaaagtcttcgaacttccaggcaattttcgggacaagatcacagcatacacgaccaaagagcagctacacggaagagtacagagacgaataaagagacatggaaagattggtgtggggtgaagagactaaaagaatgaacaaggatcgcccgagcttctatttcaacggaagcataaggtttttgcacacccttactagcagcgtaaatgtctttatcttccatcggcagaggtgaaggagtccgcgaacccaggaggcctcgtagggatgctggtctgcgtgttatccaggctcgcaacaaacgacgaggtcgcaccgtcaaagtggctgctgtcctcgaacgcctgccatctcttcagagcctgaggcagggacatgttaaggtcgataccgtagctgtcatccgagtccggatcggctggtttccaaacttccgaaagggtagagagcacattgacagcatggcccatgtcaggcctctggtgtgcttccctagcgcagcagtggccagcaagctctgagacggtactaacactagcgtaggtttcctcgtcgaggtcaatgacagggtcgattgctttgcggaatgtttccttgttgagctgcatcctccggaaccatgtaactaaatgcatgctatcctcgggctgagtctcatcaagtgccttgcgtcctgtaatcagttccatcaagatgacaccaaagctgaagacatcagcttttgtggtcactcgtccagtgactgcatactctggtgcaaggtacccaaaagtgccagcaagtcttgtctctacggagacacacttcccatcagctggtgcaagccggaccaatccaaagtccgccaccttggccttcatgtcatcaccaagaagtatgtttgatggcttcaagtctctgtggataaaggtctgctgggcaaggctgtgaaggtactcgacgcctcttgcaacatcaagtgcaatgctaagtcgttttttccattccaatggtcgcaaatttttctcagaccactcaaacaggtgttggctcagtgccccctgtggcatgtactcatacactagaatcctctcattgccatcaaggcagtagcccagcagtgaaacaagattgcggtgtcggaccttggtcaaaacagcaatctctgatttaaactcatttagccccttgttacccataacaccagcctccatccgctttacagcaattttcgtgccgtcatgaagctcgcccttgtaaacagtgccaaaccctcctcgaccaaggatgttctcctcactgaagttgttggtcacattgcggagaacttggattgaaatgaccatatttccactttcaacaacatggatgtcgcgtggaccattgctcgcttggctatatgtctcgcttgcgcgagcaccatcgttagcatttccccctgcaactgtgattttaaccatgtcatctgaacctgagtgtcgcggatggataaccatggcatgtggactctgcacccttccgaaaggcttctgtttcctcttgtaacaatagaatcccaatgcagcaacaaggcctagtccaacgactgtaccagccactgagcctacaatgactccaacagaagatggagaggaacccccattgttaccaatgcttccgctgctgcctccccccgatagactgtcgttgctaccacctgatcctgctgttggtgcaggagcatccttgcctatgttagggttaccagcagttttcaccactgcactcttggaagcaaatgtaggaagtttcccatatagattgttgtttgacaaatcaacctctgtcagcgaaggcaacgcggcaacctcctcaggcacagtaccagtgatgttattgttagcaagatttagcaccttaagtgagctaatcttcccgatggacggtgagatactaccactgagacccttattg

SEQ ID NO: 13617 - DNA, 1934 bp, Zea mays
  misc_feature (118)..(118): n is a, c, g, or t
tctgctcgtacgagaacactcaggctgtgatggtgcccaagtgcggctacatccgccgggccgtcgaggcggtggcgaccaggcccagcagcaagggcggcgccgacgccgacgccgncccgccggccaccgtcgagctggacctctcggcgctgccgggcggcgccgacgcgttcgacaaggcggcgcgctactgctacggcgccaacttcgagatcacgccgcaaaacgcggcggcgctgcgctgcgccgcggcgttcctggacatgcgccacgcctcagcggacctggccgggcgcgtggacgagttcctggcgcgggcggcgctgcgcgcgctcccgggcgccgtggccgtgctccgctcctgcgaggcgcccggcctgcgcgcggccgccgaggagctcggcgtcgcgcgccgcgccgcggacgccgtcgcgcgcggcgtctgcgccgaggcgctgtccctgtcgtactcgtcggcgtcgcgcggccccgggtggtggaagctggagctggcggcgctgtcgccgcgctcgttcgggaaggtcgtcacggcgctgcggtgccgccgcgccgagccggccgtggtggccgcggcggcggcggcctacgcggagctcgtcctggccgaggtcctcgcggcgccccaggaccgcgcggaccaccgcgcgctgctcgagtccgtggtcgacgtgctgccctcgcccgccgacgcgcccggcgtcccggcgccgttcctctgccgcctcctccacgccgccgtcgccgccggggcgtccgccaagacgtgccgcgacctcgagctccgcgtcgccgccgtgctcgaccaggccaccgcccaggacctgctcgccgtcgcgctggacgccaccggggagcgcgtcaggaacacggacatcgtgcgccgcgtcgtcgtcgccttcgtcgagcgccaggcggcggtgacgcccgcgggtgagcggaggagccgccgggcgtccatgtccgggacgacggcggcgacggagctcggtgccgccaggcccggcgcgctggagaaggtcgccatgatggtggacgaagtggcggcggagatcgcgacggaggaggcgctgccccccgcccggcccgcccgcgtggccggcgcggtgcccaaggcgcgcgcccgtcgcacgactgcctgtaccgcgccgtcgacatctacctcaagacgcacccggagctggacgagatccagcgggagaaggtctgcagcgtcatggacccgctcaagctctcgtaccaggcgcgcacgcacgcgtcgcagaacaagcggctgccgctgcaggccgcgctcagcgcgctctactacgacgagctcaagctccgcagcgccgcgacggccgacgtggtattggacacgcagtcgtcggccgccgggagggcttgcgcgcaggccagggcggcggacgcggcgctggcgcgagagaacgaggcgctgcggtcagagctggcacggatgcgggcctacctgtcagggatggagcgcagcaaagggggccggtcaacgccgccgtcctcgccgtctcggagggcaaagaaagcaagcttcctgggctccgtctcccgcactatgagccggctgaacccgtttagaagtggggggtggatggcgaaggttacgaccagtaacgccgccgccggtggacgccagagcaaaacgatgatgcagcatgtggtgacacccaagaggaggagagcatccataagttaataatcatgacactgtcgtgtaattttaggaggatatcgtgtgtgcatggcttgtagtttgattattattgtgtgtttttagtttattattgtgctagtatatatatgaatgcgtgtgtagtaccaagtggtttgctaaatcattcgataattttacatgttcgcatcgtagtgatcaattttatcttttctctttatctgcc

SEQ ID NO: 13618 - DNA, 1282 bp, Zea mays
gcgtgcgcggagcgcgtcctggccggggtcctcgcggcgcccggccgccgggacgcggaccagcgcgcgctgctggaggccgtcgtggacgcgctgcctcccgccgccgacgcgcccctcccggccgccttcctctgccgcctcctccgcgccgcgggcaccgccgaggcgtccgccaagacgtgccgcgacatggagctccgcgtcgcggccgtgctggaccaggccaccgcgggggacctgctgggcgtcgcgctcgacggcgccggggagcgcgtcgtcaacgcggacaccgtccgccgcgtcgtcgccgcgtgcgtcgagcgccagcagacgcagcagggccggcgggcgtccctggccggaggtccggcaggtgagctcagcgcgctggagaaggtggcgaagacggtggatgaggtggcggcggagatggcgtcgcacgagtcgctgcctatctccaagttcgtgggcgtggcgggcgcggtgcccagggacgcgcgcccgtcgcacaactgcctgtaccgcgccgtggacatctacctcaagacacacccggggctggacgagatcgagcgggagaaggtgtgcagcgtcatggacccgctcaggctgtcgtaccaggcgcggatgcacgcgtcgcagaacaagcggctgccgctgcaggccgtgctcagcgtgctctactacgaccagctgaagatccgtagcgcggacggcagcggcggcacggaggaagggtgggagacacagtcggccgccgggaaggcccgtgcgcaggcgcgggcggacgtgtcgctggcaagggagaacgaggcgctgcggttggagctggcgcggatgcgagcgtacgtgtcagggatgcagcagagcagcaaggggagcgggtcgaggccatcgtcgtcatcgctggtaccaggcccagcgacggcgacggggaagaaggcaagcttcttagggtcggtgtcgcggacgttgagccggctgaacccgtttaagggcgggtgggccaaggacacgaccagcattgccgatgggcgtgacaggacttccatgcatgtggtgaagcccaagaggaggaggttctctatcggctaattattttgtgatatatcgatatgatcgtgtcatcgtgtgtgacttatatttaatcactgtgattagaagttagaacagggggtgtggatgtttgtactttctctgtccatgaaaaaaaacaatatgcactacaaaggcaaaagtgtaggttccgcggccggactaacgagtaaatagtatttct

SEQ ID NO: 13619 - DNA, 1822 bp, Zea mays
gcgtggtcgcggccgaggtaccgacactgaaacagaagatgatacatcagaaaaggagaaatctgattcacctgtagctgacaacccgcgcgtcccgaaacgtgtaacagatgcagaaatcagtaatcctgcttccaaacccaagaaaaatgatactggcctggataggactatatttattagcaaccttccttttgatataagtaatgaggaggtaacagcgcgcttctcagtctttgggaaggttgaatctttcttcccggttcttcataaacttactaagagacctagaggtactggtttcatgaagttttctacaacagaggcagctgatgcagcaatttctgctgccagtgttgctcctggcttaggaatttctttaaagagcaggccacttaatgtcatgaaagcgatggacaaggagtcagctcacaaaaaggcacttgagaaggcaaagactgaggtcgaggatcgacggaacctatacttggctaaggagggtgaaatacttgctggaataccagctgcagaaggtgtgtcagatgctgacatgaataaacgtaattggttagctagaaggaaagcggagatgcttcagtctccaaaatttcatgtgtcgagaacaaggcttatcatctacaatttgcctaagactatgaccattaatgacgtaaagaagctttgcagagaagcagtcatttctcgtgctacaaaacaaaatcctgtcatccggaaggtgaatatcctgaagaatgaaaagaaaggcatacagaagcattcacgcggtgtagcctttgttgattttcaagaacatgaacacgctcttgttgctctaagggttctaaacaacaaccctgaaacttttggttcagaacgtcgcccaattgtagagtttgcgcttgaggatgttgaaaaggtgaggcttcagaagattcgaatggaacggcatcgcaagtcagcagcagaaactgcagaagttcagcagaccccttcaggggatcaacctgcaagtgaaggccgtaacgcagataacagcaggactttcagaaaaggaaacaagcggaaatcacacagtttaccatctaaaccctccgactctgttgaagggctggccaaggatcctctagttcctggagttcgaaacgcgaaagctgcaaagagagcaaggaagtcaaatgtggggaccattttgccggaccgaggtctaacagatgcaaccccaaacactgctcagaatcaagttgcgtcaagtgagcttgatcaggcagctgctccaaagaaaagaaaaaacagaaaagacggtcaggcagagcaaaagagaggaaaggttacaaaaaggacaaggaaagaaccttccggggaaggaggcgtggacaagtcgctggtggagcagtaccgtttcaagttcttgcaacatggtgtgagcaagaccaagaccaagaccaaaggatagttgacttgggaactgtgggaagtgggattgatgttgaagagcagcacggtgtcccggaccaccgtataacgtttcgaagagcaagtctccacaaactttctgaggccaaaatttcgattgtgatgcttaatagttttgtgtccatctgtactgatatttataactgatctagttacagccgtataattatgaatcatcttatcatacaccgtttatggcttcatgatgacctgcctgtgtctgaaattcctgtgttggtatttctaacggaaactttgcaggaaattcatgtggcttctcgagtgtatgtgattttgcttccaacgtgtcactcccctcgctcaagcgtgatggcggtgctgccctcag

SEQ ID NO: 13620 - DNA, 2434 bp, Zea mays
gccggccgggccgggaataacagcgggcccctcctccccggccggcaatcaatttccaccagtccccatccagtacaggccagcactgccgctgccgtgtcgccaccggcccccggctggctctccagcgactccgtcggcggcttgccttcccgcgccgcgccgggcccggatcgctcgccctttccgactgtcctgctcaacgccgccaccagcacgtcctttcccgcgccggaggtcccgctcgcctgccacagcggtgcggcgcaagctcccccaagcgtttctcaagtgacgagaagaagaaagagggggagaaggaggttggcgtcagtgggtcccgcggaccaatcagctagagagctgagtgatgtctcgcaagcgatgagcctcatgagatcggatcggaggccatcattccacgcactggtgatgaaaagctcgcttggtgcccctagctagctagtggcgaagcaaggaagctagccagccaagatcctgcttgtgagaaaaaaaagggagtagatccagtaattttaagaatctggtcaacatacctacggcaagatggctgatattgtaatccgcgacctggagagggtagtcaaagtcgcacttgcgatcaagaaggccgtggaaacagctaagcagaacaaggaggattgcgttaagatcggtgagcgtgcagctgaggtcagtactcatatgaagcggctgaaggagaatacaaaagcaatggaggaccctttgatgagcgatacgctcaagagtatggaagagacactccaacgcgctcttaagctcgtcaacgagtgccagaggaagcacgtcgtgctccattacttaaatgccggcggcatgtccaagaagctgcgccaggtgcaggaggatatatcatataaattgtggaatggggtcttggccaccgttgtcgacacaaggattgctttggaaaagcagatccaatctgctattgatgcccctctgcaccaacaccaacagcgtgcagggcaggtggaaacctcacaaagtagtcattcaagaactgatcaagctagcgagaaaggaaaggccatgttagcaagagtaaaaagggagcagtctgaacttttgtctggtgttcctcagttcagtttgtctcaactgaacgctgctacaaacgaattttcagagggctgtgtggttgaaagaggctactacaagggagtattacacgacggactagatgttgccatcaagaagttagcagtctctgatgatactcaagagaggcgcctgcaacttgagcttaatattcgtgcaaagcttgaacatggaaacatacttaaacttctgggatattgcctcgatgcccaagaaaaagaaaagctatactttctggtcgaagaatacataccgaatgttgaaagcttggagaaatttattaatgtctctcgactcgattggtcctcgtgtttcaagataattcaggggatagcaaagggcttacattgcttacataagcatcatattctctatatggatttgaatccagccaacatcctcgtccgttcagatatgaatcctgtggtcatcaattttggatcatcaatagtgctggatcgtgatgatgataaggtcaccggggatgccgtagcaggcacactgggttatgtcgctccagaaaaacttatggaagcttatgcatcaatgatgtctgatgtgttctcttttggaatcatcatcattgagatcattaccggcaggagagcttcacctttcgttgatttaccggaatggggttcagttgatgagatgattacatcagcgaaagggttatttgatccggcgctagctaacgagtctcagctgatgaagattaataggtgcagagaggtcggactgaagtgcattgagcgggatccgaaacgtcggcctaccatgggaaatgtccttgagatgctaagtagctagagtgacaggcaccgatttgaggtgttctcggttaggagtggattcgcgggggtgttctcggttaggagtggattgaagcggattagagataatcaaatctcttgctagtcaaaactgaatagaaatgggtttactttccctcaatcccctcctacctatgcaaccaaacaaggccttatgggtttcaacaatttggtttgatgtattgtcacaaattgatcatttgtaacattcaagatttatgcgcaaatgtattggcgtgtggattagagagtttctatcttataggctggctcttgaatgatatggcaaacataagctagcaaaccagttcaactactgagggtgcacatgaacctcgtgtttactagcatttttttttcgtatgctatttcctagttcaagtttgcatcccaaacctttttcatgtatgtacatgtattgtaaatgtgtcaagtgttaattttattgaaccctttgc

SEQ ID NO: 13621 - DNA, 2848 bp, Zea mays
cccagtcccagcttacgaacgagacgaccttgtggacccgcgattggaagtcaacaccccctatgagcagtcccagtttgctcatcctctgcggactgcggccgaacgcccatcacgccacgcgccccttccccaatccccatggagatctccgccggcgtcaccactgtcaccgccgtgtcgatcctcatcctcctgttgctgccgcaacccgcggcgccgttctccttcacatacaacttcacctcgccctcggacacgccgccgcccgggattgccttccagggggacgccttctacaacaaggccatccgcctcacccgcgacgagcgcctcggccccatcaccagcagcaccggccgcgccttctactcccacgccgtcccgctcgccgaccccgtctcccgccgcccggcctccttcgtcaccgccttcgccttctccatcgccgcccccgacccggcctccgcctcgggcgacgggcttgccttcttcctctccccgttcccatccgtcctccccgaatcctcggcggggggactactcggcctcttcaattcatcctcggtccgcgccggcacgctcgtcgccgtcgagttcgatacccacaagaacgagtgggaccccagcggcgaccacgtcggcgtcgatctcggggggatcgtctcctccgccaccgccgactggcctaccagcatgaaggacggccgcacggcccacgcgcgcgtcgagtacgacggcgtcgccaagaacctcaccgtctcgctctcgtacggctccgcgcgcccgaacaccacgggtgacgtccttctctggtatgccgtcgatctgagggaccacctgccggactccgtcgccgtaggcttctccgcagccacgggcgaggccgcggagctgcaccaggtgctctactgggagttcacctccaccgtcgaccctaaggaggagacggtggtcctgtgggtggtgctagggctgtgcgctttgcttctcgtactcgtcggcgcgggcatcgtctggttcgtcaggcaatggaggaaggccggacaattcgacgacggtgacatcgaggtcgacgacgtcatgggtggcgagtacgacgagctcgcggacgagttcgttgtccagtgcggcccgagaaggttcaggtacgccgaattggcggcggccacgaagaatttcgcggaggagcggaagctcgggcaaggcgggttcggcgccgtgtaccgggggttcctgaaggaactcggctttgaggttgccatcaagagggtgtccaagggctcaacgcaggggcgcaaggagtacgccgccgaggtgcgcatcatcagccagctgcgccaccggcacctcgtccgcctcgtcggttggtgccacgagcaccggggcgacttcctgctcgtgtacgagctgatgcccaacggcagcgtcgaccaccacctctacggcaagggcatgctcctcacctggccgatgcggtacgacatatcgctgggcctcgcgtcggcgatgctctacctccacgaggagtggccacagtgcatcgtccacagggatgtcaagcccagcaatgtcatgctggacgccgccttcaacgcgaagctcggagactttggcctcgccaagctcgtggaacatggtagccagccgtacaccactgtcctggccggcaccctgggctacttggcgccggagtgcgtgatgacaggcaaggcgagccgggagtcggacgtgtacagcttcggtgtcgttgcactggagatcgcgtgcggccgacggcccgcagagctcaacaacgagccaagcaaggcgagactggtgccttgggtgtgggaactgtatggcaagaacgccctccttgaagcagcagactggaggctgaaggggcagttcgatgagaagcagatggagcgcctgatgattgtgggtttgtggtgtgctcaccctgactatgcgcataggccaagcatcaggcaggccctgaacgtgcttacgtttgaggcgccattgccggtgctgccggagaagatgccggtgccgacgtatttccccttgcctgatctcgttgcttcgatttctgttgggggaacctcgagcgccgaggatccagatccaggtgttagtgattatgggtcctcgggtaaagtttcatcagtcagggataggctgctggagccatgagccgatgacggagttttctgtgttttactgcaaacacgaggagtgaatctacggttttcagattcaggtgtatagcatcgaaatgtattgattgttaattcataggtaagggtggcaaaataatttgtgctgttttatttttttcacatacaagtttgctatcataatatgcagttttgattttgttactgctaagttcagagtacgtgactttttaacgtttctcaagtgagaatgatctgtgccagattcctgtgaaattcttgtattattaaacatctcttctaaagccgacttataatatggataagcatacaagaaccaccattaaccgctatcaacaccattgaaattctcgtcctctgcgtatgaattctcccaaaagaaaatataaaattagaagactatattaagctgtgccttataaaagaaaatgaagatattagcgttgagtagagaaccctggaggctctgatttattgctggagctgtgttatggtgttgtgaacttatggttatggaacacacaacccaccaaagcagaagtcatatctgccagagtgattcagatggttgagaacaagccctccgtaatatggcccaatattctcgatggtttatcggatacgagaagaatatgtacatatatatcatctgagcttcattg

SEQ ID NO: 13622 - DNA, 1299 bp, Zea mays
  misc_feature (10)..(10): n is a, c, g, or t
attaaccctnactaaagggaacaaaagctggagctccaccgcggtggcggccgctctagaactagtggatcccccgggctgcaggaattcgcacgagaaacttttctacgtccagaatggcccggactccggactgcgtttccgtttactccggctcacgctcaccccgcctgctctctcattctcgacgatggctgggcgaccgccgccgtcctacgccaggtatcccgcgcttcaaggcggcaggcccttcgccggcgaagagcacccatcagattcccgagttgtttatcccagttatcttgcacccgagggctccgtagcatcttattatgcttcaagacctgttctacctgttggatcagatgttcttagaaacgatgtaatttctcaaccaagaacgcatggttatgatggtccagcaagagtgaccaatcctgctttggctggcctgactggactacctgctggagttacggcacgggggcctagtgctctggaagacccgtctttggctggtctgagtggattagctccagtccgggcaacaggcggagctacggcacgagggtctggtgctttggaagacccgtctttggctggtctgagtggactagctccagccagggcactgggacctagagctttgaaagaagaactggatgtagttgggagaagttcttcagtaggcagaggtgctagcattccagatgttgagcaccacagctcaattccaaactttgatggaccctcagaaaatgaatccaacattctttttgttgattgtcttcctactgattgcacaaggagagaagtagctcatttgtttcgttgttttcctggcttcaaggacatcagagtagtgcacaaggaacccagacgtagtggtgacaaggcctatgtcctgtgctttgtggagtttgagaacgcgaaattcgcacgcactcccatgcaagctttacaagggtaccgcttcgatgaccggaagcctgacgaccggtgtctcgagatccatttcgcaaggttcccgttcgctctgcctggcgccggcgccggcgccgcccgggaccacaggaagcggtagctggtagcagcgtggcctgcgcagtgggcactgcagtagatggcctgcgatcaacatgtatcgtatctgtatgcgactgttttgttgggcagttagatgaagtcgcctactatcagtagtagtctcctgtgacaccaacacgtggaatgataagactgcctccttttttttccaaaaaaaaaaaaaaaatttaaaaaaaaaaaaaaaaaaaaaaa

SEQ ID NO: 13623 - DNA, 1701 bp, Zea mays
cattggtacctcgagccggcgggagctcgcccctcttagagcaagaagccaatttcctttccaaagaaaaaaaaaggcaccaagggagaatcagcaagacgacaccatggcagcggcgctctacggcaacggcagctcgacgagcggcggtggcggcgcccgtggccgcgggaagcccatcacatgcaaagcggcggtggcgtggggtcccggagtgccgctgtcgctggaggaggtcgaggtggcgccgcctggtcccatggaggtccgcgtcaaggtgctcttcacctccatctgccacaccgacctcagcgcctggaagggagagtgcgaggcgcagcgcaaataccctcgcatcttgggccatgaggcagccggagtggtagagagcgtgggcgaaggagtagaaggcctcgcccctggagaccacgtcgttccgatcttcaccggggagtgcgagaaatgcgtgtactgcaagtcggacaagacaaacctgtgtggaacctaccgtgtggatcctttgaagagcagcatggtctacgacgacggcacgaggttctccgtggtggaccagccgtcaggccagcggcggccggtgtaccacttcctcaacacctccaccttcaccgagtacaccgtgcttgacgcggcatgtgccgtcaaaatcaaccctgaggccccgctgcagaggatgtgcctcctcagctgcggcatctccacaggagtgggagctgcgtggaacactgcaaacgtttctgctcggtccaccgttgcagtgtttggactcggcgctgttggtcttgctgtagctgaaggtgccaggctacgaggggcaactcggatcatcggcgtggacgtaaacccttcaaagttcaccaaaggtaaagagatggggataacagacttcatcgaccctaacgacatctgtgacaaaccggtccatgaggtgatcagggagatgactgacggaggtgtcgactacagcttcgagtgtaccgggataaatgatgtgctgagagaggccttcttgtccacgcatgatggttggggcctgacggtggtgctagggatccattcaacgcccaagatggtgccgctgcacccgatggagctctacagccgtaggatcaccggctgcgtctttggcgacttcaagggcaagtcccagctgcccgacctcgtcgataagtgcgtcaacggggaggtcaatataaacttcgatggcttcataacacacaagatgccattctcgtacatcaacaaggctttccggttactcgaggaaggcaagtcgctgaggtgcctgctcagtctctgatcgacaatacttcatcagcgaggacagttttggattattgagtagcaaaataaatgtacaaggaaagtttttccctagtacattcgcttcttataaaacgaatgcatgcaacttctttcgttctttgaagaagacaaaagggcacaattattctggagcaaaaaaaaaaaaaaaaggtattgctaatcattttatcgctggttcactgccgaccaggacaacattcaggcagctttgcttggcgctctgatcctcccagacctaggattctgctggcaccgtctcaactacagtttcgtttgcatttaataaactttctataagcattttttaatgatataacgaagtttttaacttttaaaaaaaaaaaaaaaaaagcggcc

SEQ ID NO: 13624 - DNA, 1210 bp, Zea mays
gatgctggactcctctgactgtgcctctgctgccgccgccgcggagacggggcaggtgcagccgcagcgccgcgcggtgggggccgtgcccctggcgcacgacggcggctacgccagcggcggatgggagagagaagatggcaaactgagttgtggatactcaagttttagaggcaagagagctacgatggaagatttctatgatgtaaaactaactgaaattgatggacaagctgttagcctgtttggtgttttcgacggtcatggaggatcacgtgctgctgagtatttgagggagcacttgtttgataaccttctcaagcaccctgatttcttgacagatacaaagcttgcgataagtgaaacatatcagaaaacagatacagatttcttggaatcagaagcaagcgctttcagggatgatggttcaacagcttcaactgcacttttggtgggtgaccatttatatgttgcaaatgttggtgattctcgtgccgttatttcaaaagctggcaaagctatggcgctttcagaagatcacaaacctaacagaattgatgagcgaaagagaattgaaaatgctggtggtattgtcatttgggctggcacttggagggtgggtggtgtattggcaatgtcccgtgcatttggcaatcgtttactgaagccatatgtggtggcagaacctgaaattcaggaagaacaggtcagtggtgggctggaatgcctggttcttgctagtgatgggctttgggatgttgtggaaaatgaggaagctgttttccttgggagatcggaggacacgccagagtctgcagctaggaaattgacagagattgcttactctcgcggcagcgctgacaatatcacatgcatcgtggtccaatttcaccatgacaaaaccggatgagccgtatggctgccaatttcagttgtaccctgcttcagtctattattatcctgcaagctgggtggtgggcttctcccagatttaccctgcttcatgctattattatcctgcaagccgggcggtggggtttctcagatctatcgctcatgtagcaactttcaagcactcgtccattgattcttttgttgtcttgtaggaaacatttgttccgacaggtgtagtagacacttttaaactgataattcaataaacgtatgtttacgattactgtttagtggaaaatggttttcattttgcctt

SEQ ID NO: 13625 - DNA, 1803 bp, Zea mays
  misc_feature (1665)..(1665): n is a, c, g, or t
  misc_feature (1787)..(1787): n is a, c, g, or t
gataatagttccttgaaaaccggtgcctttttctagcggcgaggaggcaggcggtagcggaatctggcaccggccatcacgtcccctcccgccgcttcctcctccctgccctacctttccccagatccgaatccattaaaccagcggatcttgcatcggggcgcgtccacggcatccgggcaagcgagtggtggagccagcagccatgagatggtatgcatcggtagcctcctgagggcgctggtgctgcgtgcggcgtcgtctgcgggcaggcgccgggggcccaggattctgtgtggccgcgcgacggatgtgcgcgtgacgccacggcacggacacggctggcgcgggttccgggcggtcacgggaaggatgatgctggactcctctgagtctgcctcttccgccgccgccgccgccgcggaggcgggagctggggcggtggcaggccaggcgcagccgcagcgccgcgcggtgggggccgtgccccaggcgcacgatggtggctacgccagcggcggatgggagagagaagatggtaaactgagttgtggatactcaagttttagagggaagagagctacaatggaggatttctatgatgtaaaactaactgaaattgatggacaagctattagcctgttcggtgtttttgacggtcatggtggatcacgtgctgctgagtatttgagggagcacttgtttgagaaccttctcaagcaccctgatttcttgacggatacaaagcttgctataagcgaaacatatcagaaaaccgatacagatttcttggaatcggaagcaagtgctttcagagatgatggttcaacagcttcaactgcaattttggtgggtgaccgtctgtatgttgcaaatgttggtgattctcgtgctgttatttcaaaagctggcaaagctatggcactttcagaagatcacaaacctaacaggattgatgagcgaaagagaatagaaaatgctggtggtattgtcatttgggctggtacttggagggtaggtggtgtattggcgatgtctcgtgcatttggcaatcgtttactgaagccatatgtggtggcggaacctgaaattcaggaagaacagttcagtgatgagctggaatgcctggttctcgctagtgacgggctttgggatgttgtggaaaatgaggaagccgtttcccttggcaaatcagaggacacgccagagtctgcagctcggaaattgacagagatcgcttattctcgtggcagcgctgacaatatcacgtgtatcgtggttcaatttcaccatgacaaaaccggatgagccatgtggcggccaatttcagttgtaccctgcttcaggctattattatcctgcaagccgggtggtggggcttctctcagatttatcgctcttgtagcaacttccaagaactcgtccattgattcttttgttgtcttgtaggaaacatttgttccaacaggtgtaatagatattttcaatgggttaatttctaataaaactatgtttacaattactgtttagtggaaattggttatcctcttgcctttgatactagatgataagatgatttgcaaccagtatgcaatgggccgttaccgtgtatccctattctcgaagggagcaatcgccccagcatgcccccctggatctaggagntaaagcaaactgaatgaagtttagctccccatcaggctgtgttcggctggtatggattcaatcctcaagtgtaattaatccagatatggattgaatggatcccctgttgacatttttcctanaacccccccacacccc

SEQ ID NO: 13626 - DNA, 3793 bp, Zea mays
  misc_feature (2422)..(2422): n is a, c, g, or t
  misc_feature (2830)..(2830): n is a, c, g, or t
ggtcgcatttgagactgcatgtatttgcttgtttgaaacctgattcagtttagtgattttgttgaaacacttgtttcctatatgccacccaaaaagccaggaatatgttactaaaaaaccctagggagctgttacttgcctttccatggaagatgtgggttactttcttctcagtgatgtgtgactgacatcctaaattaaagtaacaccagaaatggcctttttgcatccgacactagatataccaaacttcgctcctccctgccaacatttcactgaattgcacattttgctttattcatctacccctgccatcgaacacactcagtttcacctgcctgcctcaatcttcagggcctgtttggttttagttcagacagctttgcatggctctccttgcaatccaaggctttagattttcctgttcctggggtggcaggctttgaaccaaacaggccccaagagcattgttgaactgacgttagctagctgaacacacatctgtacttgttcgattgcaatgctgttgcaacttgctacacatgggcaagtttatgtttaaacattgaagtcatttttttgaacgagaacattaagccaatttgaagtacgttggtgttttaagtataagctttctaacttaatcggttataaatatatactttggtgtgagtagctaatatccgaaactttgggtagctggaactttttttagtcgtattgatttatcacaatgacccaaaaaatgggttagtcatgatcttactgaactctttaacctgatgcatatgttataatgctttattgactaaatgagtattggtgattgaagtcccgataacgtacttgccaacatgctatgatggggaaactatatgccaacggttgaaccatgtgcatgaggctgcagtacgcaaagttttttttgcaggttcactgttcatttcatgtagatttagcaggttgtaagttccactgggcttgattcaagattgattcttcttcatgcccgtgagtcttgttaactaggaatgtgcaggaacatgcaaagggtaaaccatatgcaggtattgtttatggatgagaatggattagcctacggagttgcacaacattgttaaccttcgaaatgttgttagcggaatggttactattcgttcattgaatcttctgccaatctgttttatgtaaatgctgtatcggattttgatgagcaaattctattgcagtgcctggaacgattgtggttttggcatagtaagtttcataagatttgattctgagatgtcctgaacactattctattgcagtgcctggaacagtgctctctctttctgacctaggacaggtagtgttgctgatccgggtagtgtaccgtagcactgcactgtccgtcatccatctatctatcgagtcaaactgcagctgaacctgacctgaacttgtgcagggttcagggtgctccgatgaaagtatcctgaatctttacaggtttcagggcgctctgatgaaaaatatatgcattatcattaacacatgtgctctcggcatggcatgctgttgcggcgtgctgtttctttcaggattcttttggatcagtttcaagattgtgtctatccttgccatgtggttttggtgttgccggtgtacggtggcggatggctcacctgtattgaatttgcaggatatgtcttcagagcgtgcgctaagaggaatggtttttaatttattattacccaaacaaaccagtcaagaaaattgttttatttctctagtccagtctatgggtgagaactgttctatccaaacaagtccaagcaaacaagaagttgaatttgaacacgtgaggatgggaatcatccaaaaaaagaagggatcgaggtcttggtcagggtttcggggttaggataggagtttaggagagactgctggcctagcggtagtgatgggtcgtgggacacaactacacaagtgtcttacctttagttgttgtgtggagactgacccaatagagcgaatatgaagacattcgcgccggtatgtattagggttttggtctttatatctttagcagtttacctatcatatcttatatttcatattctatttcaaactctattatacgaacaatgcagtttataatgtaaaacggtattttgggtaatctgctagacacgactaaatttgaatccaaggcattcgacttgagggtgtctcaagggagagcatttagatgcaagacgttaaccctcaaacaaaaaaaatgtggtggtaagtggtccaattcaagacgggttagggaaggtacgggtgcagtaaacagacacttggaacaatgtatctaataacgggcaaaataaaattttatacctaaaatttacggatggaagattgtacccttcaattcttgtgtactagtacntgccgcgcgcccctgcacgcgtggcgtgcttctggcgccggtaactgattttagcaaatgactatttgcaagtaaacatattcaacgattctgctattcttagcaaagtaatttcacttggacttttgtgctaaaaacgcattggaaaaaatctccttggactccagcacaccgacaaggatattcagggtcttattaattctcgcttaactcttacatgacaaaaaagaagagcaacaatatgagtgtaaccatatgaagactaaggtgtgtttggtttggctttggtttttgccccctaaaagccaaaagttaaaccaaagggctgaatctggaaaactgctttttctaaaagctgactttcttgtagtgcaaaactaaaaacacatatggacctgtttttagcanctttcaggtggaattgtgaaaatacatatggaagaatttttagcgtgttttagtagtttccaccaaacagtttttagctttttagcagttcacatcccacaacagcttttttcaaagctcacagcccacaacagcttttttcacagccacagcccaaccaaacagaccctaaatacatctacttatcatgtacaccgcctaagggacaaaatttatggtacctgagaaataaccataacaccgctagaatcggttgaggatcctcgtgcaggagtgagggagccaacctcatcaaataaaatggcacatgggcctgcagatgtagcctaaggttgaaagtggaaaactggggaacattattgatgtttcggacaattactcggctgtgtaaattccatacctttacaaaatatcctagacattctttttctgtttctgcaacatacatgtttatgggttctggacctttgacgctacaaaagttcagtgagtattcaggctttcgcgagtaaagcctagaagtccaacggacattcattttagcgatcccatgtctttaggatgcacttgttatcggatgtctcctaagagacagaatgcacttgttatggtaactaaacaaaaaatataatttaattcgtgtgaaaccttttcaaacctaccttccctgtttgcgcaatttagaagaaataaggcgattatacgtcaaagggagctgtaatatcaagcaaaagaaaaggtcatcccacaaaagcccaaaactattgtagggaaaacacttgtttttacctgtaattgagcgtcataatggtgttgctgatatttactgctgaaccaagtccaatttaccagaatagtatctagaagaatccttttcacatcctatagcccaccaacatcctgctatttgacactgagaacctaaaaaacaaattgttcccagacgaaagctaaagtcgcttt

SEQ ID NO: 13627 - DNA, 849 bp, Zea mays
aaatatctggtgataattgaagagatacaccaaattcttgctgaaagattggttgctgcacaacaagaaattgcagcagctgagaaagaaaatgctgaaaaggaggctgctgcccgggcaggtactcgatgaacaggaaaaaatgatgaattctatcgtagaagaatcaagaaagctgcagaaagaagctgaggagaacctgaagctgaaggaattcttggttgagcgcggtcaaattgttgatatgctgcaaggtgagatggctgtgacatgtgaggacgtttcgttgctcaagcgagtggtggatgagcgcctaccgttgagcaagttgcagcgctcagctatgtcgagcctctcttcttcactgcattcttctcatcacaagagctggacttcctcggataaagccattggatctccagataagcacacccttgctgaagctgcaagcccagtggggaaagatctggatggcaacgagtgcaccgtggaagtgtcagatggcaacgacagtggtgaaggcattttgaagcgcgtggattccaaggaggatggcgatggatgggagctttgctgaagatgttcaggaatagcggggttgccagaggatgctgaaggataaactaacaataagtcaataatggtgtataaacgcatactagcacggtgctaatctatgaatcgggaagtctcgctggctcaccacagttgtacgtgaaatgagtccaactgcagcttgatgccttgatgtgaatatataaaagtgaaggtttcagctcccttaggcctggtttggttattctgaatacacatggattggatgaattggataagattggaaaaaattaa

SEQ ID NO: 13628 - DNA, 2291 bp, Zea mays
aaggctgaccagaagctggtctcccccgcgatttatccacctcgctttccttcactggggttctaatacgcaattcactgggaacccaaaaccctaatcctctctctccacgccgccagagagccgcgtgggagctcggtcctcggacttctgcatcgatctctgctatgagtgctatctaggtttctcatatgggtgacctcaaggaggttttccgctccctccaagaactcttccctgaggttgatcatcgtatactgaaggctatcgcaattgagcatcgtaaagatgttgattccgcggttgttactgttcttgatgaagtcatgccgttcatgacgggttcagctggagtggatggttctgttgggattttgtcatctatggatggttctgttgggaatttgtttggtaatcacagcacacatgaagtgggaagttcatcatctgtttggcgtgatatatgtatcaatgagattgatgcaagtgtttactctgtgcaatacacttcttatggggatgtcaaaactggcaagcaagaaaacataaacaacacatatgtgggaagatttgcatcaatcgaaggggtcaatgagcaactaaatctacattcttatcctatcccaaatggtggtcaacatgatttgcttcccaaccttgatgtgctatcttcaaataccgatccagagaaaacgttggccaacacagataatgaagttggatacagtggattatttagtgaatgtttttcccaaccaccgacaggggaagatggtggtaatatcatagccccacaaccctgtgatcaagatcctaatggcatgattccagttggggattactttccacagaacagttcaatggagttcttcagtggctatgaggacaaaaattttgatgacggccttttgcctattggttctaatgatcaaatatcttttcgaattttgggtactgaaaaagatccttttgcgcctgtgctagatgttcctggtcgagataaagaagaatcatccactgagacttctggatttatagaatcctccaataatgttgcagatatgcttcctgatcttaatctgaaccattttacttctacggcttcaactcactcaaaccattctgttagtattgagtctcttgaggattctgttgctgatgccagaagcaataaggttatgcattatgcttgttgtgcactggtatttttattttacatgcatatgtcgctattaattttcaattgtacattctctaccatgtcactgtcatgtgtgcgtgcccactagcactggatattagaacattcatttggattgatggtggcttctctctttttatcttgcttgtttggcctcccctgagaaataatgcgagtatcttggactaataagtgcatgaatacatgcctaagctatttcatttcatcatgttgtttttgtggcaagtatttgagatgcaatatgctcaatttttctaaaaaacaccacatgctcagtttttactaaacatgtcatatgctcaatttttctacaagcataaaagacctgtacaaacaccatattttactagttgggtttatttggtttgtcacaagtacacaaaacacacactaagcacggccaattttacatagaagaggatagtctactgtgttcttctgcactaggttaatagatagatgtatatgtgtgcagcaatcaaagtatgttgagataatcatattggattgtggttaattcattaggtgtactggctgactggccaatccagttgttgtctaggatgaaaaaaagcacgatatcaccacccattggattgacgaccgaattttttatattttaatctttttttcgaaaaataccacgtttagactttttgacaacttaatatcgtttttggaccctttgctcggtgtcatgggccatggcgccgaggtgcctgctgctgcgttggcctacgagggctccgctggcactgacgaggcacagacctcgttatggacgtgcgtgcggtgactgaacaagacaggctccagtctggacaaataaagaagtcactcgacaaccgcttgcactcgatccacaaacgtgggccccggcgcgtcttgtcacgtcacacttgatagcgatgtgatatgtcggggcagccacaccattgagtcgtcggtcgctcatattcgtgtctactgccacgaggctgtacgttgtttgggcattgggctttgagagggaaagctgataatagaaactaggtgagtgcccgtgcgttgcaacggagacatataatac

SEQ ID NO: 13629 - DNA, 3367 bp, Zea mays
tccttgcgctattgttcctaagtacatatcttaaaggaacaatcaagtgaagagttctcttctcattgcctctattcatatcaatctgattttaatcccactaacatttattataaacaaagtttgtcttatttagagttgatttttgcatgatcaactattcacccactctagatgctttcaaatgctgatgagtattttagttctcttatgatatatttaatgtattttgaagacttttagtaactagaacaaaaaatatgaaggattaaactttagtcataaagtttagtctctatattaaaggaaccaaacggtcccttacaagtaaaacaaacacacctttagggggtgtttggtttgagtaatcactccatccaaaatgtggtgatgcatcatgagtctatttctcaaatttggtaggatgatctcattcctcatattagtactaactataaggaatgaggtgacgatggatcaactcattctattccacaaccaaacaaaaaagtgagaagtgagaatatgatggactagctcattcctcaaaccaaacagcctattagtcctttagttgagattatagtttttttttacttggttaacacaacattcacgttatcgaattcgaagtattggtccggtctactgttggacctatatctggaaaaggaagggacggggttgggctgagggctggaggctggagctggtacaagcccgtcctcccccgcggttttgatcgcctcctcgctttccttcaatccttcttcacctggtctctcacgcaatccgcggggaaccccaaaccctaatcctctccatccgaaccgctggagacagccgtgtgggagctcagttctcggggttctgcatcgatctctgttatctggggttctcagatgggcgatctcaaggaggttttccgctccctcaaagaactcttccctgaggtgggcacgatcggtggtcgtccgtgtctcgtgtacaacctttgatatgtcatgtgtgaggggctgcaaaagaagttttttttcttcctgaatgtatttttattttttatgaaggtactagggtaggatcactagctctagcctctaggacacacacggagattaggatctgttgttgctgtgatattcgattcgattttagtggttatggataggccgtacatgattatttgacgattagatcaaactataggcattagctgtgttgggttcacgggcagactgagttgccacgtttgtgccgttcctggctgtgttttgtgagggcaagtttgtctgattcctcttttgtgcaggttgatcacccacgcgtccgggctatcgcagttgagcaccgtaaagatgttgattccgcggtggttactgtccttgatgaagtcatgccgtccatgactggttcagctggaactttgtttacccataaagaagtgttgccatctatggatgattctgttgggaatttgtttgctaatcgcagcacacatgaagtgggtagttcatcatgtgcaggacatgagatacatatcgatgagattgatgtaagtgttcaccctgcacaacacacttcttctggggaggctaaaactggcaagcaagaaaacataaacaatgaatgtgtgggaagacttgcatcagtcgaaggggtcagtgagcaactaaatctacattctgatcctataccaaatggcagtcagcatgatttgattcccaaccttgatgtgctatcatcaaataccaatccagagaaaatgttggctaacatatataatgaagttggatatagtggattatcaagtgaatgtttttctcaacaactgactgggaaacatggtggtgatatcatagctccacaatcccatgatcaagatcctaataagatgcttccagttggggattacttttcccagaacagttcaatggagttcttcagtggctatgaggacatgcattttgatggtgaccttttgcctcctggttctaatgataaagtatcttctggaattttgggtactgaaaaagattcttcgctgcctgtgctggatgttcctggtcgaaataaagaagaatcccccgctgggacttctggatttatagaacagaaggacaccagcaatgttacgaatatgcttcctgatcttaatttgtatcatttggcttctacggcttcaactcactcaagccattctgttagtattgagtctcttgaggattctgttgctgatgccagaagcaataagaatgatctgttaccttctttggagttggttacaaaaatgatagaggatgttgagcttcttgaagaaaaggctaaagtagccaaacgtgaatcatctgttgctgggacaggcattctaaccaaagttgaggagctcagagaaatgttaactcatgcgaaggaagcaaatgatatgcatgctggcgaggtttttggcgagaaagctattttaaccacagaggcacgtgagcttcaatctcgacttcagaggctttcagatgagaggaataaatatctggtgataattgaagagatacgacaaactcttgatcaaagattggttgctgcacagcaagaaattgcagcagccgagaaagaaaagcttgaaaaggaggttgctgctcagacactactcaatgaacaggaaaatatgatgaattctattgttgaagaatcgagaaaactgcagaaagaagctgaggagaacctgaagttgaaggaattcctggttgagcggagccaaattgttgatatgctgcaaggcgagatgactgggatctgtgaggatgtttcgttgctcaagcgagtggtggatgagcgcctatcattgagcaagttgcagccctcagctatgtcaagcctctcttcttcactgcattcttctcatcacaagagctggacttcctctgataggaccaccgaagccaatgggtctctagataagcacacccttgctgaacctgcaagcccagcgcgcaaagatctgaatggcgacgagtgcactgtgcaggtgtcagatggcaacgacactggtaaaggcgttttgaagcgtgtggattccaaggacggcgatggatgggagctttgctgaaggtgttcaggaatagcgcggttgcgagtggatgctgaagcatagaaattactataaactagtaataatggtgaataaacgtttactagtgcgttgctaatctagtcgtaatgtgggaactgtgtcgtggaactgactcactagctcaccgcagtagtatgtgggatgggtccaactgcagcttgacgtggtatatataaatgtgaagaattcagctgcccctgctcctgtctaaattttatgttgtttttaattttgttctaagtt

SEQ ID NO: 13630 - DNA, 982 bp, Zea mays
cccggcccggccgggagtgaaccggtggtgggcagtgcggagtgccagcccagccagcagtaaccgccgaagcaaccggtgaggagggaggagaggggctggccgcatccactctccccttccacttgcaggcattgcctgttctccactccagttcccagctccgcagctcgaggacggaacggagggagatagggccaggggaagggacggagagccccgtctccaattcacaacactgccacggccggagccggaggaggaaggcgccagccgtagtccacaggcaacgcaagggaatgccactgttctagtctcgctctcgcagatctgctccgccgcgccctgttcaccgggaattctggagctgagggcgcaggttcgagcagaagctcggagcatggccatggccgagggggagaagcaccatgcccggtgccggtggtaggtagggctctctgatatcgcaggcctttcacgcggcccggcccaaaggcttcccgtccgttccgtcggctagccgaggacggaaaccgagatcgggtgattgcttgactcgggagctgagcggaggtcgcaatggcgtcgtgggacaacctcggagagctctccaacatcgcgcagctcacggggctggacgccgtcaagctcatctccctcatcgtcagggcggcgtccacggcgcggctgcacaagcgcaactgccgccgcttcgcgcagcacctcaagctcatcggcggcctgctggagcagctccgcgtgtcggagctcaggaagtacccggagacgcgggagccgctggagcagctcgaggacgcgctccgccggggctacctgctcgtcaactcctgccaggaccgctcctacctctacctcctcgccatgggctgggacatcgtctaccagttccgcaaggcgcagagcgagatcgacaattacctccgcctcgtcccgctcatcacgctcgtcgacaatgcccgca

SEQ ID NO: 13631 - DNA, 2749 bp, Zea mays
  misc_feature (2163)..(2163): n is a, c, g, or t
gcacgagaccattacctagaacatcctaatcgaaaaaaggaaacgagaagacaaggcctccgcggctccgcccccgatgcctccgctcctcacctcacccgcctccctcccctccgcctcccctctcctcgtctcctgtatcggcgctctccaccgccccggccccttcctccaccagcgcgccgccgcctcggtccacttcctcgcgccgcacaggaagacccgaccgccccccgcgatgagctggcttgggaagctgggcctgagcgggcttggaggcagcccgcgcgcgtcggaggcgtcggcagcgctggcgcaggggcccgacgaggaccagcccgcgccggggaacgagttcgcgcaattcggcgccggctgcttctggggcgtggagctcgcgttccagcgcgtgccgggagtcacccgcacggaggtcggctacagccagggcaacatccacgatccgacctacgaggacgtctgcaccggcaccacaaaccacaacgaggtcgtccgcgtgcagtacgacccggccgcctgcaagtacgacgacctcctcgacaccttctgggcgcgccacgaccccactactcccaaccgacagggcaatgatgttggaacacagtataggtcagggatatactactataacccagagcaggagaaggcggcaagagagtccctggagaagcagcagaagcttctgaaccggaagatcgtcaccgagatcgttccagcgaagaggttctatagagcagaagagtaccatcagcagtacctggagaagggcggccgcttcggcttcgggcaatctgcagccaagggctgcaatgaccccatccgatgctacggatgagccaaatggacctctacgtgcatggtgtgaatcgtaactgaataagggatgcatcaaagccagattttatactgctttcctaggtttgttttgccactattgaacggctgtaagagtttagctatatactaccatggtactccaatcatcgtgtacaaaaccatattgtattacatgcaagtgcgagtgagatttaagcgtaaacaaaaaaatgtagaattcgtacgaattttacagagcagaaataatgggatgcagggattgccagtgatgatggtggcatattttttttaaaatagtatattctacaaacccttttttttacagaggaagggaaattctccgtctaagtacttagtttaggaactctattttgccaaaggatttctatttttcaatggaaaataaactttttttttgaaaaatgaaaatcccttggaaaaatagaattcctaaactagccctacatatattgcatatttgcattagagtgtcaatacacgctcaaaagcagggcacgtatattaacagtcagcatacaattatgactggtaatggatcacgattcaaatgtttcttcacaatttgtttgagcctttagttaattttagttcaaaattgaatagaaatataatccgatcttaatccgatccaattcttagagcttattatcacccctatatacagctagcgacgaacacataaaactaagattgagtgtgtaagatacatatatagagactaatataaagcatgagtttcctgtacgcctctctcggcttcccttggtaaaataagctaaaattgtgcaaaatgagagtcaataaaacacacgtttttataatttacattctacactcaaccataatatcaatatcaacatttttattataaacggggaaaaacaaaaccaagtcatattggccttagcccactgtgtcgcaactaagtcctagacacaacattgtgattgggctagaccgacacgggcccggtggacaacgtaccggaccagcatgggcctagtggacaagcgggtcaggtcatgcttggggcgggctaaactgtgtcgggccacgggacgcctagcaaacctggcctatttggacttttatactcgtacaccagtaatgcgcctgtgtaggcagacatcgacgtaagcaatgcgatggcccatgcaggcgagtctaccaggtgttagcacagtagagttgttgggttatcaattgaggtacatgattctcgtaagctgctcgagacttttgtctgttcattgtaaaggtttggaatatatttgaaatactatnccatttaaacatggtctatatatgtgatatatagaaacgtagctacgcattgacaactaactagtatacacacacgaaagcatcattcatcacctagggtgatggaccaaatgtacatcacccgaacaacccacccgaccctaattaaaccacctcaaaccaacccgccacccctcgcacgcctctgccagcaattcctccgctcgttgcaccttttccatgtcgacccaacaaccaaaaaatgctgaagtaaaatttgaatagctaaaataaaccttgaacgactgaattttgttcctagtgtacgttaaagtaaaccttaaatgactgaagtaaaccttaaatagctgaaataaaccttaaatgactgaatatttgtcattgttgtatattgaagtaaactgactcaatattttttgtttacgttgaattaaaccttgaatgactaaagtaaactttgaatggcgtaaacatcgaatgattgatcatttgtaggtgttgtacattgaagtaaaccttgaatggcttacctaaacctcgaatggcctaggtaaattagggattgttgaatacttgtttgtacgcg

SEQ ID NO: 13632 - DNA, 2151 bp, Zea mays
cccacgcgtccgctggaacagattgcagaatgaaaatgagattaatcttgatggtcatcgtcctcgagttcggagatacgcacaaggcttggggaaatttgtaagaattggtaaagggccagaaatgctccttcgtcagtcttcagatcttcaaggccaagaaattgttaatacgaactttggaggtgatactggtgccgcatccgttgcgcatgaatggagatatgttcggacatttaacggtatcagaatttttgaagatattagtattacaaacccaaaggttggaaaggttatacttctgaaatctgttggggtggtcagtgcaaaccctgataccgtgtttgaagtggtcctcgatcttgataaacataagcgatatgagtgggatatgttgacagctgatttggagttggtggaaagaattgatggatactacgatgtggtttatggaacctatgaacccaaatatttaaattggtggaaatccaagaaggattttgttttctctcgacaatggtttcgtggacaagatggagcatataccattttgcagactcctgctggtcataacaaaagacctccaaagcatggctacgagcgaacaaagatcaacccatcaacatgggaaataaggactttgtatacatcaggatcatcgagtccaaaatgtgttgttactcttatgttggagattgctccaagtttttggggcagatggaagagaaggcactcaaattttgacaaaagcatcccttttgctttgctcagccaagtagcaggtataagagagtacttcgcagccaatccagccttgacatctgagctgccttcaacagtagtgaagtcaaaagcatctgaaactttgatcatccagagtgaacatgaagattctgaacttggtgatgaattttatgatgcacttactagaggtgaatccttcgaagatggggatagtgatgatgatgatgatgccacaactccaaaggctagaaaagtaaagttgaagaatgtgtcatgggctattgcaggcttggctttaaagacaactaaagctttggttgagacaagtgaattggttacaaattctagtccagttactgttgaccccagccacttccatggcacccttcatagagcgaaaactcaaaatgatcaaaattcttggagtgcacctggtggggagaagtttatgatcagagggaagacttacttaacagattatcacaaggttgttggcggtgatccacttctagagctacttgcggtcgattggttcaaagttaatgaacgctttgattcagttgccttacatcccaaaagccttgtgcaatcagaagctgcaaagaaacttcctttcatattggttataaatttgcaggtgccagcgaaaccaaattataacttggttatgtactacgctgcagagagaccagtgaacaaagattctttgttgggtagattcattgatggaactgatgcataccgagatgccagatttaaacttataccaagcattgttgagggttattggatggttaagcgtgctgtaggaacaaaagcttgccttctgggcaaagcagtaacgtgcaattatcttcgccaggataactttctggagatagatgttgacatcggttcatcatccgttgcccggagcattattggtctagtattgggatatgtcacaagcatagttgttgatcttgctattcttattgaggccaaggaagagaaagagctccccgagtacattctgggcactgttcgtctgaaccgtgtgaatcccgacagtgctgtatcaatctaattacgtttctagccgatctatgcaaatttactcttatcctcttttattctgagagaaacagcgtggcattttgaaaatgtgaaatagcattactatttgctgatccccaatcgagggtaacatatgtaaattggcatgaggcatgactacgtgacgcctttcgtaaatagaataaatcaatggttatgtaatattaatatcccatatacgcgtgtcataatctatgtggcttaaaagtggcatcaagtcatctagtttcctgtgttaacttcttattccttaggtagtcagacattaacagtgtgtttggtttgaggaatgaagtgatccatctttttctc

SEQ ID NO: 13633 - DNA, 2407 bp, Zea mays
ccggccgggcacttcctcttctgcccctccaacctctcctcttcctctggtctctggacaaccaagccagagaggagcagccagcgacaacctcctctcctctcctcccctcttattccgcgcccagcagcgaggcatggtggagaaggcgaggaccatggcgcgcaggctggagatcccccagtggaaggccgacggcctgccgtcgccgacgagcccgctggaccgcgcgtcggcgtcgccccgtgggtggcgccaccgcgacgccgtaggaggaggcgtggggctcgggatcctggcggcgctcgaggccgagggcccgccgcagcccgcgccgagggtgtccatcccgcggcgcgcggcgcggctggaggtgtcggagctcgggtgcagcgggcgctgcgccaccagcctgtgcggcggcgtcggcccggcccccgcccggcccggcggcggcgcggcgttccgcgtcgcggagttcctgtcgtgctgcgacatgtgccggcgggcgctggacgggagggacatcttcatgtaccgcggggagaaagccttctgcagcatggagtgccggtaccacgccatggtgagcgacgagttccagcaggagaaggagcgcaagcgccgcgccgccgtgtcccggacttcggccgcggagatggccgggtcgccgtgcagcggcggcggcggcggcgggcagatcttcttcaccaccggcatcgtcgccgcctgatgggcgggcgggcgggcggatacggatccgtcttctctggtctagtgatacaaaacaaaagaaaaaatatccagctagaggaaccggcggccgctgtaacataaacctgacaagaaaaaaaaaccaagaggagaaataaggacggatgggtgcgtgcgtttgtgtagagcagagaaatgggcgcgggggaattttgctcgtcctctcctcttcttcggtagaggaggaaccgaggcagggagggtttatttcatctgtggattttttttttgtattattattagtaaattatagtagtaccactattatcacgacgatgatgggcgggatgagatgttctgtagcagcagggaagggggaggggggatgatgtgacaagttttccaaggattgttgcttcccttttgtttctcctctagtcctctgctctgcccaagggaataaaactcctcgcttgttcaaatccgttccacactccatggtgttggtgtttgcgttgagaaacctcttacaacaagtatctgatgacgagttgtatactacttgatgacgattgacgagttgagccttttttctcatcatacggagatgaactcttgcggttcttgttcaaagagtaagaaaccgatttgtgaacctgggttctcctggttgcccagacacaaagaaacagtgacctgcggggagcagtatacgcttccctcgggtgcccgtccgtcctagcaaaagcaccaagcggaagcagtctcgttgtgggggagaggagacgagttcaaaccaaccaataattggtggatgcatctaccatatgggctgtggacgtacgtggactgctgctgccactgctggctattggcgtttgcgtgtccatggatcaccattgacacttctggctcggcctagcctgcatgagtcttttcttcttctttgaatcttgagctgcatcagtttttgcaaaacgactcctgcgctgagagtctctgcagttagatgtataagatagtagatgctataatttatgtactgttggaacaatcctggatcagtatacctaacctaacatatactataaacgtgtacaattctttcctacaagcaactttttccatacaagtaacccatgctattaggcggccaacaaaatagagacgtgtacaacatatataagactccaagcgtcgttgacactttacatgctcaatatgtatacatatgctattagaagggcctcttgattatgtaataaagttttagtcgtgttagcgcgaaccatttataatgcatgttatgtaatatgttaatgtgtagcatattctatataccctcaaagttcacccttcatttaacatgttagcaatccgtaaatcattatttcaagagtcatctaaataaaaatcgttttctacatgttgttttcgctctctaattctctatcaccttttttctatatcttgtatatgctctagaaatttatttttgaatctatttttggctattttaaatagattatgactataattagactataacttagagaagttgtcgttgatagtatttttatcattatattcctaacaattagaaaagatagtctgtttaaaaattgctctcagctgtccttttggctgctatactactttaccatgatccagtaggctaaaaaaattagacaat

SEQ ID NO: 13634 - DNA, 3138 bp, Zea mays
  misc_feature (2197)..(2198): n is a, c, g, or t
  misc_feature (2446)..(2446): n is a, c, g, or t
gaccgcaagaagggaaagggatagcacgtataccacacagaaaaaagtaatgaaaataaaagaaaaggtctatcagcaggaaaagaaaacccacaggaaggctggaaaccgccattgcaggggctacaaatacaggaaaccactcaccctctctcccacttcctcgccctccaacctctcctgatctcctcctctggtccgcatagaggagcagcttgccagccaaggacaccggagcacgggcacgggcgcacggccagcgcgaacctcctcccctcccctcttcttccgtttccaacagcgaggcatagtggagaaggcgaggagcatggcgcgcaaactagagatcccccagtggaagcacgacggccttccgtcgccgacgagcccgctggaccgcgcgtcgccccgtgggtggcgccaccgcgacgccgtcggaggcgtcgggctcgggatcctggcggcgctggaggccgagggcccgctgcccggcgccggcgccgccgccgcgccgcgggtgtccatcccgcggcgcgcggcgcggctggaggtatcggagctcgcgtgcagcgggcggtgcgccaccagtctgtgcggcggcccggtgtccggccgggccggcggcggcggtggagcggcgttccgcgtggcggagttcctctcgtgctgcgacatgtgccgccgggcgctggacgggaaggacgtcttcatgtaccgcggggagcgcgccttctgcagcatggagtgccggtaccacgccatcgtgagcgacgagttccgggaggcggaggaggagaaggagcggaagcgccgcgcggcggccgccgacgtgcccaggaagtcggccgctgagatggtggccggctcgccgtgcagcggcggcgggcagatcttcttcaccaccggcatcgtcgtcgcatgatgggcgcgcggtgcggatccgtcgttccgtctagtctagtgacgaaacaaaaaaaaaatccagctggaggaaccggcggacgctgtaagataaacatgacaaaactaaaaaaaaaggaagcacgagaaataagggtgggtgtgtttgtgtagagaaatgggtgggtgggggaaactttgttcctcctctcctcctctttggtagaggaggcatcatgaggatggtgggcgggatgagatgttttgtagcatagtagcaggagggaaggagagggatgatggcaagttttccaaggattgttgcttcccttttgttttcccaaaaaaaaaaaaaaaaaaaaaggaataacattcttgttcaaatccatcccgctccacgttgttggtgttgagaaacctcctcttctctacaagcattcgatgaactgttgtggtgctctgctcatcaagaaatattgccataaaaagagaaggtgaccatgacgacttgctgcagccagaaaggcatgaagcacactcgcgtctagttcagcttcagatgaacttgttgtgatgcttgttcaaagagaactgatttcagagagatcaacgaggacgcgtccagtccatgtcctttactgggttctgctgctggaagtccaaacccaaagaagcagagctgccaggaggatagatagtgtttggctggtcctgccgctgcccgtccgtcctcctagcaaaagcaccaaccgccagcgtgctgctgcatctatgtgcgggtgtggcctgctgctactaggtagtactggccgacggcgtatccatggatccatcgacacttgtagctcgtcctaaccttgcaccagaaggggagtgggaatcccgtggagaagaaaagaagatgggggaaaaagagagacagtctcctagggatgcaagatctccccaccgaagcaaggaacggcttggtgaatttacgttgaaggatgtggtggtggcacagcagctggtcgatgctttagttttgataatcatcgggatgcatgcaagtcatatactagtgcttttgtttgtgatttctgaacagcagccaattgcactccattagcatagcatcaactgtctgatacatactcgcagcaggcaggcaggcagtccaaatacagttgtagctgtttggatgatctgggactgggaacccatcggctccatgcttcagggaggcaacacagtataatatgtgacggtcactatcagactagctggcatcatgatagctgtgtggcccggagaagannaagaagaaaaagtctattgccttccatgatcgcgaccagcacgcagcagggttattatactccctaccactgatgatagcagaatgctgactttgacacacccttaggttcaaccacgtcgctttagcttgtccaatcgttatcaatattatgtgtccgtttggttcacatatttaatgagtaacattaaataatgtttgtttaaatctaaccgtaatcagatataaattgatgtcttcgacttattnaaatctattaccaccgatactcgagtgcgaatcattaccgttgtcatttatgttacatacattacctgaaccaaacaatatcttacatatatatttagctaccccctcttgtataaccactatatacacatttggtttatatgtccaggaaggaaattgaacaggtgattatgactagaggatgagatgaatcatgacgaccaagaacacattactacttattatatattttctctgtattaaaataagcatacttctagagtcctagtgaggagagcaatatcaatcaatagaaaaactagcaaaaagacaactagagttagatgatctaaaggctagaaatacacttagaaggtatttggtttctagggactaatttttagtccctctattttttcccatcttagtctccaaattgtcaaatacaaaaactaaaactctattttaatttctgtatttgccaatttagagaataaagtagaataaaatagagtgataaaaattagtccctaaaaatcaaacgtcctcttgtttcctcttgtttcggaacagttttaaattctagaagtatacatggatctgtccgtggtgctggagttggtcaataatcctacccaatatactaattaccacttaagtgcgcgtagagtaatcatgtaacagcgacggcctacatcgctattgatattgct

SEQ ID NO: 13635 - DNA, 2009 bp, Zea mays
cccactccaaattcctctctcctcgcgctctccctcgccgccacccgccatgctcgcaactccatgagaacgccctggctgctctccccacgcttgcccacgccgcatcctctccctccccggcgcccctacgtcgcggttcgcggtggctcccgctgccgcgctcgccacacggagtagcgagggtgctacttaccaccttaccagcgttggagaccgaggtggcggctttgccggacaagggtgatcctccgcgggcgtcgccgccgcaaagcagatggacgcagagaggatgaatgccctggaacagatgttcaagcgactggccctcgccgacgacactggtccaaaccggcgaagacaggtcatgccctccaataatttctactcgatgttgctccacattattctgatatggagcatgattagcagctttgtgagtaagcattgacatgcttcggtcataactgtgcctctatttgatggcattcttcgagcctcgatccccaaacttacttcatttggagccatcatgtcttcgctctgaattggcctattagaatgtggcgagtctcctcccactcccagtgaaactcttactgacaaagataaaagagctgaacatcctcttcaatctcctccaaaaaagtgttggaaacaattccaggagctacagtcacacaaccaaagcaactcggccagcgcgcgggccgggtcgcatgggcgacgccggcgacaagtgtgcgctgcggctggccgccaccgcgaggaagtggctggaggacgtccgcgtcgaccgcgaaggccgcgtccaccccgccgtagccagcggggggcaggcgctcacctggctcgcgactgccggcgcccgcgtctcgctggccgagcccggccgcgtcgtctgctcgctccgcgtgggcgccccgctcaccgacgcggaggggaggtggcacgccggggccatcgcggtggcggcggacaacgtgtgcgcggcggcggtcttcacggctctgggcgcggacgtgctcaccgtccagtacagcctgtcctacttctcgcccgcccatctcgacgaggaggtggagatggaggggcgagtggtgggccggaaggcggcgctggcggccgcgacggtggaggtgcggaagaaagagtccggcgagctggtggcgatctgcaggccagtggatggcacctctctcgacaacaaaggtcagcacaagcacgagcagcaagctctgaagaaatgcagaacgtctctcgccaacacacacaacggttgctgcactcctccggcaggggcggcacggcaacaccactggttgttggtagagagagaatagctgacggtgcagaggatgttgaggcgccgaggcggcgccgcgacggcttgtactctcgaggtagggaatcacttctgtgccgccggcgaggcttgttcagcctgagccttctcctgtttgttaaacgcaaacatcaaatggagaagaaattcatccataaattacatgttgaacataaatatagtgtcaaaaaatcagatcattcgtaagctatttatttccattggttacaaacattatcaattggaaattacctgttacccttctatggatgctcatttattgtccatgacagcaatatgtttagagcaacaaaggagcaaaaagcgtctgtggtccaatgttacttgatcatgcatatatccatttgcaactaaatgtaaaccaagcaattcaaaaaactaatgaagacaatgaacctttatcactatacatgatgagaggatgacatttttcccataattaaatcagtgaaatcttcaatagaatattttctttaaaaaaataccatcatctaccctggaaaattgccgtgacgaacgctcagcagcggagcgtccggcatggcgtggtatggctcacgccataccttagcccacatgtattcttcctcgatatacttcaacttgcagccttgttgagtcacccgcaaatcgtaatcctgca

SEQ ID NO: 13636 - DNA, 665 bp, Zea mays
atcatatgtaatgtgagagcaccggataatataactgagtacattttttttggaaatggaaatatcattccggacttttgaattttcatgcatacaaccatacaactcaaataatacatcatcccaacaatttgtggatcaaacaaacttcaacttaaaacatgatatgtaataaaagattacaaacactaaaccgcgtcaatccttgtattagaccgccacttgtgactcgcgaagacctctgagtacatgacacacacacatgcttcacaagattcaaatacaaaatacaatcacaccacgtcgagggttgtatagatttagctcgacgtccttatttatctttgcactacacacacatgcatgcataaacatgcatggcttggccataaacgtgaacatagatacggctacctcaccatcccagaacgattgaaacagagacaagtgatgagcaaaacaaggcaatctagtttcctccaccgccacctcctcctccattaccaccgccaccaccaccgccaccaccgccgccacctccgcctccaccgccgccgcctcctcctcctcctccacctccgagagactggtggagttgctgagcgagtatccttgaagaagccatttgcttaaactgctagctggaatatggcacacttgctgat

SEQ ID NO: 13637 - DNA, 2947 bp, Zea mays
tcctttagagttcgacctgcagggttgcattgcacgccttattgttgcggggtcgtcatggcaaaccgagctttttaaaaataaataaataaataaataaatgcgcgcatctactgaatggtcagatcgtcgtcagaatcattctgctcgactgcgctggtcaagcgggccctagcgcaaaataatcaaggtagcatttgaaaactaccgatccgtacagcaaaatactggcaaatactccatagacatcagggactgattaccctgttgttaatcttgctctcaggaacgccaccaaccatacttagcagcgtgagtggctccagagcgacgacagggcccatgccccgtggcagagcgggtcgttgtctccattgccacgcccgctttaaaagggaccacctcgtcactctccctcctccatgtccacggtcaccgtggcgagggcagccccgccgagcgttagtcacagttgttgcctgcctaccatgcggctctaactcgatccgtgcagcagacgccgagtcgcggcaaggagtagctaggaactaggaaggaggaggcagggaaaggccaggccatggcgctcgaagctgtggtgttcccgaaggagcacccggggtgtacggcggtcaaggcgcgcccggcgtcgctgggctgcggcttccacaccgaggagctcgaggtcgaggacaagggcggcgtggttctgcaaggagaggccgccgacgcgctgccgccgcccggtggtgccgccaccacgtgggactgggacgcggtgctctgcccgtgctccactgcaccagctgcaggcgccgtggaggagtgctgggacgtgcagcagcagcagcatcagctcctgtccgtgtccccgccgccctcgtccgccgtcgcagcgtcgtcgtctgggcgccgcaaggctgccgcgtcggaggcggcgcggcgacggcggcgacgccccaaggcggtgaggaacacggacgagatggagagccagcgccgcaaccacattgccgtggagcgcaaccggcggcggcagatgaacgagtacctctccgtgctccgctccgccatgccgccttcctacacgcagcgggtacgtacgtacgaataccatctcctcctgctgtgcaatgagcgtagcgtaccgccgctcccctcaggccatgccaccatgcatgtgcacgaacggcttggcattcaccgcattgctgattgctgctgtcaccccccaacttttactgcaacggatctcaaatcttgctgcccctctggccatccgctgctggctgctgccttcgccccgccgcgcccgccatgccgctttggttgcacatgtcacggaatctctagctagcgaccattcatcaaaagccgcgccaccttccgttccgttcgcaacgtatgtactaccagtctaccacgcggtccacgcgttaacatggttacatgcagggtgaccaggcgtcgatcgtggctggtgccatcaacttcgtcaaggagctggagcagctgctgcaggcgcgcgaggcgcagaagcggtgcaccgagccaccggcgccggcgccgttcgccggcttcttcatcttccctcagtactccaccaccgccgcgacgggtggtgcggttggctctagtagcgacagcgctggctccggcggcgatcagagtggcggcggcggcggctgcgcgggagcgcggcgaggcgtggccgacatcgaggtgtccctggcggagagccacgccaacgtgaaggtgctcgcggcgcggcggccgcggcagctgctgaggatggtggtggcgctgcagtgcctcggcctcaccgtgctccacctcaacgtgaccaccaccgccgaccacctggccttgtactccctcagcctcaaggtagtactagtaccgcgcacctactcgatccaggcgcgcgcgcggctattcgatcgactgcgacgactccagctgagctgagcagtgtactaacacgtttcctctcgtcgtcgtcctctctgctgcagatggaggacgagtgccggctgtcgccgtcggtcgacgacatcgccgccgcggtgaacgagatactcgccgatatctccgacgagtgcgcccgcggggggccaggccactgatgattagccgcttagcctaatatgttagcgagtgccatgtattgttgtgacgtacgtcgatttgatcctagtacacggataacactggcaagctagcgtggcagctcgctcgcgccactgtcaggcaggcggtaccactaccactccatatgtttgcgtgcaagtaaacatgtaccgattggaccagcttacgtactactaccactctttttgcagcgccagtaagtactgtatttgtgtgcatccaggattcagaatcattcacgtcgatctcgcatcggaccagcgctaattattagcgcagatctgtcgagatgcctgcgactgcgtgtgcacacgggtgacctgttcgaggtccacgaaagtagtttgagagccacaaaaccgaagggtattaaaggggctagaatcttctttttattcaacggataagaagtgaattataaccctactcttcggttttctgactctcaaactagctcgaactggtgtaccagcgtttttctctgacgagttttgttgctttcagaaatccctctccctctccctctgaccagtcagcacgcattcaccagataagaatgagttagcaaggaatatccagccccagccctatcatatttcaactccaagttgatagatctggccggctgcaatcatctcattctcgttgttacggtcttgcgtgagctcttatggctccaggtatcgagagtttacacatgaacagcatcgttgacagaatgacgcactgacacgtctcgttcattgctctcgagtgcaggggggtggctggacgaatgaacctgctgcaggcatgc

SEQ ID NO: 13638 - DNA, 673 bp, Zea mays
ggccgggcccggctcaccagcccctctcgcctcacgaaaaggcgcaggccaaggccaaggccaagccgccccctccctcctctcctctcctctcctctcctttcctctccactctctggcagccaaaggcgaggccgagatcctgcgcgcggaggatgccttccaggtccatgagccggctgtccgtcgagtccgcctcgggcagcggcggcggcggctgccgggaggccgagccggtgctctgcgcgcctcggccgcgcagggcccagcagcagctggtccacgtccacccccgcggcgccgacctcatcctcggcccgccgcccttccttctcaacgagagcagcgaggagggtcggtgcagctgggcggcgttcggcggcgggtcgccgccggcgcgcgcgggcaacccgctggtgcacgaccccagcttcctgctgagccagcgccaccccgcggcggacccgccgctggagctcggcttcttcgaccacctgatccgcaccagcagctacgttcaccggccgacgccgacgacgtcgtataccagcaccagcagcagcggcagtagcagcaagagtagttttggcccgtcgtcgttcgcgcccgccgtgaggatccaggggttcgacgtcgccgcgtgccggagctcccacagcggcggcggcggcgc

SEQ ID NO: 13639 - DNA, 1708 bp, Zea mays
gccggcagggcctcgaccggcacggtgtcgccgcgcgcttttccgtcttctattccacgcggtccccccggcccggctgcccgcagcctcaccctgcactgcagccagcgacggcgcgagtccttgcgtgcgtctcccgccctcccaccctctcgccttgctttcctcagcgccttcgatctctctctcccctcgccactggtagccatatttggtgccagcgagcaccgagcagcgcgtcggcatggggatgaggaggcggcaggacgctgctgccatcttggggctcctgaagctcttcctcttccgcttggcggcgtcgcagtcgttcatcggggtcaactacgggacgatcgcggacaacctgccgccgccggcgtcgacggccagcctcctcatgtcgacgtccatcgccaagctccgcctgtacgagccacagccggacctggtcgcggcgctcgcgggctccaacatctccatcctgctgggcatacccaacggcgccgtcccgaacctcgcgtcctccccggccgccgccgcgtcctgggccgccgccaacatccccaccacgcttcccgtctcctccatctccgtcggaaacgagctgctcaactccggcgaccccacgctcgcgccccagctcctccccgccatgcagaacctgctcgccgcgctcccggctggctcgaccaccaagatctccaccgtgcactccatggccgtgctgtcggcgtcggacccgccgtcctccggcgcgttccacccggacctcgccggcagcctggacccggtgctggacttcctgcaccagaacggcgcgccgttcatgatcaacccgtacccctacttcgcgtacgcctccgacacgcgcccggagacgctggccttctgcctgttccagcccaacgcgggccgcgtcgacgccgtgtcagggctcacctacaccaacatgttcgacgcgcagctggacgccatccgcgcggcgctggacgccaaggggtacagcgacgtggagatcgtcatcgccgagaccgggtggccgtacaagggtgacgccgacgaggccggcgccacggtggacaacgccaaggcctacaacagcaacctcgtggcgcacctcaagtcccaggtcggcacgccgcggacgccaggcaagtcggtggacacgtacatcttcgcgctctacgacgaggacctcaaggggggcccggagtccgagcgctccttcgggctgtacaagactgacctgacggcgaactacgacgtcgggctcgcaaaagacaacggcacggcggccccgaccagcttgactccggttccggcacagggcacgccgcagccgagcaaagggacgatgccgacggggtactgcgagaccacgtccgccgtgcccggcaccacgcaaggccaacagttgccgcagagcagctcgtgctacattcccggcggagctgagtcgcggcacgccacatggcagcttgttttattgggtgttttgctgtgcttggtcaaggtagccggcatctagttacaacatctgtgtgcgacggaacgagtacagggttcgctctccacagttgtgcgtatggattcaccactgtaatagaattcacgaaagctgctaggcacgatcgaatgttgagccacacggttgcactgctttggcctccacagctccacttgcaactccttttatgaatgatagcac

SEQ ID NO: 13640 - DNA, 850 bp, Zea mays
ttgagacagatagaggaagatcctgaaggtgcaggatagttcttgtgcaaaagaattacaaaaagatgggacttcaaatttaaattttgaattggaacttgactccttgaattggaacttgactccttaagtagagatgtcgtcattgaaaaggcaaagtatgtacaaaagaaaacttgattcttcagtcttccagcacaaaagttgtttgaagataagttcattcaaggatttgaaggaggtgattcttcagtacaagaaatttgtatcctccttttcttgacagaatctatgacataataacatctcaggcatgcatggcaatgaggcacaatcaggattgagaacggatgggctacaaagttctttgaagatgctgctagaggtagagcgcccacacttatgttcatgacttttgttgataatttcccagcttgtcgacagttagaggctctcccattcttggatccactgaagcattttagaggtgctctattctactatcaaagaaaaattaatgcactgcgctgaaaaaggacagaacaaagaaagatcttcaaatcaaagctaaagaagcggagattcaaaatctgaaaaagctaatgtgtaagtactactggtttcatatgtacataagttatcgtgttattatacggttccgttgcaacgcacgggcactcacctagtagtagaatagtaggagaagaagaggagcaccgtttccaatcaaattgtcttgttaaatttatgcgatcgattattttcccatatgatattttgtaatcactttgtgatgatgttcaattcttttcactcttgcactgttggccttacaaaaaaaaaaaaaaaa

SEQ ID NO: 13641 - DNA, 624 bp, Zea mays
cggccgggggtccttggcgaccagcccgggaacagtccgtatattccgctcataattcctcaccggcctgcctcagagagagaaaaagcggagattagcggcggcgatggcactcccggcgtcgagctccggcctcttccgcttcgtctccccgcgcagccgcccccagtccaccgacatcgtggctgccgcctcctggggagtcttcgccggcaccgccggcctctacctcgtccagccatttgactggattaagaaaactttcttcgagaaaccccaaccagaggcataaaaggcttgcaagtctgcaactttggtacttcacttttatccgggatggttcctgactgaagagaacttggataactcagcaaataatacgagaccccctcgtgtttccttgtttgttttttattattcagatgtaggcaatccccacgagggagacagggaacagagaaactgcttggttcacctgtgtctatataatactcctgtattatccaacatgcatgttttaaaacctgtggcaaatatatcttgctgattaatattggactaaaaaaaaaaaaaaaaaagcgcccaacaccgaaaaaaaaaaaaaagcggccggcccctagggcc

SEQ ID NO: 13642 - DNA, 932 bp, Zea mays
  misc_feature (868)..(868): n is a, c, g, or t
  misc_feature (879)..(879): n is a, c, g, or t
  misc_feature (885)..(885): n is a, c, g, or t
  misc_feature (893)..(893): n is a, c, g, or t
gcatgagggagagaactagtctcgggccgtttttttttttttttgcaactgaatatcaaaagccttttttttattcatgcctcagtaaaactggcaggcaacctgaacagttgattgtaaataatgaagaaacctttcaaaacaataactaaaaaaagactaaaaaatgaaacaatctgagctctaattctattattaccaatactttgacgaacttgtgtgacgaccacttgtccatttctgtatccaccaactcaagctagttaaagaatcctaatcagcagttcaacaaggtattgcctgatagatgaagatcaacgctgcttaaggttggtaactgttttccgcagtctctccatcacagactggaccttgtctgacatcttctggtaaagccatctctgggcggcctcgtccagcccatccggtgtaatggccggccaccccttccgttcagaggatgagtcatggggtaccgttgatgcttcttgcttcaagcttggcaagtcaaactctattggctctccaacaatgatatctatcttcttactgcagagtggcaccggtggtcgccgtccaaagaacgagttttctggcatgaccttttcgaaaccagagtgaacaattggcaaaactattggagttataggtgctcggacaataagactggcagttccccacttcaatcttctaatcggctgatcttcttgggctatttttccttcacggtatgtatgcagctgtttgaatatgtcatgataaattttggaattaaatagagggcagaatccataggcaggggatatggcatctgttgctaacagaaagatcagtacgtaattgtaaacaaataccccatacccagctncatttctaagncgtcangggcttcntcatgtgtcttgataatccacccctctcgtgattggatg

SEQ ID NO: 13643 - DNA, 2201 bp, Zea mays
cattgggtaccgccggcccggccggggcaaaagcgcccttcagctcccggaccgcttcccctgagctgctgcccaacaagaacttcgacaccacttgcccaccctctccctggattcttgcggctcttcctcgagctcatcgaatccttcatggagagcgccgagggaccgtcgccgtactccggtgatcgagcggcaccggttcaggatggcaatggccaaactacacctgggcataattcgcgaaggccaaacctttctttgcaaataccagctaggaccttggataccaatataccttcatcgacaagagttactatatcctgcagccccagttcaacgagagtgggtttgccaccgagacctaattcgacgagaacaaaatcatctatcaagaacatgaatcctcagcacagtttcagagcaaggagttcagcccaggaaggtgatcgagtggtccttctaaatcctgggacgtcatctgaagggcagcaggataatccaagcacagcaagatcattttcttttagaaaggtcattaactcattatcggcaaaaaggacccattctcttccagtaacgcctgtaggaactactgacaaggctgcatctcctccaaatcaattagataccctgccaactacaactaatgaaggagttgaagcaaaaattaggcgctcactttcagtacctggaaatcgcaaaaacagaagtttgaggagggcagattcattaggtgtcatccgtgtgattccaacaaccccaagacctgtcccagtcgaagcaaccacatcaagcgatataattgaagaaacaatcgatgtccctgaagatggaggcgaagatattcctgaagaagaggcagtctgcagaatttgttttgttgaactcaacgaaggaggtgaaacacttaaaatggagtgcagctgcaaaggagaacttgcacttgcacaccaagactgtgctgtcaaatggtttagcatcaagggaaacaagatatgtgatgtctgtaaacaagaagttcagaatctgccagtgatgttactgagaataccaactcaaactgcaaacaggcgggtagcaaatgctgctcagcagagagcagctcaacaatacaggtaagattttggcaggacattccaattctggtgatggttagcatgcttgcgtacttctgtttcttggaacaactcctggttactgatttgcagtcacgtgcactggcaatttcgttgcctttctcgtgtgtgttaggcctcctttcttcaatgatagcatcaactatggtgtcgaagagctatctatgggcgtatgcttcattccagtttgctatcgttatcctgtttgctcatatcttctacaatgtggtacgaaactcgacttgggtgacatctattgcagataaatgtttgtgtggcactgattgttgtcttgtgattacattcagttgaaagtgaatccacggctcgaggtcttactctcctcattcactgggtttggtattgctattagtacgaactctctactagtagagtatttgaggtggagagctaggaggaatcagcgtttggctcagcaggctgccaatgctgcacagcaccaagaatctggaaatgatggtggaaatgacaacgatgacgctcagcaagggcacgatccaaattctgggaacaatgctgtgtgatgattcaggttcttggtgcaaaaatccagcaccaaaaaaaagattatgaaatggtatgggtgtgaacagctgttttttttatctgtacagcaagtatagctcattcaacgcggcaccagtcacaagctgaaacctggaaaaacatatcttcatatgccacgtggagggcgctcacggatatcattatacatcacgcagagatgaagcaaaacacgatatgtttgtgtattagtccggtagtttgacttcaaatgtatctgttattcattttaagcttaatagatctaatgcattatagaagtacttcggtaagtgtgtgcagcttatagttgtgagttgcgagtatagccccatatagatatacatcaatgaaatgtacctttccagtatattgaggtttgctagccggcacggaacggaagaaatcctcagattgaattgtgatacaattgtctcaactgagaactacagaattgtatgcaatgcgagcgattgatataccctgcttctcgaatct

SEQ ID NO: 13644 - DNA, 5461 bp, Zea mays
ccctcgaggcctgccgggataattgcgcattgcctaactccggctgttctcgaaccccacggcggccccggaccgcacccaatgtacgaacacctccccgcgttcccgatcgcgccggccgccgtcggcgactgccgcggcatccccttcgacccttcctttctcccgcgcctcctcctctccgccacctcctgcacctcccccttcctcgccgagcgcgcagtctccgccctccacgcgaccggtctcaagctcggcgcgctcccctcctccctcccggcctcgaacgccctcatctccgcctactcccaagcggacctcctcccctccgccctccgcgtcttctccctcctcagccacccctccaccgcctcctacaccaccgtcctctccgcgctctcccgccacggccgtccccacgaggcgatctccctcttcgccacctccgcgtccgcggtcgcccccgacgccgagctcctctcctgcctcgtctcatgctgccgccgcgcgtccgccttactccccgcgcgcgcggcgcacgcctacgggatcaagaacgtggcggcgctggccttctacgcctcggcaggtccggcgctggtcgccttgtacgcgagccgcgggaaggtcggtgcggctaggagggtgtttggctacatggacggcttggacgtggtgtcctggaacgccatgatcggcgggttcgctagtgccgggatggacgaggagtcgtgggcctgcttccgggagatgcactcgagaggtgttcgagggaatgcccgcacagctgtggtggtgctgggatcttgtgacatggagtccggcaggcaggtccatgggactatagtgagtagtcatggtggttcttcaaacgccattttgtggaacgcgttgatgagcatgtattcgcgtgccggctgtgtcactgatgcagagagggtgttcatggagattgtaaagaaggatgttgtgtcatggaatgtgatgataggagcgtttgcgaagaatggatatggagaaagggcccttgaatttgtggacatggtgttgcagtgtggtatgaagccagactctgtgacattcacggccgttctcatggcatgctgccattgtggcttggttgatgaagggcttgtactattccagcgctttgtgtcagttgttgggctcgttccaactatggaacagtgtgcttgcattgtggacttgcttgcacgtgctgggaggtttctggaggccttggaatttatcggccagatgtcagtgagaccaaatgcagttgtctggggtgctttgctgtctgcaagtaggatgcatcacaacgtggaatttgcaaagattgcatttgaacaactggttcaggtggagcctgagaatgctgggaattttgtgacaatgtcaaacatatatgcaaaggctgggatggtagaagatgcaaagagagttaggatgatgattgatagtgtagagttagcgaaaccttctggaaaaagctgcgtggaaattttgtagtaaagcataagactccatggatttgtcagggtttcacatcttcaaagaggaaaggattgcaacagggcagaccaaatcatgcgattagtgatatgaagagatttgaagtgcctgcatgttttgatgcaaccaggaagctgactgaagatgaatatcagcaaatgttaccacaacagatataataaaacttatccagcaacatatactgatctccttattacttcacatgaaatggtggcaaaataaaacgtatccaggatgaggatggagtcaattcgaaactgctgccgttccctgcatgcataactcatctcccagcacccatccgacaacaaaggattgatatggagaaagggctccttgaacttgtagccaatggtttgtgacttttaaagacaattatgcatcatggacataattttatctagttcttagttttgatcattcgtgaatgttcttgtttctaatgagagctatctcactgagtcaccaggtcgtgacttcaaagcagtctctccatatttgcaacggaagacttttttgcctcattctctagacctcactcatgttggagcctccgacattgggtccgtcctgcctcaaatgttcttgtctgagagccttcatagatgaagggtatttattcagtgatacagtagtggggttcattatctgcaccactttgatcaataaattaatgttttatattcacatacaagcttcttgttgtgcatgtatctattgtttcttttggtaaaatcaattgtgacacaaatctaggctttgactgttttgttgcccatcctgattcttatcttcagcgaaaaggcctctagccgagttggttagatggtccgagtaacactccttaggtattgagtttgaatcctagtaagagcgaattttaggctgagattaaaaaaggtcactcgctgttcactggtcgtgtgcacacgagatggactaacctatggagacggatcctcgtgtaggggctaggaaggttcaaagcacgagtaaagatctggcatatagggggcggtggaccaactttcgtgacctttctcggtcggggatccgattaagcttcttcttcatttaataccgtaggggcggtctttcccctaccagccgagtttttgattcttatcttcaatgtttcttcttcagttagtaacaaatttgttgagttgcggcttgaaaggatggcagacaagaagatcaaagggactgattcatcttgcattatctcttccacaaaatatttgcaaagttcagtagggcctaagctaattgaaggtactaatgaagatgattcaggaggcctaagctaattgaaggtactaatgaagatgatctcaataacctccagaaaacagtaagtcacagtgccaattttgtggcatcgatgcagcaagaacatcctataagccttgtattggctgagaacaaaagcaatttgcaagaaattttagttgaacagaagattcctacaggtgtttctatcaatctttcaccaaaaatggatagcagtgaagtgccacgcaaggcttatagcagtgaagtagatgacccaaacacaatgaaatcaaacacatctagttgcatgtttgaggcatcaaagcagcaagaatgccctataagcctcattttgcttgacaagaaacgcgatttgcaagaagtttgtgttgaacagaatgttccttgtggtgattatgttgccctttcaccaaaagcaaacagtagggaattaacatcagccaatgaggttcctgatggttttttaactttctctagaaaggcttatgaatcaaaggaagcccaaggtgattatatcacattggaagcttcagaagtaaatatatgtgcagcttcacactccatgcttaggttaattttaggtgtccaggttgaggcttcttgattgattctggtaaggttacttatgaaacaccacctgccatcatgaaaagggtgaaagaagatagaccactgatcgcctacagatttcataagcgccaaatgagcctaggagacacacggcactgagcagatcataacaccagcaagtacttaagaatgcataaaaccattgttcatactacgactcccattgaatcagtgaaggttactgcttcaaagttgggtgacagcatcaactagaaaactcacaggacacacgcagcacaggtaacttagaactgctatcccgtcctcataaatactttttatatgtattaaactgtaatagctctgcgacatacactcatttgtttctataagcaagaaagtgaccatatagtgcttgggtttgataaactaaagaacgaaatttcagaatgtaaacatcaaactgaagctgcaaaattatcagtattaaatgagctgcagagaacaaagaaagattctcgagatggagcccgctaaaaactgtagatggaaaagcttccgcaagatgatgtggtgcggtggtgccaagtgctgctattaattatgcagtaaaggggattaggtattcacaattgtggttttgtggtgatttcatggatatttaatagtgtgtcacatcaaaatttttaatgacatggtataacctttaagatgattgagttttatgagataaaattattttcatagggatgaaatcatgttaactcgtttccaaggtcttagaaacagtatgaaacctctattaaaagtgatttgttttatcttcacacatcttactaatttcaattagctattgagttgtaacatttaattgatatgttagcctatacaatattcttagtgaaatattatattgagagacattgttttattcataacgtttttaatgatgtagcagcgttggaaagagtgctatgaaattcttattgtaaatagcctttaggacaggaccacaggagcagttcagcacatgctaccacactcactggtactgttttgatctcctgattgcttcacgagaaatgaaggcaaaacaaagcttctcaagatggagtccactgaaaactgtagatggaatgtttttttaaaggaactgtaaatggaaaagcttccgcaagatgatgtggtagtttcagggaaagatgctgttggggaccttcggcgtccgaaggtcctcaaaaacaggatttaacagtatttctgcagtacaatgtgtgaacaggtatcctcggactaaagtcggcattgcaatagaccggagttatacgaaggttgacacagagccgaaggtgccgagcaggaaagcttcggcgtaacagcaaagagtggaaccgacttaaagatgaaaaggctattcagacctcgatagactactatagagttattatcaaatgtaaagggcatgaatgtaattttgtaagggctgtgtcccgtgtctataaataggtgaacagtatccccgtactgttcacgctgacttggcattcgctttttgcgtcacgcttgtactgtcatttccttccgattgaaggtacacttgtagttcaataatatttccgtttatgctcgataataataaatgattgttcatgttttcttttacattctttatatttcaaccttcgtcattgtttgatgaatttatgaaggtatgtccttcataaccttcgtccgcaagtcgttatatcctaagggaaataatgcttcggaggacgaaggatattaacgattaacattttctatgttgccttgttcttaactcttagcacttaagaacaagtccccaacatctcccctttggaagccaatgccatccttgatgccagggtgtctcccactatagagcatactacgagcaaatttaaatttttcattctctaagttatgctcggcaattttagcatctaattttgctatatgatcattttgttggttaattaaagacatgtgatcatgaatagcattaatatcaacatctctacatctagcacaaatagat

SEQ ID NO: 13645 - DNA, 1952 bp, Zea mays
gacgactctgcatcgtgaggcgaaaacgataacggggtgggacccgcagggccgcagcaagatgaggaaagatgaggaggaggggacgagaggcagcaagggaaggcaacgcgccgtcatctcattctccctcgcaccgacgaggtcaggtcagagaccttcgagtactactagtcatggcccgcatctagaaggcagcaagaaagggggcggatggggcgcgcgttcgtgtacgtgatcctgggcggcggcgtggccgcgggctacgccgcgctcgagttcgcccgccgcggtgggtactcccgcggagagctctgcatcatctccgaagaggccgttgctccttatgaacgtcctgcactaagcaaaggctatttactcccagaaggtgctgctcgtcttccaggatttcatacttgtgttggtgctaatgatgagttactgacaccaaaatggtacaaagaacaaggcattgaacttgttcttggaacaaaagtgatttctgctgatgtgaggcgcaagacattgcttacaggcactggtgaaactatcagctacaaaactctaattattgcgacaggtgctcgggctttgaagctgcaagaatttggaatacaaggttcagatgcttcaaacatatgttatttgcgcaacatcgatgacgcggataagttggtgagtgtgatgaaatcatgtcctggtggaaatgctgttgtcattggtggtggctacattggaatggagtgtgcagcggcattggttactaacaagataagggtcaccatggtcttccctgagaaacactgcatgggtcgtctatttacaccaaaaattgcagaattttatgaaaactactacacctcgaaaggggtcacctttgttaaaggaactgtgcttacatcctttgaaaaagatacgacggggaaggtgactgcagtaatactcaaagatggtaggcaccttcctgctgatatggtagtagttggtattggcatccgtgcaaacactagcctttttgaaggtcaactgatgatgtcaacagagaatggtgggataaaggtaaatggacagctgcagacaagcgacagctctgtgtatgccgttggcgatgtggccgcgttccccatcaagctttttgacgatgatatccgacggctcgagcatgtggactcagctcgtagaactggtagacatgctgttgcctccatcttggatccttcaaagacgagggacatcgattacctgccgttcttctactccagagtgttcacgttgtcctggcaattctatggggataatgtcggggaagtggtccactttggagacttcacaagcagcagtccgaggttcggtgcatattgggtcaacaaagggcggatcgcgggtgcgtttcttgaaggcggaagtcgggaagagtacgaggccatctcgatcgctgttcggcgggaagctgtggtcacagacatgggtgaactcgagaaacaaggcctggcactcgccattcaggagagccagaaggaggtgcctgacagtgggcttgctgttgtcggaaaacctacttatgcgtggcatgccacagctggtgtcgttgcagctgtgtcgatcgctgcaattgggtattggtatggcaggaagcgccgcaggtggtgaggatttgcattggggcgattccctttggtctgccgggccaaactgctgctggcggaatatctgggacgagtgctattggctgttaatccaagcatagttgtatagcgtgtatgagagtatagtctgtcgcaaacgtatactgaaatacagatgcctcgtgtattatctagtgaagaaaccagtggctgcctctatctcctcaggggttctcttgttgtaaaattgcaactcttttctgaatgagatccgcaattttgtggcaaaaaaaaaaaaaaaaaaaaacagcggccaaaaaaaaaaaa

SEQ ID NO: 13646 - DNA, 4279 bp, Zea mays
aattatgaacttaatttgtctgcagtgggtcgtctatttacaccaaaaattgcagaattttatgaaaactactacacctcgaaaggggtcacctttgttaaaggaactgtgcttacatcctttgaaaaagatacgacggggaaggtgaggtttcataatttcagaccatgaaactggaactgatttgagatatatagttcccaattttacatttattaccaagtaataaaccatagttgtataaccaagttctggtcctggtccagaaacctcttcttcagcagttcctttctgttgtttggtagaggtttcttctagtgcgtatggataactattcaagtcaaacaatttcatctgcctaaaagtcattataatagaaattttttactattttttattgattgctagcaataaacccggtttctgcttttctcgagagattttctcaaaaaatgttattaacttggtcttaatctcgtctcttggattcacttggactcagcctgtatgttatggggataaactatacagcttttgacaccttggtactgcttgcttaaattgttgataacactgtaatataaatggcttgttctgaaggatatgctatggcaacaatggtaccgatgagcttgcctggattcatcaatccctgttaatctttttcttactgtatcaagcatatttagtcaatcaagcatattttgctctcctattttaaagcctagcacttacaatctggccaaagaatcttcaagcagtgtcagaaatagttaaattgataatcctaaacagttcaactctctccctccatcctaaaatattatttggatagcccctaaactaattctgtgttcaattactcccaaagatacttcagttggttcaatccacccttaggtaagatttttttttgtttctacacattcaatttgagtattagtttcaaattttatggggcaatagttgacatcataacttatgttagaaaaataggaccaggtcaattcatcgttattatttttgcataaatttgtatatgtagggctaatttataacttcctaacctatcaaaataattacgaaaatttgtgatgtatttttccaacactagaaaatgtgcccatgtgttgcaagaaaacacaatacatatatgaatcggctctatcaccgttatgtgtgggttctaaattgtatgagtgctgatccatatgcgagatacggatggtgtgatccaatacatactggaattagatcatgtatcaatcatcactagacgtgagtttttctaactcttatgagttgtaagttcggatcgaatcaagaaaaaagtgggatgaaagaaactatgtatagttattgggggggggggagggggatacaaaaagtgggatgaaattttggctctttaatattaggtatagataagttacgatgtcacctatcaccctagaaatgaacttaaaactcgtatgtggagaaacagaaaaaagaaaaatcttgtggacgcgttagattactagattgaaccttttgttccttaaaaaaactggacttcttccataataatatttccaggcatgcacaggtgactgcagtaatactcaaagatggtaggcaccttcctgctgatatggtagtagttggtattggcatccgtgcaaacactagcctttttgaaggtcaactgatgatgtcaacagagaatggtgggataaaggtaaatggacagctgcagacaagcgacagctctgtgtatgccgttggcgatgtggccgcgttccccatcaagctttttgacgatgatatccgacggctcgagcatgtggactcagctcgtagaactggtagacatgctgttgcctccatcttggatccttcaaagacgagggacatcgattacctgccgttcttctactccagagtgttcacgttgtcctggcaattctatggggataatgtcggggaagtggtccactttggagacttcacaagcagcagtccgaggttcggtgcatattgggtcaacaaagggcggatcgcgggtgcgtttcttgaaggcggaagtcgggaagagtacgaggccatatcgatcgctgttcggcgggaagctgtggtcacagacatgggtgaactcgagaaacaaggcctggcactcgccattcaggagagccagaaggaggtgcctgacagtgggcttgctgttgtcggaaaacctacttatgcgtggcatgccacagccggtgtcattgcagctgtgtcgattgctgcaattgggtattggtatggcaggaagcgccgcaggtggtgaggatttgcattggggtgattccctttggtctgccgggccgaactgctgctggtggaatatctgggacgagtgctattggctgttaatccaatcatagttgtatagcttgtatgagagtatagtctgtcgcaaacgtatactgaaacacagatgcctcgtgtattatctagtgaagaaaccagtggcggctgcctctaactcctcaggggttctcttgttgtaaaattgcaactcttttcttaatgagatccgcaattttgtggcactgctggtcactgttcttaactatctctgtttgccaaaagcttttgcaaatccatatattcagcgaagaagtgagctatgaatggcaatgtgtatgtccagacctatgtaaccatcaaaagcatgtatagtttgtgttcaagcgcgcatgcttgtgtactttccattggggctgtcatttatggaattatagagctacaatcagtatggtactataatttacgtgcaacttagattcgtgaacttgatattaaccgcgcaatttttgccagcccgatccgctggtccatagaatggcatcgaactgtggcagcaaagaagcgaagaaggatgaagattattgtcttcgccaaaaaaaatacccacatttcccttgtcggcgacggaaaagaacggcaggcacccaccgatcgggtcctgcaaaaggtggaatacgagggaaggcattgtttcctgtccacctctctggtccttgaaagccaagaaccgcgccggcgcggccagtctcctacttaaaggagtagtcaaggtcacccatggccattcagggagagaaacaacaagacgtagggacagcgccaaggaaccagatgggccgcgcgttctgttacgtgatactaggcgaaggcgtggccgcgggctacgcggcgctccagttcatccgcctcggctgcgaaaccgccgcccaagccggagagttctgcatcatctccgacgaggccgtacgcttatgtgccacgctcacgctctgccatttgctgttcaattgagcatgcaaagctcggcacaaagaatcgctagctgttgcactgcgatatagccaggttgcaaccattttcattctcccgtcgtcactttggcaggttccaccttatgaacgtcctacgctgagcaaaggctatttgttccccagaaggtgcgtacgttttcaatctccaattatcttaaagtctaaacatgcgcggataaccttcgtcagttcactcagcgcttgctgatcgtgcatcgttctactaagaactgcgcgctagcatgccacgtatatagagctcaaatgatttgggtcttgaaatatactggaactttggactttgtcacattcgcagggggtgctcgcctcccagcgtttcatacttgtgttggtgccaacgatcagttacttgatgcagattggtacagggaatatggtatgcgcgctccggccaatgtccctatgtttggttagatctcaactggaagtgacgagagtcagcgttaccacttgggcaggtatcgagcttattctcggaacgaaggtgatttccgtcgatgtgcgccggaaaacactggatacttccgccggggaaaccatcagctatgaaaggcttattgttgcgacgggtgctcgggtatgtccacatcctatctatgcttgcccgtgctattttttttttcttccctacatactctgtgcgatttcttaccggccggccggatgctagagcatgctattttgtccttttaaaaccgtaggccgtgaagctggaagagatcggagtgaacggcggctcagatgccgagaacgtctgttatctgcgcgacatcgcggacgcggataagttagtccgtgtgatgagatcatgtcctgctggcgccgacgccgtggtcgtcggcggcggatacataggaatggaatgtgcagccgctctggttgccaacaggatg

SEQ ID NO: 13647 - DNA, 5566 bp, Zea mays
  misc_feature (5491)..(5491): n is a, c, g, or t
tccatctaagtctatcgtaagggaagtgaagagaaggccaccgctgtaaccagggaagaaggggaacaagaggaagagcatccaatggccagccattgaacatagttcatggggaaggtcctttaaattctagcaggttatatccaaatgtactttgacatgtaataaaatgagctgtaacgccatgtatggatatggccgtgcatgtgactattacagttgtgtagagctttagtttttattgaggaaattgtattcggttcccatgcctgcagagaagatggtacactccgttggtaggttgtgttattcagtacctttgttaggccctgctgtattgatctgtcggccagtggtgtttaggtcatggtattggtgcatgaatccacggatcatccagtacaaaacatggatggttaagcttttgagtgccttttgcttttcagcaacggtggttggcattatctaatcgcctcaacgccttgtggtgtgcagagcaaaaggtcaactgacgcaatgacaaaagggctatacctatactcatcggcaactggatcgatgggacttgcaagcaagagtctctcagtttacagaaaagaaaaaaaaaataccacaaagcgacctagaggaagctcagtgtaattaatgtaagtgaacttttgtctgtcgattttggtacagggagcagagagatggtaataggaccgcgtaatttacagagacaaattaccatttccttcagaagataatacagtttctggaaacacgaacggttggtaggtttgttctacaaagcagtggacaagtacgtagatttataaaaggaaacgtctcgttctcttatttaacatatcctttgcaacgttcctttttctttccctgctttcttattctttctttgtgtagggataaagcaaaccgagtcactgctctttataaacagatcccgtgtcacttcatgcaaaagatatgccaataaacaattgcattgcattgtatgtttaacctactgaacaaaagaatgccatgagcgcatctagttacttgccctcaagtaattaatagacattggggcaatgaaagaaaaccatgctgtctttattgctcaagtttatgctagtgccaacggaagcagatcggtttgattattagacgaatggatggcttgtgagtttttgatctgcatgtagaggtgtgatcgtactgctacaaattgcttacaggatcataccaaaaaaaagggaaatcacgctaatttcctgccggcaaattgttacagactcacaggcaccacctactgtcacgggcaggtatgggttgctgacgagagaattatgggtctgtccatattttgcttaacttttctatataaagttagttctttaattcaaatgaccaacattatttaaagtatgacataattagtcacgaaccaaaatagactatgtaacctttgctatccaatccgcagagtggcagtcacagtacttcactgggatgggatgatgccttccaatctgcgcatctttccatgggtcacgtagccacggcaaaactaatccacatgctaatcaggggccactggtgcgatcctgcatccggttcgggtcttgtttgtttacaccaatctaactctaggttaacatagattagaattaaatccatatcacaattcacgctcaaaataatttaagcctacttaattttttattcggttaagtccatcatggattataactcgagggtttggaatttttttaaactagagaagatatgaattctatccatagctcattaaatatagaacaaatatataaagatattgcacaagtttatattagaattcattgatcaaaagaataactagcttcgatagatacatgaattaaatgatggatttaaacccgttatgagattgagtgcgatgtatgaattcaatctatggtgggatttcgtcccgggtaaccgaataaggccttattttatgccaatgacacagcacaaaccgattggaattttagtggagctcatcggatcattggtgaatcgcggttgttggaaaaggagatcgcagccatcattattcttcaaacgaactgcatttccaaatccacgagctactacttagctcgccgcctggtggcctagctagctgcttactggcttatactcgaagaaagtaagcaggcgatggaccgtgtgtggagtggaggaggatgcatcagtgcttgcaacgacttgttaggctcaactgtatcggtttctggttccgcaaccacatggctggctggtatcaactgcctctgttttgtgtacgccatactgcaagattgcctgttcttcttcagaaagtaggagcgactggtagacctatgtgtggtgttgaactcagtgttggagctgacagctgagtacaagaaacatccacagcaaacatgaatgcatgcatgatggtggtatggagggagaccaaaggctgtcacagttggaccggacgcacatagctctagcccttttccgctgctggtctcgtcactggatctccatggacagaccgagagcactggtccaggaccgcaggctctaatgagtgagactgctgcaccagtgtgacaggattattaccggtctcctcgtgagcgtacagttcggacaccgtgtgacaggtttttgacgaacactcaacactactatctcgtcgttttatcgatatcaccttggggaagattattgcgtttgggagcctaaaaaaatatacgtacgaaatatacaaaaaaaaagtttatgtaaatgaattccgcagacggtgcagagtgatgcgatctaggacagtctaggtttcgcctgtataggacgagtaagcttcaagaacaatcagcagtttgtcccgttagttagcgcttgagaatcattcagaaatgataagagacctgtcacacatcaccttggtaatacagttaccacacgtccgcgccctagcttggagatgacgactgacgagtcaatagcatttctgcagttccgcgggtagcagaccttaatagcgcccaaacaatggtagattgagatgagagggggggaaaaaggaaattctccaggtttagatgacaaaggacttgttaaccgaacttcccactagcaacgactgctagctttgcggactcttacgccatgcaactaacgaatctgccgacccctgtcagtatgttcccctttcaccttctgtgctcaaggagtcggagagaaccacacgaatcgaagtgacagcaactccagatctgagttgtagctagccaggaggtatctcgtttcgataagcccatgaatgaatgaacaccaaacgatggaacgtggagtagttggtgaaagggaagcaaagcagaacagaacagaacagaaccgggcgccgccgggaacagctgggcggcacttgagctgtgactgtgagcacccaaacccaaccaaaccgtgcgtttcagctggaggcgcgcacaccggaaagcgcaaatgggcaatcgcttccttgccgcgtccggcgtcccgcaccaccgcaccgcgccgcaccggactaccacacacacacacacacacacacacgaaaaagcctctcctcctcgtcgccctaccacacgcaccatcatcacacccgcccgccccgaggctgtaaaaaaaacatcggcgaaatgcgctcaaaaggcctcgtccctcctctcatctcgcaccgttccccgacgcggtcggtccccccacgtagagctaacgaaccgaagcgcgccataatatattgcagggcagcgcagcgagcaaaaggggcgcttcttccatgatcatcataccataccaaaaccttccacaagcttcagggcaatcttgtgcggctgtgccccatccaagctgcttttgtgctgctttttattcattttcggattggtttcgtttagtttccctgctggtctagtagagcgttttgcgaggtaaaaggcctgagcatttcagaagtttggaagaaaaaaaagatgcccctggatttttgaggtgggcatgagtggagagtatacagggcagagatacagccatacaggtccagcttgctgctgctgctcctcctctactcctgccattgtttagtacacgcaacaagggttcgtatctgtgccttacttctgaggaggggtggtcgagaattggttagcacagatgctgctagggagaagaaggctcctccttgtgtgcgcaagcctcgtgcttctttcactcctcgggccatccaatggcgcatcgaactccacggggaataatctcggcgagagccgcaacaggaccagcagccatcctctggaggtaaattaagcagagctccgtttccagcctccgtctttaggtcttccagtaacactcggatttctggttctgattctgactgagccatatgctggctgggaaacacaaacaaaccttccgtttttactgagcgcacaggttgcttgccttttttcttccaggtgacaccgggagtgtcgttccagctcaggctgcacgcgctgttccactggtcttcgtttgggttcttgatgcctctggggataatcctggtgagaatgtccagcaagtgccgcggcggcagatgcgtcagagccctcttctactgccatgccatctcgcaggttttccttggggtcctgagcgtcacgggttttctgttctactgtttcttatattcttatagagcgcgtcagaggataacacgtcaggtaaggtaacccaactgagttcgattttgcatgcagactgtggccgtcctcctcgccaccggcggcgctgttctgtcgctgatgaacttcgagaactccttcagcaacagccaccaaagagtggggctggcgctgtatggagtcatgtggctccagccaattctcggcttcttcagaccagaaaggtagaagaagaaaatatatgactttccaatccatttgcaccacagctacctttttctatttcttccaagaaagcttatgcctagctacctacacggctacaccaccatctaaaccatctccttcctcatatatttctgcaggcgcgccaaggtgaggagcctatggtacttcttccactggctcctcgggatcgcgatctgcgccacggggatcgtcaacgtctacatcggcctccgcacctaccacgagaggaccgccaagagcgtgaggctctggacggcgctcctcaccgtcgaggtcgccttcctcgccttcttttacctcatggtagacagatggagctacatgctgaagcaaggccgcgccaccgtcgagcagctaataaggccgaccgatagccgcagaacctacccgaccacccttcggaaggagctgaccgtggtgcaggagtgagtgaatctccgaacagaaaggcgagaggtgctttcagacttgctgaagaagacggtagagtgctgctgatggtcttttgtggcttgtttgctttgagagangtgtggagttctttaatttagaacatgtctcatgtgactgagagcgtgcattccggttccagaatgtatattgta

SEQ ID NO: 13648 - DNA, 2535 bp, Zea mays
  misc_feature (2447)..(2447): n is a, c, g, or t
acaccaccacgcagcagtgcgcccagcctatctaccccccacccctcgaattgttcccatggccgccgccattcgcggaagccctacccgcgccgccgcgccgacccagcctcgcgcggtgctgcgggtggcgtcgtccgccgcgccagcctcctcctcctccgcccgcccgcgcaggggcgccgtggcagaggccgcaatgcagccggccaaggcggtcgccgcggaggcggcctcccccgctgccgcgctggagatggggaacggcgccgcggtcgcggggctgcagcggcccgacgccatggggaggtttgggaggttcggcggcaagtacgtccccgagacgctcatgcacgcgctcaccgagctcgagaacgccttccacgcactcgccaccgacgacgagttccagaaagaacttgacggtattctcaaggactacgttggacgtgagagccccctttacttcgcggagcgcctgacggagcactacaagcgcgctgatggcacaggcccgctcatctacctcaagagggaggacctcaaccacacgggcgcccacaagatcaacaatgctgtggcgcaggccctgctcgccaagcgacttgggaagcagcgcatcattgccgagacaggggctggccagcacggtgtcgccaccgccaccgtgtgcgcccgtttcgggctgcagtgcatcatctacatgggcgcgcaagacatggagaggcaggcactcaatgttttccggatgaagcttcttggtgcaaaggtgtagtggctgtacattctggtgtctgctaccctgaaggttgctccttctgcagttgtttttgacgctagtacttgtttcagaaaagcattcactatcagtaattcagtagcatgtaagttgttagatttgtgaatcttttccttattgttcctttttttctgaaacaggtgagggctgtacattctgggacagcaaccctgaaggatgctacttcagaggctatccgtgactgggtcactaacgtggagaccacacactatatattgggctctgttgctggcccgcacccgtacccgatgatggtgagggagttccacaaggttatcggcaaggagacccggaggcaggccatgcacaagtggggtggcaagccggacgtcttggtcgcttgcgtcgggggtggatcaaacgccatgggcctgttccacgagttcgttgaggatcaggatgtgaggctgatcggagtggaggcagctggccatggcgtagacaccgacaagcatgcggcgactttgacaaagggccaagttggagttctccatggatctatgagctatttgctgcaggacgacgatgggcaagttatcgagccccactccatcagtgctgggtaggttttctttgtgtttacgctcacaagactgcaggatggtgtgggctaattatccatttttttgaatcagactggattaccctggcgttggacctgagcacagtttcttgaaggacatcggacgcgctgaatatgacagcgtgactgatcaggaggcactggatggtatgtgcctcactccctttccatcttttgtatcgattgaactaatttttaacaagttgttgctgttagcgttggtgtcagctttcagtgccttgacatctgtatcaatcactaacttttataaataacacacggacattctgtttttttcttgatctgaaagagtcactagtgaacgcgtgtccaaatctccacagtgtgcttataccagtacaactgcactgttttgtcatttgtgccagaatttattttaatacacctatgtgaattatctcaaacgtggcgaatcagcaagatgttatcttaaatgattaattgtcatgtatttggttgatgtagccgttcaggatattgcaatgccaataatatagtcgtagcctcctaggttctgctcagtagatacgccaaatgtttaatatatgccttattattgagctgatgctgattttttcaataaccaaacttaatgttaattcttgagcactctgtgctatagatcggagattagaattagcttacaaatcaatagtcctcagatgtgacactaaatacattgcggactgttcagcatacataaggcctgtagttttttttctctctccctgaacaattgaggaactgtctcaacagctgatttagtattcactctgtttataccctgaatgctatgtggaacatctaatcgcatggctactctcgcatgcagctttcaagcgcgtctcccgtctggagggcatcatcccggccctggagacctcccacgcgctcgcctacctggagaagctgtgcccgaccctgccggacggcgtgagggtggtgctgaactgcagtgggcgaggcgacaaggacgtgcacaccgccagcaagtacctggacgtctagaacaccggagagganggctgaatgagagttttgcatgccaatttttgaagggttcagcagttatgtagcgctgttttttttgtgataagagtacaaataacct

SEQ ID NO: 13649 - DNA, 1759 bp, Zea mays
acaccaccacgcagcagtgcgcccagcctatctaccccccacccctcgaattgttcccatggccgccgtcattcgcggaagccctacccgcgccgccgcgccgacccagccgcgcgcggtgctgcgggtggcgtcgtccgccgcgccagcctcctcctcctccgcccgcccgcgcaggggcgccgtggcagaggccgcaatgcagccggccaaggcggtcgccgcggaggcggcctcccccgctgccgcgctggagatggggaacggcgccgcggtcgcggggctgcagcggcccgacgccatggggaggtttgggaggttcggcggcaagtacgtccccgagacgctcatgcacgcgctcaccgagctcgagaacgccttccacgcactcgccaccgacgacgagttccagaaagaacttgacggtattctcaaggactacgttggacgtgagagccccctttacttcgcggagcgcctgacggagcactacaagcgcgctgatggcacaggcccgctcatctacctcaagagggaggacctcaaccacacgggcgcccacaagatcaacaatgctgtggcgcaggccctgctcgccaagcgacttgggaagcagcgcatcattgccgagacaggggctggccagcacggtgtcgccaccgccaccgtgtgcgcccgtttcgggctgcagtgcatcatctacatgggcgcgcaagacatggagaggcaggcactcaatgttttccggatgaagcttcttggtgcagaggtgagggctgtacattctgggacagcaaccctgaaggatgctacttcagaggctatccgtgactgggtcactaacgtggagaccacacactatatattgggctctgttgctggcccgcacccgtacccgatgatggtgagggagttccacaaggttatcggcaaggagacccggaggcaggccatgcacaagtggggtggcaagccggacgtcttggtcgcttgcgtcgggggtggatcaaacgccatgggcctgttccacgagttcgttgaggatcaggatgtgaggctgatcggagtggaggcagctggccatggcgtagacaccgacaagcatgcggcgactttgacaaagggccaagttggagttctccatggatctatgagctatttgctgcaggacgacgatgggcaagttatcgagccccactccatcagtgctggactggattaccctggcgttggacctgagcacagtttcttgaaggacatcggacgcgctgaatatgacagcgtgactgatcaggaggcactggatgctttcaagcgcgtctcccgtctggagggcatcatcccggccctggagacctcccacgcgctcgcctacctggagaagctgtgcccgaccctgccggacggcgtgagggtggtgctgaactgcagtgggcgaggcgacaaggacgtgcacaccgccagcaagtacctggacgtctagaacaccggagaggagggctgaatgagagttttgcatgccaatttttgaagggttcagcagttatgtagcgctgttttttttgtgataagagtacaaataacctggaagctaaagctagtattgttgtagccgccctttgttctttttttgagttgttgttctgtatctgaaatgttttggagtgcataatgatcaataaacaagtaaataccaaaatctttgtccatgaaaaaaaaacccgaggagtggagaagaataaagtggctcaatccaaaa

SEQ ID NO: 13650 - DNA, 1763 bp, Zea mays
gaattcggcacgaggcgcacggccgcacgcagagcccctgcccccacagcctatctatccccttcccctcgtcgatttattattctcatggccaccaccgccgccgccgccattcgcagccctacccgcgccgccgcaccaggacccgccgcgccggcccagcagcgcgcggttttgcgggtggcgtcgtccaggacctcctccgcccgcccccgaagggccgccgccgccgtggccgcggccgcaatgcagccggccaaggcggtcgccgcggaggcggcctcccccgccgcggtggagatggggaacggcgccgcggcgccggggctgcagaggcccgacgccatgggcaggttcgggaggttcggcggcaagtacgtccccgagacgctcatgcacgcgctcaccgagctcgagagcgccttccacgcgctcgccaccgacgacgagttccagaaagaactggacggtattctcaaggactacgttggacgtgagagccccctatacttcgcggagcgcctaacggagcactacaagcgcgccgatggcacaggcccgctcatctacctcaagagggaggaccttaaccacacgggtgcccacaagatcaacaatgccgtggcgcaggccttgcttgccaagcgacttgggaagcagcgcatcattgccgagacaggggctggtcagcacggcgtcgccaccgccaccgtgtgcgcccgtttcgggctgcagtgcatcatctacatgggcgcacaggatatggagaggcaggcgctcaatgttttccggatgaggcttcttggtgcagaggtcagggcggtacattctgggacagcaaccctgaaggatgcaacttcagaggctatccgtgactgggtcacaaatgtggagaccacacactatatcttgggctctgttgccggtccgcacccgtacccgatgatggtgagggagttccataaggttattggcaaggaaacccggaggcaggccatggacaagtggggtggcaagccggacgtattggttgcctgcgtcggcggcggatcaaacgccatgggcttattccatgagtttgttgaggatcaagatgtgaggctggttggagtggaggcagctggccatggcgtagacaccgacaagcatgcggcgactttgacaaagggccaagtcggagttctccatggatccatgagctatttgctgcaggatgatgacggacaagttatcgaaccccactccatcagtgctgggctcgattaccctggcgttggacccgagcacagtttcttgaaggacattggacgtgccgaatacgatagtgtgactgaccaggaggcactggatgctttcaagcgcgtgtctcggttggagggcatcatccctgccctggagacctcccacgcgctggcctaccttgagaagctctgcccgacactggcggacggcgtgagggtggtggtgaactgcagcgggcgaggagacaaggacgtgcacaccgccagcaagtacctggacgtctaaaacaccagcgaggaggctggtttccatgtcaagttttggagggttcagcagtaattaatttagcgctgttctttttggataaaagcacaaataacctggaagctggtattgttgttgtagccggtagtgcccccctgtttttttattttacaagtaatctgaatggctttggagtgcataatcaataatcaaataaatacaaagcttttggccttattaaaaccacgagacaaaaa

SEQ ID NO: 13651 - DNA, 1556 bp, Zea mays
gtcaaccacgcgtccgctcgcaccgttccccgacgcggtcggtccccccacgtagagctaacgaaccgaagcgcgccataatatattgcagggcagcgcagcgagcaaaaggggcgcttcttccatgatcatcataccataccaaaaccttccacaagcttcagggcaatcttgtgcggctgtgccccatccaagctgcttttgtgctgctttttattcattttcggattggtttcgtttagtttccctgctggtctagtagagcgttttgcgaggtaaaaggcctgagcatttcagaagtttggaagaaaaaaaagatgcccctggatttttgaggtgggcatgagtggagagtacagggcagagatacagccatacaggtccagcttgctgctgctgctcctcctctactcctgccattgtttagtacacgcaacaagggttcgtatctgtgccttacttctgaggaggggtggtcgagaattggttagcacagatgctgctagggagaagaaggctcctccttgtgtgcgcgagcctcgtgcttctttcactcctcgggccatccaatggcgcatcgaactccacggggaataatctcggcgagagccgcaacaggaccagccatcctctggaggtgacaccgggagtgtcgttccagctcaggctgcacgcgctgttccactggtcttcgtttggtttcttgatgcctctggggataatcctggtgagaatgtcgagcaagtgccgcggcggcagatgcgtcagagccctcttctactgccatgccatctcgcagactgtggccgtcctcctcgccaccggcggcgctgttctgtcgctgatgaacttcgagaactccttcagcaacagccaccaagagagtggggctggcgctgtatggagtcatgtggctccagccaattctcggcttcttcagaccagaaagaggcgtcaaggtgaggagcctatggtacttcttccactggctcctcgggatcgcgatctgcgccacggggatcgtcaacgtctacatcggcctccgcacctaccacgagaggaccgccaagagcgtgaggctctggacggcgctcctcaccgtcgaggtcgccttcctcgccttcttttacctcatggtagacagatggagctacatgctgaagcaaggccgcgccaccgtcgggcagctaataaggccgaccgatagccgcagaacctacccgaccacccttcggaaggagctgaccgtggtgcagcagtgagtgaatctccgaacagaaaggcgagaggtgctttcagacttgctgaagaagacggtagagtgctgctgatggtcttttgtggcttgtttgctttgagagaggtgtggagttctttaatttagaacatgtctcatgtgattgagagcgtgcattccggttccagaatgtatattgtacagcttttttcacggttgaattgaggatgcagtctgttgccagcaaaaaaaaaaaaaaaatgcagcatgatactaccatgcttttactgctggtgttcagtatatatatcctgcattt

SEQ ID NO: 13652 - DNA, 1122 bp, Zea mays
gcacgagccggcaggcaggcggtggcgccgcggcgacaccgttccacggttccactccacccctgaggccctgacgcgcggaactggcggtggcgagcgcagctaatggccatccatgccccgctccgcctctgcctccgcctccatgcgaggaaggtagccagacgcgtataaagggcagccagaaattcggatccacctgtatgcgtctccgttcgttcacgccacaggcaaggcacagaggcttgtgagggagagcgaggagcggaggaggacatggtgcacgggacgctggaggtgctgctcgttggggccaagggcctcgagaacaccgattacctctgtaacatggatccgtatgcaattctcaagtgccgttcacaggagcagaagagcagtattgcaactggaaaaggaactacccctgagtggaatgaaaactttatcttcactgtgtctgaccggacaacagacttggtaatcaagcttatggacagtgatacaggcacagcagatgactttgttggtgaagcaacgattccattggaagcagtgtatactgaaaggagcattccaccaacactctataatgttgtgaaaggtgaaaaatactgcggggaaatcaaagttggtctcacattcactcctgaggatactcgccagcggggtctcccagaggacttcggtggatggaagcaatcatcttagagctagatgctttaagggtgcaccagagcacagcgacaattcatgcgcttggagccttcagccgtcgagtacttcatgctaatgcagaattcattcgatttggcttcttttgattgtttcagaagaagtgttattagtgagtttcaacaaaaaatagctccatattgctctatatcccgtattggaaattctaaggccgtttgtgattactgcttacaacaagaagttttgcttctagttcccactacgcttttttttttgaagttttgagtggaacatctttgtgttcaacgtttggggaggtgtaggccagtaatactgcaagaaaggaataatttcccttgcagcaacattgttttttgtgatccttgaacaaaattgttccccaaaaaaaaaaaaaaaaaaggggcggcc

SEQ ID NO: 13653 - DNA, 1416 bp, Zea mays
gcttgcatgcctgcagcatgtctcgtcgtcagtttgctgacggcggcaaacgaaagtagagagaaaatctcttcaatgccatataaacttatactaatcccttcaatgtcatccgaaccatcaaatttaaattttaatcccttaaatgctattaccgttagtttggagttaacgtcgttagtgctaagcttccgtttcgattagcccgctcaacctcagattctctcacattttccacagccaaaacacctacactcctacagtaattccatgaagaagaaaaacaagtgcggcgcttgttttgattccagcgatgttcacggcagcagacaccggctgcactgcaacacaaatgcggcgcttgttttgagcgccatacgagacctttggcgggactgagaagattgcagcaaaaacgagtttggcttgccgcaggtttggtcgcgaagcaaaacggctgcctggaagccatccaaacactcgtggtgactgcaatactttagagtgattaaatttagtcaagacgccaaatgcttttgtctaaaacagacgagaatatctgattccagcagtttacaggcctgccggcaagcaatagtgaagttccttcgctccacccctggctctcgataagctcaaccatggaggcgacgtaaattttcttcagtgaatctggatctctatttctcacaatacagcgcaaatactcttgtaagaattatctgcacatctatagtatgtcaacaattgtaacaatatcctgtaggttactccacaaacaatggcatctctactacaatcatctccaacctaccaaatcaatcacaaaactaccagaacaaaatttcaatgactcgagtgtaaaaagaattaaatggatggatggatggaaagcatataaacttgccaccacacaatatccgcctcctttcttcgtcttgatcaaccaatcactcaatcttctagccttctgaattattctgcgaccaaaggtcagcccagtcccagatctccttttccgcagttacagtatagaaaagaatgatgcaacagtatgatacagatggtaagaattgtgttcccctatgatacagatgaagactcctgagatatttgaatgccagttttcgcaggggatggtcagttgtattgaatgccggttgctttcttgattacctattatacttatacagcagcaatcagcctctccagccaacaagcgaaccataaactatactccctcgctgtgtccagcatttgctgcaaatcactccttgacacgctcaggctccaaaatatggcagtttctaacgaagtcattggagtagtttacatgatttgtccaaaatggttgtaggttcttaaaagcaatgtctagccatggcttgcactggccattgtaatgtatcactgcag

SEQ ID NO: 13654 - DNA, 1873 bp, Zea mays
  misc_feature (4)..(5): n is a, c, g, or t
gccnnggccgggcctgggagtctaataaccatccgacagctcaaggtccggccggcactgccacgccatccagcggcatccatatctgcgtgcgcgacggctatccaggcgccagtcgtccccggattagttgtactgtacattgttcctgcgaagacactgggtcgtccgggtcaatcggcagcttgaacaagccatggcggcgcaccggccgaacgccgcggcgccgctgctcgccaagctcgacgccaccgccacgccgccggcgaagcgcaacaagtaccccttcttctgcgccgtgctcgcatccatgacctccgtgctcatgggctacaacgtcgcggtgacgagcggcgcgcagatcttcatggcggaggacctcgggatgagcgacgcgcagatcgaggtgctctcgggggtcatcaacatatactcgctcgtcggcgcgctgctggcaggctggacctccgaccgtctcggccggcgcctcaccatcgtcctcgccaacgccttcttcctcgtcggcccgctcgccatggcgcttgccggcgggtacaccttgctcatggtgggccgcttcatcgccggcgtcggcgtcgggtacgcgctcgtcatcgcgccagtctacgctgccgagatcgcgccggcgtcatcccgcgggctcctcagctcacttcctgagatttttatcaacactggggtgatgctgagttacgtgtcgaatctcgccttctcggggctgcccgtgcacctgtcgtggcgggtgatgttcgcggcgggcgtggtgcccaccgtgttcatggcggccggggtgttcaccatgccggagtcgccgcggtggctggttatgaagggccgggtcgccgaggccaaggccgtgctcgacaagacgtcggacacgcccgctgaggccgagcagcggctgctcgagatcgaggacgtcgtgatggacagcagcggcgacagcggcgcgtggaaggaggtggcgacgaaggctggcgtccagcgcgtgttggcaaccgtggtgacgctgcagttcttccagcaggcgtcaggcatcgactcggtggtgctgtacggcccgcgcgttctcgccatggctggtgtcacgtccaacagcttgctcctgagcctcaacatcctcttcggcgttgccaaggttggctccatcctcatcgccatggcgctagccgaccgcgtcgggcggcgcccactcctgctggtcagcactagcggcatgacggtggcgctgctcgtcctaggctccctgttcgcggtgttcgcgggagccaaggatgacgctgcggtggctgcggtgagtgtggtggccgtcatggcgttcgtgatggccttctccgtcggcttgggccctctggcgtgggtgtacagctccgagatactgccgctccgacttcgcgggcagggtgccgggctcggcaccgccatgaaccggatcatgagcggcgtgatcaccatgaccttcatctcgctctaccagggcatcaccatggccggcgcgttctacctctacgccgccatcgccgccgcgtcgttcgtgttcgtgtacgcctgcctgccggagaccaggggccggagcctcgaggacatggaagagctcttccacaccaagtgatttcgtatgtgctgatccaaccaccatttggttcaattctcgattcagtggcaatgcagattttgccattgttggagctggttttgagcttggtcgttatcatcatggcacatgcgtatacaattgcaagattatattgaaatcgattgattgagccggttggcgtcgacatgggaacacatgcatatagaattgaagcattgtaaatttgcattctttgacgaaatagttttttcctcc

SEQ ID NO: 13655 - DNA, 3370 bp, Zea mays
  misc_feature (3241)..(3241): n is a, c, g, or t
taataataaagttttttataagtgtaaaagttagtcctgacactaagatatcttactctttgatctattcagatcacttcagtgtttgtttatatacgttgagatatactagggtataagctagtatataccaagactatccacatcgtactccttaatttaataagagagcatttatttaggattaaaatctatttagattatataatttaacaaattttgaactaagattatataatcaggataaattatagtctcaaataaacatgtgctaaatctaccactaaagctttatagacactctaaattcatatcaattgtctctaaagaatatcctaaatttttaggattaaatactcttatccctaagtctatgatatttttctttctttcttcctaatttttttatactctagtctacgaattaaacacataattaatatgcatgtattattttagactatgataaatacatatataaaacatttaatttaaaatatattagaatatgatgtatcgtgtatatgggtggatttagagagagtaaaatattttagatgtggtgaagaggtgaaatttaaggagatgatgaagaaaccttccggatagtctaatcatccgacagctcaaggtcatgcgcactgccacgccatccagcggcatccatatctgcgtgcgcgacggctatccaggctccagtcgtccccggattagttgtactgtacattgttcctgcgaagacactgggtcgtccgggtcaatcggcagcttgaacaagccatggcggcgcaccggccgaacgccgcggcgccgctgctcgccaagctcgacgccaccgccacgccgccggcgaagcgcaacaagtaccccttcttctgcgccgtgctcgcatccatgacctccgtgctcatgggctacagtacgtagtatatcccccctcgctagatttggtaactctcaatatatacatctgtgcgcgtgcgcgcgcacacatgctgaaccgcgtgcttcggcagacgtcgcggtgacgagcggcgcgcagatcttcatggcggaggacctcgggatgagcgacgcgcagatcgaggtgctctcgggggtcatcaacatatactcgctcgtcggcgcgctgctggcaggctggacctccgaccgtctcggccggcgcctcaccatcgtcctcgccaacgccttcttcctcgtcggcccgctcgccatggcgcttgccggcgggtacaccttgctcatggtgggccgcttcatcgccggcgtcggcgtcgggtacgcgctcgtcatcgcgccagtctacgctgccgagatcgcgccggcgtcatcccgcgggctcctcagctcacttcctgaggtaacctctgctgtgtggcttggtgcgctgttttgtgcagttcatcagattttgcggcgcttgaattagtaatcttcggaaatgtcgcttcttctgtttgaagttttttatcaacactggggtgatgctgagttacgtgtcgaatctcgccttctcggggctgcccgtgcacctgtcgtggcgggtgatgttcgcggcgggcgtggtgcccaccgtgttcatggcggccggggtgttcaccatgccggagtcgccgcggtggctggttatgaagggccgggtcgccgaggccaaggccgtgctcgacaagacgtcggacacgcccgctgaggccgagcagcggctgctcgagatcgaggacgtcgtgatggacagcagcggcgacagcggcgcgtggaaggaggtggcgacgaaggctggcgtccagcgcgtgttggcaaccgtggtgacgctgcagttcttccagcaggcgtcaggcatcgactcggtggtgctgtacggcccgcgcgttctcgccatggctggtgtcacgtccaacagcttgctcctgagcctcaacatcctcttcggcgttgccaaggttggctccatcctcatcgccatggcgctagccgaccgcgtcgggcggcgcccactcctgctggtcagcactagcggcatgacggtggcgctgctcgtcctaggctccctgttcgcggtgtttgcgggagccaaggataacgctgcggtggctgcggtgagtgtggtggccgtcatggcgttcgtgatggccttctccgtcggcttgggccctctggcgtgggtgtacagctccgagatactgccgctccgacttcgcgggcagggtgccgggctcggcaccgccatgaaccggatcatgagcggcgtgatcaccatgaccttcatctcgctctaccagggcatcaccatggccggcgcgttctacctctacgccgccatcgccgccgcgtcgttcgtgttcgtgtacgcctgcctgccggagaccaggggccggagcctcgaggacatggaagagctcttccacaccaagtgatttcgtatgtgctgatccaaccaccatttggttcaattctcgattcagtggcaatgcagattttgccattgttggagctggttttgagcttggtcgttatcatcatggcacatgcgtatacaattgcaagattatattgaaatcgattgattgagccggttggcgtcgacatgggaacacgtgcatatatagaattgaagcattgtacacatactgcataatcatggccatttattttagattcaacatttcttttatatctatttcttcgtacacagaacaaggtgaaagtggtggaaggtagtgatggaggatgtttttttacaaaatatacaaggcaacaagagaggtgtgaaaagacgtcaaatatgtaatggataatcgtgatttttttgggtggggggtgtttcacttcaaaaaatcaactcaaccttataaatctttaaccaaacagtaccaacttcaccgaaaaactatggagttatcggtaacttcaccaagaagcgtgaaacagttaaagagatacttcacgaaaggataattttaactcacttattaagttagtgtacaagtattcaccttttcatcggttacacaccctgaagaaatgagcattttttttctattcccacatgtcaccatctcgccggctgcgcatcctagcgtctggatcgtgcgacgccgcgccatggccgcctgagccggttgcgcttgagctggggcaggttcaaccgcttcttctactgccagcgccactggtgcgtgtctggctggtgacggtgacgatgtgcaagacgaggagggccagcacgatgaagcgaagnaagtagaggagcttgttgattatggaggccatcatgacacaaattccggaggtcaggcacctagccccgtattagggataaaaacatgacggatactgccagatacaagtcatcccgtatactacctaa

SEQ ID NO: 13656 - DNA, 1368 bp, Zea mays
tggctctgtgataatcaaatatatttactgaatagaaaagtcaaaggtttatttgttttttattggtggtggtgtggtgtggtgactggtgggggtgcaggctggagacccgttgtatgcaggagtactactcgtttgtagaccaggcccacggaaccgaacagagaaaaattcgcagccgccccaatcacatcaatctcaacgagtcagcaaagaactcctttaaaaccccacgcgcacgccacgccggaccggccggattttcacgccacgccacgccacgcctctctcctctcctctcctctcctctcctcctcccatctcatcatctcatggccgcctcgcgcgtcggcgacccggcggagtcctcgcgcctgcgtatcggcgacgagatcgcgtggtccgagatcagcggcgtctacgaccgcgacgactcgctcaaggagaacaccaaccccaagtgcctcctcaagaaccaccccggcggaggcggaggcggaggcggccaggccaacggctcctcgcagcggttctctggcaacctcaagccgacggcggcgcccatcatcggcctctccggcaagctcggccagggcggcgcgcggcggcaccacccgcctgccatcttccccaagaaggccaagaccggcggcggcgggcgcgcgcccagggccgccgtcccggagcccagctcgcctaaggtgtcctgcatcggcaaggtgctctcggaccgcgagcgcgggcgcctgggccgcccgccgcggcctcgcggcgccgcgggcgggtgctgcggaggcctagcgttcttgatgcggcggagcaggtccaggaacagcgtcgagtgcgtcgaccagtctcctcctcctccgccgccgcccctggccgaggcgtccaggcggagggagaagagggagtcggcgcaggaggcggaggctgagccggcgccggggctgggcggcatgcggcggttcgcgtccgggcggcgggctgcggagtgggcggccgaggtggacggcgacggacgcgtcgcgacgtctgggccgttgtagcgcgtgcgcaggtgggtaggcaggcccccgtgtagtaggcggtttgggtgcgtgggtttcggtttgctttgttgctctttgtacacacttgttgaaattagattagaaattgagattttggcttgtcaagctttaaagggaaaaaaagggggagcttctggccagctatataccaaggaagtaggtagctttggtgtttccattcatggcgagatccgtgattaatttcgcctctgaataacgcccttatcttctccacatcgacgacgctcataccagagacaacatcgtagtcgtaggagtccattcaatgcccatg

SEQ ID NO: 13657 - DNA, 444 bp, Zea mays
attttcacgccacgcctctctcctctcctctccttctcctcccatctcatggccgcctcgcgcgtcggcgacccggcggagtcctcgcgcctgcgcatcggcgacgagatcgcgtggtccgagatcagcggcgtctacgaccgcgacgactcgctcaaggagaacaccaaccccaagtgcctcctcaagaaccaccccggcggaggcggccaggccaacggctcctcgcagcggttctctggcaacctcaagccgacggcggcgcccatcatcggcctctccggcaagctcggccagggcggcgcgcggcggcaccacccgcctgccatcttccccaagaaggccaagaccggcggcggcgggcgcgcgcccagggccgccgtcccggagcccagctcgcctaaggtgtcctgcatcggcaaggtgctctcggaccgcgagcgc

SEQ ID NO: 13658 - DNA, 960 bp, Zea mays
  misc_feature (65)..(65): n is a, c, g, or t
ttcatcaggatagaaggcaattccatctggtccatgagtagatgcgtctccaaaaccaaagccanggaatttaattatcctcatcaaaagcagataaggtttcccaatgatggatattgcctgttcataaggatttgggttgtcactgatattatgcaggctcataccattgaagcaattctttcctgtccattcattactctttgtgaaatcaattcctatgatcaaattagaagactcaagaccagcctgtgctaatgcttcaataacctcatccaaggatcggtactggtcaacaatcttggagtacttcctctccagccttggccgcttacccccggctgtcaccagcctagatggcaccgcccgcgtctcgattgccctcagtggtggtgctgacacagagtgtgtatgagccacccccactgttggacgcgagtaagcgctcgatggcaccacaaagtcttcatccgctcggggcagcggcgcactggcacgccgccgtaagctggaggacgaagagctctcatccgcagcgggagcaaaagcaaggtgcggaagaggcggtgggtcccacagctgcgccagagacgcagacgccggctcgtaaagttcgggatgtggggaggctggcggcgacctgcgccgtgccgccgccgattcctgatggtggtcatcctgctgctcagctgagctggcaaggaggctgccgacgatcctggtggcggtctgcaagaccaggaacagcacccacagcagaaaggtgccgaccttgccgaccaccgccaagaagccgctcatgccgatgaggagaaagaggatcgccgtgagctcagatgggatagcagaccgacgggttaggggaatttggtacaaggcaggtggggtgtgcagggtttgaaggagtcaggcaatagattttttttttgcatattttgcatctagagaattggatcatga

SEQ ID NO: 13659 - DNA, 6425 bp, Zea mays
  misc_feature (5174)..(5174): n is a, c, g, or t
  misc_feature (5224)..(5224): n is a, c, g, or t
  misc_feature (5256)..(5256): n is a, c, g, or t
  misc_feature (5292)..(5292): n is a, c, g, or t
  misc_feature (5309)..(5309): n is a, c, g, or t
attacccatgggtaatcggattcaggtttctgcccgtacccatactcacatacccaacggagaaggaatttctctcaaatccaaacccatggggatcaaaatcattccataacctaaccctaagggctagtttaggaactctattttcccacgttatttttatttttcccaagtaaatttagttcattttctcttaggataaatagaaatctattggaaaaatagaattgtcaaactagctttaatagagtaattccctataagttattgggtatcagatctctatttacacctctagtgagagataaagtagttaaactacgtaaaatttagatttaaaacttggttagaactcagaaagagaagaattaacaagtatcatgatattaattgaagaaagatgatttaggagtggtatattttttacccctattcttagtaattgtattgtttagatccagattaaattctccgtaagttagtggcagatcttgattaattaaaagtaccatggctacggtgactccggattctaaaaataaatatttcacccagtcctttcgctttagagcaaaattcatggatagcgtaatcaaaccagttgtcctctctggacgaagaaaacatgttaaagtattggccaaattgatagcagacagcaggcccagcacccaccgactccctgaatgagcgaggacgcctcgtagctgccaatggcctttacgtgccacgtcggatcctggtcagactcgtcggccggagcagccacaccctgcgcgtgccacctactccccctcctcccgaagcagtggccggcgactcggattcagattttgacccaggaaatttcctcccaaaaaggattccaaaaactaaaattgatgctgtagtactactacctaccactctccttttggttgtcaatgaatttgcagttgtattttaggaaactacaaaatatatgaaggactttcagatcgcatctttaattttaaagcagattcgataatatccactcgatcaacaacagcacatgcattgactggagtactctgctgcatatctgttagtccgatctgtgaatgttcctgccggtgaagaaacatgctctgtgaatgttctcgctcatggaaagagagattttccgtcagtcaaatttgttaacctttagaattatgaatgagatagatgaaaaaaaagattaacgcatcttattttaagcaagaggtattgcttcatcgttccgtagtttcggatgggtctttttaaggccctggcccgaaggtcacaatttcttgcccaaaattttcgtaggctgtccaccgcaccaccaccctgcgcgccgagcgcaccccgatccagatccacccatcctccctccggtctccggcgggcgccctcctccacgtcctcacgcgcctccggacgccagtgcgcgcgcagtgagcatcaacatcaacccgcctcttctctcgtcggtaaggacgacggacggacagacggacagacctgctgctcttcattttcattctatttcggtttcggaggcggaacggcatgaatctgctgtattgttcgttggccactaccacgaaccgtccctgaactccagaaatccctcctccgtaggaccggcgcgcgccaggtggcggcggaggcggcaggcatgaagcgggtgtcgtcgcacgtctcgctcgcctccgaggcggagatcaacctcgacctgtcgcgcctcgtcatcgacaagcccaggttcacgctggagcggaagcgctccttcgacgagcagtcgtggagcgagctctcccaccgccagaacgacggcttcgacagcgtgctgcagtcgccggcattcccgtccggcggcttcgactcgcccttctccgtcggcacgcacttcggcggcccgcacccgctcgtcaacgaggcctgggaggcgctcaggaaatcggtcgtctacttccgggaacagcccgtcggcaccattgctgccgtcgatcatgcgtcggaggaagtgctcaactatgatcaggtaaattattgaatgcgaatcgggcttcactgaacatcaaatttgtggaaacagaggaacctttttgtttgttctgtttatgaacgctggaatattagtgcttacctagttatttccattgctcagtgtatatactcgtttcaggctataatttgatacatgtatcataatcaatgaatactatacttccattgtttttactagcacttgcaacaagatttcaatttctgttctgtattttctaagattacgtgataaaaaatgtgttccggtaatatgtaaccgtggaacattagcagtatggtctgtaactggatttttcctgtttttctatttctggttacttcttaaagaattaagtctgatggcgtgctaagattgattgctcccttattattaattatttcaggtttttgtgagggatttcgttccgagcgcattggcttttctaatgaacaatgagactgacatagtgaagaattttctcttgaaaactcttcaccttcagagctctgagaaaatggtagaccgattcaagcttggagcaggagcgatgccagcaagtttcaaggtggaccgtaataaaaacagaaacactgaaaccttagtcgctgattttggtgagagtgcaatcggtagggtggcaccggttgactctggattttggtggatcattctccttcgggcatatacaaagtacaccggagatgttagtttgtcagaatcacctgaatgccagaagtgcatgaggttgatactgaatctctgcttatctgaaggatttgatacttttccaactctgctctgcacagatggctgctcaatgattgatcgtcgaatggtagcatcacttcacctttgatctaattcatatttagatgcatatctgtagaagtagtacatatcagctgaggtggcaataggattggcaggttctgcatgttcttccataatgaaggagcatccctgtctcctaattttctactctactttttaagtttttatggtagtcttacagctgcacaaattctcatactacttgcaaccaaattttaatggcaatcttgtatagcctttcggtaccttggaggcaagaaacacagtttttgcagaagtacaaacagataatactggtagaaagtgacaatctgtagtatgcccctacaagttctcttgttgcttgttctacttttgaattacatattgattttaaatgaagtttccttttttattaattctaaatgaagcttcccaccattgcatgatcgtaatttcttcaattttcagggtatatatggttatcccattgagatccaagccctattctatatggcattaagatgtgctctccaaatgctcaagccagagggcgaagggaaggatttcatagagaagatagggcaacgactacatgcactaacctaccacatgaggaattacttctggctagattttcaccagctgaataacatatacagatacaaaacagaagagtattcccacacagctgtgaacaagtttaatgtcattccggattccattcctgattgggtgtttggtttcatgccatgtcgaggaggctactttcttggcaacgtcagccctgctatgatggacttccggtggtttgcccttggcaattgcattgccattgtatcatctctagctaccccagaacagtcagttgctataatggatctgatcgaggaaaagtgggatgagctagttggtgagatgcctctgaagatatgctatcctgctctcgagaatcatgagtggagaattattactggatgtgaccccaaaaacacccggtggagttaccacaatggaggatcttggccaggtatcgtctctcgttgcaatgtgactaaattttgacttttggtttgttaggtttcaactctagcctactctaacttgtttgggtctaaatgtctttgttgttgttgttgtccctgtacaaagattgcaagttaattcatcataaattgttggaaataggaaaggtttaaactaaaatccattctgaaattgacaaatggaattctccatgtgctccacctaaaaaattttgtttggtttaacaatccttgataaccatgtcgtcttccgtaagatccttttaattctataattggcgcttgtatgttaacaaggtagtctgagtattttttatttactcttcatatgcttgcttttgcatgagcagggacagtgcttcactgcttattgacttcttcaggagttgagatttagctcaattacaaagtttatttaatcattgtgatgtacctagttgcaactaaagccaaactcagaactaaagcacagcataaaaaaattgtgttcacactatttttatgtgcagttcttctgtggctgctgacagcagcctgcataaagactggtcggccacaaatggcaaaacgtgccattgagctcgcagagtcaaggctgctcaaggacggctggcccgagtattacgatggcaagctaggaagattcgttggcaagcaggccaggaagttccagacctggtccattgccggttacctcgtcgcccgcatgatgctggaggacccatcgacactgatgatgatctccatggaggaggaccgccctgtgaagccgaccatgcggcggtcagcatcatggaatgcctgaatgcgtggatagttgtttctgaaccaaggaaattcagaatcagctgttatacggatttgtgatttgtttggaccacaagagtgcagcctgcagcgttggtgtgatttgttgggaccacaaagttcaacattgattatagttggactctgtcaattaggacagagtttgtataccatagaggatcataggagttgcacaagattttgccatgcccttttggtttgtttcagaacaatactcaggatactgttcagttgaaaccttgattttggaataacaaatcactgtttatgcatacatttctcttcggctttaaaggtatctcagataattctggaatgccactttcttttttttaaagaaataacaaatcactgtttacacgcagcagaacatgtggattggtactatcttagagcaactccaatcataaccctataattgggtcttgtatttcaatttagctacgtagtcnatttgtttagggtccaaactgaaaatccgtttccaaccattgagccttanactgggttacgttgttgttggaaccgtcagancatttctctgtaaattgcaccgtttataaagaagantttgaaataaaatatanagataagtaagctgttagaaataggcttaggctataaccagcagatcgtgtatacgaccgtgtataacattgttttatattatagactatactatttatagagtaaaatttgaaatgagagatgagtaaggctatgaccagcaaatcatatatatagccatataaaataatattttatgctactgtctatattgtttatggtctttaaaaagtgaagtttaaaattagaataagagccttttaagtttttttacaaatattttattacctattttctactagatccgttcggattcgtggaggtaaaatatgactttttcttgaaaatcctcatttcctttatatatacatgtgtccaatggagaataattaaagtttattggagcgaagacagaacgccccctcgacccctttacttttgcacactaacttactgccaaagggacggttacatgaccatgaccgtagggaagaagagaaggctaagcaatggaccccgaaggtgatgggatccacccctttgcccgagcagcaaatacaaccggatggactcacctatgaaggggatggtcttcgtttagcacacgaaggtttaacgagatcgggggcagtccacaagaatgcgggttgccaagtcctcgcaccatgtggtcactaagcgacgacattctgctgatccgagtccacctgtctgggaccgaagagggtacaaagtctggtgtaatagggtggtctgtacttacgaccctgtgattaccccgttgtacagtgcatgtcgagaatatagttggtaactggagacaacaatatttaggtccaccaaccctcggctacctctataaatactccatcctgtagccgcacaagacacgcttgacaagacatttgcgctcctagcctgctgtttttgtcgtgccacctgtctctttgctcccgagtgttaaacccgtgatttttcgtgccaacatttgacgcccatagtttatgctccgaacatcaatacccacgatgactcccaagaaagtgaccacagggctagctcctctctagacgaggccactaaggcggccctcgctgataagaaaggcaaagtagccctcacagacaacaacttgc

SEQ ID NO: 13660 - DNA, 2212 bp, Zea mays
gcacgagaccattacctagaacatcctaatcgaaaagcccaaaattttcggaggctgtccaccgcaccaccaccctgcgcgccgagcgcaccccgatccagatccacccatcctccctccggtctccggcgggcgccctcctccacgtcctcacgcgcctccggacgccagtgcgcgcgcagtgagcatcaacatcaacccgcctcttctctcgtcggaccggcgcgcgccaggcggcggcggaggcggcaggcatgaagcgggtgtcgtcgcacgtctcgctcgcctccgaggcggagatcaacctcgacctgtcgcgcctcgtcatcgacaagcccaggttcacgctggagcggaagcgctccttcgacgagcagtcgtggagcgagctctcccaccgccagaacgacggcttcgacagcgtgctgcagtcgccggcattcccgtccggcggcttcgactcgcccttctccgtcggcacgcacttcggcggcccgcacccgctcgtcaacgaggcctgggaggcgctcaggaaatcggtcgtctacttccgggaacagcccgtcggcaccattgctgccgtcgatcatgcgtcggaggaagtgctcaactatgatcaggtttttgtgagggatttcgttccgagcgcattggcttttctaatgaacaatgagactgacatagtgaagaattttctcttgaaaactcttcaccttcagagctctgagaaaatggtagaccgattcaagcttggagcaggagcgatgccagcaagtttcaaggtggaccgtaataaaaacagaaacactgaaaccttagtggctgattttggtgagagtgcaatcggtagggtggcaccggttgactctggattttggtggatcattctccttcgggcatatacaaagtacaccggagatgttagtttgtcagaatcacctgaatgccagaagtgcatgaggttgatactgaatctctgcttatctgaaggatttgatacttttccaactctgctctgcacagatggctgctcaatgattgatcgtcgaatgggtatatatggttatcccattgagatccaagccctattctatatggcattaagatgtgctctccaaatgctcaagccagagggcgaagggaaggatttcatagagaagatagggcaacgactacatgcactaacctaccacatgaggaattacttctggctagattttcaccagctgaataacatatacagatacaaaacagaagagtattcccacactgctgtgaacaagttcaatgtaattccagattccattcctgattgggtgtttgatttcatgccatgtcgaggaggctactttcttggcaacgtcagccctgctatgatggatttcaggtggtttgcccttggcaattgcattgccattgtatcatctctagctaccccagaacagtcagttgctataatggatctgatcgaggaaaagtgggatgagctagttggtgagatgcctctgaagatatgctatcctgctctcgagaatcatgagtggagaattattactggatgtgaccccaaaaacacccggtggagttaccacaatggaggatcttggccagttcttctgtggctgctgacagcagcctgcataaagactggtcggccacaaatggcaaaacgtgccattgagctcgcagagtcaaggctgctcaaggacggctggcccgagtattacgatggcaagctaggaagattcgttggcaagcaggccaggaagttccagacctggtccattgccggttacctcgtcgcccgcatgatgctggaggacccatcgacactgatgatgatctccatggaggaggaccgccctgtgaagtcgaccatgcggcggtcagcatcatggaatgcctgaatgcgtggatagttgtttctgaaccaaggaaattcagaatcagctgttatacggatttgtgatttgtttggaccacaagagtgcagcgttggtgtgatttgttgggaccacaaagttcaacattgattatagttggactctgtcaattaggacagagtttgtataccatagaggatcataggagttgcacaagattttgccatgcccttttggtttgtttcagaacaatactcaggatcctgttcagttgaaaccttgattttggaataacaaatcactgtttatgcataaaaaaaaaaaaaaaa

SEQ ID NO: 13661 - DNA, 776 bp, Zea mays
aggacaacgagacgtctgacggcgtgaggctgagaccaaaggagaacagagacggagagcagcgcggcggcccgggcgccggagcctggagggtaggggaagagaagagaagaggcgatggcgtcaatcgggtcttccaacatcggattccagctgctgaagaagtctggttggaaggagggcactggccttggagcgcaggagcagggaaggctggaacctgtagagactcgtgttaagaataacaagcgtggtataggttctaaagaaccaaaaccacagcctaaggttggggatgacattgaaacacatcctcaaaagcccaagcaggaaatgcaatcaaagaaaagggcaaaattagctgcaaagaggataagaaaaatgcaagaagaggagaagcgcttgaaagagaaggaattcgagatggcttttttcagggaattttggcctgataatgtgtaaggcagaaacttcaacacttgacaatgtagctgctgactttgcctgatatagtggatgtataggcttgcaaaacgcttggcctacaaaatgttacccatccattccgtggatgatttcacacatgatttgtggctagggttggcacaaagctattcatccatgtagtggacaaatccagtgtagaattgcccatgctatgtgatcttgtaatttttatacattataaatcttgttttttttggttcaaaaaaaaaaaaaaaaaaaaaaaaaaaaaaaaaaaaaaaaaaaaaaaaaaaaaaagggcggacgcgtgg

SEQ ID NO: 13662 - DNA, 3035 bp, Zea mays
ttgtagtttataaaattaatttaaataattttaaaaatatttttaatttaaataataaatgaaatgacttttgtaaatgtcttttaaagatttttaacttcagttctacgattttctgaagcacctaataatatgctccatcgactctataagattttctggagctgtaccaaacaggcttaagtgcccgttcatttcagctggttccgggtgggaagacgttcatttcagctggttccgggtgggaagaaatgagctggattggtatttgatccggattgaaactgctgttcatttggatttgaataaaaacagatcacagtgatctggtttggagattctccgtcgttcatggcctgggtaggaaacgcagtctcatatcctctgttccaggccaggaaatagtagacctgcaatctttcttagacgccgttcggttattatggattggtgggtcggaacgatttctaaccggattacttctttaatttatataaattttgattagctgaacgatttcgggtgcaatccgacataaacgaacaaggctttaggcagccgaacggggacaacgaccggttttgcaacagatcaaattaatgaaaaaaaaacaaacagttgagagatgtataagcagaatggccaccagaccgcagaacgtgtgatgtcaaatgcaaacccccccctccccctacacttattttttttttgaccagaaaccaaagtaaaacccagtgattttattcgatgttatgtacaaggaaattcattagtactccgtacttcagtacacagaacctcgaacaaaacatattctgaacactccaggtatttacagcataaaccgcacacaccggttttcattaataagtagaaaaggacaagtctaatctgcatagcagcataggtgcaacactaaaatattaccacataccataaaacgagcttcagcttcagattatcatgctgcaaaacttccaaaagggacacctggatggtagatgacttgattcagtcagtctcatgatcagggcgtggggtgtaccattcagggtatctacccatccttctcagcaaccttgtgtatggagactctggcatcaacgcttcctcttcttcggtgagctcttcctgtgttttcggtatcccatcaggcacggggaatggccttggctttgcagtttgcccctgggagccggatggtactgaattacgagatttctctgccatcttcttccgcaaatctgagcgatgatggatgctctcgatcaggtacctcacgtcaccctctgagtccttcaccatccttgagatttcctctttgggcagctcttgctgtgcagcgttgggtgagtatgagtccaaaagacatgtgatttcaaatgtctgtcgacgtaattagaacgtacctcaagtttattcagttcaaagtaagcatcccaacagctgcaacattcgtcaccttcgacggtcatgcaataatctgttcccgacaagaagaagtattgttaagtactagttgcaaataacttatatgcccagcgatcgagggcacgaagttactgcactgagatcctactcctacctgatctacactagtcagaaagaaaaggctgactgatgagttcagtaaattctgtccaactttctctactagcactacatctgtggtctgccttgtctatgatacctcaaatttcacagttcgacatcatgatgcagattatgcctctcacgaaaacaatcctgctttataattttagtgcggcgatacgaaggttcaagtgcaagcctatttagtatttacagacctttttttagggtagctttacttgcagaccaattggcaacacaaatgacaaatattatcttacaacgagaccatgtgtatgtaaaaagcatataccaccaaaacaattcagagacctaaatatccaataccgttaagtagatataccgctgcaaatgctttgtgcctctgaaacaatggacagcactctgaccagaacattttcttcttgtgctcgttcaccagaacattctaaccagcaaagcggtttccgattcagtattaatacatgctagttacatggccctccgacttcaaaaaaaaaacatgaaaagaatgtttgaactacagcagaaggtagataacgaatctacttaatcctatgccaaaatgacatgtactaccatccaaaagtaatccagtttagtcaggaaggcaaaagaactgtaaacaaatctaaactacaaaaatcgtggcaggacgacgcgtcgacgcatgacgcgcataaaaaaaatcattcagaaaaatagatcatgcaccgaggcgacgacggtgcggccggccgagcagatacctcttacctgtgatctggtccttggtacgctggacgagcggcttgtccagccggaggaactcgtcgagggtgctgcggttggaggtgaagggctcccgcttcgggatggagtcgtagttccgcaccgcgcgcaccgccgccgccggcgcacgccgccccgacgcgggcaagaagcaggcggtaaggtgcgctggcgccgccgccggaaccagcggccgcagtgtggtgggagacagcattcgctttcgattctccgtttttcagcgaatcagttgattttttttcgcgtcagcgaaatttcgagcttatataaagcagaggggtcggcaagtgacaaagtagaacggataaggatggaactgtgttttgcacgttggtccttcattgtgtaatatttttgtaaacagcctttttttgtctgttaaattaaagagacacttgggagcggatacgaaggggctatggggctgcagccctcgccaacgatggattaaaagtagtaggttacgtcttcagattataccaaatgtctcactcaataacccaccacttatcatccacgctattatctaacataacaacataatattttaccatctttattaagtggatgacacatataatgccatattaatgacttttagtgtcatccgtaaagacgacccatccgac

SEQ ID NO: 13663 - DNA, 1115 bp, Zea mays
  misc_feature (39)..(40): n is a, c, g, or t
  misc_feature (65)..(65): n is a, c, g, or t
aggttggtagggagtttggattttttagtaaggggggannagtgtgttggaattaaaaattaagnagtggtaaaaaaaaagaggaatttttttttttttttttttttattatttttttttttttttttttttttttttttttgaaaccaaagtaaaacccagtgattttattcgatgttatgtacaaggaaattcattagtactccgtacttcagtacacagaacctcgaacaaaacatattctgaacactccaggtatttacagcataaaccgcacacaccggttttcattaataagtagaaaaggacaagtctaatctgcaaagcagcataggtgcaacactaaaatattaccacataccataaaacgagcttcagcttcagattatcatgctgcaaaacttccaaaagggacacctggatggtagatgacttgattcagtcagtctcatgatcagggcgtggggtgtaccattcagggtatctacccatccttctcagcaaccttgtgtatggagactctggcatcaacgcttcctcttcttcggtgagctcttcctgtgttttcggtatcccatcaggcacggggaatggccttggctttgcagtttgcccctgggagccggatggtactgaattacgagatttctctgccatcttcttccgcaaatctgagcgatgatggatgctctcgatcaggtacctcacgtcaccctctgagtccttcaccatccttgagatttcctctttaggcagctcttgctcaagtttattcagttcaaagtaagcatcccaacagctgcaacattcatcaccttcgacggtcatgcaataatctgtgatctggtccttggtacgctggacgagcggcttgtccagccggaggaactcgtcgagggtgctgcggttggaggtgaagggctcccgcttcgggatggagtcgtagttccgcaccgcgcgcaccgccgccgccggcgcacgccgccccgacgcgggcaagaagcaggcggtaaggtgcgctggcgccgccgccggaaccagcggccgcagtgtggtgggagacagcattcgctttcaattctccgtttttcagcgaatcagttgattttttttga

SEQ ID NO: 13664 - DNA, 2133 bp, Zea mays
tgactacaacgctgtacgcctgaactacgctccatacgtaccgcgtgtctctctcggtagcgcggctgcagctttcttattttaagaaaaggaagcagcaatgtgtactactcaagtgacggcttcctttccttggcacgatcgaagaaagagaaggtaaaccaaatagcccacacattcccaagaatcctttagcatctgccaaagcaggtttgaaggcgtgcgctccgaaaggtgaagcgcggtataaacgttcaacaccacgagccaccagcccaccaccaccacggcagaaagaagcgggggagggaattacgtcccgttcacttcactccctccatccgatcccgatcgccgccttcctcctcctcctcctgccgcgacccgccacctaaccaacgaagccgcctccctccaagccaagctcccgcatacagctccaaaaccgaacctgcacccagcccaacgcaacgcgacaccgccgacagcgatggaagtgaaggcgcacacggcacgggtcctggtggcccggctgcgcggcgccaccgccgcgcgcgacggggccgcggcggcggcggtgtccgagatccgcctcgccaccaagacggacccggagatccgggcgccgctggcggacgcgggcgcgctgcccctcctggccgcgcagctccagcgcgcgtcccccgcggccgtggacgcggcggccgcgctcctcaacatctccatctcggcgcgggaccaggtggcgtcggccccgggcgtgctggacgcgctgacggccgcgctgcgctcgggcgacgccgcgcaccacgcggcggccgtggtccacagcctcctctgcggcggggagccgcaccgcgcggcggtttgcgagcggcgcccgctcctggccgcgctggtggcgctcctccgcgcgccgccgcacaggccgggcgccacgcgcgccaccaaggacgccctcagggcgctgttcggcgccgcgctctacccgcccgcccgcgccgcgctcgtctcgctcggcgccgtgcaggcgctcttcgcgctcgtgctcacggacgcgcgcgacggcgtcgtggaggacgccaccgccgtggtcgcgcaggtggccgggtgcgccgagagcctcgaggccttccgctgggtctccggggtgcgcatcctcctcgacctcgtcgagtcggggggcgccgccacgcccagggcgcgggagaacgccgctgccgcgctgctcaacctcgtcgtggccggcggggaggccgccgcggcagatgtggtcgcagtcggcggcgccgaggagaccgtgcgggagctcgccgaggacagcgccgccagcccccgggggaaggccaaggcggaggcgctgctgcgcgcgctcgaggacgccgccgtcaggaggcgcgagcaccgcctagctgatttcctcgacgggctcgtgcagtccgatccttacatctcgtcgccggcgtcggcgtccacgcacggctagtcaaaggctgatgattctggtttgagtttggtttgacgaccgacaacttcctcttctttcttccttcttcttccttgtatataaaaaacaacatcttttatgtagtgtagcttggctagaaaatactaatcgcatttgttgattgatgcaaattcttcctgtgctgcgtgtcgtcaactttgtgtaaaattcgcccaaactctggctacattcaggacttcggatgagaccaaccgatcgattaaattctgcatcacatcatggccactagcatctccgttctctgactgcccatctctgcatcacaccatggccactagcaaatcacagggtaaaaagagagatagagaagagaatgtatggtcgcaattcaaattgcaaatactctatatttagtttaaggggtcgtcgagactgcttcaccccatattgttttaagctccactttatgttttttagttaaacaacattacgtaattctggtctatgaaaattacaaaaccatgagctcaagaggcgttctctataaactctaaactttttttatgaagctgctctgaaccttcttcttttttttaaatggagcagttccaaacaactcataattaattattagattgaatagcaccgagaattttgcaggtgct

SEQ ID NO: 13665 - DNA, 1667 bp, Zea mays
gcacgagaccattacctagaacatcctaatcgaaaaacagttattacacacagacagcagtccactcgcgattactactgtaatccccaccacaccacctcccgtcgagtggagtgcttcttggcgacctttctttgcatgtcaacgcagacaaaaagaacagcgccgccgcctccacgaccacgccggtcgccgagcctccgtctcctcccgagagatctcgcagccagccagccagttagccgccgtacgtggccacatggaggcgccgcgggcaaacaacggcaggaagcgcaagcccacgcctcccgccggcctgggggccctccacgacgacttgctcgagcgggtcctcgcgcgcctcccgccggccacctacttccgcctgcgcgccgtctgcagccgctggcgcgccgccgcggcgtccccgaccttcctccacgcctgcgcccgcgtcccctcccgggacccgtggttcctcatgctctccgactccgactccgggccccgcccgcccgtcgccttcgacgccgccggccgcagctggaaccgctgccacgccgcgccgggggccgccgtgcccgtggccgcgtcggccggcctcgtcctctaccgcgcgccggccacgggcgcgctcaccgtcgccaacccgctcacgggcgcgtcccgcgcgctcccctcgccgccgcaggccgcgcgccagctgcaggccatcgccatgtacggcgccggcggtccctaccgcgtggccctcttcgcgggcgacctccccgacgacctctccatggcggtctacgactcctccagcgactcgtgggaggggcccctgccgctcgcccgcaagcccggggacgactcctgccccgacgcgccggcgcccgacgacacggtctacttcctcagcaagtccggggacgtcgtggccaccaacatgcagcgcagcgcgtctaagcagtactcctcctcagtggtcgtgcgccgcgacggcgacggcgacgccgcctttgcctacttcctcagctactcgggcacagtcgtcgcctgcgacacggcgcgccgcaccttcgcggagctgccccgcatcctccccgtctacttcgagtactccatcgacgtcgtcgcgtgcggcgcagcggcctacgccgtcgtgctttcggaatacctcggcacggccagcctgcgcgtctgggagttcgccgggggcgcgtggcggcaggtggccgccatgccgcccgccatgtcgcacggattccacggcacgcggcccgatatcaactgcgtcggccacggcgaccgcctcatggtttgcgtcacctccgccgaggccaacgcctgcttcatgtgcgacgtggccagcaaccagtgggaggagctgcccaagtacgtcaatgccgacggcgaggccagcgagttcctggccgccttctccttcgagcccagagtggaggtcaccgtataagcgcttatggttatagtgttactacgattaattgctttcttcattaaggcgccttagttttggttcggctcctactccgtgtgattgatttcttcgtgtttgtgtgtgtgcatgtacttaacttacggtaccgaattgtaatgtcatttttcattgacattatttgtcttcaataaaattgcagattcgtgtaaaaaaaaaaaaaaaa

SEQ ID NO: 13666 - DNA, 2324 bp, Zea mays
attacacacagacagcagtccactcgcgattactactgtaatccccaccacaccacctcccggatctcagggtgggtggagtgcttcttggcgacctttctttgcatgtcaacgcagacaaaaagaacagcgccgccgcctccacgaccacgaccacgccggtcgccgagcctccgtctcctcccgagagatctcgcagccagctagccgccgtacgtggccacatggaggcgccgcggccaaacaacggcaggaagcgcaagcccacgcctcccgccggcctgggggccctccacgacgacttgctcgagcgggtcctcgcgcgcctcccgccggccacctacttccgcctgcgcgccgtctgcagccgctggcgcgccgccgcggcgtccccgaccttcctccacgcctgcgctcgcgtcccctcccgggacccgtggttcctcatgctctccgactccgactccgggccccgcccgcccgtcgccttcgacgccgccggccgcagctggaaccgctgccacgccgcgccgggggctgccgtgcccgtggccgcgtcggccggcctcgtcctctaccgcgcgccggccacgggcgcgctcaccgtcgccaacccgctgacaggcgcgtcccgcgcgctcccctcgccgccgcagcaggccgcgcgccagctgcaggccatcgccatgtacggcgccggcggtccctaccgcgtggccctcttcgcgggcgacctccccgacgacctctccatggcggtctacgactcctccagcaactcgtgggaggggcccctgccgctcgcccgcaagcccggggacgactcctgccccgacgcgccggcgcccgacgacacggtctacttcctcagcaagtccggggacgtcgtggccaccaacatgcagcgcagcgcgtctaagcagtactcctcctcagtggtcgtgcgccgcgacggcgacggcgacgccgcctttgcctacttcctcagctactcgggcacagtcgtcgcctgcgacacggcgcgccgcaccttcgcggagctgccccgcatcctccccgtctacttcgagtactccatcgacgtcgtcgcgtgcggcgcagcggcctacgccgtcgtgctttcggaatacctcggcacggccagcctgcgcgtctgggagttcgccgggggcgcgtggcggcaggtggccgccatgccgcccgccatgtcgcacggattccacggcacgcggcccgatatcaactgcgtcggccacggcgaccgcctcatggtttgcgtcacctccgccgaggccaacgcctgcttcatgtgcgacgtggccagcaaccagtgggaggagctgcccaagtacgtcaatgccgacggcgaggccagcgagttcctggccgccttctccttcgagcccagagtggaggtcaccgtataagcgcttatggttatagtgttactacaattaattgctttcttcattaaggcgccttagttttggttcggctcctactccgtgtgattgatttcttcgtgtgtgtgtgtgtgtgcatgtacttacggtaccgaattgtaatgtcatttttcattgacattatttgtcttcaataaaattgcagatttcgtgtgcagtccaaaggtacattgtcaataaggagttgctaacttgctatatatactagacacttcgaatcttgagatggttttagaagcaacaaatcaatcaaaaggataacttacaagagataatctacatttttatagtaaaataaaaaatgtttcataaagaacatcaaaaaatcagctacctaaaatatagaagacgtgctggcattatcatgcaatttgtggataaaatgtctcttgcatcaagaaagcaaggccataaaatagaatattgatggttttgtatgtaataccacagttgtaaagcatacgagaaaaggtatgtagattgtagaaggataaaagtgtatttccgcgtcgctaaacttgttcactgcggctttaatccggctgcggcttctacaatattttgtctctatggattacaacggcagcagtccgaacaactactgcagggcagacgaacaagctagcgaaataattattagctaggtgcctataattagaaagttttttatctatcccaattaactttacctattactccactattagttggatgaatctaaacaccctccaaatactgaggttggatacaagcaagagcaaaagtaaaataaaaacttttctagacaattaaaaataggaggggaaaatattcatgaagaaggcaagcatgaagaaaaagattgaaaaagatagaatcttt

SEQ ID NO: 13667 - DNA, 1253 bp, Zea mays
  misc_feature (1170)..(1170): n is a, c, g, or t
  misc_feature (1187)..(1187): n is a, c, g, or t
aaggatccagctcgtagtcgcagcccatccatgccccatgcggccatgcctatatatactatactggacgcactccggcccggcgtgctcgtgctcgtcctctcccagcaccgtaaccaccgacagagcacgcaccatgacgaggaccaccaccagcagcacgctgctgacagcggcgctgctctgcctcgcgctgccgctgctccccggggccacggccaataaggcggcgcggcggcggcagggcgacaacctggcgcgcctgcgcgggtcgccgtggccggccgagtcgtcggtgtcgctggcggtcgcggcgacggatgacagagcgtcccggcacgcggcgtcgccgcccgcggggcgcagcaaggaggacgaccgcgtggacaagctgcccgggcagccgtcgggcgtggacttcgagcagtacgccgggtacgtgacggtggacgccgcggccgggcgcgcgctcttctactacctgaccgaggccgtcggcggcggggcggcggccaagccactcctcctctggctcaacggaggccccgggtgctcgtcgctggggtacggcgccatggaggagctgggccctttccgggtgaagagcgacggcaagacgctgtaccgcaacccgtacgcgtggaacaacgcggcgaacgtgctgttcctggagagccccgccggcgtgggcttctcctactccaacaggacggaggactacagccggagcggcgacaacaagacggccgaggacgcgctcctgttcctgctcaactggatggagaagttccccgagtacaagggccgcgacttgtacctcgccggcgagagctacgccggccactacgtcccgcagctggcccacgccatcctccggcacgccgccgccgccgccgccggcaagccgtcgtcgtcgcccatcaacctcagaggcatcatgatcgggaacgcggtgatcaacgactggacggacaccaagggcatgtacgacttcttctggacgcacgcgctcatctccgacgcgacggccgacgccatcggcaggcactgcaacttcagcgccgccgccgcgggctccaacgacaagtgcgacgaggcgacgtcggaggccgacgaggccctggaggacatcgacatctacaacatctacgcgcccaactgccagtccgncgacctcgtctcgccgnccatcaccccctcgatggacaactttgatccgtgctcgggatattacgtggacgcctaccctcacg

SEQ ID NO: 13668 - DNA, 973 bp, Zea mays
aaatcctttttacgcagcgacaacgagccaggcacctccacctcatccgctgacagacaagagcgcaatcacccgcgggccttgggcttgggccttggaatagggtaccaccaaccaatcaatcgaagaagaggcccgccggccgccgcggtttgctcgctatcgctcccttgctggctgcggtgcgggtgcgccgccgtcgacgagggagtccctggctccctccctccgggttcgaattcgggttgcttccttagggttcagtggcagtacatagcatggccctaaagctcggctggaggagaggaggaggaggctggcttgcgcttccattggggaatcggaccaccgcgtcttcctccgcatgcagcagctccaacttgttcgtcggcggtctttcctacgacactaacgagacagctctcaaggatgttttctctcaatgtggtgatgttattgcggcgaaggttatatgccatcccacaagcggcaagtcgaaaggatttggttttgtcaagttttcttcgcaaaaccaagctgacgcagcattgcaaaagatgaacggtcaggtgcttgatggaaggaaaattcgggtgcactatgcaaacgggactggatgacttgtgatttagaaacagatagaaaatgagatgagcaggtgatgattgatgagcatccagcggctggatcttaaaaatccgcattcgccattgaagttttgttgagatctcgaagctgtaaaaactcggacgaactcaagcgagacaaagatttctcttggtgacacggactgttataagatgttttctgtgaggaaaaagttagtctatcatatttttacttgccactatttttatttggtttgtaaaataaaatgagttgatccactcatagttagttaatactaaggttatctccagtaacatcctctaaattttatccgaaaaaaatattttttgtcaaaaaaaaaaaa

SEQ ID NO: 13669 - DNA, 3150 bp, Zea mays
tttgtccgtcaatcaccgggatgcccgtcaatttgtgcatccacttgatgtttatggttcattattcataatactcttcttcccaaaacaaaattcgtttgagtgaattagttgatttatacaacacttaatatatatgtatatagttttattatcacccatttgaatatagacataaaaactaagagctaaaacgactattatttcgagatgaagaaaatataatacaatataacaacagatagataattgatgaaatcaaaataaactgaaaggaagcaaattaggtacgggctagatcggtacatatacagagagctcatgattgacgtttgggacacgaagcttagagcatctcaacaatatctcaaactagtgttttactgttgacgcagaatattttgttggtgtcctaaatcaaataaaatatagtcatttttaaattataggtcatttttataggacaatttgctggagatgctcttagagacggatgagagacagagtttaggacataattggcttaaatgagcctggctcccaaaaaaatgaaacctgttttttcgagtctagctccgagagagatgttgcatccagccgtgtaaggtccgctagatacacgttacaagcaaccaaataaacaaacattgtatctcaccaggttggcccgtagacaggctatcaatcagtcccttaagatatctctaccattttatctcttatctcaaatctcaattataaacaatacactatacgatacgaaataatgcaaaccaatgttttaccgtgccagcatgattctcttttaccctatgcgtcgagactctccatcatgcaacgcacatgtgaccgcatcggtcaggtggacctaacgacttccacatgcagattcggaggaaggggagagagggacggtcggtcggtcggagttgaccatattcccagtgccgtgggagtggcggggcccggagcagagtggtggcccagaggaggccgcacgctcgcgtcgtcgtcgtcgcgcggagccgaggcagagcggccgccgcatgcgtcgcacggagccgagccagagcggccaccaccactgttcacgaaagcaggttttgtttgtttgctcgttccggggagaacccgtacacgctacctcttggccgcggccgcgaccgcgaccgtggcgtggcaggctgcatcactggcacacgggaagtgcacgctgctggttgcacgagcggggggcgacgagtgggtgtccgccgtccaggacggcgcgcacgcacgatcgaggcggtcacgatctcgccgtgcggcgcaaggagccaaggaccgcaagtccggagccgtgccgcccggcccgtgcgcggcagtcaatgcccccaagaattgactgcgccgcgcgtgctcgctatccgctatttccattccacccatggcagccacgcttcgccttcgcttctcttctcttctcttctctccgatgcgagcgagatgagagagagaaacagagctccccgaggtgtgtataaatgccaggtcggcgcgttaattctttctagttctactccccgctccccattcacgcactctcactctacctccctccctccctcgccggcgccgcgcgtgctcccgcgggatgctgcgtgcggcgcggtacctgctggggtcgccgggcgcgagcgggttcgggtccaggtcgacggcggaggaggtgaccccggacctgggcgcgacgacggccatcatcacgggcgccacgtccgggatcggcgccgagacggcgcgcgtgctggcgaagcgcggcgcgcgcgtggtgatcccggcgcggagcgccaaggcggcggaggacgtgcgcgcgcgcatcgtggccgagtgccccgccgccgccgtcctcgtgctcccgctcgacctcagctcgctcgcgtccgtgcgcgccttcgccgacaggttcctcgcgctcggcctcccgctccacctcctcataaacaacgccggcaagttctcgcacgggcagctggcgctctcggaggacggcgtggagatgaccttcgccaccaactacctgggccacttcctgctgacgaagctgctggcggggcggatggcggagacggcggcggccacgggcgtgcagggccgcatcgtgaacgtgtcgtccagcgtgcacggctggttcgccggcgactgggccgagtacctgcacctcgtcacccgccgcaagataccctacgacgcgacgcaggcgtacgcggtgtccaagctcgccaacgtgctgcacacccgcgagctcgccgcgcgcctgcaggaaatgggcgccaacgtgacggccaactgcgtccacccgggcatcgtcaggacgcgccttaaccgcgaccgcgacggcgtcctcaccggagagggaactgacagcgcatctggtgttcctgcggctgtccaaagctgctgaaaacgatccctcaggctgcggcgaccacgtgctacggggcggcccacccgagagtggccggcgtgtccggccgctacttcgccgactgcaaacgaggcgctgccgtcgccggccgccaccgaccgccacgaggccgcgcgcctctggcgggtctccgaggccatcatcgacggctgcaccaacagccaaccccagcgggactgcaccactgctcctctaccacgattactgccggcccagacgcagtcacagtcgccgacaggagcttcttcgtcgcctcgtcgtcgagcctgctgagctgatccggccgtccagttccagttccagtatatccgtcccttttgttctcgtccatgcgagatgcgtgtacaatagctagacattatatgtatatccgatcgattatccccggccgtcctagcagcattataaatacagcatatactccttgtcccatatataacaggcactagcatgcagtagccaacgtagtgcagtagtagttctgtgtttgtgtgtgtctcaagtctggactctctctctgaacattgaagctgtactgtaccattattaaaaaaaaaagaaaaaaaaataaaaaacaaggcaataataagatgaaaaaacaactcgtcaactacaaattgaacaagaagaagcatggccttagctaagaggataccatacaatggggggcgctccttttatgg

SEQ ID NO: 13670 - DNA, 2519 bp, Zea mays
gtgcggcgctcaaggcggcctggttcgagaccggcgacagtcggtccgccagtggcagagcggacgacaacgcacgcgcgcctcttcctcctcctcctccccgccgccgccgccgccgccgccgcgcgcgcctttgcgtgccccataccgtctcctccaacacgctcccctcgttggcatcaatttcccatcccacctgtccaccgtcgcccgccgctatctcgcacccgaacccagcgcctccctcgtcgccgccggcgcgccgccatggtgtcgcagcacggcatcctcctcgcagttaacatcatctccgaccatttcggtcctatcgtatccaaagtgtgtggctgccttctgcgccacggcgcgctgtcgttgcaggatatcgtccgccgcctcgaactctcgcccgggcaggtgaagaactccctcctcattctcattcagcacaactgcgttcaggcctacacaagccccagaggggctggcgataggacagtgacgctctacctggccatcttcgacaatgttctgcaccggctgcgcttctcaaagttcctttccgtcgtccgtgtggatattcctgagtcagaagttcttctcgaaggattacttcagaatggtaggctaacatttgagcaacttgtggagcgaacaatatttaaagtatcagaagacagccccttaccaacaagggaagaagtacgaatgaacttcaacaaacttgtctatgcgcattatgtggaacgttgcccaaaaccagaacctttttttgatcctcttgcggttgaacaacctacatccacaaggaaacgggctcctaaaactgttgaggcggttctttcacttgagcagaaagttgtctgtactgcagctctatctgacgctgaaagattttctgagataccatacttcatggacgggtcatcgagtgcaaaagatggccatcatgctgttgctggtaataagcgaaaacatgaaaccttagaagttgatgaagatgattcgataattgcagaaagtgaagtactttggcggataaattttgagagattcatattttgtttaaagaagaagttttgtgcagaacgaaagaaagcaaagatgaggctcggaacacttgctatatgggaagcattttttgaggccaatgtaacaaacaacgacaacaagactgtgacatcaccaatagatggaattttggaaagagtaggacaaaaggaaggaggcatgtcaatgactttggatcacataacaagtgtgttgaatgattgagagtgcacttctaccgctaataacccagaagaattcacattcgatttgaataaattggttgagacatgtcgacacgatgagatagagtctcttgtgaaaaagaaacatgggcaagaagcttatacaatctttaggttattgctgaaacaaggctctccagttgagacggatgaaattactgacaggacaattctagacaagcaggttgttcatgaaactctatacaagctttggaaagatgaatacatagattcagagagagtcccttcaacatcagcaacaggaacaggaagcgctcagttctttgtttggagagtaaaaaatatttatagggaacacttcatggacaatctttaccatgctgctttaaacttgcgccagatggtcaattatatggctgaactactacttgagggttcaaaggatgaaatcaagcttcggaacagaaaaaacattttgatcctagctctcactagacatgatgaatcccttatgttgttccatgatttttgagaatactggaacaggatctggttataaatttctggtctttggagaaaccaaagcatggtgatttttctttggaattgtcaaagcttcgtacctatgatgttgttgagggagttgctcgtcaacttgaattggaccatgcatgaaaattcggcttacatcccacaattgctaatctcagcaacctaaaccacagcctgtcaagtatcgaacagtggagcatctgttggacatgctcatcctttacaatcagattaaccttttttgtttcttttggtcaatatgagcatgatttccgtgtaacaaaatgtgttggacttcctgaactttaacaaagattattacattcagttaaaacatcgtttcccccagtttatatgtaacatcagaatagatgttctttgtggttaaatgtcattgtgcgccaagtcatgcatctggtatgcttgtctgttgctgttaacgcctcgtaggttgtctggacgacttcatttggaacacatgccaacaggcaaacaagaggggcatatttatattgcagtttagagtaacaaacatgatatcctactagtacttcgttccatctctagagaccatctctagagggagtaatcgatagattcagattttgaattaccatcggatcagacttctccacacatcacttttttttctatgccattagtgatatttttgggcgttcagctctagatggatgaaacgttaaaaatgtc

SEQ ID NO: 13671 - DNA, 2971 bp, Zea mays
  misc_feature (2102)..(2102): n is a, c, g, or t
  misc_feature (2138)..(2138): n is a, c, g, or t
  misc_feature (2625)..(2625): n is a, c, g, or t
gcacgagaccattacctagaacatcctaatcgaaaaaaaccggagcggcggcaccatttcgttaccatggagaacctggcagggcagcagttcgtttatgaggtgacgagtctacgagcattgtttctgctgctcctcctccctcccttcatcttcctcatcatgcgcaacgcgcgagcaacaacactaatgttcgataccaagaggacaaggggccaccggcagcctgcagatcggcagcagagcctcccgccgtcgcctccggcagtgcctgtcctcggccacctgcacctcgtcggctctctcccgcacgtctccctccgcagcctcgccaggacgcttggcgcggacctcatgctgctccgcctgggctccacgccggtgctggtcgtgtcgtcgtccagcgccgccgaggccgtgctgcgcacgcacgaccacgtgttcgcgtcgcggccgcacgccctggtctccgaggtcgtcctgtacggtccgtccgacgtcgggttcgcgccgcacggcgactgctggcggcgggggcggaagctcatcaccacgcaccttctcagcgtcaacagggtgcagtcgttccgccacgcccgggaagaagaggtgagcgtggtgatgggccggatcgccgaggcggcggccgctggtgcggcggtggacgtgggcgagctgctcggctcgttcacgaacgacctagcgtgccgcgccgtgatgggcaagtccttccggagcgagggtcgcaacaagctgttccgggagcttgtcctcgacaccaccaagctgctggtcggcttcaacgtcgaggacttcttccccttcctggctcgcttcggcgtgctcagcaagctggtccgcgccaagtccgagagactgaggaggaggtgggacgagctactcgataggctgatcgaggatcgtgagagcaagtatgaggcggcggcggcgagtgatctcaaggtcaaggacgatgatgacgataacttcatacatgtcttgctctccgttcaacaggagtacggccatattaccagggagcaaatgaaagctctcctgcaggacgtgtttatcggggggatagactccacatcttcgctgctcgagttcaccatggctgagctcatgcggaaaccacgagtgatgaacaagctccaagccgaggtaaggagcagcacgcccgaggggcatgatggagtcgtcggcgaagatagcctggagcacatggcctacctgagggccgtgacaaaagagtccctccggatccataacgtgacgccgctcctggccccgcacctgtccatggatagctgcaccatcgatggctacacggtccccgccggggtgcaggtcctgatcaactcttgggccatcggcagggacacgcgctactggggcgacgacgctgaggagttcgtccctgagaggttcatggacggcggcagcgccgttcatgtcagcttcaaggggagtgacttcgagttcctgccattcgggtctggacgaaggatgtgcgccggggtgaacttcgcgatggccacggtagagctaatgttggcgaacctcgtgcatcgttttgactgggatttaccaccggggcaggagggtcgcgacattgatgtgtcgcaggtgttcggactagtagtccgccggaaaaagaaacttctcttggttccaaaattacgtgtatactagcatccccctccccgcacccaagatatactgggctgttgcatatatgtatgtactgcaataaaggttgcctatatgtaagcttacgacattacttgtactgggtatatgatgcaataatgttattagaaatttaagcaaaaaaaaaaaaaaaataatccagaaaaatattaatagcatgtttacaacatgaaaaagttgcacgtcaccaccggaatccgacttttgacagatgcttattgctttgccaaagttaatttatcggacattcggcaaaacacactttgtctagtgccacacttggcaaaagaaaacactcggcgacgaacatttttgtcgagctcggcataaaaaggctatcgacaaagaaacgcccaactcccgtcaaaactaggcactcaacaattcgntgtaagcagccaacgtccgttacctatgacgagtgnatgagtcagacattcggcaatatttttctttgccaagtgcccaagtaagacactcgacaaacacatattctgtcgagtgtgtcttttatagccacttggcaaggtttattttattttttccccaaactttttgtggagtgtttctacagtttttgtacctacatgtttaatattggtacatttctcaaaatgtttgctatatttgttggatttagttcatttaattgaattaatttggataattcaaatttgaacggtaagtcacccgaaaaatagcaaataatgaatgcaaaaatgatattcatgttattgagcacaagttacggcctaaatcaggaatgaactagaaatttcgaacaccattttcacgagacatgaccgcgacttgcaatgcaattgttttaaaattatagaaaatacaaaaaagtcagaaaatcatcaaactgtcaaaatgtcatgataccatatatatatatatatatactangtgagtgcccgtgcgttgcaacggaaccgtataagaacacgataacttatgtacataggtgtgttatattgttatgagaaaatgtttcggaatctatttgtgatcctacccatacattaattttgttactttaatctagctatttcaccattacattgcaaccatcagtaccatatatagacttatatatatgattttaataatgtcattgagctataatgacaacacgattagggaagtgtaatttacaactcaaatctcagaaaaaggtactaagaaagcacgaaaataaggtaattagctctgtcacatgaaccaagtgaacaatgaaatatctccatccagc

SEQ ID NO: 13672 - DNA, 2065 bp, Zea mays
ggacgtggggcggacgcgtgggtaagaaatccccacctggacatcattattccaacgtcagccatgagtctcataatccagtggaagaacaaaaaccacatcaatcacatgataaccccaatgaaagaatagatggcattcttggtggcaacgaagttcctggtgtgtcgacctccaggatcgatgcaatgaataaaattgacaagggtaaggtaaaagcagctttggagaagcgaagaaaaacaaaaggtgatattaccacaaaggtagacgtgatggatgatgatgatctacttgagagagagcttgaacatggtgttgaattggctattgaggatgagaagattaagcaggataagatgcagaacttgtcccatattaaggacaagaagattacgcaggataatatgcagaacttgtcccatattaaggacgagcaggataacatgcagaacttgtccgacattgaggatgagaagattaagcaggatgagaggcagaacatgtcccatgctccagtggatcttcaaaccactgaccaagtaatggagaatggtcaccatgtcgagcctagtgtaccaacaactgtggaagacacggggtttccattggacaacaaagaacatcctccatttgataagcaaaatgatgttcctgagcacgagtcccagcagcttgaacacacattgaagcacgacctccctcagctggtaggggggcctgagcaggatgatggaacagactgtaaaaggcctaagctcgaagagtaggttctggatgatgctcactttattttggacagttttcctggagactggtgaactgcatacaacttggcacggagttggtgagcatggctttgccggtgccttgctgtgctgtgaaatatgccctacggctgattgcagtttacaattcgagggaggtcgtgctagcaaatatttttacgttcaaacgaacattggaatatatggaccaaaacatgctcacgcttctgataacggttgcattcgttccttaaatgtgttccatgaaagtgaagcaaatgattttcatcccatcagggttgcatgcacctcatctcaatagaaaattaaaaaaaaacagtatttttataacttttcaacaatattatactacaacttttgcacaaaaaagctgtcgaggaaaacctttgtagaaaagttatttggaaaaaacttttgttgaaaatggtttttttaacaaacttaaggtctgctttagattatataacatagattatgaattagtattgcagcctgtttcgatggatggattattactgtcccaaatgatccgaatattcttaaaattattcaacaagttttacaattgtttttgtgaaaaagataaaatgaaagagtgaacgccgcctcgccaaattgtttttgtgaaaattagatattcgggtcgagtacggttacccggaatttgggtacccgttttttatttttctgcataataatatagttataaaatcataacttttacatatgaaattagacgaagatatatatgaaaattgtagagttcgaagagatctataactttgtagtacatcacaattttttaaacacatctttaggccaatattattaaaatagtgtctaaatttatatcaaattaatagactttaccattttcatatggtgactaaggttatctccatgtgggaacttaagtatggatggataaaaaacctatgcagggggcagccaaggagagccctttggctccaacaatttttcagcctcttctttcctcatctgcatgctccataatcagaggaagggtgggagaccctccataaaaaatgactctattacgatgcttccaaatcatccgcgaccctaaaatgatgggggagtcaagaccttccctcaccaaaccatttactgtctctgaaaccatctcccaccaatccataaaagagactgcatctggctgtggggctaaactatgcagcccgaattttcttagcaggtcgtaccagaaaatccttgagaagacacaattcacaggcaagtggttcaggggtttccct

SEQ ID NO: 13673 - DNA, 899 bp, Zea mays
acctcccgtccgctcctctccatccggcagttcgaggccggcccgaaacgcctctccagctctcctctactagacttgttttttccgtccatcgtttcgtttgttccacctgcgcaactgcgacggggataagtacgtcttccagatgacgacggcggcatggccgcggccacgcttcctcgtcctcccccagcctggattcctccgctcggtctgccacggcctctgctcccgctgtctcttctgcttcctgctgctcctcgccttcgcctgcagctccagctccgggcgggtggtggtcactagcttgcctggcttcgacggcgacctccccttccacctcgaaacagggtacgtggaggtggaggaggacgccggcgtggagctcttctactacttcgtccaggccgagtccggcgccgccgccgccgccgatgacacccctttcctcttctggctcaccggcggcgaccgctgctccgtcttcagcggcctcgcctacgagatcggtcccatcagattcgtcctggaaccctacaacggcaccctgccgcgcctgcgatacaaccacaactcgtggtcaaaggtgtcacatatcctcttcgtcgattcaccggttggagctggattttccttctcgagagatcccaaaggctacgatgtcggagacatctcggcctcactgcagctacaggaattcctcatcaagtgggttcagtgatcatcccgagtacctcgcgaatcctttctacattggcggggactcctatgtcggaaaaatcgtgccgttcctcgggcagatgatttcagaaggtattgaacttggaaagagacccttccctaacctcaggggctatctggtgggtaacccatcacgggcgaaagtatagatttcactt

SEQ ID NO: 13674 - DNA, 1862 bp, Zea mays
ccgggacgcctctccagctctctctactagactactagacttgttttttccctccatacgtttcgtttgttccacctgcgcaactgcgacggggataagtacgtcttccagatgacgacggcggcatggccgcggccacgcttcctcgtcctcccccagcctggattcctccgctcggtctgccacggcctctgcgcccgctgtctcttctgcttcctgctgctcctcgccttcgcctgcagctccagctccggacgggtggtggtcaccagcttgcctggcttcgacggcgacctccccttccacctcgaaacagggtacgtggaggtggaggaggacgccggcgtggagctcttctactacttcgtccaggccgagtccggcgccgccgccgccgccgatgacacccctttcctcttctggctcaccggcggcgaccgctgctccgtcttcagcggcctcgcctacgagatcggtcccatcagattcgtcctggaaccctacaacggcaccctgccgcgcctgcgatacaaccacaactcgtggtcaaaggtgtcacatatcctcttcgtcgattcaccggttggagctggattttccttctcgagagatcccaaaggctacgatgtcggagacatctcggcctcactgcagctacaggaattcctcatcaagtggttcagtgatcatcccgagtacctcgcgaatcctttctacattggcggggactcctatgtcggaaaaatcgtgccgttcctcgggcagatgatttcagaaggtattgaacttggaagaagacccttccctaacctcaagggctatctggtgggtaacccaatcacgggcgaaagtatagatttcacttccagagtgccctacgctcatggagtcggtatcatatcagatcaattgtatgagacgatattggggcattgccaaggagaggactacactagtcctgcaaacgctctgtgtgctcaggctctggacactttcaacaatctcatcaacgaagtccagaacgcccagatcttactggacacgtgcgtctacgcgtctcctgcgccaaacgttctcagcagaccggtggacggtggtagaaggatcctgagggcggcggggatgggaggaggggcgacgctgaaccatccgccagctcgtcctcggtttggctgcatcacctacggctactacctgtcgtatttctgggcgaacgatgaacgcactcgaacagctcttgggatcaagaagggaacagtggacgagtgggtgaggtgtcacgacgcagacctgccgtacacgatcgacctcaagagcgccatcaagtaccaccggaacctgacgtccagaggctaccgcgccctggtgtacagcggcgaccatgacctgctggtgccacacctgggcacccaggcatgggtcaggtccctcaacttccccgtcgtcgacgactggagggcgtggcatctcggtggccaagccgccgggttcacgataaattactcaaacaacatgacgttcgcgacgatcaaaggtggcgggcacacggcgccggagtacgagccggagaggtgtttcgccatgttcagccgctggatactcgaccgtccactctaatctccactcgtacattgccggattcttgcaccatgaccatgattgatggactgtgtggattgcagttcataggtggaataaaatggatgatttctgtgaatggataggtctgccaactaggcaactttgtgtaaattaactaggtctgtgtcagcgcgctttaacgtaatatatgcggggataaatcgtacaaaaaaaaaaaaaaaaattttaggaaaaaaaaaaaaaaaaaggaccctagggcc

SEQ ID NO: 13675 - DNA, 2105 bp, Zea mays
gttttttccgttcatccatccatacgtttcgtttgttccacctgcgcaactgcgacggggataagtacgtcttccagatgacgacggcggcatggccgcggccacgcttcctcgtcctcccccagcctggattcctccgctcggtctgccacggcctctgcgcccgctgtctcttctgcttcctgctgctcctcgccttcgcctgcagctccagctccggacgggtggtggtcaccagcttgcctggcttcgacggcgacctccccttccacctcgaaacagggtgcgcgtgcccgcgtggcgtgtctactagtagtatcctccttcttcttcttcattcattcatcctggtggtgtactactagactactactagtagctcacgcgcgcggcacatgtagatgtagcctctaaccaccgttgctgccctgaaactcaaaacgaaggtacgtggaggtggaggaggacgccggcgtggagctcttctactacttcgtccaggccgagtccggcgccgccgccgccgccgatgacacccctttcctcttctggctcaccggcggcgaccgctgctccgtcttcagcggcctcgcctacgagatcggtcccatcagattcgtcctggaaccctacaacggcaccctgccgcgcctgcgatacaaccacaactcgtggtcaaaggtgtcacatatcctcttcgtcgattcaccggttggagctggattttccttctcgagagatcccaaaggctacgatgtcggagacatctcggcctcactgcagctacaggaattcctcatcaagtggttcagtgatcatcccgagtacctcgcgaatcctttctacattggcggggactcctatgtcggaaaaatcgtgccgttcctcaggcagatgatttcagaaggtattgaacttggaagaagacccttccctaacctcaaggtatgtccatcatacatttctctccggaatggaagatgctatatcgacgtgggatactagctagtctatatccaagaaattaattgtagtcggtcacttaggctgatgatatgcaggttctgaatttgtcatgatcagggctatctggtgggtaacccaatcacgggcgaaagtatagatttcacttccagagtgccctacgctcatggagtcggtatcatatcagatcaattgtatgagacgatattggggcattgccaaggagaggactacactagtcctgcaaacgctctgtgtgctcaggctctggacactttcaacaatctcatcaacgaagtccagaacgcccagatcttactggacacgtgcgtctacgcgtctcctgcgccaaacgttctcagcagaccggtggacggtggtagaaggatcctgagggcggcggggatgggaggaggggcgacgctgaaccatccgccagctcgtcctcggtttggctgcatcacctacggctactacctgtcgtatttctgggcgaacgatgaacgcactcgaacagctcttgggatcaagaagggaacagtggacgagtgggtgaggtgtcacgacgcagacctgccgtacacgatcgacctcaagagcgccatcaagtaccaccggaacctgacgtccagaggctaccgcgccctggtgtacagcggcgaccatgacctgctggtgccacacctgggcacccaggcatgggtcaggtccctcaacttccccgtcgtcgacgactggagggcgtggcatctcggtggccaagccgccgggttcacgataaattactcaaacaacatgacgttcgcgacgatcaaaggtggcgggcacacggcgccggagtacgagccggagaggtgtttcgccatgttcagccgctggatactcgaccgtccactctaatctccactcgtacattgccggattcttgcaccatgaccatgattgatggactgtgtggattgcagttcataggtggaataaaatggatgatttctgtgaatggataggtctgccaactaggcaactttgtgtaaattaactaggtctgtgtcagcgcgctttaacgtaatatatgcggggataaatcgtgcaaatccaaaaaaaaaaatttaagggcggcc

SEQ ID NO: 13676 - DNA, 986 bp, Zea mays
cctcgagggtacggtctcggggcagcgccgaacatcgtcagagacacgcgtccaaacatacagctagatagcctctgcatgcctacgtacagcatggccaaggccgagctgctcctcgccctcgtggcttcgctcgtcgtgctgccattctcctccctcgccgtgtaccaggacttctgcatcgccgacctatccgccgccgccacgccgggcggctacccgtgcaagcccccgaaggacgtgaccgccgacgacttccactacggcggcctcgccacccccggcacggcgctgaaacccttcaagatctccctgggctcggccgtcgtcaccacgttccccggcctgaacgggctgggcatctccgccgcgcggatggtgatggtcccgggcggcgtcgcgccgctgcactcccacccgggaggcaccgagctcatcttcgtcatcgagggcagcgtcgtctgcggcttcatcagcgccacgctcaacagggtgtacaccaagacgctgtacgccggcgacctgatggtgctcccgcagggccagctccacttccagtacagccacggcaacaccacggcggtgacgctgtcctcgttcagcagcgacaaccccggcctgcagatcctcgacttcgcgctcttcgccaacgacctgcccacggaggtcgtgaacaaggtgaccaacctggacgaactgcagatcgtcaagctcaaggcgctgttcggagggaggggctagacgcatatgtactccgtgtataggaacagtcaacggtattgagccttgaattgtgtgtattattctatactgcttgtgcattgtgatggatgtttgtcttgtcattctataaaataaattgtatcgcgcgcaacaggcgtgaaagcgaaagtagctgccacatttgatgtactaatatttacatcccgattgttgataataatacattattagcgctagtttgtcaaaaaaaaaaaaaaaaaaaa

SEQ ID NO: 13677 - DNA, 1793 bp, Zea mays
  misc_feature (1785)..(1785): n is a, c, g, or t
cttaagcctataacttaagaacttacatcagtcctccaacactcaattgatattgtatatcgatatccaaatctactgtcgacacagatggtcattcaatctctaaattaaatatggattagtcgttgcacttgcagcctttctgggtagggatgttcctaagcctttctgggtagagatgttcctaaaacgtttgaattatgtgacaaatctaatattttaacctagatatgcatagaattttgtgctaaattttagttatgttattggaaatattatgaagggcaaaaataatttttttgtgtgcatccgaattgagggcaccgaaaaaggatgaaaaacatttgaatctgaatttgtatctgtattcaaattttatatgaatcatttaaaaagatatagaataatttgaggtttactttttataaatattattactctcaatgtaaaaaacaagaacataaatttatatagcaaattctatgtgctatttgttcaccattgaagaaaaaaaacaaaaaaaaacatctgaataagtatccattccgggctcaccgattcagcacgtgatgcgtttgcgggttgcgcggacgtggggcgggttattagccgcctctgtcatccccgattattgtgtgctagtggtgattatattatattattatagacagttctggatcgatatacgccgccgggcagttagctagccgccggggcaaagaacaggtgaacacgccacactcctagtcctagtatatataggggtactcgcgggccggccgggaacatcgtcagagacacgcgtccaaacatacagctagatagcctctgcatgcctacgtacagcatggccaaggccgagctgctcctcgccctcgtggcttcgctcttcgtgctgccattctcctccctcgccgtgtaccaggacttctgcatcgccgacctatccgccgccgccacgccgggcggctacccgtgcaagcccccgaaggacgtgaccgccgacgacttccactacggcggcctcgccacccccggcacggcgctgaaacccttcaagatctccctgggctcggccgtcgtcaccacgttccccggcctgaacgggctgggcatctcccgcgcggatggtgatggtcccgggcggcgtcgcgccgctgcactcccacccgggaggcaccgagctcatcttcgtcatcgagggcagcgtcgtctgcggcttcatcagcgccacgctcaacagggtgtacaccaagacgctgtacgccggcgacctgatggtgctcccgcagggccagctccacttccagtacagccacggcaacaccacggcggtgacgctgtcctcgttcagcagcgacaaccccggcctgcagatcctcgacttcgcgctcttcgccaacgacctgcccacggaggtcgtgaacaaggtgaccaacctggacgaactgcagatcgtcaagctcaaggcgctgttcggagggaggggctagacgcatatgtactccgtatataggaacagtcaacggtgttgatcattgaattgtgtgtattattctatacttgtgatggatgtttgtcttgtcattctataaaataaattgtaacgcgcgcagcaggcgtgagagcgaatgtagctgccacatttgatgtactaatatttacatctccattgttgataataatacattattggccctaaaaaaaaaaaaaaaaacccgcggccttgcggtcccgccggccccgcttctagaggtatctcaagcttccgcacgcgtgcatganacgtcata

SEQ ID NO: 13678 - DNA, 975 bp, Zea mays
gcacgagaccattacctagaacatcctaatcaaaaatcgtcagagacacgcgtccaaacatacagctagctagcctctgcatgcctacgtacagcatggccaaggccgagctgctgctcctcgccctcgtggcttcgctctccgtgctgccattctcctccctcgccgtgtaccaggacttctgcatcgccgacctatccgccgccgccacgccgggcggctacccgtgcaagcccccgaaggacgtgaccgccgacgacttccactacggcggcctcgccacccccggcacggcgctgaaacccttcaagatctccctgggctcggccgtcgtcaccacgttccccggcctgaacgggctgggcatctccgccgcgcggatggtgatggtcccgggcggcgtcgcgccgctgcactcccacccgggaggcaccgagctcatcttcgtcatcgagggcagcgtcgtctgcggcttcatcagcgccacgctcaacagggtgtacaccaagacgctgtacgccggcgacctgatggtgctcccgcagggccagctccacttccagtacagccacggcaacaccacggcggtgacgctgtcctcgttcagcagcgacaaccccggcctgcagatcctcgacttcgcgctcttcgccaacgacctgcccacagaggtcgtgaacaaggtgaccaacctggacgaactgcagatcgtcaagctcaaggcactgttcggagggaggggctagacggatatatatgtactccgtatataggaacagtcaacggtgttgatcattgaattgtgtgtgtattattctatacttgtgatggatgtttgtcttgtcattctataaaataaattgtaacgcgcgcagcaggcgtgagagcgaaagtagctgccacatttgatgtactaatatttacatctccattgttgataataatacattattggcctcaaaaaaaaaaaaaaaa

SEQ ID NO: 13679 - DNA, 2579 bp, Zea mays
ctgcagaataatactcagcatggttgcggggacagtgccgataccatttgggagaggtcagtcgacttctctttatgccgatgtggtgatgttgattgtattgaggtctgtgatatcagggagtggttgccaaaatcaaaaatggaccataagctgtggaagcttgttcttttgctaggagaatcttatttggcacttggagaggcatacaagaatgatgggcagcttcagcgcacccttaaagttgttgaattagcttgtttggtatatgggtctatgcctggacatattgatggcgacgagttcatctcatccatgtccaacagttcattgagtcgagaagatcttgccctaaaaactaaacttgtactggacgaggcagactattgcaataacaaaagatgcttcagttatgaagtttcttcccaccaattgccaccaaattatttgttctgggcaaaggcatggatgcttgttggtgacgtctatgcagaatatcacagattgaatagtcatcaagcaaagttggcaccagaacagaagtctcatggcgaagttagaatgtcaaatgaagttgcattggaggtcaaacgccttaagagaaaactgggaaaggataagcagaattgtgacacatgctctttgataaactgtagctgccaaagtgacagggcaagtagtggcagcagtgcaagcagcagtagttctgaggcctctaaactttacagccgaaagaaaaacaaaaaatcacttggtaagaaccttcaacttcaatcacaatatagagaagccagcaagaaccccaatgcacaagaagctacacaaggttctgaaaataaacagcatgatgtgaatgatacttgtattgagaacaactcagtattaaatgatgatattggtcactacagtcaggccagggaaaatcagtcaagaaatgttgatggtgttcctgataaatctcaagcaagtgttcctactgtgagggatggtggtatcttcaagttccttggtggtccaaaaccaggagatgttgagtacaacttgtcttctgctattcactgctatggtgcagccaagggagcattgttcgcatttcctgtgcattcagtagaaacttccatggttcttaagaaaagaggctggggatttaatgaactgggccgttgtagacttgagaatagaaatctggttagcgccgagattgcttttgcggatgctattaaagcatttgaagaggtgtttgaccacacaaatgttatactgatcaactgtaacttaggtcatggtaggagagctttagcagaggaatgtgtatccaggattgatgaatttcagaaacatgatcttcctgaaggcacatatatgcaatcctttaagtcggccaagtcagaatattttcaagcaataaactactattccgcagctaagaggcaactgaagtatgtcaatactgaggccgataaagtactataccatgaggtttacacacagtatgcccatacctacctgaggcttggaatgcttttggcaagggaaagcttcttaactgacagttatgaaggtggacttgtcaatgagtcatctaacagaacagctgtagagatttcagcgagtgatgcttttcgggaggctttgtctacgtatgaatcccttggtgaacatcgcaaacaggaagctgcttttggtcattttcagcttgcttgttatcagagggatctgtgcttaaggtttctggatttagttgacaaggaggttaaacagaaaaacgaggataaatatcgtcagaaaagtaagtggtatggttcactagctgagaagaactggcagaaggctttagaattttatgggccgaagacacatcctactatgtttcttaacatccttatggcgcagtctgccctttctattaatatttctaattccttccactcaaccgcgatgcttgacaccgctctgactcacttgttggaaggccggcatgtggttgaagcaaatgaagacaactccaacgatatggatctggacataaaaccgaagttctggtgccagctgcagagcctgctgaagaggatgctggcgggatccctgcctagcagcacgggcagagcagcctctgtcagccaagccagcactagcagcagaacagaaacttctaagctgaaagagatgtatcgtttgtcgctcaaatcttctaccctgggccagctgcatgcgttgtacaagctttgggtatcttaacacctttattttacaaatggttgctgctcatgttttatgtcgtcggcatctatatcttgaattacatagttcttatttggtgttcacggcacgttttttttttgttttgatttccagccaacttttaaaactaaatattaagtgtaaccatggaatgtcatggacgggacacactagctactacagtctacaactgttttgtagacttatataaacagcaaataatggcattctatgtgaagcgacattgtattaaaactcgtgggggggcccggtgagagccaatgccaaaatatctgaatgtatgtgccctgcttcaccgggaatggataaatgtttgg

SEQ ID NO: 13680 - DNA, 4493 bp, Zea mays
agaacgaggatctctgcagagcagtagtaacctgtaaagaggtacccaccataaagcagcactgtcacaggctcacagcagagtaaccgtaaagcagcactgtcacagcaggccgtcagaaaacgttttagaaggttacatacgcctaaagccaggagcaacagccactgtcaactcctgtgccagcagtacaaagtctcagggattaagaataattgacactgcatacgaaacgctcttccatggaacactggataaaagcccgattaccgagagaattagcactggccttgttttcacagaacacgaggaagagatgttttcacctccaaagagagcagcagcgattaacaattcaggggagggagagggaggctgcaatggcagtaataagtacaccaactggcgataaacatatgcagagatcatgacaccaaccacaccaccttcctctcatcttccccgtcactagcactagcgcatccagtatccattttcctgattaaaaaccgattccagtacgattagtttaagtgtccaggccaagatccaatcaagcctgctctttagtagcagcagcacactgtcacacacaacactgcaacaatcgttcaaaaatctgttctttcgcttggtttttctttggggggccaaattgtaggcaattgcttggtgctcatttggatccagatctcctgcgctttccctgtagtacaaacaattcatggggtctccccctctacaatcccaatgcttgcgagaggcgccacctcacagagccagccatccaccgcattgccgcccccctcgcctctcctcacgtcacccgcccgtctcagcctcaccaccgaggcgcgcgctgccaatgccgccacggtcccgcgccgcggcaccgaggctcgcgtttctcgtgccgctcgccttcgccttcgccttgctgctggtgccgccgtgccactgcgtcaacgagcagggccaggcgctgctgcgatggaaggacaccctgcggccggcgggcggcgcgctggcgtcgtggcgcgccggggacgcgagtccgtgccggtggaccggcgtgtcgtgcaacgcgcgcggcgacgtcgtcgggctgagcatcacctcggtcgatctgcagggccctctcccggccaacctgcagccgcttgcagcgtcgctgaagacgctggagctctctggcacgaacctcaccggcgcgatacccaaggagatcggcgagtacggcgagctgaccaccctcgaccttagcaagaaccagctcaccggcgcggtccccgccgagctgtgccggctggccaagcttgagtcgctcgcgctcaactccaactccctgcgtggagccatcccggacgacatcggcaacctcaccagcctgacgtatctgacgctctacgacaatgagctcagtgggccgatcccgcccagcatcggcaacctgaagaagctgcaggtgctccgcgccggcgggaaccaggggatgaagggtcccctgccgcaggagatcggcggatgcactgacctcaccatgctcgggctcgcggagaccggcgtctcagggagcctcccggagacgatcgggcagctcaagaagatccagaccattgccatctacaccactctgctctccggccggatcccggagtccatcggcaactgcacccagctcaccagcctgtacctgtaccagaattctctctccgggccgatacctccgcagctcggctacctcaagaagctccagactctgcttctatggcagaaccagctcgtcggcgcaattcccccggaactcggacagtgcaaggagctcacgctcattgacctgtcgctgaattcgcttaccgggagcatcccggcgagtttgggcgggctacctaatctccagcagctgcacctgagcacgaaccagctcactggcaccataccgccggagctctccaactgcacgtcgctgacggacatcgaggtcgacaacaacttgctgtccggggcgatcagcatcgacttcccgagactgcgcaacctcaccctgttctacgcgtggaagaaccggctcactggcggcgtgccgacgagcctcgccgaggccccgagcttgcaggcggttgacctgtcatacaacaacctcaccggtcccatccccaaggcgctgttcgggctccagaacttgaccaagctgctgcttctcaacaacgagctgaccgggctcataccgtcggagatcggtaactgcaccaacctgtacagactccggctcaacggcaacaggctgtccggcgcgattcccgccgagatcggcaacctcaagaacctaaacttcctcgacatgagtgagaaccacctcgtcggcccggtgcccgcggccatatcggggtgcgccagcctcgagttcctcgacctgcactccaatgctctgtccggcgcattgccggacacgttgccgcgcagtctccagctcattgacgtctccgacaaccagctcaccgggccgttgagctccagcatcgggtcattgccggagctgacgaagctgtacatgggaaacaaccggctgaccggtggcatcccgcccgagctcggttcgtgtgagaagctccagcggctccgcctcggcggcaacgcgttctccggtggcatcccgtcggagctcgggatgctaccgtcattggagatctcgcttaacctcagctgcaaccggctttcaggggagataccgtcgcagttcgccggccttgacaagctcggcagcctcgacctgtcgcacaacgagctctccgggagccttgagccgctcgcggcgctgcagaacctcgtcacgttgaacatatcctacaataccttctctggggagctcccgaacactcccttcttccagaagctgcccctcagcgacctagccggcaaccgccatctcgtcgtcagcgacggctccgacgagtcctcccggcgtggcgtcatctcgtcattcaagatagccatatccatcctcgccgcagccagcgcgctgctcctggttgccgccgcctatatgctcgcccgcacgcaccgccgcggcggcggccgcatcatccacggcgagggctcgtgttttttttttttttttctgaagctcgacatcaccatggacgacgtgctccgagggctgacgtccgcgaacatgatcggcaccggcagctcaggggccgtgtacaaggtggacacccccaacggctacaccctcgccgtgaagaagatgtggtcgtcggacgaggtgacgtcggcggcgttccgcagcgagatcgcggcgctgggctccatccgccaccgcaacatcgtgcgcctcctcgggtgggccgcgaacggcggcacgaggctgctcttctacagctacctccccaacggcagcctgagcggcctcctgcacggcggccgcgccgccaagggctcgcccgcggacgagtggggcgcgtgctacgagatcgcgctcggcgtcgcccacgccgtggcgtacctgcaccacgactgcgtgccggccatcctgcacggcgacgtcaagtccatgaacgtgctgctcggcgcgtcctacgagccgtacctcgctgacttcggcctcgcccgcgtcctggccgccgcgagctccaagctcgacaccggcaagcagccccgcatcgccggctcgtacggctacatggcaccaggtggagatttcttagcgttcacgatcctaggaatatttccgttcgatttttttcctgacagatctcttttttttttgcgtaaataagcagagtacgcgtcgatgcagcggatcagcgagaagagcgacgtgtacagcttcggcgtcgtgttgctggagatcttgacggggcggcacccgctggacccgacgctgtccggcggcgcgcacctggtgcagtggctgcgcgagcacgtgcaggcgaagcgtgacgcgtccgagctactggacgcgcggctccgggccagggcgggcgaggcggacgtgcacgagatgcggcaggtgctgtccgtggccacgctgtgcgtgtcgcgccgcgcggacgaccggcccgccatgaaggacgtggtggcgctgctcaaggagatccggcgccccgcggcggtggacgacgcgaagcaggcggccacccacggccgccgcgccggtgtcgccggtgagcgcgcactcgagggggccaatcgtcgagctggctccttcgccgtgtcggagtactctgcctgacgggacgcgaatttttgcgagtgggtaggtgaacctaggtaaattactagctaacatcttagcgagccgtaaacagtgttgattagccaaagatgtactactggtaatgttgtacttaggtgtaatctgccattgtacattactctcgagaatgtcggtttttgtagcagccttttggcctaacacatctgccaaatctcaacctgtgtgttgatatgcttgtatgatcagcaatgcgcatctcggtactgtctgaaat

SEQ ID NO: 13681 - DNA, 1746 bp, Zea mays
  misc_feature (1659)..(1659): n is a, c, g, or t
  misc_feature (1666)..(1666): n is a, c, g, or t
  misc_feature (1670)..(1670): n is a, c, g, or t
  misc_feature (1701)..(1701): n is a, c, g, or t
  misc_feature (1704)..(1704): n is a, c, g, or t
  misc_feature (1707)..(1707): n is a, c, g, or t
  misc_feature (1740)..(1740): n is a, c, g, or t
cattgggtacctcgaggccggccgggacaccttgttgccttttccttgtgcggcacggatgcttttgctctgccccagcgacggcgcagatcgcaaagcaccagggcgatctcggcgcccagcacgggcggttcaggtcaagcctcgcgtcagccgtcaggtctcctccgggcagcggccgcgtgcgtccccccatcccccccattcgacgagagagagattgccccccacccattcgacgagatctcggaggcagcctcgaggtgaccctgttctgattctcgtggtttcaggggaggatctaggtccagggagattaatctcgaggttggacctcacatttttatggcctttgactgcaacaaggaaagaggagtttcttcgcctgacagttgctcccgcatttgcaccgagggcactctcgtccaggcaaatcccttatctcactactggaagcctaaacgtttggagaacttcaacaagttggagaaccagaagtccagttatgaatctgctccgagtggctctgatccaaaacaggatgctgaagcgagtgatgaggcaactgcctcactgtgtggcttcaggtgcttcactgatctgccagcttcgttggtctgcgaggtccttgcacgtctcgatgcgaaggaccttggaattgtatcctgtgtctccaccctcctgcacgccttagccacagatcatcagggatggaagaagttatactgcgaaaggtgggggcttccagacctccccaccaccctgaatgggcccttgctgccgggtgtccccctagatgggaagttttggaaaacatttttcgtggagcgggagtttaggagcaaatccttcatgggaagattcaatctggatattctccgtggccacaatgaggatgtgcgtgctgtgtcccttttggtatcagcaaatctgatattcacaggcggccgcgattctgtggttaggatgtggaagatggaggaagggttattgattgatacatcccgtgcacttggtggcaccatccgggcgattgcagctgactcgaggcttttagtgagtggaggaactaatgcctatattcagtgttggagggccgttgaaggcaatggtcaattatttcacatctctggaagtggtaccgaccagaatgcggagtttcgcctctggggtcatgaaggtcctgtgacttgtcttgccctggattcactgaggatttatagtggttcttgggacatgactgttcgtgtttgggacagagaccagatggagtgtgtgcaaaagttcatgcatgcagactgggtttgggatcttgctctgcgtggaaatactgttgccagtactgctggtagagatgcatatgtatgggatatcagggctggcgagttaacaagcttaatttccaatgcccatgttggtagcgcatattcaattgcttggacacacctgccagatgtgctgtttactggtggagaggatggcgctattcgattgttcaatgtttctgatgtctgtgatgatgagggtgacattaaaccagtggcaacttgggtgccacattcaggtcctgttcattctcttgcttttgagtatccatggcttgtgtcagcctcgagtgatggcaggattgcacttattgatttgaggaagcttctgtcnctccaanagtngcatcaaagggtctgcgtgttaagagagttnatngangcgcaatagagcctccacagaggatgcttcatngcgttg

SEQ ID NO: 13682 - DNA, 1266 bp, Zea mays
  misc_feature (12)..(12): n is a, c, g, or t
cccgcgtccggnaatgcgcaatcttcatcgtagggctcgtgaaatgctttgcggattttccaagagaatgaaaacttgaggattgacttagaaagtaagaagagagaactgaacttgcgagctaaggagcttgacaaaatatcaactgagaatgctaacgacaggaagacacttgatgatgagaagcagaaggcaaaatacgataatagtgaacttgagctagcaagtatagagcagcagagggctgatgcagatgttctgaagctattggctgaccaggagagggaaaaggaagatgtacttgctagaatgcttcaactagaaaaagagctgcatgagaagcagcagcttgagctcgaagtagaacggttgaatggtacactccaagtgatgaaacatttagagggagatgatgatgggggagatatccatgagaagatggagaagctgagcgaaagatttgagcgtgaaaagaagcgtctggaggatctgagtggggatctcgtgagaaaagagcgtgaaagtaatgatgagctacaagaagcccgaaaagaactgataaagggtttggaggaagagctaaatggacggacagctatcgggatcaaaagaatgggggaactcgatgaaaagcctttccaaaatgcatgtaagacaaaatacggaaaggatgagtacgagatcaaagcagcagagctagtcacaagttggcaggatgaactaaagaagccatcctggcatccttttaagatggttgaggttaacggagaaaataaggaaattctggatgacgatgacacaaaactgaagttcctgtggatcgagtacggcgatgatgtgtgcaatgcggtgaagaccgcactgatggagattaacgagtataaccctagcgggaggtatgttgtgccggagctctggaactttaggaaaggccggaaggcgacggtgaaggaggtgctcaagtacctgttcagtcagatggacacgacgacgaagcgcaggaggggctgaggaggtgcctgatgccgagtagtgccttctatgttgttgcatcagtcgtgtgctgctcgatccccaagtggcagtctggcataggagatgcccctcttgtgtagtgaaatctggcacgataaagtgcccgcgatccaggcttgggtatgccttatgcatcatgttcatatgcttgtgcatgtggtgctgttgccgcaggcgccctagcctaacctgtatgattgttgagatgagtagtctttcttgctgctgttt

SEQ ID NO: 13683 - DNA, 4227 bp, Zea mays
ctgcgagaaattacgttcatgccccttacattttctaatgactctaaggtaactcatcgaggtccaaatagccttttcccctttaagtcggttcgtttttctgcgactaagccgaagcttctctgcgtgtagcttcggtttaacaacaacattcgtcacgattcatcagcagccttcgtcatcaccatatccaaaggtacctgtccataaatcatacttggaagagattgttaaattatatttttgaggaccttcggaggacgaatgcccccaacactatatatttcacaacatctgtagtttacattaattgtcctgcttcactggaattataatgccttcgtatgatcaaaacattttttatttttgttaatccagaatttttgttaatgtcctgacttgacttgatgagataaatatatattccaacggaagaggctctacgggtatttcttttttaggctagtttgaaaactttattttctcaagggattttcattttcacaagagaaattagttcatttttccatgaaaaaatagaaattcattaaaaaataaggttccaaaactagcacttaggactagtttagtttagaaaccacctttttccacggaatttttattttcccaaagaaaataagtttattttcacttgggaaaacgtaattcccaaactaactcttagctttctcgatctcctggattattcctaacctttcttcccggccaaggattcttcctcgattccatccgtcgtcctccattccattccatcccacacaagatttcacccacccacgtacacatgtcattggtatgcggaggtattattcagggtggctggcgttggtctggtcggtaccccatcataccaagccaagtttcgaacaataataataataataataatccatcatctcatcttccctataaaaatatatacatacacacatgcatgcatatccctcgcgccccatcgatccagcagcacacagacgagccgacacaagcagttagctatagctgctagcctgatcgccaatggccaccgccggcagcaagcaaggaggaggctcgtccaagccgcctgcggctgctggtcaggagttggacccgaggtacgagtgggaggagaacgccagcagcttcatcctccgcatccacctctcaggtagtagtagtacgagctctagctaatggcaatggagacctggacctgtatgcgcatgcatgactccattctttgctttgcttgcttgtaagaaggcttcaggaaacaagatttcagggtgcaagtcgacggcgccggccgcctcaccgtccgcggccagcgctccgacgccgccgccgccaacgccaacgccaggcactcccgcttcaacaaggtcttccagctgccatccacctccaacctcgacgacatcgccggccgcttcgaccttggagtcctcacgctcaccgtgcccaagcgcctgcccgcgcccgcaaaggaagaccagcagcaggccaagaagcccgaggatgccgatgccgatgccgctgccgccaccaagcaggtggcgggagccaagggcgccaaatcggagccggagcagcagcacaaggaggcggcggcaaaggaagataagcccaaggcggccgccgccgccgcagcacctgcaccggcagccgacacgacggcaaaggaagataagcccaaggccgccgccgcagcacctgcaccggcagccgacacgaagaagcagcccgtgtcgccgcccgtcgctgcgggctggccgacggatccgaccgaaagcctggcggagcggcgcaccgaggaagagcgggccaatgcaaatgctgcagctgcggcggagcaccagagaaaggcatgccgtggcttcaaggagcgcgtggcggaggagctccaggggctggcgggctccgagtgggcggagggccttgtggagacggtcaagaggaacagggaggtgatcgccgtcgccgtcgccgccttctccctcggcgtattcgtctccagcaggctcttctccaggtccagcaggaactagaagccaaccatgcatgcatctctgtgacaatcgtaatagcgcttgtcaccaccacaaactacgtgacacatacagtccatgatgtggatatatacatgcactgcacagacacaagtgaattgtaaacatgtttataaatgtaacagtgttgatgaattgtcgaacaagtttattcatgtttatactttgttgtgtcagtataaacatacggtggagatgatcatggccattcacatttcaccaccagtaaacatgtcaccaaaataacggaccaacgatcagcatcagggcagaacatctgttgccatacaggctatcgttttcactggtgaaattaatctatctgaatgcaatgtatgtgggtcgagtgtagcaaagattgcacacagatgatacacgtacgtcacaactgacactacactacagtacacaacatttcactatccagccgtgcgtctaattccaagctccatggatttccaacacaagtatacaaaaggctggcctctttgtatagcagagccacaagaccatccagatgaacatatattgtcctgctctaccattctagtctctacctgggtgcggttggagttgaccatctcccagctccagcagctgcacgcttgcctgactggcgcatcgcctgtgccttggctagctgcgcggtcaggtcctagtccacaagacgaaataatcagctgagagctacacatagaaatcggtgatgaaacagggattagcaagatacctttggtttgaaagaaccatccagcgagtgtaatatcgtatcggcaagtccataatcaagagcctcttgtgctcggaagtacctcgggcccctaaggaattcagcaagctcttcctttggtttaccaactcctttagacaagagttcgaggtagtaatctgtgtttgtatctaactcttttgcctgagcgcaaaataaaatattcagtgcactagtgcacaatagcatgggcagtataagcagaaaagggagtaggaaattgagatattggacacaagagttggatctgaccttaatccacatatcaatggcagctccaccagatttgtgcaccttaggcaggtgcaatttagctgcaattaatggtgcacatttagaaccaatatataatatatgctgttaagcacacacgcctgtgaaaatccaaaagaggcaataaaacttagaaaatgcaacatactgattgaattcggcagcactcctcttttgcccttgacaccaagggaaagaagcatcgcagcctgaccatatgccatgctaagattgattgtgtaaaccttggatttacttcgctgcaaaaccaaaaaaaatagtatgcaaaagtcagagtatgcagttttagttcttttgtccatccttcactttgcttcaaagcaagtaaaatcaaacaaaatgtatgccctgtgccaagattatccagcatagttcttgaaaatgagagacctgttaccaaaatataatattcatcatgtcccttgtaaacattgttctgatgggctttacgcacaatattgatgtgtgttataagcagcagctgcgaaagggcctctagccgagttggttaggtggtatgagtagcactcctcaggtcatgggttcgactccccgtgggagcgaattttaggatgtggttaaaaaaatcctctcgtctatcccacgtcaaagcaggtctaaggctcagccccagtcgcggttgcccacacatgggcttcgatgccgctgtgtatgggtgggacaggggttcggaggttttctcgacctatgtgagaaggtcttcttcttaatacaatactcaggagctgtcttaccccccgcaggtcgagttttttttataagcagcagctgctactactactacaacaactctgccagcgcttttcggttgctactccacatcaaataaattgtctaagaaattaagcccaaattgatccagatttgaaataaggcaactttcccacaaacttattagtgctggtacattaacttcatcccacacaattgtttcataatcatccttttgtcgattcagttttaatggttcattatggtcgctgattgtggttaaggtttgttggagaattctttttatgtaacttatttatccctatagtagggtttgtacaagtcagttgtactcttttc

SEQ ID NO: 13684 - DNA, 2905 bp, Zea mays
  misc_feature (2887)..(2887): n is a, c, g, or t
  misc_feature (2897)..(2898): n is a, c, g, or t
atattggtagctcatcatcgatccagcagcacacagacgagccgacacaagcagttagctatagctgctagcctgatcgccaatggccaccgccggcagcaagcaaggaggaggctcgtccaagccgcctgcggctggtcaggagttggacccgaggtacgagtgggaggagaacgccagcagcttcatcctccgcatccacctctcaggcttcaggaaacaagatttcagggtgcaagtcgacggcgccggccgcctcaccgtccgtggccagcgctccgacgccgccgccaacgccaggcactcccgcttcaacaaggtcttccagctgccctccacctccaacctcgacgacatcgccggccgcttcgaccttggagtcctcacgctcaccgtgcccaagcgcctgcccgcgcccgcaaaggaagaccagcagcaggccaagaagcccgaggatgccgctgccgctgccgccaccaagcaggtggcgggagccaagggcgccaaatcggagccggagcagcagcacaaggaggaggcggcggcaaaggaagataagcccaagacgaccgccgcagcacctgcaccggcagccgacacgacggcaaaggaagataagcccaaggccgccgccgcagcacctgcaccggcagccgacacgaagaagcagcccgagacgcaggccaacgcagagagcaaggcgacggatccgaccgaaagcctggcggagcggcgcaccgaggaagagcgggccaatgcaaatgctgcagctgcggcggagcaccagagaaaggcatgccgtggcttcaaggagcgcgtggcggaggagctccaggggctggcgggctccgagtgggcggagggccttgtggagacgatcaagaggaacagggaggtggtcgccgtcgccgtcgccgccttctccctcggcgtcttcgtctccagcaggctcttctccaggtccagcaggaactagaagccaaccatgcatgcatctctcttttgtgacaatcgtaatagcgcttgtcaccaccacaaactacgtatactgacacatacagtccatgatgtggatatatacatgcactgcacagacacaagtgaattgtaaacatgtttataaatgtatcagaaacaagtttatacatgtaacagtgtcaaaaaaaaaaaaaaaaagtttattcgtgtttatactttgtgtcagtataaacatacggtggagatgatcatggccattcacatttcaccaccagtaaagatgtcaccacactgccggtccttcgatcagcatcagtgcagaacatctgttgccatacaggctatcgttttcactggtgaaattaatctatctgaatgcaatgtatgtgggtcgagtgtagcaaagattgcacacagatgatacacgtacgtcacaactgacactacactacagtacacaacatctcactatccagccgtgcgtctaattccaagctccatggatttccaacacaagtatacaaaaggctggcctctttgtatagcagagccacaagaccatccagatgaacatatattgtcctgctctaccattctagtctctacctgggtgcggttggagttgaccatctcccagctccagcagctgcacgcttgcctgactggcgcatcgcctgtgccttggctagctgcgcggtcaggtcctttggtttgaaagaaccatccagcgagtgtaatatcgtatcggcaagtccataatcaagagcctcttgtgctcggaagtacctcgggcccctaaggaattcagcaagctcttcctttggtttaccaactcctttagacaagagttcgaggtagtaatctgtgtttgtatctaactcttttgccttaatccacatatcaatggcagctccaccagatttgtgcaccttaggcaggtgcaatttagtgattgaattcggcagcactcctcttttgcccttgacaccaagggaaagaagcatcgcagcctgaccatatgccatgctaagattgattgtgtaaaccttggatttacttcgattgataaaatcagcaattgcataagcatcagtttcagatgcaacaagctcgttattttcgtccatagttccagtggagtttatatacagataaatgggttttgtgcggtcgtcatagtctagccatagaaattgagcagcaataagctcagttactgctggaacaataggcattccaagaaatataattcgagagtccagtagcaatgacggaagatctggagcagagcttctcattcttctatatcctctccctcctctgcccatgctcatgctcatgctgccccccatgcccatacccatgctgtaacttgcagggccctcatgcatgcctgacaaggtgtacataccaaactcatcgtagctcctcgcagcagaaacgctttcctctgtaactttctgggattgccgattataagggttatcgtcattcataaacatttccatctgagcagcacttaatccataaaggaattgaggaacatgcttgtaattatccatcagtccatccttgaggttctcctcgcggaactgcttggggatgtggtcgtagttcttgcggaatccgccgtcgccgtagtaggcgaggcacctccagctggcgggcggcctcctcgggaccttccccgcaggggctggggaggtcgacggtaggaaggggctccgggacgaggtggcggcgggagggcagcgcagcgcgagcgccatgggaagcggggtgtgtgtgaactgtggatccctcccccttctcgtctcctctcttcgcgcttgcgggggattggattggaatcgggacgggatggatccggccggccccgggaaagccattgtgtttttttttttttttnttccggccgnngcctcga

SEQ ID NO: 13685 - DNA, 3423 bp, Zea mays
cctttgccgagtgcctactagggctctcggcacagggactggctgtggggtccactggaccagtctttgccgagtgtcgccgtaggcactcggcaaaggatccgtcaccgtcacttggcgccgtgacggtgacttttctttgccgagtgcccgacaaaaagtactcggcaaagaagctgttgccgatgtacagttcgccgagcgttctttgccgagtgttacactcggcaaagcctttgccgagtgtaaaatagcctttgccgtgtgtttagaacacacggcaaaggagctgattccggtagtggagtatttgaagcaaagaggaagtcctcgtggttcagcctatgctgattacataaagcatgtagatgccctctcaagaaaactaccaagatactaatatggctctcaacaagtgcatattttgattttccccttgttcttgtccgatgagccgagttatcatcatatgtgttttgccattttgttgtactccaagtactggagaatttttgttaagtccaggaaggcaacatttgctttggctcaagcttatgatgccttcaggattaataaggagaagccggtgaaaaagatgccttttagaaaattagccatgttaatgaaattggcattgtttctgcttcattttattttagtggaataactattttattcatatactgaacccgatatacaaaataatagttggactcagaattcaaagttcgcatgctctatatgtattcttttagggagggcaaccatctttagagtagcaattagctgaacctgctaaaaaatctttttgttagccctgatttgggaggatttccccaaaccagccaataatattatattggtaaaattaaaataaagtggacaaggaaaggcgccttgtcaggcaaagagaagagctgaagataggattagcttctatctatattgcagagtttgctggtaccaggaaacacaaaagaaatacaatactcctatctatcacctgtctagatctccttctagaaagaaaccataggatgaatggtggggccaccagcatagcatgagtatacaatgaaagcagatcataaccaccagcattatagctgcttttaaaaagtaagtgttactctgaaagtttctccttttcaaggtcacaaatgattggatttttttggttatataccatttgtttgcttgcattatagttgcttttttgtggtttgaatctaacaggattttcctacttttgttgtattgtttgctttttttagaaaaaaacacagtaaaaatacgggcctctagtttataaacactcggcatgtagactagcgagatagtatatagattaaacaacagttaataaatgatattaggaagaagcttgtgtagcatcggtggccctatggggcatgctatgtcaacaatgcatcagtggccttgtcagttttattttgaccccctcaaggccttgcaaccatttcccaagccacagtatccaagagatggcagtgtcactcacagaagcagctgttcttagtatgtgatttaggaattcaatgaattatatctatgtatggttacacaagtcctatgctgacaatctgtaacatgtgtatgcttgtatttgaacctgaaacctgtgtaggctggtgtgagatctgtttgtggtatttttggtaacctgaaacctattttctatgctgtgtatgttgctttttggtaacctgaaacctgttgtgtatgttgtgcgtactactttgtagaaacctgaaatctgttttgtatacagcagcttctatgctggtacgcgattgaaaccatagaaggtgttgtttcgtatactgcttgcatgcccaaggttccacaaagcttctatggttcagactaaagaacctactgttttgtatggcacatggttccacaaggttaccaaagaagttaatgttttgtatgtttaacctgaaacctgtgtttgcacaaggttccgacagcatcttccatggttcagacagcaacttctgcatcaaatagttttgttcagatttaacatagatttattcaaactaaaaacttttttcaacacagattttgcgttgtcctaatatggcgctcgtaagggcgcctcgagttctagtttatataaaagaagtgacgtgaagtgtttttgcaatagaggtttacttggttgaacaccgactcgagatgactagcccacacatcgctcgctggctggcattatattttaatggcccctaagtatctttggtattcaacaagactcacgtccacttgacaccatatcatatcataatggtattggataagtatgatagagggtggggtgttttgttcctctaactaaagtttagtacgtgtcacatcaaacatcttaatatgctcggacaaatgtcttttatgatggccacatactaaccttgtcaagcggcaacacgatacggacaaagtcccaaaggcggggactatgacgtgtatgcgaagtaccccctcatacgacgcaaaaggtctgtattttttcgccagggtctatggactacaagaaccttatccaaaatggggcttcgggtcgacaaacacgaggccccgaggactttgctcccgacagcccactacgttcagtgcactctgctcagaccggggtgaggactcgaacgaagcgaatggtgatcgttccccctcaacgtcatattataagacgtggtggtggagccggcctcaaagaccccaaggtgaaggcctctacaacttgagattgggaggcttcaagaagacatcagaggccaggtgatcccttaacatatagagcaggccaacctgtgtgcctctcctgtgtgtacaacgtttggtgtaattaaacttatgtcatggctattgtataattacctagttgtactgtatattctgagaaattagtaggcaaccaagggtatgaacgtactttaggccctagcccattggttgccctataaatacgcccgtctggccccttggatgggacatgcttgacaagacatttgagctctcctgtcgttcggtttatcgtgcaccatcgtctcacctgctcccgagtgcttgggcccacgtgtcaggacccaacatttggcacccaccatgtctacttccacaaccaatcccataatgcctaccaagaagatcaacagtaggtccagctcctccccactgacgaggctgtgaaggcaagttgaccttcacttgccaaatcccacatgaccctgcaaaggctgcttccatcaccatcaacaaaccaatcaccaacaaccaatcttcccctcgccacaaagatccactcaccccaagggaagtgttcacacatacagtttggagacccaagactccatgagcatccccattcaacccccagagccacccctactaggtcaa

SEQ ID NO: 13686 - DNA, 1247 bp, Zea mays
tgcagcagcaggacgacgaattgaacgtatgcatggccagtggagatggcagtccagacattgaaatattggctacgtacgcgacgcgacatgcaggcaagtcgttggcctacgtactgtacactcctaatcctagccatggtacatactactactacacagctacataattaagatggaatggtctatccatccatatatattctaaatatatagcctataggatgtcagttgtctgtgctacagcagttctgtctagctagcttagctaagcggtgcacacgaaacaaagcaaagtcgttgcaaactgctcattactaagtagctgatgcttatcttattttttatatatagtggttgagaaggagaggagattctcgtaccatgttcaaaacgaaaagtctgatctgaagccagcagacgtgaaaccgacagcacgtacgtacgtacgtgtgagggctgctcggcggccatgggagaatggtgcttcaagaaacgcgcagctctggtgattattgtggccattattagctcgctgcagctgctcctgataactgctcaagaagctggaggagaccacgaggtgtggtcgtcgtcatcctcgccggccggtggtcgtggtggcggcgccgtcgtcgtcccgacggcgcggatggggccggacgggtcgtcgtcgtgttcgggggaggaggcggtggtggtgtaccagagcagcgccaaccctctgcccagcggcatcccggcctacaccgtgcagatcatcaacgtctgcggcggagggtgcaccgtgtacgacgtgcacgtctcctgcggcgacttcgcctccacggagctcgtcgacccggccaagttccagcgcgtcgccttcgacgactgcgtcgtcaagggcggcgccgccttggaacccagcgagaccgtctccttccagtactccaactccttctcctaccagctcagtgtcgcctccgtcgcgtgccactagagatcatcgaccactactactagatgatcatcgtcggtcgtcgttacgttgtgctgtactagtactactgctgttgttatgctaaccagctagttccacgtacgttaattgttgagtctatctgcatgcacttctgtttaatttccatcgtgtgtgtgtaactatatatttctacggtcgtcgtagttcggcatcaaactggaagtgatcaatcaatggaaaaatctcttcttctatctcgagcaacaaaaaaaaaaaacctgtg

SEQ ID NO: 13687 - DNA, 955 bp, Zea mays
gtagtaaactattattagcctttctatttatagtggctgagagacgggcggacattctcgtaccacgttcaaaacggcaagtcgatcgatctgaaaccacagatcgatcgacgaccagcagaagacgacgtacgtgaaaccgcgagacagtgcgaggacgactggggtgtggcggtgcgatccatcgacaaggccatgggacaacggcgctttgaggacgaacgcgcagctctggcgactgtggcaagcttgctgctcatcctaacgacagcccaagctgctgctgctgctgcttctggacgccatctgtctttgcccacgcagaaggcggcggcggcgcgcatgaacgacaccagtagtagtgacatgcaggtcatcacacccgcgccgctcgctatctcgacggcggctcgaatggggccggacgggtgctccggggaggacgtggcggtgtaccagagcagcgccaaccctctgcccagcggcatcccggcctacaccgtgcgcatcatcaacgtctgcagcggggggtgcaccgtctacgacgtccacgtctcctgcggcgacttcgcgtccacggagctggtcgacccggccaagttccagcgcgtcggcttcaacgactgcgtcgtcaagggcggtggcgcgctcgagcccagcgagaccgtctccttccagtactccaactccttctcgtaccacctcagcgttgcgtccgtcgcttgccgttagataactgctggtgagccagtgccgttaaataactgaagccgtcggcccgtgatgatatatatataacacctggagtagctagctagttccacgtacgtgttggtgttgtgttgagtagtctacgtatgtgtacttcgatctgcattgtgtttgtgtgtgtctaactatttctacggtcgttgttgtcgctacacgtttttacgtctaatactatagtctggtg

SEQ ID NO: 13688 - DNA, 2803 bp, Zea mays
aggacgctgggatcgatcaggagacctacttgctttacttggttgatgatctcctgcagaagcctacagtgagcgagcttgcagagggccatgccatcctagatgacgggagagcattgcttgacacaggaataatagccgcaacgggtaaagcatggcaggaccttgttacccttgcacattcatctagccattccgtggttaaggagctcatgtcttgtaacaaagagctcagcttatatgaggatcttgtggcggcatgggtaccagccaagcatgtatggttgcggaaccgtccattgggcaaggaactgatttctgctttaggaaaacaaagacttttcagcttttgttcatatgacttctcatttctacattttggcacatccgcggaggttcttgatcacctggcgggttcctattctggacttgtaggtcgaaggcatatgtgttcactaccagagaccactgcttgtgatattgcagcgacagctattattttgtgtacaaagatttcttctggagtctcaataggagaggatacattggtttatgattcagtactttccggtagaatacggatcggctcgcttcggctcgtggtcacggtgaatatacgtgagtttgatggtagcgcttgtttcacattacctgatcgacattgcctctgggaagtacctttggcaaactctgcggggagggttttggtttactgtggtcttcacgataatccaaaagtttctattcagaaggatgggacgttctgtggcaagccatggataaatgtcttggaagatcttagaatccaggatacggatctgtggggttcaactagccaggacaaatgcttatggactgcaaagctttttcctgtcatgtctctcccagaaatgcttaatgtgggcatgtggcttatgggatcagaatgtgacccagatgggagaatagcttccttgtggcaaaaatcacagaggatcagcctggaagagctgcatcgtgctattgattacagacaactttgcaccgattcgagcaagcatcaggcaaatcttgcagctgacatagccaaggcttgcatgaactatggcttactcggtcgtaatctgtttcaactttgtgaggaaatgttacaaaaagatacatgtttagcagtctatgaagaattactttcattttttccaagtcacagtgaacagtatcctggggttcttcctcagagcagagaatatcaggtcaagatggatctgcttagagcttctggagatctttccactgcatgtacggtggaagagaaagtgtgggcttccattgcaagcgaaactgcgacggcgataaaatatggatccaaagagccatctagcggcaagatgtcttcaaaccatgaaagcttgcatccaaggaagactgttgtagaattaccagtccgtgtggactttgttgggggttggcgtgatacacctccgtggagcttggagcgtccaggttgtgttttgaatatggcgataagtttgcaaggaagccttccagtcggtgctatggtagagacaacagaggaccaccttggagtaaggatcgaagacgacgctggtagacatgtttatatcgataatctggcatctatttcttctccattcaaagaaagtgatccattccgtctcgtcaagtccgctcttattgttactggaatccttggccacgagatattgtcgaaatcaggcctgaacatcaggacatggtcgaatgttcctcgtggaagtggactgggaacttccagtatattatcagctgctgttgttaagggactgttccaagtgatggaggacgacgaaagtgacgacagtgttgctagagccgtgctagtggtggaacaaataatgggcacaggtggtgggtggcaggaccaaattgggggcctatatcctgggatcaagtgcacccagagttttccaggacaaccgttacggttgcaagttgttccagtgctgaccactcctcagctgattcgggaattagaagaacgtctcctggttgtattcactggccaagtaaggctcgcccaccaagtcctgcagaaagtcgtgactcggtacctccgccgcgacagcatcctgatatccagcatcaagaggctagcggaactagccaagatcgggagagaggcgctgatgaacggtgagctggacgagctcggcggcatcctgctggaggcctggaggttgcaccaggagctggaccctttctgcagcaacaggcccgtggacgagctgttcgccttcgccgacccttactgctgcgggtacaaactggtcggagctggtggcggtggcttcgcgttgctgcttgccaagaacccgagctgcgccagagagcttcgacgggcgcttgaagagtccgacaccttcgatgtgaaggtgtacgattggaacgtcgccatgccacggtgaagagtagctggctcaaagggattgtgtacactgtattgctaccatagacgctgttatcattttttgtgtgtcagacgacctagggtggtggggtggttgtgtgactctgatccaaaagtcggctgttatcaagtgagcaggctgtcggtttggttggcttttccaacgcggtcatgccaaaaaaatcgctgatccaatgtctcgtcaaacagttcccgtttcgtccaggcggacggcggacaccacagcagggtactacggtactgttgccggatcgatggcgatagtaggtgtcgttgtcgtcaactccttcagccacaccccgcctttttttttttgtgtgtacaccgacacgattc

SEQ ID NO: 13689 - DNA, 1648 bp, Zea mays
cattgggtacctcgaggccggccgcggccgttgtaagaatccatcgattgctcgagagagggatatctgtttccgcatcggcagcgttctctgcagcggcgatgccgctcctcgaggagatgatggaatcgtcgtacatccgcacgtacctgcagcagatggcagcgtcggtctccacggcgagctgcgacccgtctagcggcgccgatgaggtggagtgccgcgacgaggcggcggcgctgaggcttaagatggtgttcgtcgtggccatactcgtcgcaggcgcgaccggcgtcgcgatcccgctcgtcggccgccgctgccacgggcatggagcctcctcctcctcctccaccggtggggcgttcgtgctcgtaaaggcgttcgcggccggggtgatcctggccacgggcttcgtccacatgctgcacgacgcggacgaggcgctcacggacccttgtctccccgccgcgccgtggcgccgcttcccgttcccagggttcgtcgccatgctcgcggcgctcgggacgctcgtcttcgacttcgtcggcacgcatatgtacgagcgcaagaagcaccacgccgatgcggaggaagccgccgtcgtcgttggcaatgccagtgccagtgccaatgcgagcggccacgacgtgatcgttgcgctgctacaggacggcgcgctcgtggcgagcactggcagcagcattgggagagacgggggaggccacaaggaccccatgcacatcgtggggatgcacgcgcatgccgcagcacataggcatagccacgcccacgggcacggcccatgtgatgactgtcacgatgggcatgatgaggagccgtcccaagctcgtcatgtggtcgtctcccagattcttgagcttgggattgtatcgcactcagtgatcatcgggctatctttgggcgtctcacagaatccttgcaccatcaaacctctaggtgctgctctctccttccaccagttttttgagggctttgcattgggcggctgcatttccgaggctcagttcaagagtttctctgcactccttatggctttcttcttcgctatcacaacacctgctgggattaccgtggggtctggtatcgcgtcgttctacaatcccaacagccctagggcacttgtggtagagggaattctggattccatttcggctggtattctgatctacatggccttggtggacctcatcgcagctgattttctcagcaagaggatgagctgtaacttgaggcttcaagtcggctcatacattgccttgttccttggtgccatggccatggcatctctagccatctgggcttagcaagtagaatggaagtaaggcaaagatttgagagtgctgcctaattgcctttgatagcaggaggttctctccagcagctagttggttgcaattcttgatgagaatgggaggcattttttattttcttatattcttctgtttgtctattggttctcttcatgttggtggtggacagtaagatttagttcttgtgccctgtttggtagagctgttgttgttggaaaagtaacttatctaagaagctagtgaaaaaaacttttgtttatcgcatgcttttagtttattctgagaagaagctgaattgataagttgcctcgtgc

SEQ ID NO: 13690 - DNA, 2285 bp, Zea mays
  misc_feature (366)..(366): n is a, c, g, or t
  misc_feature (372)..(372): n is a, c, g, or t
cttcgctgatgaagtaaaccggcctctgaacgggcaatgtatgcccttcctcctgcctttcgaccacaatcgcggcgctaaccacctgagtggtcgcggcgacgtagaccaagagggtttctccgtccgccggtggcaccaagactggcgcctttgtaaggagcgcctttaggttgccgagggcttcctcggcctcaggggtccaaacgaaacactcggctttccttaaaaggcggtacaggggcagacctctttcgccgaggcgtgagatgaagcggctcagggccgcgaggcatcccatgaccctctgtaccccttttaagtccttgatgggccccatgctggtgatggccgcgatcttctccnggttgncctcgatgcctcgctcagagacgatgaaccctaggagcatgcctcggggcaccccgaagacacacttctcaggattaagcttgactcctttcgccttgagacaccggaatgtcacttcaaggtcggagaggaggtcgggagccttccgtgtcttgactacgatgtcatcgacgtaggcctcgactgtgcgaccgatgtgttcgccgaacacatggttcatgcaccgctggtacgtcgcgcccgcattcctcaaaccgaacggcatggtgacatagcagtacatgccgaacggcgtgatgaaagaagtcgcgagctggtcggactctttcatccggatctggtgataccctgagtaggcatcgaggaaggacagggtttcgcacccagcagtggaatccacgatttggtcgatgcgaggcagagggtagggaaccttcggacatgctttgttgagaccagtgtagtctacacacatccgccatttcccccctttcttcctcacaagcacagggttggcaagccattcgggatggaatacctctttgatgaaccctgctgccattagcttgtggatctcttcgccaatcactctgcgcttctcctcgtcgaatcggcgcagaggctgcctgacgggtcgggctccggcccgaatatccagcgagtgctcggcgacatccctcggtatgccgggcatgtccgagggactccacgcaaagacgtcggcgtttgcgcggagaaagtcgacgagcactgcttcctatttggggtcgagcccggaaccgatccggatctgcttggtggtgtcgccactggggtcgagagggacggccttgaccgtctccgctggctcgaagttgccggcatggcgcttcacgtctggcacctctttggagaggttctccaggtcggcgatgagggcctcggactcggcgagggcctcggcgtactccacgcactccacgtcgcattcgaacgcgtgtttgtacgtggggccgacggtgatgaccccgttggggcccggcatcttgagcttcaggtaggtgtagttggggacggccatgaacttcgcgtagcatggcctccctagtaccgcgtggtaggttcctcggaacccgaccacctcgaacgtcagggtctcccttcggaagttggagggcgtcccgaagcagacggggaggtcgagtcgtccgaggggctggacgcgcttcccagggatgatcccgtggaagggcgcagcgcctgctcggacggaggacagatcgacgcgcaggagcctgagggtctcggcgtagatgatgttgaggcagctgcccccgtccatcaggaccttggtgagcctgacgtcgccgacgacggggtcgacgacgagcgggtatttccccgggctcggcacgtggtcggggtggtcggcctggtcgaaggtgatgggcttgtcggaccagtctaggtagactggcgccgccaccttcaccgagcagacctcccggcgctcttgcttgcgatgccgagccgaggcattcgccgcatgcccaccgtagatcatgaagcagtcgcggacctcggggaactctcctgctgggtgatcttccttcttgtcgtcgtcgcgggccctgccaccctcggcgggtggcccggccctgtggaagtgacgccgaagcataacgcactcctcgagggtgtgcttgacgggcccctgatggtaggggcacggctccttgagcatcttgtcgaagaaggtttgcacctccggggggcttccgagggttcttgtactcggcggcggcgacaaggtccgcgtcagcggcgtcgcgtttcgattgcgacttcttcttgcctttcttcttggcgccgcgcggagcagacgcctcgggagcctcttccgatgggcggccctggggctgcttgtcctttcg

SEQ ID NO: 13691 - DNA, 987 bp, Zea mays
ctcgacgccggcccggccgggattccagttccacatccacttccaaactaaacaccatgtccatgtctgtagagatccccatggatcgccctgctgcctccgctccacccccgggtgccgtgtgcaacgtggtcgacgaggacgaggcggcgccgccaccgggcaatgctaggcccacgcgcgtcctcatctcgcccatcgtgcccctccccgctgacggcgcttcggccgacgctgcgctgccgccggcgtacaccggcgtgctgtacctgcaccgccacaagtggcccgccgtggaggacgaccccggcaagaagcgggagaagtggctcaaggagatgcgcggctggctcatggtgctcgccgtgctggccgcgtccgtcacgtaccaggcggggctgaacccgcccggcggcttctggcagcaggacgacgcggagggcaacgtggccggcacgcccgtgctccagtccaagttccccaagcggtacaccgttttcttctacttcaactccacggcgttcgtgacgtcggtggtcatcatcgtcctcctcatgaacgagtccttctaccactcggaggccaaggtggaggcgctggagatcatcgtggtgctagacatggcggggctcatgggcgcctacatcgccggctgcacccgcgaggtctcctcctccatctacatcatcgtcctcaccctcgtcgtcttcctctacgtcgtctacacggcgcagttcctgcccaagctctggggcctagtcgttgacgtgcccttcctccacaaggcggcccagggcggcgcgctgcccgtgccgcaagacatcctggacggggccaggccgtcggctggcatcgcccggaccaagtcggcgccgccgcgttagctaggcgtacgaactgtgcctggcgcacttttcctagacgtatatatgtaccagactcactgccagactatatatgattttcatgataaaaaaaaaaaaaaaa

SEQ ID NO: 13692 - DNA, 1369 bp, Zea mays
cacagcccacggctgagactcaggtgaggtccgccgcgtccccccgccccccccgcccgcacccccggcctgagtacctgaccaccaccggataggatgaagccgccggtgagcagggccgccttcgcgtccgtgctgatagggccgcgcacgctcggggcctctctggtggccgcccgctgcgcctcctcctctgccgccgctgccgtcactgcctatgatcatgcatcgtttgtcaaggaaatcgccgcaaccgatcctccagagcatctcaactctctcctcaatgtgcttcaagcacgaggtgaaaagattgtttctcctggagcaaaaagagggttgattccatgtgttgttcccttatcagaaagtccagcaggtgatttgacatctctccttagatggccaaccgctccaactgggatggaaatgcctgttgtggaagttcgtaaacatgggctgtggtttttggctaagaatgtgaaacagtatatccacagaatacttgttgaggctgacttaactggtgatgatttatgggctgctgtgggcgaagctggtaaaaacctttacgctaaaggagaattcaaagagtcgcaggtggcagaccttgatgtctatttgttgaagaaggttggacttttccctgatgttatagagaggaaaacattgcgccatctcgaaaaaggagataatgtctcagctctcatcactggagaattctataccagagataaatttccaggatttggaagaccctttgtgttcaatgcagagatttttaaaagagttggacgtacatctgaagccaaagattcagctcgagtggctctgaaatcaccatggtggacacttggctgcagttacgaagaggctgctgaactagctgggtgggaggatgagcagctagagtttataagagagaaggtaactgaggagggtaagcgcgaggacctgaagagaggaaaggctccagaacaggtgattcttgacgaggcggcattcttaatggatttagcgtccgtggatggtaactgggacgaggttgtggatcggattgctgaatgttacagagaggctgggcttcatgacattgcgaatttcattgcctacagggaatagatgttagattccctatggtctagaatgttattcaagaaattttgattcatttgtgctctgctaatatatattcttatatacgggaagaacgcacaaccgttatatcgcagcagtccttttttgttttgttttgacatcagctagtgaccatagtttctttcctgtatagctctgaatgtacttgttttttccatttaaatttccatgcttattcgtggttagtaagtgtcaaaaaaaaaaaaaaaaa

SEQ ID NO: 13693 - DNA, 1273 bp, Zea mays
ggcactcacacaacagtatagatctcacatttggtttgttgctgccattcttctgcagtctacgggttccttagagcaagtataataaatttgactaggcgggctctaaacgaaaaggcatcgtttgcaacatagagaaaacaactatattgaagaaaataccacagttcaaaatggtcgtgcaactttgcacttcggaaagcatctctaacgtcaagtgcaaacacaacgcaataatccagttcctcttctatttggatcgatttgcaggtatctatttggatatggtccaggtatgtgaagcacaagtgcctcgaacaattgcaacttaaatatgccgcccagcggcccagccattcatctatgtctttcttcacgttgtgtcacttctggaactggatgctgtaagaaccagtgtttggatctttgacggctttgaaattgtcaacgctcattccgaagcgccccagcacggagttacccagatcttttagctttccaatcatttcttccttcatcttttccctcttctcagctgccaggggctcaagccggaaaagagaccttgtggcttgttgatttgaaggatccatttcaataacctttttcatatcggcaatagcttcatcatagtgttcgagcttttcgtgcgcttctgccctccgaagcagggctttcaggtacgatggattgagctcaagtgcttttgtgcattctttaaccgtctcatcatgctttcccaatttcaggaagcacacagcacgatttgaatggcatgctgcacgtatatcctcagaagattccagctcagcagcaatttgcaatgccatttcatacttagataatgcttcctcatattgtccggacccaaaaaacttgtttccttctgcttttgcatcatttgcttggcttctagatttctctcgcagctgctcgtcggtgagcgcgtcctcgaaggcttcctcctcttctccggccgccctcgacgcctccccgccaacagcggcggcggcggcggtgggcgcctcctcgggcgccgctgaagacgatgggcgcgccgcctccccaccggccgcggcagccgccttctcctccgatgccggtgacgaggggcgcgtcgcctcctcgggctccagctcgatcactaccatgacttccctcgctgggagaattggattcgcgaactcgctcgagaagtcctctcggactcggagacgtgcgtagagaggaaccctttaactatttagcaggcgaagaaaaaattgttattttt

SEQ ID NO: 13694 - DNA, 1511 bp, Zea mays
tttttacaacatagaaaaaacgaccttgcattgaggaaaattttttttttttttttgatcatgcaagttcgcactcgagaaagcatctctaacagtctaacgtgcgacaaatgcaaacgcgacgcaatactccaattcctcttccatgtcccaccttcagatcgatttgcagatatctgtttggatattgtccaggtatgtgacgcacaagttccttgaacaattacaactgaaatatgccgcccagccatattcatccatgtctttcttcacgtcgtgttacttttggaattgaatgctgtaagagccagtgtttgggtctttgacagctttgaaattgtcaacactcatcccgaagcggcccagcacagagttccccagatctttcagctttgcaatcatttcttccttcatcttttccctcttctcagctgccaggggctcaagtcggaaaagagacctcgtggcttgttgatttgaaggatccacttcaacaacctttttcatatcggcaatagcttcatcataatgttcaagcttttcatgcgcttctgccctccgaagcagggctttcaggtatgttggattgagctcaagtgcttttgagcattctttaatggtctcatcatgttttcccaatttcaagaagcatacagcacgattagaatggcatgcagcacgtataccctcagcagattccagctcagcagcaatttgcaatgatatttcatactgtgataatgcttcctcatattgtccagcaccaaaaagcttgtttccttctgcttttgcatcatttgcttggattctagctttctctcgcagctgctcgtcggtgagcgcgtcctcaaaggcatcctcctcttcttccggcgccctcgacgccttccctccagcggctgcctcctcctcctcgggcgccgctgaagacgaggggcgcgccgcgtccccggcgaccgcctgctcctccgccaccggcaacgaggggcgcgtcgcctcctcgggctccagctcgatcagcaccatgtctttcccccgagccgctacctcgccgagcgcttccacctagccgtggtgatggcggtggaggagggaacgtagcggctgtggcggctgcgtcgccagtggatattgctgcccgaggatacctctggcgacgaggggaatcacctcgaggagatcagggtctatggatctactgcgtagacatccagcggcggcggtggtaagctggagacggagaggcggcagtggaggcgagagagatgggattacgggattcgcagagaagaggagaccgaaaggtggacgcgaggagtctcgcaggttcgggggtttgggcggacgtgaggttcggttatgccagagtggagtatttttttttcggggtacgcgaatttcttcttcgcctttgtcagcaaggtagatattacagacgcgtgtcaagcattttattactatattaaccgcggcagcatagaaggctagaagcccagggggaccctcaggtc

SEQ ID NO: 13695 - DNA, 2345 bp, Zea mays
ttccagaagcagcgaaggtaacgagggagtagtcttcagagatatgtgagccgttgatccacaatcgagtagctaaaaaaatttccgctgacgtggatagcgtgaagaacgcagctttgaaccggtattgtatataggaagagagatacactacacctggacatttttttttttttggtggcactcacacaacagtatagatctcacatttggtttgttgctgccattcttctgcagtctacgggttccttagagcaagtataataaatttgactaggcgggctctaaacgaaaaggcatcgtttgcaacatagagaaaacaactatattgaagaaaataccacagttcaaaatggtcgtgcaactttgcacttcggaaagcatctctaacgtcaagtgcaaacacaacgcaataatccagttcctcttctatttggatcgatttgcaggtatctatttggatatggtccaggtatgtgaagcacaagtgcctcgaacaattgcaacttaaatatgccgcccagcggcccagccattcatctatgtctttcttcacgttgtgtcacttctggaactggatgctgtaagaaccagtgtttggatctttgacggctttgaaattgtcaacgctcattccgaagcgccccagcacggagttacccagatcttttagctttcctgcaaaacaaacatgcatcgcaagaaaagccattttacaggagagatatctgcaacttttcacgatgagatcacaaggcaccaaaataatgctgtttttgggacttgcaaaaaaaaggcagcacattaccaatcatttcctcccccgcattctacccccgctcccctgccaggggctcaagccggaaaagagaccttgtggcttgttgatttgaaggatccatttcaataacctttttcatatctatgagcagggatcaattgacagcaatcagaactagtgagcttcagcaatgatgcatgcttatgttgaaggcgataatgtgcgactgtcacataaaaaaccataagagagaacatctaaccggcaatagcttcatcatagtgttcgagcttttcgtgcgcttctgccctccgaagcagggctttcaggtacgatggattgagctcaagtgcttttgtgcattctttaaccgtctcatcatgctttccctagtaacacaaaagtcagcattggggtctgctaataatgacataaaaaatagctttattcaaccaatgtggtcatccaagtaaataactaaggtactgtttggttccagagccaattgggatggagtggctccatatgctagggagcggctccgtccgggtgattttggggagccagatggttcatcatttgaggataattttccatttttagagtcactatttcctactcggaaccaatccaaacaacaataaattagaagcagaggggctctatcccaccatactctggaaccaaacactacctaagagattaaggtgaatagtacaatacatttgaaactagactaaacaagtgcaaatatttaccaaaaccagaagcaaagatttagggtcccaagacaccaggtaaaacagctagagtttagcaagttcaggcagcacattcaaaacagtgtttgctagcaaacttaaacaagagtgcaaggacaggtcctctcaggtgaaaacagtacggattcatatcaggggataacagtagtggtagtaggccagtgacattaaggaataattatggcccaataaatatgtacatttttctctgcccaccgtgcattctttacccgcctcatcatgctttcccaatttcaggaagcacacagcacgatttgaatggcatgctgcacgtatatcctcagaagattccagctcagcagcaatttgcaatgccatttcatacttagataatgcttcctcatattgtccggacccaaaaaacttgtttccttctgcttttgcatcatttgcttggcttctagatttctctcgcagctgctcgtcggtgagcgcgtcctcgaaggcttcctcctcttctccggccgccctcgacgcctccccgccaacagcggcggcggcggcggtgggcgcctcctcgggcgccgctgaagacgatgggcgcgccgcctccccaccggccgcggcagccgccttctcctccgatgccggtgacgaggggcgcgtcgcctcctcgggctccagctcgatcactaccatgacttccctcgctgggagaattggattcgcgaactcgctcgagaagtcctctcggactcggagacgtgcgtagagaggaaccctttaactatttagcaggcgaagaaaaaattgttattttt

SEQ ID NO: 13696 - DNA, 3676 bp, Zea mays
  misc_feature (729)..(729): n is a, c, g, or t
  misc_feature (1013)..(1013): n is a, c, g, or t
aaccttttatcattaaatatggaggagcacgacggtagtggaaccataaaaactagtgatttatagacttttttaccatttaaatatggatgagcatgataacagtgaaaaccgtagaaccgtgaaaactattgttttatataatagatatgcatgaatataaagaatacatactataccatagcccaacatgtagattcacaggtgtgagagccacaactgttaactagtgcctgacacccaatgttttgcagtgtggacccgtttgcagctgtgtacagaccacccatgttagagcaactccaatagttatgtataattatactacctaaatcttagatttagcaagtccttaaataatataggaaacaaaaaaatcatctcctccaacagttctctatatattactttctaaatatgttaaaatttaacatgtcacctatttgagtgggaccatcatcgatgacatattcaacttggtgagttgtgttgaccttttgatttatggttgcaattatttatttgtttatttccaacatgtgcacgtgcggctattgtatcggcaattatttaatctctagatgactattgttgtccgacgcatgggctctgttaatatatctttactacaaagtgaaaaaggcagcgaaatacaaaaattaccgtcattttttttagggagttggtaaatggttgctaaatatagagagaaaataaggttagatgagnagtatctaaatttatgaagtttatttagagaactattggagaggagattttagattagttacctaaattattgatttaaggagtctttcagagaactattagagttgctcttaggctggccgcagtcggatactggaaaaggaacgctatccatatcaagtgatgtatgcagtaaaaactcagtgcagcgagccgctctatcgtctactctaaagcagagagagcacgtgaacgctattttcagggttcctagccgtgcaactggacaggccagaggtgggtcncgaggtggggccggaggcgggcaagggaggctgctcaggagagagaaataatagaatatatggtagaaataatattatatatgataattggtatagggttgagatatagagtaaacatgagtgcggaggattgtggtatagagtaaaaaattttgctgatcaggacagaatattctttttagagtagaaatttagagtagtatgagtgcggatagccttaggccttagcacgctatcctacgctaaaaagtttttagtcctgatgcaaccgaggcccttatgtcgtttgttttatgacagggtcccaggcccgtatagctcggctgcgggactgcttcagatgcagcgacgagcctgccactggccctacatggccagccagaacttgggtccgcggctccgcgcatccatacataaaagaggcccaacattcatacataaacaggcccatgtaaatgcactgacaacatgggctagcggcccatacaacaataactgcgccaactactcgcacccaccagaaacctacccgaccagacccgaacaaagcagagcagcggacagatcaaatcaggacaggcatgctgaactaggcgaggtggactgggcgagcgagcgagatggagtggacgacggtggagacgagggacggcgcgaagtgagcgtgcggctgttcaagccccccgcgtccggaacgggttggagccggagccgagggaggatgtggcggtggtgctggtgcatccctacaccatcctcggcggcgtgcagggcctgctgcgggggatggcggagggcgtcgcgcggcggggttacaccgccgtcaccttcgacatgcgcggcgcgggccggtccacggggcgggcgtcgctcacgggctccaccgaagtcggggacgtcgtcgccgtctgccgatgggtcgcagagaacatcaagccgcgcggcatcctcctcgtcggatcctcagctggtagactccactttttcgcctctccccgatgaggcgaaaccctgtcgcgacccgtacctttttttttcagttcatgaagcgtgaaaccgtcgcgcagtcagactgctgcggtaatcaagtcaaaatgatcgaacagtttcgcttttctgaagctctctttggtcaaatttaattgtacaaattacaattctctccgcagtcattcgggcctgtaagcaaatagtagctgttgatgtatgtgttgaatacaaataggaagctcagacgtttgtcctcatggaatttctgcgtttcagtctgtacactccaaatttgtatctgtaatcagcagatgggcattgatatttcatctagttttatttagggacctaaatttctgtcagatatccttaagaaaatatagtggcaaaaggtttattgttaagtaatctacacagctttcagcaaaccctcccagaaatgcaaagtagttttggatgcctgcttcctgtatggctgcaattgtcagtgagctagttgaggaagatgaagtttgtttagtttgcatcgaagaattaagatgtggtattctgcatacaagtcttctcctgtctttatgaagctgatgtgttgtgtttaggcatgtatctaacaataattccttgatgcaggggcaccaattgccggatctgcagttgataaagtggatgaagtgattggttacgttagcatcgggtacccctttggtctgatggcctcagtcctattcggaaggcataatgatgctatactcaagtctgaaaaaccaaagcttttcatcatggggaccaaagatggcttcaccagtgtgaaacaactgcaaaacaagctcaaatctgcagctggacgggctgatacacacttgattgaaggagctgggcacttccaaatggagggccctgcttttgatgcccagatggtagaaattattattaaattcattaattccttgccaaaatagcatttatggtgactgtttgagagtttgcaaaaattctagcgatgagcaaagcttgttatttaaatacagccacgatggtttgtattttctcatcctgcatatgtgtgctctctggtgttattgaaacagtgtaactgtgtgtgttgtatcttaatatattctgatcccgcacctccccaaaaaacaaagccgatacaatctcaagttcaaaatattctggttttattccagatatttcattttcccaggcaagagcagctggcttaacaactctagctctacccgtaagcagttatgtgtttcaggtatggcatctgtcattccgaaatctgaaacttaaattatttgagatcttttcgttatagatttgtaggtgtttcgaacctagctctgataaataaatttgtgtgcgggttttgtggtttggatgatgtgcttagaggacgcaagatttatactggttcggatagaatgtccctatatccagtctttggtgacttgcgttaccgatgctttgttgctcaatgcttgtagtaggggatacaagcaggcgagagagggagaagctcccaaatctcttatgcgttggtggatctaaagactacgtgattgggttcctcactaagccttaggcgtcgtggtggttcctcactaagccttaggcgtcgtggtggctcgcgtttgggctccggcctccggggtctctagtctccg

SEQ ID NO: 13697 - DNA, 986 bp, Zea mays
agagcagcggacagatcaaatcaggacaggcatgctgaactaggcgaggtggactgggcgagcgagcgagatggagtggacgacggtggagacgagggacggcgcgaagctgagcgtgcggctgttcaagccccccgcgtccggaacggggttggagccggagccgagggaggatgtggcggtggtgctggtgcatccctacaccatcctcggcggcgtgcagggcctgctgcgggggatggcggagggcgtcgcgcggcggggttacaccgccgtcaccttcgacatgcgcggcgcgggccggtccacggggcgggcgtcgctcacgggctccaccgaagtcggggacgtcgtcgccgtctgccgatgggtcgcagagaacatcaagccgcgcggcatcctcctcgtcggatcctcagctggggcaccaattgccggatctgcagttgataaagtggatgaagtgattggttacgttagcatcgggtacccctttggtctgatggcctcagtcctattcggaaggcataatgatgctatactcaagtctgaaaaaccaaagcttttcatcatggggaccaaagatggcttcaccagtgtgaaacaactgcaaaacaagctcaaatctgcagctggacgggctgatacacacttgattgaaggagctgggcacttccaaatggagggccctgcttttgatgcccagatggtagaaattattattaaattcattaattccttgccaaaatagcatttatggtgactgtttgagagtttgcaaaaattctagcgatgagcaaagcttgttatttaaatacagccacgatggtttgtattttctcatcctgcatatgtgtgctctctggtgttattgaaacagtgtaactgtgtgtgttgtatcttaatatattctgatcccccacctccccaaaaaaaaaaaaaaaaaaaaaaaaaaaaagtactctgcgttgttaccactgcttcca

SEQ ID NO: 13698 - DNA, 1263 bp, Zea mays
ctcccccctcttaaccatggcttgggagatagggttcaagagaggtctagggttttccctcctcttgcccaaggtagtaagtgcacaaaggtttgagtaatacttcttaggtcattagaaatcttggttaacacatggtctccaaggttcttatgttctccttaagttattaccacatgtgatcacagtccttagcaccaaggtgtgctctagccatggtaacacctgaggtgttacataaatacccccaaccacctccactccaaccatccaagcattcatcactctccattcaatacaagagcaaagtgcaacactccaagacacaaatcaaagccaccgatccgatcaaagtccccaattcaattctagtgttttaggacttgtgagaggatcgttcttgtgtttctttgttgctcttgttgcttggttggctttcttctttctctcattcttattctcaaagccttgtaagcgaagcaagagacaccaatcgtgtggtggtccttgcggggtctaagtgacccgagaaatcaaggaagaaagctcactcggtctaagtgaccgtttgagagagggaaagggttgaaagagacccggtctttgtgaccacctcaatggggactaggttctttagaaccaaacctcggtaaaacaaatcaccgtgtccatccgctttacttcttggttgatttgtttttcccctctctctcagacttgatattcgttctaacgctaaccctggcttgtagtgtgtgcttaagtttataattttcagattccgcctatccacccccctctaggtgactttcaattggtatcggagcccggtacttcatttagagtctaaccactagaagtgatgttgggaggatccgccaagagggagatggaaaccggcgagaagcccacaagccacgggaaggctccatcaagggagtccggcgccaaaggaagggaggaatcacctccccgcgtcaagtcgcatcggagtggcgataagaagaagaagatgaagaaagtggtctactatgagaccgactcttcgtcgccctccacctccagctcggacgcgacgtccatcacttctaagcgccatgagcgcaagaagtatagtaagatgccacttcgttatccccgcatttctaaacgcgctcctctactttccgttccattaggcaaaccaccatattttgatggtgaagattattgtatgtggagtgataaaatgaggcatcacctaacctcactccacgcaagcat

SEQ ID NO: 13699 - DNA, 1440 bp, Zea mays
cttttacccaaaaactgtaaccttattttgcatgtataccatgcagtttcgacttattaaagtgctatgttattcatgcaaacataaaagaatgcaaaaacataagtaagtcgaaaattttttttttttttttttttttttttttaaattcactaacaagtctgcattttttatactaaaaacagacaagtatgtacaattacatatataataagcaatctaaatatttaaatttagatactcaacactgttgaaaacagtaatttaaatgaacacaatgttcgtctgattataattgcagaaaatcagaaaaaatggtaaaggattcagcccaaccgcaggtagcccattcaggccgattccagccaggcagttggctaggcaacctcctcaaccggcccactagacgacccagacatctagaggagtgctggcagttagggttgcaaccactccatctcctggcggcggccggccgtcctggtgcagcaggcagggcgcgatgcccaggtacgggcttcgcggcggctcggcgcggtctcaacagcgcgaacacgggggcacggcctatgcggccactgagcgggtgcgcggccccgacgtcggtgccatggtgcggccctctggtggcgcgggcacgcggccccggccccaacctcggcgcgtgggcacgacggcactggccccggcggctcgcgtcgtgggcgcggccctggcggttggtgacccccgtctctggcgagcgcagccttagtcgcggccatcccggcgaggcggccgagccccaccggtgcgtcgcgggcgcgggccaagcagcgcgtaggcccccagacggcggcctcggcgtagcgcgtgcagggcaccccggcagcgcaggcgcggcggcctgccatggcacacggcgtgtgcggctgcccggccgaggcgcgggcgcggcggcccggccatggcgcgcggctgcccggcgagctgcggcctgccccggcgcatgagcacttggtcccggcggccctggctgctcggcgcacgcgggcaggcccccgatggcacggcacagcgcgggcgcaggctcctattcgcgcgggcgggcacacagccccagcaccatggcactggcatgggtcccactgtgtgcgtcgtcggcacggcgaccgagcgtgggcgcagaggccacaagcagcactacacatacatcatcagtgctacaacgtattttgtagaagtcaaaaaggaattggatacttcgcacgtactgtttctggacatcgaagccactcctttccatcttgctagcggcaacttgttcctcttttttttctctgatttgtttctctgatctcgcgagtcgtgctgataacgtgttgaagcgcagtgaaaaacgagaagcgagagaatgacaaatgacagtcgtatatctttattacaaaaaaaaaaaaaaaa

SEQ ID NO: 13700 - DNA, 774 bp, Zea mays
aacaacgcctggggtgtggagccgaaacctccaaaacgccaacggttatctcctcgccgatcggcggaagaatctcgattcgattcaaaatccacgtatccaaatcgcaaggccacacccacacctccctcctcccctccacccagagcgagcccgcccgcccgcatcggatcacatcgcgccggagcctgacgccgtgccgtcaacgaatccatgggacccacgccgccgcacacggacgacactagggttgcgcagctcccgctccccggcggcgccgaagattacgtgcgcgactccatccacgcctccctgggcctccccgtctccgatcgctccctccgcctcaagctcctcgcctccgaggagcagcgccaccgcctccaggaccacgtcttctcgctcgaggaagacctccgcgcagcccagcgccgcatcgacctcctcaaggccgaggccgccatgaacgccgccggcctccgccgctgcgtcgaggaaaaggaggccgtggccgccgcatacgccgacctctccgacaagagcagcaaggagtgtcggctctacgagcgggacctcgagcgcgccatggagtcctgtgacgacctcgccagggagaacgacgacctccgcgcacgcctaaaccagaacacagatttggcagcattgatggtgcaagtgcaagaactacataaggaaaaggagattctgaagatgaatcttgatacggcggaggcagaggtcgtgacactgagtgagggccgcagggctcttgat

SEQ ID NO: 13701 - DNA, 1723 bp, Zea mays
aaaccaaaccccgtaacccccccccgtcgccccaaaaacgcgacgaatcgcgcagcgcggcagggggaatcgctgcgatttcttgtggcccggcggctccagccccacggctgccgagcggataacgaacgactggcggcggctcgcgtcggccttcctcctctccttctcctctctcctcgcatcgcagtcgcagcaggcaacaaaccaaatcgcttaccgcccccgaagcgtctcggttcgcatagcagagctgctcttgcaacaagccaaacaacccagtggctgctagccgagacaggggatagattgagagagaggcgcgcagatggcgacgccgtcgtcgtcgctttgctccagcttcgcctccctgcggaccgcctccatcggccacccccgtggcatcgcctcctccacgcccaggaaggcattccatgtgagggcatcagctcgggttgacaagttctcaaagagtgacatcatcgtgtccccttcgattctgtctgcaaactttgcgaagcttggtgatcaggtaaaagctgtggaggtggcaggatgcgactggattcatgtcgatgtcatggatgggcgctttgtgccaaacatcacaattggacccttggttgttgatgctctgcgtccagtgactgatcttccgttggatgtacatctgatgattgtggaacctgagcagcgagtccccgattttatcaaggcaggtgctgatattgttagtgtccactgtgaacagacatcgaccatccatttgcaccgaacagtcaatcagattaaaagtctaggagcaaaggcaggagttgttttgaatccagcgactccactcactgcaattgattacgttcttgatgttgttgacctggtgctgattatgtctgtgaatcctgggtttggtggccagagctttatcgagagtcaagtaaagaaaattgcagaactgagaaggttatgtgcagagaagggagtgaacccctggattgaggttgatggtggtgttggtccgaaaaatgcctacaaggttattgaagctggcgcaaatgccattgtcgcaggttctgcagtttttggggctccagactacgctgaagctatcaaaggaataaagaccagccaaagacctctagctgtagccgcataaggagctggacgtgtaatcatttactctgtgcaagtttaccagtgatgcgatctgtatagatgtgtgtcttgtccagccatacgtataccggagatgaaaggagacggaggcagtgaagaaatatccttttttttcttctcatttttcacgaggatgccgtgcactgctcccagaatgctgtgtccaatttacaaacgcacaggtggcacatgaactagcagagtagctttctcttgaaaggaaactgtatttggggtcgatgaaccctctggtgttattcttcagactggtaaacgatgtaacatgtttgataatcaataaagtgcgtcgtatggctttcctaaaaaaaaaaaaaaaaaaaaaacgagagcgcgctgtttgtacatcggcatctgactgagtctgaagcccttgtacatgattggaatttaccttaaaactgtctggaactttgcacattttttttttgaaaaatggcaggagctctgcctttcattaaagcgggaaagagggtataaaaaaacagacactcatcaggagtacacctcctgtggaacgagatcctctgca

SEQ ID NO: 13702 - DNA, 1317 bp, Zea mays
tcgaggccggccgggatgtttcggttcgcgtagcagaactgctcgtgcaacaagcaaacaacccaagagccgggagagttggtgactgcgaggccgagacagaggggatagattgagagagccagagaggtgggcagatggcgacaccgtcgtcgtcgctttgctccagcttcgcctccctgcggaccgcctccatcggccacccccgcggcatcgcgtcatctacacccaggaaggcgttccaagtgagggcatcagctcgggttgacaagttctcaaagagtgatatcattgtgtccccttcgattctgtctgcaaacttcgccaagcttggtgatcaggtaaaagccgtggaggtggcaggatgtgactggattcatgtcgatgtcatggacgggcgctttgtgccaaatatcacaattggacctttcgttgttgatgctctgcgtcctgtgactgatcttccattggatgtacatctgatgattgtggaacctgagcagcgagtccctgattttatcaaggcaggtgctgatattgttagtgtccactgtgaacaaacatcgaccatccatttgcacagaacagtcaatcagattaaaagtctaggagcaaaggcaggagttgttttgaatccagcgactccactcactgcaattgattacattcttgatgttgttgacctggtgttgattatgtctgtgaatcctgggtttggtggccagagctttatcgagagtcaagtaaggaaaattgcagaattgagaaggttatgtgcagagaagggagtgaacccctggattgaggttgatggtggtgttggtccgaaaaatgcctacaaggttattgaagctggggcgaatgccatcgttgctggctctgcagttttcggggctccagactacgctgaagctatcaaaggaatcaagaccagccaaaggcctgcagctgtacacgcataaggaactggacgtgtgatcgtgctctgttcaggtttagcagtgttgggattcgtatagatagatgtgtcttgttttcgagccatacgttatactggagatgaaaggagacggaggaaatatttctctacgtgggtgaatcaatcatgtggacggtaatcacatgacgacaaagcatatggacgagcgctggctcacgagacagagtaatcaacgggagaggcttctagacagctctgcatgtccattccctctataaacaggagagcagttcagtctccattgtaaaggcacccagatatagaagaaagaaataaagagctctctatttgtctctgtttcaaaaaaaaaaaaaaaa

SEQ ID NO: 13703 - DNA, 1472 bp, Zea mays
atgctcctccacgtcagaagcccgccgtcctctttgtcctctccggctctccccaccgccagaaaggaaacggacccaacgcgatcgaagtccactgccgtcttcactgctgccaggcgccagccacggcccacggccaatgcaattgcagttgcagttgcaattgcacggcacccatttccagagccgtcctcaattagctagtcaaatctcgctatcctttccccaccatccagatcttccctttcatggacgccgccgtctccaccctcaccgctctcgccatcttcgcgagcaccgtcgagcacgccgcctacaggagcgtgcaggggtatagggtggtcgggaggaaaggcggcgggtgggtccgttgggagaggtgggtggagcggcagttcgtcctctccctctccttcccacggtgcgtcgaggttgccctgcccgccgccgcgccgcggatactgccagcggggtggcgcagccggccggtgttccgcgagggacagaccgtcgacacttggcgttgcattgtggcattcgactccgtcgccgccgtcgctccgtcctccccgccgccgcccgtgctctcccccttcgtgaacccacagctgcagtatctgtctaatctgtacaatgacctgctgatggtgtttcggtttcgagaagagaaaacggtcccacaactcgttaattcaaagcaacccatccgttgtggtgaacaggggaaaacttctgatttgggtgatgcatcggagtccgattcggatggggattgtcaatctggcaaagaacttgcaccaccagttcagaagcatacaagagccaaccggaagcatatagatagcattactttagttgatatagctcagtacttccatcttccaatccgagatgcatcaaagacactcaagattggggtcagcatattgaagaggaaatgccgacagtatgggatacctcgttggcctcaccggaagatcaagtcacttgactctctcattcatgaccttgagttcgtgctagcaagagaggatgaggatgaggaggaggagaagcagctgcagaaggacaggctggctgctgcgataaacgccctcacaaaacggaagagcatgctggagagcgagaaggaaaccatacagcagaaaccggccatggacctgatggctgaaaccaagctattcagggaagatgttttcaagaggagatatagggccaaaagttcagtcatggatatggattagcatttctctttagctgataatacctggtgtaaaaagatatggctgatcgaacctgtttgtaaagagataatcgatccatgtgtaccgccagttatatggtagctggtagctgctctcgtcataaccttcattttgttctgatggtgtctgttaattgtactcttcttgggtgaactgaactgctggagaacttaacatagccatggttggatggtgctaaaaaaaaaa

SEQ ID NO: 13704 - DNA, 1897 bp, Zea mays
actgatctctaggtcatagcctctggtagtccctggtcagcctgtgtggactgtcctcaggacaatcgccaaaaccccccgagccaacacctactacgccgccgcgccgccgcgtcaaacaacggcgagaggacgcctatggcattcacttcccaatccctaatcttccgggcacccgcctcgccctcttgtgcccgcataaccccgtcatccggtcgcgtcaccctccgggaccgcagcgccgttttcccgctcgtcgcggcggcctccacctcgatggcgtcctcggagagcgaagataagagggaaaccaagctgtggggcgggcggttcgaggagggcgtcaccgacgccgtggagcgcttcacggagtccatatcctacgactggcagctctacaaatacgacataatgggcagcaaggcccacgcctccatgctcgctggccagggtttgataacagctactgatagggatatcatcttagaggggcttgatcagatagagaggctgatccaagaaggcaaatttgagtggaggaaggaccgggaggatgtgcatatgaacattgaagcggctctaattgaaagggttggtgagccagccaagaagttgcatactgctaggagccgcaatgaccaaattgtgacggatctaaggctatggtgccgtgatgctattgacaagattttgattcgtatcaagcagcttcaggtgtctctggttattttggcttcaaaatatgttgacttaatagtcccaggttatacccatctgcaaagggcgcagcctgttctgctgccacatcttctcttatcatatgttgaacagttggagcgtgatgctggtcggctggtcaactgcagggagcgaatgaatttctgtcctcttggtgcttgtgctttggctggaactggacttcccattgataggtttcaaactgctaaagatttgaaatttacagctccaatgaagaatagcattgatgcagtatcagaccgtgattttgtacttgagtttcttgctgccaattcgattgctgctgtccatctttcgcgaattggtgaagaatgggttctttgggcatcagaggaatttgggtttctgataccaagtgacaaagtttcaactggaagcagcattatgccccagaagaaaaatccagacccaatggagcttgttcgtgggaaatctgctagggttgttggagacctcatgactgttctaaccctctgtaaaggccttccacaggcctacaaccgtgaccttcaggaagacaaggaacccttgtttgatagtgtgaaagctgtattaggaatgcttgaagtatgcacagagtttgctcaaaatatctcttttaattcaaaaagaatacaaagttcacttccagctggttatctggatgcaacgacgctggcggattatctcgtgaagaagggagtccctttcagaacttctcacgagatagttggaaggtctgttgctctatgcgtctccaagaactgtcagctagctgagcttgaattggctgacctaaaatctgtccatcctgtatttgaggatgacgtctatgaatacctgggggttgaaaacgctgtaaacaagttcatatcctatggctctactggttcagaacaagtgaaaaagcagcttgaggattggcgcatccagctcggggtgagctcataagggttggcatggttcaagaaataagctcgcaaattagtgcttgcgatttttgaaggtgtatgttgacgtcgtgaactttttctgtgtgtttgttcatacatttcgaaaactggaatgaatgatgtaaacatgttggacaccttgagcctcttttatatattattattgcactgtgttttatttgcaacgggaacataccataccaaaa

SEQ ID NO: 13705 - DNA, 2499 bp, Zea mays
gatttaaacccacccaatcccactcaatccacatggattgagagctaaccgaacaaggcctaaaaagaaatctgttaggtttagcttttggtttttgccccctaaaagccaaaagctaaaccaaaaagctggatctagaaagcagctttttttaaaagccgattttctcgcagtgtaaaactgaaagcacctctagacctgcttttagcggcttttggatggaactgtaaaaatatatgtggaatattttttagctttttagtggttttcactaaacggttttagctttttagcacttcactgtccacatcagcttttttcacagatcacaacccacaacagcttttttcactgccacagcccaaccaaagagaccctaagtcttgcatgttgcttattctttacgttacagtttaatagcaattatgctgacacttaatctcttttgatagcggttccaaaaatgtcaatatgccaggacaagacttgtaagaactggagggcgtggatggggccttgtggctgatgagaatattatggctggtcaatttgttatcgaatattgtggagaagtaatatcatggaaggaagccaaacggagagctcaagcttatgaaacccagtgtctgcagatattctctcgcttctcatatttgaattgtggcaaactggcacttttttagctagctataacatctagcttctgtaactgcaggtttaaaggatgcctatatcatttacctcaatgctgatgagtcaattgatgcaacaagaaaagggaaccttgcgagattcatcaaccattcatggtaagtttgtattaaaggcacagcatacttgaatttcatcttgcttcttatgtgtgtgatttgatcattgattttttctgtcattgacttgtaagtaattaagtctaatagttcactattgaagcatacagccaaccgaattgtgagacaaggaaatggaatgtccttggggaagtaagagttggaatttttgctaagcaaaacattccttttggcacggaattatcctatgactacaattttgagtggtatggtggtgtgatggtgcggtgcctctgtggagccgccagctgttctgggtttcttggggctaaatcacgtggtttccaggtgggcgaacaaatttatgttgtgcatgtgacttcctatttcatgcttgacacttgacagtagtgttcgacagaaggaatcaccgctaccttttagttgttatatgtcaatcctctttgtcagacattggaatgactgattgcactctggttttctgcatttgcttatttgctgacataacgttttgagccttcatgctatctacttattgcttggaagattgacattctgcatcattatctggtcatttttgcatttccttgtaagttgatatttgatatgttcattatgttcctaatgtagctttattgattggtatgttgcaggaggccacgtacctgtgggaagatgatgatgacaggttttctgttgagaatatccctctctgcgacgctgccccccccccccccacaagcattaacaaggaaatcctcgtatcaagtgatggcatggttacccaatacagcaacatcagcagagtacagagtaccgaaaatcctggaaacactggaacaaatgaatttgcgccaattatcgtcgacgaactgacaacaagctcaaatggattagcaccaatgaacgttgaaccattgactgtaagctcaaatgagttcacgccatcgaacgccatgccaatggtagctcgtctagtcgagaatgggtcaactggatacagcgcacaggacactcacgacgcttctcagaattcagcgcccaaagctgcaaatcacgcgaaccaaactggacctcagaacaacagcaaccattcagcgttggtccctgtgaagcccgcgccgaaacgccgtggcaggaaaccgaaacgcgttgtgcacaagcagctggacatcccagatatctgcgaccggcttacatcgtctgtggcgtgcgaagaaatactgtactgtgaggaagtgaagaaccatgccgtttctgaaatcgatgccctgtacgatgagataaggcctgcggttgaagagcacgagagggacagccaagatagcgtctccacaagcctcgcggagaagtggatcgaggctagctgccgcaagtacaaggccgaattcgacctgtatgctgcagtactcaagaacgttgcctccactccactacggtcgaaggatgatgtgggcccaagagagcagaacgggttgaagtacctggagaacggctcatgatttcttttagctagaagcgtggaatattacgtacgccttcaatttgtagtatagggattgcattttttttaactgtggttggtcttgtatttaggtagagaggcattgtaaggttacatgattttaaatagcgtggaatcatgtcaaacgcacatttgatctaaaaaaaaaaaaaaaaaaaaact

SEQ ID NO: 13706 - DNA, 4115 bp, Zea mays
ggccacaaccatacctgctacgcttgcgccgccgcctccccccttgtcttcgcttcccgtgcaagcttcaccgccgccgtctccgactcccttcgcgatgcgaccgctttcgcgccacgattcctctatccccgccttccccgcccgcgccggttcttgcacttgaccgacccaatccgcctatctgttcccctcttccgtgcgagaggtactatcgccggccgtttcgtttcgaggctgatcggatcggcggcagatgggccgcgacgctgaggatacttcgtctccggtgtcctcgtcggaattggagcaggaagacgacgacgattgctacctgagcgatcagggggacgatgccctagaagagtctgttctccatgttctcgaggacgagcacctcgaggactgccattggtctgcctcatctgtgatcaccaaggaatcccttttggtggcgcagagagaggatcttaggaaggtgatggagctgctagggttgagggagcaccatgcccggacgctcctcatccactaccgctgggacgtggagaggattttcgagcttcttgatcagaaggacagggataggctcttctcggaggctggtattcctcttcagtacaccaggaatgctggcccaacctcctcggcggaggtgacctgcaatgtttgttatgatgatgtgccaccctcggctgcctccgagatggattgtggccacagctactgcaatgattgttggactgaatatttcattgtgaaaataaatgagggtcagagccggcgtgtcaggtgcatggctccaaagtgcaatgctgtttgtgatgaagcaataattcgaaaactagtcactgcaagacacctagatatcgcagaacgctttgaaagatttttactggaatcatatattgaagataatgatacagtcaagtggtgcccaagcacaccacattgtggaaatgctatacgcgtcaagggcgatatttattgtgaggtggagtgcacatgtggatgccagttttgttttaattgctctttacgagcacactcaccgtgttcctgcatgatgtgggagctctggatcaagaaatgccgtgatgaatcagaaacagtgaattggataacagtaaatactaagccctgtcccaagtgtcacaaacctgtggagaagaatggtggctgcaacctggttgcatgtatatgtggacaagcattctgctggttatgtgggggtgctacaggtagagatcacacatggtcaactattagtggccacagttgtggcaggttcactgatgatcagactaagaagacagaacaagcaaggcgagacctctatagatatatgcactaccacaatagatacaaggctcacaccgactctcttaagcaggaagcaaagctaaagaatgagatccaggggaagatatccatttcagaaaataaggaatcaaagataaaagattattcttgggtcataaatgggttaaacaggttgttcagatcaaggcgtgttctttcatattcgtatccgtttgcattctacatgtttggtgatgagattttcaaggatgagatgactcctgaggaaagagaactgaagcagatttatttgaggaccagcaacaacagttagaatttaatgtcgaaagactgtctggtttccttgagaaagattttcaactttttaccgatgatgaggtcatagatacaatgaagcatgttataaatctttccaatgtggttgataggctctgcaaacaaatgtatcaatgcattgagaatgatttgttatatcctctacgcacacctcacaacattgctccatacaaatctaagggcattgacagggcctcggagctcaatattagttgggatcctggtgaacaaagttcacagtcaacaaaacatagccaggatgaacacaggaacaaacaagcatcaaatatttcgggtaaacgaactcatgaattgcatggttcgagttcttctaacaagcgagagagggtagatgttaacggtggtggtggtgcactttttgatctcaacgtgccagctgaagtggtggacaagatctgaaacttcattatctgatgggtgatggcacattcctttgaactgtacagctgacttaagcttcgtcaccaacataaaggaaaaaatactgttcttttttgctgccttaccaccatagagtacctgcatgtcaaatttttaccctggtgcttgtatcccaaggtatagagtagcttttaagttatatgttgtatttcatggcatgatctgaagccaatgttcatagttctgatgaagttgtacccctcaagcaagatgaggatattttggaatagaaccatgcctgtgttgcaaattccagatataatgtatgcagcatggtgaaaagggaattgtttgttgagaagaatgtgagtgattatttcctggcaaatgggtggttctattgacaatgaagacaatgactgattcgtcgtattaaatgtgcactttgttgcaagcaactggcaaccatcttgtttctaggacagctttgtattcaacctgtgaaaatcccggttttctgggcacacattccagattattatggataactgcattctactgtagctgcgggaggagctgcaagatatcaatcaggtgcggtgcgtgttgacagtgtgttccttcgtttcttcacattcaagtgttatccgccctcctgtattttaccaagataacactttctcgagaaaagggtcttagagttgtgttttgatgtgggactgaagaagagttttttttttatttcaacctaaattttgttttcaaggaagtcagaatttaagatctgaggagtgttaactagactgcttaattgattaaactgaaggctcttttgccaaattggatcaaaattgaaagttctgtttttgtacatagaaaagaaagaactctgcttacgatttggaatggagtgggtacatatttgtcaggtcaatatatgtttgtcaagtcaagctttggaccgtgcgttgaaacgtagcatcaagctatgccgtagctttctagaacccatgtagagacacgcatatggtgatccatggaaattgggagcacctgtacgatgcagacacttgaatcttgtgcatgaaagaacactctatattgtcagctactagcttgccctgaagaaaattgctcgagctctgaagccctctgacttggctaataggacgccgcccccaatttgccatggtagggagcatcagagtactcgtttcgttctctactggagccggtaagttcagcctctgacagcttagagaaccgatgagaagaatctttctggatctcggcctcggcccgatcccataatcaaatgctcgtggagctggtttccaatgcgcatcgccacggcatctgccgtttcttactgcctccccaacatctcctcgcttcagtcttcacctatgcgttccagcgattgtttacagccagtagctggacgcatcggcacaagagggtccaagagcacatgaaacctcgagcatgtctgtcgccggggcatttgtttaacccacctccacccccaaatgagatttaatttttgcggataagtagggttaccaaggttcctcttgtcgttataaccggcacgccttccttaggaaacagtcattggcatcatcatttggatcttagtgctggtgtctggccactgcgaaaatcattgtagccgagctcgctggggataggaactgctccctttcggagaaccggagatgcagcagcgagtggctagcttacagaaccagctcatttgacgcacaccacacgcagggaaaaaaaaagatggcccagacttggcgttcgcgataatttttttcttctttttgagcaactattatttgctgcatgattcacaaaaagatgcggcaggtccggcgcttggatgttgctcacttgctctgcgtcctgcttctggaacaggggtgggggcgcacggcacgggccaagcctagtggcgccaagcgcacagcagctgatggcactgggattagggcaaaccccaaggcggcgagattccgtgacaaaaagctacatgacgcctgggcccg

SEQ ID NO: 13707 - DNA, 1948 bp, Zea mays
  misc_feature (1420)..(1420): n is a, c, g, or t
gccggttcatcaaaggacgccgcaaagacatcagcccagccttccccaattccggccacacccgctacgcctgtggtgccgcctgccgcctccccttcctcttcgcttcccgtgcaagcttcaccgccgccatctcgtcctctcgttgcgatgcttccctttccgcgccgcggttcctctatccccgccttccctgcccgctccggctcttgcacctgaccaagtccgccaatctgttccccttttccgtacgagggtactatcgccggccatttcgattcggggttgatcggatcagcgtaggctgatgggtcgcgatgctgagaagacctctccgccggtgccatcgtcggaattggaacaggaagaagacgacgactgctacctaagcgatcaggaggacgatgccctagaagagtccgttctccatgtcctcgaggacgagcacctcgaggactgccattggtccgcctcatgcgtgatcaccaaggaatccctcttggcagcgcagaaggaggatcttaggaaggtgatggagctgctagggttgagggagcaccatgcccggacgctcctcatccactaccgctgggacgtggagaggatttttgagcttctcgatcagaagggaagggatagcctcttctcggaggctggtattcctcttcagtacaccaataatgctggcccaacctcctcagcggaggtgacctgcaatgtttgttatgatgatgtgccaccctcgtgtgccttggagatggactgcggccacagctactgcagtgattgttggactgaatatttcattgtgaaaattaatgagggtcagagccggcgtgtcagatgcatggctccaaagtgcaatgctatttgtgatgaagcaataattcggaaactagtcattgcgagacacccagatattgcagaacgttttgaaagatttttactggaatcatatattgaggataatgatacagttaagtggtgcccaagcacaccacattgtggaaatgctatacgcgtcaaaggtgatatttattgtgaagtggaatgcacatgtggatgccagttttgttttaattgctccttacaaacacactcaccatgttcctgcatgatgtgggagctctggattaagaaatgccatgatgaatcagaaacagtgaattggataactgtaaatactaagccctgtcccaagtgtcacaaacctgtggagaagaatggtggctgcaacctggttgcatgtatatgtggacaagcattctggtaagatatatgcttcttcatctttacttcttccattcctaattcctgtagttgattagacccaatcttaacattctttgtttgatgaagttttccacttgattgttcttttggccttgaccatacaacaatatattcttgatcccctagnttttctcctttatatcatcattataatttagactagctgttctatacttctacatagcgtggtcgcaatttcatatatctagttagaggatgtttcattcaaataatctggtagacctccttgtatcaaaatctggaaggcaattcatgcacgggttataaggttgttgtttatcgaatattcagacttagacatattgagttaactattaccaagcgcacatgttatgatgtcagtctttatatctaaaccacaagcatataatgtaggattgataagtgaattgcctgtgagatgttcttgtgtcaatatcggtcatatatataatatatttcagtaccttagtcttagcattgactgatcttttttcgcaagaataagatatttgtaatttgcaaatctattttctcttgattagagacaaccatttaaatttaccacataaaattagttgctagtggtgtgaatgattctagtattttacttttagtatattgcacagcttggcagaagcatatgggtagctgg

SEQ ID NO: 13708 - DNA, 1225 bp, Zea mays
cattgggtacctcgaggccgctctccaagactccatccccccaaccaccagaaccagcgccagctctaacgtcacctctgatttctctctcctctctattgctagctgctttattataagtagcagctgcagcaggccggggcgggacacacccatccaattccagctgctgatcttgatcctgcaccccgagccgtacacaagagctagtcggtagaacttgcaggagcggagcagaactaagtgcagagaacaggacatatggctacgccggcggtgaaggtttacgggtgggctatctcgccgttcgtatcgcgggctctgctggccctggaggaggccggcgtcgactacgagctcgtccccatgagccgccaggacggcgaccaccgccgcccggagcacctcgccaggaaccctttcgggaaggtgccggtgctcgaggatggcgacctcacgctcttcgaatcacgtgcgatcgcgaggcatgttctccggaagcacaagccggagctgctgggcggcggcaggctggagcagacggcgatggtggacgtgtggctggaggtggaggcccaccagctgagcccgccggcgatcgccatcgtggtggagtgcgtgttcgcgccgttcctgggccgcgagcgcaaccaggcggtggtggacgagaacgtggagaagctcaagaaggtgctggaggtgtacgaggcgcggctggccacgtgcacgtacctcgccggcgacttcctcagcctcgccgacctcagccccttcaccatcatgcactgcctcatggccaccgagtacgccgctctcgtccatgcgctcccgcacgtcagcgcctggtggcagggcctcgccgcgcgcccggcggccaacaaggtggcgcagttcatgccggtcggcgccggagcgcccaaggaacaggagtgacgatgaagcgatcgaagcgacttgtgttgttgtgcttgattagttaattggaaaccttctcactcatctagtccatcatggtgcctgcttttctttatactatttgtcttaattttgctgctttctccacggaataatagtagagatttggaaatgtaatgtattttatcaaaatatattggattttcaagcaatatagtatggttttcgctgccaaaaaaaaaaaaaaaaaaaaaaccccacaagaaacaaacatcttgtaaaaaaaaactcagactagttctcctcgtgc

SEQ ID NO: 13709 - DNA, 1135 bp, Zea mays
ccacgcgtccgcaatgatgagattggtataactggtgctatactgacaaaactggatggtgactcaagaggtggagcagcgcccgaggttaaagaggtgtctggaaagccaattaaatttgtaggacaaggagagcgtattgaagatcttgagcctttctacccagatcgtatggcacaacgtatcttgggaatgggagatgtactttcatttgttgaaaaagcacaagaagtgatgcgccaagaagatgctgatgaattacagaagaagatcttgagtgcaaaattcaactttaatgacttcctgaagcaaacacaaatgattgcaaaaatgggttcattcagtcgtttgattggcatgattccgggcatgaacaaggttactcctgcacaaatccgtgaagctgagaagaatctcaagtttatggaatcaatgatcaatgtgatgactcttgaggaaagggaacgaccagagcttcttgctgaatcacgcgagagaaggaaacgagtggccaaggactctggaaagactgaacagcaggtgagccaattggtcgcgcaactcttccaaatgcgtgcaaaaatgcagaaaatgatgggcgctatgcaaggaaaagagtcaccagacatggacgagctcatggaatcgatgaaagctgaggagcaggctgctgccggtactggacggcgtagaaggaagtatggcaacctgaggcagaggcaactggatgccatgcgtggtttccgcagacggtgagatgctcattgccgactagtactggcggtgcctgcacgaacgatggcatttagggacttgggctcggatatagaagtggaagaagatgaagtgcttttgggtgcaatggcaatcatctgggtacattgagttgagtttgcatattcatgtgcagtgtcctattttgacatattagccgtattattatctttcttcggagcaagaactcgcaaagttgcgtcatctgaaccctgtccaccgtcgtggaaacgagtgcacttcggccatgctagcaaatacaaatacggatctggatcatacgtgtggcacataactctggaagaatttgcgagaaaaaaaaaatccccaataagcatagctagcaatgcttttagtttct

SEQ ID NO: 13710 - DNA, 1716 bp, Zea mays
  misc_feature (1677)..(1677): n is a, c, g, or t
attgcttctctctctctccctccagaagacgggggagaatgttgccgagccacgtggcaatctatctcacagcctgaatcagaatcagcccgcgcctcccctcccacctccactcgtttcgctcctctgaatccccccgggccccggcacggaattccccccggcacaccccccaaggccaccggacgccagcagccccgcccccgcccacacctacgtgcgagcgcaatgctggcggcgtccctcaggccggggccttcgctcgcggccttccccggtaccgcccagaggagcccagttcctttcctccccttccctgcccgcctccaccaccggcccgtcctcctctccgcgaccgccgagggaaccggcgcccccgccggccagggagacgcctcggctgccccgctcgacgaggtgcgcctgccgcagttcgctgcggactgggaatccgcgcgcgcgtgcaaggaccaggggaggatcttctcgctgccggtgctgagggccaacagcggcgggctcatcgtcaggttcaactccctgcaggggttcgtgcccaaccctctcctcagccccgcgcactggtgtaaagaccccaaaaggcccatccaagatgttacgaaagacctagtaggaacgtccatttctgtcaaggtggctgaagtgaatgaggaggaaaagaaacttgtcttctctgagaaggatgctagttggtcaacatactcttcccgaataaagattggcgacatctatgatggaattgtgggctcagtgttccactatggtgcatttgttcacctgcgatttcctgatggattatatcatcttactggtcttgtacatatctcggaggtgtcttgggatcttgtccaagacgtcaaggattttctaaacgaaggggatgctgtcaaggtcatagttgtgaacattgatatgacgaagtcaaggatagctttatctatcagacaactggaggaagatcctctattggaaacattggacaaagttatccctttggaagctgatcaatcacctaatcgaatgatgtctccttcggaagttgaacttctgccaggacttgatggtatatgcaatgaactattgcaagaggatggtataacagacgtacagtttgggcgccaggcattggagaaacgtgtcgtttcacaagatttagagctttggatttccaatgttcaagctaaggacaacaagttcacacttcttgcgcgagctgggaggcaggtccaggaagtgtatttgaccacttccctagaccatgagggcataaagaaagccgtgcaaagagtgctggggcgtgttccttgaacccgacacgcagcgtgtagaaaccgattttctaactaaagcattacaaggaatcaacagtacgagcgaacagcctgaaacatttgccactgtcattctgtcacaacatccggctaaatttttctctgttggatactacaacaaccaaaaatctgtaaatattttcagtcctacacgagtaggttaggcaccttgggccaacccttcaaactaagacgttgctaagcagtggttctgtgcaaaaaaaaaaaaaaaacgcggcctgccatgtgcacttgtcatactgtgacttcagttcactgcttgcacttggctgaactccccgagtaacttgtgtacatgagtatnactatgtgagtttatgtcagtgctaacgcttactttagg

SEQ ID NO: 13711 - DNA, 1402 bp, Zea mays
tctgccttatcaaattaacagctgttcacataggaaaacttttcttttcttacatcataagggaatgattagatattggattcctttggttttttttcttttgaaataattggacatacttcgcatttaccccaaaaaataggacgaagtcaaggatagctttatctatcagacaactggaggaagatcctttattggaaacattggacaaagttatccctttggttagttgtttaatacaatatcttgactcttagtttatttaactctgagatgtaaaaaaaagtggactcattcagtaatctttcttttcttctaggaagctgatcaatcacctaatcgaatgatgtctccttcggaagttgaacttctgccaggacttgatggtatatgcaatgaactattgcaagaggatgggtatgttttttgtttctttgattggtatcttttttttttttttttgcattgttgcatagttggatagcaagttctttactgtcacagatatgccgccaagtcacacaaaggttctactgcatatccacagacgaactggttttgttatattaacacccatagtctaatcaattgtattatctttacagtataacagacgtacagtttgggcgccaggcattggagaaacgtgtcgtttcacaagatttagagctttggatttcgaatgtactatcccagtcattttcatagttgcagctcggaggagatgatggatgctataaacttggattaacttgttggatctgactacgcaggttcaagctaaggacaacaggttcacacttcttgcacgagctgggaggcaggttaggtttcttctggtgaccgcaatgatttgttttgttttcagaggagtttcattgtactgctgtcgggccttggctggttcgtttccgagtaaatagaattatatggattgtaattccttcttattacttggcaggtccaggaagtgtatttgaccacttccctagaccaggagggcataaagaaagccgtgcaaagagtgctgggggcgtgttccttgaacccgacacgcagcgtgtagaaaccgattttctaactaaagcattacaaggaatcaaaagtacgagcgaacagcctgaaacatttgccactgtcattctgtcacaacatccggctaaatttttctctgttggatactacaacaaccaaaaatctgtaaatattttcagtcctacacgagtaggttaggcaccttgggccaacccttcaaactaagacgttgctaagcagtggttctgtgtatttgctggggtctatcttttgatgccatgtgcacttgtcatactgtgacttcagttcactgcttgcacttggctgaactcccgaggtaacttgtgtacctcggccgcgaccacgc

SEQ ID NO: 13712 - DNA, 1672 bp, Zea mays
ccggccgggttgaaaagctggtatacacttgctctgcgtggccgcggccgggggaccccggtggatcaaaacatggtccctgttcgaggagatattcatgttattgtagttggtgatccagggctaggcaaaagccaactcctccaagctgcagcagctgtttccccacgaggaatatatgtatgtgggaatacgacaacaaaggctggcctaactgttgctgtggttaaagattctatgacaaatgattatgcatttgaggctggtgccatggtccttgctgatcgtggaatatgctgtattgatgagtttgataaaatgtttacagagcatcaggctttacttgaagccatggagcagcaatgtgtttctattgcaaaggctggtcttgtagcaagtttgtcagctcgaacttcagtgttggcagctgcaaatcctattggtggccattatgaccgagcaaaaacagtgaacgagaatctaaaaatgagtgctgccctcctttctcgatttgacttggtgtttattctacttgacaagccagatgagtcactagataaaagagtgtcagaccatataatagctctccataccaatgatgttgataatttcagacccaacaagaggaccagaacagggtcacattttgatggtgatccggggcttggagttggtggaaattcagtagcttcaaggctgaggctacacccagagaaagacaaggacttcactccattatctgggcaacttcttcgcaaatatatatcttattcaagagaacatgtcttccccagaatgtcaaaggcagcagctgcaattttgaaagaattttatttgaagctgagaaaccgcagtgcttctgctgatggtacacccatcacagccaggcagttagaaagcctagtcagattagccgaagctcgtgctcgcgtggatctaagagatgaagtgactgaagaagatgctcaggatgttgtcgatatcatgaaagaatctctgtatgacaaatatgttgatgaacatggttttgttgattttactcggagcggtggaatgagccaaccgaagcaggcaaagaagtttctgaatgcattaaacaaggaatctgagttgcagcaaaaggactgcttctcgagaactgaactttacaccatagctgataagatcagcttgcaagttccagacttggacactcttgtagaaaagatgaacattgccggttaccttattcaaaaaagatcagggatgtatcagctggtgactgcgccatattaacaatgcagccaacgaggtcaagatggagagttttcttgaatgaaactagaatttgcacctgctttgtctgtactagtgcctgctctagatctccagacactctggaaggccttaatccatttcaacataattgacatgtacctttcagctcatttccccccgtcccgtgagagatgtatggtttggaagctatgcgtatcgtcatggctgcgcacatacgtgctgcagtgtacaggcgactgaagtgcacgcgtcgcaggatgagcactaactttggtagcttggtgtatgccatggttgcgatatgatatattattgtgaaacaggagcctctagcggctcgtaggtgggggggtttcaagtttgccaatgaaacatccagaatagcatatgatgc

SEQ ID NO: 13713 - DNA, 2839 bp, Zea mays
  misc_feature (12)..(12): n is a, c, g, or t
  misc_feature (17)..(18): n is a, c, g, or t
ctcgaggcttgnccggnngaagccgcaaataataatcgccaaagcccaaaagagatagagaggagagccgcccgggccggcgagtggagaaaagcagagcacagagagagagaagggagagggaaaagagagagagaaaaaaagatccccgtccaccgcccacccgctgcgccggcgctgcacgcacggacggacagacggacctcccccccaagcggtgccggattcagtgcggtgggccaggggctgggacggagtgggcgacagatcgagcgctggcgatgccgcacccgacggacccggaggcggggtccgagcagaaggcgccggcggtgccttatttggcggctgcggcgccggctccggtcaagaagaagcggaacctccccgggacgccagatccggacgccgaggtgatcgcgctctcgccggggacgctgctggccacgaaccgcttcgtgtgcgaggtgtgcggcaagggcttccagcgggaccagaacctgcagctgcaccgccgcggccacaacctgccctggcgcctgcggcagcgtggtccgggcgcgccgccgccgcgccgccgggtgtacgtgtgccccgagcccgcctgcgtgcaccactcccccgcgcgggcgctcggggacctcaccgggatcaagaagcacttctgccgcaagcacggggagaagcgctgggcgtgcccgcgctgcgccaagcgatacgccgtccaggccgacctcaaggcgcacgccaagacctgcggcacccgcgagcaccgctgcgactgcggcacgctcttcaccagacgggacagcttcgtgacgcatcgcgccttctgcggcgctctcggggaggagaccggcagggtgctggcgccaccagcgccgccatcgcctcggccgcctgatttggaggctgacgaaaatgttgctgatttggaggctgacgaaaatgttgacaaggacaacgacaaggagggggaggaggagaatgaggattctgccgtggccgaggtggaggagcctcagcgtgtggaggtggtgccagaggagccacagcgcattccatctccacctccattgccgaaggagccaccgtgccgtccgtccccacctccattgccgcaggagcaactgtccccacctccgtcgccaaatgagccaccgtgctgccatccgtctccacctccactgccaaaggagccacagcggcttccatttccaccggagcagcatgcagttgtggtggcattggtgccaaatgtggatgagccagaggtggttgctgtgccaagtgtgactgccgaattagaggatgaaaccgatcaagacgaagatgcctgtttcctggaagctgatcagtacaaggactcggagcttgaggtctccaatctgctggacaaggacaccccgatgcttccttgcttcctcgcgtcgccctcggaagccattggcaccgatggaagcggcacaacaacctgcggcgcaggtggcagcgtctccaattccatcgcgccgtctacaaccaccaacaccttcgccggcctcttcgcgtcggccacaacaagcaccacttcccacagcacatctctgcgcgatctcatcggcgtcgatcccaccttcctctgcctcgcgatcggagcgccgtctctgttcccgcagacgggcgcgagcaactcaggcaccttcgccctgctgccgccggcgccgcacatgtccgcgacagcgctcctgcagaaggcaacggaggctggagcgacgcagtcgagctcatcgttcttgaaggagtttgggctggcctcttcctcctcctcgtcgtcgtcgcaaccttcatcgaagcagaatcatcatcaacagagggagatggagccatgttcgcaacaatggcacccctctagtacccagcaaacggagatggagcgccgccaccggaatcatcatcaagagagggaaatggagtccagttcgcaacaatggcaccgccaccaccggaacgaccggcagatggggtcggagagctaccggagtaatcagcaaatgcagatggagtccagctcgcaccaatggctgcaacacagaagctctgagcaaatggtggggcggcggcaccacctggagagggtggaatccagggggatgctgctgtctggtggtggccttggtctgggcctcgcatacgaaagtggaaaatcaggcttgcctgatctgatgacgggaccatcgccatcgccatcgccactgttgggtcccaagccagccacgctggacttccttgggctcggcatcggcgggaccatggtcggctccacgggcctcccggcattggtggctggaggagagctggacatggggtcgtcggcgcaggtgcctgccccatgggacgacgcccagaggaaggccaacggccgcacgatcctgtgaggttttctccttttttttgggtgacctgaccttcttagaggagttcggtttgcccattctttttcagtcgcagctttgcttttggtggggctagaagctctgtgaggtgtagcagtgcagtgcaggcctgtacatagctcgacctcgacgctcctcccgatcctgcatctgtgttgtgtctgaaaaaacaccgagttgaggctgctattatagccacaattcgatcccggcaggatggatggaaatggaacctgactttgatttgatgccccgacgctttgggataatcggatgtgacggggcaacagggttattataaatcttgcggtgataattcattaattcgatactgctgttggaaagatccgagattagaacagcgatgctgacacttgaaatgtgccttttttttactgttatac

SEQ ID NO: 13714 - DNA, 1905 bp, Zea mays
tcttttgcattatgttcgtgaacttgtcttattgtccatgcatagcatagatgtgatgaaacttaacgcaagttcttgctctttgtaagtcaaacttaccatgcaataagaaaccattgcatgcacattggctttttgcccaatttggattgcgaattcggtcaattagctcaatagggatgactgacctgttcttgcttgttttggtttatctgtttcagagccagaggtggctgctgtgggaactgtggctgccaaattagaggatgaaaccgatcaagatgagactgcctgtttccaggaagctgatcaattcaaggatgccgagctcgaggtctccaatctgctggacaaggacaccccgatgcttccttgcttcctcccctcgccctcagaagccattggcaccgatggaagcagcacaacctgcggcgcgggcggcagcgtttccaattccatcgtgccatctacaaccaccaacaccttcgccggtctgttcgcgtccgccacaacgagcaccacttcccagagcagatctctgcgcgacctcatcggtgtggatcccaccttcctttgccttgcgatcggggcgccctctctgttcccgcagacaagcgcaagcaactcaggcaccttcgctccgcccccggcgccacacatgtccgcgacagcgctcctgcagaaggcaacagaggctggagcgacgcaatcgagctcatcgttcttgaaggagtttgggctcgcctcctcgtcatcatcgcctcgaccaaagcagcagcaaccccatggaagggtcgctgaaaccagcacggacccatggcagtaccggagcagtaatcagcaaatggagatggagcgccaccagagccatcaacggagggagatggagtccagttcgcaaccatggcagcacccccgtagtacccagcagatggagatggagcgccaccaccagcggagtcatcaacagagggagatggagtccagttcgcaaccgtggcagcacccccgcagtacccagcagatggagatgatggagcgccagcaccagcggaaccatcggcaaagggagacggagtccagctcgcaacaatggcaccaccaccaccaccaccaccaccacccgaatgaccagatgatggggctggagagctaccggagtaatcagcaaaggcagacggagtccagttcgcagcggtggccgcagcacaggagctaccagcaaatggagattgatccgagttcgcagcaacggtgggcgcagcaccagaggagcaaccagcagcagcagcagatggagatgatggagcggcaccacctgagtaaccagcaaatccggagtacccagcaaatggagaggagggcgatggtatccgggggtggtctgggacttggcctcgcatacgaaagtggaaacccaggcttgcccttgcccgacctgatgacgggaccatcgccactgttgggtcctaagcctgcgacgctggacttccttgggctcggcatcggaggagggaccatgggcggctccacggccagccgcggcctcccggcattgatggttggaagagagctggacatggggccttcggcacaggtgcctcctgctgctgctgcggcgccgtgggaggacgcaaagaggaagaccaacggccgcacgatcctgtgactgtgaggttttctccccccctttcttctctctctgtaatgcctcggcttgcctgcccattctttcagtcgcagctgtgcttttggtggagctagtagaagaagctcggtcggtaacatgcggacctgtacatagctagctcgatgcatctcatcccggttctggaaaaaaaaaaactccgcccccgaattgaagctgttattattatagccccaattcgatcccggcaggatggg

SEQ ID NO: 13715 - DNA, 2445 bp, Zea mays
ctcggtgctctcgagtctcgagagtcgagactcaggggacctgatttcctcgtccggccatggcgaccggtggcaagtccgctgcccctcagccacctcccgccgcgtcctcctcctccgaacgcgcgctggagtcagtccacttctcttccggaaaccctcgcatcgaggagacccgcggcgtcgtcgtcctccaccccgacccgcccgcggccgcctcctggtctcatgtcccgttggggagtaagccgcgggtgtgcgtgctcgccgtgcccaaccacatgacctacgccgacttctgccgtttctgcggcgccttcgtccctcacacactcgagatgcgcatcgtcagaactgatggagcagaggaccagtacagcgttcttataaattttgacactcagagctccacagacagcttctataagcacttcaacgggaagcagttctcttcgctggaggggggtgtctgccatgtccgttttgtggaagaggtgcactacactgaattgattgagcatgcacatacctcagttacaaacttggctgagcaacctacatgcccagtatgtcttgaacgacttgaccaagatcctggaggtattctcacaacaatctgcaaccattctttccactgctcgtgcatatcaaaatggacagactcctcatgcccggtctgtagatattgtcagcagcaaccagagaaatccatgtgttctatttgcggaacttcggagaatctttggatatgtctaatctgtggccatgttggctgtggaaggtacaagggtggacatgctattgaacactggaaggaaactcaacattgttattcacttgagttagagacacaaaaagtgtgggactatgctggggacaactatgtacatcggcttattcagtcaaaaacagatggaaagctagttgagtacaatttccatggtgatcacacagcagagagcacgtgttcactatgcagtggtgatgccgcaatggatgaagctctactgaacagtaaatttgaagctattgttgaagagtacaatgatctcgtcacatttcaacttgaaaagcaaagaaattactatgagtcacttctactagaagtcaaggaggaaactgagaaagaaatttctgctgctactgagaaagccatgagcacaaaactccaaaagttggaagtaaagtttgacaagtgtatggaagagaaaaaatttcttgatgaagtaaatggcaatcttgtcaagaatcaggagatgtggattgaaactatacgaaaagcacaagcaagggagcaagctgcgctcagattaaaagatgagaagatcgaaaaacttcaggaagagctaagaggtttgatagcccatttcgactgccaaagtgacactgcacaagcttcaaatgcgatctcgagcgatataccagggggcatgattcttccggtagcatcagaatcgtcctcgagcggcggcgttgttggtggcactggaaacggggagcaaaattgagtaaactgcgccctgtataaagcacgtttggatcttagggacctaggtatattcttgcttccaaacccccaccgttgtatgttcagttagggtaatacacacttgttagctgtcacctcactgcccctcgattctactgtcactagccgctagtagtgtggtactagggatgaaaacgatttcatttttttttggtttttcgaaattcgtttccgatttttcgaccgtatttaatggttatggtatttttcgaaaacataattggtcatcgaaattttatatcgaaattggattaatgttttattgatcgttttcttcgtttatcaaatttaaatcttggaattttaaaaaaattaaataaacttggaaatttttttgtctcaagttaaattatattatatgctaaacgatatcccaataaaaattaatattaattatgaacttttttgattaagacgagattgttaaatttattgtaaaaaagtcaaatgaattataaattggaacagagagtatttgtgaactttgaatctgtgaacttgtgatctttataaatttgttatattgtgaacttatattatgaacatgtgatctttatgaacttgttatattatgaattgtaaatgtgatctttgttgtattgtgaacttttatattaagatatttttatattgatatgtttactgatcgtatattagatttcgatcgttactggtatatttttcgtatcgaactttcatttccgatattttcaaaataccgatatcgttttgtttccatgattaccatttcaatttcatttaaaaatatgaaaatggaaatggttttagtgtttactggctgttttcatcccagtgtcgctatagcgttttggataggttactgctaagatattgtatattttgtcgctattgttgctatgattgttttttcgggt

SEQ ID NO: 13716 - DNA, 1671 bp, Zea mays
cattgggtacctcgaggccggccgggaaaccttcataccgcgattcctcaatccccggcatcgcgcaaaaccctagcccagccccaccgccacatacccgcccctctcgccgctgccgacatggcaggcccatccggcgccgcggcctcctcctccacttctcgtggcgtgccggagaaccggttctacaaccctcctcacgtacgtcgacagcagcagcaggagcaacagcggttgcggtccgcgtccccgtccccgtcaccgtcgccgtcgccgcggtcggcacggcagaagcccccgccgccgccgggggccctggcctcggcggcggatgtggacagtcgggtggattctgacgactcctcgtcgacgacctcgtccaagccgtcggtggcgtccacggcggcggggaatttggagaggtttctcacctccacgacgccttccgtgaccgcgcagtacttgcccaagacaagcctaaggatgcggcggggtggtgattctatggattcacggccttatttcgttctgggagatctttgggaatctttcagggaatggagtgcttacggggctggtgttccactggtgctaaatggcagtgactctgtgattcagtattatgtgccatatctttctgctatccaactatttgcagatccatcgagacctgcttcaagaaacaggcgtcctggggatgaaagtgatggggactctatggatactagcagtgagagcagcattgagaatgacgttgagcggctaagagtctcatcatcactggaaggtacacatcgactggaaaatggtggcatacgaagtgatgatggtgaaggtgatgcatcttcaagctttccaatatttcagtatatggagagggatcctccatatggtagagagcctctgacagacaaggctatcaactcttgcacacagatttccagctctgaagacattcaaaagctgtgatcttctgccatcgagctggatgtctgctcccgctggctgccggttgcaggtaccccatatatagaattccaacagggccaacattgaaggatctcgatgcctgttttttgacattccattgcctagcaacaccttgcaaggattgtgaccctcctacgccagcatgccctggctttgggggaattaaccgcggcacgactgcagctgggaaactatctttgccaatctttgggctggcaccttacaaattacgtgcctccatttggacatctgacaaaacccaagaacgggaccgcgtcacctctctgatgcaggaggctgacagctggctccgcagaatacaagtagaccatccggatttccggtttttcgtctcccatttcagtacaacgtggagatgacccgtggctgtaaatggttcatttagtatgaatatggcatagagacacctgagtggccttttgtaacgggggaatgtatgagttataagcctgcgtgcataactttttctcatgtctccagtaagctgtatcttttgtaggtttgttttgttgtggggtgaaagtaaagatggatggtggaaaaagcaaaattggaggcattgtagaactgaagtgaaatatggggaaaaaagaataaagatttccagttattagagttgacaaaaaaaaaaaaaaaaaaaactcgagggggggcccggta

SEQ ID NO: 13717 - DNA, 894 bp, Zea mays
gccggccggttcgggaatcacgctttgatcgcttcttttttctctccatcatttctccccgtttcgtctcgcttcttttctgtcgcctcccctttcggctcctcgaggccggcctttctgctgaaggaaaccatattgtttgctggatctttcaaaaagggaaaccgaattcccgagagcgagcagcagggaatctctgctgaatccgtaggctccgaattggagctggaagtgtagtgatttcctgattggggacataaggcggggtttgtccctactccccagtgagctccacgcggtccctgctcttcttccagtcaaaattctgtacccttcggtgctgggatcaaggaactaggcgtgttgtcttgaactcttgattcctgcttcatggaaattgtatatgtttttctctgaattcaaaatcttccctattctcccaaagctttctgagtgcaggaagaaggatattgtccctctccaaaactataaacatgggttggttgagtaaaatatttaaaggtccagtaaatagagtttcaagaggacactacaacgggaactcccatgaaggctattcaactcagcacactaaatcatatggtgtgcatggcaatgaggacgaagacatggatcatgctattgcattatccttatcagaggaagatcaaaggaagggaaaggccattgataccgggcatcatttagatgaagatgaacagattgcacaggctctgcaagaaaatattggtcataacctagctgaagatgaacagcttgcacgggctctgcaagaaagtatgaatgatggacctcctcgtcagcacattccagttgaagatgttaactcaggaagtactccagcaagcatcttgccctcaaatattttcgcac

SEQ ID NO: 13718 - DNA, 2219 bp, Zea mays
ctttctgctgaaggaaaccatattgtttgctggatctttaaaaaggggaaccgaattcccgagagcgagcagcagggaatctctgctgaatccgtaggctccgaattggagctggaagtgtagtgatttcctgattggggacataaggcggggtttgtccctactccccagtgagctccacgcggtccctgctcttcttccagtcaaaattctgtacccttcggtgctgggatcaaggaactaggcgtgttgtcttgaactcttgattcctgcttcatggaaattgtatatgtttttctctgaattcaaaatcttccctattctcccaaagctttctgagtgcaggaagaagggcggcggcccgctcctccactgtgaacatgggttggttgtgtccaatatttaatggtccagtaaatagagtttcaagaggacactacaacgggaactcccatgaaggctattcaactcagcacactaaatcatatggtgtgcatggcaatgaggacgaagacatggatcatgctattgcattatccttatcagaggaagatcaaaggaagggaaaggccattgataccgggcatcatttagatgaagatgaacagattgcacaggctctgcaagaaaatattggtcataacctagctgaagatgaacagcttgcacgggctctgcaagaaagtatgaatgatggacctcctcgtcagcacattccagttgaagatgttaactcagaaagtactccagcaagcatcttgccctcaaatattttccgcacaagtggcttgagggtttgtgctggatgcagaagtccaattggccgcggtcggtttctcagttgtatggactctgtttggcatcccgagtgcttcaggtgttatgcttgtgatagaccaatatcagagtatgagtttgctgttcatgaaaaccatgcctaccacaggccctgctacaaggagcgtttccatcctaaatgtgatgtttgcagtagctttattcccacagataaaaatggcctcattgaataccgggcccatcctttctggatgcagaagtattgtccttcccctgaaaatgatggtacacctaggtgctgcagttgtgaacgaatggagccaaaggacagtcaatacataacattagatgatggccggagactctgcttggagtgtctgcatactgctattatggagaccaatgaatgccagccactgtacattgatattcaagaattttatgagggtatgaacatgaaagtagagcaacaagttcccttgcttttggttgagcgacaagctttaaatgaagccatggaagcagagaaatctgtgcaccaccttcctgaaacaagaggcctctgcctatctgaggagcagattgtcagaactatattgaaaggaccaattggaccaggcaacagaatcatagatatggtcacaggaccatacaaactcattagacggtgtgaagtgactgcaattcttatactgtacgggctgccaaggctgctaactggctcgattctggctcatgagatgatgcatgcttacctccgacttaaaggataccgaaccctgagtccagaggttgaagaaggcatctgtcaggttctagctcatctttggcttgagtcagaaatcacatcaggttctggtagcatgtcaaccacctcagatgcgtcatcgtcatcttcaacatcttcatcatcgaaaaagggcgcaaagacggaatttgaaaaaagacttggggagttcttcaagtaccaaattgaaacagattcttctgtcgcttatggagatgggtttcgagcaggcatgcgagccattgagcggtacggcttgagaagcacccttgatcatatcaagatgacggggtcttttccatgctgaagctggttttttttacctcggtttggatatgggtatacatattttttttggagaacttttggttcaggttatacatacgaaaagccgaacttctgtgtcgagaagaggcataaggatttagctatactgtccattgcaggaaaaaactgtttcccttttcaattataaaatttcacagtgcagacatgaaggtatgtggtctttagcttggccaaccttgtggaatgctgtcacagtgtcacttgatgcaaaagaaaattcgaatacatatgctttgctgtgcttgaaatgcaatggttggatgctatgctcttctttattgcgttc

SEQ ID NO: 13719 - DNA, 2764 bp, Zea mays
attgggtacctcgaggccggccgggacgaagctgcgaaatataaactttgcgcacctccaggccacagcccagtaggtggaccattctgtcgtgctcacccaatgccaatggagtcggttgcggtcgtggcggtgccgttcccggcgcagggccacctgaacgcgctgctgcacctgtcgctgcagctggcggcgcgcggggtacccgtacactacgcggcgcccatggagcacgtccgccaggcccggtcgcgcgttcaaggctggggcgacgacaccctctgccgcgtacacttccacgagctctccgtctccgcgtacgcctccccgccgccagaccctgccgccgaatcggccttcccctcgcacctcgtgcccatgtgggaggccttcaccaccgacgcgcccgccccgctcgcggcgctcctcggcgggatctccgcctcctgccgccgcttcgtcgtcctgtacgacatcgccaacgggttcgccgccgaagaggccgcgcggctgcccaacggcgaggggttcgggctggtgtgcaccgcggtgtcgtgcatcgtcgggcggacggacgccggcagccggctcgtgcgtgagcgcgggctcgacttcttccccgtcaactcctttgtgacggaggagtttctggctaccgtcggcaagcgggcgagatgggcgcagtccataccgtgcagcgtcggcatcctcgccaacacctgccgcgcgctcgagggtgagttcatcgatattttcgcgcagcagcttgccgccgccggcaagaacctctttgtcgtcggccccttgaacccactactgctgccggacgcgaggtcgcccaagcatggaattagcaaggagcgccacgagtgcctggactggctcgacctgcagccgccggcatcggtggtctacgtgtcgttgggttctacgtcgtcgctgcgagacgagcaagtcgaggagctcgcatctgcgctgcgcgacagcaagcagcggttcatctgggtgctgcgcgacgccgaccgggccaacatattcgcggaccacggcgagagcccccggcacgccaagttcctgcccgagttcgctgaacacacccaggacagggggctggtgatcaccgggtgggcgccgcagctggagatcctggcgcacggcgccacggcggcgttcctgagccactgcggctggaactcgatcatggagagcatgggacacgggaagcccatcctcgcctggcccatgcactccgaccagccatgggacgctgagctcgtatgcaagcaccacaaggcgggcatcctgatccgcccgatggagaagcaaagggaggtgatttcggcagcggccatacaggaggcaatcgagaagatgatggtctctgatgaaggctacaagatccaacagcgcgcaatggcgctgggccaagctatccgtgcgtcagcagcagtaggcggtgggtcagagaacaaggacctggataagttcattgcccacatctcaaggtgatttggggatttctggttggtttgggaaatgtcaagcatatttcaacaaaaaaaaaaaaaaaaatttcagtgtgatctgtaatgttctcaatttaagaaccggagattcaactttagagttggaaatcatctcattgcccatacattcgttttaggcatttatcggagtgagaatggacatcaatttgctcgacaccccggaaaacacacatgggccagttcacaagcaaccacagcgctggatctggcaatcccaatcaactgtttcctttcaccatttaagaaccggaaaaatcagttagcgccatcaaatttgtactcaagtcttaggactagtttggtaaggatcacgagagtatccataggtaaggaatctccttgttcctctgatctcttatcaccaaatcagcttttaccgactagacattaacggaagcagttcagtgtggctctagacaaatgcttgcatctgaatataacaagacaaacgttgtaagatgaccgtctttcaaaaatcattgtttaacaaaggtcgtcttagacgttagtattcgtaaatcaatgttttgaggtcacttaagacgtttgcctctgttaatcaattaatgttttgttaatcaattatttttagaggttgtcattttaagcgtctcttccctaaaattgttttataaagacacaaatggctcctttaaaaaaggatctatatttttcacatcaacttggacgaagataaactttctatcaaaaaattatagtccacaaaaggatctataattttgttgttcaattatttgaattgaaactgttattgtcctaaaatattgtaagttcatagattttaaaatttaaaatttcaaacaatctcgagcgatgatatgttccatttgaaagttatagtttcaataagatctacaactttgtagttgataagttttttatttaaaatcatttagtgtcataaatatgcattctaagggggtgtttgggagtgctccagcttcagaaaattcagtggagttgatcgagtaggatagtaagtgctccagaaaatcgtggtgttaaagttgtgaatattagaagacatttagataagtcattttatttattatttaggttacatataaagctatctaaatttatattataaactacagctccacataggaatttgttattccttgttctcgaatactatacatcaagaacaaagcaacacaattgttaataatgagggaccttcgtccttcgaagca

SEQ ID NO: 13720 - DNA, 2662 bp, Zea mays
tcacttgcatctaggcttctagctgtactcctcggccggtcggtcccacccatggacagtgacaatgattgcggctccgacgccggcgccgagtgggtctgggtacgccgtccgtcggaggttgaggccgctgccgcggcggccggatggcgggcctccccgcggtggcggccgctcaaggtggtcttcggctccccggctaagtacttcaccgacgcagcgccgatcgggaacggccgcctaggcgccatggtctggggctgcgtcgaatctgagaggctccagcttaaccatgacactctatggacaggtggacctggtaattatacaaatcccaatgcacctgctgttctttctaaagtaaggagccttgttgagaacggaaagtaccctgaagccacatctgctgcatatgatctatctggtgaccaaacacaggtctttcaacctcttggggatattgatctggtctttggtgaggacatcaagtacacaaattacagacgagagctagatcttcacactgcaacagtcaccgtcacatatactgttggggatatagtctacacaagggaacatttctcctcaaacccacatcaagtcattgtgactaagatctctgcaaataaaccaggaaatgtctctttcacagtgtctttaactagtccactagaccacaagattcgtgtaacacatgcaaatgaaataatcatggagggtagctgtccaggccaaaggcctgaagagatcaagactgctgctgatcaacctattggaattaaattttctgcgattctttatctgcagataaatggtgccaatagcacagtggaagtattgaatgataacatgctgaaacttgattgtgccgactctgttgttttacttcttgcagccaccacttcatttcaaagtgcattcatcaaaccttcagaatctaaactggatccaacagtgtctgcttttacgacattaagtattgctaggagaacgtcatattcacaactaaaagcctaccacattgatgattaccagactcttttccagcgtgtttccttgcaactatcacaaggctctaattatgatcttcggaggagtaggctagttcagtcagcagagactagttctcagggtgctaatgtatcggattatggttttcaaatatctggctgcaccagattgacatcccttaatagttttgtgaagcctacggtagaaagaattgtaactttcaaagacaatgaagacccttctcttgtggaacttctgtttcagtttggtcgttatctactcatttcgtgctcaaggcctggaacccaaatttccaatctacaagggatatggagcaatgacacttcaccaccatgggatgcagcaccccatccaaatataaatctacaaatgaattattggcctgcgcttccttgtaatcttagcgagtgccaagaaccactgtttgactttattggttccctctcaatcaatggagctaagactgcaaaagtgaattatgaggctagtggttgggtcagtcatcaagtcacagacttatgggcaaaaacatcaccagatgctggtgatcctgtatgggctctatggccaatgggtgggccttggcttgcaactcatctctgggagcattactgttttactttggacaaacattttttagagaaaacagcgtatccactattggaaggatcagctaggtttttgttggattggttaattgaaggacacaggggatatttggagaccaatccttctacatctccagaacattattttattgctccagatggtaaggaggcctgtgtgagctactcaacaactatggacatctcaattataagggaagttttctcagctcttatattgtctgctgacattttaagtaaatccgacactaatgtggtgcagagaataaaaaaagcactgccaaatctcccaccaatgaaagttgctagagatggcacaatcatggagtgggcacaagactttcaggatcctgagattcatcacagacatgtgtctcacttgtttggtctttatcctggacatactatgtcacttgaggaaacacctgacctctgcagagctgttgccaatagtctttataaaagaggttcccagctgcgttgtcggaaatgctggtacagagcactgggaccgacttgtaccttctccctgctctgccccgcaacaagtggcctcaaggctacgttaaaggtctgaaggcccgaggtggtgttactgtaaacatcagctggaaggaagggagcctccatgaagctctgctatggtctagcggcgggcagaataccctttcaaggctgcactacggggaccagattgccaccgtcagcctatcatcgggtcaagtttacaggttcagcatggatttgaagtgcttgaagacttggcccctgtgatagcacacatttgctgaaatgaaagatacgattgattgtgcaaaaattcatgaaaacttctggctggcaagaaaataatcgatttcatacatcaatcataacacgtatcatatttcttatttactgtgtatgtttagttacatttcactgtatacatgtttactcgttgcccgtgccaagtgctatacagtgcacgactgcatgtgcattctgtaaaaaaaaaaaaaaaa

SEQ ID NO: 13721 - DNA, 2322 bp, Zea mays
  misc_feature (1)..(26): n is a, c, g, or t
  misc_feature (38)..(38): n is a, c, g, or t
  misc_feature (53)..(53): n is a, c, g, or t
  misc_feature (59)..(59): n is a, c, g, or t
  misc_feature (79)..(79): n is a, c, g, or t
  misc_feature (85)..(85): n is a, c, g, or t
  misc_feature (106)..(106): n is a, c, g, or t
  misc_feature (115)..(115): n is a, c, g, or t
  misc_feature (118)..(118): n is a, c, g, or t
  misc_feature (132)..(132): n is a, c, g, or t
  misc_feature (147)..(147): n is a, c, g, or t
  misc_feature (159)..(160): n is a, c, g, or t
  misc_feature (178)..(178): n is a, c, g, or t
  misc_feature (200)..(201): n is a, c, g, or t
  misc_feature (205)..(205): n is a, c, g, or t
  misc_feature (207)..(207): n is a, c, g, or t
  misc_feature (212)..(212): n is a, c, g, or t
  misc_feature (217)..(218): n is a, c, g, or t
  misc_feature (225)..(225): n is a, c, g, or t
  misc_feature (233)..(233): n is a, c, g, or t
  misc_feature (243)..(243): n is a, c, g, or t
  misc_feature (245)..(245): n is a, c, g, or t
nnnnnnnnnnnnnnnnnnnnnnnnnncccccccccccnccccccccccccccncccccncccccccccccccccccccncccccnccccccccccccccccccccnccccccccnccncccccccccccccnccccccccccccccncccccccccccnncccccccccccccccccncccccccccccccccccccccnncccncncaaancgcgnnccccccnccgcgggngcgcgctctntnccttttccgagcccccccgggctgcagggagagaccgctcactagtcccccccccccccccccgacttatgggcaaaaacatcaccagatgctggtgatcctgtatgggctctatggccaatgggtgggccttggcttgcaactcatctctgggagcattactgttttactttggacaaagtgagccgcactagaacaaaatatagtaatatacattacttatttactttcgtgtatcaaactaaaatgagaaaattgtttttccatagttagatattaaaagagacaaagagtagtttcatggtcatttttattttgcgacctcttgatgacacttccattcttctgggcaatatcttgtgctactattagttgagtctcatctgctgtcatcctgggatggcatgctctctatttggtcaaggtacttgtcttttcaacactaaaagcacaatacaatgaacactagaaagggtgttaggaattgagaatcatctgaactacatgtgttagatgtagcatctagcaccagaaagatgtatgttttcatgtgtgccaacttgttatgtcaatagtgtgctgaagatgctcaatgattcacatgctgcacttcagtgatatcctaaaaactgcactagtgtcatttactaatacacaagctttactgattgtaatatatggatagtttattttgattacatggtgaagtttcggtgttaatgcccttgactaggagggaacgcatgtcgatagctttgaactgactgttttcttttaacaaattgcatgctcacattccctgaatattttaaaatttacataaaattgaacaagatcagatgcgagttattccactttcgttgcagcattttttagagaaaacagcgtatccactattggaaggatcagctaggtttttgttggattggttaattgaaggacacaggggatatttggagaccaatccttctacatctccagaacattattttattgctccagatggtaaggaggcctgtgtgagctactcaacaactatggacatctcaattataagggaagttttctcagctcttatattgtctgctgacattttaggtaaatccgacactaatgtggtgcagagaataaaaaaagcactgccaaatctcccaccaatgaaagttgctagagatggcacaatcatggagtgggcacaagactttcaggatcctgagattcatcacagacatgtgtctcacttgtttggtctttatcctggacatactatgtcacttgaggaaacacctgacctctgcagagctgttgccaatagtctttataaaagaggtgacgaaggcccaggctggtctacttcatggaaaatggtcctatgggctcgccttcacaacagtgaccatgcatacaaaatgatactgcagctaatcactttggtggatccagaacatgaggtttcaagagaaggaggcctatacagcaatctgttcactgcacatccacctttccaaattgatgcaaattttgggttcccagctgcgttgtcggaaatgctggtacagagcactgggaccgacttgtaccttctccctgctctgccccgcaacaagtggcctcaaggctacgttaaaggtctgaaggcccgaggtggtgttactgtaaacatcagctggaaggaagggagcctccatgaagctctgctatggtctagcggcgggcagaataccctttcaaggctgcactacggggaccagattgccaccgtcagcctatcatcgggtcaagtttacaggttcagcatggatttgaagtgcttgaagacttggcccctgtgatagcacacatttgctgaaatgaaagatacgattgattgtgcaaaaattcatgaaaacttctggctggcaagaaaataatcgatttcatacatcaatcataacacgtatcatatttcttatttactgtgtatgtttagttacatttcactgtatacatgtttactcgttgcccgtgccaagtgctatacagtgcacgactgcaaaaaaaaaaaaaaaaactcgagggggggcccggtacgcaatcg

SEQ ID NO: 13722 - DNA, 5072 bp, Zea mays
gacggcgtgattcaatcgaaggcatgtgcaggcttcgttcgccagcgcgactggtgctcaactttggcatgaacttgctggcggcgcagaaacaaataggcacatccaagattcaaaacagttttagcttcctatatatcaggaactgttggagattgatcttttttactcttaaagcaaatttagcagcttggtaaatgcttatttgaggagctattatttagacagggcgacgtacgtacgtacgtaggtactagctccctccacttcaaaaatgatgcgttcgtagaattttagatttcgttctaaaatatgctagagtgtattttttgaatctccaatgtatttatagatacttatatttttaatccatagtacgatctaattctagttattgttttttcccttcatttttttctactttctctatttttttcaagtggaattattatatcttagagcaaacggcttttttacaaagttatataatgacacggatcggatatgcacttgttctccccccccaccccctcttttgtggtggttcttgttcgggttgtggttgtggttcgggtccatcaacaataaccacatcatcttgactcggatttgcagatgtaccatttctattgctcctgcttacactctaaataaaatacctctcggctgttgaggatgtaccatttgcattgtcatatcatctctgatttaaatcctaccacatgctttgagctcttttgtcctagcggttgtatctaaacaatgttggcaaacaggccttagttagttcaatactttccgtgattcgaagattggagtttttggataagtccataagttctgcttaggaccacaaattttgatactagtaaatttatcgactacaaatatttttttttgtgaatttcatgttattcctattcgcccttccacttggcattttgtttctttcaataatatgcaagggcaagcttcacttggatgttatacggatggaagggtttgttgtctaaacgacaaaaagtagctcttcaatgcccccgaaaccattctcaattgtcacgcgcaaatgaagactgcctcaagttggtacaactctcatgcattctaggatagttaagactatctccaacacaattcctatccgactctctatcttactcaatattttaaactctactttaaaaacagtgcaaaacagtactttgtacggctatttacacagcctgctggagatcgtactatcttcggtaggtcgtgtaaatggtcatgttttctactgtagatttatactgtttgtttatagagtgtagtttgaaataaagagtgtgatatgaaatctgatagtctaagatatgtgctacgctcgttcctgatctcctgtgtcctgtggtggcctgtgtgggctgtgggtaacggttctagctatcgtttgagaatcgtttcgggcgggttacaggctatacacggcgggcagccagccagctagcgcgatccacagaatttgaaaagattcgggcctgggcactgcctgtcaagagcatcgtggcactgtctgtccaaattgcgagtggacggctggagtgacggcaccacagtgaccccggcatgccatatcgatcgagaactcagatccctgctacctctctctctctctactactacgccagatgccagccagggtgccgacatgcgagttccaggacagaagaagagtatgattacagtgcagaagcgtcgccgtctcctaataaagcggcgacgtttaatcggtcatcatcatcagcattcagcgctctgacttgtcaagctccacgtcgtgcactgtcacgctcacgccgagaactccagaagagagagagaagaatgccacacggacacggctggtaaaagacagccggagaacgcgtccgtcagacaggccgcagaaacacgcataccatgggcacacgcgacagatctcgcagaagatgcatctgagagctggcggtgatgaatgcgatctctccctccccatttatgccccctctcctgtttcccggccggcggaggagaagagttgagatcggtgtcggccctctcgatcccctgtttctgcaaagggggagcggcgacctgatgatgagatgcagatgaaggcgcaagagagaccgagaccgaggtgcgtagacatatccacaaatgtctcgccgtcgttcccgaacacccaataccgacaggcagcagcagcacgtgcaacaaggatccactccactggcactggcactgggccgcatccgcatgccaccgtggcttcattaaccgatcaataataataaaccgatcgaatcagatcgggcactggacagttcttctctccagtctttctatactggagattacattaaggaatgggctctgctaacgtttggctgcagagttctgttacttagtttggcccacttgttgctgataaaaccagctagctagaaatttacatacatacagctgagctgacccccttttttttatatgtggttgttgagacgacgaccagcaatcatatatgccatgccaagtggttcagctctcgggacgacgtgcggctattcattcgttgcagtggccatttcggcatcaggttggattgagatagacagaccacacagcacacacgcgaggacagatatcgagccatggcatggaagaaaacaagtgcacgagacgtggagacgtcaagcaattatggcccagttcctcgacctgtctgtcctctagcctcaacagccagagccaacctgcatgctgaaacgattggtacgttgatgatgatgatacggagaacaagagtaattagctgcgtcaagagatcaggcagcccatgctatatttgactagcattgggtggggggccgcgtggaggttcttataggttttcctctttggattaaagtatactactactaaacaggggagcggccaccctagctactactactagccaataatagctgcgcacagtcataagatatgggcaagttcagaaggaaggaaaaaaaacacacaaaacaaaacaaaaactgatggtcagtgatagtagctcctccaagcatacctccttacagctcagtctacatacagcttagaacctagttcctcctctcccacatggccaagtgaaatcgcacgcgcccctcctcctctcagctcaggttctcacactataaatatgcactccccctgcgcaccacacacaccaccacaagcctaatacagctcaacacttgctaaaactagagagagagagagagccagacagacagacacagagagatagagtccatggtgacactagcaggaaaaggagcgagaaccagcagagggatggtgtcactgaggagaaggcggccgttccagctcatggtgctgaggcggctgcgggagctgaagaagatcgtgccagcgggcgctcgccgccggaaggcagacgtcgacgtggtgctccggcggaccgccgagtacatctgcgcgctggagctgaaggtggcactcctccggaggctctctcacatgtacggtgtgtagcctgtgccgccggtcacccacgccattgcctgccaccaccccaccaaagtagtagcccctatatatgcgattggttattggtcacatatggtcatatggacgtgcgtgtgtgtgtgtgtctagctagtagttaagatctggctgggaagaaagccagcccccggcccgttgctccagctctgagtgcaagagagagagagagagatgctttcgctgctggtggctgtgtcaataggctggaactggaagtaagaacgcatttcatttgttttcaaaaaaaaaaaaaaaaacgcgtgcgtggtatggtcgtctatttttgtttttgttttttgcctagctcttcagctccttgttgttattattgcttatcatcgatcgcctataagactatatgcactacagacacatgaagtaaaccacacacattcatctagctagagcaaacaaagtactaattaaaacacatcgtcgtgtgataatgatcatacagggtcatttggacgtacgtgtatgggggacatctgtcgtattattatgataatggtcactgctgagtgctgaacactgattgaactctctactcattagaacgacgtggactcgtgtgtacctagctacctaccaatcagacactccataaaaaaacaataataaagacaatggcaaaaaaatattcgacggacaataatcctccgctcaggatggaagtagtaggatgattctcacactgcatgcagggaccttgcagattctgctgcgttagcgggtcggacaagatcgaacacaagaggaaatactattctacatgcggaattattatcagtttttaagtctatttcttgtttctgtcaagtccatttcttcaggttatacgtggtcgtagatagacagacaggcggcaattgttgatatcgcgggatctgatctgatcctttttaccggaggagaattgagaatatatatatttgctagctagcacgtcacatcaactggtgatctacaatcatcctacttgaaaaggatgctatgatgaagatgtagtacgtgcgtgcgggaggggatttaatccatgcgtcaatgtactgctgaccagatagatagatagatagatagcaggcagctaggataccagaggaagcgtccaagaagggcatgtgcacatgcgagactgctctctgtccttttgctccacatcattggagacccctgtctcccctcccaccctatccccagatttatctatcctcttggggtgaaacgaaaacacgcccaagtttaccgagcagggcagggagagctaacgcaacagtagtacactctccactgagcccaggcttcctgtcggggctctggagaaaaaaaaaaaagaacactgcaacacagcgcgtgccaagctgagggcgacagtaagattctgtattttacagcacagccatgtgggatattcccgcttggatcaggcggccagctatgagctactgccatgccatttcagctacagtctgcag

SEQ ID NO: 13723 - DNA, 2778 bp, Zea mays
gagctaacatcctagctcggttcattaacgagccagcttggtttgttaacgagccagctcgcaagctaaacgagttatcaacgaaactatatgcatatcatttacgtaacaactattgaacatgctatatgtaaatgtggtgtctatgacctataagttaaattaatgattactgaactgtgtctatgtgttaaattggtctatgcgaatataactgtggaataaacttacgaatacgtgtgtgaattgtgaattaatgagtgataagttgtgttaattcgttggtacattgatgtggtttgtgaaactatgagtataattactattttctattgttaaattaatttagaattaactagaacttgattattatatatatatatatatatttttttttttctactatgacttatgagctaaacgagtcagcttgagctcgtaaacgagtcaaattgagtcatctcattagtttaacgagacagcacgaattcagccgagccgagccgagccgagtcgagccaagtatccagccctcatgtcctgcgcacaggtgacggacagtccggcccaaggtcataaaccgttcgcgccgtcgcaataccgtcagacggtataccccacccagataggcaccaacaaacatattccatgttgattcatgtgtcgcgtctggtcgcttgtacattgtagtacgtgcttcaaaaaaaatttggtcgcttgcttcgacggcatgcatactaatcatgctttgaagcgaagtccttcctcagaccaaatcggaggccaaaccttaaagctagctctggcaggcatatcatccttctgcgacgggcccaagcaattaggaaaaaacatgtatatgttcgttcgttgtgtatatacacttgggcatcctccaggccggccgaaccaccaccatagatcgatccttgagttgacgaaaacatacacagctgctagctaatcctgccgtgagtgcaatgcatgcgaagatgacgaagcccgcagccatcgttgttgctgctatcgccgtcctctccgtcagcctgctggctgggtcgtcgtgccttgcccttgcgcggcccagcggcgacttctccatcgtgggctactcagaggaggacctgtcgtcgcacgagagcctggcggagctgttcgagcgctggctgtcccgccaccgcagggcgtacgccagcctggaggagaagctccggcggttccaggtgttcaaggacaacctgcaccacatcgacgagaccaaccgcaaggtgagcagctactggctgggcctcaacgagttcgccgacctcacgcacgacgagttcaaggccacctacctcggcctacggagcagtgttggcgatggtggtagtggtatcgatgacgacgacgagccggaggaggaggagggctacgagggtgtggacggggcgagcctccccaagtcggtggactggcggagcaagggcgcggtgacgggggtaaagaaccagggccagtgcggcagctgctgggccttctccacggtggccgccgtcgagggcatcaaccagatcgtcacgggcaacctcacggcgctgtcggagcaggagctcatcgactgcgacacggacggcaacaacggctgcaacggcggcctcatggactacgccttctcctacatcgcacacaacggcggcctccacacggaggaggcctacccgtacctcatggaggaaggcacctgccagcgcagcagcagcagcgagaagaagtggccgggatcgtcggaggacgccaacgacgatgccgcggtggtcaccatctccgggtacgaggacgtgccgaggaacaacgagcaggcgctgctcaaagcgctggcgcaacagcccgtcagcgtcgccatcgaggcctccggcaggaacttccagttctacagcggcggcgtcttcgatgggccctgcggcacgcagctggaccacggggtagcggccgtcggctacgggacggcggccaagggccatgactacatcatcgtcaagaactcgtgggggcccagctggggcgagaaggggtacatccgcatgaggaggggcaccggcaagcgccagggcctctgcggcatcaacaagatggcctcctacccaaccaagaactgaactcagatcatcgattcatcgtcaagcagcagctggctgattactcccactgctggcgctccacgcttcactagttcttcgtcgttctccttcacttccattgttttcaagattggacgatctttcgttgtttgaaatgaaataataatgatgatggaattagtgttccccaagttcgaacaaaaaaagtattgttggagttttcgttggaacaactgtagtctgtagtcagagtgagccccaaatcagggcagttgcttttgaacataacattgttaaatacttggcttaagtctttcaaaggagacatatgcccgatttgtttcagttttttttaaagcttccgaccacaaaaaaactgttggagactgtcaaacgtttagcttttcgactagcttctataaaaaatcaatttggtaaaaatcatccaaaatcaatatcaacacataatcgatttctcacgatatgtacaccttcatcttccagtccttgcaatagtaggaatccatcaatttctagatcttaaaccatatgtacaccttcatcttcctctacacgtaattctcacgatactcacttacaattagatttttcctcatagttatattcttacaaaagccggtcagaaaaaagctgaacc

SEQ ID NO: 13724 - DNA, 2005 bp, Zea mays
  misc_feature (352)..(352): n is a, c, g, or t
cgacacggtgtacagcgacgacgccgaggagcgcgaggacgccggcacgccggcgatcatacagaaagtccgcgcggcgctgtcgttccgcgtcaaggagtgggtcggggaggcgtgcatcgaggcgcaagaggcgcgcatgctggcgctggccctccgccgcgtccgcgcgggggccaaccccagcctgcgcctgctgcagggcgccgatgccgccgcgagcgcgccccgcctccccgtgctctccttcgtggtctacgctcctccgcgagacgggaccgagcccgagggcaggctgcagctgcactgccggttcgtcaccaagcttctcaacgacctgttcggcgtgcangcgcgcgcgggttgcgcgtgcgcggggccctacgcgcaccggctcctcggcatcagtccggcgcgcgccaaagccatcagatcagccgtcgaacaggtaaataaacccaacgataaacgtcgaatttctcattctgctcggatcatatttatattttcctgaagctcgcaaatgagttcggtatcgatggtaacgtacagggctaccacggggttctgcccgggtggacgcgcgtcagcctggcatactacacgtcgatgcaggaggccgagttcgtgctggacgccgttgccttcgtcgccagcttcggccaccggttcctgccgctgtacacgttcgactggaaaaccggagactggcactacgatcacagctgcgcccgtgggctcgtgccgaacatcgtcggcggcaatcccagtgggcgagtcaaagccgagaactgctaccagagctacatggcatttgcgcactgcctggcggagtccttggctaccacttgcactgggctcagcagcgatcctgctatacgtattcccaagagcgtcgacccacagttggtgtatttcctcgtatgagttgtcataggcggtgatactactccgttgtacggtgtaattggattggaatactggaggatactactccgttccgttttgacctgacttgaagagttcatgtgggccatggtcatgagtagcaggtgttgttgggctaccgatgtgggccatgagtagcagcaacacctgaccgcatcgctcctatgggccgtcccattcccaccgcccctcgtgaccagcttcctcaatcccgcctctggaatctggattctggaacagaaaagcaccacccggattatatgccgttaattacccactgtgccacgcgcaggcgcgttcggcgttcgggactcccttctgcacaacctgacaattgcatcggaagatggccaccagaagaaccagatccgcggccccagccatgctgctgctcctggtctgcgcgatggcggtctcggcggcctctgccgccgccggggcgggcaggggcagggtcggatcgggccgcgcggggccgtcgccgtgccaggatctggcgacgcgggacgactgcgcggcgagagctgggtgcaggtggtgccgcagcgaggcgctcgacgacatgtgcttcgggcctaccgaggcgaggcgcctcccacggcaggtcttctcctgcgatccaccctccgacgcggcgcacgccagcttcaacaagtgacgcccgcagccgcgctcgccttgttcccggactgctccgtctgacctttactttcgccaggcaccaattgttgctccttttgtcattgctggatctgagatttatttattagagaatagcttggtccgttttgctacgtgattctttcgtgggtttatataatataatgtaaaatctgctcaaaattcaatcagagcattgcaaatattgtatttaaaaaaatctaagtcgttttcgtcaaaaaaaaaaaaaaaagcctcgtcgtcgggcgtgtccgcgcaattttctgtgtggtcgttaataccgcaacttggcagtaacggcctgcttggtttgtggatgaattttgtaacgccaaaaatttggcatgttaaaagttaagcaaagaaaagttgtcat

SEQ ID NO: 13725 - DNA, 2158 bp, Zea mays
gcacgagaccattacctagaacatcctaatcgaaaaatctccgtctccctgtctcaccggtgccgcttcccctcacccgctcgatttactgcccaatccggcccgcttcgccccgccacgaattttaatcaaccgtttggagcttgaatttgaattccagctcgaatcacccacccggccagctgggagcgagagcgttccagctcgaatcacccagcccgccagccgggagcgagagcgagctgggtgagctcgattcgatgcgttgctgagcgtggctcaaccgattcaggtcgggcggtggcgcagtcagagggatctgaaccctagcgccgtccggatctgtgacccgcgctgctcggcgcgtcggcggcatgagtgcctggaaaacgtggcgaggaggagaagcggcggggatatgagcggagccagcggcagcggggacgacttcgggcgggcggtggcgcgtgccgcagtggcgcaggcgctggaggccgcggggttcgactgcgcgcaccgctccgcggtggacgcggtcgtcgacatcctcctgcgctacatcacgcacctgggtcggtccgccgccttccatgccaacctcgccggacgcgcgctcgccaacgagcttgacgtcatccaggcgctcgaggaggtcggcgccgacacggacggcttcgccggcgcggcggccacgggccactgcctcgtcagctccggcgtcgtcagggaccttatggcgttcgttgactccaaggacgaggtgccgttcgcgcgtccgctgcctaggttccccgtccagcgcgtgcagccgcagcccactgccagcttggcggtggcggggcgggagactgggatgaggcacgtgccggagtggttgcccgtgttcccggatccgcacacgtatgtgagtacggaggtgtgggttgagccaccggcgaccaaggacagggttgacaaggtggagcaggtgcggcaacggaggaaggctgagaagcccctgctcagcttgcagcaaaggctggctatggcaggtgcggatgggtttcgtccagtagctgctgtggcgcaggataacgcagagaaggggaaggagatacaggcagctgggacaaagagaaacccatttcttgagccagcattgccgcctggagagaagtatgtatctgaggttgatatgcctcctgaaaagaagaaaccctctgtccttgaggcatttgcgccagctatccaagctagaaccatcaaagagttcgatgctggggcagggttggatcaaaatcaaaggaacatcgttccaaaggagagggctcgggtgcatcttaagattggatttggaaagaagccatttgctgcagctctgaactcaagagccctggacctgagggaagatccttcattcctgaaagaggaagcaaaggatgacaagaagcggagagcaggcatgatattaagggcatcgatggagaacccacaagaacttcctcagctctaaagttatctatagaggaagtgcggtacccagagtggagttgcatcatggtgtaattgtggaacttcagcttcctgaatctagaggccatgcatgtctccgtgatacaatacaaccttcctcagaagcttaacctgcaacccggggtctcccccatccacctagcattttcctagaatcaccaggggctgacaagttctgcggcgccgtagctgaagtaccagcatctcaccgctctgagcttggttctggtggtgtttcaccttgtgagttggttggttcaaacggagctgatttgtgaagccgcggttctggtctccagagtccagacctggcgtccaaaagaatgatgctccctggtagaattggagatgtttgtacaaaagctaacctctagttgttagacagaattgatgtatctggtggattactatacgatggactcgtttatgacgattgattgattgattctgcctggtgacttcatgttatttgtgagtagttgtggtgctttgtagttggagactgggatcgtaataagagggtgcctttggtttgtgccctttcccggcatttaacttgagtaattattcgagactgaacttgtaaagattttattttgagtgaactgtgatgtgggtctttagacctttttttcccccttgaatt

SEQ ID NO: 13726 - DNA, 1314 bp, Zea mays
ggacccccgggccggcccggggcctactgtttcggactttcgggttttggccgacacccgacaatcttaacatcaaactcgtcgtccacgcctcctcggcaaggttgcgtacggcgtggccctaaggttcatctcgccgcctccctcaacctcttgattccgcctccctcaacctcttgattccgcctccctgaaggcataccagcgggatcaagctattttgctggccaaccgaacggtcaagccgacgatgacgctcggatcggcggcacacaagatcccgctggaggttgcgcacaccctcgtcgagatcgccgaggtcgcgcgctacgcctaccaccaccgccccggccgccctgcaacccacgagggggacccgactgcgccgcccgcaggggctgatagcagcgggggcaccaacgaggatgccgcgcggctgctggaggagaacgccatgctccgcgcccgactcgcagatgacctcgcgctcctgcgtgagctccacggcgcgccctgcgtctccaaggagtgccctcctgatctatacaaccgattgatggcggcggtcaacaatgttagcttccttgctcatctcgagaaattacaggatgagtcagcacgtcaacttaatgaactaacttctggcgacatgacagaggtggaagctgcagacattccggacaaagcgggtaacgggaagaaaggattgtgggtcttggtcccttgtgatacagctggagctaatttggaggaaattagtgggattgatgatgaaaattatgtcatagtaaatgaagacgatatagtcgatggtattgccgcctttgttgctaggtgcattcttgaagatccaaaatccaagtcgttatcgccaatgcagctccaaaaggctgttgcaaaggcattagatagcatgaaagctcgatggagatggtcaaccttttgggaggctggacagattatatatatcttggctacttggggcatcacattagcagggttgtacaagagccgccatgtcctgaaggtggcagcaaagggtgctgctgtgtctgccagatttgttatgaaggccatttgagtgtaagaggcactcatgtgggatcagcaatttgcaaaatgtaaatacaaaactcgtcccgtcagttgtgcatatggttgtggcatgtttatcatgatgaagttatgatcatccagacatgaaaaactgtttcatttattttcgttgtatggacggtggtgtgattgcagaaaaaaaaaagatacatatgtgattacttgtaaaaacaaaaaaaaaaaaaaaaaaggccccta

SEQ ID NO: 13727 - DNA, 1901 bp, Zea mays
cctcgaggccggccggcagaggcacagcgccacagacctccctcccagtggtcgattctttgcttgtagctagctgtaccagcctctctctctccgtctcttgtgttgaaggggagacagagaagggtaggcgacacgccatggaaccgacaaggctgctgcttcttctcctcgttctcggcgtgtcgctgcaaggatgcattgcgcagggcggcggcggcgccggagggctcacgcgggggagcttccccaagggattcgtcttcggcaccgcctcctccgcttaccagtacgagggagcggtgaaggaggacggcagagggaaaaccatctgggacaagttcgcgcacacgtttgggaaggttgcagacctgagtaacgccgatgtcgcggtcgatcagtaccaccggttcgaggaggatatacagctcatggcggacatggggatggacgcgtaccgcttttcgattgcctggtcgaggattctgcccaatggtaccggccaagtcaaccaggccggcgtcgaccactacaacaggtttatcgatgcactgctatcgaaagggattgagccatacgtgaccctgtaccactgggacctcccccaggccctggaagacaggtacaacggatggctggacaggcagatagtgtacgacttcgccgagtacgccgagacatgcttcgaggccttcggagaccgcgtgaggcactgggtcacgctcaacgagccgcacacggtcgccgtccagggctacgacgccgggctccaggcgccgggccgctgctccctgctgctccacctctactgcaggtcgggggactcggccaccgagccctacgtcgtcgcccacaacttcatcctggcacacgccaaggtctccgacgtgtacaggaaaaagtacaagctaggcggctcagaacggagagcttgggatagcggtcgacgtcaggtggttcgagccgatgacgaacactaccgccgacatcgaggctgccaagagagggcaggagttccagctcggatggtgagcctagctagctagctagctccctctcagttccaatttgttgttgttctgaaactgtaattaggttcgcggaccccttcttcttcggcgactacccggcgtcgatgaggtcgcgtgtcggcgacaggctgcccaggttcacggcgggcgaggccgcgctcgtcaagggggcgctcgacttcgtcggcataaaccactacaccacctactacaccaagcacaacagcacggacctcgtggcccgcctgctgcacaaacaccctgggcggacaccggaacccatcagcctcccgttcaggaacgggaaagccatcggtgacagggcccactccatctggctgtacatcgtgcccagcgggatgaggagcctgatgaactacgtcaaggaaaggtacaagagcccgccgatttacgtcaccgaaaacgggatggacgacggcaacagccccttcacctccatcaaggacgccctcaaggacagcttgtggggcgagtaccacaacgactacctcaccaacctggctgcctctataaaggatgacgcctgcgacgtgcgtggctacttcgcctggtcgctgctggacaactgggagtggacggccggctactcctccaggttcgggctttacttcgtcgactacaaggacaaccttaagagataccccaagagctcggtgcgatggttcaagaacctgctggcctctagctgaagcctcgatggatatatacagcattgtcatttctgtcttccttaatctttatggcctggccatctgaaaccatgtacgctgtggcgtccccttctggatgccttctcctttcatctatatagccacgatacaagttgcctggatgaaaactatcgaggcg

SEQ ID NO: 13728 - DNA, 2007 bp, Zea mays
ctactttttagcctggtcatttgtccaacctaaaacaatgggttggattcagacattcacgcccgcccgtccgccctcgcctccggttcagacttgccgtgactgttagagaccaatgcaggagtgtccgcttgtgattgcaggaagctgaacgcagtttttttttcatttccattttgtaggcaagatttcagacttcagcaacgcggaatgttgcagttgaccagtaccaccgtttcgaggaggacgtgcagctcatggcggacatgggaatggatgcgtatcgcttctctattgcctggtcaagaattctgccaaatggtacgggccaagtcaatcaggccggcatcgaccactacaacaaagtgatcaatgcactactatcaaaaggaattcagccatatgtaaccctgtaccactgggacctcccccaggccctggaagacaggtacaacggatggctggacaggcagatagttaatgactttgcggcttatgctgagacatgcttcaaggcgttcggagaccgtgtgaagcactggatcaccctcaacgagccgcacacggtcgccgtccaaggctacgatgctgggcttcatgcgccagggcgttgctcggtgctgctccatctatactgcaggacagggaactctggcactgagccctacatcgttgctcacaacttcatcctagctcatgccaccgtttcagacatgtacaggaggaaatacaaggcagctcagaatggtgagcttgggatcgcatttgacgtcatctggtacgaaccaatgacaaacagcacgatcgacattgaagctaccaagagggcgcaggagtttcagctaggatggttcgcggacccgttcttcttcggagactacccggcgacgatgcgggctcgggttggagagaggctgcccaagttcaccgcagacgaggctgcccttgtcaagggggccctggacttcatgggcataaaccactacaccactttctacacgaggcataacgccaccaacatcatcggacggctgctgaacgacaccttggcggacaccggaaccatcagcctgcgtgagtcctcgtcgtgtgtgtttgcaagttcatttcaactgaaaaaacagaaacctggaaggcggctaaccttgaaggctgctactgagccttcaaactgacaacacgtgccaagcttcctatctgtctgtccaaaaaaacttctagcgacacttgaaatttgaaaccgtgggtagctgatacttcgcaatttcacagccttcgacaagaacgggaagcccattggagatcgggctaattcgatatggctgtacatcgtacccagcgggatcaggaagctgatgaactatgtcaaggagcggtacaatagcccaacggtttacatcactgaaaatgggatggacgacggcaacagccctttcacctccctccagaacgccctcaaggacagcaagaggatcaagtaccacaacggctacctcaacaacgttgctgcctccataaaggaggacgggtgtgacgtgcgtgggtacttcgcgtggtcgttgctggacaactgggaatgggccgccgggtacacctccagattcgggctctacttcgtggactacaaggataacctcaagaggcaccccaagaactcggtccagtggttcaagaccctgctgagctccagctgaaggcgtcacacgggctgtgattggactgaccatttacccgacaccatacccttatcctgttgtgtcaagcactcaagctccaatcaatgtaaaataatgttacccctctctctctctctctggtagaaaaacatgtcgtgtagggctacatttagttacacattaaaagggcatatcagtaacttcaaacttagttcgtttgaaagcataagttacacgtgtggatttgtattgaaatacactttgtaaaaaaaagtcatgtttgtaaataaattaaataatatagcctagaattaaaaaaaaaaaaaaaaaa

SEQ ID NO: 13729 - DNA, 2728 bp, Zea mays
cgacgccacccgcccggactgccccatcatctacgccagcgccggcttctacaccatgaccggctacacccccaaggaagtcaccggccgcaactgccgcttcctgcagggccccgacacggacatgaacgaggttgccaagatccgggacgccgttaaaaccggccgcagtttctgcggccgcttgctcaactaccgcaaggacggcacgcccttctggaacatgctcaccgtcacccccatccgcgacgacaacggcaaggtcatcaagttcatcgggatgcaagtcgaggtgagcaagtacacggaggggctcagcgaaaagcgcatgcggccaaacgagatgccagtgtccctcatccactacgacgaccggcagaaggagacggcaatgtcatcgatcacggaggtggtgcagacggtgaagcacccgcgcgctcgctccgagggtgaacaggagcccgtggagcctgcaccgcccgtcatggcgtcgccgttggtggcccctggcacgccgtcgggcggtgccagcctcaagtccccgctctgggacgtgaagaaggaggactcacggctgagccggaagtcgagccgccgctcttccctcatggggttcaagatggggaagaggagctcgataggaagcaaggatgcccttccagcggaggtggaggccccggcgccggcgccggcgccaccggagtcaacgacggagaagcagcgcaagaacagctgggagcaagaggggagggagagggacatcaggcaggggatcgatctagccacgacactagagcgtatcgagaagaacttcgtcatcacggatcccaggctccccgacaaccccatcatcttcgcgtcggatagcttcttggagctgacggagtacacgcgggaagagatcctcgggaggaattgcagatttcttcaagggccagagaccgacatgtccacagttgataagatccgggaagctatccgggaacagaaagaaatcactgtccagctaatcaactacaccaagagcgggaagaagttttggaacttgttccacctacagccaatgcgagaccagaaaggagagcttcaatacttcattggagttcaattggatggaagcgaccatgttgaaccccttaggaatcgtctctctgagaacactgaactacaaagtgctaaattggtcaaagctacggcagagaatgtggatgaagcagtcagagagcttcctgatcccaacctgagaccagaggatctatgggacatttactcacgatatgtttccccaaagcctcataaacgttacaactcttcttggattgcgatggaaaagattataaaatctggtgtgaagattggcttgaagcacttcaagcctataaaacctttgggttatggtgacactggcagtgtacatttggtggagttgcaaggaagcggtgaattatttgcaatgaaggcaatggacaaatcagtgatgttgaaccgcaacaaggttcatcgagcttgtatggaaagagaaatatactcactattggatcatccttttctcccaacattatatacttcattccagacaccaacacatgtttgtctcataacagacttttgtcctggaggagaattatttgcactactcgatatgcaaccaatgaaacttttcagagaagaatctgcaaggttttatgctgcagaggttgtaattggcctggagtatctccattgccttggaataatataccgtgacctaaagccagaaaacattttgctccaagaggatggccacatcgttctgactgattttgacctctcgtttttgacttcctcaaaacctcatgtgataaagcattctacatcaaggcgaagaagatctaaggagtatctgcccccaagttttgtttcagatcctgccactccatcaaattcttttgttggaactgaagagtacatagctccagaggtcatcactggtgtaccacatacaagtgccattgattggtgggctcttggaattctcttgtatgaaatgttgtatggacgtacaccttttcgaggaaagaacaggaaaaggacatttcataatatcctgcacaaagaccttacatttccaagtagcattccggttagtcctgcggctaagcaattaatccatggattgctacagagagatccctcttctcgacttggttcaagtgctgctgcaaacgatatcaagcaacatcccttttttgaagatatacactggccactcatccgttgcatggagcccccagagcttgatgttccactgaaactaactcggaaggaacctgaacaaaaagtgaagcctgaggaggatatatactcatgttcagattattgagacattttaagggcaggttgtacgatcccccctcccgaccccgtgcatgactttcagcctgaagagattttatattaccgagtggaaataacgttgctgagcatgtacatagtaataaaagaggtttataggcatgcaagatttccagcctgaattgcacaagaggtcgttgtaagtcattcttttggttaggttaagtgaataatccatcaacaggataaagttcttgtaaatgtacactttctttggcatatataataaaaatcttactaatttccgttggtccaaaaaaaaaaaaaaaaacaaacaaaaaaaaaaaaaaaacacccagttctagatcgcgagcggccgccgactagagagctc

SEQ ID NO: 13730 - DNA, 555 bp, Zea mays
atctttcatccgacgcatgggataagatgccatagcggttgccggggatctgctccacgcgcatagtggttcgcctggcctagaagcgcccatgtccgatcgtcgccctcgccccattcgccgatgccgagctccaccccgcccatgttccgcccaggccgagctccgcctccactgtagctccgccccagcgtctggcccaagtggtctttgccacgttcttgagctcccccaacaacacgatggggcaggtctttctctttaatccaaaatgcttttttatccggtgctcaaagctcttgttttttaatggcgaaagaatattgttgttctttagagaatctgtgcggcactattctcagagttggctgttttgaacagaggttggtctttgtcatcagcaacaaggattgctgctcactccttcctatgcatttcccgatcggttgtttgggctctgaaggacccagtaaccaaatgtgtaactgaatgaaggtgtcttttttatgaaaaaaaaaaaaaaaaaaaaaaaaaaaaagaaaaaaaaaaaaaaaa

SEQ ID NO: 13731 - DNA, 1084 bp, Zea mays
tgggtacctcgaggccggccgggaggaccttcttgagtccttggcgtacctcgaggccggccgggagtttcagccttcaggcttccagcgatgtgttcctgcgcctgcgcgcgcctcctccccccgctcttcagccccgctccaagccccaatctcagacccgccttcccgcacagcccgacgccagcccgcagccgcgccgtcgtcgcgctcgcgggcgcagcctcccgggacgacgcgcctgcgccgttgtccagcttcgacttcctcgcactgaagcgggagcttgatgaggaggaggaggcagtggtggctgtggatgcgaaggaaggtgctggagctgtcaatgaggacgatggagagttgggggcggaaaggagtgcgggtggtacgaggagacggcggcggaggcagatggcgaggcgatcggctctgcttgcgaagcaggtgattagtgtgacctcggcgcggagcctcgggttcgtgtcgcagctctggatcgacaccgcctcgtgggctgttgcattggttgaagtgaagccaagcttactttcaggtgaagcggagaaattcctttttgaggacatatatcaggttggagacgtggtgcttgttgcgaatgaatctgtgatcgataatgaacataaactggttggattgcacagcttggtgggctacaatgtcgtaacttcccggcgacgcaatgttggcaaggtgcgtggtttcacatttgacatcagctcaggtgctatggagtctctcgagcttgactcttttgggctttcgattgtcccttctagcttggtaagcacgtactgtttatttgtcgaagacgtgctggatatagtctctgatacagtcgtggtgcatgaagacgccgtctcacgggttcaacggttaacacagggcattttgggcactcaaaacatccacgggcctggtggtgagattgacgagtacggtagatttggggggaggggaagggggagggggaggagggcgagtgcccagggccaggccgggggccgagaactccgcagcgaaccgaagcatccggaggatgaatgggagcttgcgatggact

SEQ ID NO: 13732 - DNA, 1559 bp, Zea mays
ttgggaccctcgaggccggccgcgggacctgtttaccgctccactccccagtccccactaccgccgccacccccagaacacaaaccccgcgcccggccgtaggggatagagagcggaaggaaggaggcgaacaagagcaacccaccggcggggatgcagatcttcgtgaacgcaattacggggaccatcacgctggatgccaagagcagcgacaccatcgccaacatcaaggccgtggtccaagacagggaaggcatcccgctggactggcagcggctcatcttcgcagggatgcagctggaggatgaccgcaccctggccgactactgcatccagaaggagtccacgctgcacctgctgccccgcctccgcggcggcggcaggggtggctacccgctcaccagcgtcccgtaggacctcatcaaccttgcccgcaagcacaacacaacgagagcaagatgatctgccgcaagttcgtatcgagtctctaattctcctggctctattgatctcttatgaaaatgatatgatttggtacagtatgtgttgtgtggtgcgttgtcttgtttaagatccgggtaagtggtaactgaacgtcgcccaagaggtcgctctctgttttcgtgtatatggtcgttgactgcccccaaacgaagtacatgtaatgagattgatgcagttacatgtatgattgtatgatatgatgagtgcaagatggatctcaatacatgcgctttgattccggcctatttgtttctgttagattgtcgatctcattatgcaaccgcgccttgtttgtatagttgttgtcgaatctagtgacagatcataagatatgcacagctgcctctagttaaacacagcaaatttatctacccactgttttattacaatttatacatgtttcttcattttactaagttttgtgctgtttactctggcgttattatggctatgttttcatcagaattaagggtgtgtgccttttcagtctctatctttagcttaaggccccgtttagttagagggactaatctttagtctctggtttttagtcctgtttagtctctattttgccaaacggaaggactaaagtagagactaattgattttagtctctagtccctcacataaatgttaaaaaggactaaagggcaacatttactccagttactcttgctaaaaaactggtgtcaaacaaaaaaaagggcattttggtctttatgtgttgtatttaatgtatttataatctgtttagttcctacaaccaaacagaaccaaacagggtagtgactaaaatttagtccttgaactaaactttagtcttaggactaatgaaaccaaacggggcctaaaacaacagggtaattcgttttaccctcttgttgatgagcccggggtgcacttcgttttacagcccagccaagagtcatcagtactcggtatgtcgcgcgcgttcgacgactactatatcgaggactgtcgcgtcatcttggcgctagaggtgacgcaggggaggaccgacaacaatgaccagttcgtcatcctcgccaccgttg

SEQ ID NO: 13733 - DNA, 1546 bp, Zea mays
caaatctctcgcgcctcccactcctccccgccactcgccgccagcgaccaaccatcgcccgcccagcagcagcacggccccacgccaggactcgacccacgcgcggctagctaagctcccgccgccatgatcacggccctgcaggtctccggcggcggcctgccgctcctgttcgcccggcgccggcgccgggcgttccggccgccccaagcggtggcgtccgacgccgccgccgccgccgagggcacggcgagggaggatggcgggaaggtggccctgggcgggtccggcgtctccgtcaccaagctcggcgtcggggcgtggtcctggggcgacaccacctactggaacgagttccggtgggacgatacgaagctgaaggcagccaaaggagcgtttgacgcgagcatcgactgcggaataaccttcttcgacaccgccgaagtgtacggagcaggggtatcgggagcgattaattcagagagtttactaggaaggtttatcaaggagaggcagcggaaggagcaggtggacgtggctgtcgcgaccaagttcgcagctcttccatggaggttcggtcgtgggagcgtcatctgcgcgctcaaggcctcgctggatcgccttggcgtctcttcggttgagctctaccaactccattggccagggatatggggcaacgaagactacctggacggccttggagacgctgtggagcaagggcttgtgaaggccgtcggggtctcaaactacagcgagaaacgtctccgagacgcgtacgagcgcctcaggaagaggggggtcccgctcgcctccaaccaggtgaactacagcctgatataccggaacccggaggagaacggggtgaaggcggcctgcgacgagctcggcgtcactctgatcgcgtactccccgatcgcccaaggtgctctgacgggaaagtacacgccggagagtcctcctaaaggccctcgaggacggatatacacgccggagttcctgacgaagctccagccacttatcaaccggatcaaggagatcggaggaagctacgggaggacttcaacccaggtggtgctgaactggctggtgtgccagggcaacgtggtgccgatcccgggcgccaagaacgccgagcaggcgcgggagttcgctggcgctctcgggtggagcctggcgcccgacgaggtggaggagctccggtccatggcgcgccaggtcaagcccgtcatcggcttcccggtggagaagctgtgaccacccccatggcactggtatatatcaggccactgtagtagtgtaatgtatagtaggactgtaggtacgtagatgggcaaagcataccatttccatcgcgagactgcggacgatgtatgctacattgctactgaacgtagcgtcacgccgtcgaccagagatcacagtagctgtctgcgctaaggacgtggttcactacttgcgaaagtcagtgttttaattacatggaaaaaattataaaattatacaatttttatccgcttcaaaaaaaaaaaaaaaaaaaaaaaaaaaa

SEQ ID NO: 13734 - DNA, 922 bp, Zea mays
aaaaaaaaaaaagcccctttttttttccgccggcctgcgccgatccatatccgccgcagtccagccgcagcgattctccgccctcggccccctgccgccgctctagctgctcgctcgttccacacctttcctctttttttccctcccttctcagcgtcctcgctcgctcgtccagtccagctccgtccgtgcttgcctcctccggcttcggactcccaatggccatgctgagggtgtgggagtgggactgggacgtcgacctcgactcggtgctcgacttcgtgctctggtgcctgccccttctcctcgtcgcctgcctcatcggcagccgcgtcgtcacgggaggccagctcgaccccgtcgctgacgccgccgcggctgccgccgctgccgtcgcgatcgccaatgtcctagcgcgccggctcaagctccgctgcttctggcgccgcaagaattgaaggtgtgccatgatcctccgctgctctgttctcagtactccgtaggctcctaggcgaagcgcagaaggccgcagttcgccgatctgagcttcacttgctgtcttgcggatgcctgtggtcggcttcggttgttgcaggtcagcgttgcgctgtccatgaatattaaggaaggatttgctctcgtgttcgtctctcggctcgcacacctttgattcttgtttctaaatcgatcgatttgtgcctggatgcatcgtgcctgtattgagcttccccgccggtggaggttcgtttccgcactggaccggatcggcgtacgtgtcgcccccggggacccatcggagattcggaggggagaccgcagaggaggtggatgcttgccgctagatcagcatggaataggtgactgttcctgttgtcatcatccacctttcaggccagggggtcctttagagtcaacctgcagg

SEQ ID NO: 13735 - DNA, 3289 bp, Zea mays
  misc_feature (426)..(426): n is a, c, g, or t
  misc_feature (2171)..(2171): n is a, c, g, or t
  misc_feature (2808)..(2808): n is a, c, g, or t
  misc_feature (2861)..(2861): n is a, c, g, or t
agaagtgaggcgtatgttgctacttaggttacgagttagagacgtctatgctccacaattttttttacaaataacctctttaaacacttcaagagtctctacattaaatatcactatacatactttaatcgatactaggtgagtgtccgtgcgttgcaacggaactgtataataacacgataacttatgtgtacatatgtatgttatatgtatatgctcgtgcgttgctacgaagttaatattataaaacacaatattttttgtatattaatgtattttatcatagcaacacacgagcatatacctagttagatttttatgtggttaggtcacaactatttaattccattatgctctataggttgcatatacacgagatagttcacgggcaacgtactgatgaagtggttcctaaagagcttcggnctatatgacagtaccttacggctggtaccggctcctatggcaaggactgaagaagtggtgaccggagggctgggggtgcctcatcacagattgctacgacagaagctggtagtactatttcagcaggagcaacatcgtctccacgcattgttagatgtttagttaaaaatcaccccgaagaagaagaaagtgtaatatggccacttaaattgtaatatgtgaagtgcagtgtgtaccggtatgtgaacttgtttgaaactgtaatttgtgaaatgaactactgttctctagtgaaaatagtctagaattcattcagtgatctcaagcactgctttctagtgaaaatactcctctatttcccttgtaatctatgaactgcagttatttcagatttcggtgaaaatagtcacttaaatctgcagttatttcatatttctatgaaaatagtcacttgaatctgcagttatttcagatttctatgaaactgaacaatatttatttctaagaaactatacaatagttcaagacaaactcaacaatagttcctgagaaacagaaaaatagttcatgagagattgaacaatagttcctaagaaactgaagaataggtcctgagaaactatacaatagttcatgagaaaatagtctctagttcctgagaaacttaaaaatagttcagttgaaactgaacaaaagttcccaagatactgaagaatagtttccgagaaactataaatagcctcagtagtactgagaaaatagcctcagcagttatttcagatttcatataaacacaagtacacggacttagccatttagagccacaatgtacacagattgctagtacctcattcacagaaagcagttttttccttaaacatatgctttttagccacaacaggcacaagtacatagatttagctcagtagtacaggtgcaatgcattacctcatcactactacacttaatacaaaaggaactacagtgtgtacgcagtaccacacaattcgctaaatacaaaaggaaccgcattaccaaacagttcactgaatacaaaagtaactgcattaccaaacacacagtacaacacttaatgcaaccaaccaaaagtaatacaaacagacagcatccacggcgcagcccgccttgtgcgcagcaacggcgacaagctacacagacgcgacaaccttcttctcagcgaccatagccgcgctgccggcttcctccgcagcaactgcggtaaagaacattcataatattttagcatgtattttcagtgcgtctactgtaatgccaatattcattggccattcagctttataacccaacaagatgtcatccagcaaatcaaggcctagcagtaaagaatcaagtagttagcagtttgagaaatagaacttttttagtaaacaagctgcatatatagtaggtagagacaatctcagatgaaactattaccacatgtagagacatcaaaagaatcaataggtggctccctcatgtatataaattatctttccttataaggatccgaatcacatgaagatctttgcaataccaattccataagcccttggatttccgatcttttctgctcagatttaacaaatgaccatttctgcataggagaagttcaaaattgagtggactcgtacaggttgacaaaaaaacatgacctataactaaaatcataatttagaatgagggcccatatataggttgcaaccatctgttgaagattgcanacttacattaatgagaatgttcacgaaacgttttgaagttcaacgataaattggtgtttgagagatctattttcatgtttggtttttaaacaaactatttgttttattatccaaaaaacagactatatgtttcttcaacctacaataactaattgctatgtgcatattttttagcttaaacaatcttattcattgatctaaaagggtagcttgtactccctccattccaaattgtaagtcatttgggactgtgctaaccaaaatgcttgagatagcccattgttcaacctaccttatctacaatgtgaaaaagctatctgaaccaagagcgttatcttagtggtgtcagtgacttacctcaagttgtttatttaactatctctgaacctcaatttgcatctgaagtacttcaccaatttgaatggtcatgttatcatcacattcttgagattgacatggtagtagtccgagatgtgttgtggttgtgaggtgtcaccatcaggatcttctagaatcgaatcatgcctaatggttggcatctagatctgcacacgaataagtcagtgtctcttttatgataactacaaggttcagttagatacacaaatcatgtaattcacttgtaacataatttctntacacagtatcatcctatctctttctatttcatcctaaccaatttctctacanagttctggattcaaaattatggtatttattagtaatgtatgcaggctgaactggaagtagagagaactatccaacatggcacataaagagagaaagagcccataagtgtacaacctatctctttctatttcatcctaaccaatttctctacacagttccagattcacttataaagcaagtgatctgaagtcactatattcatcagctgacgactaagaaagcgcccataagtgtacaacattgctgtgaaaaaagtgcctacaataggaaataatacttgggcataaacgtcacaacgggaaaaaatactgctgaaaagcatgcggctgtgaaattgacaaatttctgtttaaacttggtagaaacaaaatgaaacattgcttaccaattcaggaccctgaaccctggcagttgtttctcttcactgg

SEQ ID NO: 13736 - DNA, 2024 bp, Zea mays
cattgggtacctcgaggccggccgggaaatttattccctgcgttcctcacctcgggggggggaaaaaaaccccggcctgccaccctacttcatcctcgagtcgacttgtgcgccgccattctccgtcgccgcggtctcgcgggcccgccgccgtcctagccgccctgtccccgccctctccgtctcgcgccccacgcggcccttgtccatcttttccgtcgccggctcgtgcggtccgacgcctgccaccggttcctcctctcgagaaaggcggcggcgcccgagagagcttctttgagggaggataaggcggcgcggagcgtctctgagcggctcaggcccctccggcgctgagctttcctccggcgttgtgtgtgcctgagttgttgactcccaattgaagcgtggtcaaattacctcggctccggtatgggttggagctctttatgggttgctaaagcgtttagagtgtggctctaggcgtggattttcaccaatggcaatcgagtgcctcgtgctaggggcggggcaggaggtgggtaagagctgcgtggtggtgaccatcggcgggaagcgcgtcatgttcgactgcggcatgcacatgggctaccacgacgaccgccactacccggactttgcgcgcgcgctcgctgcctggggggcgcccgacttcaccaccgctatctcctgcgtggtcatcacgcatttccacatggatcatatcggggcactgccctacttcaccgaggtttgcggctaccacggccccatctacatgacgtatccaacaaaggctttagctccatttatgctcgaggattatcggaaagtaacgatgggtcagagaggtgaggaaaagcaatatagctacgaagatattcttaggtgtatgaagaaagtcacaccaatggacttgaagcagactgttcaagtagataaagaccttgtgatccgtgcctattatgctggacatgttataggggctgccatgatttatgcaaaagttggggatgctgctatggtatacactggggattacaatatgacaccagatagacatcttggggccgcacagattgatcgtctgaagttggatgtattgataacagagtccacatatgctaaatctatacgtgactcaaagcctgcccgagagagggagtttttaaaagcggtacataaatgtgtttctggtggaggtaaagttctaattccaacgtttgctctgggaagagctcaggaactatgtatgttactggatgactattgggagaggatgggcttgaaagttcctatttatttttcagctggtttaaccattcaagctaatgtgtactacaaaatgttgattgggtggactagtcaaaagatcaaggacagccatacagtgcataatccatttgacttcaagcatgtttgccactttgaacgttccttcattaacaaccctggtccctgtgtactttttgcaacacctggtatgattactgggggattttcccttgaggcgtttaaaaaatgggcaccatcagagaagaatctggttacacttccaggatattgtgtttctggaaccattggtcataagttgatgtgtgggaaacctacaagggttgattacgaggacactcatattgatgtcagatgtcaggtcgattttcacctcatttcatatcttgcaaaaaatgtacaactttaaataataatgacaagaacatggtcaaccagggggaagccatgtaaatcactagtgttttaaacactgttgaagtctggcttttaaattcgatccatatcaatccccacttatcgttctgcatgggtgcttactcgagggctcgaggcccttagttgtctattgcagttggctggctgtggtcgtttttgtttctctctctcagtttttttctgagtaatatgtctgtatgtgttgaagagcttcctagtcccctccctgttttacacattttatactttatcttaatctactcattaccattcatgatgcaaaaaaaaaaaaaaaa

SEQ ID NO: 13737 - DNA, 1623 bp, Zea mays
atgacaccagatagacatcttggggccgcacagattgatcgtctgaagttggatgtattgataacagagtatggtctaacctcaaactataaacatttctgttttgcggttgcctttacttggattttcaatctagtgttgttgtgatttatgccacattatatccataggttatttcttatggtttcacagcacaggttttatggggcagaggaggaccccggctatgtatatggcagtcaatagtcattctgtagagggtcaatcatattcaccttggcaccctatatttgggaatagtgagggagggagagagattattttgttgcctaagtcccaccgattacatctgctcagttgataaacaccaagttcaacaatctcctgcttccaagcactaacaaatcaaccactaacaagtcaaagcaatcctggaactgactaataaactgaccaaaactccaaaccaactgaaacggaagaccttgccacttgtcaagcagctgttgccggcttgctgcagtctcaggcgtgttactgctgtgctcatgccatgcctgcactgctcttcttggagagcctgctgcagtgcttgctctgcataacagcagggactaaagggcatgttttacctatttgacttatcattgtgtgatcgtcttagttgatatcagattttgggaatattttcctgaccacctgtggacctttgctcagctcctgttgttagccaatctttgttctcctgaatattgtttgagttatggttgtaaattacctatataatttgttattacacttgctactcagttgaatctactagtttataatgctgcgataatcaaccaacctgcctttgttgcatagtgccatagttgtagtggcttcctaacttttcactgttatatttgaattaagagcatcaattgttgcaaatgattttttccctgtatacataaccaattaactacttttttattcaggtccacatatgctaaatctatacgtgactcaaagcctgcccgagagagggagtttttaaaagcggtatgaaaatctgaactttgctgcagcctgcagtgtatatatttgtagattttcgtaatcaatgcttttccgatggtgtactactctattttctaggttttggatcctatgtgctcaatattatttgggcacacaacacagttcactaagtgtatctatattttttattcctgatgttttcgtcccagaagatgcactctgactgtattaaaccaatcttctgaagtgtacacagttgattttacttccaaagcataactgagtatatgtttcctctaggtacataaatgtgtttctggtggaggtaaagttctaattccaacgtttgctctgggaagagctcaggtattgtagttctcttaattctactttatgagacaaagtgatggttaagtgtgataactatatatgacttaaatgagcaagtttccctgagaagtaccattccgagggcacactgttcaaaggtttcataatttgagtatctatttgtgacgcttgtatttcaggaactatgtatgttactggatgactattgggagaggatgggcttgaaagttcctatttatttttcag

SEQ ID NO: 13738 - DNA, 1298 bp, Zea mays
gcacgatgttcctaagagagtccacatatgctaaatctatacgtgactcccatcctgcccgagagagggagtttttaaaagcggtacataaatgtgtttctggtggaggtaaagttctaattccctcgtttgctctgggaagagctcaggaactatgtatgttactggatgactattgggagaggatgggcttgaaagttcctatttatttttcagctggtttaaccattcaagctaatgtgtactacaaaatgttgattgggtggactagtcaaaagatcaaggacagccatacagtgcataatccatttgacttcaagcatgtttgccactttgaacgttccttcattaacaaccctggtccctgtgtactttttgcaacacctggtatgattactgggggattttcccttgaggcgtttaaaaaatgggcaccatcagagaagaatctggttacacttccaggatattgtgtttctggaaccattggtcataagttgatgtgtgggaaacctacaagggttgattacgaggacactcatattgatgtcagatgtcagatccatcagctagcattcagtcctcatacagactccaaagggattatggatctgacagaattcctgtcacccaaacatgtaattctcgttcatggtgaaaagcctcagatggcttttcttaaggagaggatcgaatctgaattggggatgccttgctactacccagggaataatgaatccgtctccattccgacaacccagaaccttaaaatgagtgctacagaaaggttcattacaagctgtgctgtggagcaaggtaaacgtagcctgcacaagcggaacctgatttatggtacaggtttgtcagaagagattggcagtgatgaggcggcgggggagggcgttcttctgatgcagaaacacaagtctccgaaaattctttgtgaggatgagctccttgaggtgctgggcatgggtcggcatcttgtccagtttgaaccaatggtctccagaattgtagctgctgttgaatccgagttgcagcgggctaaggcagcggatttagataacgatgggaaatgaatggaacaatataaatgtacattgccataattttggctgattactgtttcacctttctttcccaaaaatgcgagtaatgtcctcccccacttcagcactattacttacaagtctctttaaggtccttgggagttcccaagttatccaatatctagagagctcctatcgcataaaatccctatagggtattctgtttgtatagtgaaatttgaaata

SEQ ID NO: 13739 - DNA, 1128 bp, Zea mays
  misc_feature (4)..(4): n is a, c, g, or t
gagnaaagcaatatagctacgaagatattcttaggtgtatgaagaaagtcacaccaatggacttgaagcagactgttcaagtagataaagaccttgtgatccgtgcctattatgctggacatgttataggggctgccatgatttatgcaaaaagttggggatgctgctatggtatacactggggattacaatatgacaccagatagacatcttggggccgcacagattgatcgtctgaagttggatgtattgataacagagtccacatatgctaaatctatacgtgactcaaagcctgcccgagagagggagtttttaaaagcggtacataaatgtgtttctggtggaggtaaagttctaattccaacgtttgctctgggaagagctcaggaactatgtatgttactggatgactattgggagaggatgggcttgaaagttcctatttatttttcagctggtttaaccattcaagctaatgtgtactacaaaatgttgattgggtggactagtcaaaagatcaaggacagccatacagtgcataatccatttgacttcaagcatgtttgccactttgaacgttccttcattaacaaccctggtccctgtgtactttttgcaacacctggtatgattactgggggattttcccttgaggcgtttaaaaaatgggcaccatcagagaagaatctggttacacttccaggatattgtgtttctggaaccattggtcataagttgatgtgtgggaaacctacaagggttgattacgaggacactcatattgatgtcagatgtcaggtcgattttcacctcatttcatatcttgcaaaaaatgtacaactttaaataataatgacaagaacatggtcaaccagggggaagccatgtaaatcactagtgttttaaacactgttgaagtctggcttttaaattcgatccatatcaatccccacttatcgttctgcatgggtgcttactcgaggcccttagttgtctattgcagttggctggctgtggtcgtttttgtttctgtctctcagttttttgtgagtagtatgtctgtatgtgttgaagagctttcctagtcccccgacagcaacgccccaaaaaaaaaaaaggccccta

SEQ ID NO: 13740 - DNA, 3245 bp, Zea mays
  misc_feature (2544)..(2544): n is a, c, g, or t
  misc_feature (2608)..(2608): n is a, c, g, or t
aagaagagcgcccgcgcccgctcccctcctccgcctactcgtaatatgttcgtacccaccgccatcactacgcatgccggtccgttaagcttcctccccagcttaccgcgtgctgaaaccctagccgccgaggagccgacgatgtcggacccttacaacccgtactaccgtggagccttcccaggcggcgacggtgcgccgccgccgctgccgccttactcggactttgatgtcgacctcgtcgcgacccgttacaccggcaccccacggtctcatccatcctctgccgacgtcggcgccttcgaatcgcatctcggcgcgagacgattcgcggaagttctctatcagtaccaccaatcttgtatgggaagtcatagtactgttggccagagtgagactttatattcatcaattactatggctaagcgccctaggcttgaaagcagccttcctatatatccacaacgaccggggcaaaaggactgtgccttctatatgagcactggaacctgtaagtatggagagacttgcaaatttgaccatccacaatgggttccagagggtggggttccaaactggaaagaggtcctgaatgatgaggattattatcctgagcgaccaggggaaccagattgtccttatttattgagtagtagatgtaagtttaaatctaaatgcaagttcaaccatccaaaggaaatggtgaacgcattaggaacaagaacagacaatgaatcactaatcgctgataccgctatcttaccagtgaggccttctgaacccgtttgttcgttctatgcaaaaacaggcaaatgtaaatttggtgccgtttgcaagttcaatcacccaaagctagaagatattaagacaccatctttgattgcaaaggaaaccatatatagagcaacaactgatgcagcagcgcacattggtgggacagatgattctgttccagcaaagacacatgcaccaattgccccagccgaggcacataatgcaaaggggcttccaataagaccaggtgaagtggattgctcgttttatatgaagacaggcagctgcaaatatggttctatttgtcgcttcaatcatcctgatcggtcagttgtggatatagcttttatggctccagttcaagctactcttccttttccagcacccattgtccctgcagtggcgttaaatccggctgcaaattttctgcaaagctttgatttccatgcaactcacgtgccggttgagcctatgccaatgatctatcctcaaagacctggagaaattgtttgtgatttttacatgaagacaggatcttgcaagtatgctcagaattgcaagtttcaccaccctattgaccggtctgcacctcattccaaagaaaacgaggatacacagcagcctgtggcacttactcttgctggccttccaaggagagaggatgctgacgcctgtgccttctacatgaggtctggcacgtgcgggttcggtgcgcgctgcaagttcgaccaccctcctcgccaggacgatgtcctgcccgaccctgatgtctaatacggtactccctccgtttcgttttagttgtcgctggatagtacaaaattgaactatccagcgacaactaaaaaaacggaggaagtatcctgtatcaggatgtggtaccatgcgaatcgcactgttaatgcttgatgctgtcactgccatggtgggagcctgacttgtaaagttcagtatcaccggaagtgtttgtcggcgcgtgctggtactaacggtgtaccttcggcggttggatggtgtcaagagtaaaaatacaccgcttgttctcaaactttgactggatgctaatctccaaaatgtgagaaccaagttaccgtaaaaaaaaaaaaaaaaaaactcgagagtcttctagaataaggcgttgggacgtggagtctacatgatggtagggatataggagatcgaatcgcatgttcgcctcacatgttgatgcaatgccaacgtgcaattagcttgtcaacagattaatttagcattattggcatattaaagagtttaggccttcaggtatcaggatatacattttggaattttgaaaacctggatggcaccatgagtcggttggtacatgctagagcagctttagcgagctgcgagcccaaaatcaaggccccactttttcatgggcatctcccgcgggaataaatccctgttctcatttaaattataattagaatatactttttttactattaacgcaaaatagtcacttacataatgttagatgcaagaaattattatgtgtaggttaaaataagcacatttatacgatgaatgatcttttgacaagttaattatttatttttattattaatattacacgaaaacatcgtcacatgtaatcttaatggttcccacggggaacgtggatgtaaatgattccccgtcctcgtaatatcaggagagaatttttcccatttacattttcgtggggaagaaaattttccattcctatcctataatggatgaattccccgtggggaatcttggttngggaaggtcagtgaaatctaactctatgttaggaccccctcccaacaatattcttagggatggnatggcaatgacctatgggtgggtgtagtgtgtgtggagcaaacacctgtatgtattgacatccgacacattaagtcacacccatattcatagtatttaataggtgaatttttacacctgcaccgattgggtgatcaacaattgcaaataactaaataaaagcaccaaaaataataagagaaatctatataattgtttagaagcacacgatacataatacaatatcaattcacttaagtgaagatgagtagatgacttagggttttattggactagactaaagtcatatataaacaaggaattaaagttactcactccagtgtcctattagttgttgtttaggacagcgacacagtctcaaaatataacttcgaccaatgttttttaaatacaaataaactcttcgtacatttacactgtacttttaaaacaaatcggtacatataaacattaagtttcaaaactaaataataaaacagttatttgtagtcaaaattttacaagtttgactcaaaccttgtctaaaacgacaactaataggacaccgaagagagtagtctcctagagttcattgggcacctatggtgaaaagccacacacaactcgaatccatcattttgcgggtcggatagggactt

SEQ ID NO: 13741 - DNA, 1539 bp, Zea mays
atttattaaactttcgcaagcgcaggtatctccccacagggcagcgcgtgcggaaaccctagtcgccgccgatgtcggaccctttctacccgtactaccgcggagccttcccgggcggcgacggtgcgcagccgccgccacgttactcggattttgaggtcgacctcatcgcggcccgttacgccggcaccctattgccttatccatcctctgccgacgtcggcgccttcgactcgtatgtcggcgcgagacgatccgcggaaggccccgaatgttgaagattcttatcctgagcgaccaggggaaccagattgtccttatttattgaataatagatgtaagtttaaatctaaatgcaagttcaaccatccgaaggatatggtgaatgcattaggaacaggaacaaacaatgaatctctaattgctgatagcgctgtcttaccagtgaggccttctgaacccatttgtgtgttctatgcaaaaacaggcaaatgcaaatttggtgccatttgcaagttcaatcatccaaaagatattaagacatcacctttgattgcaaaggaaaccatatatacagcaacaactgatgcagcagatgccccgaccgaggcgtgtaacgcaaaggggcttcctataagacaaggtgaagtggattgctcgttttatatgaagacagctgcaaatatggttctatttgtcgcttcaaccatcctgatcggccagggccagctgcggatatagcttttatggttccactggttcaagctactcttccttcatcagcacccattgtccctgcagtggttgaacctttttcaatgatctatcctcaaaggccaggagaaactgtttgtgatttttacatgaagacaggatcttgcaagtattctcagaaatgcaagtttcaccaccccatcagtcgttttgccccgcattccaaagaaaacggggatcctcaacagcctgcgacacttgctagcctgccaaggagagaggacgctgaggcttgtgccttctacatgaggtctggcatgtgcaggttcggtgcgcactgcaagttcgaccaccctcctcgcgaggaggctatttccgagctgcaggcagccggaaaggaaggaatagaagggccgagcctcgtccagcgcgaccatgatgtctaatactgtatcctgcttcagtatgtaataccatgtgaatcgcactgttagttaatgcttggtgctgtcagtcttgttgggagtctgactcgtaaagctcattatcatcggaagtgtttgtcggaggagtgctggcactaactatttatcttcagttggttgtcgtgttgccaacttgcgatgtcaaggtgcatatttcagttttttagagtaaaaatgcactttacatcctgccgccaaacttaactatgggcctgtttatggccctgtttggtttagcttttttttaccagcttttctaaaaatctggttgtggaaagaatttgagtatcgtgaagattacatgtggagaagatgaagtggtccaaagggtccatgatct

SEQ ID NO: 13742 - DNA, 1855 bp, Zea mays
gcagatgctcttatagccgcgtgcaagcgcctcgtaagacgccagtggacattcgcccgcttgccgtccatttattaaactttcgcaagcgcaggtatctccccacagggcagcgcgtgcggaaaccctagtcgccgccgatgtcggaccctttctacccgtactaccgcggagccttcccgggcggcgacggtgcgcagccgccgccacgttactcggattttgaggtcgacctcatcgcggcccgttacgccggcaccctattgccttatccatcctctgccgacgtcggcgccttcgactcgtatgtcggcgcgagacgatccgcggaagttctctatcaccaatcttttatgggaagtcatagtactgttggccagaatgaggctttatattcatcgaatactatggctaaacgccctaggcttgaaagcagccttcctatatatccacaacgaccggggcaaaaggactgtgccttctatatgagcactggaacctgtaagtatggagagacctgcaaatttgaccatccacaacgggttccagagggtggggttccaaactggaaagaggccccgaatgttgaagattcttatcctgagcgaccaggggaaccagattgtccttatttattgaatagtagatgtaagtttaaatctaaatgcaagttcaaccatccgaaggatatggtgaatgcattaggaacaggaacaaacaatgaatctctaattgctgatagcgctgtcttaccagtgaggccttctgaacccatttgtgtgttctatgcaaaaacaggcaaatgcaaatttggtgccatttgcaagttcaatcatccaaaagatattaagacatcacctttgattgcaaaggaaaccatatatacagcaacaactgatgcagcagatgccccgaccgaggcgtgtaacgcaaaggggcttcctataagacaaggtgaagtggattgctcgttttatatgaagacaggcagctgcaaatatggttctatttgtcgcttcaaccatcctgatcggccagggccagctgcggatataccttttatggttccactggttcaagctactcttccttcatcagcacccattgtccctgcagtggttgaacctttgccaatgatctatcctcaaaggccaggagaaactgtttgtgatttttacatgaagacaggatcttgcaagtattctcagaaatgcaagtttcaccaccccatcagtcgttttgccccgcattccaaagaaaacggggatcctcaacagcctgcgacacttgctagcctgccaaggagagaggacgctgaggcttgtgccttctacatgaggtctggcatgtgcaggttcggtgcgcactgcaagttcgaccaccctcctcgcgaggaggctatttccgagctgcaggcagccggaaaggaaggaatagaagggccgagcctcgtccagcgcgaccatgatgtctaatactgtatcctgcttcagtatgtaataccatgtgaatcgcactgttagttaatgcttggtgctgtcagtcttgttgggagtctgactcgtaaagctcattatcatcggaagtgtttgtcggaggagtgctggcactaactatttatcttcagttggttgtcgtgttgccaacttgcgatgtcaaggtgcatatttcagtttttttagagtaaaaatgcactttacatcctgccgccaaacttaactatgggcctgtttatgcccctgtttggtttagcttttttttaccagcttttctaaaaatctggttgcggaaagaatttgagtattgtgaagattacatgtggagaagatgaaatggtcccaaaggtccatgatct

SEQ ID NO: 13743 - DNA, 6226 bp, Zea mays
  misc_feature (6060)..(6060): n is a, c, g, or t
aatttagtatattgcaccagttgtgtagttttgaggctttagggagatcatcaagcaaggtttttggtttattactcttggaggttgttgctcattagacgatttggtagtgatacaccgtgaagctattcaagaagattgtgaagaggctctagtaaagttgtgagaagttgtgcttgcgtcgctagagcggtgaaaaacaactctagcggaattaaggctagagatgttatttgatagaagacgactcataaacgaattggactattggtagatgagtgactaaaagacaatgaatccaccttaaaatggattaagggtgaccaacaagccatcgatatcacgaacaattcctatctctcgttgcgacgaattattctctatcttaatttaacgttgtaacggttttttgttcatttacatttacaaatcttatggtttattttgtagtcgtaaaacaattttagcatattctaattgctaaattgagtcgctcgatgcttttaagttaaaaccatctatccacccatctagctgatacattgatcctataaaaaaatagaggtcacgacggctgtgtgcagccgagatgccgtggcaatgcactccgagatgtggcagcctagatgtggtggtgcaaggccgaaatgtgatattgcaggcgacataggtgaatcgagactgagcagtgtcatagacaagggggctggcggggcccatggccctctaacaaaaaaaaattgttttctagttatatatatatggctaaaataaataagttagctaataacaaattagtatttattatatacttagcacatatatgtattaattgttatgactagtgactatagtatatatatatatattctattatttataattataactatagttatatatatgtgttggtcctctctaaaggaaaatcctacacgttgcagtggcagccaggatcgtgaatcgtgatgctacatgctctggtggccatcgtcgaccagtggtactccagggtccacacacgtcggcagcttctgtgtatgctcccgaaatggtggatttgaaatgatccatcgaacatttatttattcatataaaaaacagtaaaacatatacatcaaagacagtttggccgagtggtctaaggcgccagatttaggctctggtccgaaagggcgtgggttcaaatcccacagctgtcaaatatttttgaatttttttggctcattcccttctgattatttttcactgattctcttctgatgaaatatatacttacaccaaggtgtactaatattttaattttaagataaaagaacttccccgttgtgtatggcataacggcgaatagtccatccatcatcagcttgagacggagacgacaagaacgacgctacctcaccatcttaatcttattagcagcaaatagcagatgcagatcaataaacccttaccaagcccaatgcagggagcagattctctctctctctctttctcacacacacacaaccccaatgatccatacacacattttcatttttgagctgatatgttgccacaaagcgaggttctggatgcaaagtgagcagccacaggccacagcaggtcagcagccaattggaagtcactgtcttcctctgaatattctgagaccctcctctcaacactttgtcgagttaacaaagtcacctcatccaatcttgcatccccatctctggcccctgctcctccatggccatggccatggcccgaccttgtgctttccttctcttcttcctagttcttttctcctacgacggatccggtcctgggagcagcaggaggactaggaggagtggcgtcgcgcaggccacgcagagagtcttcctgtacccacaggctcccaaggtctcctccatcgtgagcagcaagtacaggaccgcgtaccacttccagcctcccaagaactggatcaacggtactcttctcttctcttctcttgactcttctcgtatgctcttctcttctgttgactttccgtatgccttgtaatccgaggttcttttactggatcaaggaaaaggaagttcgtctgattttttttttgcctaactggagggagtttgacctcccttctctttctgaataaaaattactggcgaggttaatttccctagttgcctagctctgtgttcatggtatacatgtgaaagggaaggtaggtaggctacacaatacttgtgctgcacagagccaaattttctgttggttcttgccgaatgctgcacagagccaagatacatattagtgaaggctcacattcatggcactgcttttacattttagtgaagtcatagcaatgttttacctaaagggatcgatgctattcccttttcgcactacattggcatagtctgaagtattgtgttaaagttttcagttaggcaatgcattcaggccaactgaaaatttgtctggaaatgcactttgcccccgtttggtcttatatatgctgattatattttcatttcaagttcctgataccatctgaaaagcttgttttggactcagggtctttgccctatcaagtttctgatatcatcttttattcttttctcgtccttgaaaatccaaatgaatcggcgaccgtttgaaacaacgactcaaaaaaagatccaaatggtatgttacgcatctcaaattaaacaccaaccgcttgcttccatacataccaaactgcagtagaagaagctcctcttgattttcaggaccaatgtactacaatggtatctaccaccagttctaccagtacaacccaaacggctcgctctggggcaacatagtctgggcgcactcggtctccacagatctcgtgaactggatccggctcgcgccggcgatagagcggacgactccgagcgacatcaatggctgctggacaggttcagccaccatcctcaagagcggccggcctgccatcatatacaccggcgccgacaccgagaagcgtcaggtccagaacgtggcgttccccaagaacctgtccgatccgtacctgcgggagtgggtgaagccacacgacaacccggtgatccagccggtcggacgagggctgaacccaggccagttcagagacccgacgaccggctggatcggcccggacgggctgtggaggatagccgtcggggccgaggtcgacggccacagcgcggcgcttctgtacgagagcgaggacttcgtgcgctgggacagagtggaccacccgctctactcctccaacgcctccgccatgtgggagtgcccggacttcttcgcggcgatgccgggcgagaactccgggctggacatgtcggctgcggtcccggatggcgccaagcacgtcctcaagatgagccttgacggctctgacaagtacatggtcggcgtctatgatctgaaaggtgacgcctttgtgccggataccgtgatcgaggaccggaggctgtggtcaaggattgactacggcaactactacgcttccaagtcgttcttcgactcgaagaaagggaggagggtcatatggggctggacgaatgagacggacagttcgtcagacgacgtcgccaaaggatgggctggaatccatgtaagcttctgactatactgtagttttgtaatttaacacgcatgcatgtaattttttgatttggtttaggcaattcccaggactatatggttggacaaagacagcaagcagctgctgcaatggccggtcgaagagatcgagtcgctccgaggaaaacaagtcagacaccaaggcctggagctcaggaagggggatctgtttgagattaaggaaattgacaccctgcaggttagtttcagtcattattctcatgtagatagatagatagatagatagatagataatctggcacacttttgttcttgttggaacaggcagatgtggagatagatttcgagctcacatccataggcagtgccgacccttttgacccttcctggctcttggacatcgagaagcagtgccgggaagcgggcgcgtcggctcatggcccgttcgggctcgtggttcttgcttctgagagcatggaagagcacacctccgtgcacttcagagtgtactacagatcacaggagaagcacatggttcttatgtgcgccgatctgaggaagtcagtacagtacacatgcacatttaatctaggaacggcctgcttcatgttcgtcggttcattaagcagcagagccttttctctcattattgcagatcgtccttgagaccggagctgtacacgccagcctacggaggcttctttgagctggacctggagaaggaaaagacggtggtatctctgagaactttggtgagtggagctgagcaaacacctcaagcgtttgttcttcatgtcgtcgtcgtcatcgtcgtcgtcgtaggaaatggaataacagcagcacctctgcagatcgatcgctctgcggtggagagcttcggtggaggcggcagggtgtgcatcatggcccgggtctatccggcggcgctcgtcgacgacggcggcacccgcatgtacgcgttcaacaatggcactagcaccgtcagagtgccccggctagaagcgtggagcatgaggagggcacaggttaacaagggatgaggaggaacacaaggccatttgatagctagaggagaggaacagagcatgggcacatgaattaaacacacactgctggtttaatttgctggaattaatcaatcaatcaatcaacaaacacacgaagattaaatcaaaacactctctactcctacactaaatttcagtacaacgaccttgcattgctacttaatcagatccggcgatcggtcggcatcgtcatggctactgcgcatctctgactctgaatgtggccgagtcggtgctcgtgcagaggaggaggaagaagacgaggccagccggcggtgctcgtgcttgagcgccctctcgacgagcatgttgaggaagttcatgagctgcacggcgtgcgcgagcgccgtgagcgggtcgtcggcgcgcgtcatgttgggcgcgaacaccatggccacgttgcgcgtgcccatcttgttagccttctcctcccgcgccacgtccgccatcaggttcaccgcccagtccagcagcgccgccctgggcgccggcagcctggcgccgcagagccgcgcgcagtcctcctccgtctggcaccgcgtcacctcatccgccggcagcgcgtccagcagcccgccagggagctcacggaaccacgcctgcttgcacgtcgtgccgtgcgtgcgtgcgtgcgttgtcagatcagcagatacgcaatgcaacaaatgcaatggcggcaccgtaccttgatgaggcctgcgatgcagtgcacgtccacgccgtctggcacgacgcccgagttgttgagctggtccctggcgtactgctcctgggcgccgtcggcggccaccctgaagatgccctccgccctgaggccgccctggtcgacgaggcggcgctgcaggtggaggagcacggtggggacgctgttgccccgcccgtcgtaggagcactgcatcgactccgtggacacgccgaacaccgtcttgctggcgctgggcgcccggacgatgccgtccacgacgtccaccaccaccgccgccgccgcctgctgctgcagtagctcctcgggcacgccgcggaagccgtggaaccggtcgaacgtcacgtgcgccacgtgccggacgtccgtcggccacccgatctccattttctcgtcgtcgccaccaccgcgcggaggccgccgcccggcgagggcatcctcctcgtcaccgccgccgccctgcattgtcctgagaggagagtcgtcgtggtctcgtggacgtgatgatatgagaacgagaagggatgacaaggagtgcactgcaatgcaagcagaacaaaagctagggagggcagaggcggttgggttgggttggtggatccatgcttgctgccgcaccactacctttccaggacgtgggcggcaccactacgtacgccaactcaccaccagttcgtcactgtattttcaatgctngatctacctcgtatcttcaaattatttactagtttagtatccatgcgttactacgacacataaattattcgattaaatattagtgcatgtcgattatattgttgaatatctgatggtaatatagataccagttagttatgccctcacatcaggtgtcctttcaaca

SEQ ID NO: 13744 - DNA, 2697 bp, Zea mays
gtcgagttaacaaagtcacctcatccaatcttgcatccccatctctgtctttgctcctccatggccatggccatggcccgaccttgtgctttccttctcttcttcctagttcttttctcctacgacggatccggtcctgggagcagcagcaggaggagtggcgtcgctcaggccacgcagagagtcttcctgtatccacaggctcccaaggtctcctccatcgtgagcagcaagtacaggaccgcgtaccacttccagcctcccaagaactggatcaacgatccaaatggaccaatgtactacaatggtatctaccaccagttctaccagtacaacccaaacggctcgctctggggcaacatagtctgggcgcactcggtctccacagatctcgtgaactggatccggctcgcgccggcgatagagcggacgactccgagcgacatcaatggctgctggacaggttcagccaccatcctcaagagcggccggcctgccatcatatacaccggcgccgacaccgagaagcgtcaggtccagaacttggcgttccccaagaacctgtccgatccgtacctgcgggagtgggtgaagccacacgacaacccggtgatccagccggtcggacgagggctgaacccaggccagttcagagacccgacgaccggctggatcggcccggacgggctgtggaggatagccgtcggggccgaggtcgacggccacagcgcggcgcttctgtacgagagcgaggacttcgtgcgctgggacagagtggaccacccgctctactcctccaacgcctccgccatgtgggagtgcccggacttcttcgcggcgatgccgggcgagaactccgggctggacatgtcggctgcggtcccggatggcgccaagcacgtcctcaagatgagccttgacggctctgacaagtacatggtcggcgtctatgatctgaaaggtgacgcctttgtgccggataccgtgatcgaggaccggaggctgtggtcaaggattgactacggcaactactacgcttccaagtcgttcttcgactcgaagaaagggaggagggtcatatggggctggacgaatgagacggacagttcgtcagacgacgtcgccaaaggatgggctggaatccatgcaattcccaggactatatggttggataaagacagcaagcagctgctgcaatggccggtcgaagagatcgagtcgctccgaggaaaacaagtcagacaccaaggcctggagctcaggaagggggatctgtttgagattaaggaaattgacactctgcaggcagatgtggagatagatttcgagctcacatccataggcagtgccgacccttttgacccttcctggctcttggacatcgagaagcagtgccgggaagcgggcgcgtcggctcatggcccgttcgggctcgtggttcttgcttctgagagcatggaagagcacacctccgtgcacttcagagtgtactacagatcacaggagaagcacatggttcttatgtgcgccgatctgaggaaatcgtccttgagaccggagctgtacacgccagcctacggaggcttctttgagctggacctggagaaggaaaagacggtggtatctctgagaactttgatcgatcgctctgcggtggagagcttcggtggaggcggcagggtgtgcatcatggcccgggtctatccggcggcgctcgtcgacgacggcggcactcgcatgtacgcgttcaacaatggcactagcaccgtcagagtgccccggctagaagcgtggagcatgaggagggcacaggttaacaagggatgaggaggaacacaaggccatttgatagctagaggagaggaacagagcatgggcacatgaattaaacacacactgctggtttaatttgctggaattaatcaatcaatcaatcaacaaacacacgaagattaaatcaaaaaaaaaaaaaaaactacactaaatttcagtacaacgaccttgcattgctacttaatcagatccggcgatcggtcggcatcgtcatggctactgcgcatctctgactctgaatgtggccgagtcggtgctcgtgcagaggaggaggaagaagacgaggccagccggtggtgctcgtgcttgagcgccctctcgacgagcatgttgaggaagttcatgagctgcacggcgtgcgcgagcgccgtgagcgggtcgtcggcgcgcgtcatgttgggcgcgaacaccatggccacgttgcgcgtgcccatcttgttagccttctcctcccgcgccacgtccgccatcaggttcaccgcccagtccagcagcgccgccctgggcgccggcagcctggcgccgcagagccgcgcgcagtcctcctccgtctggcaccgcgtcacctcatccgccggcagcgcgtccagcagcccgccagggagctcacggaaccacgcctgcttgcacgtcgtgccgtgcgtgcgtgcgtgcgttgtcagatcatcagatacgcaatgcaacaaatgcaatggcggtaccgtaccttgatgaggcctgcgatgcagtgcacgtccacgccgtctggcacgacgcccgagttgttgagctggtccctggcgtactgctcctgggcgccgtcggcggccaccctgaagatgccctccgccctgaggccgccctggtcgacgaggcggcgctgca

SEQ ID NO: 13745 - DNA, 2160 bp, Zea mays
cattggggtccccgcggccgccccggtcgtctcttctggaaccgtccctcgctcgtcatctttccgccttcgctacgcaattcctgtccacgctgcgggccagttgtgacgaccgcgaagctcgtcagagaaagaagagaggccggcgggcgggcggcgatcggagatggcgccagagaagccccggaaggagcaggagcaggaccaggagaaggaggaggaggaggagttgatgctggaggatggaggcatcgaggagagcccgcgccgcagcttcgaggactgcggtgattccgacgaggaggacgatgacggtgacaacgatgaggagcgggacggcgacggcgtcggttcgccgcgctccttccagtcccataagtggccgcagagctacagggaaacaactgatacttacacaatcgctgcatcaccgagctttggttacttgggcccttctacaagcaaatactcactcctcgatcttggtcgtagtggtcttggttctgacctgaagttgcctctagtgtcggacaaggctgatggaaagcaagattctgtcaaaaccctgccgaaaacccttggttcaataagagatgagagggtctcatttcaattgcaacacacgggagaactctacattactcaagggtgcaatgtgacgcaaacagtcttcaatgggattaatgtacttgctggtgttggccttctttccaccccgtttacaattcatgaagctggatggactggccttgcagttctagtatgttttgcgattgtttgctgttatactgggattcttctgaaacattgttttgagagcaaagatggtatctcaagttatccagacatcggagaggctgcatttggaagaattggccgtctgttgatatctattattttgtataccgagctatatacatattgtgtggaattcattattttggagggtgataacctcacaacaatttttcctaaagctggaattgattggtttggcattcatgttgatgggaagcattttttcggagtgttaactgctattttagtcttgccaacagtatggctgcgagatcttcgagtgctctcttacctttcagcgggtggtgtgattgcaactcttctcgtattcctgtccgttggtttagtcggtgctaccgatggtataggcttccattcaactgggaaggtagtaaactggagtggcatgccctttgccattggtatttatggattttgctactctgggcattcagtatttccaaatatctaccagtcaatgtccgatcgctctaagttccctaaggcactgttcatatgttttgcaatttgcacagcaatatatggatcttttgctgtcattggctttctcatgtttggagagaacacattatcccaaatcactttaaaccttccaaagcattcgattgcctcaaaagttgcactatggaccacggtgatcaaccctttcaccaaatatgccttgctgctaaacccactcgctcgaagtttagaagagttgcgtcctgaaggttttttgaacgaaacatcatgctctattatactgaggactgcccttgttgcgtcaactgtatgcattgcctttcttctgccgttctttggtcttgtgatggctctcattggatctcttcttagtatacttgtggcggtcataatgccagccctgtgcttcctgaagatcgcacaaaacaaagcaacctgtccacaggtgatcgcgagcgtcggtatcgtaatactgggcgtcgtcagcgccgcgctggggacctactcgtccgtgaaaaagatcgcagaaaactactaggcactggggacagtttctctccgcagaggctactaccacacggttgcacgtacgtccggccggagctggggaatggtcagggtttacgtacacgatctcaaagttttgctagaactaccgaaattccctgtagattattactgttatgattcggaccacaatagtctacttatacaaacaaaaaaaaaagaactgcatcatcacatcacttggaataatgtaatcatgccctcctttttttacaaaaaaaaaaaaaaaaatcgctgtacttgtactgtagcaagttgctgtgctggcgactgttccctatacaataaggttctgctttgtgcaattgaggt

SEQ ID NO: 13746 - DNA, 1534 bp, Zea mays
cccacacgtccgatcggcccaggccggttccggccggaacctgcccgaaacccctggttcaatgagagatgggagagtctcgtttcaattgcaacacacgggagaaatctacattagtcaagggtgcaatgtgacgcaaacagtcttcaacgggattaatgtgcttgctggtgttggccttctttccactccgtttacaattcatgaagctggatggactggccttgcagttctagcatgctttgcgattgtttgctgttatactggaattcttctaaaacattgttttgagagcaaagatggtatctcaagttatccagacattggagaggctgcatttggaagaattggccgtgtgttgatatctattattttgtataccgagctatattcatactgtgtggaattcatcattttggagggtgataacctcacatcaatttttcctaaagctggttttgattggcttgggattcatgttgatggaaaacattttttcggagtgttaactgctattttagtcttgccaacagtatggctgcgagatcttcgagtactctcgtacctttcagcgggtggtgtgattgcaactcttctcgtattcctgtccgttggtttagtcggtgttaccgatggtataggcttccattcaactgggaaggcagtaaactggagtggcatgccttttgccattggtatttatggattttgctactccgggcattcggtatttccaaatatctaccagtcaatgtccgatagatctaagttccctaaggcactgttcatatgtttcgcaatttgcacagcaatatatggctcttttgctgtcattggctttctcatgtttggaaagaacactttatcacaaatcactttaaaccttccaaagcattcgtttgcctcagaagttgcactatggaccacggtgatcaaccctttcaccaaatttgccttgttgttaaacccattagctcggagtttagaagagttgcgtcctgaaggttttatgaacgaaacatcatgcgctattatactgaggactgcccttcttgcatcaactgtatgcattgcctttcttctgccgttctttggtcttgtgatgtctctcattggatctcttcttagtatacttgtggcagtcataatgccacccttgtgtttcctgaagatcgcgcagaacaaagcaacttgtgcacaggtaatcgcaagcatttgtatcgtaatgttgggcgtcatcagtgctgccctggggacatactcctccgtgaaaaagattgtagaaaactactaagctcttcgacaataattgcctgcctgcaccagactccacgtatggaactcgaaatggtcaggttttactgtacgaccaaatttttactagaactaccggatttcctgtacattattgctgctgttattattcggaccacactagcctactaaaaaggaacacttccaataatgtaatcttgcgcacctttacctgagttctttatcatgcagctgtactggaaaaaaatttgcggccaaa

SEQ ID NO: 13747 - DNA, 696 bp, Zea mays
  misc_feature (622)..(622): n is a, c, g, or t
attaaaagcttccctcccctgcctctctgctccgctcgtctcttctggaaccgtccctcgctcgtcatctttccgccttcgctacgcaattcctgtccacgctgcgggccagttgtgacgaccgcgaagctcgtcagagaaagaagagaggccggcaggcgggcggcgatcggagatggcgccagagaagccccggaaggagcaggaggaggaggaggaggagttgatgctggaggatggaggcatcgaggagagcccgcgccgcagcttcgaggactgcggtgattccgacgaggaggacgatgacggtgacaacgatgaggagcgggacggcgacggcgtcggttcgccgcgctccttccagtcccacaagtggccgcagagctacagggaaacaactgatacttacacaatcgctgcatcaccgagctttggttacttgggcccttctacaagcaaatactcactcctcgatcttggtcgtagcggtctgggttctgacctgaagttgcctctagtgtcggacaaggctgacggaaagcaagattctgtcaaaaccctgccgaaaacccctggttcaataagagatgagagggtctcatttcaattgcaacacacgggnagaactctacattactcaagggtgcaatgtgacgcaaacagtcttcaatgggattaatgtacttgctggtgttg

SEQ ID NO: 13748 - DNA, 638 bp, Zea mays
gtttagaggagctgcgtcttgaaggttttttgaatgaaacatcatgttctattatactgaggactgctcttgttgcgtcagctgtatgcattgcttttcttctgccgttctttggtcttgtgatggcgctcattggatctcttcttagtatacttgtggcggtcataatgccagccctgtgcttcctgaagatcgcacaaaacaaagcaacctgtccacaggtgatcgcgagcgtcggtatcgtaatactgggcgtcgtcagcgccgcgctggggacctactcgtccgtgaaaaagatcgcagaaaactactaggcactggggacggtttctctccgcagaggctactaccagtctaccacacggttccacgtccggccggagctgtggaatggtcagggtttacgtacacgatcaaagttttgctagaactaccgaaattcactgtagattattactgttatgattcggaccacaatagtctacttatacaaacaaaaaaaaaaccctgcatcatcacatcacttggaataatgtaatcatgccctccttttttagccgaggtccctaccatctcgctgtactgtagcaagttgctgtgctggcgactgttccctatacaataaggttctgctttct

SEQ ID NO: 13749 - DNA, 1725 bp, Zea mays
  misc_feature (204)..(204): n is a, c, g, or t
aattcggcacgaggctctctccgacagcccgccggtctcgccggagatcgatgacgcaaagtactgcagagcggtgagcacgccgaagccgcaggcctaccgggcgggcaacaagacggtggggcggtggctcaaggaccgcaaggagaagaagaaagaggagacgcgggcgcacaacgcgcaggtgcacgcggcggtgtccgntagcggcagtggcggccgccgtggccgccgtggcggcggcgacggccgcggcctcggcgtccggcaaggacgagcgggccgcccgcacggacatggccgtggcgtcggcggcgacgctcgtggccgcgcagtgcgtggaggcggccgagtccatcggcgccgagcgggagcacctggaggccgtggtcgggtcggccgtcaacgtcaggacgcccggagacatcgtcaccgtcaccgctgctgcggccaccgcgtgtgcgtcgcgcggcgtcgctctaggcgtctctagcaggcccggcgcgagcttgcgcgttcagtaacacggacttgctgggttggttgtcttagcgttgagaggcgcggccacgctgaaggcgagggctctgaaggaggtgtggaacatcgcggccgtgatcccggtagagaagggcgcggtcggcggcggcggcggcggcggaggaggagggcacaaccagaagcacggcgcgtccaagcagcagcagcagcatcgcaagctggagagcaacggcagcagcgtcagcgacgtgtcgatggaggaggggaactacttcctcggcatctgcagccagaagcttctcgctcgcggcaccgcccgcctcgaccccgcgcccgcaggcgctctgcactggaaggtcgtatcggtgtacatcaaccggatgggcctggtgatgctgaagatgaagagccggcatgtggcggggacgatcacgaagaagaagaaaagcgtggtgatcgacgtgtgcagggacgtgccggcgtgggccgggcggcacctgctggaggacggcgagcaccggcggtacttcggcctgcggaccgcggagcaccgggtgatcgagttcgagtgcggcagccagcgggagcacgagatgtggaccaagggcgtggcgcggctgctgagcatcgccggcgagcggaggcgcctggtggcgtgacctggcctggccctggactggacattggcggcctgcgtgctcgttgttcggtcgcctcgtgccgtcaccgttcgttcgtcggcgacccgcccgaccgctggggcctggggcctccatccaccgtaccgtccgtccctgtgctaggctggagcacatgcgagaggtcgaaggcaacagagcagagcggcatgggcatttggcgggaggagagggggtatgtagctataggaggtagggttggcaggatcctggtgctgctagggcacgaggtttgaatccgtgtcggtgtgttttcttttctttttttctttttttatgggggggatgcgacgccggtgcatggggcgccatgccttggggtagagatgagctctctgccctattgttctctcttctcttccactctcttgtaagttttgcttctactctttttccctttttcttccatctcgttcggggtgtggccatactgggactgtagctggtgaaagataaatgctttgttactggtagtagcagtaactccgtagtgaccgtagtaaattagcaagcgtctgttctgttc

SEQ ID NO: 13750 - DNA, 6735 bp, Zea mays
gatgataatagttatatagtaaagtttgaaatagtaaactagactgagaacgagacatcgggagctgcttgattatataacacggcttcacaacacagaagaaaatgaaccaatataaatgtccttgtacggctgacagagataatgagtaaaagcgccgaagagcagcaagacctgcacggcgagtggcgaggctattaaaaccagcggaggccttaccttcaaccacatttctgaactggcatcagactcacatcactagtaacgcccccggcccccgctcgctcgcactcgcaggtcgcaccacactccgtccccctccataactcccacccgcgcgcatgggcgatccgcgggcccgcacgtccgccgtggccgccggcgagctgcggccgccggagccggcgctcgacccgctcgagttcctctcccgctcctggagcgcctccgggcgcgcgcccgcgcccacgccgccgccgccgccggccgcgctcgcggccagccccatcgcggaggacgccgcgtgcgagctggacgacgggggcgtcgtcgccgccgcgtccgggagctccttctccttcgcgtccgcggccacgtcgcagctcatcatggaacggatcctcgcgcagtccgtgagagccctgccctgacctgacttcgtccgtccttcctctgctgagtctgctccgcgattcatcttgtctttttttttcttccccctccccaaaaccgcactctctctcttttctcttcctcctgaatgaactagaaagaaaagggcaatcgttaccggtgattaaaaaaaaaattcttggtaacacctagccacctggtccgcattacaaataaaacaaaaaaaagatgcgtgctttggtcgttttttattttccgattcgggataagccccccgttttcccctggctgcattttgctgcacactggtggaacctcccgatctcgtcctctgcctgtaaagagttcgcggaaacgggtggatctttccgtcatctggccagtggccacctgatttgttcgtgattttgcccccctcttccccgcaccacccagctccgctcctgggtttcactctgaccccgtgtttgggctgggacaaggagaaaccgccaaaggagagatttgttttcccgcgacactcggaaacacaagtgtaatcccccctaccgttctctctgcccaagtgtcgccattaatggccaggcctctcccataaagcaccatcaattcctcatgcaaaaaagaaaaaaaaaacatgctttcttcttcatcaccctcttcttcctcgagacgtgattgcggatttccagtcgtatttttcgttcttctgaccctattgtacaaatttctgtatccttatgtctgaaacacgcttgctcatgctgtgtgtgcgtcgcaactcctgcagcaggaagtggcgccgctcacctccggccggctctcgcacagcagcgggcccctcaacggcggcggctccctctccgacagcccgccggtctcgccggagatcgatgacgccaaggtcagtccccgtctcgtagtcggaggtgtactagccgtacgtgctacaggcttctctgcagctttccttttggtttttttttgtcgccacaaccgcgctggtctggcactaacccgcagtttcttgcggcgctaattatgtggctcactcgccgctgctgaacgttgagccgtactagattatttagatgccattagattagctgttttgactgcgtttgtagaataaccaggggtaggtaacccaagcaattccttcctgcttttactgccggcctagtgtatagtggggcacgctgttcgctgtgttcatctgtcggccgtgtcgtgtgctttgattccaagggacgggaaaataatttcttcgtggctcacgccctcgtcagcactcggcagtaaggataagaaaaagggagtgaggagatttcgagccagcttttgtttaatcatttggcattctacagtggtgttatttttgtcggataacagtcaggttacatataatcttctctgatcagttttttttaaaagaatccaatttctgtttacatataccttttgtcactttgtagcagtaataggtttgatctgttttatagtggtactagtaaatacagaattttaataccagtaactagcaccgcagcttcggttagttttgcctgcatttccgaaggcgagtggcagagtgattcacttggcactggcactggcactgtcagcgggagaaaaaaataagagcaggctggcgaggtcacaagcatgattcgtccgcgagagatagggagagggggagggagagcagaccatccacaccacacccacagccataggcttggaagctgtgggtctgcctgcgacaaggtgaccagccttgcagccttccctgtgccgaaagccagtagacaatgaactggtaggcgtggctttcgcgccttccaataaaacccccgaccccgacttgctgcaagccctttgctttttttccccagtgcagtagtcttcggtgcaggagtactgtacagtatagcgtggtgatagtagtgatgttttggcatggacgcgtctctttccatcacccccaccgacaaaccctgcttaaacattgcagcttcatcaggtctctctatgtgtctagccacatgaacaagatggaggcattcctcttcaatgaaaaccgcagcgcgtactaatccagcctggggtcttgttggtcttgtgccgttccacatgcccccaagaaaagacaatgctttatgacagattgagaggtcatggtcaaagtcctgattagcgaatggcgatttggagaggtaaaagccaccaacacaggggcactccggtcattccacccgagctatactccgagagcagagcagctcatcagtcgctcagcttatctacttgtataccgtgggctttgctgtccgttgggcgcagctttaattcctgcgcgcgcctgtcgctggtctcctgcctccgcaagcaaaaacgtccagtctggtagagcagcaccggcaggcggcaggccatgccataccgctctgccctgctgggtgaacaggcagctgcagccggcaggctctcagtcgtagtaggcacgctcgcggtccgtgccgctgccgcatcatgaggctgcactggaccttttcggtccctaatcgagcgttccagccttttctaatccgctttaggccttgttcgtttacgtcagattgcacccggaatcgttccagctaatcaaagtttatataaattagaaaagcaatccggataggaatcgttccgacccaccaatccggtagaaacgaacaaggccgtaatgatgcccgatttagctgatctaggcgggggctagctagcatcatcctctccgctgccctcatcattgtctcctcgtatactgatgcatgcgacgcaatagtttattatagtgctcgtttctgagaaggaatgccggcaggcttcagctttcatttttttgtccaggctacgggttttacactaacattgtgcaagtattggctgatgagctgcacctgcacctttcttcaatcatccactacttaaaaacccttgtatgaaacatgacagatccagtttttttttccaactcgaaatttagcactgaaactgaactaaactatacaccgtaaaactctgcagtactgcagagcggccagcacgccgaaggcgcaggcataccgggcgggcaacaagacggtggggcggtggctcaaggaccggagggagaagaggaaagaggagacgcgggcgcacaacgcgcaggtccacgcggcggtgtccgtggcggcagtggcggcggcggtggccgccgtggccgcggccacggccacggcctcggcgtccggtggcaaggacgagcgcgccgcgcgcacggacatggccgtggcgtcggccgcgacgctggtggccgcgcagtgcgtggaggcggccgaggccatgggcgccgagcgggagcacctggaggccgccgtcgggtcggccgtgagcgtccggacgccgggggacatcgtcaccgtcaccgccgccgccgccaccggtgtgtgtcctcgtcgctcgcctgttctctacagactagactcgggcttgcacgttcagtgtgacgtgatcgcttgttgtgctgtagcgttgagaggcgccgcgacgctgaaggcgagggctctcaaggaggtgtggaacatcgcggcggtgatcccggtggagaagggcccgggcccggtcggcggaggaggaggaggccaccaccaccaacaccaccagaagcacggcgcgcccaagcagcagctgcaccgcaagatggatagcgacggcagcagcgtcagcgacctctcgctggaggaggagaacagcttccttggcatctgcagccaggagctgcttgctcgcggcaccgaactcctcaaacgcacccggaaaggtgacacttttttttctctctctctctcttctccctgtgatcatgctgctgtgcgtgcgtgcgtgatggaatagggatggatgtcgtgctgctgtgtacgtacgaccattccggatcatgatgtgctactgttagcatagaatggatgtcgtgctgatgtttttggtcctgtctacacacatgcaggcgctctgcactggaaggtcgtgtcggtgtacatcaaccggatgggcctggtaataaaacgagtggcttctgcactctgctggacagttgttgtgatgacgtttcgcttgatcaaaaaaaaatattcgtgccttttgcaggtgatgctgaagacgaagagccggcacgtggcagggacgatcacgaagaagaagaaaagtaagaggcagcagagaaacaaccgcgcatgcgcatggcttcagcagcagcagcgtgccactgctgcactgttgtgtttgtccgtgcagctgacgagcgtgtccgtcactgtcgctgttgccgtgcaggtgtggtggtcgaggtgtgcagggacgtgccggcgtggcccgggcggcacctgctggaggacggcgggcaccggcggtacttcggcctgcgcacggcggagcggcgggtggtcgagttcgagtgccgcagccagcgggagtacgagatgtggaccaagggcgtggcgcggctcctgagcgtggccgccgaagcggaagcgcctggcgtgacagattgcgtgcaggtgcagccccgtgccgcacaggaattatgtaggtaggtatgctagggcacgaccgcacgaggttggattgggtttgtggcggtgtggttttttgtacgggctgggatgcgacgccggcgcgtggaacgccatgccatgcccttgtgggtgtgagaaggcgcttgctacgctgagctgagctctgaccttgttctggctctctctctttctctttcttgtaagttttgcgtctactctctctctctctctcgttgggccatactacactgtagctggcgaaagataaatgctttgttctggtggtagtagtaactctgtctttgaccggacagtcgatgtgtttggttcccgtggtttggccatcaccatcatcctgtcctgaccgagcaacccgaagccgaggggcgctgctggtccggcaacagcgacaacagcgaaatgcaagtgcgctggagtatctgagcattctgtggtacaagaccctgtcgaccagctcggtttcccaacgtttgcgctgaccgctgagcgtgtagccgcgtacagattgaaagcttagggcgtgtttgtgaccttggcccagctcggcccgttcaactggtccaggctgaggctagcctgtcccggctactgcaactcattttgtttgtgcacctgtaccatatgagtctgacttagacgagttgatgtttgtcactcaatatacagccgggctagaagaccaaaactacctaaacgtggaatccttgcgccacgagcagccagactcctagaaaatggaccttgagctcgtttctatggagtcaggctgagaggctaaatttgcacgcgtatagtctggcttccgaacaagccagacgacgcaaacacaggagctgctgagccatggcggcaaacacgcccttagtagctgatggccgcagctcatggggtgtggtgtgcgtgctcgagaccggtggcgcgaagggcggacggcatccgcatcgctttcgcttttcccggccggcttttgctgcgaggaggaaggaacaaacaacacatgcgttactgctcctcctactacacgcagcggtcgatgaggaatctgatgcaaacatactagaggtactggaggccagggtttggactatggagcacggatctgactgactgatccgatgcaaagggaacggatgcatgcagcgctttggcgacaacaatgatcaccaccaccactccaccagcagcaggaggcaggcactcgagatgggatgagaatctctctacttgttgcttttgccatgcccgggacgttgcctgttgacgtcgggagaggtaaaaaaaagaagagagaagcggcgccgtcagatcagaccgtgaccatgggaatgggatgggaggaagagggtctttggccgatcgaggcgcttgtgatccaggcagagacgagacaacagacgaggtcagctcaggcggtcattcgttcgggttcaacagatgcctgcgtgccggagcccggagggaggctctttggcaaatcaaatcc

SEQ ID NO: 13751 - DNA, 1549 bp, Zea mays
  misc_feature (290)..(290): n is a, c, g, or t
gtttagtactcctttctgacaaggaatgccggcaggcttcggctttcattttgtcccaggctacgggttttacactaacattgtgcaagtattggctgatgagctgcacctttcttcaataatccactactacttaagaaccctttactgcagagcggccagcacgccgaaggcgcaggcataccgggcgggcaacaagacggtggggcggtggctcaaggaccggagggagaagaggaaagaggagacgcgggcgcacaacgcgcaggtccacgcggcggtgtccgtgngcggcagtggcggcggcggtggccgccgtggccgcggccacggccacggcctcggcgtccggtggcaaggacgagcgcgccgcgcgcacggacatggccgtggcgtcggccgcgacgctggtggccgcgcagtgcgtggaggcggccgaggccatgggcgccgagcgggagcacctggaggccgccgtcgggtcggccgtgagcgtccggacgccgggggacatcgtcaccgtcaccgccgccgccgccaccgcgttgagaggcgccgcgacgctgaaggcgagggctctcaaggaggtgtggaacatcgcggcggtgatcccggtggagaagggcccgggcccggtcggcggaggaggaggaggccaccaccaccaacaccaccagaagcacggcgcgcccaagcagcagctgcaccgcaagatggatagcgacggcagcagcgtcagcgacctctcgctggaggaggagaacagcttccttggcatctgcagccaggagctgcttgctcgcggcaccgaactcctcaaacgcacccggaaaggcgctctgcactggaaggtcgtgtcggtgtacatcaaccggatgggcctggtgatgctgaagacgaagagccggcacgtggcagggacgatcacgaagaagaagaaaagtgtggtggtcgaggtgtgcagggacgtgccggcgtggcccgggcggcacctgcctggaggacggcgggcaccggcggtacttcggcctgcgcacggcggagcggcgggtggtcgagttcgagtgcggcagccagcgggagtacgagttgtggaccaagggcgtggcgcggctcctgagcgtggccgtcgagcggaagcgcctggcgtgacctgacccgaccgtcgtcggtgacctgccgacgctccccccgcccaccgttcatttgcttgtgcaggtgcagcctcgtgccgcacaggaattatgtaggtagccaggtaggtatgctagggcacgaagttggattggatctgtggcggtgtggtttttttgtgctggccgggatgcgacgccggcgcatggggcgccatgccatgccgttgtggcctgtgggtgtgggaaggcgcttgctaagctgagctgagctctgaccttgttctggctctctctcttgtaagttttgcgtactctctctctctctctcgttgaggtgtggccgtgtggccatactacaactgtagctggcgaaagataaatgctttgttctggtggcaaaaaaaaaaaaaaaa

SEQ ID NO: 13752 - DNA, 1477 bp, Zea mays
gcacgagaccattacctagaacatcctaatcgaaaagacgcaccgcacaccctagcataggaggcaaagaagtacagagggaggaggcgggcagcagatacgcggcgtgacagacacccagggccaggaagggtgctgtttatccatgctgctccggctgaagatcgtcgtcggcgtccactcggtggtgctcccggttcctgttccaggcggctatggccatggcgcctgctacgcggcagtagagccctgctggcgccgcagccggaggccagcgctagcggcggcgggtggcctcgtcgcgaggcggccgaggcagagcgccacggtggtgatggcgctgaaggaggagccggagggcagcagccgccgcggcttcgccggcggcggtccgagctgggaccccgggctggagatccaagtccccttcgagcaaagaccggtgaacgagtactctgctctcaaggatagcgccctctactcgtgggcggagctgagcccagggtccttcttcctccgcctcggcggcctgtgcctcgtgaccttcactgtgctcgcggctccaattgccgccgcaagcttcaatccaggaaaggatccactcaagttcgtgctagcagctgggatcgggacgctgcttctggtgtcactggcggttctcaggatatacctggggtggagctacgttggtgatcgcctgctgtcagcggtggtaccgtacgaagaaaccggatggtacgacggccagatgtgggtgaagccaccagaggtgttggcccgtgacaggctcctgggatcttacaaggtgaagccggtggtcaacctgctgaagcagacgctggtgggcaccggcgcgctgctcgtgggcgccgtgtcgctcttcgcgttcgccgcgccggtcgaggacttcctccacgccctgagccagcctccctcctccgccaccgcctcgtccaagccgagcttgaggaaggaggagctgctgcggctaccagtcgaggtgatgcaggacgacgacctcgctgcggccgcggccgaggccgccgacggccggcccgtctactgcagggaccgctactaccgggccctcgccggcggtcagtactgcaggtgggacgacctgctcaactgataaatacctagagcagtattgctgtggtacgacgcggcaggacaggacgtattttttttgtcagatgggaaatttcggactgaactgctagaaattgagttcttaatggcacacaagcataaggaacagcaagaaaaagcaacacagaatcagagaaaaaacaagagtttatatattcacttttctctctttgtttctggagttacatctggtctttccgtttcttgagttacctctgatctttttgtttcttgagttaaaaaaaaaaaaaaaaaccttttatttacagcaaaggatgcaagggttaatacacattacagtgtgtacttttcagtttctcccctc

SEQ ID NO: 13753 - DNA, 1689 bp, Zea mays
  misc_feature (11)..(11): n is a, c, g, or t
aaaacggcgtnatactggcttcgataatcacgagaagggcaccgatctgggaaggcattgtcttgttgtactttcccttccggcagtggcctcgattcgcatccccttttcccgtccatgcgcgcgccggcgggcggtgccagtgccagtgccaccgcgctcgcggcggccatgaacattaagcagccgctgcacggcgcatcgacgctgttcgcgctgctctccctctcgctgctcctcctccgcctgctcctccgcctccgcctggcggccttccgcgacgcggcgctgtcgctccacctgctggcgcgcctccgcttccgccccgtcctcctctgcctcccgtcagcctgccacgacggcggcgccggcgccaccacgctgcgcgtctggtgccccgccgccccatcctccaagccgccgctgctcctcctccacggcttcggcggggacgccaagtggacgtgggcgcgcaacctcccgcgcctgtcccgccacttccacgtgtacgcgccggacctcgtgttcttcggcgcgcagtcccggtccgcgtcgccgctgcgctccgtggcgttccaggcccgctgcgccgccgaggccatgcgcctcctcggcgtgccccgctacgacgtcgcggggatcagctacggcggcttcgtcgcctaccggatggccgccgccgaggccagggacgccgtgggcaggctcgtcatcatgaccaccggcgtcgcggccacgcccggggagatgcgggcgatggcggcgcgcgaggaccgcaccgtcgaggatgcgctgctgccggacaccgccgaggggctgcgcttcctcgtaagacgctccatgcatcgccccccgccttggatgccggacttcgtgcttgacgacttcatccagctcatgtacgtggaccagaaaagggagagggcagagttgctgcacgaacttctcaagaccggagctggcttcgaccccctgccggttcttacccaggaaacactgatcatctggggcgacaaagaccaggtgttccccgtcgacctcggccacaggctgcacaggcttctgggcgagaggtccaggctagagatcgtcagggacgcagggcacgcgctgcagctggagggcgccgaccacgtcaaccgctccatcaagtcgttcctcctggacgagcgggtcggcccgggagccggcgcgggccgcaagtaggacgaggccttctcccgtccaggcccacaagcaaacggaggcctgctcgcagtcgcaggtgcctgcgtacttgcgttgcagagctgcaatgcaacagtgccaacgccagctgtagttaagcagcggagcggcaatgacctgcacgcacgcagacgcccccaccgccccgcaatcatgcagcgctggggctactggttacataagtacagagaagcgtcgctccggactactagtttgttttgtacaataatgtctgaaagaatgagcttgtgcggccgaaattccgagagctgtcttttgtctggtgccctggcgcgcacagtctgtctctgttgtttctttaggctcagccttatgggataacgacatatttaggacagctccaacaataatttgtaagctaaattcaagcattttattttatatttcaataaaaaaaaaaaaaaaaagctacctcctcatcaaaaaaaaaaaaaaaaaaaa

SEQ ID NO: 13754 - DNA, 1671 bp, Zea mays
aaaacggcgtagcatactggcttcgataatcacgagaagggcgccgatctgggaaggcattgtcttgttgtactttcccttccggcagtggcctcgattcgcatccccttttcccgtccatgcgcgcgccggcgggcggtgccagtgccaccgcgctcgcggcggccatgaacattaagcagccgctgcacggcgcatcgacgctgttcgcgctgctctctctctcgctgctcctcctccgcctgctcctccgcctccgcctggccgccttccgcgacgcggcgctgtcgctccacctgctggcgcgcctccgcctccgccccgtcctcctctgcctcccggcagcctgccacgacggcggcgccggcgccggcgccaccacgctgcgcgtctggtgccccgccaccccatcctccaagccgccgctgctcctcctccacggcttcggcggggacgccaagtggacgtgggcgcgcaacctcccgcgcctgtcccgccacttccacgtgtacgcgccggacctcgtgttcttcggcgcgcagtcccggtccgcgtcgccgctgcgctccgtggcgttccaggcccgctgcgccgccgaggccatgcgcctcctcggcgtgccccgctacgacgtcgcggggatcagctacggcggcttcgtcgcctaccggatggccgccgccgaggccagggacgccgtgggcaggctcgtcatcatgaccaccggccgtcgcggccacgcccggggagatgcgggcgatggcggcgcgcgaggaccgcaccgtcgaggatgcgctgctgccggacaccgccgaggggctgcgcttcctcgtaagacgctccatgcatcgccccccgccttggatgccggacttcgtgcttgacgacttcatccagctcatgtacgtggaccagaaaagggagagggcagagttgctgcacgaactgctctagaccggagctggcttcgaccccctcccggttcttacccaggaaacactgatcatctggggcgacaaagaccaggtgttccccgtcgacctcggccacaggctgcacaggcttctgggcgagaggtccaggctagagatcgtcagggacgcagggcacgcgctgcagctggagggcgccgaccacgtcaaccgctccatcaagtcgttcctcctggacgagcgggtcggcccgggagccggcgcgggccgcaagtaggacgaggccttctcccgtccaggcccacaaccaaacggaggcctgctcgcaggtgcctgcgttcctgcgctgcagcgctgcgaccgtgcgaacgccagctgtagttaagcagcggagcggcaatgacctgcacgcacgcagacgcccccaccgccccgcaatcatgcagcgctggggctactggttacatcgcccccgcgtcccgtcgctccggactagtttgttttgtacaataatgtctgaaagaacgagcttgtgcggccgaaattcggagagctgtctttatctggtgcgcacagtctgtctctttgtttcttcatgctcagcctcatgagataacgatatatttatgacagctccaacaataatttgtaagctaaattcaagcattttattttatatttcaataaagaaagggagaaaagctacctcctgatcaaaaaaaaatgttagataccaaaa

SEQ ID NO: 13755 - DNA, 897 bp, Zea mays
cattgggtacctcgagtccggccggccggcgcccgacccacaccacaccacgcgggagcggggcgggcaccagaagcagacggcgagcgagcgacacacctctcatctgcccgcccctctcctccgtccagcctctccccctctcctctcctctcctcccaaaacaagagcagcgagacgcgcgcgcgcgcgccacgagctggtggaacctcgccgcctcccgcggcagatctcgcgccgagccctggtttcgacgcgagatccgcgcccgccgtccgccgctcgccgcctccgtcccggagcattaccaggattatacttccaccttgaagatggcgatcggattactagcgtttgagagccaccaggggctctggaacagcggatactattcacagttgtttggaattggaggagttctcatcactcttaccattcttatgttatccacgggctactttgggggaattggtgccccatttgctccatatttctggccgtatctaggacaagttccaaagaagagggaacgcaaaaggcctgtgagagtgtacatggatggatgctttgatctcatgcactacggccatgcaaatgcattgcggcaggccaagttgctgggcgatcagcttgtagttggagtggttagtgatgaggagattgtggcaaacaaaggtccacctgtcctttctatggaagagaggttgactcttgttagtggtctcaagtgggtcgatgaggtcgttcccaatgcaccctatgagataacagaagaattcatgaatactctcttcaacaagtacagcattgattacattattcatggagatgatccttgtcttctacctgatggcactgatgcatatgcgctagcgaagaagtcgggcgttacaagca

SEQ ID NO: 13756 - DNA, 2437 bp, Zea mays
gattcgatttttctccatgttttttgggtttgggattagaaacttatcggtttcaatttttggtttacaatttttacccattgatgtcccgatgtccggtgaaggttcgaaatagttaagtcatgaatttgcttgatgtttttttttcaccttttatgtgtatatgtgagtatcttttatgtgtatatgtgagtatggaatatatatcatatatgtgctcgtagaatgtttgtattgttttccggtattgccacgcagcgatggatcttaggttttaaataactactatgacatttgacttttttgtcttaattttgaccaattgtgttattaaaaaagtctagaaattttattgattttcactgcatcttggtttagtatataataagccttaaatgtagctataaattattttggattttttaaaaatcaagacaagtggtcaaagtcgagactaaaaaagtcaaacgttaaacgacatatatttacgaacaaaggtagtatttaggttttgaggactcgtcaaattttgttctgaatttgaattatcacctaatttagtatttagggtggttttggatttccgttcgagttttaggtttggactcgaatccgtcgtgttgccattggcaagcgcacacacctgttcatttcagattttttcaattagttttttaaaaaatctggttgttagaagaatttaagtattgtagggattatatgcggctgaagataaaagatccataggttttatgatatagaaactggcggatttctaatatcgcgaggactcgactgattacatatttcagattttggatgacttttattttatataaaactagctgaaaagctaaatatttggtaatcagtgaagacaggctcagaaaagagaaaaactaaaacaaacggggcccaaacccgcagcgccgatcgttgaactgagaaacccaaacccccgcacccctgaaaggcaacataaatgcacacccgctctgcacgaaccgcaaggcgctggctggctagctgacaccgaggagccggggcggaatccgtccgctgcagcacagccgcgcccgggggaaaccgccaaaaccccgtaaaaagtccaggaaaaaacaagcccaaagcgggcgagtgcgcggccgcgggcaagcaaccggccacccacctagctcggctccgctcagcggcagcaccgcaggccgcagcagcacggcatgggcgcaaacactaaaaagaagggagcggccgcgcctccaccccaaacccacctcgcctcctagtccccccacttcgcctcctctcccgagtcccatcggagcccggagctctctcgcctcccgcgaggctgtgtggtgaggcgcggacgagatgaacgagcaggggctcggtggtctcggcgggggccgcggggccgtgcaggggcacgggcgggaggcgatggcgctcctgcagcaccagcagcttcaacagcaacggcggcagctggaggaggaggatgaggtgcggcgccagatgttcggcggggtggcggcgttcccggcagcgctgggccacggccagcaggtggactacggggaggacgccggcgggctcggggacagcgacgcgggcgggtcggagcccgagccaccgccggagcggacgcgcggggggtccggcggcggcggcggcaagcggagccgcgctgccgaggtgcacaacctctccgagaaggtggtgccgttgtcatttcttgaaatccgagttctttctccccgcgctgaagagtaaagatcgttgtttgggtttttatgtttttttggcgcagaggaggaggagcaagatcaacgagaagatgaaagcgctgcagagcctgatacccaactccaacaaggtgagtggaaactgacaagagctctttctcactctctcgttcgcttgcaaaggttgttcagttgttagtcctggacttgaccgtaatgtgtttctgctgtgatggtttttgggagtgcagaccgacaaggcatccatgcttgacgaggccattgagtatctgaagcaactgcagctccaagtgcaggtgagcaaataggacacgtccacatggtgccgatgcatctttctggtacaaaacattgacgtagaattggtacaatagaaagtacccggccataatgattcttcatcaaatccgtgacgacagacttgcatgactcttgagttgaggccacttgccttattataaccagcaagggccttcgcattatgtgtgatcctgtgatgggtgcttcgtttttattatttttgaagagacagagacagcttcattagtttgccgataccttccattttcatttgtttaaaatttaggtttgccgagacaccactgtggctaaactattgatcgatgccaagcttgcatgttgttttgttaagtaaaagcatgtcccgc

SEQ ID NO: 13757 - DNA, 2254 bp, Zea mays
cggacaggagctccaccaccaccgcctcctccaggagctccacctcccccacccccacctggaggtggtggaagaggacctccaccacctcctgcacctagagggcatcttggtggtcctcctccacctccaccaccaagtggacgtgcaccaggtgtgccacctccacctagagcaccaggtgtgccgccaccaccaggaaataatccatccttaggcagaggacgtggggctgtacgccctctgggatcagcttatggggctgctgcctcacgtaagtcaacattgaagccattacactgggttaaagtgacaagggcccttcaaggtagtctgtgggaagaattgcagcgcaacgatgactcacagagtgtttcagagtttgatatatcagaacttgagagcctttttcctgcagctgttccgaagtccgatgacagctcaaaatctgaacgtagaaaatcacttggatcaaaaccagaaaaagtgcacctaattgagttgaggagggcgaataacacagagatcatgctaacaaaagttaagatgccactctcggatttggtgagtgcagctctggcgcttgatcaatctaccttggatgttgatcaagtggagaatctcataaagttctgtcctacaaaagaagaaatggaacttctcaagaattacaccggagacaaacaaaatctggggcagtgtggacgcccccccccagaattgatgaaagtgcctagaatggagtcaaaactgcgagtattctccttcaagatccagtttggttcacaagttgctgatcttagaagaagcttgaatatcatcgactcttcatgtaatgagatccgaacttctctcaagttgaaagaaataatgaagaaaatccttctccttgggaataccctgaaccagggaactgctagaggtgctgcagttggcttccggttggacagtcttctaaaacttacagatacccgggcaacaaataataagatgacactaatgcactacctctgcaaggtacttgctgcaagatctccacagcttttaaacttctatgtggatcttgttagcttagatgctgcatcaaagatacaactaaaaatgttggctgaggaaatgcaagcagttagtaaagggctggaaaaagttcaccttgagtatgatgcttcagaaagggatggtccagtatctgaaatttttcgtgagaaactgaaagagttcaccgacaatgctggagctgatgtgcagtcgttatcttcattgttttctgaagtgggtaaaaaggctgatgcgttgattaagtattttggtgaggatcctgttcgctgcccctttgaacaagtaatctctaccctcttaacatttgtaacaacatttcgaaaagcacatgaggagaacctgaagcaagctgagcttgagaagaaaaaagctgaaaaagaggcagaagcagagaaggccaagaacgcacaattaactggcaaaaatgactctaaaccatcaaatccaagacggcaagctaaacaaaccttagagaggacaaggtctgcaagcagacgaggaagagatgttgggtgataacccgaatggtcagtaattttctgtgcttctgatctgctcgcgaggctaatggacgaccgctgggcaagagaagtttcatggacggacgctggcatccgtcgggtgcagcgcgatcgcatcaaagaaaactctacaggccacccttcaacggtctcactggagaatgccgacgtctgtttttatccatgtcggccatcagggtccagtgctaacttctgactgctgtaaagaattgctaacactgacgctaactccattctttcttttcttttttcatgttacttttccattctttctaacaacggtggccaagtacagccatggcttcgaaaaactaccgcctggtgcttaggtggaaaattgtaaaaaataggcatctgggtgaaaaaaaggtatggagataatctaggtggcaaagagtatcaggagtaaatatgtgatgcaaactcagccagtagtttagctgtaaagttttgtagtgagtgtgtattgccgccactttgtattctatgatcatgaagcagtgaaggcggcgttttctttacgatacgtagtcagatagccttgtcggctacgtgtcgcctgtgtacgtgtgatatatgtgctgtcaattgctgttatgattcaaccttgccaaaattaggcatgattcaaatgcatctttagttagcgtcct

SEQ ID NO: 13758 - DNA, 769 bp, Zea mays
  misc_feature (56)..(56): n is a, c, g, or t
aattgagcctgcacaagcatcacaaatgtttgctgcagttggtgggggcaacatancagcgtcaagctctggggcagtgatgccaccagtaaaccaaagttcaggacttcaagtatttgatccattaaatcctccacgagaccaaccactgtcttttgtattaccaaatgtagccaaaaccattcaggaagctccctttcacttggaatcatcgcagttccaccctcgaccatttcgaatgcctgaatcttctgagatgatgcttccaggtgaggtagtggcaaagcaccagctaacttcaattcaaggaagagttagtatgccaggaattggtatgaaccccattaggcaagaatcatccactgtaaaagctgatcagtttgatggttgctcacatagcaaagagtgactacgagatatgtgccacaaaatgcatgacaagttcagcttaggaaatggcaaccgatgaggaccgaaggcaagatgacacagttcagtaacccagctgacagcctggcacgcaggcttcccctttattttcctctgttactgcaatagtaacttaaatttttaggcttcccctttattttcctctgttactgcaatagtaacttaattttttttaggcttcacctttcctttttgtttgaaaattagcagggcagtattaattaatagtacaaaaccatgtatcaccaagatttcaggggttgaaacttgaaatgccaatattcaccaagcttagtttttgtcaaaaaaaaaaaaaaaa

SEQ ID NO: 13759 - DNA, 1437 bp, Zea mays
cattgggtgccccgggccccgcgctcgctgcgcctgcgtgcgtgtgctcgcctcccaccctccccgcactagctctgcactttccctggcagtcgtcccttgttcctgacttcctgcctgagcgcatccggccaccttctatccgcccgccagtccccgccggcctccgcggatcatctgcctgggatcaagatccgtcgaggccgaggcacccgcgcgccaaagatcgtttcttgatctaaatttgggtggtcgtagggatcaaagctcggttctctgcggtgcagttgagagggcaccaatattcttggcatggtggctgacacggaaagctcagattcactgcctggcagttcaaatgctgcttctgagatgcctgctaatgggtctattcaccgaaagtctcaggaaaagccccccaaaaaaacacataaagctgaacgagagaagcttaaacgtgatcagttgaatgacctttttgttgagctcggcagtatgctagatcttgatcgacaaaacactggaaaggctacagtgctaggtgatgctgcgcgagtactgcgagatctaatcactcaagtggaatctctcaggcaggaacaatctgctcttgtatcggagcgccaatatgtcagttccgagaagaatgagctgcaagaggagaacagttcgctcaagtcccaaatatcggaactacaaaccgagctctgcgcaaggatgaggagcagcagcctgagccaaaccagcatcgggatgtcggatccggcaactcaccagcagatgcagatgtggagcagcattccccacttaagctccgtggccatggcggcgcgcccagcaagtgcagcgtccccgttgcacggccaggagggctactctgctgacgccggtcaagcgggctacgcgccgcagccgcaacctcgggagctgcagctctttccggggtcatcggcatcgtcttcaccggagcgtgaacgttcttcccggctcggaagcggccaggccacgccgccgagcctgacagattccttgccgggtcagctctgcctgagcctcctacagccatctcaggaagcaagcggcggcggcggcggcggcgtcatgtcgcgcagcagagaggaacggcgggacgggtagccaactgacagacaacgcacttgaatcggggtgtgtggcggcggcggcgattgtcctgtaaataccaagaattccctccctttactgtggctgtctcgttcatccagaactaatgctggtaaataaccctgtgttgagcggcagctctgcttgttctagaagcttctgagaacatgtgtggcagtgtgggctatgttttccatgagattgtaagatgtgaggtggagccgctagaacacttagcgtgcgttttactgacagtgtggagcgctgctccttagttggaatagaaaatgcaat

SEQ ID NO: 13760 - DNA, 1750 bp, Zea mays
tgggtactcgagccggccgggccggggctgcgcctgcgtgcgtgtgctcgcctcccaccctccccgcactagctctgcactttccctggcagccggcccgtgttcctgacttcctgcctgtgcgcatccggccaccttctatccgcccgccagtccccgctggcctccgcggatcatctgcctgggatcaagatccgtcgaggccgaggcacccgcgcaccaaagatcgtttcttgatctaaatttgggtggtcgtagggatcaaagctcggttctctgcggtgcagttgagagggctccaatttgcctcgcatgggggctggcacggaaagctcagattcactgcctggcagttcaaatgctgcttctgagatgcctgctaatgggtctattcaccgaaagtctcaggaaaagccccccaaaaaaacacataaagctgaacgagagaagcttaaacgtgatcagttgaatgacctttttgttgagctcggcagtatgctagttctgccattacagatcttgatcgacaaaacactggaaaggctacagtgctaggtgatgctgcgcgagtactgcgagatctaatcactcaagtggaatctctcaggcaggaacaatctgctcttgtatcggagcgccaatatgtcagttccgagaagaatgagctgcaagaggagaacagttcgctcaagtcccaaatatcggaactacaaaccgagctctgcgcaaggatgaggagcagcagcctgagccaaaccagcatcgggatgtcggatccggcaactcacaactcaccagcagatgtggagcagcattccccacttaagctccgtggccatggcggcccgcccagcaagtgcagcgtccccgttgcacggccaggagggctactctgctgacgccggtcaagcgggctacgcgccgcagccgcaacctcgggagctgcagctctttccggggtcatcggcatcgtcttcaccggagcgtgaacgttcttcccggctcggaagcggccaggccacgccgccgagcctgacagattccttgccgggtcagctctgcctaagcctcctacagccatctcaggaagcaagcggcggcggcggcgtcgtgtcgcccagcagagaggaacggcgggatgggtagccaactgacagacaacgcacttgaatcggggtgtgtggcggcggcggcgattgtcctgtaaataccaagaattccctccctttactttggctgtctcgttcatccagaactaatgctggtagctgccctgtgttgagcggcagctctgcttgttctagaagcttctgagaacatgtgtggggtatgttttccatgagattgtaagatgtgaggtggagccgctagaacacctagcgtgcgttttactgacagtgtggagtgctgctccttagttggaatagaaaaatgcaatttgatggctgtgctgctgtcttgatctgctatcttcctgctcctggtgataagttatccagcacatgtaatcatgccgtctttcaaacaatgagaagagcaggtcaacccagactgatgcgagtggcacagcagcgtgccaaataaggtgaagaggtcatccacagttgacagttctaaacatcgcgagaatgatcacccctgtccccaatccgaatcccaattatccaagggtggcagttggcagcacaccagcaccagtttaacttggccttggggttttggccctgccccccaataacaattaattttt

SEQ ID NO: 13761 - DNA, 1128 bp, Zea mays
cccccagcgaagcggaacgcgaacaaccggatctgcatcgccgaggccggtgccatccccttgctactgagcctcctgtcttcgtctgacctgcagacgcaggagcacgccgtgacggcgcttctgaacctctccatacacgaggacaacaaggcgagcatcatactgtccggcgctgtcccgggcatagttcacgtcctgaagaacgggagcatggaggcacgggagaacgctgcggccacactcttcagcctgtcggtggtggacgaatacaaggtcacgatcgggggcacaggagccatccctgccctcgtggtcttgctgagcgagggcaggcagcgcgggaagaaggacgcggcggctgccctgttcaacctgtgcatctaccaggggaacaagggccgcgccatacgggctggcctcgtgccactcgtcatggggctcgtgacgaaccccaccggagctctgctggacgaggccatggcgatcctgtcgatactgtccagccaccccgagggcaaggccgcgatcggggcggcggagcccgtccccgtcctcgtggagatgatcgcgggtgggtcgccgaggaacagggagaacgctgccgccgtgatgctgcacctgtccgccagcgtgcggcagtccgcgcatctggctcgggcgcaggagtgcggcatcatggccccgctgcgggagctggcactgaatggcacggggagggggaagaggaaggccgtgcagctgctcgagcggatgagcaggttcctggtccagcagcaggaggacgcggtggatccacgtgtgcaggagctggaggagatcgagcgccagcttgccgcctttggacctggcgttacggaggctgatgtccttcaacagttgggagctctttaacctatggtacatttttcactatgatactactatacttacatagaaaagttctagcggcggactttattatcagtaaaatctcagttctagctactgaatgttagcgtgggtttcggatttcaagatttttatggtcatgcgtgtatatgcatttgcgattttgacattgtcagtaggtggtatcgtagtctacggcagtgccagttgcaacgagaatgccatttcatgccgtcg

SEQ ID NO: 13762 - DNA, 1089 bp, Zea mays
aatagaagttgcttggttcaaaaaaaaaactcgtctctctcgggggccgcccctccccacacgtggttaatttctcgctttggttgcaggcaatgtcgtatccttcggcctcttcctctccccagtgtaggcgctcatcgatcggtccgggttcatctggctctgggtggttttttgatttggttagggttttgtttgtactgatatatggagaggaactgagaccaactgcggtctgcggcactgcgctcgccgccagcctccctagggtttccttccccgtcgaccatcagcgcctccccagatttggacctaagccctcgcggacgtgcgcgccggccgcctggttgccggtcgaatccgccctccagccgctgccaacgtcgatctgctactgacgcaccgcaagggagcatttagctgtagtgagatggatatcctttatcagtgtaaggaggttttgaagatccagaagtttcggcgtatggtgtcatatgctggattctactgcttcacttccctcattacttatgcttacacaagcaatacgacaagggctgggatgtcaagggctgaccagtattattcctcctaccctgctggtactgaactactaactgacactgcaaagctttacaaggctgcattgggcaattgttttgaagtagatgaatggggcccaatagagttctccatcatggcaaaacattttgaccggcaagggaaaccaccatatgcctaccatgctcaatatctggcacaccttctctcccatgggcagctcgatggaagcggttaaatgcaggatgtattgttggtaactgcatcaacgcaactagaatttcactatatcttgtataaaaatgttgcctttgctagaacaatgagttcagactgcaccagtttagaagttacagaactggcatcagaaacaagttctgaatttttttggtcattggctggtacgatatcagtgttgaatttgtgcgatcgccgaacaatttctgaaaaaaaaacatgaccttgtcttgttggcaaaaaaaaaaaaaaaagcggccgttgaataaaccactgaatgttaatgcatgc

SEQ ID NO: 13763 - DNA, 2225 bp, Zea mays
ccggccgggaacacccgccgtcacttatccgcgccgcggcctccccgcccccgccactcatcagaaacccccgcaccctctaactaaaccctcaccggccgccacccatggcgatggccggcgccgccgccgccgccgccggtcgctgcctcctcctctcccgcccgtcccccctccggctccgcctcctccacgctgccctctccaccgccgcccccaccctcggccccacctccactccggctccccctccgcggcacgagctcctcctcgagcgcctccgcctccgccacctaaaggacgcctcctcccccggcgccccgaggcctacctcgaggagctcggagcggagctcgcagcaggggaaggggaagagggtcgaggccgcggagagcttcgaggagctcggtctcggggaggaggtgatgtccgcgctgggggagatgggcatctccaagcccacggagatccagtgcgttggcgtgccggcggtgctggccggaaccagcgtcgtgctcggctcccacaccggatccgggaagacgctcgcctacttactccctcttgttcagctacttcggcgtgatgaggcaatgcttgggatgtcaatgaagccaaggcgtccaagagcagtagtactctgccccaccagggagctaactgagcaggtttatcgagtagcaaagtctatcagccatcatgcacgttttcggtcaacgatggttagtggaggcacccgtctaagaccccaggaagattctttgaacatgcccgttgacatggtcgttggcactcctggaaggattcttgatcatatcaaggatggtaacatggtttatggtgatattaagtatctggttctggatgaggcagatacaatgtttgatcaaggctttggaccagacatacggaagtttcttgctccggtgaagaatcgtgctgcaaagcctgatgatcaaggtttccaaacagtattagtcactgctactatgacaaaggctgtgcaaaagttgattgatgaggaatttgaaggtattgtccatttgcggacatcatcatttcaaaagagagtttcaacagcacggcatgactttatcaaactttctggagcagaaaacaaacttgaggctcttctgcaggttcttgagccaagcttggcaaagggaaacaaagttatggtgttctgtaatactttaaattcaagtcgtgcagtggatcattttttaactgaaaatcatatatccactgttaactatcatggagaggttccagctgaagagagagttgagaacctgaacaagttccgcaatgaagagggggattgtccaacattagtatgcactgatctggcagctagaggcctggacctggatgttgaccatgtcatcatgtttgacttcccatcgaattctattgattaccttcacagaaccgggagaactgcacgcatgggagccaaagggaaagttacaagcattgtggctaagaaggacgtagctttagctacacggattgaagaggccatgaagaaaaatgagagcttggaagctctcacgactaacaatgtcagaaggccaaccagctcgcagagtgtgaacacgaaagggaggccctcaaggttggttaagacttcaaatgctcttaaagttgtcagtcagaagggtagaaggggagtatcgctatctagcaggtcatcccgggctcccaaggatacaacttcaacccgaaggcgctcgccaccgaagagccaggcaaaggcaacaaaatcgtcagcccctcggaaagccaagccggtgaaacccactcagagcagcgcaaaggtctcgaagagcaaagcaaaacctgaggggcgaagatcaaagagtgacactctgaacaagctgggaactaagctcagtgtggttggatttagagggcgcagctcaggcaaatcagcacaatcttcataaggctttggtatttttttttattattgttatgctaaaaaggttcttggaggatttgcagcctgtaaatatctgagactaagtttcatcatttctttttctccttgcgggtttataagtgaagaccacaatctgagatatgaacgcagcactgctatgtaatattgtactgcactcagcagaatgttggaagaatacttttcattaccgactaaaaaaaataattggatagaccttatggacggggttgattttatataaaaaaaatatatttaaaaa

SEQ ID NO: 13764 - DNA, 6345 bp, Zea mays
  misc_feature (5525)..(5525): n is a, c, g, or t
  misc_feature (5684)..(5684): n is a, c, g, or t
cactatttagcacatttgtattagtagttagcttttcgctattaatgcaggatcttacttatctctctcacaaagtttcttggttcttgtgtctaaatttggcggtaaatttacagtccgcttctcttctcttctttttcatccatctcagcatttagctagcttctaacctcttaattatacttactcttagagcaagcttaataacgcaacctatagtgagctttataagagcaagtttaacaatagtgcctatggtgggcttaaaacctctatagccatcaataaaacattcatataatggtgttaactataaggttgactcttagattactattttgtctttttgtcttttatctttttattttggagctcgtgtagcagctgactcttgtataagagcccacttctcctaattttttatctctctcttccacgtaagaaaaaatgtcgtgtaagcaggcctgtagctataataactctctcacgataaaaactgcacatttaatacttcgtcaaactctttcttttatagagtctagctactagtgagtaatctgattttctctctctttatttctctttctttcacatcattataatttggtatatcatcccttgcagcccatctacatcatcttattatatttgttcttagactatctctaacagattttctatactttgcaaacaatgtaatctacagtacaaaacagtactttgcacgacctgctggagatgaccttagtgataacatatgctacctattataccacgatagcgcctctttggtatcgctgcaaacaatgcaagggcaactaaggtagtgtttagttttgtagtatggttttggagtggcttcgcttttaatttattgttgttattattgtttggattgattctatatagcatggagtggttctaaaaatgaaaaattatgctcaaatgttgaaccattttagcttctcaaaatcttttggatggagccgctagcgggaacgaagccattctatcccaagtggcttcgaaaccaaacgctacgtaagttaacacattggccaatattgattcaccggctgaacaagaagagggtggatttctcgtcaccaatggaagacccaggccgtggagcgaggaaggcagaaagcaatctggacagccttgtcctctgaaggctaggctgggcacgcctcaacccagccctgtggatccactcccacctgagcggctgagcctgagggtccagactccagatcaccgagctcacgtgggcgacgcaccgtccacaatgcaaccccacatttccggccaggtatctcgtcgcctcccgtccatagaaaagcacgacgtcgcttgtcgatggcccatgggcgagagagaagcgtgatggagacgtgtgctggaattgaactgcggagagggtcgccgcaggcaacgtatagctcggccggccaccattttctccttccagcaggatatgtacagcatttttattgttgttgttctaagagcaactccaataaactccctatattctttctaatatatataaataaagttttttttataaaaaatattctcgaacatcttatctaaatggctatcaaaatatagccatattttattccgagtttctcgctagccaagtataaataacgtgagtgcaaacaaaatatagaaagactaccagagattgaaaagatatagaaagtgacatttatgcaaatgactcttcaaatggtgatttagagagtataatttagactctttagagagtatattttttatgtcttgtttagtactgatttggtgactacggaattggataggtgcatggggagaaatatcattgctattcaaaatttgaatagccttttaataggaagggatttatctctcatagacccctctaagtcactggtcatcaaatcagcccttagagagagttagaggcacgctagaatttaagcagacaggtaatgatattacaacctgataactatttgtttgagatgtttttcccccttcttttgagtcttgtatgtagggcagctagatgagatctgatgcctgttttggatcgatcagatatcatctgaaacgatgagggatctaggaccgatggcatcggtatttgatttcaactcggtatggccgtcagacgtcagttaaagttcgctttcctccttggtcttggatcacgatcgatgcggtacggtttaagccatcgctctcatgcacatatggtgctacaagggtgcatgtgatgcaagtcatatacagctgctgctgcctttgttagctcatcaattaatcgtaaaccctttcgctcgtgtatctccactcaagcactgaactaatccaagtcgccgtcctcgaatccagtaacttaacccatacaccatcggcatcgagtggctcgatcgtcttgaccgccttgtaaattactctatctacaatgatgcatggtattatgataacacgtacagaaatacctattacgagttcagtgcatcttcctcctgcgtcccgggcacgcgcatactgcgtcaccctccactatggggcgtcaccgtacctcaccatcatcgccgaaataaacaagcaagaagaaagaaaccatcaacattgaacaacagcatcccatctaaccagctttttaacctacttgctccagaaaacactggaaattgccgtgtccgttcggccttttttttatatctacacgtaaacgtctcgtattgttggaatacaatattgtatcgttcttgtatgatcccggcgtagttagagaagagtgttacagcaaaagcaaatggtggttgagacgagcgcttcagagaacagtggcgggggcggcgcaacctttttcgtcgatcagctttcgatcgaggcgggtgggtgcgtgctacggccgctggtgcaacgggagtacgggacacgtcaggttcggtgccgggcgatcgagtgcacggccccgcggcgacggcgacagcagccagcgacgagccctcaccgtcgccgggcgtcgtcggcgcgccctcgcggcttcggggagagcacccagtgctggccgtgcgggcggacggtgagccccttgaccttggcgaagagcgtgacggcgcggcgcacgccgcgcccgtcggcggacgtgaagtagtcgtggccgaacatgacgccgccggggcggagcacggcccaggccaggttgatgtcggcccacgccgagtggaagtcgtggccggcgtccacctcgatgaggtcggcgtagacgccccagtcgcagagcgcggcgagcgcggacgccgtggagaagggcagcggcaggacgacgcgcgccccctccgccgccacgacgttggccatgaactgcggcagcagcagcgcgtcgccgtgccgcggcggcggcacgtcgcggcggaagcggtcccggaacgccggccagccgcggaagtcgtcgacgcagaggatggccggggacagggacaggttcctggccacggccgccatgtgcagcgccgacgcgcccaggaacgcgcccagctccacgaccaccgccgggcgcaccgcctccatgagctccgcgaacaccgcccccgtcgacccccacccgcgcgggcgcgccgcggccgggcgcagcagcgccgccgtgcgctcgggcgggaaccccgcgtaggggctctcgccgccgaagagcctgtcgagcagcgtccgcaccacggcgtcgctcggcaccggctccccgcaccgctccctgaaccggaacaggtcgtgcggaggcgaccgcgggtagctcgacgcggcggtcccgttcgagttcgacgacgccgggaataaagcgtcggcgtgcggccgcgcgatcgtcgtcgcctgggactgggactgggactgggacggtctcggtggcggcggccgggtggacgacgacaggaggcccagcgagtagcccacggcgaagacgatcaggaaggaggcgagccgcgccaggtgcggccgcagcctgggcggcgcggcggaagcggacgacgcccccgccggtggacgtggcttcatgctggtcgcgcacgccacaaaggagtctcctttgcgctgcggctcttctggagtgttgacagacaccgggcttatcgctctttattcctcggtttagctagaatttttatccaaggattaggctttggattctccgttatttatagtatttaatagctacggagagctgcagctagcactagcagcggttgttagcttagtttggtttgatatatatattgcccctagtatttggttggagtgaggatagtgtaaaacaagccaagataacctttttttttggattcctaaataaataaataaataggagaggaaacaagaaagagatgttggtgaggggtgattgttctggttggtgcgttttgggtggcgagtctgatggcagttaggagcaggaactgaacttggaggaagcactaggaaattccaaaagtaaagtacatgaaaagcgagcgtcagacttagaggtatgcgatgcaggcaagatcttggcatgtcagtggtgcactgggatcttcgcatggtacctggctggctgcaagccctgcaagcagagcagcaaccggactctgaagtctggacatggaaaccgttgaaacgatcgatcagttcgtgcggctgtcgccgttcaaattcagcaaccgtacatttccgaccaagtctctgctgcctgcctcaccctcacacacagcctacagcaccaccgcctgttctctagaaggacgaacaagtgtcccaccacccgtttctggtgctcaactcaacccttcccttggcttctcaaccaccaccgcgacggccacacacagccttctcacgggcacggatcaagcgccgccaagcctttcgctttcgggcggcgaggagcgaagaggtcgtcgcagttgttgttgacacaagctaagaattggctgaggggagggccgcggacgatggcaaggcgacgtcatgggggtgcgatactcacccgtggtcgctgcttcggctggtgcgcaagtagaatttgggagccaagggtggttgccacggagctgtcggatcaagtgcgcgcgcacctgcaagcacggcgacagtgatcggtccgccgggccgatggggcaggcagcgatcaatcaatgacgcgcgtcgctgattcgccggggtgcctggcgctggaagaatctgattcggatcacaaacaaccatagccttgcgctcagcccagctgtactgtttggggtctggactggcccagaaacaactgttcggctgcacagaaaagctttgagcccattttcgcgtctttaataattggcggctccactatctttgcgcgttgacttttttcgaaaactttcatcacttgtcttattcaaaaataaaaatttttaagttaaaacaaactgccttaagagataaaacaaatcacaaaaaacttattattttttgaataagacgagaaaaaaaacagtgtcatatatttatgaacgggnagagagtattatcttgttgtttatttaaccttatggttaacatgataaatctcattttttctaattctgttatcgaacccacaattaacacttcattgcatttataggccttcagtccttcacaagacaagtacttgagtgttactataacgaaaacantatcgagctgagccctatcgaagaggttggtctaagcaagatatgttcttgttctgcttattctacttcagaacatggtcagccttgggtacaactcagagtatattaagactgtctcctgcgggtagtgtaaaataaagaacatgtaactgcaaatgacactgtttacagagtgaagtttgaaataagagatgggataaggagatggctaaaagaacaagtgcactcatttgatggctaagagaacgatgcacatgtgaaatgtcaaggcacttatttgatggcaacttgtggagagcacccagtgttcaaactagcacacttttgctttagtcgaggataagtgaaggacattgtacatgtgggcgcaaaaaggcaatacaaccacttgatgaaaaatggccttttgccattgttttgaggagggctactcaactaatccatcgaggatgtttaagaccctttaatctattataaagtagtacataccctacatacccacaattaacacttcattgcatttttagaagattctttaaaagattagaatatttgaataagcgaccctcaacatatttattctaaacaaccaaagatttgggctaagaatatatgcttcaccatacaataacacatatataagacttaaagagcacttcat

SEQ ID NO: 13765 - DNA, 1945 bp, Zea mays
accaacccacacccgttccgtttctggcgcacagcacagtcacagtgctcggcatcttttccgctccgctctgacgctctcccactcccccacagtcccacgccctccagtcaaagcaagccgctgcttggccggccgggaaggctcggtcgcagcgccgaggaatggcggccaagccggtcaccgtcggcgacctcatccaccgcgtcgcctcttcctgcctctccaaccgcctgccgtgcaaccacaccttccgcgactccgtggacagcgactttgacgacgacgacgacgacgacgaccccttcgccgacgccgtctccagcagcgagaaatgccagcggtccccgcccgctgcggaggtcgaggaagaggaggaggaggacgagaagctcaagatctgggaggagagggagcaggagaaggagaggctggccgccgcgtccaagggcgccgagcgcgcccgcgacgcggacgcgctgatggcggaggtgttcgacgccgtctccggggtgcgccgcgcctacgccgcgctccaggacgcgcactgcccctgggaccccgacaagatgcggaccgcggacgcggccgtggtcgccgagctccgccacctcgcgcgcctccgcgaccgcttccgccgctccgcagccgtgggccacatcccgcgcccgaaaccgtccgcgccgccgctgcgcgaggccgtggcgccgtacgaggcggcgctcgacgacctccagcgccagctccagtccaggcaggccgaggtggacgcgctcaaagagaagctcgcggcggccaccagccgccgcaacgggcgccaccaccacgtcccgccctccaagcagaacggcggcgcgccgacggcggagctcttcaccacctgcgccgagcaagcccgcgcggcgacgcgggccttcgcggggcacctcgcgcacctgatgcgcgcggcggggctggagctcgcggcggccacccggtcgctcaccaagatcccggtgtcctccccgcagctggccaagcacgcgctggaggcgcacgccacgcgcgccctcctcggcggcttcgagcacgagtccttctacctggacggctccctctcgtcgctgctggaccccgccgcgttccggcgggagcggtacgcgcagttccgggacatgcgcgggatggagcccgcggagctgctgggcgtgctcccgacctgcgccttcggccgctacgccgccgccaagttcgcggcgctcctgccgccgcgcgtggaggaggccgtcctgggcgacgccgagcaccggagggtggtcaacgccggcgcccacccgcggacgcccttctacggggagttcctgcgcgcggccaaggccgtgtggatgctgcacctgctagccttcgcgctggagccgccgcccagccacttcgatgccggacgcggtgcggagttccaccaggagtacatggagagcgtgaccggcgcgccaccgcacggcggcgcgggcctggtcgtcgggttcgccgtcgcgcccgggttccggctggggaacggcgccgtcgtgcgcgcccgggtctacctggtgccgcgtggtggccgaccgtgacagacccatgcatggcgtgacagaccgcgtggtagcgttgcatagcgccgcggcccacggatcacctccgagagttgttggtgggtgccaatgcgcaccctgctggagcctggagctggacctgcggagtagctgctggctggctgcgttggtgaagaacagacaaaggctcatagctactgtactagtggctccgtagattttatttcattttacttctccttgttaatctcaaaaaaagtaataatcgccatgtgtaagaggactttgaatttaacaaaaaaaaaaaaaaaatttgtaatcatcaccttgagatttgactttgtagttaagagggacagttaagttcagcagtg

SEQ ID NO: 13766 - DNA, 1062 bp, Zea mays
cattgggtacctcgaggccggccgggactggttgaaacctagggtttacatcccttataaaatctcgtcttccacccccgcctccctcagtcgcacttcctccggcggcggcaactcgacggccaaccgcgccaccctgccgcggcagccatggtgcatgttaacttctaccgcaactatgggaagactttcaagaagccaaggcggccgtatgagaaggagcgcctagatgctgagctgaagctggttggtgagtatggcctgcggtgcaagcgcgagctgtggcgcgtgcagtatgccctgagccgtatcaggaatgcagccagggagctgctcaccctggatgagaagaacccacgccgtatctttgagggcgaggcgctcctccgccgcatgaacagatatggtcttcttggtgagggacagaacaagcttgattacgtgcttgccctcactgttgagaacttcctccagcgccgcctccagaccatcgtcttcaagaatggcatggccaagtccatccaccatgctcgtgtcctgatcaggcagcgccacatcagggtgggaaggcagctcgtcaacatcccctcgttcatggtcagggtcgaatcagagaagcacatcgacttctccctcaccagccctctgggtggtggtcctgccggaagggtgaagcggaagaaccagaagaaggcctcagggggcggcgacgctgaggaggacgaggagtaaagggggggggggcacgtaggattctgggacggcaattggtttaaatgtgaggtggacactttagttgttgtgcctgagtgtgtttgtgttgtaatgaattcagaaattctactgtggtagacaattttgcacccccactactgacactcgtgtttaaatttaaacattggcatcgtgtctggacacgatgaattgtattctggtttgggtggctatttgctagtttggtctttaggccaatgtttaagactgaaacaaattggtagccaactttactatcttatgctctgctggtctgtttggtgattttttttaaaaaaaaaaaaaaaa

SEQ ID NO: 13767 - DNA, 1000 bp, Zea mays
gcacgagatcccttatattgggttggctccctcgaggccggccgggagtcgcacttcctccggcggcggcaactcgacggccaaccgcgccaccctgccgcggcagccatggtgcatgttaacttctaccgcaactatgggaagactttcaagaagccaaggcggccgtatgagaaggagcgcctagatgctgagctgaagctggttggtgagtatggcctgcggtgcaagcgtgagctgtggcgcgtgcagtatgccctgagccgtatcaggaatgcagccagggagttgctcaccctggatgagaagaacccacgccgtatctttgagggcgaggcgctcctccgtcgcatgaacagatatggtcttcttggcgagggacagaacaagcttgattacgtgcttgccctcactgttgagaacttcctccagcgccgcctccagaccatcgtcttcaagaatggcatggccaagtccatccaccatgctcgtgtcctgatcaggcagcgccacatcagggtgggaaggcagctcgtcaacatcccctcgttcatggtcagggtcgaatcagagaagcacatcgacttctccctcaccagccctctgggtggtggtcctgccggaagggtgaagcggaagaaccagaagaaggcctcagggggcggcgacgctgaggaggacgaggagtagagggccacgtagggattctgcgaccgcaattggttgaaatgtgaggtggacactttagttgttgtgcctgagtgtgtttgttcattgtaatgaattcagaaattctactgtggtagacaattttgcacccccactactgacactcctgtttaaatttaaacattggcatcgtgtctagacaggatgaattgtattctggtttggccgtttgggtggctatttgctagtttggtctttaggccaatgtttaagactgaaaaaaaaaaaaaaaaaactttactttctgagtcttctagaaaaaaaagcggcc

SEQ ID NO: 13768 - DNA, 1047 bp, Zea mays
  misc_feature (33)..(34): n is a, c, g, or t
ggttcggccgggcccactttgttgaaacctagnnggtttacatcccttataaaatctcgtcttccacccccgcctccctcagtcgcacttcctcctccggcggcaactcgacggccaaccgcgccaccctgccgcggcagccatggtgcatgttaacttctaccgcaactatgggaagactttcaagaagccaaggcggccgtatgagaaggagcgcctagatgctgagctgaagctggttggtgagtatggcctgcggtgcaagcgcgagctgtggcgcgtgcagtatgccctgagccgtatcaggaatgcagccagggagctgctcaccctggatgagaagaacccacgccgtatctttgagggcgaggcgctcctccgccgcatgaacagatatggtcttcttggcgagggacagaacaagcttgattacgtgcttgccctcactgttgagaacttcctccagcgccgcctccagaccatcgtcttcaagaatggcatggccaagtccatccaccatgctcgtgtcctgatcaggcagcgccacatcagggtgggaaggcagctcgtcaacatcccctcgttcatggtcagggtcgaatcagagaagcacatcgacttctccctcaccagccctctgggtggtggccctgccggaagggtgaagcggaagaaccagaagaaggcctcagggggcggcgacgctgaggaggacgaggagtagagggccacgtagggattctgcgaccgcaattggttgaaatgttgaggtggacactttagttgttgtgcctgagtgtgtttgtgttgtaatgaattcagaaattctactgtggtagacaattttgcaccccccactactgacactcctgtttaaatttaaacattggcatcgtgtctctggacacgatgaattgtattctggtttgggtggctatttgctagtttggtctttaggccaatgtttaagactgaaacaaattggtagccaactttactaacttaaaaaaaaaaaaaaaaaaaaaactcgagggggggcccggtacc

SEQ ID NO: 13769 - DNA, 808 bp, Zea mays
actctccaccgatcccctcaccccagcaccggcggcgcacagctcgacgacccgagcgatcctgcggaggcggcaggcatggtgcacgtcaacttctaccgcaactatgggaagaccttcaagaagccaaggcgtccgtatgagaaggagcgtcttgacgctgagctgaagctggttggggagtacggtctgcgggccaagcgtgagctctaccgtgtgcagtacgccctcagccgcatccgaaatgctgccagggagctgctcaccctggatgagaagaacccccgccgtatctttgagggtgcagcgctcctccgccgcatgaaccgctacggtcttctcactgaggaacagaacaagcttgattatgtgcttgccctcactgttgacaacttcctccagcgccgtctccagaccatcgtcttcaagaatggcatggccaagtcaatccatcatgctcgtgtccttatcagacagcgccacatcagggttggaaagcagcttgtcaacattccttctttcatggtgagggtggacactgagaagcacgtcgacttctctctcaccagccccctgggtggtggccaacctggaagagtgaagcggaagaaccagaagaaggcctcaggtggtggtggtgatgacggcgaggaggaggaagactaagcgcccagcctcacccgcataactttcgttgcagaaatgttgagattgccttgtggaaactcggaaatgattcaaactttccttcttggactctgtggtgtagagcttttgttggtcagatctttttgctgtcggtctaaat

SEQ ID NO: 13770 - DNA, 877 bp, Zea mays
ccgggctcgcggtgctcgccgcggcgctgctgggcgccgaccgccagacccgcaccttcttctccgtggagaaggcggcccggttcaccgacatgcagtcgctcgtattcctggtgatagcaaacgggatggcagcgtgctacagcctgctgcagggcgggaggtgcctggtgagcatcctcacaggtggtggcgtactaatcaacaggcccatggcatgggccatcttctcctgcgatcaggtgatggcgtacttcacgatctcggcggtggccgtggcgatggaggcggcgatgatcggcaagtacgggtcgcagcagttccagtggatgaagacgtgccacctctacaagcgtttctgcgcgcaggcgggtggcgccgtggcctgcgcggtggcggccagcctgaacatggtcggcgtctcgctcgtctcggcgttcaacctcttccggctgtacggcagcggcaaagggaggaagtgatctcggtcggcctgctgccactaggaacacagggccggcagcgccgcctgttctcttaggttttaacacccagtatggaaccatagcgccatggatggatggatggtctcttcttctccggtttgagtttttctggtgttgggtaggcatacctgtcgtctgtcagcgtagacataaaaaaaaaggtctctgggacgctcgcccatgtatgtatgtatatgatgtgaagtgatccaaggtggttcgcgtgctatggcaataaacgtgtgggaaagcgatgtatcgtcgatgcctgtccccgcctgcagggatggcaggggaatttcctctctgggttattatccaatgcggtagctggctttgctgatgctgtgccaactgccatcatttactcc

SEQ ID NO: 13771 - DNA, 1799 bp, Zea mays
  misc_feature (1669)..(1669): n is a, c, g, or t
ctcgaggccgaaggccgcagcgtgcatcgcggctcccgctcccacactcgcctccctcatcagtggcagctagcagcggcagcacccgcagctcgcaggagagagagagagagagagagagagagagagagagcagccatgaaccacggaggcggagccgacaacggtgtgagccccggcaacgtcccggtgtgctactacggcgcggcggggcgcgtgccggcggcgctggagcggcgggtgcgcgccgcggagctgttcatgcggtgcgcggcgtgcgggctcgcggtgctcgccgcggcgctgctgggcgccgaccgccagacccgcaccttcttctccgtggagaaggcggcccggttcaccgacatgcagtcgctcgtattcctggtgatagcaaacgggatggcagcgtgctacagcctgctgcagggcgggaggtgcctggtgagcatcctcacaggtggtggcgtactaatcaacaggcccatggcatgggccatcttctcctgcgatcaggtgatggcgtacttcacgatctcggcggtggccgtggcgatggaggcggcgatgatcggcaagtacgggtcgcagcagttccagtggatgaagacgtgccacctctacaagcgtttctgcgcgcaggcgggtggcgccgtggcctgcgcggtggcggccagcctgaacatggtcggcgtctcgctcgtctcggcgttcaacctcttccggctgtacggcagcggcaaagggaggaagtgatctcgatcggcctgctgccactaggaacacagggccggcagcgccgcccctgtgctggcatttctcttaggttttaacacccagtatggaaccatagcgccatggatggatggatggtctcttcttctccggtttgagttttttctggtgttgggtaggcatacctgtcgtctgtcagcgtagacataaaaaaaaaaaggtctctgggacgctcgcccatgtatgtatgtatatgatgtgaagtgatccaaggtggttcgcgtactatggcaataaacgtgtgggaaagcgatgtatcgtcaaaaaaaaaaaaaaaatgcagggatggcaggggaatttactctctgggttattatacaatgcggtagctggctttgctgatgctgtgccaactgccatcatttactcctgactactataagcttgatgttggcgaaaggcatgtggcgttctatgggttcggcacagatgtactccatgcagtgtgcgctcttattagcagttccacttacctcgtttccaattcgaagtcctttcacttttttaaagagccaaaatatctcgcaattgaccaaattaatacaatagagtaatacttccaccgtcccaaaatagttatcgttttagctctaggtttttatgttcatattcatatggttgattatgaacctagccatatatatagaacacagacattaattatcctataaatctatttagtgaataggtaaaaacaaattttaatttgggaggaaataatgtttatgttaacaaataaatatcattagattgtttattaattatattttcaaagtatatgtatttgatatagatctctgcaatttttattataacttcaattaaatttagtatgttttgtctctctttgtaatttacagaagagaaagtnttatagtttataatagaggaagtattatggatcaaatggatgtcgattgtccaagttccgttcttgacaagttaaaggtctgtttggcttggttgtggcagtaaaaaaactgctgtgactattatttgtg

SEQ ID NO: 13772 - DNA, 1900 bp, Zea mays
ggcagacctcacttcttatgactatgatgcaccgattaaggagcatggagatgtgcataatgcaaaatacaaagcgctaagaagagtaatacatgagtgtactgggactcctctccatccacttcctgctaacattaaaaaagcaagttacgggattatgaaattacaaaaggttgtttctctgtttgacatcattgataatatcaatgatcctctgaaagtttctgtttcggagcatccactttatatggaacagataggccagatgtttggatttctcctgtacatgtcagaataccaagggaaactcccatcaagcatcctgtcaattccaaaggtacatgacagagctcaggtgtttgtgtcttgctcagctggtgttagaaccctaagatattgtggtgtaattgaaagatggtctaataaaacactagagataccgaacttaagatgttcatctaagaccagcctatatatcctggtagaaaatatgggtcgtgtaaattatgggccatatatttttgaccggcggccttcccgggctcctattcaaatggatggcattactctccgtcactggaaaatgtatccactggcactcaattcactggacatccttccaaaacttcaactaatcactcaaataccttatgctggagccagtaaaatgtccattcatggagactcagaaaagattttacaggaatcgtcatgctgttcaaatgaaagcacttctgcggagcctgcgttttatgaaggccatttccttattgacaatgagactgaattaagggatacattcatatcgtttcgtggttggaacaaaggtgttgcttttgtgaacaacttcaacattggaagattttggccggcacgcggaccacagtgtaccctttatgttccagcgcctatactcagacctggggataacattgttgtaatctttgaactgcatgctccaaatcatgagctcactatcgattttaccacggatccggatttcacgtgcggtccagaacagtgaaaaagggttgcacgtggacgtggtgtacatactgttacatagcagtacagtgcagtgttctgtccttcctcttgcttttctacgtcggtgctggtatagaatgggtaaatctgctctaggacactactctataaacgtggtattggctactggacactgctcaattgtgtacctttgatagctggatttgctgttgggtaccaaagaaaaaataaaatatcagggacagatcgtgaattctccactttgctccctgtccaaatgggggcccagcagtcacttctccattttggcaagccacaccgagctccgctacgccctgcgggggtgcagcacgatgtggattcctatgcacggggaacggctgtccgttacgacgacggacacggccgtggcggcgatgcccgggcacgacgcacgcgagatgctcgacgttagattgcctccaacaagacaatgtaaatgacactgaacgctaaatttagaggagaaagacatccgttatctctctaacaacagactgcaaacgaatcggtaaaatatagcgcacgtacggtgtactctaaatctagagtacttcatttcatccgctatccatccacaagcacgtggaagcctgccagatgtcagcgctatggagaaaagcaaggaaggggagagaagcgtgtacgtcgccgaaaaacaataaacaaaagaaataaacaggaggagagagaaggatcttatgtagagacaaataaagaagaacgacagttctatttgtttgttatttctggttttcattttttcagcatgtattttacaacaaaattgtaatctgtaaatgagtcatttttttttaaaaaaaatacagctgcggaaataaaaaaaaaaaaa

SEQ ID NO: 13773 - DNA, 4085 bp, Zea mays
  misc_feature (960)..(960): n is a, c, g, or t
gcggttttattctagtttttttatgtttagtttctaacaaaataggagcggagcggtgcctgtagttttcatatagaaatttactaaaaatagttgaagtgcttccgctccaccaaaatggtcggatacgagcgctcttcttactcttctctcctctacactcatatgactctccaaccaaacaaagaacagagcggctccgctctattctactcttcaaccaaacaaaaaatagagtggctatgttttacttgtcaaacaaagaatagaacgactccattctaaaaaaactagaacggaaccgctccattctaatggactctccaaccaaacgcaccttaagttaatgtttggtttacaaaatgtaatgtaaatgacaatggtagtaatgatcacattcgagtgctaacaataataagtttgaatagactgatattcgtttttagtgtgttatctgattacgttgaacttaaaaaacatgatttaacgttatctgttatccatcacgttacaattatgtgaatcaaacaacacctaagtatgacgcaaagctgcacctttttccttggcagcattaggactcaagagagaaggcctcgccataatgcaatgacctggaccaaaaaaactcgagagagggcccacattcaaaagggttttagagaaactattggtagctattggagtattacctatttttgatttaatattttaaagatatcctattttttatgttttgaaaattatatttttttggacttattggagttgttttaaccctataacttgagggtgcaacatattaccctgatccctaaacaccttcagtaaacaaggttaacttctagagacaatgcccgatcctcgatttcccgcggagaattcctctattaggggaatgaggaagtttctcctctatgaggatgtaaacggaaaaattcttctccgacgagtaaatgnagataggtaagcattctctatctccgtttcccacgaggacccgttaaacttacacgtgacatgttttcgtgtgatacttaatgataaaaataaataattatcttgtaaaagatcacttattgtacaaatgtgtttattttgatgtgcatataatgattttttatatctagcaatatttataaatgacaatgttttacattattatttattaacaaagaacatacatcttagttataatataagcgaggttgggatctctgtcagggatttacctctgtggaaaacggggatgagaaagaaacgtcccagcaaacgtttgtaagaatctccttgagcaaatgttttcgtcgcgaggacagagatgaaagctattgtccaacggagaatttccggttgccatacttactagttccgtctaccggccatgtagatcggtgtaacctaaatcatcatcagcatgctccgttttgtccccttcttgaagcaaccgaacaaaggcaggcgctgcctcgttcgtttcaatcaagtctccatcggtttcaagtacagctcctttgtccagtttccttgctccttctcgtcattttggcgcgccaccatctcacggaaatgtcaacaacccaacgaaagcagtaaaccgtacataggaaatgaaagccagaggagatatttcaatggaaaaatggcaaaagtgcaacttttttccccccatcaagcgtattagatgcctttttcccttgcacaaaacgcttctccggtttattcgacagacaaaggacttgtttagtctgatgtgtgcaagccagccaccgcttggcggctcgcattcatctcatagagctcattctgagatgaagtactcctccctgctcttctcgatgggcatgtaaattaacaggcgcatgtatatgttgtattgcgtatctcatacacaagaagctaataccaaaggtagattgattagccttggaaactcctctccttttcttttcaattgaaagaagcaacgatgtgcaatttgcacggcacaattacgctaacctactgcaaattttgaaatggaaaataacaacatcctttgcatttttatctcaatgaaatgataagatagtccttctgtagtcttatatacgtgttcagcatccatcaagaaataactccacgcctcgttttttaagaggcgagcttaacatttatgatgcacaataagtataattacattaagcacgataaacttcctcataataaaatatattctctataataaacatactagagatataaatgttgataacagatgcgcagttattttttgagactggaggaataacctgttgtgtgctcgcaatttcctaatgcggcaggtggctgcggtgcgtgcgtggtccttatctccaagtacaacccggccaccgacgaggcgaccgagttctcagcgagctcctgcctgacactgctccgtagcattgaccgctgctcagtgaccacgagcgagggcattggcacccccgaggatggctaccacgcggtgcagcagcggctcgcaggcttccacgcttcccagtgcggcttctgcacgccgggcatctgcatgtcaatcttctcagcgctggccaaggccgacaaggtggccagccgccctaccccgcccacaggcttctccaagctcaccacctcggaggctgaaaaggccgtgtccggcaacctgtgccggtgcaccggatacaggcccatcgtcgacgcctgcaagagcttcgcggcggacgtggaccttgaggatctgggtctcaactgcttctggaggaagggcgatgaacctgctaccgtcagcaaactacctggctacagtagtgctgcagtctgcaccttccctgagttcctcaagtctgagatcaagtcctctagggagaatgcagatggtgctgcagtagcagtctccagtgacggctggtaccatcctcaaagcattgaagagctccacaggttgtttgattcctactggtttgatgaaagttctgtgaagattgtggctgcaaacaccgggtctggagtgtacaaggatcaggacctctatgacaagtacattgacatcaaaggaataccagagctatcagtcatcagcagcagcgttaagggaattgagcttggatcggttgtgtccatctctagagccattgaggtgttgtcagatggaaatctggtcttcagaaaaattgccgatcacctaagcaaagtggcttcgccatttgttcggaacacagcaaccataggtggcaacataatcatggcgcagaggttgccattcgagtcagacatagcaactgtgctactggctgcaggtacaacagtcacaatccagacggcttccaaaaggttgtgccttactttggaggagttcttgcagcagtctccatgtgattctaggaccctgctgatgagcatattcatcccaaagtgggattcagatggcatcacctttgagacattccgggcagcgcctcggccatttggcaatgctgcttcatatgtcaatgctgctctcttggcaaggacttcaactgatgcagcttcagggaagaacatcatggaggatatatgcttggtgttcggtgcttatggagctgaccatgccatcagagctagcaaggtagaggattttctaaagggtaaatcactgagctcttctgttatacttaaagcagttcagttgcttaaagagacggtttcaccaccagaaggcacaacacatcctgagtatagggtcagcttggctgtcagcttcttgttcaccttcttatcctccttaaccaacaggatgaatgaaacagcaaaggttaatgttatcaatggatcacttactaatagaactacaaatattagcggtgggtactcactgaaggaaaatcttgaggttgacagaaattatttaccaatacactcaagacaagaaatggttttcggtgatgaatacaagccagttggcaagccgatcaagaaagtcggggcagagctccaagcttctggtatttcccctccaatgtactgccttgccaaaaaaaatattttgacagcatcagcttataacctttcttcagcatattctgcaaaatactgtatagtgatgc

SEQ ID NO: 13774 - DNA, 899 bp, Zea mays
gggagggaagtgctttaatgttacttggaggaccagcataagatcctgaattcaaaaacaaaataagaggcttgtaagtagcacctggacaaggcacaagggtggtgacaaaacaacacccctgtaggtgaggcacatcacgttggtgaactcccttacacatggggtttacaaactcgtgtgtggactccttacctacactcctagtagtatgagaatgatgctaaagtatccaacggtacaaaacaacaagaagatggatatttctcctttagaaaaaatgagcggggagtggcagtgaactcccttacacatggatcaggacctctatgacaagtacattgacatcaaaggaataccagagctatcagtcatcaacagcagcgttaagggaattgagcttggatcggttgtgtccatctctacaggctacaaccattgaggtgttgtcagatggaaatctggtcttcagaaaaattgccaatcacctaagcaaagtggcttcgccatttgttcggaacacaacaaccataggtggcaacataatcatggcgcagaggttgccattcgagtcagacatagcaactgtgctactggctgcaggtacaacagtcacaatccagacggcttccaaaaggttgtgccttactttggaggagttcttgcagcagtctccatgtgattctaggaccctgctgatgagcatattcatcccaaagtgggattcagatggcatcacctttgagacattccgggaagcgcctcggcccggacgcggggcggacgcggggggcaatgctgctctcttggcaaggacttcaactgatgcagcttcagggaagaacatcatggaggatatatgcttggtgttcggtgcttatggagctgaccatgccatc

SEQ ID NO: 13775 - DNA, 2693 bp, Zea mays
ctattgcagcagtgcttgaggattcagtgatcagcagatctgcaaggacaaaaggaccaaaggagtgagctggtttttatattttaactgatgcacctggatgctttattgagcggtgtctatgaaatgagttggatggaagggagacttcaacttgtcaactctgtcctctcgtctctgccaacatacgccatgtgcaccttacaacgtccagcagcggtcttggagtacattgacacagccagacgacactgtttgtggcgtaattctgatagcaatgcaaaatttaagcctctggtggcttggaataaatgcacacgaccgaagaaaaaaggtggtctgggggtcatcaacctaagaagccagaactcgtatctccgaatgaaatttcttgacaagctctacaacaggaaacaaatcccttgggttaacctggtttggaatacatactactctgacggcaagacccctcatgcatccaagttcatgggctcgttttggtggagagacgcccttaaactttgtgatctcttcagaggaatctccaactgtaaggttggagatggtaaaactgttctattttggcatgatttatggaatgacaacatccgcagaaacaaatttccaaggcttttcaccttcgcaaaaaatcaaagcatttcggttgcttcctttttgactcaggagaacttgacagacaatttccacttaccccttactgagcaagcaaacactgagctgcaacttttttttttttttttgcagcaaattcgagaatcagtgattgaaccagaagagaaagactcttggagttatatttgggggaatagcacctactcgtcaactaaactttaccactacactttcaaaaatgtgaatcctccaaaaccatttctctggatctgggagtcctgatgttcaaacaagcttaaagtcttcgcctggctgctgttgatggacaggctgaacaccagaaacatcctaaagagaaagaactttaaggttcaaggcgacaactacagttgtgctctttgtcaacttcaaagagaagaaattgccttccatttgttcttcaattgccctttcagccaagactgttggagacatctgaatattcagtggaaccaccagattgacttctttgcgacctttcaacaagccagggacttgcacggttcaccattctttatggaggtctttatcatagcagcttggcaaatctggaagcaaagaaacaattttatctttgacaggggacgaccatctttcattggctggaaaaaagaattccgcgccgaagctcttctgcaagctaaccgcttttctgaagagaaatcaactcttttctcctcgcttgtgaattcctatagatagcggatagttcttttccctatgctttagttagtttccttctggtttatgtcttgggagcgactgctaatgctctttgtctgtcttcttctttatattaataaatatctaccacagcaggggcttcccctgctgtacattttcaaaaaaaaacagcagcgttaagggaattgagcttggatcggttgtgtccatctctagagccattgaggtgttgtcagatggaaatctggtcttcagaaaaattgccgatcacctaagcaaagtggcttcgccatttgttcggaacacagcaaccataggtggcaacataatcatggcgcagaggttgccattcgagtcagacatagcaactgtgctactggctgcaggtacaacagtcacaatccagacagcttccaaaaggttgtgccttactttggaggagttcttgcagcagtctccatgtgattctaggaccctgctgatgagcatattcatcccaaagtgggattcagataagatcacctttgagacattccgggcagcgcctcagccatttggcaatgctgcttcatatgtcaatgctgctctcttggcaaggacttcaactgatgcagcttcagggaagaacatcatggaggatatatgcttggtgttcggtgcttatggagctgaccatgccatcagagctagcaaggtagaggattttcttaagggtaaatcactgagctcttctgttatacttaaagcagttcagttgcttaaagagacggtttcaccaccagaaggcacaacacatcctgagtatagggtcagcttggctgtcagcttcttgttcaccttcttatcctccaatacactcaagacaagaaatggttttcggtgatgaatacaagccagttggcaagccgatcaagaaagtcggggcagagctccaagcttctggtatttcccctccaatgtactggatagatgcggatcggcttgaagcctcgaaccagttcggagcctagccagcttccggttaggcgccaggccacgccggcggacagtggccgctgtgcctcctcgagcgccattggctggcttggtgccggttggggagagcagagacggcgagccgcgagcccgatcgaattggcggcggggaagggaaatcagtgaaccatctccgcttgaatcgggggacctatctcgcctgccagttcggcaagggccccggttacttggattcgtcgcagccgcaacggacgtcttcgccgccgccgccgccgccgcccgccagcgtcaggtatccggcggtcggcggtcccttctttgctctggttcccctatttctc

SEQ ID NO: 13776 - DNA, 6662 bp, Zea mays
  misc_feature (1619)..(1619): n is a, c, g, or t
ggcccattaaaaaacttacaattaaagagaaaagaaaaatcccccttatggaaaatgggtgtcatccttgaaaacaaaagtagaaaatgcatgctatacataatatctatgaagctcatcagcattacaggatcttagaatttcattcccttccatgtattttagtctgtatgaccccagtcgatttgatgctgcaactaaaaaaggaccttcccattttgtttgaagcttgcctgttgtatcaggattggccaccctccgaagcacgaggtgccctatcattatttgtttcagttttaccttcctgtcttgctattttcttgttttgacttgttatttgctgatcttctcgagtgcttcgagtctgacttcttctattgtgtctttaggatttttttcactggttgcgtcttcagttgcagcaataatccttgatgatcttgtctttacctcttctagggatactgcttcgtctccatagagaagtttaagggggtaaatccagtgaatcacgacaaagaagtgttgtggttctataccatcttgattaattcattaggcattttccctttagcaatccaaacacagacagtaattcctagcaaagctagggctatacaggtacatgagggttggacttatcgggcgccccaaagcacgacatgggtttggcgcggcccaaactccacacagcatgtagcgaagcaggcccatgccggcctagcccgattactaaggtgcaacacggtgggctaggcccggcacgacccgatttttttccattttttgcatatatgtacctatattatacttgaatatagagcataaaacacaacaacataattgtttttgttggtttgtgggtgtaaatatgtgtttagagctaacaactacgggttataccctaatatatgcatatttttagattatttttatatgactgttatagacccattaagttcgttgggctgtaggccggctcgacacggttattaacctagccgaccttgtttaagctttgcacgtggcctataaaccggcacgacatgaccaactagctaatttgtgccggggctggcatgaccacaattagtgccggcctggcctggtcgatctatttggagccttaatatctaatagtatcttcactcgtatcatctgtctctataaagatgatagtgtagcccgtagctaaggttttgtccggcgatggttcaagtaaatagcatgagtcgtgaacaaactgattttggcacatgaattccatttgatgatcttttatgcaatatattttgccgcttcactagaatatcacaatgtcaaaaaatttatttcaaaatgaaggtgttatgggctaagaccatcaaatcaaaggtgcacataaaaacaaaacatgtcaacaacttccgtgataaatcatgagaagcattcctactactagaaaacgagagagctaagacaatgatatatcatttcgacgacaaccaacaaaaataaacagaaactatgaaatatcatttcgacaaaggaaaaatacatattactctacaatcattcacatacaatactccgggacaaattctcagtggaagtaaatgtaaatatatatataggcctanaaggctaaaactatagagaaatttgttgtttgggtagaagagagagcttggagggatgggatgagtcgatgagagatgccaaaaaggcgggctcggaagaatcaaatcccaagtttgaccgggctcggatgctgagacacacacaactgagaaacgaacgccttttcctatcagcccctcgcaataaccaacaattatattcttccacggcctcggctagacaaatgcattagttttttttattacaaaatccggcccctctttccagggctaattgccgtcgcaagcaaacaaagctctccgaggctttgttaatcctaagtgccaatggcggggttcagtagctgactcgcccttccttactctctttcgctcgtcctacttaaatactctcaagtgccgctgtgtgtgctcttctacttttgcttcgtctcaagaggctcctgttcccttcttctccctcctcgtgcatcttcgtctccaattgctgaagtagtagtaggttggttggtctgttggtggtgttcttcattcttgatgtggggttggtttcttcgcttggccaaggtgagcaggagcctcttggattttcattctgctttgttcttgtgttgaagaaatgtttggatgtgcatctaagtacctgcttaatctggattcttttggtggctttctggtcctctggtttatattcgtacaacctgattaggttcgtctctttcgtcccaaattggagttggtttccttcccggtatagttcatcatcatggcatctttgaattttggaggaaaactacctcctgggttcggtgcgcagtttgtgccgataatttcgcatttgcaactgtatgactgttcttgcaccggcgctttcccttccaaactaagattccttgtgctcttctatcgttttgcttctctgttaaatgattcgagaatttcctgtgcgaatttgcagtgaggtcatctgctccacagtcatgtgaagttgtccaagaattcggcaggacggagaaaccggcggcccttcttctccattgttcgctcatcttcttgcctgcgattgcggcaaatcgacgcacgcgaattggaaccatggccgcctccacgacgtcggctgcgtggttctttgtggctgtggtgctgctggttctgcttcatgcgacggcggccgccattgctggcgcagaggaggcggcggcgctgctcgccttcaggcgtgcgtccgtggcggacgacccgcgtggcgcgctctcgggctgggcgcaggccaacgccaccgcgtcggcaccgtgctcgtgggccggcgtctcttgcgcgccgcagcctgacggccgcgtcgtggccgtgaacctcagcggcatggcgctcgtcggcgagcttcgtctcgacgcgctactcgcgctcccggcactccagcgcctcgacctccgcggcaatgccttctacggcaacctctcgcacgctgcggagtcggcttcgccgtgcgcactcgtggaggcggacttgtcgtccaacgctttcaacgggacgctccccgcggcgttcctggcgccgtgcgccgcgctgcagtccttgaacctgtcgcgcaacgccctagtcggcggcggcttcccgttcccgccatcgctgtggtcgctcgacctgtcgcgcaaccacctggcggacgccggcctcctcaactactccttcgccggctgtcacggcctgcggtacctcaacctctccgccaaccagttcgtcggccggctgccggagcttgcgccgtgcagcgtggtctccgtgctggacgtgtcgtggaaccacatgtccggcgcgctgcccgcggggttgatgtccacggcgccgtcgaacctgacgagcctcagcatcgccgggaacaacttcaccggggatgtctcggcgtacgagttcggcggctgcgccaacctgacggtgttggactggtccttcaacggcctgagcagcagcaagctgccgccgagcctcgccaactgcggccgccttgaggtgctggacatgtccgggaacaaggtcctcggcggcccgatcccggcgttcctgactggcttctcctcgctgaagcggctggcattggccggcaacgagttctccgggcccataccggatgagctcagccagctctgcggcagaatcgttgagctggacctgtcaggcaaccggctggttggtggcttgccggcaagctttgccaagtgcaggtcactcgaggtgcttgacctcggtggcaaccagctctctgggagctttgtggacgatgtcgtcagcaccatctcctcgctccgcgtgctgcggctgtcgttcaacaacatcaccgggcagaacccgctgccggcgctggcggcgggttgcccattgctcgaggtggtcgacctcgggtccaacgagcttgtcggtgagatcatggaagatctctgctcatcactgccgtcgctgcggaagctgttcctccccaacaattacctcaatggcacagtgccgaagtcgctgggtaactgcgccaatctggagtccattgatcttagcttcaacctccttgttggcaagattccggaggagataatggtgctgccgaagcttgttgacctggtcatgtgggcgaacggcctgtccggcgagatcccggacatgctttgctccaacggcactacactggagacgctggtgataagctacaacaacttcactggaggcatcccggcttccatcttcagatgcgtcaacctcatctgggtgtcgctctccggcaaccgcctgacggggagcgtgcctcgcggcttcagcaagctccagaagctcgccatcctgcagctcgacaaaaaccagctgtctggccctgtgccggcagagctcggcagctgcaacaacctcatctggctggacctcaacagcaacagcttcaccggaaccataccgccggagctggctagccagacagggctcattccggggggcattgtttcagggaagcagtttgcgttcctgcggaacgaggccggcaacatctgccctggtgctggtgtgctcttcgagttcttcggcatccggcctgagaggctggctgcgttcccgacggtgcacctttgcccatccacaaggatctacaccggcacgacggtctactcgttcgacaagaatgggagcatgatcttcctcgacatctcctacaaccgcctcaccggtgcgatcccggcgggtcttggcaacatgatgtatctggaagtcctcaacctggggcacaacgacctcaacggcacgataccgtatgagttctcagggctcaagctagtcggcgcgcttgacctctcaaacaaccatctcaccggtggcatccccccgggcctcggtggtctcactttccttgctgacttggacgtatccagcaacaacctgtctggtccgattccttcgactgggcagctcaccacgtttccgcagtcccggtatgccaacaattctggcctctgcggcatccctctgcctccctgtggccatgacccagggcagggaagtgtgccgtcagcttcatctgatggaaggaggaaggtcgtcgggggaagcattcttgtcggaatcgtgctctccatgctcacgctgttgttgctgctggtcaccaccctctgcaagctcaggaagaaccagaagactgaggagatgagaaccgggtacattcaaagccttccaacatctggcacgacaagctggaagctgtcaggtgttcacgagccactgagcatcaacgtggcgacatttgagaagcctctgaagaagctcaccttcgcgcatctcctcgaggccaccaatggcttcagtgctgagactctcataggctccggcggctttggcgaggtgtacaaggccaagctcaaggacggcacggttgttgccatcaagaagctgatccacttcacaggacagggcgacagggaattcacggcggagatggagaccatcggcaagatcaagcaccgcaacctcgtgccgctgctcggatactgcaagattggcgacgagcggctcctcgtgtacgagtacatgaagcatggcagcctagatgttctgctgcacgacaaggccaagactgctggtgtgaagctggactgggcagcaaggaagaagatcgccatcggtgcagcaagggggcttgccttcctccaccacagctgcatcccgcacatcatccaccgggacatgaagtcaagcaacgtgctccttgacagcaacctggaggcccgtgtctctgacttcgggatggcaaggctgatgaatgcactggacacgcatctgagcgtcagcacacttgcaggtacgcccgggtacgtgccacctgagtactaccagagcttccggtgcaccaccaagggcgacgtgtacagctacggggtcgtgctcctggagcttctgtcagggaagaagcccatcgacccgaccgagtttggagacaacaatcttgtcggctgggcgaagcagatggtcaaggagaacaggagcggtgacatcttcgatcctacgctgacgaacaccaagtcaggggaagctgagctctaccagtatctgaagatcgctcgcgactgcttggacgaccggcccaaccagaggccaaccatgatacaggtcatggccatgttcaaagacctgcaccttgaccccgacagcgacttcctcgatgggttctcgatcaactcatcgacgatagacgaatcggcagagaaaccgacttgatgctttctcatgagcctttgcagattttgattccatggtccctcgaggggtacgatacaacagcagctagctcaatcattttattttagattggtaggaaaaagagtggcctcctccgatttagtaggaaaagttgtgattttgattccagtcacactcactgtaaatagcgggatgtttaactatttactaccgatatggaagccacctctcagtttgccaattttatcgtagcaactacaattatcacggaaaacagaaacatacctgagcatttacactagttcctaaaaagaagac

SEQ ID NO: 13777 - DNA, 5827 bp, Zea mays
atttcgtaaacatatattttttggacccaccaaaatcaagaaaattccagagatttccgtccgagattgtaaaccccagcctattgatcaaacgtgattctgcgctgcctactacgatcgccaggtccgtccacgaccgccgactgcggatcgtcaggtcagtatgcagctcaacgtgattcaactcgcatccaacggcaggtcgggatcgtcgagcgcggatcgtcaggtatgcctgctctgctgtcatggtttgcgttgtttttcccatgtcaatcggtcacggcctcatagcggatcatggactgcattgttttgaactagtagctggtgcgcgcccttgggcgcgctttatcacggatataagctagattataagtgttgttattatagagaaaaaaatatgtatagaaattggtcccaactttaatatatagaaattggtgcacgtgctcattaaagcaagggtacatgtttctgttatggctggatgaaacattgtccaacagttgcgtactgcttcaaaattttcttttctcggccagggatgatgcaaatagattgggaataggcttatacattaatttgggtgtggttcgtcagtgaactgtcctctcctccctttatactttgcatctgattagaatggtttgaaccgcacttgtttcctgattagaatactttgcatctgattgcacgtgattttgggtttgagggatgaagatgagagaaagaaaaagagggatgtgcatgagaatgcaaatgtgctgaaaagacttggttgagcaggagggtggatattcaaagtgcagacattcctcactgcgttgtgaactcactaataaactatgacctgtgaactcagtcatgtctgcctctaatgtgagctgtgaactcactagtatgagatgtgaacctctagtttggaaaaaaaatgtggctctcaatttgcaaagatggtcctgtgcaattttcacattacatcagcagtggtgctcaattttcaaaggttacgctgtcccatactactagtgatgtaactcccagaaaagcagcattgattgaacagcagatcacagaacatgtagggatcagatcggtggtggaaagagtgcctcaaaataatagcacagtccagttcaatatgatgattttctgagtttcattttttacatgggttaagtcagttaaacattttctttgccgctgtcaaattcttttgaattctcaagattatactccaaaattcttttcaatacaatgtcgcacaatactcattactttgccagcattgcattctcgagaatacactgtcgatactacattctcaaacaatcaattacgttgtcaaccatgggatctaaaattgaggtacattattgcattcactccgtctggactctggagtcacatgactctgaagatgccccttacaggtagcatcaagcacccaaacagcaccctgtattgcaagtttcaactaggaacctcatccagcaccagcacgcccttgctctgaaatcgatttttgcacaactagaatctcacaatgtagctcagaagaagaccgcgctggatgcagaggtactcctgtttctgtagaagaaaatacaagcagaaacaacaggaggtacttgcaccgggtctcgtcgacaaacagcctatttgccagctgacagagacgccggcggcgagcggtaccagagagagaggcggagatgatggtagcttagcaacacctacaagatgcggtgacgtcgctggcgagcagaagcagagtcgcgggcgaagggggtagggatggcatctggtacattttacccgcgtgcccgcgcgtaaaagccctataggatgcgggtttgggtgtgagtttgtacccgtgtgtacggaaacgggtttgattctcaacccgacgggttttttctcgtgggtatgaaaatgttgtaccagtgtccgcaaacccacatacccgcgtgtgtgtctgtgtagactgtagagcacatgcatctcaatttagtgccaccccgaaagctttgaatgaacagagtcaatcaaatgatataaaaaaagactacaggcgctagggaactcgtaaaacttttggctaagatcgatacatgtttttatcagtttaataaatatttattatatgactgtgcctgcggatgtcataaacccgcgggtagcgggtttgggtaacgtacgctacccgtcgcgggtagcgggtgcgggtttaacattaatcttacgggtataggtttgtaatctctgtacccgcgggttttaaacccgttgccatcctagaatgggcagctttttttctaaacagcttttttgaaaatctgttgtgacaagattactgtggagaatctaaatattatgatcattacgtgcggaaaaaatgaatgagtccttagagtttaggatcttaaaagtgatgaatttttgctattacaatagatcgtccgattctatgttcacgttcgttttagacttttaataaaacgattcttataaaaataaattgaaaagttagacgtaactgataatagaagctgaaaaagaactgaaagaaacaaactcaaaaaatgagaacagataggatcctggtggatacaagatccagaacgagagcccgtaacccgcgggtgaaaaagtacatcctcagttccccacccgccgcacacagaccgccccaccgggtctaacccgagaaaccccagggggtccctcgagggcccgggccctggcccccggccctgttgtcatcctcctgcggctcccgcatctctagctctcacgtgcgcaccgcctgctcgacgcaattccccactcgcccaccaaccttcccgtccccgatggcgatcatggcggccaccgccactgccgtggcttccccctccagctccacctcgccaggtcccctccaacccagcccccgcttcctccctcccgtctccacgcccgctcgctgccatctcctccccaagccgcggcggtggtgcgcgcgcctccacatcgagcgtcgggtggccgtcggcagcgacgtgtcttcgtcccatgacgtggctgccgaggaggccgctgctgcgcccaaggtcgggaagcgcgtgcgcgtcacggtgcccgtccgcgtccaccacgttgccaaggcgcccggcctggacctgcgcggcatggagggcgtcgtcaagcagtacatcggcgtttggaaggggaagcgcatcacggccaatctcccattcaaggtagagttcgagctcaagctggacggccaggacaagccggtccggttcatcacccacctccgcgagcaagagttcgagatcctcggggaggaatagagctctggactagagaataacgcgctctcatcggcggctgtggcatctgtatactattgtgtctgcgctaaagaagaacgtggtcgagggtgcggggagaataggagattgcaactttgctagtaagttcctgtttgtttgcttatttgcggtgcgcttctcccctctccaccctttaacattgaaattttcatatgtgaggattgaggaattgttcgattgttgatacttatgatccaaagtaattaaactgaggaatctgttcagcatcaaaaaaaaaaaaaaaacaagacaaaatgttacctctaggagtgagcgatgccgtgacatatgatggaatgtattgtagttaagtttgtttgccacttggatgataagaactagtttgatcctggctcaaacaggaggcatgttggctgatttttccaattaaaataagaagccaatatatctgttgatagccatgcaaaatgaataaaaatatgagcatagctattctgttatgaaattcagtcgcatcactttgtaataaatctactcttcagatgtttcttgttttccttcattacttctatagcattggtcgtgagtattctttcgagatctacaacaacagaaagcaagggcaaagatgccagccctggctttctcagaacaggcactcctcaaactcatttgcagtgaatttgaccaatataaactaggctgaccacttaggggtcaagactaacttgaatttctgattctttgagtttaacctgagtatgctctgattatatgatgcaatttgtgaatcacacctaacttaaattctgcagcaatattcctgataacatttcttactctcctagagactttattactgcgcgttggatattttgtcttctttttttagctttcatgcattctattcttgtttcttgatgtggggttgcacagcctaaaaagactcccctttggttttgacaaaagttccaatcttgtcatatgatattcttttacagggaatgtatgtatttagagttgaattatcagtggcctgttctaatgatgatttcaccattacaagttttgcatcaatccttctgttctagtgatgatctaatgattaatgttccagtgcatttgtttgtgtgctgcatgcaatttctaaatctcacaatgtgagttttcttaacaaaatgaccgtttctattattttacgttgcttatgtgccaacacattcattttacagaaaatgcacaagcggtcatcttctgaccaagcactcatctactcgtatatgcaaaatacatggttatattcatatgcatacgctcacatgtgtgtctacagatcttttctatcacactattaattaaaatttatgaaatcttaatttaccatgaataaatagtatcagaaggagcaaattgagatattttctcaatggacaatgggtaataacttgaagaaacagctgtccattatgcttgatgtttccactaatagaccgaaaatgttattagggctagtttgggaatctcatttttccaacggatttaattagttcattttcccttgggaaaatgaaaatcccttggaaaaatggagttcccaaactagtccttatatggttattggacttctctgccaagtattcttgtgtgctgtttgatttgttgaaagcataattgacaagttagaacttagaacaatcaatgaatgatcttttgggctgccacataatgtttccttcaatctagttaccactcgttcagttatgttatgagtgactcagatgggtgttgaaggatatttgttcaattcaacctatgtttatgtcttcgtattggacaaaatgcctgcagacagctcgctggtgggcacaggtgtttggatttcaaagcgtcaacaaatgggaataagttctgatcagcttctgctgctttcagagccatcattcctgcacaattggcaaatggtacttggacagttgaaaatcccaaaaacatcactaatcctttcattgagggctggcggaattctatggctgatatggaggacatatatagttctctatcattgagggatgtcaaaatgaagatggtgatatgagtgaaacaaattattcaacaatttagagctacaacggcctaagaacattctctgttagagctactggtacttcacaaagcttttctttatataagagacacgatttattacctaccacttcaggagcaggggagacccaatgtcaaaggctcacacatgagtagggtttgagagggataaatcgtggtaaatcttccaccacaaatacagagtggccgagaggctacttcgaacctgtgacctagtggcttagttatatagctcacgccacggcacgaggcacttagttctatagctctccccactgcaccatacacagtgaatcagtgatataaccctcgcaccatgtctgttcttctattatctaccactatcctgcaggtcg

SEQ ID NO: 13778 - DNA, 2424 bp, Zea mays
  misc_feature (2035)..(2035): n is a, c, g, or t
tttttttttttttttttgataatatacaacaagctaatatttacatacaatatacagcagtacagtagtacaccactacttagatcatgttaaatcactacgtgttcagtaaaataaagaagcacaacactgcactacacttactttacagtttacgctaaacatcgtacatgccacacgcacgatcaaggttatgcaagttttccttcctcacatgaaaaaaaaaagataaacaagttccaaacttagaaacgtttggcaggttaaaaatcgacttttctgtcaacttgtttatcaaggttatggccactggagtctggaggaacaaacccccgagccagagaggttacggttcgccaggcagcgtcacaacatcaggccgagccgctcgctggcgacgtcgcacttgacaggcgtgatcccgacgcgaccgcgctccaggtcgtactcgacccacaggttcatctggtggtggtgcccgatcacgtacgccgtcaggggcaccatgtccgcgttcccgaacgttaggcaccacacgccgtcggctccccggcgctcgccggggaccttgtacagcagcctgtccccggccaccgacatctccgcgccattgaacagcagggtcacgggcgggagcctcgccgacggcggcgggcgccccgctggcacgcggaagcaggtgtcgagcgcttcttggaatgcaaagctggggtcgccgagcgcggggaggaggggcttcgtttgtttcaagaactcggctttcagggcggagtatgcatccccgaggaggaaggtgaactgcgtgccggagtccaccatcgtctgccctgcgccggtgtggtccggcgcgagcaccgacgccgggatcggcaggggcttgccgccgacgcggatgccgaggagctggacagagtaggccacgcggtcgaagtaggggagcggcagggtgggctgatacagcggcgtgtagttgagcggcagaaaggggaggtcgctgtggccgaggagcagcacgccggcgtcgtcccggtcggagatgcagtacgagaagcggcgcgtgctggcctgcgtcacaaaggagagcgtgcccctgttcatgcccagcagcccggccgtcgcgacaccgtcgggggaggagtcatacgcggtggacatgcacccgaacgcggaccgcagcggcggcgcgtcgccgacggcgaaaacgtcggtggcgagcgcgccgtcggaggtggacccgtccgcgtaggacagcgacacgctgcactggcgcgaggccccgtcgcaggacggcggcgccggcaggtcccgggagctgcactgcgcggagccgcagggcacggcggcgaacgtggccgagtccctcgggcggaacgactcgcccatggcgctggcagcgccggcgctgccctggcgccccgtcgcgcagagcagccaggagagctcgctgccggtgtcgaacaccatagtgacgttctgcggcggcttgccgacggcgagcgagacggtgaggctgacgttgtggtggaagcgcagcttgctcggcggccgcggcagcgcccccgccggcacctgccgcgcccgcagcgggaacacacgaggcttcgcgcccgggctctgcggctcggcctcgacggcgacagaccacggccgcgacacgggggcgagaaagatgaggagacaaacaagcagcggaggcggcatggtggtgatgtgatggcgacctgcggtgcggccgggggcctatgcgcgcatgtgacgcgagggtggtgatgggttcttgggttggattcgtgcgtggggtttccgtttcggccggctcggggtggattttatggaggtggcgcgcgcgcagtgcagcactgcagcagtgccacagtggtcagtggagggccgaagggtggtgacgcggagggacgggatgggattgccggatgggggcgaggggggcagccggggagggacgcgtcacgcgtccctgtcgcagggacgaagcacggaacagccggattcttctacctgtcgtcttgtggtttcngtactggggagcgcgagctagactggtcacggatacgtatagcttcctaccactcttgcagtgtttttattttacatttttcctaccttgctcagacgattttttaccacgagagtccgtgactattcagaaaagccgctagtagtgattacatacaccactaatccaatgactattctatgtcgacggaaaagaagactgcgtatgaacttttaatatttcaggcccctgttaaataacaactggctaagcattggtgccgattgataaatacttttcaccaatattttttattaaaatacaaatgaacttttaatatatttatatttttgtaaaggtactttttaaaataagtaggtgcatatgactattaggtttcaaaactaaat

SEQ ID NO: 13779 - DNA, 1743 bp, Zea mays
ttttttttttttttttcgcccttggggccaatggtcaccacaagcttagttgatcttagtgcatgcatgttgatatttacagacaatatacaacaacactacctgttcagtaaaataaagaagcacattagtacactacacttaatttccagtttacactagacaccgtacatgccacatgaaaaaggataaacaagttccaaactttagaatcgtttggcaggttaaggttatatggcaactggaggagctaacccccgagccagagcacaggccgcgtcacagcatgaggccgagccgctcgctggcgacgtcgcacttgacaggcgcgagcccgacgcggccgcgctccaggtcgtactcgacccacaggttcatctggtggtggtgcccgatcacgtacgccgtcaggggcaccatgtccgcgttcccgaacgtcaggcaccacacgccgtcggctccccggcgctctccggggaccttgtacagcagcctgtcccccgccaccgacatctgcgcgccattgaacagcagggtcacgggcgggagcctcgccgacggcggcgggcgccccttgggcacgcggaagcaggtgtcgaacgcttcttggaatgcgaagctggggtcctcgagcgcggggagaaggggcttcgtttgtttcaagaactcggctttgacggcggagtaggcgtccccgaggaggaaggtgaactgcgtgccggagtccaccatcgtctgccctgcgccggtgtggtccggcgcgagaaccgacggcgggatcggcaggggcttgccgccgacgcggatgccgaggagctggacggagtaggccacgcggtcgaagtaggggagcggcggggtgggctggtacagcggcgtgtagttgagcggcaggaaggggaggtcgctgtggccgagcagcagcacgccggcgtcgtcccggtcggagatgcagtacgagaagcggcgcgtgctggcctgggtgacgaaggagagcgcgcccctgttcatccccagcagcccggccgtggcgacggcgtcgggcgaggagtcgtacgcggcggacatgcagccgaacgcggaccgcagcggcggcgcgtcgccgacggcgaagacgtcggtggcgagcgcgccgtcggaggcggacccgtccgcgtacgacagcgacacgcggcaccggcgcgaggcggcgtcgcaggacggcggcgccggcaggtcccgggagctgcagcgcgcggagccgcagggcacggcggcgaaccgtggccgaggccctggggcggaacgagtcggcagcagcggccgcggcgcgccccgtcgcgcagagcagccaggagagctcgctgcccgtgtcgagcaccatggtgacgttctgcggcggcgtgccgacggcgagcgagacggtgaggctgacgttgtggtggaaccgcagcttgctcggcggccgcggcagcgcccccgccggcacctgccgcgcgcgcagcgggaacgcgcgaggcttggccccgcccggctcgccggcgacagaccacggccgtggcgcggccacgagcaggatgaggagacaagcgagcagcgcgggcggcatggtggtgattgcgaccctgcggccggggcctatgcgcgcatgtgatgcgagggtggtgacgggttctcgtgttggatccgcggggtgggggttccgctttggccggctcgcggtcgcggtgggttttatggaggtggcgcggggtgcgcaggacc

SEQ ID NO: 13780 - DNA, 1085 bp, Zea mays
ataattattatcgtttttgggacaggccggaaggaagcgtaaagggtagggcggtggttggtgacagcagcaggcctccttcctcctcgctcgcggcgcctccgcctatacctgttgcggcaggcaacaaggcaggcaggcaggcagcagcggagcgccttggtgatctacgaagaggatgaattccaggatctccctcctctgcgccctcgtcctcgcctcctccctcctgcactgcgccagatccgacggcaatgacgcgcagctcctcaagggcatcaacagctacaggtcctcgctcaaggtcccggcgctgtccgagaacaagaacgcggcgtgcctggccgagcagctcgcgaggcagttcaaggggcaggagtgcaccaacacgacgggcgccaacaccgtcatcggcaccgagcagcagttcccggactaccccaggtacctggaccgctgccacctcaacgcgtcggtgaccgaggacggccaggtgatgccggcgtgcgtgccgggcctcgcccccgccgtcgtcctcgccaactacaccaagtcgcagtacaaccggttcctcaacgacagccagttctccggcgccgggatcgcgagcgagggcgactgggtcgtggtcgtgctcagcaccagcacgggatccggcgactactcgccggctccgccgggctccaactgggcggtctcggcggctcggccgttcggcttcggccagctggtccttttgttggtggggtttgtagttttgctggtgaagtgagtgtttagtacgcatgcaccaacatcttcgtggcttatgttgtcacgttcaggtctcgttggctttattaagcttttttcacttgaaaagattgattacgaaacaaacatgtgatttattgttaaaaaaagtaaatcaatctatcgcaatagttaatggaggtcaaaaaaaaaaaaaaaaaagcggactttaaaataaaaaagataaaaaagtacaaaaaaaaataaaaaaataataatacaaaagtaaaccttaaaaaagaatatatcgtaagatcaaacaagaataaaaaaaaggggctgcccttttaaag

SEQ ID NO: 13781 - DNA, 999 bp, Zea mays
aatatcactgcttcaattcaaagtagtaccatctatttatttacagcagaacagtaaaagggcattaaatattgtgccaaaaaatactagtagtaattattatcgcttttgggacaggccggaaggaagcgtaaagggtagggcggtggttggtgacagcagcaggcctccttcctcctcgctcgcggcgcctccgcctatacctgttgcggcaggcaacaaggcagcagcggagcgccttggtgatctacgaagaggatggattccagagtctccctcctctgcgccctcgtcctcgcctcctccctcctgcactgcgccagatccgacggcaatgacgcgcagctcctcaagggcatcaacagctacaggtcctcgctcaaggtcccggcgctggccgagaacaagaacgcggcgtgcctggccgagcagctcgcgaggcagttcaagggccaggagtgcaccaacacgacgggcgccaacaccgtcatcggcaccgagcagcagttcccggactaccccaggtacctggaccgctgccacctcaacgcgtcggtgaccgaggacggccaggtgatgccggcgtgcgtgccgggcctcgcccccgccgtcgtcctcgccaactacaccaagtcgcagtacaaccggttcctcaacgacagccagttctccggcgccgggatcgcgagcgagggcgactgggtcgtggtcgtgctcagcaccagcacgggatccggcgactactcgccggctccgccgggctccaactgggcggtctcggcggctcggccgttcggcttcggccagctggtccttttgttggtgggggtttgtagttttgctggtgaagtgagtgtttagtacgcatgcaccaacatcttcgtggcttatgttgtcacgttcaggtctcgttggctttattaagctttttcactttgaaagattgatacgaaacaacatgtgatttattgttaaaaaagtaaatcatctatcgcatag

SEQ ID NO: 13782 - DNA, 1994 bp, Zea mays
ttttttttttttttttagaagcagagatgatttacgtagaagcagaaatgatttacataatttcggtacatttgcggtgagtgtcacgaaaattagcgacaacgcgaatacctgaaccatcagctacgcttgttcctcagtgccatctgcaagcggtccaaactggcagaattttccgtctacagcatcggaaacagaacgcaagccgaatgggctcagaaagatggtgatcccggccgcgcccagagccccagacaaacggtcactgcgggacagggacgcccagccgaatgggctcctccggtgagtgcgcctctctgccgaggtgcttccacgagaccaccacgcctcgcttcacagcggcggcgtacacggtcatggcgtcagcccaccgcccctgccggctcagctctcccaggagcgcttcgaacgcgttccgtcccggcacgaagtccctcacgatcatcacaagcacaagcacctgcagcgcgtcgcgggccctgccacggtcacagagcgcgcgcaccacgtccgtgtaggcgcgcttccgcagcgcgtatcccttgcgcaccatgtcctccaggagcgccacggccgcgtccacctcgccgccgcgcgccagcgcctgcgccatcaggcagtacgtgtaggacaccggctcgtggcccgaagccactaccttgccgaacacctcctccgcgtcgccgagggccgaggcgtccgtcgcgcaccgccggcacaggccccgagccagcgtgtccagcgcgcgcccgtccacctcgaacccagcgcgctccatccgcttgtacgtctgccacgccgctgaggtctcgccggcgcggagcagcgccgtcagcacgatcccgaagctggtcttgtctggcaggcaggcggcgtcgttgttgccgcacatctccatgagcagcgcgaacgctttgagcgggtttccctccttgcagtggccgttcaagagcgcgttgtacgtgaatgtcgtcggcgagaggcccatcccgatcgcatcgtggaagatggccgtggcctcctccgtccgcccgaccttacagaatccgtcgagcacgatggtgaaggtgtagatgtcaggcgtcaggggcgagtccttgagcttcttgaggagttcgagcgcctcctccagccggccgacgtagcagagcccaccgacgaggctgttgtacgtgcggatggtaggctcgcacccgaggccgagcatggcgtccaacacctccatggccttggtgacgcgtccgcgcttgcagaggcaccccacaacggctgagaacgtggcaacgctggggcggaacccgcgcgccaccatctcgtcgagcgcgagcttggcctcgtcgggcgcgccctgtcggcagaggcactgcacggcggtggcgaaggagtgtgcgtcgggggcgacgggcatggcgcggaacagagcgacggccgtggcgtggtctcccgcgcgagccagcgccgaaaggatgtcgttgtaatcggagacggtgagcgccgcgtcgtcgcgctgcaagaggtcgagcaccttcacccgctcctccacgggcagctccatgatccgcttcgcgcaatcccgggcgcagaaacgcgacctcttgctgctgccgtcgccgcccggtccgtcggagcgcgagtcgagcacttgcggcagtgctgtgtccccgtggagggtgccgttgccgttggaccgtagagcgcggaggagctcagcgtcgtggtcccgcaccggtgctttgcagtggcacgcgaaggcgaaggaagccgccgcgggtcgagggagcgcgctgacatggttggaggaggacggcagggcggggaggcgcgaggatgggggcagcgcgcgagagggttcggggacggtgacctggtggggcggggagagtggtagcgaggtatggtggacgcagagggaagccatggtggaaagtggaatggaatttttgattaggatgttctaggtaatggtctcgtgc

SEQ ID NO: 13783 - DNA, 2099 bp, Zea mays
ccggccgggcggcccccccgcgcctcccccaatccagtccttcgcgccgcggcccgctcattctgtcgaacacctcgtcctctacatcctcatcgacgtcttcccaattcaaaactcctaaaccctagcccttcttcccgacaccaccatccatccaaaatcactgggtgatgcggaagaggtagcctccgcccgccgcccctcccccttcgtccgcgtcgctgcggcgccccgcctcctcatctaccgcgccgccgctccgcggcagctcccgtcgccgctcaacgtattcaggaagggtttttccgagcagtcagttctgccagtcacagattcgattgagtgtttccaaggaccatcagtgccgaatactccacggattccactgtatgatgacagcgtatcctcaagcatattggatacattgtcgaatccgactgggggtgtccctcatgctgatccttcaaagagcagaataatgctagttgatggaacgtcgatgatgtatagatcctactacaagatattagcacagctgcagcacggccagttggagcatgctgatggaaatggggattgggttttaactatattcaaagctctatccctgcttcttgacatgctggagttcattccatctcatgctgcggttgtgtttgaccacgatggagtcccatatggtcattatactgccatgccatctaaagaatgtcacatggcaaaaggaatgacctttcgtcatatgttgtaccctgcttacaagagcaaccgcactccaacacctgacaccgttgttcagggcatgcaatacttgaaggcatccattaaggcaatgtcaataaaagtaattgaggttccaggcgttgaagctgatgatgttattggcaccctggccataaacagtgtttcggctggttacaaggtacggattgtctctcctgataaagacttcttccaaattttatcaccttctttgcgtctgctcaggattgctccacgtggatcagggatggtttcatttggagttgaagacttcgtcaagcgatatggaccattgaaaccctcgcagtttgtggatgttgttgcactttcaggagacaaagctgacaatatacctggagttgaggggattggagatattaatgcagtaaagctgatatctaagtttggttccttggataatctactgaaatccgtggacgaagttgaggatgaacgaattaaacaggctttgatttctcactcggaacaggcaatcctttgcaaaaacctggccacgctgcgttctgatcttcctcattatatggttcctttcaagacagccgaccttgtatttaagaagccacaggatgatggagagaaattcataaaactcttacgagcattggaagcatatgcagaaggttcctcagtaaatccaatcatcagaagagcagcctatctttggaacaaacttaaatcatgatgacactgatgttttcagcgttgaataaaaaggaattttgtcaaggctgagagtttgggttcaaagcttggtgtcgtagtgctcaatactggcggcattgacttctgtggactcggcggccagctacactcacatcgcaacgcaaaatcaaattgttgctggcagaagtgcataaattgaaggtgccgatgcttaagcaaagcagctcagtgtttatacctcggaacttagctctgtagataagaaatgcacaacattgcccatgtattccgccttttttgagaggaaagctcgtggaatctatttgattttttttctctgtactaccaattacaaagggttgtaggtggagctgtggaggccagagcgggcaaccgtgtggcttaacattctaccacgcctagcactctagcaggtttcatgaagtctactacggtggtgaatcagttcgcacaactgttgtgttgtaggagcgagtatgtgctcgttttgtcgctacaaagatgttgtaaggctgagtccaatccccgtcgatcctgactgtggatgccggcggtcggtaccgagcaaactggctccaatgccggtcggtttgattggctggttggagggcttgccaatcgatctgaggcct

SEQ ID NO: 13784 - DNA, 1823 bp, Zea mays
ctggtgtgaatatatccttttccaacaacattggggcctatgagtttcaaggcgatgatggtggccccagttggaaacccaggcctctgatccacttaagtttagccaagaccttctctcagatggatcttaggggtcttttgctggaaatttcgaattctgagcttaaaaacaagctaacagtgatgagtagtaatacatcccaagttgctagtgaaaaagcgagcaagaaaattgcggtcaaggaaaatggtggggataatgaagctcttggaccagaagatcctacagctaataaagattctcatgattcagaacagattggttctaatactagcacagatgctgaaaatgaagatgatgaccacttatcttataatgttcctgatccagatttccatgattttgacaagaatcgcactgaggaatgtttccaaagtgatcaaatttgggctacatatgatgatgaagatggaatgcctcgttattatgcatttattcagaaagttctttccttgaaaccattcaagctcagaataagctatctcacatcaagagcaaatagtgaatttgggcctttgaattgggtttcttctggcttcataaagacttgtggtgatttcaggattggtaaatatgaaagctgtgatatagtcaacatgttctctcaccagatgaaatgggataaagggccgcgcgggcttatcaaaatttatccacagaaaggtgatatctgggctgtttatcggaattggtcctctgactgggatgaagatactccagataatgtgctccatgcctacaatgtggttgaggtactggacgcctatgatgaagtccatggcatctccataattcccttagttaaggttactggatttcgaacagtatttcagcgccatcaggatccaaatgctaccatgaagattcctaaagaagagatgtttcggttttcacacctagtgcctttttacaggatgtcaggcgaagaagctgcaaatgtccccaaagatagttatgagcttgatccagctgctatttctaaagaactgcttcaggggatcacggaagcagtggagccaaatggaacctaaggcagttgatgatgcctgccttggttaacctgccattttgaagtaatcgagcaaaaaaatattaacgcttgctagttttatagatttccttctgcttttgactatcacctttgcatagaagagatacaatggggccagtcattcaggagtcagctgcttagcagcttctggtgtaattagcaggctctgatatgaattttgctgtgatatgttacttagggcttgtttggatgtacgtggattggaggggatcgaagcggcatataatcccttactagtccattcccctcaatcccatgcatccaaaccagcccttagcaactctagatgtgggtgtactaacgcgaagctcaagcagtttttatggtcagtgttgacacctgttatctctgttgccttttttgcgaattcaaatgctaattgaactcgtggccgtttgttggttctgttattttgaaacacccatacgttgtatgtgaaaaactactagcattgcttcactcagtaatttcataaattccagcctactgcggtatactgtatggccagttcgtgttccttttttttaggtgcaccttgtgctcgtttgtgacagcttttattgtctcttttttggaaggaaaaggtcttgccatcgtttttgtcctcttttgcttagtttctgtcgtaaaaaatgtttcttaaaagtaggctaaataaacttcaagcgatttgcatccgcagggggat

SEQ ID NO: 13785 - DNA, 2774 bp, Zea mays
gattcttagtctgtacgaattaatctaggctttttcctggatctgtgttcgctaacctcacttttttcacataggatttctgcagtcaagaaattgacatgctatttcaatgctatggcatgggatcgactattgtgaatgcatatctcgatgtttgaacatttaatgttttagtaatatgacaacttgccatgtatgctaccttatctactgtccttcacagatactcttgtcattgacatttgtcttaaattatacatgacacgtgcaccctaatttttcagggtcattgccgattgtgaattctacgactttgaaggtgttgaatctctcttcaaatgtcttatcaggatcattacccgcccccccgggcaaatgtacctcagttgatcttagtgggaacctgttttcaggggaattagctatattgcgttcctgggatgggattgttgaggtcattgacttgagctcaaacaaattggtgggaagctacccaaatgatgcctcccagtttcagaacttagtgtcactgaaattacgaaacaattcattgtcagggtctctcccttcggtgttgggtacctatcagaagttatctgtccttgatctgagtcagaacaccctcgagggatctgtgttgcctactttcttcatgtcaccaactttgactgtgttaaatctttctggaaataaattttctggaactattccatttcagagcacccattcaacggaatcaatacttctttcatctcaaccaggtctcaggattgttgatctgtccagcaattctttgactgggccattgccaccagatatctcgaacctgcaaaaacttgagttcctcattcttatgatgaatgaattatctggggagattcccagtgagataagcaagcttcaagcactggagtatattgacttatcacacaaccacctgacaggcagaattccggatatgcctcaaaatggcctgaaggtgttcaatgtatcttacaacaatctacaaggaactgttcccaaaagtgtcgaaaagtttcctttatcttgcttccgacctggaaatgacatgttagttttcccagatggcctccctgctggaaatgatgattacaccggagtttctcagggccaaacatctcatgtacataaggctggtgttcccggcccgcttattattggttgcattggagctgttttgctagttatcttcatagccctagcattctatgtggtcaggtctcaagagctttgcggaagaaatggatttagaagtcagatcactatcagggatctgaaggggagaataagccctccaaatctgttcaagcccccgaaagataatgtgataccaagtaaaacaagtttctcaaatgatcatctcttaagagccgcagctagatcgatgtctgcccagaaagagttattggctgaagcctctgttgaatatggctacactgatccaaaggaagttgccgagtccacaagtttaggtgtgaccgagacttctgcaatccaggctcaggagtcttctccacggtctgcattgccaacatcgccacattttgctgattctagattccttgaggaacctgttgcttttgaagtatactctccagaccggctggctggagaattgatcttcatggacagcactttggttttcacagctgaggatctgtcacgtgcaccggcggaagttcttggaaggagcagccatggaacaacgtataaagctgttctacaaagcgggcatgtcctaacagtgaaatggctgcgtgtcggtcttgtgaagcataaaaaggagttcacaaaggagataaagaggattggcactatcaggaatccaaatataatttcatggagagccttctattggggccctaaggagcaagagagattaattatttctgactatgtcaatggtgatagcttggcactttacctttatgagtcgactccaagaagatactcccgcctatcagtttctcagcgtctcaggatcgccatcgacctagcccgctgcctccagttcttacaccaggagaagggcttgccgcacggcaacttgaagccaactaacatattcttggctggtcctggcctctctccaaagctggtggactacggcctgcacaggttcatgactccaagcggcaccgccgagcagatactgaatctaggagcgctagggtaccgagccccagagctggcgaacgcggccaagcctgcacccacgttcaaggcggacgtgtacgcgttcggggtgatcgtcatggagatgctgacgcggaggagcgccggggacatcatctcaggccagtccggcgcggtcgacctgaccgactgggtccagatgtgcagcagggaagggcggggcaccgactgcttcgaccgagacatcgccggcctggaagagtccccgaggatcatggacgagctgctggcggtctcgcttaggtgcatcctccctgtaaatgagaggcctagcatgaagacggtctgcgatgacctgtgctccataacagcgtgagtgagtttccccctcccccaatgtacatgtaaccgatcaattttccgcccgttggtcccgattttttctctatcccgtgggggttccagagccttgtagacagggcttgtttgatttgtaactgctagtgtaaagaggattcgatccacccattgattgattgatatcagccattgccgtcaaaaaaaaaaaaaaaaaaaaaaaaaaaaaaaaaaactcgaggggggaacccgggtaccca

SEQ ID NO: 13786 - DNA, 4848 bp, Zea mays
ttgacatttctcttaaattgtaaatgacacaggcatcctctaatttttcagggtcagtgccaactgtgaattctacgactttgaaggtgttgaatctctcttccaatgttctatcaggatcattaccagccatcatgggcaaatgtacctcagttgatctgagcgggaaccagttttcaggggccggcccggtattgcgttcctgggatgggattgttgaggtcattgacttgagctcaaacaaactggtgggaagctacccaaatgatgtctcccagtttcagaacctagtgtccctcaaactacgaaacaattcattgtcaggatctctcccttcggtgttgggcacctatcagaagttatctgtccttgatctgagtcagaacgcaatcgagggatctgtgttacctaccttcttcatgtcaccaactttgactgtgttaaatctttctggaaacaaattttctggaactattccatttcagagcacccattcaacggaatcgatacttctttcatctcaatcggctctcaggattgtggatctgtccagcaattcattggctggaccattgccaccagatatctctaatctgcaaaaacttgagttccttattcttatgatgaatgaattatctggggagattcccagtgagataagcaagcttcaagcactggagtatcttgacttatcacataaccacctcacaggcagaattccggatatgcctcaaaatggcctgaaggtgttcaatgtatcttacaataatctagaaggaactgttcctaaaagtgttgaaaagtttcctttatcttgcttccgacctggaaatgacatgttagttttcccagatggccttcctgctggaaatgatgattacaccggagttgatcagggccaaacatctcatggacataaggctggtgttcgagttgctcttattattggctgcattggagctgtcttgctagttatctccatagccctagcattctatttggtaaggtctcaagagctttgcggaagaaatggatttagaggtcaaattactatcagggatctaaaggggagaataagccgtccaaatctgttcaggtcccccaaagacaacgttataccaagtaaaacaagcttctcaaatgaccatctcttaagagccgcaactagatcgatgtctgcgcagaaagagttattggctgaagcctctgtcgaatatggctacacagatccaaaggaagttgccgagtccacaagtttaggtgtgactgagacttcatctgcgatccaggctcacgagtctcctccacggtctgcattgccagcagcaccacattttgctgactctagattcctcgaggaacctgtagcttttgaagtgtactctccagaccggctggttggagaactgatcttcacggacagcactttggttttcacagctgaggatctgtcgcgtgcaccagcggaagttcttggaaggagcagccatggaacgacatataaagctgttctacaaagcgggcatgtcctgacagtgaaatggctgcgtgttggccttgtgaagcataaaaaggaattcacaaaggagataaagaggatcggcactatcaggcatccaaatatagttccatggagagccttctattggggccctaaggagcaagagaggttaattatttctgattatgtcagtggtgatagcttggcactctacctctacggtaagcgttttagggttcatggccatcttcgttttagtcaacctgattattttggcttgttacattgctcatttagcctggagagtttttacacttacataattcctactgctgttactatcgtactgcgtatggatctaatgagctgcccctaaattctttagccctttctaaccagactcgaggtttacttcaaatcactgactatattttgtttttttgttgtggactgatgcagagtcgactccgagaagatactcccgcctgtcggtttcgcagcgtctcaggatcgccatcgacctagctcgctgcctccagttcctacaccacgagaagggcctgcctcacggcaacctgaagccgactaacatattcctgactggtcctgatctcactccaaagctggtggattacggcctgcacaggttcatgactccaagtggcgccgccgagcagatactgaacctaggagcgctagggtaccgagcaccggagctggcgaacgcggggaaggcggcaccgacgttcaaggcggacgtgtacgctttcggggtggtggtcatggagatgctgacgcggaggagcgcgggagacatcatctcggggcagtccggcgcggtcgacctgaccgactgggtccagatgtgcagcagggaagggcggggagccgactgcttcgaccgcgacatcgccggcctggaagagcgccccggggtgatggaggagctgctggcggtctcgctcaggtgtatcctccctgtaaatgagaggcctaacatgaagacagtctgcgatgacctgtgctccatcataacagcgtgagtttagtttccccttccttgccttgccttgccttgccccagtgtacatgtaaccgatcggttttcccgtccgttggttggtccctattttttctttctttctcccggtgggttttccggagcccgtgtagccagggtgggttcgtttgattggtaactgctagtgtaaagaggattcgattcgatccacccccattgattgattgatatcccaaccattgccgtcttgatgagttggcccacctctgttcgctggtcaagttcttcacactgagcattttccccgcggcccgccgctgtagctgcaacacctaccctgcagctgatctgctgctcgtgcgaaagttactggcctcacatgcggctctggagccgctgcagcagcatgtgttgggtattcagtcctgatcctgggcacaaggatttattgaacgaaacacaggggtcgttactgaaaccggtccagccttcaattttcgctgtggaaaggaaacaggagatcggcagggggcacaccaccatgttcccacgaatccgatcgtatcttcatctcagccgtcgacaccctgtgtcgccagttggcactgggacttgccaggtgggcccgcgatgtcgccatggtgagagtgctctggttcttggactcatgggccgcaatggaatggttctgacttctgatgagtgaaagacactgtgctgtggtggcctgtgggcggtctatggtctttttgctgcaacagttgcgtatgtattggcactcttgtcggccgacgcgcatcatcagttcgcaaatgcacctgtccttgcccatgattaccgctgattctgagcatctttgagtctgccggatcaatgcgatgtgcagccttttatactcctttctagggcagcacagcaactcagagtattttcttaggtgtcaagcaagctcatcatgatccaagtatccaaacccagtcatttaggaacggccaaatgccagtgccaaggttcaggtcctactgactaccaacatggcttcggttggtaacaacactgtagatgacgatgaaacctgcgaagccttagcattaacacgggcgacaactgcttccacataatggcttcttcctttgcatccacctcctaaactttagtccatctcacatcgaatgttttgatactaattagaaatattaattatagtctaattataaaactaactttgcacaggaagaaccaaccgatgagacaaaactattaaacctaattacttcatgattttgttcatttgatataaattaattaggcataaattcatcttgttgtttagtcttcatatacttaattagttttataattaaactatatttaatatttataattaatattgaaatatctgatgtgagatgacctaaacttaaggtgacagaggaatcaaacaccctagcaatttaaggtgcatttggtcgagctgtgagttatggaaaggctgatataaattgtatcctataagttgtcaggtgtaaagaaaaagcaaaaggctattttgtttaaattgatgtgagttatctaatgtgaacaagttatactgtttatatgcactttgtttaattacatctcttaatcaatgtatataattaaaaaacgatgtcatatttatgtttatgatattttaacaaacacaactagactccactcgatatatatttttaaaatatattatttatttcatttattctaagtgttaattaattttaatctcattttatttttttatttgacatatctcttcattaatatattgaattaataaatcaatcttaaaattcatttcaataacttgttatttaaaatattttttattttatttagaaaaaaatccaaattactctcgtctatgaacaatgttcacataatctcctaaagtatttttaatttaatttatccatctacttctttaagttggttcaatttaccccttaataaaatttgtccttttcaactctttatgtacaaattaagttttcaatttaattttaatttttggttagaggctaatagcataatttagcctagaaaaatatattatttttttatatttattttgataaattagagataagataaaataataacttcaatactatatacctaaatataaaataataatgaaaaattgttaatatatctttttaacataagttataatgttctttcacctcagaaaatattaacttaaaattcaacttgtacgagaaacgaaaaagataaaaattattagaaacagattgggagaagtccaaattcatatagtaaggtggcc

SEQ ID NO: 13787 - DNA, 1426 bp, Zea mays
gtcgttgtactttagtggcctcgaggccgcccgcccccaggggggcggggcaccacaggtactcttctcctgcttggcctcttgtgccgcaaccgcgagtgcggcctacggtagcctccaaagcagcacatccaaagcagggaccgaatggacatggaccggccggaggaggaggggcagcagcggagggagacgatgacgccggtgctcctcaggctgttcggcgtggacgtccaccggggtggcggcagcggggagccggaggagtcgccgatggacctgaggaagagctccagcatgcccgacctcaccatcaacccgctgctgtcgccggaggagaaagagggctgcaaggggtacgcctccgacgacgcggagctggcgtccggccagcagaagcgccgccgtcgcaaggcacaggacaggaagaaaggaattccatggaccgaggaggagcacaggaagttcctggacgggctaaggcagctgggcaagggggactggaggggcatctccaagggcttcgtcaccaccaggacggcgacgcaggtggccagccacgcccagaagtacttcctccggcagaccaaccccggcatgaagaagcgccgggcgagcctcttcgacgtcggtatcgcggactacaaggacaaccaggtgccaggccctcagagcatcgtcgctgccaaaccggcgcctacgcaggagataatccacaccgaccgcggcgacgtccccataccaagatatagaggcctcggagagattttaggcagtaacatgcaggttaatcaactgactgactactactatttcaacaagaactcccatgttcccgcggggacttcgctctccatggcctccggcctggaaacggcctcgaccgtcgacagcctggagctcagcatcgccgtcaacggcctggagctcagcatcgcgcccccttcccggtgcgtctgcggcggcgcggcgggggccatcaaggttctgtgactcggccgggacgccgagggagctactcgcatttggcttcccctgcgagcatgcgtttcatcaagtattatcagcctcgtcaggctgccgcgcgcagccgggtttcggtcttgctggttgtgttggtgtgttctgttctgttttgttgtgcgcaaggaatgtttgtgaagtgcattgcgttgtaatacactaatactagcagtgttgtggaatggaattaggggagagggatcagctgggatttgggggttggggcgtccctgtctcgacttcgagtgggttcgtttcgtgttccaatccgaggaggcggcgacgggcgcaaggcgtcgtgtgggtgtggctctgagctccccgatcccgcccaataattggaccgtgccgtccaaaacgcatacgccaactaatcttcggaagaaagtcgcagctttacgtt

SEQ ID NO: 13788 - DNA, 1207 bp, Zea mays
  misc_feature (1186)..(1192): n is a, c, g, or t
  misc_feature (1194)..(1196): n is a, c, g, or t
  misc_feature (1198)..(1199): n is a, c, g, or t
  misc_feature (1201)..(1201): n is a, c, g, or t
  misc_feature (1204)..(1205): n is a, c, g, or t
ccggccgggaaggaaatacacagagaccgggcatataaatgtaagcaagtccaatgtaaggccgcccccccaggggggccgggcagcagcggagggggaagatgacgccggtggtcctcaggctgttcggcgtggacgttcgccgggttggcgccagcggggagccggaggagtcgccgatggacctgaggaagagctccagcatgcccgacctcaccatcaacccgctgctgtcgccggaggagaaagagggctgcaaggggtacgcctccgacgacgcggagctggcgtccggccagcagaagcgccgccgtcgcaaggcacaggacaggaagaaaggaattccatggaccgaggaggagcacaggaagttcctggacgggctaaggcagctgggcaagggggactggaggggcatctccaagggcttcgtcaccaccaggacggcgacccaggtggccagccacgcccagaagtacttcctccggcagaccaaccccggcatgaagaagcgccgggcgagcctcttcgacgtcggcatggcggactacaaggacaaccaggtgccaggccctcagagcatcgtcgctgccaaaccggcgcctacgcaggagataatccacaccgaccgcggcgacgtccccataccaagatatagaggcctcggagagattttaggcagtaacatgcaggttaatcaactgactgactactactatttcaacaagaactcccatgttcccgcgggcacttcgctctccatggcctccggcctggaaacggcctcgaccgtcgacagcctggggctcagcatcgccgtcaacggcctggagctcagcatcgcgcccccttcccggtgcgtctgcggcggcgcggcgggggccatcaaggttctgtgactcggccgggacaccgagcgagctactcgcatttggctctcggcccctgcacgcatgcgtttcatcaagtattatcagcctcgtcaggctgccgcgcgcagccgggtttcggtcttgctggttgtgttggtgtgttctgttgtgttgtgttgtgcgcaaggaatgtttgtgaagtgcattgcgttgtaatacactaatgctagcagtgttgtggaatggaatcaggccagagtcataaaaaaaaaaaaaaaaaaaaaaaaaaaaaaaaaaaaaaaaaaaaaaaaaannnnnnnannnannanaannaa

SEQ ID NO: 13789 - DNA, 5387 bp, Zea mays
  misc_feature (1741)..(1741): n is a, c, g, or t
gtgccagggcagggggtagaaatttcggaagggcggcccttttcttgctgcccatgcagctgccctcctccttcagtccttccttccccattcatgtgcctcgcgacctgtgacagcgctgacgtgtcctagtaaaatatatagacgcgcgcgcgtcgtaaaagacgacgacggacgacggacgagatcgaggccggccgccggcggcggaaacgaacaaagaggaccggccggccgcgcgcggcagtgcagcgtacgtaccccgcggagcatcgtgctcgtcatatcgatcgatccagccgacggctcatggtggcggccgacgacagcgaccgccgcgagagccgagcgacacccgtccgcgtcaacgggggggccgggaatgcgtgcgtgcgtgcgtgtccggccgtgccgctggtggtggtttactagcttgcaggaggcccgtgtccggcacggcgtcgtgtactagcgcgtacgtacatacatacgcaaggctacaaactaacgcgcgcgcgcgtggtatgcagcggtcgcggtcatgcattcacgacacgagcacggcgcggcggtgtacgtaggctagggtacaagaggaaggaggaggctgactagccacaccgtcgccgtcgccgcgcgccctttgtcgttccagcaccccccccttgccagcgtgtacaaggagacaaggcggcttgtatgtatgtatgtatacgctgcgccaactcgcacgacggccggcatgcgcgcgcgtctctcctcggattattgcccgtagctataatagctgaagctacagctacgcgctatacatacccctcgtcgcctcgccgcccagagctagctatctcagtactagacactagcagcagcagtagtgggcagtggcatgcgtcgtcgtcgatcgcattggcattggcattggcacacgtacgatcgatatgccatgccatccttggtcctcgtctcggccacgaccacgagaccagctgagacagcaaacgggccgggcggccaatgggcgcgcatcagtcgtcgtcgtcgttgctacgtacgtacctcggtacctggtgctagctagcttagctgggcgcgcgtgccatgaacaagagctgctggcctcttcccgtttctttgtttcttctagcccctgctgctagctctttagtattttgtttgttatagttaaatcgattgattaggttcaggtcttgaagagagctaccatctgctgcccgcgcatactaacagctgctctactggccgtacgtacgtgtgagccccgtgatcatgctcagctgctagctaagctagctagtagatatcttaactatctagctagctacctagtgtcatgccagtatttgactactgtagtagctagtgtgctactgtgtgtgtatatatagtgtagtaatatatagctagtcttgttgttgagaagccaactgttttttataatattaaaaattaataagaaattagttacgtcgtccgtcgtgtaggtgccatgcaatgcacgtaggacaaaagtacgtacatacgcgtagcaggacaaatatatacaccccccatgccaacgacaaaccataccacacgcactcgtccgtccgtacacccagccctttctatagggatcgtatccagtgcacaagggccacgccgtgcacaaatgcacaaaacgaaatctggccgtccgtctcccatccaacggccgtcgtaaatatgcagatgaaccctnccgcagcctccgtagcttgccgagtctgttttgtgaaaaaccccccgcgccgtcatgtcgttggatggaaaatggacggccagatttcgttttgtgcatttgtgcacggcgtggcccttgtgcactggatacgatcccataaatgtaagcaagaccaacggagcaaggcccccccaggggggcggggcaccacaggtactcttctcctgcttggcctcttgtgccgcaaccgcgagtgcggcctacggtagcctccaaagcagcacatccaaagcagggaccgaatggacatggaccggccggaggaggaggggcagcagcggagggagacgatgacgccggtgctcctcaggctgttcggcgtggacgtccaccggggtggcggcagcggggagccggaggagtcgccgatggacctgaggaagagctccagcatgcccgacctcaccatcaacccgctgctgtcgccggaggagaaagagggctgcaaggggtacgcctccgacgacgcggagctggcgtccggccagcagaagcgccgccgtcgcaaggcacaggacaggaagaaaggtgagctttttttttctttctggatttctatcaatcgctttctttactgctctgctcttcttgtaattaatcccacgatggacgatggattccaacggaaaatgttgtcctttcttagattcagaaaccaaccagtaaaacattcaggcatttacacaacacacacacacacacaaaagtatctccgtgcgagtcaacggcagctatcttgcagcccagaaatgcttttactgtgaattgatccgttgttcggtggaatcggcgcaggaattccatggaccgaggaggagcacaggaagttcctggacgggctaaggcagctgggcaagggggactggaggggcatctccaagggcttcgtcaccaccaggacggcgacgcaggtggccagccacgcccagaagtacttcctccggcagaccaaccccggtatgaagaagcgccgggcgagcctcttcgacgtcggtatcgcggactacaaggacaaccaggtgagctagcactccaactggtacagtacaagaacgattcgtcagatcttggagccagccaacagcgctaatcgtcctctttctttctccccccctttttttttttgtttcgtttcaggtgccaggccctcagagcatcgtcgctgccaaaccggcgcctacgcaggagataatccacaccgaccgcggcgacgtccccgtaatttatatactccttccgctgtgttttctccttgtcctggtggtaactgagaacccaagatctgaacagtgaattttttatcctccctctcctcagataccaagatatagaggcctcggagagattttaggcagtaacatgcaggtaaggtaaccttatgccctctattgcactggtagtaagggcggaaggacgttttcatgtactatataatagtctgagcaaaactgacaagcgaactgaatgatcctttggacaggttaatcaactgactgactactactatttcaacaagaactcccatgttcccgcggggacttcgctctccatggcctccggcctggaaacggcctcgaccgtcgacagcctggagctcagcatcgccgtcaacggcctggagctcagcatcgcgcccccttcccggtgcgtctgcggcggcgcggcgggggccatcaaggttctgtgactcggccgggacgccgagggagctactcgcatttggcttcccctgcgagcatgcgtttcatcaagtattatcagcctcgtcaggctgccgcgcgcagccgggtttcggtcttgctggttgtgttggtgtgttctgttctgttttgttgtgcgcaaggaatgtttgtgaagtgcattgcgttgtaatacactaatactagcagtgttgtggaatggaaaaaaaaaaaagggatcagctgggatttgggggttgatgggtccctgtctcgacttcgagtgggttcgtttcgtgttccaatccgaggaggcggcgacgggcgcaaggcgtcgtgtgggtgtggctctgagctccccgatcccgcccaataattggaccgtgccgtccaaaacgcatacgccaactaatcttcggaagaaagtcgcagctttacgttatgtgacatttagttaaagtgatatgcgtttagccagtttttattttttatttttatgaatattatttatatctattgtttaaattaatttattataaaatgtattttataatttatttaatgacatttatttaatatcataaacataaaaaatcatctgtattaatcagacttttagaatataagattatgttagaattatatattttttctccttgacgtggagagtaatgtcacactgagagaagcgaacgagaggcggctgtgctgtccgagtcttccgtttgcggctggctatatcccatgactctaaattttacactatagtaaaatttaaaaatcagattaaattataatcagattctatttctattatttttaaaataaaatttatttaggatttaaaaaaatatgatggaccgtgacccattatcatcactgccggcgtctcatctcgcttttgcatgaatcacagcgactaatataaagcctctgcgatgatgagcgggtaaagatgaagggtgaggtcgaatctgggacgggatatgtggatctcgccggtgacaaagtggtccgtccacgcacgagtgagggggcacagcacagcacagcgagagagacgggcggccacatcgccatcgcggcgcgcaatgcggacgtggccacctgcaccgggacccaaacccaaccaagtgatggcttttgccgccgctgttttgctcccgaccgcttcaccgtcggcggcagcgccagagggcccgtctggctggccggccggtgtcccaccggtgcggcggccgcgggtgctggtggagggtccacgacacacctgacacacgccgttagctttttaggcttttcagtttcaccgaaagggagggtgcagtgcaggtggagaatggggattggggaatcgatagaaaaatggatggatcatgagatagcgctcgccgacctttcacgggattgggaaggcgatcctcgaagataaggtgcagatcttgccgattcttctcccctttttttttgttctgggtttgtgggttgcttcgaatcaggagagcactgtttgtgctcctcgatctcgaggtggccggccaacgtgcaacgacggcaccacaccacctcatgcacgctgcatgcatgtacgaggtcggaaggaaaacgtacgatatatacatccagatacggcgagttcataacacctaaacctaggaatgggcggggggaaaataaaaaccttgcggtcctctcgatggcgagtcaacgttggtagctagagtattgtagatactccagactccagtacgaaagatatcatagtcaaaggcatccaagggcaaggttcgcagggaaaacaaagttttaattaacttttttttttaaaaaaaacagagtaagtcaatgcgtgaatcgcgtatgtaatcaggacagatcctagtcgagttgacccaactttgctggacgtgcttgtttcccaaggt

SEQ ID NO: 13790 - DNA, 1640 bp, Zea mays
cacacaaaatcagcacttttctttcttccttttggctagttaccttcaatttttgtctcaaaaccagcattgaaacataggctaccccaacgaaacataggctaccccatatattatactacctccgtcctcgaatatttttgaactaaaacatgacagataaaaaaagaacggagcgaataacattattaagctgcaagcagaaacaccaaaagcgcttgccaccgcgttactgttttcccatgtcaacagctgacagcaacttcctgcaccttagcgacaaggtttcccagctccgtcactccagcctcctgcgatttctgaatcgagggtaactcaaaacagacataattccagtaatctactaacttgtgatcttttggaaccacttcgtttgcccttccagcacagaagattgcgtaagcatcagcagcatacttgccaacaccacaaagctcagtgatataggtccattcttctccaacgtaagccttagagaatttctgaattctgtttgttttcacacgctgcagtccaagaggtgctagatactctgccatcttttcgggatcagctgtatatgcagtctgagcatcaggatagcgcttgaagaagcccttcactttcttcctgacctgttttccctgtgttaagttgaggagcatgcatattacgatgaccttccaggggtcagaagcatacttctcctgcaatagcttatggggggagcgtggtgggggcaccagctgatccagcggcaggcggcggtatttatctgaccgcttctcggcaggactaagtaatatcggtggtttcctcggctttttctccattgtcgttttctcctcaggttttttctttcccttgacccttacaccttcttgtgaacttgagattgatgctgaggctgggcatgcttgcttggtgttcaaggttgttgtccgggcagccttggagacctcttttgcagtaagcagagaagacccagatgacgggtggcctcgaggaggcagcctcgctgtgcgaccagtggtactaggaagtggcgaaccattcccatcttgccggcgctcaggtttgtaggcgaattgggcaaaaaatgcaccaaaaggtgaacaataattggggtcctgatcaatgaaatcgggattagctatgggagggaaaaagccttggggcagtgtctgctgcttcttcaaaaccttggaattcttgctgcggttgatcctcttgacacactgtctgcccatgacgccaccagcagcagcttcttcccctgcccttgaatagacatcattgagaaatggtgtttggccagattgctcctgctccaccttccgccgcctatgtttcttccttaccgtcgcaccctctgtcatcaccttcttttccatctgcgtgatttgtgccgcggccccagttggcaccgatggtataatcattgcagcctccctatccttccttttcttgtgcctcttttctaccttcggcacaggatcctcaattaatggaactgccggcagcgcctcctgattctccctcttgcgctccttaccctgcatcactgtcgctgctgtcatcgccgaggttagggtttcgggagcgactgggactcccgcgtacctcggccgcgaccacgc

SEQ ID NO: 13791 - DNA, 4566 bp, Zea mays
aattcggcacgaggcctcctcccgttccagagctcactgcttcgctccacccacccttaagcaggagtggtatctggtggttttgtttttcaaaagaagacagaaatgtcttccttgaggcctgcccagtcttctagttcatccagcaggactcggcagagctcccaggcacggatactagcacaaacaacccttgatgctgaactcaatgcagagtatgaagaatctggtgattcctttgattactccaagttggttgaagcacaacggagcactccacctgagcagcaagggcgatcgggaaaggtcatagcctacttgcagcatattcaaagaggaaagctaatccaaccattcggttgcttgttggcccttgacgagaagagcttcagggtcattgcattcagtgagaatgcacctgaaatgcttacaacggtcagccatgctgtgccgaacgttgatgatcccccaaagctaggaattggtaccaatgtgcgctcccttttcactgaccctggtgctacagcactgcagaaggcactaggatttgctgatgtttctttgctgaatcctatcctagttcaatgcaagacctcaggcaagccattctatgccattgttcatagggcaactggttgtctggtggtagattttgagcctgtgaagcctacagaatttcctgccactgctgctggggctttgcagtcttacaagcttgctgccaaggcaatctctaagattcaatcgctaccaggtggaagcatgcaggccttatgcaataccgtggttaaggaagtcttcgaccttacaggttatgacagggttatggcttacaagttccatgaagatgagcatggggaggtctttgctgagatcaccaaacctggtattgagccctatctaggcctgcactatccggccactgatatccctcaagctgccaggtttctcttcatgaagaacaaagtcaggatgatctgtgattgccgtgcaagatcggtgaagattattgaagatgaggcgctctccattgatattagcttgtgtggttcaactcttagagcaccacatagctgtcaccttcagtatatggaaaacatgaactcgatcgcatcccttgtcatggctgttgtggttaatgaaaatgaagacgatgacgaacccgagtctgaacaaccaccacaacagcagaagaggaagaaactgtggggtctcattgtttgccaccacgagagccccagatatgtgccgtttccactgcggtatgcctgtgaattcttggcccaggtgtttgctgtccatgtaaataaggagtttgaattggagaagcagatacgagagaaaagcattctgcgaatgcagacaatgctctctgacatgctattcaaggaatcatctcccttgagtatcgtatccgggagtccaaatatcatggacctcgttaagtgtgatggtgctgctcttttgtatggggacaaagtatggcggcttcaaacggctccaactgagtctcagatacgtgatattgccttctggctttcagaagttcatggggattccactggcttgagcactgatagcctccaggatgctggatatccaggagccgcttcccttggtgacatgatctgtggaatggcagtggctaagatcacgtccaaggacattcttttctggttcaggtcacatacagctgctgaaatcaagtggggaggtgcaaagcatgatccatctgatgaggatgacagcagaaggatgcaccctaggctgtcctttaaggctttcctcgaggttgtcaagatgaagagtttgccatggagtgactacgagatggatgctattcactcgttgcaacttattcttagaggtacactgaacgatgccttgaagccggcccagtcatctggtttagataaccagattggtgatctcaaacttgatgggctcgccgaactgcaagcggtgacaagtgaaatggttcgcctgatggaaacggcaactgttccgatcttggcggtagatggcaacggattggtcaacggatggaaccaaaaggtggcggacttgtcggggttgcgagttgatgaagctataggaagacacatacttacacttgtggaggattcttctgtaccaattgttcagaggatgctatacttagctctgcagggtgagtgatctgcaacatttgattgccgttcttgctagtaatagtcaaccttcagaaaaaagaaacgaacagcttattgtatttttttgaaagggtttattgtattgtgtattgatttctaactatttcatcgattgagcaggcagagaagagaaggaggttcgatttgagttgaaaacccatggctccaagagggacgatggccctgttatcttggttgtaaatgcttgtgccagccgtgacatgcatgaccatgttgttggggtgtgctttgtagcccaggatatgactgttcacaagttggtcatggacaaatttacccgggttgagggggactacagggccatcattcacaacccgaacccgctcattcctccgatatttggtgccgaccagttcggatggtgctctgagtggaacgcagccatgaccaagcttactgggtggcacagagatgaggtgatcgacaggatgctccttggcgaggttttcgacagcagcaatgcttcctgccttctgaagagcaaagacgctttcgtacgtctttgcattatcatcaacagcgcattagctggtgaagaggcagagaaggctccaatcggtttctttgaccgcgatggcaaatatattgagtgccttctgtcagtgaacagaaaagtgaatgcagatggcgtcgtcaccggagtgttctgtttcattcatgttcctagtgatgacctccagcatgcgctacatgtgcagcaagcctctgagcagacagcactgagaaggctgaaggctttctcgtacatgcgacatgccatcgacaaacctctctcaggtatgctctattctagggaaacactcaagggcacagacctggatgaagagcagatgaggcaggttcgtgtcgcggataattgccatcgccagctaaacaagatactcgccgacttagatcaagataacattactgacaagtaaccttcttgccaagtctttttaaactgttctattaggttcttgtattcaataactactgaagcttatagccatattcgttactaccaccttaatatttctgtatcattatgtttcacaggtcgagttgcttggatttggacatggctgagtttgtgctgcaagacgtggtggtgtctgctgtaagtcaagtactgataggttgccagggtaaaggcatcagagttgcttgcaacctgccggagagatccatgaagcaaaaggtttacggggatggtatacggctccagcagatcctctccgacttcttattcgtttcggtgaaattctctcctgctggtggctctgttgatatctcttccaaactgaccaagaacagcattggcgaaaaccttcatctcatagacttcgaacttaggtacaccgtgcatgctaatttgcacgcatgcactcatttctggataggagattacaaggtatgaaggcttaaattactcctgtgttgatggctttatggtctttcaggatcaagcaccaaggagcaggagtcccagcagaaatactgtcacagatgtatggggaggacaatagagaacagtcggaggagggcttgagcctccttgtttctagaaaccttctgaggctcatgaatggcgacattcgtcacctcagggaagctggcatgtcaaccttcatcctcactgctgaactcgctgctgctccttcagcagctggacattgaagccgtcactgcaaacaagtgccaaatggtatgttcgctagtttgtgttaaggcagtctgcaatttcccaaatttccttagcttagaataaaataactctgcaatttcccaaatttcctactatggatatatgatgaataaataaggtaccatgttctttccatacgaggggtaatgatacatagatctcctgcgtatcctcggaaaacaatacagaacagaggataacaattatgcctaattccgattaattggtactgtgatgtatttttgtttcatgtgtacgtcaagtaacacagtcctcaagagtattatttctgcccttggtgccagctgcccagctccctcagagttcattcggaaagccacggtggttcgcggagaatgggaaatgctgcagcctgtaggatcaccgaatgcataagaaataagattgacttgtatggttgtttgttaggcggggaagttgtgcaggcatagtaagactccatacttctgctcttttctgcctgtaaccaactgttttctatcagttattaggctatctcatcagtttaattatacttatccctcatatttaaatttcactttgcaaacaatacaaaacagtgttttgatgaccatatggatgaactgcgaagacaatttttttaggctgtctctaatatttcatccatatggtcacccaaaatac

SEQ ID NO: 13792 - DNA, 2239 bp, Zea mays
gctggatatccaggagccgcttcccttggtgacatgatctgtggaatggcagtggctaagatcacgtccaaggacattcttttctggttcaggtcacatacagctgctgaaatcaagtggggaggtgcaaagcatgatccatctgatgaggatgacagcagaaggatgcaccctaggctgtcctttaaggctttcctcgaggttgtcaagatgaagagtttgccatggagtgactacgagatggatgctattcactcgttgcaacttattcttagaggtacactgaacgatgccttgaagccggcccagtcatctggtttagataaccagattggtgatctcaaacttgatgggctcgccgaactgcaagcggtgacaagtgaaatggttcgcctgatggaaactgcaactgttccgatcttggcggtagatggcaacggattggtcaacggatggaaccaaaaggtggcggacttgtcggggttgcgagttgatgaagctataggaagacacatacttacacttgtggaggattcttctgtaccaattgttcagaggatgctatacttagctctgcagggcagagaagagaaggaggttcgatttgagttgaaaacccatggctccaagagggacgatggccctgttatcttggttgtaaatgcttgtgccagccgtgacatgcatgaccatgttggtggggtgtgctttgtagcccaggatatgactgttcacaagttggtcatggacaaatttacccgggcggacgcgggcgccggcgcctgcattcacaacccgaacccgctcattcctccgatatttggtgccgaccagttcggatggtgctctgagtggaacgcagccatgaccaagcttactgggtggcacagagatgaggtgatcgacaggatgctccttggcgaggttttcgacagcagcaatgcttcctgccttctgaagagcaaagacgctttcgtacgtctttgcattatcatcaacagcgcattagctggtgaagaggcagagaaggctccaatcggtttctttgaccgcgatggcaaatatattgagtgccttctgtcagtgaacagaaaagtgaatgcagatggcgtcgtcaccggagtgttctgtttcattcatgttcctagtgatgacctccagcatgcgctacatgtgcagcaagcctctgagcagacagcactgagaaggctgaaggctttctcgtacatgcgacatgccatcgacaaacctctctcaggtatgctctattctagggaaacactcaagggcacaggcctggatgaagagcagatgaggcaggttcgtgtcgcggataattgccatcgccagctaaacaagatactcgccgacttagatcaagataacattactgacaagtcgagttgcttggatttggacatggctgagtttgtgctgcaagacgtggtggtgtctgctgtaagtcaagtactgataggttgccaggggaaaggcatcagagttgcttgcaacctgccggagagatccatgaagcaaaaggtttacggggatggtatacggctccagcagatcctctccgacttcttattcgtttcggtgaaattctctcctgctggtggctctgttgatatctcttccaaactgaccaagaacagcattggcgaaaaccttcatctcatagacttcgaacttaggatcaagcaccaaggagcaggagtcccagcagaaatactgtcacagatgtatggggaggacaatagagaacagtcggaggagggcttgagcctccttgtttctagaaaccttctgaggctcatgaatggcgacattcgtcacctcagggaagctggcatgtcaaccttcatcctcactgctgaactcgctgctgctccttcagcagctggacattgaagacatcactgcaaacaagtgccaaatgtaacacagtcctcaagagtattatttctgcccttggtgccagctgcccagctccctcagagttcattcggaaagccacggtggttcgcggagaatgggaaatgctgcagcctgtaggatcaccgaatgcataagaaataagattgacttgtatggttgtttgttaggcggggaagttgtgcaggcatagtaagactccatacttctgctcttttctgcctgtaaccaactgttttctatcagttattaggctatctcatcagtttaattaaacaaaaaaaaaaaaaaaaaacccgcggcc

SEQ ID NO: 13793 - DNA, 1229 bp, Zea mays
cgtctttgcattgtcatcaacagcgcattagctggtgaagaggcagaaaaggcttcattcggcttctttgaccgcaatgagaaatatgtcgaatgccttctgtcggtgaacaggaaagtaaatgcagatggtgttgtcactggagtgttctgtttcatccatgttcctagtgatgacctgcagcatgcgctacatgtgcagcaagcctctgagcagacagcacaaagaaagttgaaggctttctcgtacatgcgacatgccatcaacaaacctctctcaggtatgctttattctagggaaacactcaagagcacaggtctgaatgaagagcagatgaggcaggttcgcgtcggagacaattgccatcgccagctaaacaagatacttgccgacttggatcaagataacatcactgacaagtcaagctgcttggatttggatatggctgaatttgtgttgcaagatgtggtggtgtctgctgtaagtcaagtgctgataggttgccaggctaaaggtatcagagttgcttgcaacctgccagagagatccatgaagcaaaaggtttacggggatggtatccgactccagcagatcgtctccgacttcctatttgtttcggtgaagttctctcctgctggtggctctgttgacatctcttccaagctgactaagaacagcattggggaaaaccttcacctcatagacttcgaacttaggatcaagcaccgaggagcaggagtcccagcggaaatattgtcgcaaatgtatgaggaggacaataaagagcagtcagaggagggcttcagccttgctgtttctagaaaccttctgaggctcatgaatggtgacattcgtcacctcagggaagctggcatgtcaaccttcattctcactgctgaacttgctgctgctccttcagcagttggacgatgaggacaaactgcaacaagtgtcaaatgctctctcagagttcattcggaaagccacggtggtttgcggagaatgagaaatgttggagcggcgtgtaggatcaccgaatgcatagtacggctccatacttctgctctgtttctgcctgtaactcaactgtgaaaagttttaaactttcagaaagaaaaaccgtgagaggtgcaggttcaagttaatatgaataataaagtgtttttttttaaaaaaaaaaaaaaaaaaaaatataaaatttagcggcagcgggggtgcccgccggtacc

SEQ ID NO: 13794 - DNA, 2770 bp, Zea mays
acctttcgtctgggagatcattatattctaagggaaataatgtctcggaggacgaagggcattaacatttaacattttttgtgttgccttgttcttaactcatagcatttaagaacaagtccccaacatatcctttgaaagactagagggtaattagttcccatattctaaactttagtgacttaattttagttatttttaatcattaaaataccaaatgatatgactaaaataggtgttcaaagaatttgaaggaactaaagtttaggaggttgactaaggggtattttgtttctaggtactgaattttagtccctccaatttattccattttagtctctaaattgctaaatataaaatatttttgtttccgtatttagcaacttagagactaaaactctattttattttctatatttagtaatctaaagactaaaatagaattaaatgaagaaactaaacattaattcttaaaaaccaaacaccacatcgtgtaaagaacttttgtttctcagctttggccttctgctatatagcacttgaaggccattcctttgaaaaaaaacacgacctatgataaaataaggacactatcaaaactaaggcactagcttaaaaaatacaacaaaagtgagggcacccgcttaaaaaaccgtcctccacagcccgacgaattttttagggcctcactctctcattcggccggcgaggaagccttggcctgccgaccaaaccatgcttgcgcgccgactcgcggcccccgacggcggtaggctgttctctgcggcgtcctccgcctccgcccgaggcggtcacgcgggtggcgacacactagggaagcgcctgctgaagctcatctacccgaagcggagcgcggtggtggtgctgcagcggtgggcggacgaaggccgcaccgtgcagaagtaccagctcaaccgcgtcgtcagggagcttcggaagtacggtcgcttcaagcacgccctggaggtacaccacccaacccttgtccacgtctccaccgccgacgcttcggaacgctcgcctcctgctcgatgtattgccaacctggttcctgacgtgaccctgctcgtcccgcgctcaaaatgcagatatgcgagtggatgcggacccagccggagatgcggctgcttccgggggatcacgcggtgcaccttgacctcgtcgccaaggtcaggggactcgccagtgccaccaagttcttcgaggacatgccggagcgcgccaaggggccgtccacctgcaacgcgctgctgcacgcgtacgtacagaatggcgcaagagagaaggccgaggccatgctggcggagatggcccgtgttgggtacctcacctgtgccctgcccttcaaccacatgatgtcgctctacatggcgactggtgagctcgagcgggtgccagaaatgatcaaggagctaaggaggtacacactccccgacctcgttacctacaacatatggctgacatactgctccaaaaaggacagcgtgaagagtgccgaaaaggtctttggtctgatgaaggatgactgcgtggttcctgattggatgaccttcagcttgctcggtagcatttacatcaacgccggactccatgtggaaggtcggaacgcgttggtggagatggagaagagggcctccaggaaggagcgagctgcttactcatcgctcctcaccctgtatgcaagcttgtcagatagaggtaacttggacagagtatggaataagatgagaggaaccttcaggaagttcagtgacacagagtacaagtgcatgctcacttccctcttgaggtttgacgacatagcagcagcagaaagcatttttagtgagtgggaatcaacatctggaacacgtgattcaaggatcccaaacacgatcctttcatattacatcaagaatggcatgataaaaaaggcagagagctttcttgaccacattgtggagaaaggagtcaagcccagctatagcacatgggaggcattcgtctggggttatctcggtgacaagacggacaaagtccttgagtgcatgaagaaagccctgtcatgcttggagaaatgggagccgaaccatgagctcgctaccgcgatcttttctcagatcgagaagacaggtgacattgaagctgcagagaagctcctggtcatattccgggatgcagagtatgttaccactgagatgtacaactcagtcttgcgcacttatgcagaggccaagctcatgcctctgatagttgacgaacgcatggagcaggataaggtggccatggatgtggaaaccaagagattgttgaggttgaccagcaaatatccaatcggtgaggtttcagtatcgatgtcttgaggtgtgccaacaatagaagggtgtttcaggatgcaatgtgtactagcccttacgttttcatgcactttagttctgaagtacaatgcaatgcaaataacaaacatttagttttgaagtgcaatacagatggttgtgattttttttgcatacttatctaacttgttggactgtattgtctctatctataaaaaaaaaaaaaaaaagcccggctctgaggccttctacttagctgatatcttaggcttgtgtatatattgtagccccccaatacatattatttttatactggccaacatggcatcaaagagcctacaccaatcctaattcaccctggtcgttggcctcctctagttgtgtaacaccataaatccatcaattaaaataatataataatagtcatttaaaac

SEQ ID NO: 13795 - DNA, 1745 bp, Zea mays
agggcctcactctctcgttcggccggcgaggaagccttggcctgccgaccaaaccatgcttgcgcgccgactcgcggcccccgacggcggtaggctgttctctgcggcgtcctccgcctccgcccgaggcggtcacgcgggtggcgacacactagggaagcgcctgctgaagctcatctacccgaagcggagcgcggtggtggtgctgcagcggtgggcggacgaaggccgcaccgtgcagaagtaccagctcaaccgcgtcgtcagggagcttcggaagtacggtcgcttcaagcacgccctggagatatgcgagtggatgcggacccagccggagatgcggctgcttccgggggatcacgcggtgcaccttgacctcgtcgccaaggtcaggggactcgccagtgccaccaagttcttcgaggacatgccggagcgcgccaaggggccgtccacctgcaacgcgctgctgcacgcgtacgtacagaatggcgcaagagagaaggccgaggccatgctggcggagatggcccgtgttgggtacctcacctgtgccctgcccttcaaccacatgatgtcgctctacatggcgactggtgagctcgagcgggtgccagaaatgatcaaggagctaaggaggtacacactccccgacctcgtcacctacaacatatggctgacatactgctccaaaaaggacagcgtgaagagtgccgaaaaggtatttggtctgatgaaggatgactgcgtggttcctgattggatgaccttcagcttgctcggtagcatttacatcaacgccggactccatgtcgaaggtcggaacgcgttggtggagatggagaagagggcctccaggaaggagcgagctgcttactcatcgctcctcaccctgtatgcaagcttgtcagatagaggtaacttggacagagtatggaataagatgagaggaaccttcaggaagttcagtgacacagagtacaagtgcatgctcacttccctcttgaggtttgacgacatagcagcagcagaaagcatttttagtgagtgggaatcaacatctggaacacgtgattcaaggatcccaaacacgatcctttcatattacatcaagaatggcatgataaaaaaggcagagagctttcttgaccacattgtggagaaaggagtcaagcccagctatagcacatgggaggcattcgtctggggttatctcggtgacaagacggacaaagtccttgagtgcatgaagaaagccctgtcatgcttggagaaatgggagccgaaccatgagctcgctaccgcgatcttttctcagatcgagaagacaggtgacattgaagctgcagagaagctcctggtcatattccgggatgcagagtatgttaccactgagatgtacaactcagtcttgcgcacttatgcagaggccaagctcatgcctctgatagttgacgaacgcatggagcaggataaggtggccatggatgtggaaaccaagagattgttgaggttgaccagcaaatatccaatcggtgaggtttcagtatcgatgtcttgaggtgtgccaacaatagaagggtgtttcaggatgcaatgtgtactagcccttacgttttcatgcactttagttctgaagtacaatgcaatgcaaataacaaacatttagttttgaagtgcaatacagatggttgtgattttttttgcatacttatctaacttgttggactgtattgtctctatct

SEQ ID NO: 13796 - DNA, 661 bp, Zea mays
ttgcattcataaggttgtcgttatcatggtcaacaaatgtacctggaaatcgtgaagttgtccctatggatggggcaagtgatccaagagcaagggttgcttttgcctttccactcggtttaaatggtatacgtgtgatggagccagatgcagccttaatgatcctgtatttgacaagctcgtggaaatgtagcctatgttggaacggagtccagcatatgtaaaatggattgatccaacgggggattagccatcatggccttcaggtgattgttcatttgaaaattcatgttgtgtgcggtcctagtcccagtcactgcgcacagggtttggtgaccaaaagtgtatccagttttgtacaagcctgcagtcatcgtgttgtttgggtgactgcatccatcagcctttggacctaatatgcagtcatcattgtgttgtttacactactggttgtagccagtgatggtcattggtttgccccagtttcccaatttaaggtgtgatttatgtgtgtattgctctgtgtttggtggttccaagcatagagcggtttttttgtacttcaaaataaagccatttaatgggaatcccatgacgctggtgccagtgataaaaaaaaaaaaaaaaaaaaaaaaaaaaaaaaaaaaaaaaaaaaaaaaaa

SEQ ID NO: 13797 - DNA, 2003 bp, Zea mays
  misc_feature (17)..(17): n is a, c, g, or t
ctcgaggccggccgggngccttttccaccctcccccattcccacccgccgattcactcaccttggggcctcacgcggtcgcgcctccagcctcccctacccctgcgcccctcgcgcccagggaggagcccgagtcgcggcgagcgaagattccctccgattgctctcctcctagaacttccgatcggctcgtgatggccatgcagcagcacgcggcgtcggcgtcgagctccagcttggggctgcaccttctcgcctcgccctcgtccatcagggaggccacccacaccaaggttttcgtgggcgggctcgcctgggagaccagcagcgacaggctccggcgcttctacgagcgcttcggggacattctcgaggccgtcgtcatcaccgaccgccactctggccgctccaagggatacggattcgtgacattccgtgaagccgagtccgcgagcaaggcctgcgaggaccccacgccggtgatcgatggcaggcgcgccaattgtaacctggcatctttgggtcgagcccagcatcccgtgccccctgggcggccaagatcagctgggtcctatttgggtgtcccagttccaaaggccttctatttagggggttacagccaccaccgaccgtttccacttgggtactaccaaggatttcctgttccgcagtacagttacccttcatatgggaccgaatacatctatccacagggtacattaaactcatattccggtcagcaatatcttcctatttatggagtctcagctgcagcaaacacatccaaccaagcatttagccagctgagtccatccgtttctggtggtggcaatggttatttgtcggttcatagttacaacgtgcctggaaatcaatatgtgcagctcactggatccaacttcagcggtgcatcaccaaccgctcgaccttccattcagacttcttttttagtagcaacacccgttcctgcacatccacacctaataattccagccccctcacctcagtttacacaagctagtggttcagaccaaagtgcaagttgaactgtgcatccaaacatttgtaccttgaggtacccttagattgcagcaggactaaaaagagcagtgttgctgtattcacagcatttgttcttgcctggcaagcaatcatccttgcattcataaggttgtcgttatcatggtcaacagatgtacctggaaaccatgaagttgcccctatggatggggcaagtgatccaagagtaacagttgctcttgcagtttcgctcagtttaaatcgcaagcgtgatggagcatgaagccacagatgcagccttattggtcctgtatctgacaggctcatggaaatgtagcttatgctggaatggagttccagcatatgtaagatggattaatccaatggagatcagccttcaggtgattgtgcatctgaaaattcgtgttggtgtgtggtccctagtcccagtcaccgtgcacagggtctgatgatcaagaagtgtgtcctgtcctgtacaagtctgcagtcatcaactcatcaccccgttgtctgcatgactacgggcctgtttggtttggtgcctaacttgccatacttttctgcctaaggttagtttttcaattcgaacgactaaccttaggcaaagtgtggcagatttagccaccaaccaaacagcccctacattcatcagcggtcagcctttggaccaaactctggaagacctagctactctcttttcctgagagttaccagtaagtgtatccagttctgtatgcagtcatcatcgtgttgtttacaccactgggttgtagccagtgatgatcattcgtctgtaccaaatttttattgttgcaactaaggtgtgatctagcgtgtagtgctctgtgtttggtggtttcaagtatagagcgcttctcttgtacttcaaagtaaacccgtttacccatgatatgttctaaactgatgatgctatatttagtcgatttctcttctgattatgct

SEQ ID NO: 13798 - DNA, 4857 bp, Zea mays
  misc_feature (1244)..(1244): n is a, c, g, or t
tgtttctacactatttaaatttacatgtttcattttggcacaattatcaaaatgtttgctataactattagattttgttctttttaattgaatttactcgggtaattcagatttgtactgcaagtcacttgaagaatggaaaaccgtgaatacaaaaatgatattcatgttatttagcacaagttacgaccgatttaagagcagaccggaatttttgagcaccatactcacgtaacatcaccgcgaacttgcgatcaagttgtttaaaaattgtataaaacccaaacaaagtcaaaaaaatcataaaacttgtccacatgtcatgatatgtagagtctgtgataaaaaattgaaaaatgtttcatgatattatatgtagaggttgtgatgtatatgtgatatctatgatgtatatgtaatatctatgattattatgtgatatcttttatttgtttggatggaatattaaaaacaaataaaaaaggtgtatactggtcactttgccgagtgcaacactcggcaaagaccctcttagctgagtgtcaaggccatagcactcggcaaaagaaggaacatttgggcaccgataaagcctctttgtcgagtgctacgaccctgacactcgacaaaaaaacaagctttgccgagtgcctcctaggacactcgacaaagaaactgacaaaggggttcgccgatgaactcgttgccgagtgtcacctaatacactcgataaataaaattatctttaccgagtgtcatctagtagactcggcaaaggcgtcgtctccgtcaccagccgccatgacggcgccttttctttgccgagtattgggcgacactcgaagcccgataataagtactcggctaagaagctgttgccgatatacagttcacaaagctatttttgtcgaatgtcacacttgtcaaaacattcgctgagtgtttttcaggttttaccgagtgcttcagacacccggcaaagagtcttattctggtagtgaactaagaagtcgtttaaaatagattttactattttttaaatcatgcgacagggagtctacggaatcaaatatcatctcgaaagcactttgaatacgagatcaaattttatatagtaaacttgctggtatgtgatttgaataaccgttaggcaaagtttataaaatttggcttgtttatctctgataaatgtcataatgtaggggcatattataagaaagatagcgcgaaagggtggtcttganagacagtataaattgcatgtagtcgaactttacaaccatcagctaacaacttttagctgttgtgatataaaatcgatactgtactactagtagatttgttatcagatgtgatatccagtaatcatagattcgtactcgtaaacagtataaatatataaaatataaatggatggatacatttatttaatggcccacggattagttaaacccaagtccgatccaaaacccaatccctccagcggcacatccaccaacgcatcaataatattccatggatcccagcggggccctccaatcgccgtccgccacctggcgccactggtcaataacacaagcggccgcccgagcgctgacctgccgcgccgcgtggtctcagtatttgctgagaggagtggtgagatttgggaagctgcggctcgacattgcgtcctgtgctttgcttgccgcgtcgtggatcgtcgtcgcatgcggagccagccaagctggacacggtgacggagatagaggccgacatggacggcgtgctccagcgattcgacgtcgacctcctcctcgacggccacggccacggcgacgacagcttatgtgaggagcggcgctctagctcctcgatccggctttcggatcgctggttgctcatggctgtttcggtgggtggatccgtgtgtgtgcgtgcaggtgggagcgagcggaggagcgcgagcggcggcggcgcgcaggacaaggcgggcatcgacggcgcggtgaaggagcggatcgcgcgggcgctgaggatctacaaggacgcggcggggctcgacggcggggcgctggtgcaggtgtgggcgccggcgcgggacgggggccggcgcgtgctggccacccggggccagcccttcgtgctgccgccgccgcggtgccaccgcctgttccagtaccggacggtgtcgctcgcgcacgccttccccgtcggcggcgctgccgtgcccggggagcggggcctgccggggcgggtgttcgacgccggggagcccgagtggacgcccaacgtgcagtactacggcaccggcgagtacgcgcgcatcagctacgcgctcatctacgacatccaggccgcgctcgcgctgcccatccttgaccccgccacgggggcttgcctcgccgtgctcgagctcgtcaccacctcgcccaggctccacttcgccgccgacgtcgacaggctctccgaggcgcttcaggtacctcctctgctccaactctttcgtctgcctagctaagctacctgccccatccatcgcccagtcttgctgcagatgcaacaacagcatacactattcgtctagtccatgaaatgtgaccaaataatccgatcgaaacggcgcaatttcgtccatttggtatttggatcttctgatcatatcatctgctttccaaactcgtgttcacgtccatgccaatgcaatgcaggctgtggcgttgaggggctccgagatctgccgccgcccagcacccgaggtgcgtgccgtgcgatgcgaatgccatcacatgaaatctaagcaaattttgggggaataaacattcgatgccatcgatcacgaccataccatgttcatcgactgatccagtccagtgccgttgatttctcacgagccaggcatgcaacgacgacggggcggcggctcaggtggccatgtcggaggttgcagacatcttgaaccaagtcggcgaggctcacaagctgccactagcgcaggcctggaccaggtgcaggcgctgcagcaccggcacggagcacgcctccctgacggcggccggcgcaccgttctacctcaccggcgcggacccaaacccaaacctgctcggcttccacgaggcctgcgtggagcaccacctgcggctacggtccggccggggcgggctcgtggaggaagcggccgcggcgcggcggcccctcttctgcgccgacgtcaccaagtactccatggacgcgtacccgctggcgcaccacgcgcggttctgcgaactgtccggctgcctcgccgtgtgcgcgcggctgcgccgcggcggcgacgagttcatggacacggacggcggcagcggcgccggctgggacgagtgcgtgctggagttcttcctcccgccggactgcagggacggcgcggcgcagaaggcggcagcgggcgccgtcgcggctaccatcatggagcggtctggcggtggcggtctgaaggcggtcgtgataagcgggttgcaggatttggtgtttgacatcgccgcagatggcgagtgcgtgcttcggcctgatcctgtggccatggctgatgatgttcctcagcttgagctgaacggtcatggaggagacgagtgggactcggatgaggagggtctgcatctggtggtagctatgggtaccaccactacagacattgaagcatccaagatgcaccatgacgaacaccatggtggcgaggatccgagatcacaagttggcaagaaggcggcgaaaaggaaaggcgagaaaactgtcagtttggaggaactgcagcgctacttctctggaagcctgaaagatgcggccaagagtctcggtggtgagtggagaaagattttaggctaagagcagctatggattccctgccgatccacatttacgcgaaaatgcgtattgctgctgaacattctgacatgatataacatgcctctctcttcttgtgcagtccccccgaccccgatgaagcgcatctgcaggcagcacggcatctccaggtggccgttccgcaagctcgccaaggcgaaccgctccctggacaagatcaagcgcgtcttcgagtcggtgcaaggctcatcacaggccatggccgccgctcctgctcctccacctgccgccgctgctgcttcctattctcagcaagctccagccgtggccgctgctcgccgcgcacctgctttatcaccatgcctatcgagtgctccgagagtggcctcctcccaagcctcatgccaagcgccgccgccgcctctgaaggaggccgcatggcgcaagcctttgcgcggcggggacgccagcgtggtcacggtcaaggcgagctacagaggggacatcgtcaggttcagggtgccgagctccgcaggcgtcgcgacggtgaagggggaggtggccatgaggctggggctggcgcccggcgagttcgacgtcaagtacctggacgatgacaacgagtgggtgctcttgtcttgcgacgccgacttccaggagtgcctcgacgtcgtcccggcgttgtcaggcgcgtcagcgtcgtctggctccgggacggctcagccggtggtcaggctaatggtgcacgaggtagctgaggtccatgggagctcctgtggcagctcagattagtcacaggaaatagagctgcagagctcaaccgatgtttggtacaaccatctgtagaagctttcactactggcatgtgtctgtctctagtctctctacatgtatccatgtccaaaaactgaagtcataaatacttacaaatagaaataggagcatctcacactttttgttgtctcagacagtacagatctggtctagtctagggcacagaaaagaacaaatcattgtgatctagcactggtattcgct

SEQ ID NO: 13799 - DNA, 2068 bp, Zea mays
cattggtacctcgagccggccgggcccagtttgcacaaaatttgcatgacttacttttggagagtggtgcattgctaccctcggatttattatttgatcaaaataaccatgacattcacgagaaagagagtaaaggatggttattagttgctcaaacaacacaaaatttgccaaatgcttttgtagctaaagattcgtcatcgcctgatgaagatgaacagccccgtgcagaaaatacagaagcagccatcagagatttggatttgcatggtcatactgctagtgttatttccaatgaggatcaaatggttgctgaaggttctttggtgaacatgtcaggaagtagcaatggaaatttggacacgttgagttggtctagtgtaaaaacgatcagctctgttatagatgatgtcgctgaatacgaaataccatgggaagatcttgatattggagaacgtattggtttaggatcatttggggaagtttatcgtgcagactggaatggcacggaggttgcagtgaagaaatttcttgaccaggatttatcaggtgtttcactagagcaatttaaatgtgaagtgagaatcatgtcaaggctaaggcatcccaatgttgttcttttcttgggatatgtgacacaatcgcctaatctctctatattaactgagtacctcccaagggggagcctatatcgtctgttgcataggccaaatagtcgaattgatgaagtacggaggctaaaaatggcattcgatgtggcaaaagggatgaactacctgcactctagccatcctaccattgttcaccgtgacctgaaatcccccaatcttttagtggataaaaattgggttgttaaggtgtctgactttggcatgtccaggttgaaacatcatacttttctttcctctaagtcaactgctggaacaccagagtggatggcacctgaggtactacgaaatgaaccatctaatgagaagtgtgatgtctacagctttggagtaatcctgtgggaactagcaactatgcgtgtgccatggagtgggttgaatccaatgcaagttgtaggagcagttggattccagaacaggcgactagagatccccaaggatgtggttccacaggtggctagcataatatcttcatgttgggatagcgatccgagcaaaaggccgtcgttctcccagctcttgtcccctctaaagcaactacaacatttagttgttacagaaagctgctgacatgcgtttcctgggacaaatctcaggatacatatattcaagtatttaagctctgttacagggctaaaattttcttttttgaagctcgtggaggagtctctgcggtatagatgtgtttgggcgaaggttctgcacatcagtaatcatcaccttgtgaaaatgcgagtctctgaagccgtgcaaaggcgctgctggagaaagcgtagtgtgtagtctcaagtgaagaaaagtggtgcgacacaaagtgttctgtgccatggtaaataattgttcagttctggatttgaacgggtgataaattcaccacaaagataggatcttgaagttttttccccttgccttacaaaagatggaaagtgaagtgaaaaaaaattcacggtgtctgcaaaaagtcgcagcccgatgccacgtgaaaatgtatatgatgtaatacagttgctttggaaaggcaaacataaagttcacagttttgttcgataatggtgtgtttggttttccttcctatgaaaagaattgatatttatctcataagctaataaagctaaattggaggaatcaactcatgtagaattagggctggaaacgagctggactcggtgtggctcggtatctgaacgagctcggcttgtccattccacaagctgacgaaagagcctcatctcacgagccatattctggtatttattgttgcattatttattgaattaacattatataaatttgaaatatagaatcatcattcaatgagtaatttaaattataaattgtaatatattcatcgtcaaagactaaaaaatgagctattatctataaaattatttaatattcat

SEQ ID NO: 13800 - DNA, 1312 bp, Zea mays
  misc_feature (3)..(3): n is a, c, g, or t
  misc_feature (6)..(6): n is a, c, g, or t
  misc_feature (18)..(18): n is a, c, g, or t
ggnagnacttgaggtccntactgaaggacactgggtggttctaacaggcacttaagcagtactggttcctttgttcaactcaatgatgcagcagatgagttctttgacgtgccagacgaatcagaatatgatcagagagaagttatgtttccccctcgcgtccgcttgcatgctgcggaccagcgtcgcgctaaactgtccactgctgctgtttttgtaaaaaggttgcatgatcttgcagttcagaaaagaggatacattgacttacagggagctgcagatgctgataatgggccatgttgctatggatatactcttcccaaagattcgagctatacagtgccttctacttgggcaatgacagatcctacaacattcttaatccggggagagacttatttgcacgatcgtataaagatcaaggcaaatagtaccctgatgcaaatggtaggtgctgactggataaaatctgataagcgtgaggatgatctagctggtcgccctggggggctagtccagaaatgtgcagcacaagggggcacccgattcttcttcattgtaaacattcaggttcctggttcaaccacatacagcttagctttgtattatatgatggatacaccattagaaaaggtccctctgcttgaaagatttgtaaatggagatgatgcattcagaaattcaaggttcaagctcattccttacatctcaaagggatcttggattgttaaacagagtgtgggcaagaaagcttgcttggttggacaagcattagaaatcaattattttcgtggaagaaactatttggagcttggagttgatattggttcatcaacggtggcacgaggtgtggtgagcctagtgcttggctacttgaacaatcttgtgatcgaaatggccttcttggtacagggaaacacaaatgaagaactcccggaattcctcctaggtacctgccgactgaattacctggatgcctccaaggcagtgtccatagacgagtgctaggaccccaactgacctcattttttaaagccaagtacaccaaaagacaaaaaaaaaaggctgaatccccattccttgctgccgacacaatcggcaaccctagcccagatgcccattttattgcctcaccgcaaaagtgggggatccattgcaaccgttgtacattctcttcttgccgactgctcaggtattgtgttgtaatgatgatagcaatccatgataaaagccccctcattctttggcatcttatcaccacggcaaaaacggaaagaaaaagtgtattctaccatgccgtctcttctgaccg

SEQ ID NO: 13801 - DNA, 1792 bp, Zea mays
ctcaagctctttatcagtgtcaatggacaatggttgtacctcccgagcatgttcttgctagaattgatccccggttgacccaatctctactactctataagactctaacgtagaccatccatgcaccatggttctgccctctcacgtgttctgctcactctcgaccatacgattgcccattcgctcgcttgcgtcgttcgatctccgcacaacgcgcacgcaccctaccctctccacagccggcccccccgagtcctgcccccgtctcttcatctcccccatcgcacgaggtttgcgcccctccccgctcgccatcggcccgtctcaacgcgcacgcaccctaccctctccacaaccaaccccagtaccccacgagatctgctcccatctcttcttctcccccatcgcacgaggtttgcgcccctccccgctcgccgtcggcctgtctcagcccctgaccctccaccgccaccgactccctctcttgccaccgagggaatttggatctaggagcccatgccactacagctctcccccgcccacgattagccctcggctcgggagatgctgacgcccatcgcgaccacgatttgctccctcgtgtcctcggcctcttcctccactctcatcctccctcctccccccgtcctcggttattctcgtcgcctccgccgcgcgttccgctctccccacagcctttgtccgccacatcatcctcggctgttgtcggcgcctcgctccacgcccgccctcgcccaacgaccctcgccgcacccctccctgtcctcgacaacttcccctctggccccgtccttgccggcatcggcgcctgctctctccgtcatgggggaggggaaagtgaaggaggaagaagagccaagcggctaagccagctcggccggtcgcctcccaccaaaatcccccgagacatcatcgacgaggagatggagatggagtctagccccgcagctcctcggcatcacaatcgttgcctcccgtgttgtgcccttggatccacttctcgtgcgacgcccctgatcgacaagcacgtcgtgcgtccgcaccgcctccctgaccgacaagcatgtcatggctccaggcacttgcagcctccgcgcttcttcggccagcaagcacgcgaccacgcctcccactattcagtcgtggtggttccaggtgcttcttgcctccgtgtctccctgactagcgactatgtaaggagggacctcccctgccctggctccaaacagaatcagggaatacggtcagcctcccatggttgctgccatgtaggcgatctgatagtccacaaaaacctaagattcgacaccaagtcactaaccaaaggaagatcgagatgaggaaggatgtgatttgatctcaaatatcaactacatctgtctagcgtcgagacacatgtgtggtagtgctaagttggttctgtcattcagtttctttctgtatcctatttctgtgaaaatatgttatgtgagtgatgtaaactgattgccagaattaatggatgttttgcagctacgccagaaaaaaaaaaaaaaaggtaaaacatttttgttgctgtaatccccagcctagcaagtttcacttaaacaatggttcaggctttcgtagcttgcaaggtactataggctgtagcacaacttatatactattttgtactgactcatgcggagggcccgtgatcagaggtgctgctaaatttttagttacacaaagtctactatttagcatccgcatgttagtaattttttagcaagaatgcaatatcggtaca

SEQ ID NO: 13802 - DNA, 1653 bp, Zea mays
gagcaagcagacgagaacatggtgacattcctttaccagtagaaaggacagctgactgactgtcttcttgcttttgctttcaccaaaccatatgtctgaggaattaatttataaggagtatagaggtcgaatcggatccagtctctagtacgtatgtttctttacaaatcgaggttgtgccaacggcagcagggcatcacagaatccacggtcaaaacatatgcatctcgtgttcaggatggaacaaagccctacatctgctcctgtattatgttataaacagatatcaagatctcaacactgatcaggatgatgataagccattccagaaaatccgacttcctgttctgaaggatctcctgaagaaacctgatgttgtgctcaacaaatttcaacttaaaatcaaggttcccaaatctctgggttagctcgtattcatctcgaaggtattcccagatctgagcatagtttgcattcttccacgctatgtctgacctctcaaagagtccaagcttaagaataacatcagccaagttagagttggccttccctacaagctggaaaagcttcttcctctccatagtgaaggtaccagttttttccattccacggttgatatctgtgaactcagctaccattccatccacttgacggatatagtagtcaagagcaatactctgacccaggacacttccaattgtacggatcccatcaatactcagatcccgaagcacgatatagtcaagaccaccttgcatccatgtctctagggtaggcttttcaacaacagcatagtcatcctttctcatctctggaagtaaaccagatgcatgcttctcaacaattttcaggtatccatctgcttcatgatcagaaacattaaacagcacaatggacccatattggaaaacgaccatgtagtggcaatggctctcatctatgacaccagacttaaaaccctcggggtctcccttgacatcgtagtatctaaggacaacgtagttggtggcacgcgatgtgggtggaatgacattgaaggaattctgggactgcaggctccgcaggtcgatgctggtgcatagaaagaatgccttgacggggacgacccgtgactggttctcctgcgccacttcgagaaggtgctcgtggtagtaggactcgtcttcggaggcgagctcctctggcggtggcggaggcaagggcgcgggcgggggtccctgttccttggagttgaggtggtccctccctggagcaggggcgggggccggggagacggaggcgaaggtgctgtggaaaagaagacgggatgggccgccatggggaaagggaggaggtagacggcgcgttcggaggaggaaggaagatgggatgcgcggaggaggcggcggggagcaaagagctagggtttggagggtcatccctgcggcgcgggagcggcagagtaggaagggtctgaggaggctttggagcctcgacgacacctccatggactgaggaagctctctcactcaggtattagacattgcaagcaaatggcaaagggtggaagacgcagaggcagagcggagggcggaggctgaacggagaagacagggtcgccggccggccgcgacgcaccctgttctatctcgagctcaagttcaactttggact

SEQ ID NO: 13803 - DNA, 590 bp, Zea mays
ggccgcaaattttttttttttggtcgaccggccgccgcttttttttttttttttttggaacatatcagtgttattacttgtgaatccagaaatagccaagtagtcgtttcaagtagccaagtagtagtccaacaagcgtacagattccaaggatgagcatgcatcctccctgttatttatactttattactagtagtgacatatagcaggtggtcatggccggcggtgccgacgacctctaggctgaggctctagcctagccaacatggggcgtctgggcgacggtcccgacgaagacgcggacacggtcgaacccaaagtcggaggtcaccgcctgcgtggtggtgggcagcaccacgatgtcggcgttcggcttgtccgccagaatcaccttcttggcttcctcgacgctcagcccgaccacctccggccacgacgtcttgccgccggtggctggcttcgccgacgacgcactcatggctgatttccctgtagttgaggggaggaggttgcgttgtgcagtgcagtgcagctggcgatcccggccggcctcgaggtacccaatcgcccataggagtgtatacgcgcgt

SEQ ID NO: 13804 - DNA, 408 bp, Zea mays
  misc_feature (267)..(268): n is a, c, g, or t
  misc_feature (399)..(399): n is a, c, g, or t
  misc_feature (408)..(408): n is a, c, g, or t
agccagctactccatcccccacccaacccccttggcattgccacccccacagtagagacagacagccacgcgcgcgaggcgtccactcaagctcaggccgccactctacctcgcgctctcggccatggcgtcaggggaagcagagccgctgcagtacacgaccaccgcgctgcggtgtccatccactgcgagggctgcaggaagaaggtcaagaaggtgctccgcagcatcgaaggcgtgtacaaggtgacggtggacgcggcgcannacaaggtcaccgtcacaggcagcgtggaagcggccgcgctcgtccggcgcctgcacaaggccggcaagcaggcggcgccgtggccttcgccggcgccggcgccggcaaacgtcgagaccaacaagtccgcncctgctgcn

SEQ ID NO: 13805 - DNA, 1740 bp, Zea mays
cgtctctgcgtttcccttaccgaccgaccgcctgacgtcctctcttctgctcttcccgtgccgccagaccaccgcgctgcgggtgtccatccactgcgagggctgcaggaagaaggtcaagaaggtgctccacagcatcgaaggtacgtacgtacgtacgtgcgggctcgtccgtctcttagggtccccactccccagccggcgcactcaccgggttgctttgcttgtctgcggcggccggcggtgcacgtacgaacgtgcaggcgtgtacaaggtgacggtggacgcggcgcagcacaaggtgaccgtcacaggcagcgtggaagcggccgcgctcgtccggcggctgcacaaggccggcaagcaggcggcgccgtggccttcgccggcgccggcaaacgtcgaggccaacaaggccgcgcctgctgcacccggggagggcggcgccaaggaggccgcggacacgaaggcggctgaggccgacgccaaggagaagaaaccggccaaggacaagggctcgggcaagaatgccggaacgggcgaggccgccgacgcgaaacccggcaaggacgtggccagcagcgacgccgccgaggtgatcgcggggcccaaggaggcggaaaaggcctcctcccctgagcctgtggccgcgaagccagacgccgccgaggagcccaaggacggcggcgagggcggcaggaagaagggcaagaagagtaagaagaacaagcccaaggacggcggcgagggggatgtcccggccccggccgcaaccccggcggcacctcccgagaagaaggcgccgcagcagccctcggctgtgccagcgccggcgcctggtcccgagcgcccgcacggcggcggcggcgcgttcccgtgctacgctgcgcagccggtgcttagctacaacgtggcgcacccgagctccagcgtgtcgtactgcgcgcccacggcagcccgtgcccatgcccccgccgccgccgcagatggtgtcgtactggtacccgccatacccggccatggtgccggtgccggcggagtttgtgtacggcccgccgggcggcgtgcggtcgttcccgccgcacgagtcgtacaacaacatgttcaacgaggacaacgccaactcgtgcagcctcatgtgatgtcacgacgcgccggcgtggtgtccccgggccgtctacggtggctctcgtgaaccacaagcctccccgatggtgtctcgtgccgtcaaattaggcggacagcgctccagattttaattttttttactgtaccctcggctataaattgctcctcggcgcatcgtgtaatcagatggtggtggtattcttccacttgcaagctgcaaaaaaaaaaaaaaacggctttctcttcattgctatgaatgaactcgtggaagaaattctcgtgaaatttggagcgcgggtctgggtacggcggcttgtgactgaaattttgaaggtgatgtgggttggtagggcattgaagcggaggtttaaatactctgctagaataataattgcctgattggtgaggggtggggggcgaggcgggacccacatcccccggcgcaagcagggtaatcaaaaggtggggccttgttggttgacaggccttttcccacgatgattgcttgggaatgattcccgtgacattttgcgttgctagtaacctcttgtcatgacgtttccccgaagaataacgggtatgtttggttcagcttttttcttactaactttc

SEQ ID NO: 13806 - DNA, 512 bp, Zea mays
ctcccctggcattgattgccaccccctgcaactgcaactgcaacacagagaaagaaagcgctagccagaggatcagctccggtcatcgagtgaagctcaggctactctacctcgctctcggccatggcgtcaggggaagcagcagagccactgcagtacacgaccaccgcgctgcgggtgtccatccactgcgagggctgcaagaagaaggtcaagaaggtgctccacaacatcgaaggcgtgtacaaggtgacggtggacgcggcgcagcacaaggtgacggtcaccggcagcgtggaagccgacgcgctcgtccggcgcctgcacaaggccggcaagcaggcggcgctctggcccagctcgccggcacccgtcgaggccaagaagcccgaggaggtcgcgcctgccgcgttgcctgcggcagccgccaacaaggacgctagggcccaggagaagaagccggccaaggacaagaaggccgactacgtcgaggccgcggcgcaaccgagcaa

SEQ ID NO: 13807 - DNA, 1058 bp, Zea mays
  misc_feature (9)..(9): n is a, c, g, or t
tcgagtcanctacgtaggccccgcttccgtgcgccaaccccaaaggcccccaactctccaaagtccaaagctcccaaaacccaaaaccctgcgaccccaagataccaaagccagcagcagaggccgatgcccatgcagccgcaggcgccatcgatgaccccggccgccggaatcaccacggagcagatccaaaagtatctggatgagaataagcagcttattttggccattttggaaaatcagaacctaggaaaattggcagaatgtgctcagtatcagtcacaacttcagaagaacctcttgtatctcgctgcaatcgcagatgcccaaccagagactgctgtaagccgccctcagatggcgccgcttggtgcatcgcctggagtagggcagtacatgtcacaggtgcctatgttcccgccgaggacacctctaacgccacagcagatgctggagcagcaacttcagcaacagcaagctcagttgctaaacttcagtggccaaatggttgctaggcctggcatggttaacggcatgcttcaggccatgcaagtccaccaagctcagccatcgccggtagcgaacagaccggacgctggtggggtcgcctcggagccctctggcactgagagccacaggactagcactggtggcgataatggcggtggaagcgactagtccaaagagtcctgaggatttacgagctagccttgtaggttgcaaaatatgcacgtatactgccgatgacagaagagaggatcgttcctgtgcccttcgatgataagtggccatgatctttgcatggatgatcagtagctgtcacggttttatctttgttgccagtctgtagaacacacgtatagattgttgtgacatttatttgcttgctgtttccacaatgtactgtcgtagactcggagccatatgctagtttatggcttcaggagctggatttcagttacgagctgtgatggcaaaactttcaactcttcaggtagctggattcatttatgctatatgttacaagtttcatatctgtcaccaaattggaagcagta

SEQ ID NO: 13808 - DNA, 779 bp, Zea mays
ggccggaacccaaggcccaactctccaagtccaaagcgcacgagaccattaccccctgcgtccccatcgtacaaaagccagcagcagaagccgatgcccatgcagccgcaggcgccatcgatgaccccggccgccggaatcaccacggagcagatccaaaagtatctggatgagaataagcagcttattttggccattttggaaaatcagaacctaggaaaattggcagaatgtgctcagtatcagtcacaacttcagaagaacctcttgtatctcgctgcaatcgcagatgcccaaccagagactgctgtaagccgccctcaggaaatcaactgggaggcctgcacaacctttatggccctagtatgtactaccaggcttataggaaactatgttgattcaaatcttttgcaaggtctgatagtcaccatttcttcggtgtcctaatacaatggagcagagctggttgaaacatgtttatgggaacgatgagaaagccatgtgccaagttagtgaaattgctttgaaaaaatcgtgccatgttggcatgtgctcatgttaaatagccctttggacaactatcatctttggatgctgcgctcattggagagggaagccattctcagaactgttcttagtgagtgtttagtttctagtgactaattcgtagtctctctattttattcaattttagtccctaaattaccaaatttattgagaaattaataaatcttaaatttgatcaaaaaaaaaaaaaaaagcgttgatgcttatgatgt

SEQ ID NO: 13809 - DNA, 1039 bp, Zea mays
  misc_feature (1037)..(1037): n is a, c, g, or t
cacatgttccgacacttgagccaacatgtcacgcagtcgctttgaccttccctgcgctgcgccgacccccaaactctccaaccccccaaaacccaagcccctgcgaccccgagataccaaagccagcagaagaagggatgcagcagccgatgcacatgcagccgcaggcgccggcgataaccccagctgccggaatcaccacggagcagatccaaaagtatctggatgagaataagcagcttattttggctattttggaaaatcagaacctaggaaaattggcagaatgtgctcagtatcaatcacaacttcagaagaacctcttgtatctcgctgcaatcgcagatgcccaaccgcagactgctgtaagccgccctcagatggcgccgcctggtggatctcctggagtagggcagtacatgtcacaggtgcctatgttcccaccgaggacacctctaacaccccagcagatgcaggagcagcagcttcagcagcagcaggctcagttgctaaacttcagtggccaaatggttgctagaccaggcatggtcaacggcatggctcagtccatgcaagctcagctaccaccgggtgtgaacaaacaggatactggcggggtcgcctctgagccctcgggcactgagagccacaggagcacgggtggtgacgatggtggaagcgactaggccaagaagtcctgataattttacgagctagccttttaggtcgcgaaatatgcatgtatactaccgacgacgaagagaggatcattcctgtgccctttaatggtgagtggccgtgatcttcgcatggatgatgatcattccacctttgttgtcagtcctgtagaacagacgtgggttgttgtgacttttatttgtgtgttttttcccacactgtactgttgtaggctcgaagccatatgttagcttatggtttcaggagctggattcagttacgagcgagttgtgacagcaaaacttttatgaattacgttagaagtttcatatatgaaaaaaaaaaaaaaaaaaaaaaanag

SEQ ID NO: 13810 - DNA, 2225 bp, Zea mays
atcaatggttctcaccctcgccctcttcctcgtatgatcgtatccactcgcgaaaataggtagccgaagagcacattccctcacctgccatggcgatccatccccggaccaccggcggccgcaggcagccgctgccgctacccctgaagggggccctcctagccgccatcgctgtcgcggcggctctctccgtcctgttcgtcctgtccttcacggacacgctgaccttcacggacacgctgccctacctggggttccggccccgggacgtcgacaagagggacggcaaccggaggtacctctactggggaagccgcgtagactgccccggcaagcactgcggctcctgcgcgggcctcgggcaccaggagtccagcctccgctgcgccctcgaggaggccctcttcctcgacagggtgcttgtcatgcctgcaaagatgtgcctcagttcagtgcacaatacaaagggggtccttcaatcaggcaatgcaacttcacaacaaaggtgggaaacaggttcttgtgcaatggaatccttatacgatattgacctcatatcaagaactgtacctgttattttggataatccacggtcatggtacgagataatatcaagaagtacaaaactcggtgaggatggcttggtggtgcatgtgcaaggggttagcagagctgaactcaaacataattcaaattactctggtgctctcctcataaaccgcacagcaagtcctcttgcttggtttatggagtgcaaggaccggaccaagcggagttctatgatgttgccatacacttttctgccaacaatggcaacaaggaaactgagggatgcagcaaacaagatgaaagagatacttggtgactatgatgctattcatgtgagacgaggtgacctactgaagaataggaaagatagatttggtgttgagcgaagtcttcatcctcatcttgacagagatactcgccctgagtttatcaagaaaagaatcgcaaagtggattccaccaggtcgcactcttttcatttcctcaaatgaaaggaccccaggcttcttttcatctctatcagacaagtacaggctggcatattcatctaacttcagcagcatattgaatccgataatcaagaacaactatcagctgttcatggtggaaaggttgataatgcaaggtgcgaggacgtttgtgaagacaatgaaagagttcgatgaagatcttgctctctgcgacgatccaaaaaagaataccaaagactggcgggaaccagtttatacagatgactgacggcagctgttttgtgttcctagatgcttaggtccaactatatcaacgacatcaacaacaaaactttttagccccaagcaagttgggtctaactgtatcactgatcttaaaggtttcacaaagatgaccaattacatgccatttatgagatgacataatagcttgagatggatgcatgaactatatatggcatgacaggagaggaacagagaaagcgaatgttgtctgaagtctaagcttgaacatcagatgtgactgctcttttgttcagctacagtgtccaattggattgttttactttatttgtttaaaaaaaagtttactaggtggtgggagactgtggtgtatgtatagcatgtaactgctgttggaggagctatcaaccggaatactggatgagatacattacttgctgcttctgttgctatttgtacttgtgttaacagcatcagttatactagctctgtcattcctagaaaaagagagaatgtggagcatcttgtcttatttctagtgatgtagaaattcgtgttagcgacacagtgatatatgtaatgtataatccataagctataggatatttagcagggagtgcctgtgactagcgttgtacacagtactgcaagttcagtgaaccccatgcaagctccctcggagcattcatcactgtagctcgagaggtgcatcatgcatcggtgggtactccgttcaaatattctctctcctgtgtgggtcaggccactgcctcctgctgcatagaccgctggctggctgtggctctcttcttccccacactctctcccccttccctgccctagccactagccagaggacggcgtacggccagagcactctccctctctcatcattatatatgcatatatgcatggatatctgtgcccaggagcagtgcaggcaggtgaatgtgggtgcgccagt

SEQ ID NO: 13811 - DNA, 2277 bp, Zea mays
aaccgcgacagcatttaactagcgtgcgtcacctcccgtcctactgcttcctctcgaggctccgagccgcccgttagtagtgtagacctgcctccgccttctcctcgccaacgcgccaccgcagtaaagagcgcggattaattccagggcgaggggggagagactcacctccattacgctccgtccccttccccggcgtgcaccgtgcagtaggtatctgtgcattcctgccctgctgtggttggctaggtaggggtggtaactggtaagaacagcaagaaccaaccatggctgctgatgttgggcttcggttcaacggctggtcatactcggatttgccttacaacgaccacaatgcacaggattcatcagttcaggaaatggtgctcaaccatggctcagtgtcattcggtagatttgctgcagaatcattgtcatgggaaagaaggtcagtgtttgagcataacagacgccaagaggaactaagcaagctcacagcccctggtttggttgcacaaaagaaggctttctttgaagaatattacaagagggcaagacatctcaaggctcagggggtattgcaccaggctggagccgcagtggaggagaacgatagcagccaggcagatgaattgccagcagctttctgaagatccagtagccactgctccaagttctagttttgagccttccactgatgttgagagcaaatgccaggatgctcatgagcacgggtacttgacatttaatcctttattttctcagacagcaagcttgccaaacattcaggaggagagttctagctctggtcaaaagcatggattcagttgtgaaactattgagagaaaagttcttgcaccaagacgtgtgccatcaaatgataatgatcaaagcaatattgctggatcaaggattgtcttaccaatagccagtctacaatcagaatacctcaaagctgatcctgagaagagtgaggcaagcaaaaatgtacctattattaataggtcaaaaaaggtatcaaaggacctggcaacttctgttatcagcatcccaagggtagatttaagaaggaattcagaaaacggaccctctcgagacttggaggatccattccacaagagagttgagatgaaattgcgtgctttatctgatcggatggatgctgacagaactgcggcctctagtagatcagcttcttaccaaccacctcctgagagagctatgacctcatctagatctgcatatcaagatagactagcaatatcttctagatccagtgtgtgtcagaacactagtaaagccttggcaccttctaaattagctgctcaagcttcccataaatttcttaaaggtgtgcagcgtttagatggcataccccgtgagattttcgttaataaaggatcaagtgcttctcttgttgcttcttgcaacagtagtgcaactgggaagttgtctgccaagattttggtggcacccagttcatctcaagttggtgcaaagacttccaggactgctcaggttacaccgaaaagaacagcaggacctaccagtgtaaacaatgtgtcacacaataaaaggaagcacacaccggtcgcattgggtgaaaaatacccaaagagagagtatgtgcgcagatctgcacctccaagtgcaagaagcagctccgagaatctccctcgtgctgcaaaggcgcctaagatatcaaaagtgacgaatgcggtgtccaaggctgaagttgtgcagaagtcaaaatcatcaagcaatcttgttggaggaaggaatttatcgacaaagcgctccgcaaactgcaatgaagaaaacagaaaggcgatcccgtcgcgcaaggtaaacctggctgaatgcacgaggagcaatctgaaaggtggcccatcactgactaagaacaagccacggcaagagaggccacggtggagatgattgccaggcgagagaggccacgaatccaccacggtgattattaaatagtcttgagaagcatcgatcacctggagcctcaaacgtgtacctctggttagttttgcaacacgaaattgagtgccggccatcaaaagcatacagcaccaagacttgccttgtcttgtagctgtagcatacagtggctggctgtttattccccttgttgttgtaatccaacaacagtcgcaagagaatatctggatgtgcaaggcagtatcaaaaaaaaaaaaaaaagtcgttacggcccgtgacatttctggccgtcgcgtttgttgctgctttgcgaaagggataccccgg

SEQ ID NO: 13812 - DNA, 1125 bp, Zea mays
acgatctccaacaacttatccattcatatctcttattttaaaccacattccataaaaagtgtagtctataatgaaaaacagtatcttgaacagctatataggaaatgctttgaggagagagagagagtacagttctttgtccacagttggtaacgtgtacttatttatgtatatggatggatacacagaaagagaagagaacatcagagctcagagaacattgttcagtcatgtttatttgccacatgcccagaaccagagccgtagccgtagccgtgtccctcgccgtagcctgagcctgaaccttctccgtatcctcttcctgaaccctcaccgtatccagatccttggccatgaccggagccgtaaccttcaccgtagccggatcctgatccttggccagagccggaaccggagccttcgccgtagccggatcctgatccttggccagagccggaaccggagccttcgccgtagccagatcctcgaccggatccacttccctgaccgtatcccgagccagacccagaaccctgtccctggcccgacccatgcccttcgccatatccagacccttgcccttgcccgtaccctgaacccgaacccgctccggacccagctcctgaacccgcaccagagccagagccagagccggcgccggcgccagatccagcatacgatcctgcaccagagcccgcactggacccggaacctgaggccgagccggagccggagccggagccagacgccgagccagagccagagccaccggcaccaccaccaccgcctatgccaatgctaatcccagcaccgatcccgatgcctgccccgctgccaccgccgaggtcgatgcccaggtccttccgagaaacgcggccctcggacgtgagaacgagggcggcaagcacggcgacaaggaaagcggtcatggtcggggctcgaggcatcctcctgagtcctgaccttcctttcctctaggagaggccggaacaacaatgcacctatgcagactgtgtgctgctttctatgggttcagtggtgtatgttcacaggagcatgcgctctgtatcttcttcttccagctccgggactctcctgctggtgcttttttttttttttggccgg

SEQ ID NO: 13813 - DNA, 1587 bp, Zea mays
taacacatattcacagaatcacggttgcaagacatttgtattgttgttaagcaccttgtatattttatacattaactgttgtgcatatctaacaagacgtactaattgtgcttttgcaggtccctcatccacttgaaggacgtcgtcattggttcactaatgaaaaacattgtgtatggtgagctgctatccgcagtacgagcttcatcattacaatttcatataattatagatcaaactacatggtggactatgtattttcatattcattttgaaatcagctcaactaattatatggacactcacatttttcatttggtttttgaatattatatcaacaactattattaacatgggcacctgcggctacaaataactgtatagttcttttccaccacgctattcatgtttcttgctattaagtgcttacagaaaatactgtggttttctcacctccatacatggtaaggccatgttaactctgaatacttaaatatgtcttaatttatacatttcaaattactctttactattatttataatatgtaatttagttagaatagaaatttcttatggaagtacatctaacaccaatttgttcaaacatttctactaaagcagaaaatagcgactactctactccgcagcctaaaacctcaagatatgttggcaaccatcgaagtacaggtttcaagaaaatgggaattccatgaaaatacagacaccgggcccatattacacattgatatggtttaagctgacaaagaggcaaggactcattatcctttttcctaataacgtgactcctgcttagccagttacaatttcaagtatgcttagccagttaccatcacacaccaaacatttatcttaaacatctctactatcactttgtgccaatactattttaccttcaattgcactattctttccatttgtttcttaaagaacgtaagctccacacgctgccaacaaatactcaaaaaatgaatatcaattaataaattaccagaattttattaaactcttcgttgtttttttgcttttgtttgttacgtatgtttgcaaacctgcttctctgtctatttttcttgaaaaatgatttgattacaaaaaacagtcccttgccgctattctataatgtcaaagaaaaacgaatcctccgtcacaaaaagtcacggactttgacgttcccatgtaagttttattttctcctgacaaaaaacacttaaatttcctttactatgtaactctctattggacaatgatgtaggttgttaagtctgttacgttctcagatgtagacaacactatgtaagtatatttacattaccattccattggtctcactattatgtgctggcactagacactcctatttaatatcattcatttacatgtttcaaccccataaaccaataggagaaagaactgaaaacagacgttgaatctggctcttcaccagcttaatgcaatatatttacattccaccatacttaactgttcaatcaaacttcattgtagggcaaagacttttttaccatccaatactcctgaaagttccgccaacacattagaaagccctgc

SEQ ID NO: 13814 - DNA, 2126 bp, Zea mays
ctgacagtcggcccatatatcgctatgcgggccagtcttgcagttacacgagtgcggcacttccgccccgcggtccacagaggcacagccgaagtgtcgcagcagtgcaaaggcgatagctttggctcccgcgaggccgcccgcgcccacgtgcactgtgaatctgaggagggaaaatcacccaaaatcgagagcagatttttttcccgaagatgccgaagatcacctcgtcgccgtctcccaccatctccgccatgaatcccctcctcccctcctcctttcccaaatcaccccacccgccggacccaaaccctagctccccgaatcctagcccctgcagctacctcctccacgccgacgccgacgacgaggcgctgattcaaatccctggtcagaaccctagcctggtgggcgcctccgcctccttcgcgctgctgccgtctatcgacccggctccacacgtctcgtcgcagttctacaccttcagcgccgcctcctacgggctcatgctacgctgcatccgcgcgggccgctccgcctcctccgacgaggtccgcggcgccacgtcgctctccgtgctcgcctcctggcgggcggtctggaaagatcgaaacgaggacacggcctacctcaccgcgtggaagcgcatccaggacaagctcgccgcgtcggccgacggccggcaccttcacttcaagtccaacgccgcgcagcgcgtctcccacgtcggcatgtggagggacatagtctcggaggcgcatgccgaccctgaactgctacggcacctcgcgttcagggacaccgtcgaccgcatcaaacagtcgtggactgtgggggccaaattctacggtattccagaatcatttgtccgcgcatgtgttgctgcatgccctgtttgtaaagctgcgcctgctggccagccgtatttcactatctcatcacctggacatgggaagcggcggcgcaggtttgaatatactgagacattggatgtgccggctagagatgtagctcgtaggttacagcaattggctgctaagcacaaggttgttctttgtataaggcagaagtatattaggtataggcccttcatggctgaggtgaaagattatgcatgccaccgtgctggagagcccacttcaagtagtgggagtgctgcatcctcagccggtaatttagagggtaagaaggcgcgggtaaagcgagagccataccagtcgaagaggtgtggttgtgggttccgtattcgggcaattgtgccgatagctaattacaatgaaaaagacaagacttttgtgtacttggaggagggcactgcagtgttcaagctttacgctgtgcattcagggcatgagccagggccacttgatggcaatgcacgaattgttcacaggttggttggtcataagggaggtcttgagtttgatccagacatttatggtgtcagtggggaaggtgatcctaccttttcagcaaaggggtatgaatatgctgatattgatgattcgcaccaggcagtcttgcagcaagtacgggatctgagatcagaagttctcttgctagaagggaaggtggctaagatgcacccagaattgttagggtcactgtccaccgagttgtctgaggttttgcacaggattaggaagtttaatttggagggtaatgtctaccaacatgagacattgatggtaggcaatgaagaagtcaggggatgggggtcagcggatgtatctcaccagttagaccagcatgatcgagcattctgcaaggatgatgagatgcttgatgatgatactgactttggctcaagccttggacctattgtctcgtgggataggatggaagcagagtgcgaggatagaaagatgctcatgggtgatagcccaaagtgcgacaagtggatgcttaaggatgatgtgggtgaatttgatgcgaagagtattcttaactgtggggatgatgatggcgtgggagattccaaggtcatcaaaccattgatgcatgatgacaccatggtaactgggcccagtttgggaaggtattcatgtacgaaggattttatgccgggaacaataatggtattgattcaacaaagttttggatttccaatggttggatgggagggg

SEQ ID NO: 13815 - DNA, 972 bp, Zea mays
cattgggtacctcgaggccggccggggccgtgcagtgcagtccagcactccagtccagtccactgggcccctggccctacacgacgacggggcgggccggcgcctgtggacgatggatggctatataacattgggttcctcgaggccggccgggaacggcggcgacgagaagtggcgagccccgagagcgggtttagttagaggctacgggcggtcgggcgcggcggcggcggcggccatgagcagcgggagcgagagcactaccgccagcaggtggcccgagctggccacgctgcgcgcgctggcgcgcgacgccgcggagcagcttcggctgccgcgggccggcacgtcggcgtcggcgtcggcgtcggcgtcgtcgtcgccgtggcgcgggcgcgaggaccacctccacggccacggcaagacggccaaggtgatgcacctgctgctctggggacccaagtgaagcggcggcgagaggccaccgtaccgccgggctctcccgccggcgttgctcgttttgctctgcctgcaatccgccccgcacggactgtactgtacctatacacctatatactacgacgtgcacctgtactacgacgtgctgctgtaccatactaatactagtgcgctgctgctcccttgccttcttgcttgcaccagccactcccgctttttttgctcgaacgatcgactgctcgtgtcgcgtcgggccacggccggtcgtcagtttgggtgtgtccactccactgtaaagctcctctcttttttttgggtactccctccatgccaaagttagcggacgtgtactaggtgtggttcggagcagcaggttgtattacttaccacccctctgtaatgtaagaacgcgttctaaaattatcatgtcgataccaaattatggcatatggattggatgagaatgaaaaaaaatatgatgatttttgacttgcaaaaaaaaaaaggccccta

SEQ ID NO: 13816 - DNA, 830 bp, Zea mays
tcggccgcggacggcgccacggcggcgacgagaagtggcgagccccgagagcgggtttagttagaggctacgggcggtcgggcgcggcggcggcggcggccatgagcagcgggagcgagagcactaccgccagcaggtggcccgagctggccacgctgcgcgccctggcgcgcgacgccgcggagcagctgcggctgccgcgggccggcacgtcggcgtcggcgtcggcgtcgtcgtcgccgtggcgcgggcgcgaggaccacctccacggccacggcaagacggccaaggtgatgcacctgctgctctggggacccaagtgaagcggcgagaggccaccgtaccgccggcgttgctcgttttgctctgcctgcaatccgccccgcacggactgtactgtactgtacctatacacctatatactacgacgtgcacatgtacgagtctacgacgtgctgctgtaccatactaatactagtgcgctgctgctcccttgccttcttgcttgcaagttgcaccagccactccgcttttttttgctcgaacgatcgactgctcgtcgcgtcgggccacggccggtcgtcagtttgggtgtgtccactccactgtaaagctcctcctcttgtttttttgggtactccctgcatgccaaagttagcggacgtgtactaggtgtggttcggagcagcaggttgtattacttaccaccccctctgtgatgtaagaacgcgtgctgaaattatcatgttatggcatatggattggataagaatgggaaaaaaatatgatagattttgacttactataaaaaaaaaaaaaaaaaagcggcc

SEQ ID NO: 13817 - DNA, 1861 bp, Zea mays
acttattcgtttgtacagaatacactagagatagttacacttgatcaaaggttatataaattaaataaataaacctgactagtttcaggccacggttcagtccttagaggacgatgactgaacttgcgaacttaaaagacacgaaaggttcctgctacgaataagaagatacagtatgtgatgagataaagatcacactgccagatgtccctcacaggtacaaatccctcgagagctaaaccgatcgatgatatttgtcaaacatgttattatacgacccttaagatttgtttaattttgatcaaacaaaatatggtgaaacccactttaaaactaacagctacagctacgtgcaatgaatttggtactgtcggcaaatgccggggcttgagatattttcccgctggattgagatctttttatccttttggaccaccgctggtcggattttttccctccatcttcttccatcaccacggcgacaagtacgcagcgatggcgcgcagccactacttcctccgttcccttcccttccggccggagcagtctcgaaccctctctttcggcagcgagccccacgcacttgaataccttgcgacccctccctgtctcggaccgcgaccacccgccggcgaacgtaaccggcggcactccgatcccccaccccactcgtggatgctcaccgaccgttcgtcactgatccggacggacgggcgggcggacgggcggcctggtatgtgactgtgagcgaacgaccgcgtccgcgtggcgcggacgccgaggccgcccggtaccgcaggaccggggccaaaaaaaaaaaaatcggccgcgcagtgcgtcaaccaggtaaccccggccactcgatccacgtcctctcgtcactgaacgccacgcgatatttatcgtcgtcgcgtctcacctccactcacctgtgccgtgcagtgcagtccagtccagtccactgggcccctacacgacgacggggcgggccggcgcctgtggacgatggatggctatataaaccggccggctccgtcgccggccggcaacggcgccacggcggcgacgagaagtggcgagccccgagagcgggtttagttagaggctacgggcggtcgggcgcggcggcggcggcggccatgagcagcgggagcgagagcactaccgccagcaggtggcccgagctggccacgctgcgcgcgctggcgcgcgacgccgcggagcagcttcggctgccgcgggccggcacgtcggcgtcggcgtcgtcgccgtggcgcgggcgcgaggaccacctccacggccacggcaagacggccaaggtgatgcacctgctgctctggggacccaagtgaagcggcgagaggccaccgtaccgccgggctctcccgctggcgttgctcgttttgctctgcctgcaatccgccccgcacggactgtactgtacctatatatacacctacatactacgacgtgcacctgtactacgacgtgctgctgtaccatactaaatactagtgcgctgctgctcccttgccttcttgcttgcaccagccactccgcttttttgctcgaacgatcgactgctcgtgtcgcgtcgggccacggccggtcgtcagtttgggtgtgtccactccactgtaaagctccttttttgggtactccctgcatgccaaagttagcggacgtgtactaggtgtggttcggagcagcaggttgtattacttaccaccccctctgtgatgtaagaacgcgtgctgaaattatcatgtcgataccaagttatggcatatggattggataagaatgggaaaaaatatgatagattttgacttaaaaaaaaaaaaaaaaagcggccgcggcc

SEQ ID NO: 13818 - DNA, 909 bp, Zea mays
cgggtaaggtagcggcgagacgaggccgtttaaataggtgtcaagtggaagtgcagtgatctgtgcggcgggcgcgccggccggtcccgggaacggcgccacggcggcgacgagaagtggcgagccccgagagcgggtttagttagaggctacgggcggtcgggcgcggcggcggcggcggccatgagcagcgggagcgagagcactaccgccagcaggtggcccgagctggccacgctgcgcgccctggcgcgcgacgccgcggagcagcttcggctgccgcgggccggcacgtcggcggcgtcgtcgtcgtcgtcgtcgccgtggcgcgggcgcgaggaccacctccacggccacggcaagacggccaaggtgatgcacctgctgctctggggacccaagtgaagcggcgagaggccaccgtaccgccgggctctcccgctggcgttgctcgttttgctctgcctgcaatccgccccgcacggactgtactgtacctatatatacacctatatactacgacgtgcacctgtactacgacgtgctgctgtaccatactaaatactagtgcgctgctgctcccttgccttcttgcttgcaccagccactccgcttttttgctcgaacgatcgactgctcgtgtcgcgtcgggccacggccggtcgtcagtttgggtgtgtccactccactgtaaagctccttttttgggtactccctgcatgccaaagttagcggacgtgtactaggtgtggttcggagcagcaggttgtattacttaccaccccctctgtgatgtaagaacgcgtgctgaaattatcatgtcgataccaagttatggcatatggattggataagaatgggaaaaaataggatagattttgactaacagaactttaaccccggccccta

SEQ ID NO: 13819 - DNA, 1799 bp, Zea mays
ccagagagcaccacgtttccgcaacacatatatgtgtcacgtcggctctgtgatggattctcaaactccaccgttgcacttttgaagatggctacctttagagttggcttggtaacctgaaaattgagagggatttataagagaggaattctcctactatttaaaattgaatagcaagaaatttttcttagtcatcatttctgtccttgttttttttttttttttttgcctagaccgaaatcgccttcactgccactagcgggtccatgacaacctggccccgctgctgagtatatttggagggcccacttcacactcagtccaatggactccggccgctccggctccgctgcgtgaacggtagtcgcgcgcttttctcgttatccaacactcggggctgctacgtgtcccgcatgggcctcccccactcaccttttgtctcgcccacagccgcacagccttctggtctatgcccgctgggtccgccagcaccgggccccacttaattggcttctctcctgtctcctcctcggctctgccccacaccgccgttcccttcggtcagtcagttgtcccctcccccgcttccctttccttctcggaagagacgggcagacgaccatgtccatggaggacgacgcctcgaagatcagcgactgggaggtgctctctgccacctcttcccgcgggggcggcgacgacgatgaggtattaactgtctccggcgggggcggtgacgtcgtcctccttgaccacttcgtcctcacccccgaccccgcagcctcctgtcccggcgacggcgagggctcgtggtcggacgaccggggcgcctggcaagggttagaattattggatggattcgatccgattccggaagcaagtttcgatcttgcagttggtgttaggagccaacaactgctgataagcgacgtggatgacgcccgcgaagaaggctcgattgttcaagccaccgtggcgcgcggtgcgacccgtagcgcagaaggaaatcaagaggatgtggtagaggtcgagattgagcaggagagcagttccgtgattagccgcggtgcattgtgcccggtgctgcaggtggcggcgcatcatggcgtggaagaaactctggattctgaggcagttacacctacaggtgcctcgctccaaagccaggtatcagagagttcccttgtgcaactggatgatggaggaattggtgctggtgtaaaaagatcatgccttgaggatgctgtgtcaagtgatgagattcatggtgaacaagaagagcaggagcaagggagcaacgctaatgctgccattggttgcgatgaaccagatggagaggccaaggatgatgctttgccactggctcacacgccaggtactgaagagggagagaagtaatttgttgcctggtggaggctgccattcaagctgatgcactacaatgcttggaaggtgaagccagtatggtccttctccgtcgcagcggcacttctcggcctggtcgtgctggggaggaagatgtacaggatgaagcacaaggcaaggggcttgccccagattaagattgcgtttgatgataaggtaagctctttgcctctgttgaatacttttattgctatatattagaattatctgaacctgattctgattgtggtgtagtctaggacaatacataactgctccctaaattccaaattctaacatgtttttggcgtagtgtatatcctagtcgatagcaaaagctctgaacaaaaatatctaacacgtgttatgattttgaatggaatagcatatatagc

SEQ ID NO: 13820 - DNA, 1901 bp, Zea mays
gattagatctactagatggaacggagcaaggtgccgccctcacgctcgagaatgtgcactaggacgactagatgcttacggtcggcaaacgacgtgcgtgtatggtgaaaatgtcgctgctactccatagagtctatgataactagtgcttctcgccataaaaacgctttagtacaaaaaacacaaagatagatgaataagaacgacatcaccttgattgcgagatgtagtcagggtggcatgtcacttacccatggaaaaccctaaaaacaggggcaacgatgcgccaaaagcttgtggttgcaaacatgtgaagattcacgatcacactaatgagtgaacaagggtatatatttatagtccaaagacttgtgacctccactaaccctaatgcatctaggttggactctatctttccatctttaagcttatcgcttaaactaacctactagatacatggccgattcggactgggaaatacatgtgcaggggccgattcttaaactttccttaattgccccttgaagcccatttcagtcacgacccacttccaatccggttaaattatgacgaaaataagtctataatacaaaataatattttagattatcttatgagtgcactgttaaattcggtcttacaatctatttatataatcttattttaccagttgtccgaatatagtaaatagacatagaaaagccatggccactccaaattcctaaatgaacagtcgctcgcttttctcgacacgctgggctgctacgtgtcccgccagtactgggtcccacgtgcccgcctcctttcatcctcggcgggcccccctcccggcccccacacaccgccgtgttcccctcccttgtcagttgtcccttcccccacttccctttccttcccgaagagacgggcggaaacggcagagccaccatggccatggaggacgccgcctcggagagcagcgattgggaggtgctctctgccacctccgcctgcgggggcggcgacgacgatgaggtattaatcgtctctggcgggggcggcgacgtcgtcctcgaccacttcgctctcacccccgacaccgcagccgcctgtcctggcgacggcgagggctcgtggtcggacgaccggggcgcctggcaaggattagaattactggatgggttcgatccgattccggaagtaagattcaatcttgcagctggtgtttggaaccagccgctgctgataagcggcgtggatgacgcccgcgaaggggcgcgcggtgcgacccgcagcgcagatggaaatcaagaggaggtggtagacgccgagattcagcaggagagtaattctgtgtttagccgcggtgaattgcgcccggtgctgcaaccggcgtatcatggcgtgggagaaactctggattctgatgcagctacacgtacaggtgcctcgctccagggtgaggtatcggagagttcccttgtgcgattggatggaggaattggtactgttgtagaaagatcgtgccttgaagatgctgtgtcaagtgatgagatccatggtgaacaagaagagcaggaacaagggagcaacgttaatgctgctactggttgcgatgaaccagatggagaggtcaaggatggtgctctgcctctggctcacacggcaggtactgaagagggggagaagcaatttgttgtctggtggaagctgccgttcaagctgctgcactactgtgcttggaaggtgaagccggtatggtccttctccatcgccgcagcacttcttggcctggtcgtgctggggcggaggatgtacagaatgaagcgcaaggcaaggggcttgccccagattgagattgcgtttgatgataaggtaagttcttcgccactgttgaacacatctgttgctatattagaata

SEQ ID NO: 13821 - DNA, 912 bp, Zea mays
gcacgagaccattacctagaacatcctaatcgaaaaccatcaaaatctgcacgggattctgttgtgcgagtgatactcgtgcagagtctactccgcggctccgcgcgggcgcacgcagatgggcatcagcccctccaagcgcgtggacgctgcgctgcgccgcgctccgttgttcgccgccgcctgcgacgccgccttcgaccggtgcctcgccgacgcgcagcgccgcttcccgggcgtccgccggtaccagctcgccgacgccgccgcacaccttcactcggagctcagcgcgtccgtcccgctggtccggcgctgggtgccctcgccgccgccccgcgtccgagtcgacgccgcgctccgcgccgctgggctagaggacgaggcagagctctcgcgactccagttccgggagtttgccgtcgagctgttcagggaggccgtgctggccggagccgcggacctcctccgcgcgccccgcagccgcggccgggatcgtcgggataggcatggtggctcgagccgctcccccggtggtcgggaggatcgtcgccgtctgcgccgctagcgtggccaccgcagtttacctcagcctgggctagggtttcccccccaaattctagtgatgattagagaacctatacaaaccacttcccacagctctgctgtgttacggttgaacctggattcaacggcagttgttgcagtaatgcattttatgatcggattgagctcaaatgccattgaatcagctgtgcaatgtttcactgtcaaatcgcattcctgaaagaactaaaggatttgctgctgcatgagatatttgtatagtttatatttgatccataaacttactacattttacccttttttctctgaattgattgtgctaaaaaaaaaaaaaaaaaagcggcc

SEQ ID NO: 13822 - DNA, 1352 bp, Zea mays
caaatagaattacttaactagttgttactttgggtggatcaaacaacactttagttgtaggctcgttgagttccaaacattaaattttgaattacttttttttttcctaaaaacttacaatatcgaatatttttgggattctaaaataggttggagggggtagttgtagtagccacgcgagccccatggaaatctagcacattggaccgttttcactctcttttttctagctctagcttcttgaggtgtaatggattgattttggtaaaagagcatggtggagagaagccgagcagctgacaattattttagaatagttatggtggtaaatgaaaatggagccatgagaagctagtttgttttttttttaacctgaactcctagtgtaaaatggggttttgattcggcgtcgttcccatcaaaatctgcacgggattctgttgtgcgagtgatactcgtgcagagtctactccgcggctccgcgcgggcgcacgcagatgggcatcagcccctccaagcgcgtggacgctgcgctgcgccgcgcgccgttgttcgccgccgcctgcgacgccgccttcgaccggtgcctcgccgacgcgcagcgccgcttcccgggcgtccgccggtaccagctcgccgacgccgccgcacaccttcactcggagctcagcgcgtccgtcccgctggtccggcgctgggtgccctcgccgccgccccgcgtccgagtcgacgccgcgctccgcgccgctgggctagaggacgaggcagagctctcgcgactccagttccgggagtttgccgtcgagctgttcagggaggccgtgctggccggagccgcggacctcctccgcgcccccgcagccgcggccgggatcgtcgggataggcatggtggctcgagccgctcccccggtggtcgggaggatcgtcgccgtctgcgccgctagcgtggccaccgcagtttacctcagcctgggctagggtttcccccccaaattctagtgatgattagagaacctatacaaaccacttcccacagctctgctgtgttacggttgaacctggattcaacggcagttgttgcagtaatgcattttatgatcggatccagctcaaatgccattgaatcagctgtgcaatgtttcaccgtcaaatcgcattcctaaaaaaaaaaaataaatcaactctaaaggatttgctgctgcatgagatatttgtatagtttatatttgatccataaacttactacattttacccttttttctctgaattgattgtgcaaatgatgtacatgtgacgatataacagaagaaagtagttccaacttgcttatcaaagtaatttgtaaagaa

SEQ ID NO: 13823 - DNA, 2158 bp, Zea mays
  misc_feature (2150)..(2150): n is a, c, g, or t
ggtcccccccccccccccccgggtcagctcgggactcgggagcggcagctcccaaccatacgtccatatccccctcccaacaaaaaaaaaaactcccatcaatggcgatctgaatcaaccaaggcatctggaagcttggacatggagcggatcctcaagtccgccagggagtcgggctccctgaacctctccaatcgctccctcagggagatacccaaggaggtttacaacaacttggacactggcagccaggatgagaaatggtgggagggagtggacctccaaaagctcattctggctcacaataatcttgaggtgttaagagaagaccttaggaacttgtcttcgcttgttgttctaaatataagtcacaacaagatatcttcccttccagcagctatcggagatctcccgttgctaaaatcactggacatgtctttcaatcaaataaacactctgcccgaagagattggcctggctactgctttagtcaaggttgacttctcaaacaattgccttactgagcttccacctaacctcgccacatgcccggacttgtccgaactcaaggcatcaaacaacaacatatccagagtaccagatgtacttgctggctgttccaagttaagtaaattggatctagagggtaacaagcttgtggcactttctgaaaacatgtttgtgtcatggacaatgctcacagaattgaatctcgcaaagaatctacttacagccatcccaggtagcattggagcacttccaaaactaatccgcttggacatgcatcagaataaaataacatcgattcccccttccataaaaggttgctcttcgctagccgagttgtatatgggaaataacttattgtcttcaataccagctgatattggcacgttatcaaagttaggcatacttgatctccattctaatcagctaaaggagtatccagttggagcctgcaacctcaaattatctttccttgatctatcaaataactcattatctggtctaccagctgaactaggtaaaatgactaccctaagaaagcttctgcttactggaaatcctatgaggacacttaggagttcattggtttctggaccaacaacaacattgctgaagtatctgcgcagccggctttcatccgatgaggaagcatcaggatccagaagcaccccaactaaagatgaccaaattgctgcagcaaggcgcttgtccttatcttcaaaggaactggacttgagtggccttggagtgaccagtgtaccagctgccgcgtgggagacaagtgatgtggtgaaactggatctttctaaaaattcaatagaagatctaccaaatgagttgtcattatgctcatcacttcaatccttagttttgtctaataacaagataaaaaggtggcctcacacagtggtttcctcccttccctgtctgtcttccttaaagctggacaataaccccttggtagagatatcatccactgatcttgtgcctctgtccaaacttgaagtacttgatctaagtggcaatgcttcagcacttcctgaaccttctgcagtttctgcattaccacagctgcaagagctttacctaagacgaatgaaactccatgaatttcctaatggtttgctgggcctaaaactgcttaggattcttgacctgagtcagaatcaccttacaactgtgccggagggcatcaagaatttcactgcactcattgagcttgatctgtctgacaacaatataacagcactcccagcggagctgggattgcttgaagctaacctgcaagtgctgaaactggatggaaatccgctaagaagcataagacgaactctgttggagcgaggaacgaaagcagttctcaagtacctcaaagaaaaattgccgtctgaataatatttatagaacaaactattgttggagtaatggaataaaatgtttttttgccactgtatctcagttttctggactgaattttgtgcaaaagtatctggaccttgtgtgagaagagagctttgtgagtgtgttgttggatatactggttatagtccacatgttttattggaacaaaaatattttctctgttcaatactttacatggacacaaaaaaaaaaaaaaaaaaaaactcgaggaagggcccggntaccccaa

SEQ ID NO: 13824 - DNA, 1809 bp, Zea mays
cattgggtacctcgaaccgaaataaaagacggcgactctgcctgcacagcattgaccgccgccttcgctcctccacctccccgctcgctctcctgcctccgcgcgggccgcggatcccttcactcgccacagcaagcgctagaagagggaatggagcccggcctcgcatcccgcgtcgcccgttcagccgctcagccgctttccggctgcctgtcgcggcactcgctctcgccgtggctcaagatccagaaccacatttatcctatgccaagtctctgtcacaaggttcctagcacgggaaaatgccacgcttctatgacaacaagttacatggaaacatcagatgtcactgatttggactgggaaaaccttggctttggcctcatcgagactgactttatgtatgttgcaaaatgtggaactgatggaatcttttccaaaggtgaagtcctaccatttggtcctatagcactgagtccttcagctggagtcttaaattatgggcagggattgtttgaaggcctaaaagcatataggaaaactgatgggtccatccttctatttcgtccagaggagaatgctataaggatgctaagcggtgcagagaggatgtgtatgcctgctccaactgttgagcaattcgttgatgctgttaaacaaactgttttggcaaataaaagatgggtgcctcctactggtaaaggttccctatatatcaggccactcctaataggaagcggtgcagttcttggtcttgcgcctgctcctgagtatagctttatcatttttgtatcccctgttgggaattatttcaaggaaggtttatctcctattaatttgatcgttgaggataaatttcaccgtgccagccctggtggaactggaggtgtgaaaaccattggaaactatgcctcggtactgaaagcacaaaagattgcaaaggggaaaggatattctgatgtcctttatttggatgctgttcatgacaaatatcttgaagaagtctcttcctgcaatatttttgttgtgaaagacaatgttatttctacgcctgccattaaaggaacaatacttcctggtataacgaggaaaagtatcattgaagttgctcagagcaaaggtttcaaggttgaggagcgtctggtgtgtgtagatgagttgattaacgctgatgaagttttctgcacggggactgctgttgtggtgtcacctgtggggagtgttacatatatggggaaaagggtggaatatggcaaccaaggagtcggtgtcgtgtctcagcaactatacaagtcacttacaagcctccagatgggcaatgtggaggactggatgggttggaccatgcaacttaatcagtagcggatcacagatattgccttggcagatcccagattattacagctactgggtgcgatagggttttttttggcagatccatcttgagcatatttgactgtacctgtttcccttgagactaagacgaaagtgatcttactgatcttttgtttcaaatctgtaacgataaaataaaatgtggtttgcaccttgccatgtactgtaagaatggacccaaaaaaaaattcatgctgctgttgcttgatatctgaaactgtttatttgctgcagcagcaataataaaaaaaaaaaaaaaaaaaaaaaagggctggcctccacttatggactctgtcaccctgaaattaaattccgacccgtgtcttttaagcagtccacattttccttttagtaggcctattataactttggctaaatattgacattagtgtttcccttgtgaaattggtattc

SEQ ID NO: 13825 - DNA, 2953 bp, Zea mays
gtgtttggttccagagccggttgaaatagaatggctccgttcccgagagcggctccgtccgggggattttgaggagccaaatggttcaacatttgaccataaattttcatttttagaaccattcctatctatatggaatcaatctaaacaacaataaattgaaagcggagcggttctgttccaccatacaccggaaccaaaggctaggaggaactgctagtgaaattacagaaccacaaccgtgcttctcgcattgttgatttgcagaaagtggaaagtcagagtaatgtgcagctatgttggaatctgacatcatatggctttggtttgcagggtggaatatggcaaccaaggagtcggtgtcgtgtctcagcaactatacaagtcacttacaagcctccagatgggcaatgtggaggactggatgggttggaccatgcaacttaatcagtagcggatcacagatattgccttggcagatcccggattattacagctactgggtgcgatagggttttttttggcagatccatcttgagcatatttgactgtaccggtttcccttgagactaagacgaaagtgatcttactgatcttttgtttcaaatctgtaacgataaaataaaatgtggtttgcaccttgccatgtactgtaagaatggacccaaaaaaaaattcatgctgctgttgcttgatatctgaaactgtttatttgctgcagcagcaataatcttgtctctgctcggcgtatggcacagagtttttgctttgtacagatccagtcgatatgttgatgctgttctataatttgccgaagcatacaatttatttgattccgttcctacttttgcctctccggatgaaaaatgcagggataaaaacttgcttcggttggttgatctttcaccaaacgtcactaggttcttgttgggttgcatccaatccttttcagtccacttctaaccgaacaacaaagtctcgtgtgtgggagttgtgagcccgtttatttttttttccacttctaatcgaacaagctccctgtgtgtgtgagagactctgagctatcagcccgctcattcaggagacaattcacgtgatgatttaaacagagaaacaaatcggtccaggtgtcagtgtcactggcacagtgggtggtatggtacccagggaaaggcaagtgcgtcgtaccctgtacacgcaggctggcacagtgggtggtatggtaattggtacccagggaaagtctctcccagttccaggctccagcagtcactcagagccagaggagagaattcaaattcgcagcgcagcgccctcattttgtcattacgttgctctgctcctggctcacctcaccagcgatcactaccggagcaggccatgaagcttaagatcaacaaggcatgcgacctcggctccatctccgtcctccctccccggtgaaattcccgccctcgagttccgccccctctcgccgcggcggctcccgttgttctgagttctgagtctgacacgtggtcgcttcgtctttcgttactgatgctttcagtaggaccggtgggagcggcggcgcaggaggggcgggttcctccgccgcgcccgtggcggcggggtcgcagcagaggtcgcagccgatgtcgcagcactccttctcgcagggcgttgtggggagcggcggcgcgtcgtcgctcctgcactcgcagtcgcagctctcgcaggcctccctcgacgagaatctcctcaccctccacctcgcctcgcccgctcgcgatcaggtcccgtctgcgcccgttcttacctctcgtcgctgttcatgtgtgctcatagtgatcggggatgtgagccgttgtgctctcatgtgtgattggcggtggttttgcttcatcaatgagttcgccaaggggcggttagtggctgggggaattctgtgattatcgtgctagctgcagcaggttggtcgttttggattacttgcctcatcaggtgatttcagttgtgcttgatcgatacttgtaaggaaaacttcaaattagtgccctgctacatttaatcgagaaattcataaaactatgttctacctgaggacctttcaggcatactagctgggcagcctttggttcaaaaatttgtaggatgcataacggcagtgcatacattcgccaatttccaacggtttagctgcctaatcaattccgattagtaaaattgtttgctctggtactcgtatgacatctctttgatatagcatgtactgaagctattagggagtagatcccatattcccaccatgactgtgagactgtttgaaattgtgaatctgtttgaaattatggttccattatgtgagtccagcagtacgcaatttggttacgatattctctgtccctcagcagtcacttatgctttattcatgatcagtgaccaatgtgacaatgccctttctgcttacgtttcacttagagcacctgtgcttcgctagtttccaaagatgtatgattgtggtttattgcacaattatgacctccattttcttttgcttggtggtcagagattcgggttccatgacgacttatcaaagaagatgacatcgttgcctgtcagctcggcttcttgtgtgcgagaagaatctcagctgcaactggcaaaaacatcaagcaaccctgtccatcgatggaacccttctcttcctgacggtagaagtaaaccctccagatcccatgctgcatttggtagaattttcagtttattcatacgagcatagtagtatttcagaagaaaaaaactgggcctgaagatgattgtgttctaattaggtccattattcttatctcgttcactgtgtgtccagactattcattgagacccatagtttcattgtagctctattttgatttgtgtgccttaaccaggtgtgggtcctactgaggatgttgagcgcaaattcagaaaggcg

SEQ ID NO: 13826 - DNA, 2223 bp, Zea mays
cttgcggccccccgccatacttccgtgtcttcccggccttcttcggatggccagacccctccttctccaaaaatcccagaataccttgggctcccgagcaggagagagcaatgcaacgagccatccggatagccgcggctgcgacaaggcgagcgctgtcgtcgtcggcggcgagggcatcgccccctcctccccgcggccccctggctcctggctggggcgccactaggtggctctgcagcgggcgggaggcgctgagctacgacgtggtgatcgtgggcgcagggcccgcggggctcgccgcggcgatccggctgaagcagctctgccgcgctgctgacaccgacctctccgtatgcgtcctggagaagggctccgaagtcggtgctcatgtgctgtcggggaatgtgtttgagccccgagccttggacgagctcattcccaagtggaggcaagaggattctccaatcagagttcctgtttcatctgacaagttctggctgttaacaaagaaccaagcttggacactaccatctccatttgacaacaaaggaaactacgtgatcagcttgagccaattggtgcgttggatggccacaaaagctgaagagttgggtgttgaagtgtatccaggttttgctgctagtgagatactttatgatgaaaatcaaatagttacaggagtcgcaaccaatgatgttggtattgctaaggatggtaccaaaagggaaacttttcaacctggtgtagaactaagagggcgaataacactgcttgctgagggttgccgcggttcgttatcagagaaaataataagaaatcacaagctcagagagagagggcaagggcaacatcagacatatgctcttggaattaaggaggtttgggagattgaagaaggaaagcacaatccaggttctgttattcatactgttggatggcctttggatactaaaacatatggaggatcattcctgtaccaccttgatgatagacagttggcaattggtctggttgttgcgttgaattatcgaaatccgtttctgagtccctatgatgaattccagaaatttaagcagcaccctgctgttagaaaacttttggaaggtggaacagctattcagtatggtgcacgtactctcaatgaaggtggtttccagtcaataccatatccaattttccctggaggtgcaattattggatgctctgcaggatttctaaatgttcccaaaataaaaggaacccatacagctatgaaatcaggtatgcttgcggcggaagcaactttcaagtccctcgttgaaggatcttcgatggaactgtactgggagaacctcaagaagtcatggatatgggaagaacttcataaagctaggaattatagaccagcatttgaatacggattaattccgggtatggttttgtctgcactggaacgctacatattcaaagggaagtcaccttatacattgaagcatgggagacccgatcatgaagcaacagacacggccaatctgcatgcgcctattcaatatcctaaaccagatggacatataacatttgatgtcccaacatctttatacaggagcaatacaaaccatgagcatgatcagccgcctcatctccgcttgagggatcctacagtacccgaacgagtaaatgttgcactgtatgcagcgccagaatcacgctattgcccagcccgggtttacgaatatatctctgatgagaaaggtgacccaaagcttcatataaatgcacagaattgtcttcattgcaaggcttgcgacatcaaagatccaaagcagaacatcgagtggacagttccagaaggtggaggtggtcctggttacacagtaatgtagaatgctcaatgatgaaaatatgttgccttcaaaaataataacggctcattcaccactggtgtcaaactggaccaaatccctggctaattgggttggaagttacaccagacatctagcaatgagcaacttccttaaagcagtagacaggatgtcaggatgttcctagagctatgtaccgatcaggatcagtcagggaaagaagcgtgcatcacatggatgtggtgactgtaaaactattgggaagatgcaatttgtcgaccaataacaggcgctgtaagagagatctgtcccaaacgaaagatcgtaaggtgagatggaaaaaaaaaaaaaaaaaagaatgtattaaaatagacagagt

SEQ ID NO: 13827 - DNA, 3443 bp, Zea mays
gcaatacccttttcagcaagaacttagtttctattctccgatatttgtatatcttgttctaaccactaatcaagggatctagttgggggataaagttttaatttacaggtgtcgcctatccaccccccctctaggcgactttcaattggtatcagagctaggcacttcatcttgagtctaacaactcgaagtgatggctcgtagaagatcccaaaagaacaagaagactcctccaacgaacgcaactcaaaaggaggtaactcttgagatattatgtgatgattgttctaattatgattcatggtctactagtgtgataaatgcctttagaaccatacatcctcaattagaacaaattattgacaagagtatttttccctctagttttaatggaaaaattaattccgaggaggatcaaagatgttatcgcttaaactatttagcttttgacatcttaactaattctcttagcaaagaagattatcatgccttcatatcaaactatgacgaatccatccatgatgcgcatgatatttggactagaattagaagcaaatttgatgagtccaaacatgatagttcatttagtgcttccacttcctttggtatctgtgacactaacccttgcaaggaagaagaagaaaatgaacgatggagaccaaacgatgaatccacctctccaaaaggtttgtcttcccatttcaattctcacatgtgttgtgtggctaatgaaaatgatagcggaaggacaaatgaggatgaggaggaagaaagaagcttcttgcatctctacgctcgcctaagccaagaagataaggcggtcatgctcaaacttctagaaagagcaagagagcaaagcgaagctcgtcaaagggtagaaggtattctctccatgaagatgcaatgctttgacgagttgactaaagaacatgaggagctaaaatgctctcatgttgatttggtccaaaggtatgaaactatttcaattgagcaagataatgctttacattgtatcgctcaattagtaaataggaatactttgcttaaggaccaagtagaaaagctaaaagttgaaaatctaccttttcaagaaaaatatgatatgctcctatgctctcatgaaaatctcatgagatgatcatatcatattaaacattgctcatgaggttgtgatagaaaacttaaaatcccaacaacctcactcatgcacatgtattcaaattgatactatattaccatgtgctaatgcttgttgttcgtcgacaagcaaatcttcctttgagctagaatttgcaggaacaaatgatgattcatatcaaaagctcaaagaagaaaatgagaggctaaagaagagcttgacacaactaaaagggaaatgcattgcccaaccttctcaagataaccgtgatcacatggtgaagaagcttgagacgggaacaaccgtggcatgcactacatcccttgaagaaaatgtcaaggatttgaggattgccaagaggaagaaacaaaagatgaaattcaacacctcctccaaaagcctcaaccacgcctccacaaaaggtaacatccaaggtaatgatcaagccacacttcacattaagaggtgtagtgaatgctttgaagaggggcacttgattaggtcatgtccctacattaaaaatggcttgattattaacaaggatgatagactttgttttaaatgctccaagaagggacacttgcttagatcttgtccccatttaaaacaaaaaggcatagggttagaaaagaaagtttttactaaccatgtagcaagcaacaaacaaggaaagaagaaaacttcaaaacttgaaaaacgcctatgctacacatgccgaaagaagggacatcaatgcaaggattgtcccattggtaacaattccactcctagcttgtcaattaattctcatgtaactaggcaacccaaaattgcaacttgtgctagaaaggtaatgagtttacctagtgctaacacaaaggacttttgggttcctagatctttgttgactaaccgtgttggacccatcaagcgatgggtaccaaaacatgcttgacaagcttggcgggagagggggatggtatgaagctttgggatgcttgagagagtcaattcaatttttatttactcaagctatcaatctacagtgatctacatatccaagattgaccccaaggttatttaaaattattatgtctaaaatcatatcatcttgggaagatattaatgttataggaaataaagaattaatcttatgtcaaaaagtcaagacctacaacatggaggaaaagccaaaggatggtaacttttatgcttttaagtgcaagtattttagaatatcatttcttatgtgtcttatgtagtcacatagaaaaataaagcacttcaagtatctttaaattatatcaccattctttgaagaagttcctctcatatggtagattgtatattcagcattcctatattatgtcaatctacataccttaaattgttggaaggacttcatggcatgttttactttaattatcctattattgccataatctagatataaataaagattccatgttcttaaaagaataaggtgtcatgtaaggaattcaaatccttaaggacacttaaaaaaagggaatctttatttatgtctaaaatagtgagactaatgtttttatctaagtaacctaagtagtctcacttctagagaatgtgtttctctttggagatgtgctatctaacatgataagaaaaatcaatccaatggtatatgacgtattacctattgcttaaattggatatgattcttctatttttatcactctccatgttatgaactagatttgttcctataatcttaaattaactatgcttgtttttgctagtgaaaatttgagcataatatcatcatggaataacctagttcatatcttaaagtttccatgctttagtaatccactttttattccttatcaaaataattacacaaagggaaactagtgcttgtattgctattaacatttctcttgagcttacttatgaaaatctacaagaaagtaagtgcaagtttaatgccacaagcctcaaagggttgatcttcacccaaaggaagaaaggtaaaaagcaaaggtatgggaactcatcttcttaatcaatatagttcccatcaatggttgtttactctaatatatcatattctacctatgtaatggatagattcttattggaccaaagtcggattgatgtgcattcaatctcattctctcaaaatgcatttgtccattaaaatctatttcatgcctttgctatgtatcttctcatattaatttgcttctaaacaatgattaataaattcaatatgaagaagtaaattttatatgattgatccaaacgtttaaaaggtgcatattccgtgcactaacattaagggatt

SEQ ID NO: 13828 - DNA, 1941 bp, Zea mays
tgttgatttggtctaaaggtatgaaactatttcaattgagcaagataactctttacattgtatcgctcaattagtaaatacgaatgccttgcttaacgaccaagtagaaaagctaaaagttgaaaatctagcttttcaagaaaaaatatgatatgcttctatcttctcatgaaaatcttatggatgatcatatcatattaaacattgctcatgaggttgtgatagaaaacttaaaatcccaacaacctcacttatgcacatgtattcaaattgaaactatattaccatgtgccactgcttgttgtccgtcgacaagcaaatcttcctttgagctagaatttgcaggaacaaaagatgatacatatcaaaagctcaaagaagaaaatgagaggctaaagatgagcttgacacaacttaaagggaagtgcactgctcaaccttctcaagataaccgtgatcacatggtgaagaagcttgagacgggaacaaccgtggcatgcactaaatcccttgaagaaaatgtcaaggacttgaggatcgccaaggggaaggaacaaaagaagaaaatcaatacctctgccaaaagcctcaaccatgcctccatgcaaggtaacatccaaggtaatgatcaagccacacttcacactaagagaagtaagaagtgtagtgaatgctttgaaaagggacactcgattaggtcatgtccctatattaaaaatgacttgattattaacaaggatgataaactttgttttaaatgctcaaagaagggacacttaattaggtcttgtccccatttgaaacaaaaaggcatagtgttagaaaagaaaatattcactaaccatgtagcaagcaagaaacaaggaaagaagaaatcttcaagacttgaagatcgcctttgctacatatgccgaaagaagggacatcaatgcaaggattgtcccattggtaactatcccacttctagcttgtcaattatttcacatgtaactaggcaacccaaaattgcaacttgtgctagaaaggtaatgagtttaccaagtgctaacacaaaggacttttgggttcctagatctttgttgactaaccttgatggacccatcaagcgatgggtaccaaaatatgcttgacaagctttgcaggagaaggagatggtatgaagctttggggtgcttgagagagtcaattcaatttttattaactcaagctatcaatcttcaatgatctatatccaagattgacccaaagttattttgaattgttatatctaaaactcatatcatctcggggaagatattgatgttgtaggaaataaagaattaatcctgtgccgaaaagtcaaggcctacaacatggaggaaagccaaaggatggtaacaattatgcttttaagtgcaagtatcttaaattatcatttcttatgtgtcttgtgtagtcacatagaaaaagaaagcacttcaaatgtttttaaattatgtcaccattctttgaagaaattcctctcatatggtagattgtatattcatcatttctataccatggcaatctacatgctttaaattgttgtaagtatctcatggcatgctttacactaatcatcctattattgccatgttctagatatagagagatattccatgttcttaaaagaataaggtgtcacgtaaggaattcaattccttaggacacttataaagggaatctctctttatatctagaaatcgtgagactaatgtttttgtctaaataacctaagtagtctcacatgtagagaataagtttctctttggagatgcgcaatctaacatgaaaagaaaagtcaatccaatgatttatgggtgttttgcctcttgcttaaattggatatgattcttctatgtctatcgctctcccatgctatgaattagatctattcccctaatctttaagaattaactatgc

SEQ ID NO: 13829 - DNA, 1750 bp, Zea mays
ctcaaacttctagaaagagcgagagacaaagcgaagctcgtcaaaggctagaagatattctctccataaagatgcaacactttgacgagttgactaaagaacatgaggagctaaagtactctcatgttgatttggtccaaaggtatgaaactatttcaattgagcaagataacgctttacattgtatcgctcaattagtaaataggaataccttgcttaaggaccaaatagaaaagctaaaagttgaaaatctagcttttcaaaataaatatgatatgcttctatgttctcatgaaaatcttatagatgatcatatcatgttaaacattgctcatgaggttgtgatagaaaatttaaaatcccaacaacctcactcatgcacatgtattcaaattgatactatattaccatgtgctaatgcttgttgttcgtcgacaagcaaatcttcttttgagctagaatctgcaggaacaaatgatgattcatatcaaaagctcaaagaagaaaatgagaggctaaagaagagcttgacacaacttaaagggaaatgcattgcccaaccttctcaagataaccgtgatcacatggtgaagaagcttgagacgggaacaaccgtggcatgcactacatcccttgaagaaaatgtcaaggatttgaggattgccaagaggaataaacaaaagaagaaattcaacacctcctccaaaagcctcaaccacgcctccacaaaaggtaacatccaaggtaatgatcaagccacacttcacattaagaggtgtagtgaatgctttaaagaggggcacttgattaggtcatgtccctacattaaaaatggcttgattattaacaaggatgatagactttgttttaaatgctccaagaagggacacttgcttagatcttgtccccatttaaaacaaaaaggcatagggttagaaaagaaggtttttactaaccatgtagcaggcaacaaacaaggaaagaagaaatcttcaaaacttggaaaacgcctatgctacacatgccgaaagaagggacatcaatgcaaagattgtcccattggtaaaaatcccactcctaacttgtcatttgattcatatataactaggcaacccaagattgcaacttgtgctagaaaggtaacaagtttaccaagcgctagcacaaaggacacttgggttcctagatctttgtttactaaccttaacggacccatcaagcgatgggtaccaaaatgtgcttgacaagatttgtaggagaaggagatggtatgaacctttggggtgcttgagggagttaattcaattcttatcaactcaagctatcaatcttcaaatgatctacatattcaagattgacccaaggttacttcagtttattgtattcaaaactcatatcatctcgggaagatattaatgttgtaggaaataaagaatcatcatgtgcggaatatcaaagcctacaacatggaggaaagtcaagggatggtaacatttatattcttaagtgcaattatcttaatttgtcatgtgtcttgtgtagtcacatagaaatagaaagcacttaaggatgttttaaaattatgtcatcattctttgaagaaattcctctcatatggtagattgtgtatttatcaaattctatattatgacaatctacatgttttaaattgttgcaagttcacatggcatgtctttacattaattattctattattgccatgttctagatatagagagataattcatgt

SEQ ID NO: 13830 - DNA, 531 bp, Zea mays
atcacaaggcttgagacagagaaggagagctttgaattgaggtgtagacatcttgaagaggaattggcgttagcaaaaggtgagatactgcgcctcgtcgtcgtgtgttccgctgccggtgcgcggagaccaagagcaagaggaccaccagaggccaatgaaactctgaaggagcaacctgtgaatgattataatcagaagaccagtggagttgttgctggaactccacagcctgtgaaaaggactgtaaggagaagaaaaggtggcgcataaacatgtgtgtgactgtgtgtattggaagccctagccagagccatcgttttcccataccttcctatttagtaatttcattgttactcattttttttttgaaaatagcatcaatagctattcaagtgttatttacatcccccccccctagtatttcagttactcgatgtattctgtttacgttttttgaaaattgaggtctgtatgtgtataaatgagttattgaatggccaacacgatgaaattaaagtatctgcacct

SEQ ID NO: 13831 - DNA, 2026 bp, Zea mays
ttttttttttttttttgcaaccagcaacatagaagaacctaacgatatgatctgggagggaatggccctggtaaactcaatgaactgttgcgagtcaaagttacacgacaggcacagcaacatcctacataaatcttcttctatgaatacatgacggtacaacatttccgactaacaatgcattagcctctctaatcggtcgccctatgtcacctttgcaagaactcgttcctcacggtattgcagatctcatctgccactgcagcgttttcacgcaggaacttctccgcttccaccttgcctgccaggaactcgttgttgatccaatacccacacccgtctttcaggatcactccgacggaggaagccgtctccaggatctccgactcgtggcagatccccttaccgaatgtgatgtcgatgccggcttccttcttcaggttcgctggagccaatttgttcttgatgatctgcactgatatacctacgccggtagcctcatcttcactatagcgcagttctctccttgaagtcctcattctgactgcagcatagaatcctagtgcattaccaccgcaaggcacctccttgtagatcccaggattacttgatgtcctctttgttctaacctgattcacaaaaataataagtgtttcagatcgacataaagtgtactgaatttttctaagggcccgagtcatcaaatgggattggatgtctccacaatttgtgtatatttcaccttcaatttcacatttgggaataagtgctgccacactgtccacaacaacaacagcaacagaaccaccaacaagagtgtttacaatgcttagagaattttcagcagaatcaggttgggctatcaagagcctttcactgtctacgccaatagattcagcaaatgaagggttgaaggcattttctgcatcaatataagcacaataacctccattcttttgagcttccttaataacatgaagcgcgagtgttgtcttcccagatgcttctttcccatatatctccaccattctacccttcggtaatcctccaacgccgagagcgaggtcaagcttaagagaaccagtagagactacagatgctttccttgcacgggaaaatcgctccaaacataaattagagtctctatcgaagtcaattgcgagttgagaaacagcaacattaagtgatgactccttctcaatagcttttgtatcgtcaagagggggatcactctcatagtctaactgcatatcaactgtggttgataccgaacgacctttgaaccaaagcgaacaaaatgtgtctcttttcccattctagcaaatgacatcacagggaagaaagattatcagcaatttgcgcagatctcttgaaatatgagcaagtaggcattgtgaactcgatacttcacttatgaaggtattaaagccagtgagaacgaaacagtaaagcagcacatacaccaattgaaaccaaaagccacagttctcccctagtgggaaaaggctgacgtgggaatagcactattgtacagcattacagcccataatgcatatttctccgaatctcactcttctatgttttagtagcttgtgcacatgagcaggagccagcaaagcagaacttgtacgctcatggtcaaaccgttgcagatatcagctgtttcagccaatctaacccaacaaaggtcaagggcagtttgacaacattaactagcaaagaggacttaccagtccgactgaaaatcctctattgcaaaaggaagttacagtccctagcacacggcaacaagccacgagcccgcgatcgagggagcggcagcgagatacgcggtcatcatacctgaagaggggagcggcggagaggagaggtcgcggacgctgaggggctactgcagtccgtgcgcgagagctgggcgccggctcgccggaggagagcggaggaagaggagaggatccctcgcatggcggcgggcgggcagcggcggagcggtgggccgcgcgcgcgctcgagtggtgtggtggat

SEQ ID NO: 13832 - DNA, 1326 bp, Zea mays
cgttgggtccctcgaggccggccggaaaacaagcaaagcgtggacgtacttcaggcggagctgagtccttgagaagaagacttcaagaagagcacatcagtcacaactttcttttggtgagcattttgagaaagttacttacaatgatctagcgcaagcaacaagggacttctcagaatccaacctgattggaagaggaagctatggcacggtgtacagtgggaaattgaaggaatcaaagacggaagtggctgtcaaggtttttgaccttgagatgcaaggtgcagagagaagcttcttggcagagtgtgaagcattgagaagtattcagcaccggaatcttcttcccatcataactgcatgctcaactgtagatacggcgggcaatgttttcaaggcattaatttatgagcttatgccaaatgggaacttggataaatggatacatcacaaaggcgacgaggcagttccaaagcaccgtctaagcttaactcaaagaattgcagttgtcgtcaatgttgctgatgcattggattacttacaccacgactgcggaaggcccactgtccattgtgacttgaagccaagcaacatccttctcgatgacgatatgaatgctctcttggcagattttggcatcgcacgtctctatgccgatcctcagttgacttttgcaggttcaattagttcgatcggtattaagggcacaattggctatatccctccagaatacggaggtggtggccatgtttcgacgtccggtgatgtttatagttttggtatagtgttgttggagattttgaccgggaaaaggccgacagatcctatgttcaccgggggactagacatcatcagcttcgtggagaacagttttccggatcaaatatttcaagttattgatccgcatcttgtggaagaccgccagaagataaatcagccaaatgaagtagcaaacaatgaaatgtaccaatgcctggtggctctgctgcaagtagcactttcttgcacgcgctcattaccatctgaacggtccaatatgaagcaggtagcaagcaaactgcaagcaatcaaggcggcacaacttggaggcaaatccaagtgagattagatgtactccctcgacgagcagcgtaaaccggaatacgagatgactagaaatgtactctagtctagcatacaaataagtgttgtttaccttgtatatgcatctatggttcaatatggttataccgtcaagcaactacaacatgatatgtaatatctagtatttacacattgaaagcatcgaacttgtgctgtgatttaaagaagtaaaaaaaagcggcc

SEQ ID NO: 13833 - DNA, 2280 bp, Zea mays
acctcattggcttctgatgagtgataaccacctatccggaatagtcccctcaagcattggaaaatttaatggtttaattgaactcgatcttggtggaaacaattttaccggtacaattgaggattggatcccaaagttgacgagcctacaaaacttatatctcaatgacaacaactttgatggtataatcccaccttaattctattagtaaccttactcaattggcacttttggatgtttcaaataataaattcactggttcaataccacctagcatgggaaccatttaacctctattcaatttgaccctaagcaacaacaatttcagagggagaatacctgccgagttttgggaccttaaacaattagtcttccttgatgtttcatcgaacaaatttagtggggaaattcctcaaagtttgggccagtgccaaaatctaggcaccggtgccctgcgccgctcggcccggacaggaaacatcccgacctccttcagtaatctatatagcttgaccttgctaaatctttcccataacagtttctcaggtcgcttgccagattatctaaatgacctaaagcttctcaataaaattgacctgtcttacaataatttccaaggagagataccaaaagctagtatattcgataacgctacagttgtttcactggatggcaatccaggattgtgtggaggaaccatggatttgcatatgccttcatgccctactgtttctagaagagcgacgatcataagctatttgattaagatattgatcccaatatttgggttcatgtccctcctattgcttgtctactttttagtccttgagaagaagacttcaagaagagcacatcagtcacagctttcttttggtgagcattttgagaaagttacttacaatgatctagcgcaagcaacaagggacttctcagaatccaacctgattggaagaggaagctatggcacggtgtacagtgggaaattgaaggaatcaaagacggaagtggctgtcaaggtttttgaccttgagatgcaaggtgcagagagaagcttcttggcagagtgtgaagcattgagaagtattcagcaccggaatcttcttcccatcataactgcatgctcaactgtagatacggcgggcaatgttttcaaggcattaatttatgagcttatgccaaatgggaacttggataaatggatacatcacaaaggcgacgaggcagttccaaagcgccgtctaagcttaactcaaagaattgcagttgtcgttagtgtagctgatgcattggattacttacaccacgactgcggaaggcccactgtccattgtgacttgaagccaagcaacatccttctcgatgacgatatgaatgctctcttggcagattttggcatcgcacgtctctatgccgatcctcagttgacttttgcaggttcaattagttcgatcggtattaagggcacaattggctatatccctccaggtatatatatatatacatggtttcacaaccctcccccgtctctctacaaaacattataaatctgcatcttttcatgacttacataaatcaatctactttgtacatatttttctattcagaatacggaggtggtggccatgtttcgacgtccggtgatgtttatagttttggtatagtgttgttggagattttgaccggtaaaaggccgacagatcctatgttcaccgggggactagacatcatcagcttcgtggagaacagttttccggatcaaatatttcaagttattgatccgcatcttgtggaagaccgccagaagataaatcagccaaatgaagtagcaaacaatgaaatgtaccaatgcctggtggctctgctgcaagtagcactttcttgcacgcgctcattaccatctgaacggtccaatatgaagcaggtagcaagcaaactgcaagcaatcaaggcggcacaacttggaggcaaatccaagtgagattagatgtactccctcgacgagcagcgtaaaccggaatacgagatgactagaaatgtactctagtctagcatacaagtgttgtttaccttgtatatgcatctatggttcaatatggttataccgtcaagcaactacaacatgatatgtaatatctagtatttacacattgaaagcatcgaactatgtatggtttgaaatagttatttactttgtttagatttcttgaattatgtagttcattatttaattgtgagaaaatttaatgagtttatcctctaaaaaaaagtcgacgcggccgc

SEQ ID NO: 13834 - DNA, 2765 bp, Zea mays
tagttgttgcttaataaaataatgttggttggttttgttcttcctttaaattgaatgaccactttcatgctattgttatttctcaccggtgctagttttccagagattagttgttactgcttcatctttgcattttaagtgaaatcccggtataatcggtgcatttcgtatggggaaattgctggtccatggttgttgggtgttggcaatttaaaccatgtggctggccattagtgttaagtttctccctacggtgtaatttttagaaaggtcagggggggccttgccagcatcatccctgccgtctgccgaaacggcgaaaaaaaaaacaagagtgcgagcccaccacctctccttctctctctgtctctcctcctggctcactctgtgcgctcctcggcgcgtgcccacgtctcccacgcctccctccctgcattccccccttcagatccggtctgccccgccgccgccgatgtccgaagatcccgtgggatcccgccgctggcggtgcgacctcggcggcgacgagcgctggctctcgggggccgctggcgacgaccaattcgaccgcctcccggacgcgctcctcctcgtcatcttcaaccgcatcggcgacgtcaaggcgctcggccgctgctccctcgtctcccgccgcttccacgagctcgtgcccctcgtcgactccgtcctcgtccgcgtcgactgcgttatccccgacgagcccccctcctcctcgtcctcctcgtcaacgccgtcctctcctacggcgtccgtgcgcgcccgcggggtcttctcacagattgcgcgcatcgtgctcggcggcatcgtgaagcccatccaggcgcttggtcagatcctctcacccgccaactccgcctccggctttccggcatccgccgcttcgtcgctatcgtcgtcgtcgtcctcctcctcgccactgcctggctggggacgtgtcgcaccactcgccatcggaggtgctccgttccttcaaggagctccgccaccttcgcatcgagctcccagcgggcgagctcggcatggacgatggcgtgatgctcaagtggaaggctgacttcgggtccacactgggcagctgcgtcatccttggagcatcctcagcctcgccgtcgccctccccctcctcagctggctcagatagtccgagcgccgctccctctgatgacagtggccacaccgagcctgatgaatgtgacgattcaggaagcatccctgagtcgttctacacaaatggggggtttaagctgcgagtggtttggtcaatcagctcattgattgcggccgccgcgaggcattacttgctgcagccgatcattgctgatcacatgacgctcgagacattggacctgacagatgctgatggtcagggagtgctcaccatggacaagtgccaactgcaggagctgagggtgagaccggtgtcaacatctaggggctcacaccggacgctcatgccagagctttgcatgtggctgtggtatgcaccatgtattgagctgcctggggggttgttgctgaatggtgcaacgctggtggccatcaagccaagtgaggaaggaacaggggacacagtttggaatgaaactgctgatgcagcctgggtgttggatgcattcgaggagccatatagaacagcggcgaagatgcttctcaagcgaaggacctacagccttgagatgaattcattctaatctatgggagatggcattttggaagcttcagatgtgagaggtacacaatagttgtctgatttttgtttgtaatttctgtttggtagatcgagttttagtattcttgcataattgtgaaatactgaaatgaatacaactaggtcacctcgacacacatttttctaaacactaaacagcacgagtcaaaatatcttggttgaatttatgtgccgaatttgactttggcttgtgttgcatcttagaagtacacaaatttctgttttagacttttagttcattaggtggaactaagttttgggcagtcaggaccagtattaggtggaaacctatgttcttttttttttggccgagctgggcaccctgcacccatgttgattccaagtgctatttggtgtttccaaattttttttgcccacacatcagccgctgtatggtggattgaagcttattgtagaggccatatagcaaaacaaaagcacagaggacagagggacctgggctgcaaaacgaaaagacgtgactagctagtttgcacaattcctcaaaacactggctccttatgacatttttttgcttcgttggtagctttgtgctaataccctgctcattgacctcgccatatccaaatgctggagtgcctgtatttgttgttatctcaccgcaaaccaaaccttgtttagccaaaagggatctttgcctttcttggtgttttgattctgttccatagtaagttttttttcagagtatagacttctacaacttcatgttggttacttgtattactctgttcctcgttctgccactgtactggctacgactgctaagtatagtattctgcttactctttttttacacatccgacatgtcttgattggttattgctgtgcaacgccacttcatcattgtgagtcctcttttcaaagccttccaaggctccaagctttgagaatgcaccattatacctcatcccaacagaatcatagtgaactccacttcatcattgtgagtcctcttttcaaagccttccaaggctccaagctttgagaatgcacc

SEQ ID NO: 13835 - DNA, 694 bp, Zea mays
  misc_feature (589)..(589): n is a, c, g, or t
ccggctctctcccctcctcctggttcactctgtgcgctcctcggcgcgtgcccacgtctcccacgcctccctccctgcattccccttcagatccggtctgccccgccgccgccgatgtccgaagatcccgcgggatcccgccgctggcggtgcgacctcggcggcgacgagcgctggctatcgggggccgctggtgacgaccaattcgaccgcctcccggacgcgctcctcctcgtcatcttcaaccgcatcggcgacgtcaaggcgctcggccgctgctccctcgtctcccgccgcttccacgagctcgtgtcccttgtcgactccgtcctcgtccgcgtcgactgcgttatccccgacgagcccccctcctcgtcgtcgacgccgtcctctcctacggcgtccgtgcgcgcccgcggggtcttctcacagattgcgcgcatcgtgctcggcggcatcgtgaagcccatccaggcgcttggtcagatcctctcacccgccaactccgcctccggctttccggcatcctccgcttcgtcgctatcgtcgtcctcctcctcctcctcgccactgcctgctggggacgtgncggaccactcgccatcggaggtgctccgttcctttaaggagcttccgcacctttgtatagagctcccagcgggcgagctcggcatggacgatggcgtgatgctta

SEQ ID NO: 13836 - DNA, 1502 bp, Zea mays
gcacgagaccattacctagaacatcctaatcgaaaaattcgctcctagcgacgccaccgctagctcgcctctccaaccaaacgcaaagcaaagaacccaattccattgttccccactcggactcccggtatccaccctcctccctcgcctcgcggcctttcggcatttgctccagctccgaactgagccacgcaacacgaggctaacggaggggatggagtcggacgcgtccacctccccgcggcgacacaacatgagctgttacagcgacagcggcgattcctcctgctccgagcccttcagcgagtgcggtaatgacaacctctccttcacgcccgccgccaccgcgagcatccaccgcctactgctctcctatgcggccaaggtgtcagaggacgcaatctcctcgctcgtggccgagctggaatgcccatcgcagtcgctggactcgctccgccacacggcgatggagctccggctgctggccaagcacaacccggacaacagagtgcgcatcgccgtggtgggtggcgtccgctcgctcgtcaggttgctatcgcacgcggacccgctgctgcaggagcatggcgtcacgacactgctcaacctctccatctgcgacgataacaaggcgaccatcgtcgaggcgggagcgatacgaccgctggtgcgcttaagtccgcagcatcacccacggcgcgggagaacgccgtgtgcgcgctgctctggctgtcccagcttgacggcgcctccgcggtcgcgctggcgccatcccgctgctggtctccgtgctcgagaccgggtgcgcgcgaggcaagaaggacgctgccacggcgctatacgcgctttgcagcagcgcgcgcgagaaccggcagcacggcgtggagaccggtgccgtgcggcccctgctggacctcatggccgacctgaagtccggcatgatggataaagccgcgtacatcctccactccctagtgaactccggcgagggccgcgccgccgccatcgaggaaggcgacatccccatcctggttcaaggtggtggaggtcggcacctcgcactagaaggagatcgctaccctctccctcctgtagatcaggatcgatcgtgatggggcggacggggatcgcggagcagaggaggaggatgtcggcggggtcgatggaaggtggccattgatggcggcatggaaggtggccattgatggcgacgggtcagaggcagttttgcagacgggatctgagcgcttggggaggagggcgcgatggggcggatggggatcagagcaaagaggggcagaatcgtgcaccatggacgcctacactgtagtcttaagaagtagtatagattttccattgcaatctcatccgaacatgtttctataacaacattcttgacaagaacttgattatagaggttagaattatcaattaaatcaaagcaagaagtagaagcatctttcttaataatttcaggtattgcaacaaataaaaaaaaaaaa

SEQ ID NO: 13837 - DNA, 1587 bp, Zea mays
ctttatttaaaaatataatattcgactaagtttcaactaaatattgtgtatgtactattgttcataatttgcttgtaatatgatttttatcaaactataaatccatcgataaaacaaattaatacttgttatgatgctatgttccaaatcaagtaaatatccgaatgtaaatccgaattcgaattattcgttttgtattcgtatccgatagtattcatattcgtatccgtattcggattaaagtatggtaaatagtgacatttaaatccgtttctatgtatccgatccgaatccatccctatcctcaccagcttgaaatgcttttgccattcctctggtagccattcaatttcaaatcagcggaagttgtggaaatcagcgctgcggacaggccgaagcccagcccaacccgcaactgtctgagcctgcgggctgcggcactagcctgcccaccacccgagacagcccagcgtggtgcacgccaacatggacctgtcccgacccgcacgcgccctgccggctgctgctctcacgtgcaccgccgtccgtccgtacgcgcgcggagagggagaggagcgaggaggggcccatctcacgtgtcacgcccgccggtctgcctctaacgagatgcgcgcctcctctaccgtcgcaccacgatccaacggctggcgctccacgccgtgtctcacgcccttcgaccgtcgctcgccacgcggcggaaaacaccgtccgatgtggatctggtggcggtagttgcggtatagatggaggcgagaaaaagttaaaagggtgtgtggattacttgacgcgagagtgcgagacggttaaccccgcccgagcccctccttatttcattcgctcctagcgacgccaccgctagctcgcctctccaaccaaacgcaaagcaaagaacagaacccaattccatcgtatcgttccccactcgggctcccggtctcctccaccctcctccctcgcctcgcggccttccggcatttgctccagctcggaactgagccgcgcgacacgaggctgacggaggggatggagtcggacgcgtccacctccccgcggcggcgcagcacgagctgctacagcgacagcggcgattcctcctgctccgagcccttcagcgagtgcggcagcgacgacctctccttcacgcccgccgccgccgcgggcatccaccgcctgctgctctcctgcgcggccgaggcgtcggaggacgcaatctcctcgctcgtggccgagctggaatgcccgtcgcagtcgctggactcgctccgccgcgcggcgatggagctccggctgctggccaagcacaacccggacaaccgggtccgcatcgccgcggcgggcggcgtccgcccgctcgtcaggctgctgtcgcacgcggacccgctgctgcaggagcacggcgtcacggcgctgctcaacctctccatctgcgacgagaacaaggcgaccatcgtcgaggcgggagcgatacggccgctggtgcacgcgctcaagtccgcggcgtcgcccgcggcgcgggagaacgccgcgtgcgcgctgctccggctgtcccagctcgacggcgcctcc

SEQ ID NO: 13838 - DNA, 1457 bp, Zea mays
gaattgttctgttatataaatcttctaaacattttaacaaattatatgttttgtaggtccgaggttctatgccattcttgtgggagcagattgttgatttgacatacaaacccggtcgcgtcggggttagacaagaggatgcgccttctgtgcttgagaggcatttccatgatttgcaaaagaaatacggagctgtcttagctgttgatcttgtcaatacaggtggcggtgagggtcgcctccgtgaaagatatgcaaaatctattgaacctattcttagtgaagatctaagatatgtgcacttcgacttccaccgaatttgtggccatattcactttgagcgtctgtctcagctgtatgatcagatcaaggactaccttcagaaacataagtacttccttataaatgataaaggagagaaaattgaggagcagactggcactacaagaacaaattgtatagattgtttggatcgcaccaatgtgactcagagcatgattgggcggaaaattctggaaagccaacttcaacgtataggagttcttagtgctggtgatacaataagcaaacatccagcctttgatacaaactacaaaattttgtgggccaatcatggagatgcaataagcattcagtactctggaactcctgctctgaagggagattttgttcggtacgggaagcgaactactcagggaattctaaacgatttgaggaatgcacttggtagatactacttgaataacttcgttgatgggactaagcaggatgccatggatcttcttcaaggacattacatgacatctgttagtagagatatggcagtgccaagcaaagcaggacttctgcagagttatgcgtccttccgccttgcttttgcattggttatgggagctctaatgttcatgttgatgtcactgagacaggcccggaatgatgttcgtcatttgttgctgtcacttatgtgggctggtctttgtattggcatcacacattttgttagagccaatggtcgcacgttcactaaccaacctaggtttcacaagtcacgccattgatggttgcaagatgaccaatttgctcgtcaagcggcctcatagattatcatcatccatcaaacttgttgacacagattggtttacatgaagtgttgcgtttttttggcacggtatttacccttttgtaataaggtttcttccattttgtaacaagtttttgtttcctcgtcgcctacttttgcttcatagtgttctggacatcatggtctttgttagaatttacttgtaaaaaccaagtgaatatgccttcagcacatattattgtattatgatttgttcatgctacaaacgaagtgaatacgccttttgtgatttgttcatttgtaataaaaagtttgaatactccttttgtgaaaaaaaaaaaaaaaaaaggcccctagggccaaaaaaaaagcggcc

SEQ ID NO: 13839 - DNA, 1000 bp, Zea mays
cccacgcgtccggaaaattgaggagcagactggcactgtaagaacaaattgtatagattgtgtggatcgtaccaatgtgactcagagcatgattggggggaaaattctggaaagccaacgcctaccgataggagttcttagtgctggtgatacaataagcaaacatccagcctttgatacaaactacaaaattttgtgggccaatcatggagatgcaataagcattcagtactctggaactcctgctctgaagggagattttgttcggtacgggaagcgaactactcagggaattctaaacgatttgaggaatgcacttgctagatactacttgaataacttcgttgatgggactaagcaggatgccatggatcttcttcaaggacataacatgacatctgttagtcgagacatggcagtgccaagcaaatcaggacttctggagagttatgcgtccttccgccttgcttttgcattggttatgggagctctagtgttcatgatgatgccactaagacaagcccggaatgatgctcgccatttgatgctgtcatttctttgggccggtctttgtattggcatctcacattttgtcagagccaacggccgcacgttcactaaccgacctaggtttcacaagtcacgccattgatggatgcaagatgaccgtttgctcgtcaagcgacgtcatagattgtcatcattcatcgaacttgttgacacaaattggtttgcatgaagtgttgcattttttttggcatggtacttgccctttgtaataagttttcttccatttcgtaactagtttttgtttcttcctctcctatgtctggtccatactgttctggccttctatggtcttcggtagaattcattggtaaaaaccatatgaagtgtattatgattttttcgtattgcatactcagtcctcggcatttgcaccagggatggctaaaaaaaaaaaaacaaaaagaccaactaaaaaaaaaaaaaaaaaaaa

SEQ ID NO: 13840 - DNA, 2840 bp, Zea mays
gagggtccaaaatagaccgatacaagataaagaaaccaccttacggtggccagaaaataaaatacaaaaatacatccatagtgtgctccatcaacttctccagcctgctcttataagtgctccttgtgcctttggtggcaactcctcttttcccctctaccggttgttttttacttgatctcgacacatggcctgctactgtgttctgctgctgcaactcctctggtggatgtttgaagtataagccaagacagactaggaactatgtttacttcaccgcccttcaccattgtcaccatgctgcattgcatttgcatcgcgttcctggcactcgatcttttgcatttgcagtgctactacactacactatgcccatggggtgtgtatgatcaagttgatgtgccgggcagcatggcaaaatcaatgacgtgtttggtagggaccagactacgatggccatggagtcttccttgagactgatttggaggatgttaagaaatcgatttgggagttgagagtgaatttagatcgcatcaccattccaaggacaaatatgacattttccttggctttgttatacgcatccttcattttttgagtattttaagtgtgtgaactaagtcaattacacaagccgatggaatttgttagttgaagctttgatgttcacagctcactgctacattatttttgcagcccggaatgatgttcgtcatttgttgctgtcacttatgtgggctggtctttgtattggcatcacacattttgttagagccaatggtcgcacgttcactaaccaacctaggtttcacaagtcacgccattgatggttgcaagatgaccaatttgctcgtcaagcggcctcatagattatcatcatccatcaaacttgttgacacagattggttcacatgaagtgttgcgtttttttggcacggtatttacccttttgtaataaggtttcttccattttgtaacaagtttttgtttcctcgtcgcctacttttgcttcatagtgttctggacatcatggtctttgttagaatttacttgtaaaaatcaagtgaatatgccttcagcacatattattgtattatgatttgttcatgctacaaacgaagtgaatacaccttttgtgatttgttcatttgtaataaaaagtttgaatactccttttgtgcactcattctgatggactatcagatgttcctgcaaacgatcataaactagcatggctactttagcctgtccttgacctttcttgatgttttgttgaagtcctacagaagcagcaccaagagctgtcgttgctgtctataaaagaaaaaagagagacagatcttccatgtgtacgtcctttctactgttccttgtcagctgtgtctgctccatcaacttgtccagcctgcactgataaaagctccttgcgccttcggtggcaagtcctcttcttcccctctaccggctgtttttttttacttgacctcgacacaaggcctgctgctgtgttctgccgctgcaacttgtttgaagtagaagccaagacagacaaaggaacgatgtctacttcaccgcccttcgccatcgtcaccatgcgtcgcgttccgttgctcgcactcgatctttttcagttgcagtgatactctgtgtagtctacacacatggtgatggaggaggtagtaactgacgcgagccgagccgaggtggacacctcccggccgttccagtcggtccgggaggcagtggaggcgtttagcgagcggcggcaggccggtggcaacgggagcagcgcgtcgtcgtccagcgtcgagctcggcgcgcctgatccggcggcagactcaccatcgtccgtgatgctggagtgcctgaagaagctggaggaagagctggcggaggccaaggacgagatggtggagctgaggcagaggcaggcccagatggaggtggccgtgtctagcctcagcgtgcagttcagcaagggtctggccgtctactccaggctcagcaagggcaaggaggtggccgtcgtcgtcggagaagaggacagtgcccgcgtccgcagcgaccggtgggacgagagccgggccgaggagtgggtggcgagcctcgagtacctgccgagcctgtcggaggcgctggcaatcaagatggtcgaggatgacctgggccacgacagcaaggcgaagaagaagaagaagagcaagaacaaggcggccggtgccagcaggaccaagaaacacaagagcgggatctcactgcaattggtcgggggcatgttgtgcaccaagaaagccaagtccaggtgatggtctcagagatgcagccttttcagtttccctaccctttttttctgttgaaaaatctgcctcgtgtataagctggcatctagtctggaacatataggtattccgctaggatttcatggaacaatttggtttgatccccgtgtaaatccagcgaaatccctatttattgttgcagatgggggctgagagatgctgctccgtatgttcttttccctacctaaaatgaaatacatgaatctatcaccttgtttccgtatacattactactatatcaagctatgtatgtaacgagcgttaaaaggtaaattttgcactaggtcaagtacaggtgcagttttttcaatccttttaaaatcattttaaaataatattagagtaatttatttccaaaactaattcattggtcacgctaattcatgtggggtggctaaggtagtgtttggttgaagagccaagtaaaacggagccgctcagatccggaatattctcctcagatccggaaccatcccgctccaaaaaatcaaccggacggag

SEQ ID NO: 13841 - DNA, 2693 bp, Zea mays
gcgcattgcacgatattcacgtgcattttgcgctgcacagtgggctcaccatgtaatgtttgcattgatctttttttttgtgcaaaagaagtaacaacttccaaaaaaatctgttacacactgcatggggttcctcaggagtgtttttcttcgtaatttctcttgactgacactggtccatgtgctagagtagtgtctcaactttttggcacaggtctttcagcattagcttgcacaagagtttaagcatagctctgctgtacaaaaaatctagcctgcaaacaaacatggttgaaattgtctgtgaaacattgtcaatattgcttattcagcgttctttctcctgttatgtttattttttccttgggattcttgggttcattttgtgcaaaccgttcctaatctacctgaagttgcgaaagggcctctaactgagttggttaggtgacctgagtagcatttaaggttgtggttaaaaaaatcccctcgtttgtctcacgccaaatcacaggtctaaggtcccggtcgcagtcgtgttctcacatgggctacgatgccgctatgtatgggtggggcaggggttcaggcgttttctcgacctgtgtgaggtcttcttcttaatataatgttcgggggctgtcttacccccacaggtcgatgtttttttatctacctcatggaaatgactctgtccccactcccaccaaatacaccttgcatgcacatgcctatagaaactacatgaaatccatattctttgtgtccgtcttggcccatatggtttcacttttggcaatatattgatgcactcgctgaccaacatccatttggcatatgtcgtgattgtgatggccaaaattctatctgttctgatgtccattgattagcacatttgttgagagatccgttttgttctattttatgtttttacccaatcttcatcaccaggtgcatggaaaaaaaactaaggtaatgtagttgtctcttatgatggatcaactggcagcttaagggtgtgtttggttcagctttctaaaccagatttgttgccaaaaatctggaatctcaaccaaaggggtataatagcagaatatatttctgaaaatctgtagatttatatagttcaatttagaatcacctcatatcctagattttctagattcctgccatccatgttaccaagttatcatgcccttacagaatctacagttgacagtggttcaaccaaatatattttagctttctcacaaccgtctgctcgcagcagctcacagccagaataagatttttagaaatctatagctggacgaaacagaccctaagtctgaccaatcatttagtgtatcaaatgatatcaaagcactaacattttgacctttgccgtatactttagtcagcaaatcagcatagagaatttatttgaaattgggactgatccatgtaacttcagttttgcttgcctgaaacgatgactagggcccgtttgctccgctccttgctggagctgcctggcccagtcagctacccagcgtccgattttggacgctcggatgcctggtagggcacgaaccaaacaggaacccatactcaaaactgaaattttattctgccttttaggagtgtgaagggttgtgattttctgggttatcagttttttgggggagcacactgttttgacatactgtttactgctggatattttcataaacttcctatctctgtgacctgtttagtcatcttgtacttaattttcataacgtttactctattttgttcataacgtttactctattttgtgcatgatattctttttttggtaacatgttcctttgttgatgttctgttttccagcctacaacagagtgacgagactccaatggtctgggagatccttctttatatgtatgtcctttattcgccggactggcattacaggagcacaatgccaaccttccttttcctatatggtgctgcctttgctgtagttcatttctttgcccggttccaattcgtattcaagctgcattacattggcctctgcttcctctgcatcccccggatgtacaagtattacatacagaccaaagacgtggctgcgaagcggctcgcaaagctgtgggttctcacgttaacccttgggactctctgctggctagttgatcgcatcttctgcaagaagctttcgcattggtatgtcaacccgcaggggcacgcatggtggcatgtgcttatgggcctcaactcatactatgcaaacacattcctaatgttctgtcgggctcagcagcgcgggtgggaggcgcgaatcacctaccttcttggatttttgccttatgtcaaggtccagaaaccagagaagaagagggaatgatttgtctctgcttaacactgatgctactcagtccaccgccagtaagctaatgtctatcccccaccccatcccccacccaatgtgcgcagacaagttgtggcatttttgtatatgggcatcgaaatgattacggactataaatgttctgatgtcacactggatttcggtaacttttgactggcacctgttttgtaccatacttaatcatcgaacggagattagttggagtggttggttggtgtcctagttttggccatctttctttaaaaaaaaaaaaaaaaaaaaaaaaaaaaaaaagaaaaaaaaaaaaaaaaaagcggcc

SEQ ID NO: 13842 - DNA, 766 bp, Zea mays
gtccgccccggatgtacaagtattacatacagacgaaagacgtggctgttttgctttttcgcgaagctgtgggttctcacgggaacccttgggactctctgctggctagttgatcgcatcttctgcaagaagctttcgcattggtatgtcaacccgcaggggcacgcatggtggcatgtgcttatgggcctcaactcatactatgcaaacacattcctaatgttctgtcgggctcagcagcgcgggtgggaggcgcgaatcacctaccttcttggatttttgccttatgtcaaggtccagaaaccagagaagaagagggaatgatttgtctctgctgaacactgatgctactcagtccaccgccagtaagctaatgtctatcccccaccccaccccccacccaatgtgcgcagacaagttgtggcatttttgtatatgggcatccaaatgattacggactataaatgttctgatgtcacactggatttcggtaacttttgactggcacctgttttgtaccatacttaatcatcgaacggagattagttggagtggttggttggtgtcctagttttggccatctttcttttggtttctttgcaattgccttttggtggtaataggacagggttatttgtttaaaaaaaaaaaaaaaaatggagtccagttgtactagttatcatcactccgcatggggatacatccttccatatgatgaccgttaattcaaaaaaaaaaaaaaaactagagggggggcccggtaccc

SEQ ID NO: 13843 - DNA, 719 bp, Zea mays
aaggaaacggccccgccgggctcctgccgataaaagctgacgccacggtaccattcccaaggccagcaaaagcttccagtcttgttggctccgttcctccatgaaccagtagcctctctccaatccccatctcctcttcctggggttttcggtcagtgtcttggcttgtgtcggggtcgcaatggtgaaggacggcggcgtgaagaaggtggcggtggcggcgccggcgccggaggaagcgacgccaaccggcctgaccgcgacgccgaccctcaccgtgaagctaccggcaccagaggcgcgggagaagtgctataagaagacggtgggggaggatgcgacgttcctggagatcgctaaggactacttcaaccagttcaaggaggtacccgcgcaaaagcactggatctgcttcaagagctacttcgtccagaagcgcggctcggtgttcggcaaccgcaagcagaagatcgaccctgcggtcaaggatgagactccggaggtggtgaagcccgcagcagcagcagttgtcccttaggctatgttcggtttcaagattttaattccccaagtggatctaattctatgagggagtggatccctccctttcactcaatccacttggggtttaatccccctttggtctaacccctgtccaaaaaagtctattcggttaatccatatcgtgtataacttgatctctcaaaaaaaaaaaaaaa

SEQ ID NO: 13844 - DNA, 2997 bp, Zea mays
ttactcattaatgtattttgatataaataattataaattgtttgacttagttttttttttggttggaattgcgtctcttttttttttaaatggagtgagtaccacggaggggaactttgacgctggttgttaatgtcctctcttcggaaacaatttgcataattaataagcaattagctattttctttgctactacataatataaagaagtaagattttttggataaaagaaaaggaaaaattggaaatgtcgtgggttcgtagctctcgcttcctggtcgtcgcgagtccaaacaaaaagaagttcacaatcaccgcgagcacgcagaaatgaacggaggcttgcgcttgcctgtatcgcgcgaccggagctgagcagcagcacagagtggagccagctcgcttcgcctcctcggtcgcctccacttctatatcacttccccgtctggccccttccccgtgcgccaccgcgcacaatcacacgcgcgcgcccacacgtgcggcttcccggattcgcgccgccgcgccagagccagccaggccagcttcggatcgaggaagaggaggtggcgaaggtgaggagtcaacccagcttccgagccatggacggatcggccgcggagctggaggcggcggagcgggtggtgatgcggtgggactcatcctcggcgggcgccggcgcggacgagccgatgctgttcgacggcggcggggaccgggccgaggcggacaggttcctccgcgccgtcgacgatctgcgtcggctcgcgccgccgtcgcccgcggcagtcggcagcccgcgccgcctctcgtcgtcctcggtggcggcgagcggcgccgtgcaggtcgctatggcgcggctcgaggacgagttccgccacgtgctgtcgacgcgcgccctcgacctcgagatcgaggcgctcgccgacctcagctcgctctccatcaacagtgaccgcaccaactcggcctcctccgccgacctccccgccgctgacgaggacgactccgtgtcctcctccatcggccgccgcagcaccgcctaccgctcgctccggagcatccgcgagatcgacctgctacccgacgacgccgtcgcggacctccgcgccatcgcgtcccgcatggccgccgccgggtacggccgcgagtgcgcgcaggtgtacgcctccgtccgcaagcccgccgtcgacgcctccctgcgccggctcggtgtcgagcgcctcagcatcggcgacgtccagcgcctcgagtgggacgcgctcgaggccaagatccgccgatggatccgcgccgcccgcgccgccgtccgcggcgtctttgccagcgagcgccgcctctgcttccacatcttccacgaccttcctatctccaccaccaccatctccgccgcctcagcgtccgccacgcacgacatccctttcgccgaagccgtcaagggcgccgcgctgcagctcttcggcttcaccgaggccatcagcatcggtcgccgctcccctgagaagctcttcaagatcatagacctccacgacgcgctctcggacctcctccccgacgtctccgacatcttcgccgcctccaaggtcgcggagtccatatacgtgcaggccgttgagatccggtctcgcctcgccgatgccgtgagagggatactctcggagttcgagaacgccgtgctccgcgacccgcccaagaccgcggtgcctggcggtaccatccacccgctcactcggtatgtgatgaactatagcagcctcatttgcgactacaaggtcacgctctccgagctgatcatatcacgtccatcagctagcgctcgtctttctgctgagggcaatgagctcgcgccgtccttggccgacctcgagctccctgagcttgagaaccagttaccgcttgcctctcacattgtctggatcattgttgttcttgaacacaacctggagggcaaggcggcactctacaaggatccagctctctcgcatctgttcatgatgaacaatgttcactacattgtccacaaggttaaagattcgccagatctctggagcatgatcggtgataattacttgaaacggcttactaccaagttcacaatggcggccacaaactaccagcgcacctcatggttgaagatcttgaattgtttgcgtgatgaggggctccatgtaagtggtggcttttcgtcggggatatccaagtcggcactgcgggagcggttcaagtccttcaatgctgcatttgaggatgcgcatagggtgcagtcagggtggtgtgtgccagacaaccagctgagggaggagctcaggatctcaattgctgagaagctgctgccagcataccggtcattccttggcagatttcgacatcatatagagaacgggaagcatccagagctctacattaagttctccgttgaggaccttgagatagctgtgagcgatttctttgaaggtgttcctccttccccacataacaggaggaaatcacatggatgagggacttttacctcaggtattcaactggctgatgttgctatttattcttttattcttcacaaagaagctggttctggtatttgggctcgatttcttctgtcctgatagatgtgagtataaatttggtggtcttcaatcagagatggcaaatatgaatacattttgggatctttctgaagctgtcaatcggcccagtgatccctactctgtaagagaaggtgttcatttggtacactataattatataaattttgcaagtagcatgtccatatagaaaattctttcagcaacgttggatagttggaacccatggcatttttgcccctgttttgcaccagcttctgttacccttttcattgttaacaattatcaaatgggtctacgctttgtggattagatgtaaaaagatttctacgactctcatgtaccacatatttttgtaatatgataatatcacgctgttgcaaattcaaaagaaaacttcaagtcttctccatgg

SEQ ID NO: 13845 - DNA, 3629 bp, Zea mays
ctgctgataacgttatgtttctgctgacatatactcgtaggaaggtgaaaagccagacagcatcattagcactaacctcaactttaacggaaagcttcagcctgatgctagtaacggcaccgctcaggttttcattaacgggcgggaaattacaaagattgaactgagaattctaaaggtgtcaattgttccttaccattggttttccaagaatatgatgattgagagttgctactgaatgtacattgtagttctgtttcactcctctaaccaaaccgatcacatatttactgtctttcatgcagattgcaaaagtccaatgcccccgtgatactcacttctgggtttaccatgatggtggctacgaggaagaaggacaaaacaatatcaaagggaaaatatgggagtcagtatgtatcttggtcaaacattcctttttggttttctaaacattgttaattaacatgtattgtcgtttcgttgcttttagcatgacttgttgtgctcttcttttaacagcctttgacacgttttgcgtgcgccttggtttcactaccggtgcctcctacaaactttgatgcgacaaaagatgaagccccttattcatcaaaaactgtacctgactacttagatcataaaagaatacaaaagcttcttattcttggatctcctggagctggaacaagcaccatatttaagcaggtatcaccaaaatttacatccataacgccttcagtttccctatatgtttctgcaaggtgccatgtgacatcacctatgggttattgcagcagcatgcattactcgtctacagctagctatttagaaccttggacgcactccaaatttgtcatcagttcttctatgaaactcagctgaaagtttattgataaagtttctgttcaagtaatcccaaattctggtgaagtagaaaccaaccatctgactattttggagtgcctgtttctgcagtacttcataaaaaccttacacaactagatcttatatacatttatgtttggtaaagttagcactttgaatcttggcttaaagtttattactaaagtttcagcaacaaaacaaaaaaaatggctctcccagtaaacttctatatgctttctataaaagccggttttacctgtcaaaaaaggagtcccttgttttggtagtgtgggaatactattattgtttcagagtgtcaatttgtgtggttaaacgctgagatcttctgtaagatataattgcttgggactaaaaggctttgttgttgttgtctagtttagtaattttaatgagaaatggcaccatttgagttcatatcctgttacccttatttggtttacatgacaggctaagttatcatttatcttgcatacatttgcatgacatttggtttacataacaggctaagttgttatacggcaatagatttactgatgaggaacttgagaatatcaaactaatgatccaaagcaacatgtttaagtacctggggattctgcttgagggccgggagcgctttgaggaagaggctttggctgtaccaaatcacccaagctcagtgggcgatgatcctcagcaaggtatcaggacagctgatacttgttctgcttcttttgtttttcaggagcttatgctgtatattattaagttggtctttttgatgcagatgaaagtaaatcttcaagttccaattcttgcatctactcgataaatgcaaaactgaagaagttttccgattggctcctggacatcatagcgacaggagacctagatacattcttccctgcagctacccgtgaatatgctccagttgttgatgagttgtggaaagatcctgccattcaagcaacatacaaaagaaaggatgaattgcattttctccctgatgctgctgagtacttcttgagcagggtataagccaaagcagttgacttgaactaatatggtccattccattgctgataagctgcgattaagtacagagttacccttgattgatcctgttgacgacttgcattttcactgattctgctagatcagcactccatattatgacttactctactcgtgcatccttctacccattagtaatttcgttagatttttggggaaatggaattgatggtccgcaggtttttaatcatttaaggaactttaagtttccagatttttctggccttctctcatctgcaaacaatgatcttcggctccatactgactagatgtgctgctacttattttcttttccctctctgattacctaaattgacctgtccattgtatgacaaatccatgcaggctgttgaagtatcaagtaacgaatacgaaccgtcagagaaagacgtgatatacgctgagggagtaacacaagggaacggattggccttcattgacttcaccttggatgaccggagccctatgtcagaatcctttggcgacaaccacgatgcgtaccctcaacaaccagtaaacaagtacagtctatcttccccgctctgctcacctgtcgaattcttcctctcctagttgtcttgcctcatatgcttctatcctctctcaggtaccagctgattagagtgagcgccaagggcatgaacgagggctgcaagtgggtggagatgtttgaggatgttagcatggtgatcttctctgtagcgctcagcgactacgaccagctcggagccccagcgagcggcagtagcaggacactcgtgaataagatgatccaaagcagggacctgtgtgaggctacaatcaggtgcaggagcctctccattactgtccatgtcattcatatgtgtatatattgcagaaacacaattccaatggacttaaagttactgaatcatatatttttcaagttacaggcagccgtgcttccgtgacacgccgttcctgcttttgctgaacaagtacgacgcgttcgaggagaagatcgggcggtccccgctgtcgtcgtgcgagtggttcggcgacttctgcccgctgcggacgcaccacaacagccagtcgctggcgcagcaggcgttctactacgtggccatcaagttcaaggacctgtacgcggcgagcacggggcggaagctgttcgtgtggcagacgcgcgcccgcgaccggcccaccgttgacgaggccttccgctacgtccgggaggtcctccggtgggaggacgagcgtggcgtcgccgggtactgccccgacgagtccttctacagcaccacggagctcagctcgtcccgcctcatcgccgccgcacagtgactgtcccagcgttgttttgtgtataatgatcgtatgcttgcttgtttcccgaacaaatcaaatgctatcaaatatagtgatctgagtgatgagcagaaaaaaaaaaaaacaaggacgctgcccatgctgccgatgttcccttctcttctgattcggagcatatccggtgagcatgggcttacggtgttgtgcacatcaaatccgagccatccttttggatccaacggttcttgtttttttttcatattatcccatacgctcccctcttctctggtcaagtatttttacaataacccacccccgcgactcaccaccactctctcagcttgaaacacagccgaagaacatgacccatccagcaaact

SEQ ID NO: 13846 - DNA, 1739 bp, Zea mays
caaaactgtacctgactacggtgcgcctgcaggacggcccgagctccgggttcttggatctcctggagctggaacaagcaccatatttaagcaggctaagttgttatacggcaatagatttactgatgaggaacttgagaatatcaaactaatgatccaaagcaacatgtttaagtacctggggattctgcttgagggccgggagcgctttgaggaagaggctttggctgtaccaaatcacccaagctcagtgggcgatgatcctcagcaagatgaaagtaaatcttcaagttccaattcttgcatctactcgataaatgcaaaactgaagaagttttccgattggctcctggacatcatagcgacaggagacctagatacattcttccctgcagctacccgtgaatatgctccagttgttgatgagttgtggaaagatcctgccattcaagcaacatacaaaagaaaggatgaattgcattttctccctgatgctgctgagtacttcttgagcagggctgttgaagtatcaagtaacgaatacgaaccgtcagagaaagacgtgatatacgctgagggagtaacacaagggaacggattggccttcattgacttcaccttggatgaccggagccctatgtcagaatcctttggcgacaaccacgatgcgtaccctcaacaaccagtaaacaagtaccagctgattagagtgagcgccaagggcatgaacgagggctgcaagtgggtggaaatgtttgaggatgttagcatggtgatcttctctgtagcgctcagcgactacgaccagctcggagccccagcgagcggcagtagcaggacactcgtgaataagatgatccaaagcagggacctgtttgaggctacaatcaggcagccgtgcttccgtgacacgccgttcctgcttttgctgaacaagtacgacgcgttcgaggagaagatcgggcggtccccgctgtcgtcgtgcgagtggttcggcgacttctgcccgctgcggacgcaccacaacagccagtcgctggcgcagcaggcgttctactacgtggccatcaagttcaaggacctgtacgcggcgagcacggggcggaagctgttcgtgtggcagacgcgcgcccgcgaccggcccaccgttgacgaggccttccgctacgtccgggaggtcctccggtgggaggacgagcgtggcgtcgccgggtactgccccgacgagtccttctacagcaccacggagctcagctcgtcccgcctcatcgccgctgcacagtgactgtcgcagcgttgttttgtgtataatgatcgtatgcttgcttgtttcccgaacaaatcaaatgctatcaaatatagtgatctgagtgatgagcagaaaactcgtactgtccttttggtgtccatgctgccgatgttcccttctcttctgattcggagcatatccggtgagcatgggcttacggtgttgtgcacatcaaatccgagccatccttttggatccaacggttcttgtttttttttcatattatcccatacgctcccctcttctctggtcaagtatttttacaataacccacccccgcgactcaccaccactctctcagcttgaaacacagccgaagaacattgacccatccagcaaactattgctgtcggctaaaaccatgcatgtttggtttctttaatcacccttttatatagctgctatgtagccgctgcaggtcgactctaga

SEQ ID NO: 13847 - DNA, 1016 bp, Zea mays
  misc_feature (999)..(999): n is a, c, g, or t
ggccccctttttttttttttttttaatttttttttttttttttttttttttttttttttttttgtccttttttttttttttttttttttttttcagtaattggcagctcttaacgaagcatgaccttattgagcaatttggcaggtcgcagtacacccctcagtcttcagtaagaatacagctgactacggaaagctacctctgcaaacagcttgttcacccccggttgaacactccaccgattccagaaaacgaagaatttagttacatgcagccaaatgtccagaagaaccgggcacgattgacctgcacatggtcgttcaggccttcttggcggcgaagccgaggatgaactctctggtctcgtcggtggcccggtcgagcgccgtccggccgtcgacgtccttgacgtcgaacctggcgccggcgcggagcagctcctcgatcttggggcggtcgccctcggaggctgccagcatgaggaggatgtccacggggtggatgtcctggttcagcagcgcctccatcttgtcgtaggtgccctccaccgccagcatccccatgtagttgaagtactgctcgacgtcgtcgcggtcgaagtcgtccctggcctggctgccgtagatgccggcaccctcggcgtccttgttgccgaacttgaaccagcaggtgggacccgcccgcccgctctcgctcgccggcaccacgcggctcaaccgcgacggccgcagccaccccaggccccgcctccccgcgcccagcagcggcgtcctcagcaccgctccccctcctccttggcctctcccctgcgccgccacccgcggcgacaccctcctcgacgccgccgtgctcagctggaaggtgcacgggatggacgccatggccgcgtcctctgtctgcctctgggctcggcgcggaggacgtgcgcgtcggcgggagagcgagaggctgggaagggcactgagctgcagtgccgagggagtggataagcccggaatncggaccggtactgcagg

SEQ ID NO: 13848 - DNA, 5132 bp, Zea mays
attaacttgttgtgcgctgtagcaacacaaccataatttgttgtgtactacttttgatatgtttcaacctaataagcctgtgtattcaaataaatgagcctcttcctactttggcagtggatgaacgatgtggtatggaattagatgaaactgatcctgctatctggcttaagttggaagctgcaactgatgagtacattcagaagaattttctggctttcaagaatctttgtgagcttctggtcccaaggtaccaagaggaagaaaagtcatctgatatttacaaatccctttcattttcaaggctgacatcactaaatcaaggtttgtctctcccagaattcagcatttcttaaaaaaatatttagaataccttgttgatatgttttttttatcctctcttaacaggtttcagcgaaagtaatcctaccttaggatggaggcgtgtggttttacttgtcgaggcttcctttagtcctgatttcgggaagaaaataaatcatgcacgctcccttgaatctttctgctcccagaatggtattaggttagctctaatgaatagtgcttctgggtttgggaaaccagccactgcacttcctaccccgataacttctcccttgtttactggaagtttcccatctagtccacttctatatagtccagatggcactcaacggatcggtcgaattgacctagttccaccacttagtttggatggccacccaactacaaagtcctcaccaccaacatcaccattgaagtcaaggcagccatcagcacatgttcggtcattgtatgataaactgcagaatatgcctcaagttggtgtaatacacctggctcttcaaaatgattcaaccggttcagtattgaggtatctttcacatgcttcagcattttctttgtttctggtttatagttatgagcctgtgacacaaaactactgttgcagttggcagaatgatgtatttgtggttgctgaacccggagatcttgcagacagatttctgcaatctgtcagaactagtttgtcaaccttgttgcgtgggcgtaatagaaagggtgcatattccttgtccaagatttcatgtttatctgagctggttgctgagtgtccatcttttgaaatcggtgggatacaccaccgctatataggtcgacaaacacaagtaggaattgctttttctggctccttgtttccaactaggtcattattttgcatacttaattatccttttttcgtaggtaatggaagataaccaagaaattggcgcatatatgtttaggaggacagtgcctgctgttcacatggcacctgaagatgttcgatggatggtaggtcaatttgcgcagcatgaatgcattggtcttcataattatgttaaggccataactgatcacatgccagctgtgaaagtggccaagtatggcaaccaaatctgtgtcgtaggaaaattgtgaaaggggttcaagtagaaatcatccctatggcactgtattggtttggttagctaaaatttggccatggagaaacactaggcaaattgaattatttccgcagtcactctcccaacttgctggttgtgtctaaaatgaaattgctgctaccaaactatcctctgcgcacctctttgattagactctgctaccacttcttatccaaatacatgtgatcgagctcatttttttaatccctgccaggctagtagaaacctgtttcctgggccaaggcagcttaaaagtagggctcaatatgtttttttttacttgcacactgcactatcttgcttatctgttgtgcttcttcgcatatcattaagcttacggcattatgcctgctgttcacatggcacctgaagatgttcgatggatggttggagcatggagggagagaatcattgtatgcagcggtaagtatggcctcgctcatggcctggtgaaggcattcatggattgtggcgccaaagcagtcatctcatcgtccatcgagcctccggattcccagacaatagtctatcatgggatggatgtcaatggaagcctagagaatgggaagtttgtcatcggggatgaagaagccgatgaatcggaacctgaacctgttagccctgtaagtgactgggaggacagcgacgtggagaaaggtggcaaccatgacatggatgatgaggagtacctggctcagttcatgtgcctgatgtacgataaattgttccgtgagggtgtgactgtggatacagctctgcagcaagctctccgctcgcatcccaagttaaagtacagctgccacttacctcacgttttgtagttagggacattgacaaaccatacaggagtatagcaaaacgggcatggacaacaggaaatgaataaggattgggtggattcatagtggggttatagaggtttatatcgtgttcgttgtgcaggcgtagtgacagagggtacccccttactgaatctttgggcgagaaagcctatgtaaacctgtgtgctcatgagcagagtagttaagctgacgaataaaagcatgatgaagggcattgtaatctggatgtgcatttttgtttcagctaggagaatggacattcgcaatgttttggtgtctcatgacgttcagttgctagcttgcaggcttgcggcgtacagcctgtagttaactatcttcagagacccggtttcatgtatacactatacaggctggcaccttatgctagaaacctgaatgtgtgtactgtagaagttccccattttaccacagtttatgcgatgctggtagtggcatgaactttgctagcccatatgttctgtttaaggccccgtgctgtcttgaaacaaatctctgcattaataaacagtaaagacatcaagtgctaagctggcgattgagcggcggctctgattttcagtaattggcagctcttaacgaagcatgaccttattgagcaatttggcaggtcgcagtacacccctcagtcttcagtaagaatacagctgactacggaaagctacctctgcaaacagcttgttcacccccggttgaacactccaccgattccagaaaacgaagaatttagttacatgcagccaaatgtccagaagaaccgggcacgattgacctgcacatggtcgttcaggccttcttggcggcgaagccgaggatgaactctctggtctcgtcggtggcccggtcgagcgccgtccggccgtcgacgtccttgacgtcgaacctggcgccggcgcggagcagctcctcgatcttggggcggtcgccctcggaggctgccagcatgaggaggatgtccacggggtggatgtcctggttcagcagcgcctccatcttgtcgtagggtgccctccaccgccagcatccccatgtagttgaagtactgcggttgtcgtcaatcgccggggggcggttttacacatatgctctgtgatccacggacgacgcaacgcaaatgcgtcccggcaaaaaatgacaatgcaggaggagcttagttaagattacctgctcgacgtcgtcgcggtcgaagtcgtccctggcctggctgccgtagatgccggcaccctcggcgtccttgttgccgaacttgaaccagcaggtgggacccgcccgcccgctctcgctcgccggcaccacgcggctcaaccgcgacggccgcagccaccccaggccccgcctccccgcgcccagcagcggcgtcctcagcaccgctccccctcctccttggcctctcccctgcgccgccacccgcggcgacaccctcctcgacgccgccgtgctcagctggaaggtgcacgggatggacgccatggccgcgtcctctgtctgcctctgggctcggcgcggaggacgtgcgcgtcggcgggagagcgagaggctgggaagggcactgagctgcagtgccgagggagtggataagttaacacgccgctgctgaactcaactgtttgggtcctgcacttgttttatatggacgcctcaagagtatggcaaaactaggtgatgatcactgcctgaattatgaatctctcagctgctttttaatctggtattctggtggcgcaagacagcacggcagatatccaggaagtgcaggagagatacaaagtgtctttttttttctgtcctacaggaaaggttgggaggatggccattggccaaaattttgtgaagctcaaattgggtcgggccgtcaggtttggtgtgagatatagcaaaattatgtgagaggttgtggatcagagaggacttcaagcttcaggtctatcgaggctgtttggatcagaaccagtgtgaagcagaggtaaacttctcgtccggttttttttaccggaaactggtaaaatttaccgttccccgtcctggaaaacgaaaaccggctccggtttcttcatagtattaaacactttttcatgcgaagttgtttaaagacgagtttcagcataacaacaacaacaacaacaacaacaataaagaagtacagttgtttgggaggagctactactataagattgttttcagtagattgtgtaaaataggaaacgtgaaactgtagatgatacagtttgacactatttgtatagataaatttgaaaatagtaaataagatagaagatgagttaggatctgttggagatagccaacggctccatctcctaaataaccttaagccgcatataataaactgtaaagggcgtgtgcgaaaggctggtctgttcgagaccacactgggacatagtaccatacaacactgtctggcatactgtcttgtgcctcaacccggaaaaggatacctgcgctgctgcgcagctgggctgccatgagggtccatggctctggcatgttcgcatgtggaccatgtttagcatgttctctcattctctgtatgtcgactactgtagtggtgtgggtgtgttttagtcatgtatctcctggtgactgttgtcagtgctgggacattgagttcaaccatgtatgcgtatgaacagcttgaacgcgagcctggtttagaccaatacattacatcaatgcaatggctcagtctactcccaaaataacatgtttgattggttttaatccgtaccagtttctactatttttatattgttttgtctctagattacag

SEQ ID NO: 13849 - DNA, 1386 bp, Zea mays
ctgatatttcttcagcaatgcagctgattaagtgtgacattatgaagcctattgaagctgtactaaagtcatctgacgaagaagaactagtatcagtattgcaagtggtagtcaccttaactttcgtttctgatcatgttgctcaaaagatgttgacgaaagatgtgttgaagtcactgaaagcactttgcggacacaagaactctgaggtgcaacgtctatctctgtttgcagttggcaatttggctttctgcttggagactcgtcgcaccctagtccccccccccccccaccccccccttttaatccgcttaactatttcacaagaacgtcgtgtcagcaaagcagctgcacgtgctttggcaatcctaggggagaatgagaacttgcgtcgagcaattagaggaaggccagttgcaaagaagggtctacgcattctatcaatggatggtggtggcatgaagggccttgcaactgttcaaatgcttaaacagatagagcaaggaactgggaaacgcatacatgaaatgtttgatctcatatgtggtacgtccactggtggcatgcttgcaatggctcttgggatcaagcagatgactttggatcagtgtgaagaaatatacacaaaacttggaaaacttgtatttgctgaacctatcccaaaggatgaagctgctacgtggaaggagaagcttgatcaacttttcaaaagttcgtcacaaagttttagagtggttgtacatgggtccaagcacagcgcagatcaattcgagaggttactaaaggaaatgtgtgccgatgaagatggtgaccttctaattgaatctgctgtaaaaggcattccaaaggtttttgctggatcccctttagtcagtgccttgcctgctcaaccgtatatattccgaaactatcagtatcctcctggcacctctggagggatccccaggaatggcagaaagccccttcaatcaagtgcatttgggcctgctgtttctggtgcgccagttggtattaaacgtggtgccttcatggggagctgcaagcatcgtgtgtgggaagcgataagagcatcatctgcagcaccatattatttggatgatttctctgttgatgccaatcgttggcaagatggagctattgtagccaacaatcctacgatctttgccattagagaagcacaacttttgtggccagatacacgaatagattgtctagtttcgataggatgtggctcagttccaactaagagtcgtagaggtggatggcgctacttggacacagggcagtgttgagagtcattgttgtgtatgtaaaaccaaacacttgagcttgtagtaccttattcgatttcttatttaaaaaaaaaaaactagttctagatcgcga

SEQ ID NO: 13850 - DNA, 4103 bp, Zea mays
  misc_feature (781)..(781): n is a, c, g, or t
  misc_feature (1372)..(1372): n is a, c, g, or t
  misc_feature (1380)..(1380): n is a, c, g, or t
  misc_feature (1848)..(1848): n is a, c, g, or t
aatagccccttccttccttttccattttctgaacctgacaaaggttgcttactctcccctttcaggttcttgcttttgcacaacaatcaagagaaaggtctaactatgagcaggctgctcttcttgagaggatgcaagagttcaaacgacaaattgatcgtgaaagtcggtggtcaccaaatggaatgaatgattctcctaacggtgatggaatacaaacaataggtagaagttcacataagatgattgaggaagcaatgcagtcagcttcaaagggcaaggtaaccagatactggaacttattttcttttttcccccttgaactatgcaggagagctgcacatcatttcattaaggtagggggaaaaaggagtacacgagtccagaagggtcaaacctgagttcatgaacaaacacaaacaccacaccccaggaactaggctatattggcgccacaagctacaagaaacacaaccagtgaccacaaggcatgagccaaggtccagcaatctggagttctggacattgagtccttggagcttcgaagcccctgctgaacaccagaggtcaccctccatgctcactgccctaagcaccgcatgagggctcggcctcaatttctcaaacacagaatcatttcagtgcttcaacctcccatgccaccaagattaatgagttgaggcccttactgtcaggacccaagattaataaagatagactagtttgggataagattagaattagagataagattagatctagtgtttaggggtcaagtaancctctctatataaggagagggattgtatcaattggaggtaagagattagaaggaaataccttctctcttgctggccgtggggaaatccctgcggccggcctccccagcgcccctaaccctagccgtcgccctcaaacccctcgcagcccatatagtgaacagcaacgtgggtattacagcactgttcatatggccgtcactatcccctgggtactgttcatcccgtgtgaacagtaccgctcatccccagccaacaactcgacggcacccaagcgtcggggtcctggtcctagaccccgaacctaccactcgtactacctccgtaaccctagatccataacacttaaatgttttttttgggtaaagctctgaatacttttctccaccatccagagaaacgactcactgaaggatcaggtgcttactgcactaagcccaagagctgaaaatcaaagcttagatttggtgagcaaacacagacaaccagaaggtggtggttgtttcctcagcctgatcacataaggggcagacctccgggtgagccagaccctgttttgctaggcggttagccgtccaacaccagttctgaancaccaacnaaatcaaaatttgcaaagcatggtgacccaaattttccaatttcttctccatggacgttctgtttcaacgaagaaggctgaataagcagaattgctgctgtaggtgcctcgcagagtcaacttccgcttatggtcagacacatcttgttgcaaaactataccatcgactaagtctcaaacctgaagatattaaaccaaaatttgtactgtaactctgtaagagccccatttatgtctctgacctatatttatttttggagtgcttgggaaaaactgtggagccccatttatgtgtctgacccatcgtctattttggagtgctggaactctccaaagacaatattcatgcatgcatgattaagtaatttcataaaagaagatgcatgttttatactgaaacgtaaggaactattttcaggttcagaccattcgccaaggctatctatctaagagatcttcaaacttganaggtgattggaaaaggaggttctttgtcctcgacagtcgaggaatgttgtactattatcgcaagcagaacagtagaccatctgtaagcattcacacagcacttcacaatactcgacctgaatttttttttcacacacttaattggtgtttcagttaatattatctcatcatttttgtcccaattttgattttccagagtggatattctaaccaaagaactagcattccctcagaacatggttctgggttgctcagcagatggttctcttctcattatcatggaggcgtgcatgatgagaaatcggttgcacgtcatactgtaaacttgctaacatcgaccattaaagttgatgcagaccaatcagatctgcggttctgcttcagaataatttctcccacaaagaactacacgttgcaggtatgaagcttaaatgcatatgttgatatctgtttctttatacaggatgatgttatatgaagctgttcaatagacatacttgtgatattgatttctgtctagtgatgtgcattggaaattgtgcaggcagagagtgcaatggatcagatggattggattgaaaaaattaccggcgtcattgcttctttgctgagctcccagtctcctgaacgagtaagtgattaatgaacattgaattatttacatatggaccgcgtccttgctgacatccgcattttgtttacagcatcttatatcaagtcctaagggcagcagtcatcatcgaactgccagctcaagcagttcattcagtagctcaacagaacttgaacattcaataagtgaagattgtatgctggaaaagaactcaggaagtggttatttcgagcattctgcaagagttgcacagcatcaccgaacaagcatgatgaaacctgacaagccaattgacttgcttaggaagggggctggcaataattgctgtgctgattgtggtgcttcggagcctgattgggcatccctgaaccttggaattcttttatgcatagagtgttcgggggtacacagaaatatgggtgtgcatatatctaaggtaagatccctgacgcttgatgtcagggtttgggagcaatctgtaatcaacctctttcagtcaataggcaacacttttgccaattctgtctgggaagaaatgttaccttcatcaagctgtgttgaccatggtgatatttcaagggctgatggattagaaaacatgtcgcatggctttgcacccaagaagcctaaacaatctgattctattccagtgaaggagaaatttattcatgccaagtatgctgagaaggatttcgtgcggaaacatagcgtggatgggattcaacttgcagaacagatgtgggacaatgtaagttcgaacaacaagaagggggtgtacagcttgatcgtggggtcaaatgccgacgtaaatttttcctacggccatacatcgttcaattcggctttgactctgggaaaagctctcctcctacaagagcaatcagcctctccatctaacggaagttctagatgttttgaccgcaatccactcgagaagggttgtaccggggattctgtttctcctgccagcacaagcgcccgtatagacggtccggacgattatgttgaagggttatctttgctccatctagcatgccgcgtcgcggacctgggcatggttgagctgctcttgcagtacggcgccaatgtaaaccccacagattcaagagggcggacgccgcttcatcacagcatcatgaaagggcgacatgtgtacgccaagctactgctttccaggggcgctgattctcaagccgcggatagagatggtagaacagcgttacagtatgcaatcgacagcggaaccatagaggacgaagagatccttgttttgctagaggacccaagtagataaatcacgtaggtgtagtagtccaagtctcgagttcctgcggtggtgcattgtggctgccttttgcagtcacctggcacacacaggggccgaggatgccttgctagtattcagtctctgcctttgtggcaagaggaagttatagtttttctaggtctgtctgcggttttggtcgcgcttagggtaaaagtggcctgtttgtcgtggatgcagtttgcaagttgttggtttgcctttgtttgcagatgtcgcagtgtacacttgggaagtggctgccattgttgcgactgatgtacatatagcgatgtctgatacaggttatttatgcaaggttcaaaaaaaaaaaaaaaa

SEQ ID NO: 13851 - DNA, 1226 bp, Zea mays
gcgcgaggcgatgctgcagtctccgcctccattccggcctggtgtccaccctttgtcgcttcttctctgcgctgcgaccatcgtcaccaccagccaccatcaccatccctcctctcggcctcgcggtcgcagcggtcagagcctccgagatggagctccgcctctgcctccgtctccacgcgcgcctcccacctgccacggcgccaccgcctttccaggcggccgcggtgctcccggcctcccgccgccttcggacgggtggtagctacggggttgctcttaggcggcacacgaggcgttcgagtccggcaatctgcgcttcaataaccgacggcgagcagggcgtggctgtgaaggagaggagcgtctcggtgatcctcttgtccggagggcagggaaagagaatgggggcgaatatgccaaagcagtatctacctctactaggactaccaattgcatttttaaaaacattctgtcaactgaaggaagtcaaagaagttgtggtagtgtgtgatccagactacagtgatgtatttgaaggttctattgacaacttgcaaataccccttaaatttgcacgcccgggaaaagagagacaagactctgtttttaatggacttcaggaaattgatggggattcagaactagtttgtgtccatgattctgcaaggcccttagtttcttctgaagatgtaaaaaaggtcttagaagatgctgcagtacatggagcagctgttcttggtgtgcctgtgaaagctacaataaaggaggccaatactaattcttttgtagtgaaaactcttgaccggaaaactctatgggaaatgcaaactccacaggctatgaagcccaatttactcagagatggttttgagctcgttaaacgggatggccttgaagtcactgatgatgtatccattgtagaatatctaaaacaccctgtgtatatcacggaaggctcttatacaaacattaaggtgactacgcctgatgacttgctactagctgagcgcctgatgaatgaggaatagaggtggtaggcaaaattagctctttgcctgattttacagacaagtacgattttgtaggacggcatttatctacacttctacagttttcaaaaaccaaaaataaattatggtgctcatgcacgagatatctgagctctctgtagacattctgtcattctttctatattaatatatcaacgaaaaaaaaaaaaaaaa

SEQ ID NO: 13852 - DNA, 4970 bp, Zea mays
acaatcgtcgaaagcaagaaaaaacaccctgtcctcaccagttcaacgcctcttctccgttcacccggcgtgtgctctgcctctctctctctctcgtgcagcgaccgccgacgcgcttcgccagaccttcgccggcgacgagcactcaccagggcgtgaaaatgtcaacaagctctttgaaagaacccaatgtttctcaatcaaaagacgtggagaatggaaatgacaattctgtgaaatcctgcattagcaagcctgtgttgaatggcaacaaatgtgccaacaaggaacaaaatgttccgtcttgttgccctggcgctgtgacaaatggaaacgaggctggaaatgcagacgtggagtacattgattctgagaatctagtggatctaccagatgttgatgcagctctatgtaccttagttaaaaggttggattcaaaggactgggttatgacatgtgaagctctcaacaatgttcgtcagttggcgatgtatcacaaggaaagattgcaggagctgctggagcctctagttcctcttatcgtgaaatctgtgaagaacccaagaagtgctgtatgcaaaacagcactgatgacttgtgctgacatctttaaggtctatggtgacctactggttgagtctattgatccactgctagtgcagctgtttctaaaggcttcacaagataagcgttttgtctgtgaagctgctgaggcagctcttacatcgatgacaagttggatctccccattactactgttaccaagaatgcagccctacctcaagaacaggaatccgcgggttcgagcaaaagcatcagtgtgtttcagcaagagtgtaccttgcttagatgtgcagggaatcagagaatatggaatggatacagctgcagcttctgtaacccaattcttattgtaaaaggaacttaagataggaatggataagctgaacctagttgacatggtattccagatattttaagtttattttcagatccttcgttctatgttctaaacattgaacagcctgtgtcaaaaagctgaacctagttggcatgttattcatttgatggttgagaatattaagacagatgtgcttttagctgtaggctgtatgttattcatgtttgaactcatactttgatggcatcttcaatagagcaacagtgagattggatacatcaatttgtgcactatagagctacatctacatgcaccaaccagtatttgttgcctagcatttgagggatgcattgttattcttattgtttaacaacaatggtattctctttttgtccaggatgtgcagggaatcagagaatatggaatggataagctcgtccagattgcagcaacccaactcagtgaccagcttcctgaatcaagagaggctgctcgcaacctggcactggaactacaggtattatatgagaagtctcaggcctccacctctgacgaaaatgagggtgaaccttctgtctcacaagatgctgagtcatgggaggctttctgtcagtccaagctttctgccttaagcgcccaagccatccttcgcgtgacctctactactccaaaagagggtgtcgcctctacttcaaatgctacaaaagagggtgtcacggcggccccaaaagaaggtttggatgtggattgctagcatgaggcacacaagcccacaatgagtttgtagatgcgatcagagcgcgattgtccacccccttcggtttttttgatgtacatgcttatggctggtccttggttacatccagttgggaatcggttgattattggttcgggaattcaggtgtgaccgcggtgttaatattggttgggacatatatctgctatagttgattgtataatcattttgttccactacttggtatttgtttcgccaggtgaacgtagaatttgacccacggtcagtgttatatacagtcctctttctgccacatcgggtgcaggttatgttatttttgaaggagatgtcattggcattcgtgcgccacccttatgttgtactctctctccgttttaaatcataagtcgttttgacttttttttaagtatatagcttttgttatgcatctagatataagttgtctataaaaggcctataactttggagggagtagaactttatggtgttcattctggtatttacagcatgtctctgctttcgttgtggtatcgaaatggcaaaccaccagtcttgtgtcgtcgccaacatgttatattccgttgcaggacactgacagtatgaccttggcatcatgccggtgcttgttggtggttgacggcttgacttgacatggttcttacccgtgtatatggcatgagcattttgctgcctgaagtttcgtggattttgatgccggtcggtgcttagccgaaggtttgcttagaagcaagggaggcaaaatctccttgttatttaaaattaaatagcaagaggttttttagcctctccatttcccttactcccaattcccaaacaaaacaagccctaaaagcaatactgcttccggcaaactcgtttgtttaacagagcggggatatacaggtcaagaacagtttgatttgcttcactggacacgttatgtgtctacacccgccaatcggatcatttgaggtcatcgtgcacaacgagtattcaatcgaaatgtttcctaccaagtttgtacttatccgggccaaatctgcaggcgcccagaaataacgaactcccacgcggatccagagcccatcctctgtatttttgcttggtcgttcagggcaccaggccaggccaccagcacatcgtccgtctcgctcgagtctcgacggtgtttgaccattccccggccatgtaggcatgtacgcggaaacggcgccacgggaggcatgcaagaagggattaccggtcgtccgttgactgtgtcgctgtcgtcagtacgagtaaaaaaaaggcgaagctaatacgatcgacgtacgcacgtacgtgtcattgtgtcaaagcggacggacggacgacacgcagtatctacctttgtacatactatagaatgtagcgaatcaccgagccccacgtgcagcatactgtagtgtagggtacaggaggtacaggactactctcctggcatgtgtgtagtgtagacgagttccatcagtaaagccttttcttttttttttcttggatttgatctgcattgcatggtcttgccaccataatgcctttgcggcggtatatccgcggaaagctgacaagcgggcccgacggcgtcgtgaccgtgcatgtagtacccggaagcggaacacacacctcttgctccgcctggacagtggataactggataccgtaccggagacggctatcgcctgagctagcttttggatctgggaggcgcagagaacatgcaaggcacgcgttacatgcgagcagagctaacgctagatagatcagatgtacgtgcgatgctccacccaacagaaacagaccttgctgccacaaatctgttcgtctatccggagttccggactgtggtgtgtggtggtgcccggactgccacactactagtaactggcggcctagcatgaccaccataacgcgtgataatccaaagattttttttaatgggtgtggtgacggtgattgggtcagaaagagggcccgaaaagttgcaggccctctttcccttcgttccagcatggatagtaggcggcgttgccccgcgcccagcggtggtgctggtgggctggggttgtcgaccccagcgccggaggagaggagaggagaggagaggaggtgggggtccaaagaatttgaacgcgacacgtcctgggctcctggcccagccatgcgccgccagtcgactccggactccatctcccctctcgatccgaccgtccattgggtagccccccaagaaaagcaccacgaccggatcaaatacccgccacgggcgcccttcttcgcaggctttgccagctgctgtgctacccgcagtgtacgtaacgtacgtactactcgggaaatggatcgggacaggcactggacgataacggcgtcgaacattcaacggcacacagtgtcgtcaggtaatggaaaaagctgataatgaactagtagcactaagcacgccaactgtacaaaccacaaatagacgcagcaacctgaggcggggaaacgaacgaggggtgaagaaaaagctcctaggctagggcatacgacatgagccaaggcgcacctacccagctcgatggactggactagagccccgagctgtgaattctcgccacgacgtacgccaggtggtttggacttggagcttgcattgggaactcaggcagcgccgcgccggctagctggtgaatgaatgacccggtgtgctcgtggtccgtggagctagtcgtccggcactcggtacgcgtcggcggtgatctcggtcagccacagccccgggaacagcgactgcacaagggaaaacgaacagtttattattcttgcacacaacaatcatgtccggtccgatagaatatgcattcgtattactacctagtggcaactggcaagcaagcttaaacggaaccgtatcgagcggataaacacacagagtcacagagacacagacagtcgtaaaataggagccggattgaataataaactagtaattaattaactagagcggtttggaccgggagggcagttcggggagaaatcgccttacatcgacgtgccgctgcacggcgcgcggccgcttccggggccgccgccgcggccgggcgcccgtcagcgcgtagatgtcctcctcgatctcctccgccgccagaggcacggagaagggagcgcgcctgcgccgcttacgcgacgacgggggcggtgccggcggggacggcgacgcggcccacgacctggcggcggcgggccgcctcggcgtgcgctcccgcaggttccacggcctcgtggcagcgtccggctgcgggggcgcagcag

SEQ ID NO: 13853 - DNA, 1642 bp, Zea mays
actcccctccgagttctccgattttaaaactcccccaactgacggccacctcgaacggaaggggatcccccttaattatgagacaattattgctgaaattatttttttcggaatccaatcaggtagtagtatttgtgtgattgtgtccaggccctatacataagccgccatttgcagtccggacgcagccccgttcagtcccagcccaggccgacgacggcagagagcgagccgccgccgccgcgcaccctcgtgccaggttacacggtgtgaaaatgtcaggaagggctttgaaagatctcaatgtttctcagtcagcagacctggagaacggaaaagacaattctgtgaaatcctgcatcaccaagcctgtgttgaatggcaacaaatgtgccaacaaggaagaaaaggctccgtctgcttgccacgacgctgtgactaatggaaatgcggctgccattgcagatgtggagtacattgattctgaaaatctagtagatctcccagatgtcgatgcagctctaagtaccttagctaaaagattggattcaaaggactgggttatgacatgtgaagctctcaacaatgttcgtcagttggcaatgtatcacaaggaacgattgcaggagcttctggagcctctagtccctcttatcgtgaaatctgtgaagaacccaagaagtgctgtatgcaaaactgcactaatgacttgtgctgacatctttaaggcctatggtgacttaatggttcactcaatcgatccactgctagtacaactgtttctgaaggcttcacaagataagcgttttgtctgtgaagctgcagaggcagctcttatatcgatgacaagttggatctcccctttactactcttgccaagaatgctgccttacctcaagaacaagaatccacggatccgagcaaaagcatcagtgtgtttcagcaagagtgtaccacgccttgatgtggtgggaatcaaagaatatggtatggataagctcatccagattgcggcaacccaacttagcgaccagcttcctgaatcaagggaggctgctcgcaacctggcactggaactgcaagcattctatgagaagtctcaggcctcaacttctgacgaacacgaggtcgaggcctctgcctcgccagatgctgaatcatgggaggctttctgccagtccaagctctccgcattaagtgcccaagccattcttcgtgtgacctctactactacaaaagagtgcgtcacctctgccccaaaagaagggttggctgtgggttgctagcacaagccacaggggagatattgcgatttttcaccctgttcgctgttttgctgtacatgcttttggtttgtcctgcggtgcacccagtcgtgaaaaggttaatcattggttcaggagttcaggtgtgaccacggtgttaatattggtgtgggatatatatccattatagttggttgtacaatcatttggttccactacttggtattggagtgtagattttttttcccatggttcagtgttatacacaacagtccttattttttgtttttgatgctggtcctgttattttgaaggaaatgacatattttgtgtttcggaccaaaaaaaaaaaaaaaaccaaaaaaaaaaaaaaagaa

SEQ ID NO: 13854 - DNA, 1440 bp, Zea mays
  misc_feature (2)..(2): n is a, c, g, or t
  misc_feature (730)..(730): n is a, c, g, or t
anttaaccctcactaaagggaacaaaagctggagctccaccgcggtggcggccgctctagaactagtggatcccccgggctgcaggaattcgcacgagaccattacctagaacatcctaatcgaaaagaggtaacccaaagaacagagagaaattactgaagcatgagcgcggagctgaagagggactacgagatcggcgaggagatcgggcgcggccgcttcggggtggtccaccgctgcacgtcccgcgccaccggggaggccttcgccgtgaagtccgtggaccggtcgcggctgggcgacgacctggaccgcgagctcgcgcagctggagccgaagctggcgcagctcgccggcgcgggcaacccgggcgtggtgcaggtgcacgcggcgtacgaggacgaggcgtggacgcacgtggtcatggacctgtgcccgggcccggacctgctggagtgggtgggccgccgccgcggcgcgcccgtgccggagcccgtggcggccgccatcgtcgcgcaggtcgcgcaggcgctcgcgctctgccaccgccgcggcgtcgcccaccgcgacgtgaagcccgagaacatcctcatcgacgccgacgacgacgccgggagcgacgaggaggaccaggccgaggcggcgccgcgcgcgcgcctggcggacttcgggtcggcggcgtgggtgggcgccggtgggctcgggcgcgccgagggccttgtggggacngccccactacgtggcgcccgaggtggtggccggcggcgagtacggcgccaaggcggacgtgtggagcgccggcgtggtgatgtacgcgctgctctccggcggcgcgctccccttcggcggcgacagcgccgcggaggtgctggcggccgtgctgcgcggcagcgcgcgcttcccgcccaggctcttcggcggggtgtcgcccgccgccaaggacctgatgcggcgcatgatctgccgcgacgagtggaggaggttcgccgccgagcaagtcctcgctcacccgtggatcgtgagtggcggaggagcccgggcaatggagcggccaacctgaggaggaatccagacggacgtgtattgccgtagagcactcaggcacggcaagcaatcccggacgttatgtatgaggtttttgtacgtacgtacgtagtagtgtacggtagctgctgccagctgcagagcagatcgatcggcaaaagaagctttgtaggcttgtggttttcctttgccccccgggtttttggggacgctctttacctagcggagcagagagcacccgttttccgatgtgctggttttcctagctggatgtacatacactgaccgtcttttgtacagatggagtgtgctgttggatacataaataaaaaaaaaccaagcctttgtactcaaaaaaaaaaaaaaaaaaaaaaactcgagggggggcccggtac

SEQ ID NO: 13855 - DNA, 2613 bp, Zea mays
tttgtcttgttcgattgcgtctggatcgaaaggaaatgagggagattaaagtcctctatattcaattttgactatattcaattttgacttgagaaagattcaatccctccaatccccttccatctaggcataaccgaacaagcccttaggactggtttggtgaccagggatctcaagggggaccgcgagggaggaatcccctgttatttaaatctgaatatcaagatatttatttctcatggatttcctccaattcacttatcattataccagctctaagagtatatttaggagcgaaaagattgaaggggctaaatctctatgctattcaactaaacaagctctaagagggtgtctggtttcaggtactaaaatttagtatgtgtcacatcaaatatttaaatggctattatgagcgttaaatataatttagttatgaaaataattatatagctgaagactaaatggacataaaattttattaagtctaactaatgcatttttaacaaatatttattgtatcatcatatgatttgatcttgaattaattagatttaatagatttgtcttattgtttagtcattattagttttataattagactatatttaatatttttctaattagcatcaaaacattcaataggacaaaaactaaagttcaataagagtaaacacaaatggagcctaagcatgtttcgaacctccgatagtcagatcatcttttggtcgttttcgggtctagcaactgtttagtttgttgaattatatagagaactatgaatgaaatgattataaactataattaccagactatttgaagaattattgtgatggattgttcttctttcaagtgataaatcataatcaccaaaaagcaggttggacataaattatgaaactattatagtcgagtgttttaattatagagtccacatcctgaaattagtttgtttagttcataattaaatccttttaagtaattattataacgacggtttcaacattcatgtttgtcactgctgctgtgcacgttcatgttaactaaaacatcttgcagtatgtaaaaaaaaacgttagctaagatttcttccattttagaatggagagacaggcaataaggacagtacaaggatagaaatctaaaacgaattttgttgagaaaaaaaaggtctaaaataaatccaagtagaagcaaacacaatatgcttttttttttttttttgatactaaaacgagtgtatagtctcgcattaatttattaaactagaattatccagctcccagtgcaataagcctatgataagcagaacattttacatatacatcaagcttttacagaacttgtgatctttatctgatcatttaacgatctgtgggttatcagaagcgataaccctcagttgtttcagatggaggatggatgtgcaccaccagtttacagccctgtatacttcacccaataaccgatcactctgaaagaatgaactatctgtggctccttgatgagcccagcatgtttgttgtttaggttcccttaggttaaacgctaaatcttcatgatggaatgtggttgctggaactccaagacagcaatgttttctacatagttctttacctcagccaccattctgttgtacgattcagggtatttgcaaaggttcacaattttgattcagctcccttgctagtgcctgcaacgtcaacatgatcctttacaaatgttcgaaggcatccattgattacccgaggggcaccaccatcacaaaatcgctttgccagatctactgcctcattaatcacaactttgtgaggtgttccttttgatgtcatctctgccatagcaatatgtagaatgcagagctcgagtatccttgccacaggctcatccttccaagcctgggggattattttgtcgatgatctctacatgcttatcccatccactggcaacagccactaaaagttccctggacaaccgtaagacaaagttgttgtaaaccagttttggaggagctgaaagtacatctgcttcgttggctgaatccttctcgttctgactggtcagcttctcagcctcctcctccgttccaacctcgagcggtcccccgccaaagctcatatggttgtaactcagtaggcatgccttgtcgaaaacaaacccgggctctcgtcttgcgctgatcctgcggtcgaagagccgaacgacgtcggttccctccagacacgcggcgtaggaaatcatcagcgctagctcccgggcggcgcgagggctgcagaagcggccggagcggtcgaccttggcgtgcgcgggtgcgggcgtccccgaggccgcgggcggtggcggactggagaccaccagcgccgcgcaggtggaagcgacggcgcggggcaggggcggcgcggcgagcgcccgggcgcgccgcgaggccgggcccgcgagcagaaggcagtgtctaggccccgcggagaagaacgatgagggggggaaggtgcggacggatggtgccgcttccatttcgcccggcgcgtgcccgccggcggaaggaccggaggagtggagagcgggcagcgattgaactcgaaatggagcggacaaggaagatggggatagc

SEQ ID NO: 13856 - DNA, 3004 bp, Zea mays
agccgaagctgaaaaataagccctaccaaaggggccctaagtagtccaaatggttcaagatctaaaaagcgacgaattcctactatcgtgacgacttgaccgattttatgttcatattgattttaaatggtttttattaaattaatttttataaaagctgactaaaaagatgaaacgtttgacggtctatatcagcctgcaaaaagcccaaacaaatatgggcattgacatatggcgcgagcggagaatgcctccatgaaccttccttggtgaggcagtcaccctaccctaccctaggtcctaggagggtatgataagcatctggtgacggcgagttaagagcagttcaaacttcaaagcaaaggtaaaacagaacacctggtcttacgcctgccagcaacaaactcgatggaaagatcggaaaaaagacacgcaggcctggctcccggccaaaactgccctgctatcccgtcttccagacgtagagaaaaagcaggggggctgcaacggaaacaaaaactaatctaatcgtactgtccagaacggaaactgccctcgcttcgcttcctcctgttcttctctcccctcctgctactgccgcccggctccgctccgctcccctcccgaaccccgttccacctccacccgccgctcccgtcccgtcccgtccatacccgcgccgctctcgactcgctcctcgacctcaaggctacctacctcgacgggccccgcaccgtacccgcccgctagctcccgcggctgcagcagcaggacgagctcgccgccgccgtgcactagaagaagaggtcgctgtcggtcgccccgcccaatcctggttcctggacctgcgccgcgtcgtttcgcctcaggttccagtgtctcgatttgccaggataacttgtataattgaagctttcctttgtacgatgatgggggcatgccatggaccagaactgagggggctagggtttgctatgtggtagtagctcctgcttcaggtggcgtcagctgttctgggtggggtaatatgatgaaacagatatttggacggcgcaaggcgtccaaaaccgcagacaaggagttcactggtgggaggacgttcagccagctgtcggggtctggagttgctgacctgagtggccaaccgccaattctgtcgagtactgggcacgcctatgggagtggaaaccgtacggggttccaagactcgaggataaatgataatttgttttcttccaacttccgtccgttgccgagcctttaaggatgtgccgaatacagagaaacagaatctgctcatcaaaaagttggacgtttgttgcgctctgtttgactttacggatgcgtctaagaacatgaaggagaaggaaataaagacgctgatgttgttggagatagatgagtatgtaaggactgctaacgtgaagttccctgagatcgttgtggaggcaatcacaaaaatgatttcggtgaacttgttcaggacactaatttccccacccagggagaagaaggcgcttcaagcttttgatctagaagaggacgaaccgttgatggaccctgcgtggccacacttgtaccatgtgtatgagttgctcctgacatttgttcagtctccagaaaatgatgctaaacccgcgaagaggtacattgaccattcctttattctgaggctgcttgacctctttgactcggaggacgctagggagagggatcgccttaagatggtgcttcaccgtatctatgggaagttcatggtgtatcggccatttatccggaaagctatcaataacatattctaccagttcatatatgaaacagaaaagcacaatggaattgcagagctcttggagatttttggaagtatcatcaatgggtttgctttgccactcaaggaagagcacaaactgttccttgtaaggaccttaattccacttcacaagccaaggtgcactacaatgtaccatcaacagttgtcttactgcattacacagtttgttgaaaaagattgcaagcttgcggattctgttattaggggcctcataaaatattggcctatcaccaacagcacaaaggaggtactgttcttgggtgagttggaagaggtactagatgcaacacaacctggcgagtttcaaaaatgtatggttcctctttctcaccagatcgctcgctgctcgaacagccctcacttccaggttgctgagagagtattgtttttctggaacaatactcacttcgagaatcttgttaagcaaaacagtaaggtgatcctgcctatcgtcttccctgcattggagaaaaatataaatgggcactggaatcaagtcgtgcgaagcctcagcctgaatgtccgaaagctattctccgatcgtgacccccaaatgttcaatgaatgcttgcggggttatgaggaagacaaagacagagagaaggaatttagactgaagcaagagttggcatggaaacgtctagatgagattgcatcagcaaaagtcacaagtggtgaggctgtcctggtgtctccaaccttgcatcgtcaaccttcagtcttgtaggaacctgcgctacatgagtggtccttgcagagtcgttagacattgtacaggattgggttgtagataaaagcgggtatatgaagccaccaaggcaggtgtgcgaaatcgaggaaagagagatgaggagccagtagtgcatcatttctgtaaatcccgtgccatggcttcttttggcatcatggtggttcactttgctgctgtagtccgttgtttgggagaatgaatgtttttttttcttcttataatggaaaatgtcgagatggcgtgcagtcagcttaaatgataaaagttataagcttttcctttcgcatatagttttgatccaatttgtcatggttgtgaatgcaagcgaatcataccaaatccctgagaatgctggcccccggtggtcacatgtgtggggattttttattttatccccagggaaaaatattttaattttcatc

SEQ ID NO: 13857 - DNA, 1929 bp, Zea mays
tgagataaatgtctttatgttgcggttggactgaatacatagtaggaagctactgaagttgactctgctgtttcatagctgatggcaggttcttctgctgcccctcaaactctgtaatgatttctgttgtaatctagttttgaaaacaacagcatctcggtaccccttgatggcaggttacacctgtttgaagtgccacatattcgtgtctagctggtttcaagctagtggacaagacacatgaagtatctgaactattacaggtagcagcttgctagtaggctgcctgaaatatgttcatatcaacacatttcatgcaatcagttgagatgatacatggtgacgttgaccaattctgcataaatgaatccacttggagcaaccgaggcataatagtttatcctccatttctttcaccttggaattgggactgattccgagctgatggtagactgctggttttattgtgtacttagagtagctgtttagaagtgatctatgtgttagagtggacgcaataaccagttcaacccaaaaacttaagctgatgggagaaggtagtcaatccactattccacttatacacttcaacaccctcactcacgtgcagccagagagaaaggcgtaaatatggaaataaataagtggagacacaaataaagtctctgccaggattcaaactcgagacctctggcggctttgtaactatgttagagtagacgcactaaccagttgaaccaaaagcttaaactgatgggagaaactagtcaatccacttatacactttaacaccctcactcacgtgcaccaggattcaaacttgagatctctagctttgatacctagagtggatgcattaactagtttaacctaaaatcttaaactgatgaagaatatagtctatccacttataaactccaacaataatcatgttcctagctagattcaaccatctaaggagccatggaatgatgtttgtttcctatcagatttttaaattagccacacaagtgaactaggttaagcactgaagctattctaatttctaactacagcactttgcttccttcttattttataaaattagagtatggtaagtgcagattcttagcaactctagttagggatggtaatgggctctaggttttatactataaagtttaaggataggattaggattgggctctatttctattcatttttgaactaaaaattattaatggcttaatcgaattgtgaagagattgtgatctattaccaccccctaagtctagtagatcttatgttcctatgtgcagacaatcttgtatcacaggattcagttcattcttttgcaccaaattgtaggctctcccttctgatgtccgacaagcattgctggaggtggtcaggtgctgtaggagacgagactacttggctgcagtggacaactatatcaagctagcgataggtaactcgccctggccaattggtgtgaccatggttggtattcatgagcgatcggctcgcgaaaagatctacacgaacagcgtggctcacatcatgaatgatgagacgaccagaaagtacctgcagtctgtgaagaggctcataacattctgccagagaaagtaccccactgatccatcaaggtcggtagagttcaacagcctggcaaatggtagcgatctgcagtctctcctggcgcagcaaaacgcgaagaattcagaagaaacgcttcggttagtggcagcgtcatgaaaggttggattatatctgtcctcggaattctaggcaagttcgattcttgtgtgatttatttgtgatacgaattagtacttgtaagaacctgaattgtatgttcggtcgttactcgttactgccttactgaaccgtggaacaggaacctaatttaactggagcatactgataccctttggggacattgct

SEQ ID NO: 13858 - DNA, 5325 bp, Zea mays
tgggtgttggtataaagttgagatgtagagtaaacatgagcgcagagaattgttgtatagagtagagaatattgctgattaggacggaatattctttttagagtggatttttagagttgaatgagtgcggatagcctgattgcgcgaggcgacgagggtatggccagacggcgggatgaggaaggttcggaaagaaaggagctggccagccgacgtgaaccaccgagctgacgggtcggacgggcgcggggtgtgaagccgcacccgcgcgtacacaccaccgcggatgatggatcacccgtcagcgccaccgactaggctaacctatgttcgtttattataaaattcgtatatttttatataaatttagttaagttttaaaagatttaactcttccggagacacgcggtggatcctgatgacacgtcagcaaggactagtacgttcttaaagaacgtcgcgtaccgacgaaatcgaattagaaatcggctaagctaatattgatcctattatttacagttacactcccaaaacttttcagaaagacccatcagggaggagtaggtgatggacaataagatagagataaacaaagagataaaagaatattagatgtattttgatcgacaattgaccgcgatcctctcatatatacaagacttcattaaaggttatcttcttgtccaacggaatgatggatcccttcatagttcatagggactcaactcaaaagagaacccatagcaccaaaccagggtcatatgatcgtgagtcagtgaaaccagcccatttagtatatttgcatcctctgaatcatcaccactgtaatcttcactttgtgtgtagattttttttttttttttgaaatagaagctgtagtatctcaaatgttcttctaaagctggtttacatcaagtcctgtgttgccaaaagtttcagggactgggtaaaataaagcatcatgacaataatgttcaaaataagtgtactctaattgcagaacttcagagcagaatgctccagcatgaaagcattcatgacctgccaacataatctgctgattgcttttgtttggaggagatatccttgaatgctgtgcaagccactgcatcaggagaacccacattcaagaaattaattgtccatcaactctgttctgctactttaccttcctgaaaactgagaagatgcaatagtcctcatatgctcagaagtcagaactgtcccactgctgactaaccatcacaataaattcaagtagtaagttccaacatcagcaaatccaagatctcataaatttccaatgataaaggatgcttctctttccaagaaaagaaggcatggtattgtccccttaattgcaaccagctgcacccagcatctttcttaaggctagccccttgcatcagtatcctcgtctcagcagcatctttccatttaccacaagatgcatacatgtttgagagtagcacatagcctgctgtattatccttttccaactcatgaagtttctttgctgccctctcaccaatctccttgttcctgtaagtgctgcaagcactcagaagagatgaccatgaacttgtgtctaattcacttgaaaccttcatgagaagctcttcagcttctggcaaacagccagctctagctaggacatcaaccatgcaagtgtagtgtttacttttaggtgggatgccatgtgcctgcattgtttcaaaataatgtatggcttgctccaccaaaccacagtgggaacaagcaaatagaatagctagaaatgtatgttcgtttggtgctattccattttctatcatatcctcaaacaacgaaatagactcttcagcaaagccattttctgcaagtccctgaaccatggcagtccatgtgatattatttttctcaggcatttgatagaacaccctcctggagctgtccaaatcccctgacttggcatacatgtcactgagagcagtccccataaagatgttatcttcgattccaagcttgacaatctcagcatgaaccatcctgcccatctctaaagagcacaagtttgcacatgcaagcaggacacttgacaaggtgatttcccctggaatatgtcctgaagccaacattgcataaaaataatttagtgcatcaccaaatcgtcgattttctgcatagccagaaatcattgtattccatgaaactgaattccttgcaggcatcttattgaagagcccctctgcttccaccatttttccattccagctataacctgaaataagagagttccagcatactgtgttcttttctgggagggaattaaaaactctttgagcatacgtgcattgcttgcatttgcagtacatgtcaatcaaagagctggatacaaacaaattggtactagagcccatcttcagtgcattggcatgtattcttgttcctccccttaagtcttgaagggtagcacaagcactgagcacactagagaagcatgaaatgtttggcctgcaaccatcagcaagcatctggctgtaaagcttcaatgcttctgcagtatcacctttctgctcatgccttgcaatcaatgtaccccaggagacctcgttcctcgcaggcattgcatcaagaacccgtcgtgctccataaaggtcacccaagtcagcatacacatcaagtaatgcagtccatgaaacaacatctctcacctccatgtcatcaaacaccctgtgtgccgcagctgcatctcccattcttagatacagagtgatcaaagaattgtgtacctcgatactcttttcaaacaagttgcatttgactgccaatcccacaacacccatggcaagatcaaattcaccagcaccaacacaggccttgatgacacaaatcagagtaaccacattaggtctcacactgcaggttagcatctttcgaaaaacagggaaggcatccttatggagttcattgcggacaaacccagaaatcatggctgtgaagaaggcaaccgagtggagtgggcatcgttcatacagctcaaccgcatcccttacagacccacgcttcatgagcgcgtcgaccatggttgtgtacgacacgacactcttctcgggcattccgtagaacagcctgcgggcggaggcaatgtccccggccttcacgtgttctgacaccatgaagtcgtaagtgaaggacgatgccgcatcggcggcaacgcagtctcggaaggcctggtcacggtccgcggcgcgcgtgaaggcggcgtaggctgtgagcaggttcgatgcgacggagcggtcggcggtgaggccagagcggaaggcatgcgcgtgtagggagaggacaagcggcaggcaaccggaggagggcgcgtaagagggcatggtggtggaggtggcgctcatagcgcggcagaggcggaggagagaggcacaggtctcagagtacgtcttgaagtccttcgccgtggacgccagcggtggaccgttagccaggcggagcttgaacgcctttatcgggagggttaagggagaggggtcttcctccggtttactccttgtcgtcggcgaaatcggcgccttggccagctccggcgatgggcgtggcggccgtggccgcctcgtgcggaccgctctcatgcttccatgattcgaacttttgaacttcgaaaaacttcgctgttcccatctatcgctctctcaagtcatgcgcgatagtgggatgctcagttgggctggctgggccaatcggcagaatctgccctgacacaaacttaatctgggcctaattctgtcagcccaaaatacggttagccaccgttcagccagaaaaacaaccttccgcagttccgctccaattgcgtccccgggaatccggaaggttcgcgcgagagctcgagctccccgtctctgcaccagacaccagtgcaccaccaaatccgagccgaatcttctcgaccccgctcctcccccgccctccgacccagcgccattttcacgatcctaaggtccttgcccgaccaaacgacccgtgacctccgccacagctgctgcaggcctgcccgatggacgtgctgaaggcatgcctgcagcgcaagcgccagctcctcaacgccgatttcggcggccgcaagatcatccgccgcgccgaaatcgaggcacgcgagctccagcgcatccgcgaggtcgagcgccagctcctcctccaaaagcagcacaggcattcccgcccgctgtcctccccctccagttcctcctcaagctcctcgcccacctccgcagccgctgacgccgacgccgacgcgtcgcgggcagagagcggctccaaggagtcgctcccgagggaggaggtcatccggcgcctgcgcgtgctgcggcagccggccacgctcttcggcgaggatgacatcgcgcgcctccgccgcctccaggtcctgatcgaggactccggcgcgctcgccgacatcgacgcggcggagatcggggagggccagaccaacgacttcctccgcgacatccaggcgatgcgtgctaaagctgcgactgtcacgaagcccaaggcggccggcgcggaggccgagcgtggggagggcgacagcgtatcgatagatgtgccgttcgaggagctctgcgacgaggacaagatcactgcgttcttcaggagactgttggacgagtggacccaggaggtggacggtatgcctgaggcggaacggaggacggcaaaagggaaggccgcgatagccacctgcaagcagtgcacgcgatacctcgaccctctgttcaagcagtgcaagaagaaggtatggagcatcaagtgtctcagtagtatcagtttgaatgacctaatgcttattgcgaacgtttggctggatgagttcataggtttgtcaacccgtctgatagcatgctttaatttgaacttttaatacggttttgcttaatttgtttacaccattgaatatctattatctactgcttagtgataaaggaagtgtaggaagcgtgaatattatatttgtcactagcggattgcgtgtgatatagtgaaggaatgatgatacaagttgttgttaatacttacatttaaattgatcttatcttttgtaaaaaatggatgctgtctacactctatctacgccttacccaatgaattggtgatgcagtttctgataaatatttgttcaaatctgtatctgaactatttcttctattggctgaagattcttacagcatcaagtaatccatttaaggaatacaaccatacagcgaagacaacagagatatggtgtatgctgtttctaaccgtatgggttctaatattattgatttgtcttctgagatg

SEQ ID NO: 13859 - DNA, 840 bp, Zea mays
  misc_feature (740)..(740): n is a, c, g, or t
  misc_feature (766)..(766): n is a, c, g, or t
  misc_feature (812)..(812): n is a, c, g, or t
  misc_feature (824)..(824): n is a, c, g, or t
  misc_feature (834)..(834): n is a, c, g, or t
tcgcgatctgcacggcgacgagatctcgcgcacaagagcccaagcgccataaacgcctccttcctcgtctgcccttgatggagctccggccgtttcaaaaacccctatcccccgccccgcgccacgcggctgcgtctgcgcatcctcggcccttggcccgcgtcgccttgcgccggacgccgcgctgcttctgatttccgaccgctcctactgggggtcggccggattccgcatgtccttgtcgtgcaggagggtgcggtttcctggtgcggatgtgagggaagccgggaggagcagggaaggaatgcagaggtcgcggaaggcccttctgcggaggacggcggcggcgcaggtgcagagcgcagtggcggaggctgccggtaacgggaggaagaggcgtctgtacggcttctccgtctccctcgtcgtcaccttgtgggtcgccgtgctcctgctccactccctggtcgggcacggcgatggtcaacgagatggaggcggttctgctgtcgatattacttttatcgagcctgccttgaatggtggtcctgttaattcggctgtacaggaagtgcatggagagaatttggcagtgccgggtgatacctgtgtcggatctgtcgaaaatgctgtgcttccagaaggacacgctggtgcaagcagctcagttgtgctccaatgatgaggcaccgagtgagaacaccagaagctctaacaaaaacaatcaagttaactttcangggatcagtgtgggtttcttcctccnccaaatttgatctggaattcaaccaaggggaaaaggttggaaaatnaaaaatttgccnaaaccccaanaatatc

SEQ ID NO: 13860 - DNA, 1060 bp, Zea mays
cccacgcgtccgcttgtgtgcgcgtgagatgttgactcaagaagatggatcagctgacttaatccgtgccctgaacaatgggcccctcgcgcccgcccggcatatcagagactactattggcttgacatgcaaaaattgaatgagatatatcgatataaaacagaagaatattcttatgatgctgtcaacaagttcaacatttaccctgatcagatttctccatggcttgttgagtggatacctcctaagggtggttactttattggaaacctccagccagctcatatggacttccgattcttttcactgggaaatttatggtcaatagtaagcagcttggcaacaactcatcagtcgcatgccattttagaccttattgagtctaaatggtctgatttagttgcagagatgccactaaagatatgctatcctgctcttgaaaaccaggaatggaaaatcatcactgggagtgaccctaaaaacacgccttggtcataccacaatggaggatcctggccaacattactgtggcagctcacagtggcatgcatcaagatgaacagaccagaacttgctgccaaagctatagaagtagctgagaggcgaatcgctactgacaaatggccggagtactacgacaccaagagagcacgattcattgggaaacagtcgcggctgtaccaaacgtggtctattgctgggttcctagtagccaagctactaatagaaaagccagacgctgctaggattctgtggaacgatgaggatgctgaaatccttaatgcttcgagcacaaacagaaaacgtggcaagaaagtgttgaagaaaacatacatcgtgtgagttctcgcagcaagttcgattaaattcctcagttagcatttttaagttgtaatataggaagtgttgtccctgtatataaacttaaatgaggttgcatttttgctggggagggtgcatgctgtcggaattggatgctgttattgtcgatgcatctggctttgcaacgaatcatagacctgcctggtagcttccctatacactttatccggcatgaca

SEQ ID NO: 13861 - DNA, 1866 bp, Zea mays
cccttccctcccctcccctccctctccgaaagctggaggggaaggagatccattgcttccgatggctgcctgccgtctctgacctccgacctctgcctccagcctccagccatctcccgccctacctgaaagcaactcctgatcggattcaggctaggtcctcacagcacagccctcctctgagactcaggtacttagtctcgctccctccaccccgccccgagctcctctgttccctgcccccgggctggcttcctccccttcctggtctgcttctcctcaccgttgacgaatcacgaggcctgcctgcctgcctgctttctctgtgctccgttcgaatggacgggcagaggagtcgatgagcggccgtgggctttgatttcccctggggtctgctcttcttggtcagcaaggagacctgaacacgaattgatctctgcgccgctgcaaccccggcccgtcgaagccatggggtccggggactggttcaagacgatcatcagcaagaaaaaatcgaagcggggaaagtcaaagcacgcaaagctctctggccaagtaacaaatggaggcaaccagacaaatcagaagttagacggcccttcttcaagtagtgaggaccacgaagacaatgcagcactagaggaatgggctgctactcgcattcagaatgcgtttcggaaatacaaggcaaggaagaccctgcgttgtctcaagggagtcaaaagattgcgcgttgtgggtcaggcgaatccggttaagaagcagactgctgccacgctgagttacatacagtcttggaacaagttgcagtcggagataagaaaccgacgtgctttcatggtcaccgaaggacgcaacaggaagaagaagcaggagaaccaaatgaaacttgaggcaaaactgcataatttgcagattgaatggaatggaggctcggatactatggatgaaattcttgctaggatacaacaacgggaagaagcagcagtaaagcgtgagcgagccatggcgtacgcgttcaaccatcagtggagagcaaggtctgccacaagtctaggaaacttcagctatgaagtcggtaagggtggctggggctggagctggatggaccgctggatcgcagcacgaccatgggagccgcgatccatggtccaccctgagaacccgaagaaagcacaggcaaagaaggagaacaccacaaacccatcagctctcaagctgcaaggctccattaccctaagcaacaatatcaatgaccggaaaaccctgaaaaagaagccattgccttcagcttctcctgctgatcagaagaagccatcaccgtcgccttcttccgatcagaagaaaccagtaccgaaggagcagagagcaaaggcagctggcactcctccaaaaccaaaggccaaagatatgaaggggagtcaagagaaaaagccacaaccacaacagaaagtgcctcctccggttagcgcatgaagcttcctgctgcgaaaatggttactgatcatgtaagatacatcttgtgaagttatctcatgttcaacactcatgcttgtatgtttttgttttttgttttatggtgttatgggacgaggggtgcccaatctagaatgtgcttggtttgagcgattgcgcacgcacaacatatctgatgagaattgtttttggttaggattaggatctctgttattcattgttgtgatgctgtaataagacttgccttgcctggctatctgcttgaatggaaggtcttgttggaacaacatgtaagttcgttttctgtccataactttaggatcaaatgacaaatcgtcatatgtaaactgtttattacatccagattagccctaaattcaaatttgatgc

SEQ ID NO: 13862 - DNA, 2656 bp, Zea mays
tgagcgagccatggcgtacgcgttcaaccatcaggtttatacttactaattcggatgttgtaactcatatcgttgtagaattccactaagattcaaattataaataaaattcaagttttcatttaaaatctgcacacatgacttaactctaaaaccaatcataatttgttcaagagaatagcagcattgtgagtgcacctaacagaacgatgtactttaccatttggcagtggagagcaaggtctgccacaagtctaggaaacttcagctatgaagtcggtaagggtggctggggctggagctggatggaccgctggatcgcagcacgaccatgggagccgcgatccatggtccaccctgagaacccgaagaaagcacaggcaaagaaggagaacaccacaaacccatcagctctcaagctgcaaggctccattaccctaagcaacaatatcaatgaccggaaaaccctgaaaaagaagccattgccttcagcttctcctgctgatcagaagaagccatcaccgtcgccttcttccgatcagaagaaaccagtaccgaaggagcagagagcaaaggcagctggcactcctccaaaaccaaaggccaaagatatgaaggggagtcaagagaaaaagccacaaccacaacagaaagtgcctcctccggttagcgcatgaagcttcctgctgcgaaaatggttactgatcatgtaagatacatcttgtgaagttatctcatgttcaacactcatgcttgtatgtttttgttttttgttttatggtgttatgggacgaggggtgcccaatctagaatgtgcttggtttgagcgattgcgcacgcacaacatatctgatgagaattgtttttggttaggattaggatctctgttattcattgttgtgatgctgtaataagacttgccttgcctggctatctgcttgaatggaaagtcttgttggaacaaaaaaaaaaaaaaaagcctgcccataactttaggatcaaatgacaaatcgtcatatgtaaactgtttattacatccagattaggattaaattcaaatttgatgcagataactctgtttcccgtatctctaacaagttcacagctttcccgccgaaccctgctgctgcggttgcaacagcagctcctgaatttcctctctgaaaccagccagcgacgtgcgctgcagcgcgatgaacaccttgaacccttcccgccggcgctcatccctggcgccgtagggtatcaggaagcacggctctgtgctcccgaggatcctccacgagagcggcagcacggactcggggccgccccacccgaaatccacctccccgtgtccgagccgccgccagtccgtgaacgcgctcacggcgcccgccgtgatcccatcgtgccggtgcacctcctggaagtcgacgtaggatcgcacgtactcgtcgtccacggcctgtttgctcttccttaccagggcggcggttgcggccagtggctgggagacgaggtcgcaggcggccagcgcgacgtacaccggggcgcacacgttgccccagtacccatcggggagcggcgggtcgacgagcttgctgatgttcatggagtacaccatcttcaccacctcgccagggctgctcccgttcgccttgaccctggtttccacgagtacggtgagcacctttctgtggtctgaattctccgacaggtggaggagtgcttacctggcgcgccatatgaacgcggcgacaacctcgaaggaagtgaacttgacgccagcctcgtcagcgatccgcgctctgagcgcctccacgcgcgcgttgctcacgtggaagcattccctcgtgagcagacgctgctgttcgcgccgttccacatcggttccgtacggcccgcgccgcgcgacgccgccgtcgagcgcgaggacgcggtcgaacacctgcgtcgccactcgcggcgggcgcctcggccctagcagctcccgccgctcccacactagcgcaacctccggcggaccctgcccccaagcgaaccgcgccgcggccgcgaggaacttggtggcgcccgcgccgtcgcacagcgcgtgcgccacccgcatccccagcgcgacgccgccgcacgcgaaccgagtgacctggagcgcgagcgccggggtatccgcgtcggcgtcgccgtcccccggcgcgaggcggtcgagcagcgccgagccggggcagtcggtgtcgacgtcgaccgccgacagcccggactccgcgaggacgaggggcacggcgccagcgccgaccacgacgtggccttcgcggcggaggcggcccgcgagcgccgggtagaggccgagcgcagcctcgaacacgggcgggaggaccgcgtgggcatcgatggacggcgggggaggtgggaagaagcggagcgtgcggaaggtgacgtcgaacgcgttgcggtcggcgtcgaggccggagagcgggaggaccgcgggctgcgccggggcgggtggcggcgacaggcgcacggtgtccaggactcgcagccgcagctgctgtggctccatgggatgggagtagcgcgcgtgagccgccgttcgcgctggacagcggctgcgtcagtgcagcgacagactgacagtgagtgttgtatggttcgacccgtgtgagatcgagttggattc

SEQ ID NO: 13863 - DNA, 918 bp, Zea mays
gacaagggacttgatctcgaccattgggtacctcgaggccggccgggcccttccctcccctcccctcccctcccctccctctccgaaagctggaggggaaggagatccattgcttccgatggctgcctgccgtctctgacctccgacctctgcctccagcctccagccttctcccgccctacctgaaagcaactcctgatcggattcaggctaggtcctcacagcacagccctcctctgagactcagcaaggagacctgaacacgaattgatctctgcgccgctgcaaccccggcccgtcgaagccatggggtccggggactggttcaagacgatcatcagcaagaaaaaatcgaagcggggaaagtcaaagcacgcaaagctctctggccaagtaacaaatggaggcaaccagacaaatcagaagttagacggcccttcttcaagtagtgaggaccacgaagacaatgcagcactagaggaatgggctgctactcgcattcagaatgcgtttcggaaatacaaggcaaggaagaccctgcgttgtctcaagggagtcaaaagattgcgcgttgtgggtcaggcgaatccggttaagaagcagactgctgccacgctgagttacatacagtcttggaacaagttgcagtcggagataagaaaccgacgtgctttcatggtcaccgaaggacgcaacaggaagaagaagcaggagaaccaaatgaaacttgaggcaaaactgcataatttgcagattgaatggaatggaggctcggatactatggatgaaattcttgctaggatacaacaacgggaagaagcagcagtaaagcgtgagcgagccatggcgtacgcgttcaaccatcagtggagagcaaggtctgccacaagtctaggaaacttcagctatgaagtcggt

SEQ ID NO: 13864 - DNA, 5397 bp, Zea mays
tgcatgcctgcaggcgcgcagctggaccgtaaaaaaaaaaaaaatcagccgcgtgtgcgcgcagtagctagcactacttttggtagggtttaagtgataagtactagtcatgagaaagccaaacctgataaggtcgtagctaacacaatattgtgatcaaacgaccgcgcccttattagatacgacaacatcttctccatgatcacatcgtcactcggctacgtatttgttggtctcgcagactgtgaattgctgaatcttttcttttctagattcataggtttggttactattttaggttcgagtatatattgtagtattaaaaactgaataaatttatgaacacttttgctacatcgcctgtctcggtcaaactaaattttggacctcaagtgctgttgtccgatgggcacagggaaaaaaacttttatcttttttttttgttgatgatgatatttcccctgtatatttctctgataccgtattttttgataagacaggaggggcgagcccctactgaaaattttattaaaacattaaaataacagagttagaagcagacagaaagcagattacaaagggtaaaacagcctaactacagcgggaaaaggaaaagaaacgaggtctactgccaaagctgaagccatgcaggaattgtcgaatcaaaacggcctttagccctcagcatgacaagatgaagttcccttgcaaactcgtttttgcagtgttgcacagtcggggctttgttctgaaaaaaccatgcattgcgggttttccaaatgctccagttcatgagaatgacaatttccatagaaaatggaacattgagttgttgcattaggtttactgccgcggcctcaggattagcaattctgggagacgtcagaccaatagaagtccagcaggcctttgcaaagttacacttgaggaaaagatggtaaagagtttcttctttttgccagatgcagttctcacaagtgtaggactctaggttcatattcttccttttcagcagagctcttgtattgagtctgttttttagccacagccaaaaaaagaccttgtgctttggttggcacttgtttttccaaagcaatctgaagatctggtggacctgggcctgacccatcaaatgcttggtgatgataacctactttaattaccatatgacatcacgaaagcacaaagaccacaacattataataggtctgagttacacaaggaaagtgcagacagcaccacatccagatccaaatatttaaaaatatgatcatgttttcccagactcagaaagcgacctttaagctgcaattgactaatagaagcgtggatcaggttttcaaccactttgctttccagcaaacttgaacaccgtgtccctgatttctggaatatgttatatgcaaagtactgaccatgaacagaaaccaaacgtgtctgtcttttattttattttttattaataaactctgggctactatattttgtggaaaagaatcttgctgtgtgttagttttttatttcctgcaggttgcaatattccctagagtgcatccaaccaagcgttttaggacatatttggaatcaatgaatcatagagatttatgtctgttcttgtaaaattattttggcattcgtgtgttatctgatgcacgggtatagatgttagatgaggctatgaattttagccacaaagaaatattggtagattgttcataaaaaaatatttcacaatggtatatttctcctttcattttcccctgctgtaagaagatcatggttcacaatggatgccgctttgtaacagttcagtgttgcaactgtaaatttattttaccaaattaacccttcgctgtctttgacttgtctgcaattttgctgagaacaaaaatattgtagggttttgggtaagctgcgtgtcaatctcaagaacttacaatcagtgcatttttttacctatctcaggagaagctacgtgtgcccgtgctggtttcaaaggctgcacttcagttcattcacagtatgataccaccccacctgcgtccggagttcactaccacttgtccacttctatcgttttctccaatcatcaaccttaccaccacttcaattccacaggcgttgctccgtcgagtgagtaccgcgtccctgccgatgtcaagcccgcgcgtcccggcatctgcgctgaagagctgagctcgattgtcgaggggcatgatgtgaagaagctgaaatctcatggtggcgtgcagggcctcgcgtccaagctatccacttcggagtctgacggcctcaccacgtccgcggacaagctagcgacccggcgggatgtttttggcgtcaacaagtttgcggaggcggagtcccgtggcttcttggtcttcgtctgggaggcgttgcaggacatgacactcatgatccttgccgcgtgcgcgttcttctcgctcatcgtcggtatcgccacggagggatggcccaagggcgcacacgacggcctcggcattgtggccagcatcctgctggtcgtgttcgtcacggcgtcaagcgactaccgccaatccctgcagttcaaggaccttgacaaggagaagaagaagatcacggttcaggtcacccggagcggctacaggcagaagctctcaatatatgaacttctcgtcggcgacatcgttcacctctccattggtgatcaggtgccggctgacgggctgttcatgtcaggcttctcgcttctgatcaacgagtcgagcttgaccggagagagtgagccagttgccgtcaacgttgagtacccattccttttgtcagggacgaaggtgcaggacggttcttgcaaaatgctcgtcacgacagtcggcatgaggactcagtgggggaagctgatggccactctcagcgaaggtggtgatgacgagacaccattgcaggtcaagctgaatggtgtggccaccatcatcggtaagataggacttatctttgcagtggtcacattcgcagtgctcacccaaagcctgttccggcgcaagatcattgatggtacgtacttgagctggactggagatgacgcattggagctgcttgagttcttcgccattgctgtcaccatcgtcgttgtggcagtacctgaagggctaccgctggccgtgacactgagccttgcatttgcaatgaagaagatgatgaacgacaaggcactcgtccggcaccttgcagcctgcgagaccatgggctcagcgacctccatttgcagtgacaagacaggcactctcacaacgaaccacatgactgttgtcaaagcctgcatctgtggtaagatcaaagaagtggatggtgtttcggatatcaagaacctgttctctgaactcccagactctgtcatggcgattctctcccagtccatattcaacaacactgggggagacgttgtcttgaaccaggatggcaaacgtgaaatactggggacacctactgagacagcgattctagagttcgggctgtcacttggtggagactttttggcggtgcgcaaagcaagcactcttgtaaaggtggagccgttcaactctgccaagaagagaatgggagtggtaatccagctcccagagggtgcactgcgagcacactgcaaaggtgcatcagagatcatactggcatcttgcagcaagtacctcggccgcgaccgcgctgtcatccccctggatgcaggaaccattgatcacttgaaggccacgatcgatagcttcgcgaacgaggcacttcgcactctctgtcttgcctacatagaagttgaggatgggttctcagtcaatgatcagatcccaacggatgggtacacctgcattggcattgtggggatcaaagacccagtgcggcctggagtgaaggaatcagttgctatctgcaggtcggcaggtattacagtcaggatggtcacaggtgacaacatcaacacggcaaaggcaattgcccgggaatgcggcattttaactgaaggtggcattgccatagaaggcccagatttcagaaccaagagtgaagaagagcttactcaactgataccaaagatacaggtgatggcaagatcttcgccactggataagcatacccttgtcaagcatcttcgaactaaactctacgaagttgtggctgtgactggtgacggaacaaacgatgcacctgctcttcatgaggctgatattgggcttgcaatgggcattgctggaaccgaggtggccaaagagagtgctgacgtcatcattcttgatgacaacttctccactattgtcactgttgcaaaatggggtcgatcagtttacatcaacattcagaagtttgtgcagtttcagctcactgtcaatgtggttgctctggtggtaaacttctcctcagcttgcctgacagggagtgctcctctcactgctgtgcaattgctctgggtcaacatgatcatggatacattgggtgcgctggcattggcgacagaacccccaaacaatgaactgatgaagagaacacctgttggaaggaaaggaaacttcatcagtaacattatgtggagaaacatcctgggacaggccttgtaccagttccttgtaatttggtacctacagacagagggaaagtggctgtttggaatcaagggcgataactccgatctagtcttgaacacactgatcttcaattgcttcgtgttctgccaggtattcaatgaggtgagctcaagggagatggagaggataaatgtatttgaaggcattctaaacaacaacgtgttcattgctgtccttggcagcaccgtcatcttccagttcatcataatacagttcctcggcgatttcgcaaacactacccctcttacgctcaaccagtggatcgcatgtgtttttatcggtttcataggcatgcctatcgcagctattgtgaagatgatcccagttggatctacgtagtgaattagagctaatttcgtccagaaactgaagttgggcatggctacagtctgatcatggcaatggagttttctgggttgccatttgtgtacaagatagatctgtgctatgcttctattctggtcaatctttgcctcttttatcctgtagtatcttatcagccaaggttgtggactcgattgttagaaaatgccttgggctcttgtagctgttctttgctttatatttttttcttggtgcttttgctaggaacattggaggctggagctgtatatgacaatcttgttgttcactcgaatgtgcttgttttgacacctatcattttgcttcatctgataagtaatgtttcagtcagaagttccagagaagggtggaattttaatgtttctgatttgccaagaaaatggacccaaaaaaaaaaaaaaaaaggctagttctagatcgcgag

SEQ ID NO: 13865 - DNA, 880 bp, Zea mays
ttttttttttttttttgacgtcatcattcttgatgacaacttctccactattgtcactgttgcaaaatggggtcgatcagtttacatcaacattcagaagtttgtgcagtttcagctcactgtcaatgtggttgctctggtggtaaacttctcctcagcttgcctgacaggtacatccgatatcctgtatatgagttcgtggtttggaaatcctctactacttgagcgtatcctgaatgtactttttgtttatttcataaatctacgtctcattgttcgcattcatgctgattgctgattcagggagtgctcctctcactgctgtgcaattgctctgggtcaacatgatcatggatacattgggtgcgctggcattggcgacagaacccccaaacaatgaactgatgaagagaacacctaaatcgacgataaggacgaccagatcgcgcggtggaactctcttccaaagatgcctctgcctcctccgaacgcggtcgcttgccgttgccctttgcgcttatctgagtagatctggctccttcctctcctcccccaactcccaagcaaccggatctgggggagggcttcgcttcctccagtttggcgcgtcgggatcccgcgaccgccggaggccgccggatccagggtcgtcagcgctcgcctccgcctcgtccggacccggcttcggtcgccggcgtggttcccggtccgccgccttccgtctcggcgagatgcttcgcccgcgcctctgtctgcgtgccgccgcgtggttcctctgtccgcgtctttcgccacgcgcgcggtagttgggaagtggaacgacggagagggaagaggagcggagagagatatggagtaaatgaaacggaactctggaaat

SEQ ID NO: 13866 - DNA, 2119 bp, Zea mays
ccgggggctctgtgtgtcccccattcacttcacactctagactctagttcgccccatgagtctggcaggtcaaagaaggcacgagaccattacctagaacatcctaatcgaaaaaacggatcaagcgaggtagacgactccgcgtctaattaaacctgtggtctgcggacgggcggtcgtcggttagagcattgcttccgtgtggtgcggttgatagctcggatcttctgctggcggagttcgtcttggaggagaagagagagagagagcgcgcgcgccgggatcggagccaggaagcatccagcagcgatggcgggcggcggggtggcggcgctgggcgtgaagacggaccgcgcggcgcagtacaaggggcgcatgacgctcgccgtcgccacgacctgcctcgtggccgccgtcgggggcgccatcttcggctacgacatcggcatctccggaggcgtgacatccatggacccattcctggagaaattcttcccggtagtgttccaccggaagaactccggcgggaagaacaactactgtaagtacgacaaccagggactagcggcgttcacatcgtcactctacctcgccggcctcgttgcctccctcgtcgcgtcccccgtgacgaggaactacggccgcaaagctagcattgtctgcggcggcgtgagcttcctcatcggcgcggccctcaacgtggccgccgtgaatctggctatgctcatcctcgggcgcatcatgctcggcgtcggcatcggttttggcaaccaggctgtgccgctgtacctgtcggagatggcgccggcgcacctccgcggcggcctgaacatgatgttccagctcgcgacgacgctgggcatcttcacggcgaacctgatcaactatggcacgcagaacatcaagccgtgggggtggcggctgtcgctgggcctcgcggcggtgccggcgctgctgatgacgttgggcgggctctttcttccggagactcccaacagcctcattgagcgcgggcgcgtggaggagggtcggcgcgtgctggagcgcatccggggcacggccgacgtggacgccgagttcacggacatggtggaggcgagcgagctggccaacaccgtcgagcacccgttccggaacatcctgcagccgcgcaaccggccgcagctggtgatggccgtgtgcatgccggcgttccagatcctgacgggcatcaactccatcctcttctacgcgccggtcctgttccagagcatgggtttcggcgggaacgcgtccctctactcctccgtgctcaccggcgccgtgctcttctcctcgacgctcatctccatcggcatcgtcgaccgcctcggccgccggaagctcctcatcagcggcgggatccagatgatcgtctgccaggtgatcgtggcggtgatcctgggcgtgaagttcggggcggagaagcaactggcgcggagctactcggtcgcggtggtggtggtgatctgcctgttcgttctggcgttcgggtggtcgtggggcccgctgggatggacggtgccgagcgagatcttcccgctggagacgcggtcggcggggcagagcatcacggtggccgtgaacctgctcttcaccttcgccatcgcgcaggcgttcctgtcgctgctgtgcgccttcaagttcggcatcttcctctttttcgcggggtggatcaccgtcatgaccgtgttcgtctacgtcttcctgccggagaccaagggcgtgcccatcgaagagatggtgctgctatggcggaagcactggttctggaagaaggtcatgccggacatgccgctcgaggatggctggggcgcggctgagggtcatgcggcacctgccagcaacaatcacaagggatgactggagtgaagcatgcatggttgcctggttggtttcgtggacactttatataataactgaagaaaacaagacacacactaacatgtaggcggctgcttattcttattgtattttgtataaagcaggctgtgtgatatgcagggataaaaacgaacgagatcgttccaaataacctatcttttgttttcagcggcacattttatttgggaaaaaagattgaagaagggactagcgggat

SEQ ID NO: 13867 - DNA, 2205 bp, Zea mays
gccggccgggtccgagtagatacgtattcctatctgtatctcaacggcccgatgcatgagttagcttagctgtcgtcctgctcgccgcttatgtaagcaaccgtagacccatccccaacatgctggctctctgtgtcccccattcacttcacactctagactctagttcgccccatgagtctggcaggtcaaagaagggaagagacaaccgaaggatcaacggatcaagcgaggtagtcgactccgcgtctaattaaacctgtggtctgcggacgggcggtcgtcggttagagcattgcttccgtgtggtgcggttgatagctcggatcttctgctggccgagttcgtcttggaggagaagagagagagagagagagagagagagcgccgggatcggagccaggaagcatccagcagcgatggcgggcggaggggtggcggcgctgggcgtgaagacggagcgcgcggcgcagtacaaggggcgcatgacgctcgccgtcgccacgacctgcctcgtggccgccgtcgggggcgccatcttcggctacgacatcggcatctccggaggcgtgacatccatggacccattcctggagaaattcttcccggtagtgttccaccggaagaactccggcgggaagaacaactactgtaagtacgacaaccagggactagcggcattcacatcgtcactctacctcgccggcctcgttgcctccctcgtcgcgtcccccgtgacgaggaactacggccgcaaagctagcattgtctgcggcggcgtgagcttcctcatcggcgcggccctcaacgtggccgccgtgaatctggctatgctcatcctcgggcgcatcatgctcggcgtcggcatcggttttggcaaccaggctgtgccgctgtacctgtcggagatggcgccggcgcacctccgcggcggcctgaacatgatgttccagctcgcgacgacgctgggcatcttcacggcgaacctgatcaactatggcacgcagaacatcaagccgtgggggtggcggctgtcgctgggcctcgcggcggtgccggcgctgctgatgacgttgggcgggctctttcttccggagactcccaacagcctcattgagcgcgggcgcgtggaggagggtcggcgcgtgctggagcgcatccggggcacggccgacgtggacgccgagttcacggacatggtggaggcgagcgagctggccaacaccgtcgagcacccgttccggaacatcctgcagccgcgcaaccggccgcagctggtgatggccgtgtgcatgccggcgttccagatcctgacgggcatcaactccatcctcttctacgcgccggtcctgttccagagcatgggtttcggcgggaacgcgtccctctactcctccgtgctcaccggcgccgtgctcttctcctcgacgctcatctccatcggcatcgtcgaccgcctcggccgccggaagctcctcatcagcggcgggatccagatgatcgtctgccaggtgatcgtggcggtgatcctgggcgtgaagttcggggcggagaagcaactggcgcggagctactcggtcgcggtggtggtggtgatctgcctgttcgttctggcgttcgggtggtcgtggggcccgctgggatggacggtgccgagcgagatcttcccgctggagacgcggtcggcggggcagagcatcacggtggccgtgaacctgctcttcaccttcgccatcgcgcaggcgttcctgtcgctgctgtgcgccttcaagttcggcatcttcctctttttcgcggggtggatcaccgtcatgaccgtgttcgtctacgtcttcctgccggagaccaagggcgtgcccatcgaagagatggtgctgctatggcggaagcactggttctggaagaaggtcatgccggacatgccgctcgaggatggctggggcgcggctgagggtcatgcggcacctgccagcaacaatcacaagggatgactggagtgaagcatgcatggttgcctggttggtttcgtggacactttatataataactgaagaaaacaagacacacactaacatgtaggcggctgcttattcttattgtattttgtataaagcaggctgtgtgatatgcagggataaaaacgaacgagatcgttccaaataaaaaaaaaaaaaaaaaaaaaaaaaaaaaaaaaaaaaaaaaaaa

SEQ ID NO: 13868 - DNA, 5805 bp, Zea mays
  misc_feature (2043)..(2043): n is a, c, g, or t
aaactacattcgatcaaaaatgtcttcacattgtatagacgtcgagatactggtatttatattaaaaagggtgagtataatttagataatagatgagttgtcccacatagcatatacttactcaaaaaaatatcaagctcatataaatgtagaatattgcaataaaagtagaattcttaaatatttatgaaaatgtgtaaacaaaggtcctgacaaagctagaatagtttttcagcaaataaaaaagggaaactatacgtttatatatgaaaacaatgaagataatgaaatacaacaatatttagaatgtaggtacatatgtgaactagatgcgatttggagattacttggcttctaaatacactatcattttccttctgtggaacgtctacctgttcatctaccactcatgaataacattatatataaagaaaacattgaacttaaacacatattagaaaatccaaaaacacaaaaaaaattgttcacatgtaaattagacgatcaaatcaatctcacttttgttacagaattgcaacaccaaatctgatactttcaatgttttatatatattctattgcaatgatgacgcaacacacatatattcaggagttcaaaggtcatttggtattatggaaatttaatagtcaagaagcataaacagtaaattagatctccattcttttctaccttataatgttgcataattataactcttaaattctaattaaatgtgttatatcctatctcacttcttattttgacttacaaatcaacacatgtcatgaagaccacttttgagcaacgatcgtatgccttttcttttgggcagatttatcataactcttttggaaccactgaagaatagagttgttaataaatcatcaatattttattgtaaaacacagtactgcttgctatcaggttgctaacaatggagtgtctgtaatattttggaagaacagagaaatcaatgtgtgctatcactcttactatatgctcaaacactatcaatgtataaaccccttgatgtatatagtgggtttttttaaagagtgatatacttagtagcttttgcttaatcactgggactattatctatcactcccaacttcgacaacaaaactcttttgcaatatacatagctacatactatatattcaagtagctaccaatataaaaaccagtcttttgtaatatacatagctacttactatatattcaagtagctaccaatataaaacccctgatgttatataccgtaactaaaaatataaattacaccaaaaaattacaatagaaataaaaagtgtgcgcgacaacgccgcgcaaaattctagtctactctactccctacgagagcgggctgtaaaaaattccacttgagttgtcataaatgtggccttagaccttgtttggcttggctccggctccactgatttgggctccaactccaaactccagctgaagcccactctagctggagttagagctgtctggaaggggtgtttagctagctgggtattcttagttccagaaaagtgaatttataggttgtattgacattgttgctcttggttgattgagtgcgctttaatatgattgtgatacatttttttagcaaaatatttttgtacaactattttttcatgaatatgaaataaaatgttatttgacagaagtttataatataaaatatgacatgtccatagactagaaccgaatagctcatagtataaaatgttcattatttttttctagttccacgaaaaggcaatagatgtagccaaactatcatgaaatgcacacatggtcacaaagcttaattccgaagtcgatccatgagacactgcatacttgtatctttctaggatagtatgaacaaaatgtggatcactgtcaaaattagcaaaatcctcatcctcactcgcatgttcgcgaatgaagttatgaagaaccatggtggcagcaacaatctttttttgtgtgagcatggaatagctcgatgtcatataaatgatttgccatttcatgttcaatacncaaacgagcgctttatgacattacaaatagacgagtgcactcgattgaacttctctttaggagtacttcgtaagggaacatgagagagaggcgtaagggaacatggcacggtaaaaaaagatcgaatcttttttatgtgtaaaatggcattggtgtgtaattttcatacaagtccacgtctttattcactttgaagagttttggagctgtgaaatagttactccaccaaaatgaacaagagctcgaggaactccatggaattaaggtgctccaaaaaaagatagagttgagttgtttggctggctccactcaactccaccatagagtttgaagttggagctatgccaaacaaggtcttgatcttcgttgatgtgttcatctcaaataattacgcaagtaatttggataactgagagcgatggtaattattaccatatgcaaattaaataggctaattacatgggtttcctttttgataaattagcaacgagggttctctttaccttattattaagaaaatgaggaacctaggattgtgcgatcggaagagtggcttctcttttccgaattctgaaccgggtccacgagaagctgtagaagcaacgggaagatccctgctgcgtggcatcgcgactcgcggccgacacgcgggcccggggcgctccagtccactccacgccaagccagcctttgccgcgcgccaaactagccgttgcgcgcgtcgccttgccagttgcccctcgtccccgtctcctcctcaaacggtcgaatccaatgcatgccgcaacctccatttaaacatctcccccgccccccggctccccaccacactccactgctctcctccactccactgcctcccatccctgctgctccctctcccatcccggttccatcatgggcggcctctcggtgatcgcaccgcccgcgcgggactcggcttccccgcagcaccggcgcgcgcgccgcgcgttcctcgtgtccaactacctcatcctgggctgcgcctccgggtgcggcttcctcacgctctcgctccgcctggccccctccgtcgacggcttcctcctcatcctgctgcacgcgctcacggtggccgccgccgtggccgggtgcgccgtcatcgcggcgccggaccctccgcgcggccgctgctacaccgtccacatgtccgccaccgtcgtcgtctccatcctgcagggcgccgccgccgtgctcgccttctcccgcacgtcggagttcctctccgacggcctcaagtcgtacgtccgcgaggaggacggtgccgtcatcctccgcatggtcggcggcctcggcgtcggcatcttctgcctcgagtgggtcgcgctcgcgctcgccttcgtgctcaggtactacgtctacgtcgacagggagtgcggcggcaaccccatgcgccgcagcgccaaggtcggcggcgaggacggcgccggcacctggccctggcccttccaggtctgaagtggaccatgagtttttggaagggaaatcaagcgtcgagtgttatagaactatgtggggggacgggatgcacaatgttgtgattcgtttatttgtttattatgtggttttgtaatgtcatatttgtaacgctgttatatttatataattatatatgtgaaatttgcactgtaaaacaaaagaaaaaaaaaaattctgacgagatctgaactaaaacaacgagtactcaccgttaagcagcctgaatctctgtcgagatttgagtggcttatttgatctgaccgttcgggctgcgtcatgttgttatcacctggaactggaatgtggcacaccgaagatacctgcaattttaatttgggagacgggggagccagcatctagggaagcgaatacgctgttacacagggcctttttgttttcagtgagctcccaaacattgcaatttagtcgtatgctccaacctcttttgtcaaaattttcaataaagaacaagcatacacatccgtcttgacaatggcctatcagtattcccgtgtgtgtgtgtgtgtgttggctgcccctgcggctctgccccttcagtcaaggtagagagtaaaaaagacttgggttttctgcagtggaacttggacattgatgaccttgctcggcttggatgtaatttcaacgagactgcgccgaaacatctgaattccactgatcttggcgcgcttcctcggggaaatttaaccccaactatgccatcttcgacgattacgtgcggggaatgatgccaggtgggtcgggccactgtgcagacagctggagctcggagatgggccaaggcgccgagcgacaggcacccgagaccgcgacctgttgggggatcactgagcacggtcgcctccatttcagacctgaagacgaaagaaaagctaaccggatcgatcccacgcacacatcgacacccctcatgtgtcccccgccgaaaccggcagctgatggagcagccactgagacggcggcggtggctaccacccacttgccacgccagggccccagttccctcccggtacgggacttggcaacggcagccggcacggcaggaaccggccacaggagcgcgctgcctcaaagtgtccccagaaagttgcgcctgctggttaggcaaaggcttttcagctgatgatctaatctcatcaggtcaggtgtcggttgagctgctccacgacgggcgtgctttgtattttttttttgtatgccgagctaggtcgccaaacacacggtcggtgttgtctctaaactatgccgtctccgtccatcctccacagccagtagcgcagagctacactactaatcgatgggaatattgtagtactacaaaatagggaccacctaacgttctaatgctgccgcgtgacggtgaactgcacttgccgaccaagattagctactgtgctctagtggctctggctcgctttgagtaactgggtggatcggaggatgtcaccggccggccgtgggcgcctaaccgcctacgaggcgtagctagagtccagttgtctaagatcaaaagcgttacgaaacgaaggtcttcctggggatgaactttctggaggtctaaaagggtcgctctggttatcgtgggcaattttctcattcagctagaattgtgacacgccagtcaagatggtacggcgtaacaagaagtgggtggctgtcatactaattcctgtttgggggtgggtgtcatactaattcccgttgacactcggcgaacggggttaactggattccttttgtgaaggtgattctgaatttaactagataaatctatagtttctttagaaacatattctgctattatacttgtttggttgagattccagatttttttgcattgaatttgattcaagaagctaaaccacacccaccctaattctactgatttcaaaccattagccacagtctcgctttggggtgaaagggtgagaacgtcgtccaaagagagtaaataaatagatgtttctcaaaaaaattacaaattagatatagatgttgttgttagaagaggattttcattacctagctagcaaactcaaatcgaagtaaaataatatccccaagagaagcattaagtaattaaagaatattaagcagtctttaaagtctaacacctccaacacaatagattagttacataaaaacaaggttgtagctaaaaacaaagttgtagctatacaaacacacattaaatacaatagctttcgacatttagctacaactttgtttttatgtaaaataata

SEQ ID NO: 13869 - DNA, 832 bp, Zea mays
accacactccactgctctcctccactccactgcctcccatccctgctgctccctctcccatcccgggttccatcatgggcggcctctcggtgatcgcaccgcccgcgcgggactcggcttccccgcagcaccggcgcgcgcgccgcgcgttcctcgtgtccaactacctcatcctgggctgcgcctccgggtgcggcttcctcacgctctcgctccgcctggccccctccgtcgacggcttcctcctcatcctgctgcacgcgctcacggtggccgccgccgtggccgggtgcgccgtcatcgcggcgccggaccctccgcgcggccgctgctacaccgtccacatgtcggccaccgtcgtcgtctccatcctgcagggcgccgccgccgtgctcgccttctcccgcacgtcggagttcctctccgacggcctcaagtcgtacgtccgcgaggaggacggcgccgtcatcctccgcatggtcggcggcctcggcgtcgccatcttttgcctcgagtgggtcgcgctcgcgctcgccttcgtgctcaggtactacgtctacgtcgacagggagtgcggcggcaaccccatgcgccgcagcgccaaggtgggcggcgaggacggcgccggcacctggccctggcccttccaggtctgaagtggaccatgagtttttggaagggaaatcaagcgtcgagttgtgggggacgggatgcacaatgttgtgattcgtttatttgtttattatgtggttttgtaatgtcatatttgtaacgctgttatatttatataattatatatgtgaaatttgcactgttaaaaaaaaaaaaaaaa

SEQ ID NO: 13870 - DNA, 1717 bp, Zea mays
  misc_feature (1716)..(1716): n is a, c, g, or t
ctcgaggccggccgggactctctcttgtgtcccatttctaaccctagccgccaagcttgagctcccaagtcccaaactgcccgtctgccctccagccgtgcagggcttcaggccatccgggctccggcttccggcatccatcaggcgtcctcataagatggtgtagggcagcgagcgccgagcagagcagcaaggcagagcagcgagcagccgagcagcgaggcagcgggcgtcctcagaatccgggctgccgagccgccgagcagagcagccgagagcagcgaggcagcgagaacggcccacgagaaggcccgtgcgggtgcggtcgccctgggccgaacaaccccggaccgccgtccgctgcttcctactcttcaccgcttcaccccgcgtgcgcgctttctctgttgctctgctacaactgcggcgccgccgccgccgccgccctacgccagttgccgagcccttcatcgctcttctcgccggcgacgagcacccaccacaacaagtctttcacccacagaaggcaaagatgatcaagaggcgctactttaggcaggaccatggtgataacagcggctcctcatcttcctcctcatcggattgtgactcggacaacgatttggcagaagaggcagtcagcagtgaggaagtagaggagcaggaagaagaggaagcagtcaaggaagaatcaggagaagaagaggaaggagaactagaacaacaaattgtagaagggagttcaggataccaaagtgaggacaactcatggaatgatgttgatggtgcatctatagacgatgatgaacacagcagcccaagagatgaagaacgtcatgaaataagtttgcccattatgaaatcttctggtgctaatgctgactctgccaaaagtgctgataacacagatgacgctgttgatgcagacttccctaactgcattctgaaatgcaaatctgtgtttaagtgcaagctctgtcctaggatcatgtgcttaaatgtggagatggtcaagatacatctgaaatcaaagaggcatgctcgttccgagaaactactaggagaagggaggcttaagctgatgctcaacagcgatggtgaactggaggaagagcaagagacacatgctgaacgacatgctcggactatagccctttcccagcaagtacaaaagcagaagaaggattcaggtaggcagcgacagaatcggagaaagaagaagaggtctcgggttaatctggaagaggcacagaacaacaaaaaacaacgcaaagctaaatgaagtgggtcttgcagaagcttccaagttcttttgtagcttcaactgctgtgttcccaaactttgtagcggccataccgttaggatattcaagtatccaagagttttctcgtcggctgtaccccgtttaggcctaaactgttagtaatttgttgaattttagatatttaattgaagtggatcaaaatgatatttttgagccgagcagctgatataggctcctcgaactacagtgtgtcgcctgtgccaaatcatcacaggttcatgatccacacgaactataattgtgcttctcaaactgtggtgtggagcttgagccattttagaggagtcacacactgtgtgtgtattttaaaaaaagcggatctggtttctcattttgtattaaaccgtttggctgttttcagcaacgtcctcgaaaaaaaaaaaaaaaaaanc

SEQ ID NO: 13871 - DNA, 4660 bp, Zea mays
gtaaagagcgtaactccaatgactaatctaggcacatggccggctgggacggaggagactccagcattcactttcactggatatatatgtcggtgtgcacaactgcgcatgcgattcattgagccagcaccagccgtactcattttcttcctagcccgcgagcgagggggcaccgggcacgtggacacccctctcggtatccgatcgatccacgatatttatcacctccaatccacctcgtatctgtattctgtatgcatcagccagcacccagcagcagcagcagcagcaaagagtcagctagacagacatgccggggctcacgacgatgctggtcgcagtactgccgtgggcatcatcacccgtgccgccgatgaagctttgcagcggcaagaggacggcgagcgcgatgccgctggcggccaagaagcgctctgcttcgtcggcaaaccaccaaggccgcggccgtgccctaacggcagcgacggcaacggcgcccgcctcttgccatgacgacgaccagcggccgcggctgcagaccctggagcttctgcggttcctggaggaggacgggtgggtggaggaccagatgctgtcgctgctcaccccagtggacgaggcatggcagcccgccgatctcctgcccaccttcgctgtcgccgcagaggagcagcgggcccaggtggcggagctccaggcccgcgcggcgggcgtgcccgacgagctcctcgtgtgcctcgtgggcaacatgatcacggaggaagggctgcccacgtacatgaccatggggaaccggatcggcccggcggaaggcgtcaccgacgccaccggccgcgacggccacggctgggctcgctggctgcgcggctggaccgccgaggagaaccgacacggcgacctgctcaaccgctacctctacctgtgcggccgcgtggacatgcgccaggtggagaggacggtgcaccacctcctccgccgcggcatgagcatgacggagccctcctgcccctaccacgcgtccatctacggcgccttccaggagcgcgccaccttcgtctcccacgcccgcaccgccaggcgcgccgcgctccacggcgacgcctgcctcgccaagctctgcggggtcatcgccggcgacgagaagcgccacgaggtcgcctacaccagggtcgtcgccaggtgcttcgaggccgaccccgacggagtggtgcgggcgctcgcggccgtcatgcgagccaaggtcaccatgcccggcgagcgaatgacggacggccgcgacgacagcctcttcgaccacttctcggcggtggcgcagcgcgccggggtgtacacggcggcggactacggcgacatggtggagcacttcgtgcgcacgtggagggtggcggggctccaggggctgtctggcgaggggcgccgcgcgcaagactacgtgtgcgggctgccgcgcaagatccgcaggatggaggagctggcccacgaccgtgccgcccaaaaagaggcccaatctgtcagcatcagctgggtgttcgacaggcccgtccgtctgcactgaaggaaagttgaaggacatacaccaatcctcaactgaagccccaatcactactactactactggaggcgttggaaatgcaccttactagttaaatgctcctatattctaagttttctatatatatcatataaatatcatataagtaagctttattttaataaaacctaaaatatatgtgttattgttggttagatagatgctaatgcgaagccaacgatcaaagttcaaacccccactttatacacaataaattgtgggttatatagtagagatattgtaaccgagcttggctgatatgcagtgtacaactataaatgtgaacttctccctccgtgacataccaaatgacaagtcattgcaacaaatttaaccaaatttctataataaaataatagcatttatgatatcaaagattctttattctttatatttttatactatacttatttgatgtcacggatcttaataatcatctataattttgatcaaactacttgagatgttttgactctaaaaagaaggtacaacgactcataatttagaacgaacagagtgtatatataagacttagtaagtttttgtggcaaatataaagcttgaataactataactgcataccccctccgatttttttattagacatttgttagtgtaaatttgtactatctcacgtcaaataaaaaatggaggtagtacaatattaagaatgaaattgttgctaacctcttttttttttgtgacccggaaattggtaacctcttgttgatttgcggaattcatttggtcatcaaccgtgcaactatatttacatatatcaaaacactgagtgtagtgtagtatgctaaaatcagatccacccatccatcacccctcacgtcacgcaaggaagctctacagacaaatcatacctctgagagtacagcacctttgcacaggttaattacttgtatttgtccattatcctacgggcctcttcaacagggtcctccgatgggttgcccattgcttcatccagcctagagccggatgcctcctttgggttcatagccaggaagctgagatatataaggcccatcattgcctgcgaccacaggacccgtcaatttgatcgtatcaagtaccatcaaaactgaaacataaaagactggaatgttgaatggataatggatagtcttcagctctcgtaaatatgtcaattattggaagtgcagtgtacattcgctatttgtcaagtaagctactgcaggactaagtgccattcaatattgtgcacagcgcattgatcgtcaatggcaggagaatcgtaccgcaaatgtcgtgactgcttaccagaacaaataatgcagtggacacaatggatttgacaaggaaaaaggcgactgacacagcagcaaaggcaacacctatcctggcaattggtcgtggaactgaaccctggcagacataagagggggataatcagtccaatttcaaatcttaaagaaaaaccaggactagagtctcttgttgtcggtatgttttcttgagatcgaagcttcagtaagaaaacattttcttcagagctaagaggatgatggatgatagcttaagagatatgaatggccaaggaatacatactgggacaagattacttcctgcctccacagcatcgttaccgaccctccatgctgtttgaacagctgttatcatatatgtagtgttaagagaataacagaacatatatttcattgcgttaagaaaatcaaaccagcatatattgctccgagtcctaggaggataataaaaaaactacagaggcatccatagaaatataagtgacctaacatgaaggcatcatggacaaaatcaacaatgagtcattaggcaagtcaatattcggtatagtaggcaagacaatattcgcactgagtacggtttgccgctcatacttgatgcttggtcctaaaccctgaaagctgagcacaggagcagcaatgcatcctgagcggtgaggagtggagagccagaattttagtactgcacccgaatcagaatcagattacggcatgtacaaacaagagcccctggctcggtttttcaagtaaaagagacgtctaaaaaactacatcatacaaccctgagtcgttagaacattcatgtagttaagagactatgtatggaaaatagtgaagactgaagagtcgtctctttttttttgcacttaaccacccatcaaaagacctttcaattaatggggttgtacatgcccttattgtgtgtttgttgtgccagaaaaactaggaataacaaaccgacgaatgtttttgctgacatgaggcatccaaccctgttgtccattaatctgcagtggtgacttcagaagatccagtaatccccctgaatccccgatggtttcgagatttgcgatttgcgatcacaatctatggattagttgtaacgagacgcagaaacagacacacaagtgatgctgcaaggttgaataaataatttgtttcagatatggtgcatatagtttggcaagtatagcctccgttcccgttttggtttttttaggtccacaaattttatcattttagtaggtatatctgcattgttctagacagaggttggtacgcagttagcaagaataatactccgcctggcaagatggaaacaaaataacggcatacaggtcgtcctcgcaagtcgcaacaagaagaaaagagtaaaatacacgcggtacggtacctctggagaaatcgagctgcgcgtaggcgacgaagaggcgcggctttggatggatgggactgggaggcggcgcccgccgtggcatgtggatggagataggggccgcgaacggagggagcggagaggataagattctccggcgagaggcggtcgacggaagccaggcggctgccacggtcatggccatggcgagggcggagagttggagaaagcctgtgtggtgcgccgggcgccgctgcccgacgagccgaggtcagaacggacggacggaactgggatagggctgagccgctgggctgtcaacgagccgaactcgaacgagcctggtttgaactcggagctcggctctagtaggctcctcactttctcagctccaac

SEQ ID NO: 13872 - DNA, 5530 bp, Zea mays
  misc_feature (1524)..(1524): n is a, c, g, or t
  misc_feature (3576)..(3576): n is a, c, g, or t
acccagaggttaaccgtgccatgcctggcacgtttaaaatggtcgtgtcgagtgcatgcccgtataaggtcgggtgaagctgcccgtttagacatctatatgcattgccatggatcgatatcaattctgcacctccctggactctggctcccctacctatatattcatccatgtgcagccagatagagcaacgaaagcaaactcagcagtgaacacaaaggaagctgaccatgccggggctcatgacgatgatggcgttggtgccatcgccgcccatgtcggtgaagcaatgcttctggagcagcagcaagaagacgagcggttgtacggtgttgctggtcaagaagtgttcttcttcgcaagcacatctcctcggccgcagctgggctccggcagcgacggcggccaccgcagccgcaactgcctttcgttgtgatgagcaggagctgatgatgatgcaccgcctggcggacgacgggtgggtggacgagcatatgctgccgttgctcacccccgtggaggaggcctggcagccagccgacctgctgccctccttctccgtctctgccgacgagcagcggagccaggtggcagacctccaggcccgcgcggccgccgtacccgacgacctcctcgtctgcctcgtgggcaacatggtcacggaggagggcctgcccacctacatgaccatgggcaaccgcgtgaccggcgccagcgacgccaccggctgcgacgaccatggctgggcgcgctggctgcgcggctggaccgctgaggagaaccgccacggcgacctgctcaaccgctacctctacctgtgcggccgcgtggacatgcggcgggtggagacgacggtgcaccacctcctccgccgcggcatgcgcaccatgctgcggccctccagcgcgtaccacagcctcatctacggctccttccaggagcgcgccaccttcgtctcccacgcccgcaccgccaggctggccggcctccacggcgacgcctgcctcgccaagctctgcggcgtcatcgcggccgacgagaggcgccacgaggccgcctacacgagggcgtccgacagggccttcgaggaagacccggacggcatggtgcgggcgctcgccgccgtcatgcgcgccaaggtcaccatgcccggcgagctcatggccgacggccgcgacgatcgcctcttcgatcacttctccgcggttgcgcagcgctcaggggtgtacacggcggcagactacgccgacatggtggagcatttcgtgcgcaggtggaaggtggcggagctcgacgctggcctgtccggcgaggggcggcgcgcgcaggactacgtgtgtggcctgccgcgcaagatacgcaggatggaggagctggctcaagaccgtgcggctcaaatggaggcccagtcggtatgcttcagttgggtgttcgataggcccgtccgcatccactgatcagctagcttcttccaatccaaagcaagcttggaggcccatttgtccctcatcaactgaagaaggnccagctacttctacttattttattgtaatcttgttttgtttactgcttaaattgcgtgccgtgcctgggccagcacggcccgacggaagcccgtcgtgctttagggccgtgctgggccttatttttactcactaagcccgataaggcacggcccgattttatttcgtgcttgctaggcccgactaattgaggcccgaagcacggcgggcttgtgccgggccggcacggcccggcccaagttgcagcactatgatctggcgctgtatctgagttacttaattcataacacgcatcagttttaaattgctatctggaaagaatcaggttgttgttgcgctagtttttcttagtggatggtttgttgttgcattcttaaggatgctgtgtgttttcttctgtttcttcttttcagttttgttgtgtctgttctcccattagcttcgtggtggtttgtaatttgtctgctgagacagcggcgcacctatgtaaggattgtcccttcttcaaggaagtgtgaagcatgatcttgtcttaggtcgatctgcggttcctagacggtactccaaagaagggaacctgtacacttggtggcatagactgagaatgctctgtagcaagcaattaagcaaaagtttcgatgacttactaatttatttctgatggaggttggaaagaaacaacagaatcttcaagagacaacagagaacgacagagcaagttgcgtaggtggtgaaagagctcgttggtagaggtttagcttgtctgtagcggctagttgccctaaccctctttcttgatgtctgtttactaagcagttctggtcaagggggtcgggtctttgtttcagtgtcagtgttccgcctagtgcaggatcgttaagttgtatggatttgtaccagtttgtaatgttttttttctcccttctaatatattggtttgcctttccctttcaaaaaagatctctttctttaaatgaattgtggcaattctcttgccgccttttcttaaaaaaatcaattttgggttgctctccatcagtttagttcctacctagctttaacatcttgaaaagccatgcgaattaggtatcattggaatttctcctatttggtgtaagatggtgttgctgcctttttttgccgtgcttctgttgtgttcttcatttggatttggatatccatgcatatggatctgcagaagagatctgaaattgtgacgcacgtcgttcctagtcctaggtggacatgttctccttgcaaacaagaacaagttattattactccctccgtttctttttatttgtcgctggatagtacaaaattacactatccaacgacaaataaaaagaaacggagggagtattaaacaagcatgcgcgtcaaatctgaacgacttctccaagaagcggccaccttgcaatcaccaagcatttgtttttgctgtggtaaagctgacaaggctcaagtgtttgcttcttgtcctctgacgaaattaacatgaatgcagattttggagccatgcctgggattgaattgatcgcaaaattgtctgatccaaaacgctgcagataagttccaagcgaatatctcccgggctgcctagtgattccaccgagatgcagacgacatcggcttagcccttgccgcacatgcgtccactcctgcctcgtcgcttctgcgctccatgacaaggtcacccacctcggaacgtatgaactcgagacccctgcaggcttgccaacacgtttgtcgccacgccaaggtccagtgtccaagcccagcaatggcgtgcggtgccttcatatccagcgcagcagcagcgacggtccattaattgaccacaagcccccgcccgtccgaagcaaccgacatggacatgttccaggaggacacgctgtcgtcggccacgtcgtctccggcgtcgtcgctgtgcacgccgtcgccgcacccgcacgggtcgtcgtgggtgcaggagctgagccacgaccagcagggcctgcgcctcatcagcctgctgtaccagtgcgcggcggaggtggcggcgggcgccttngaccgcgccaacttctaccttgagcagatcacgcagctggcgtcgctggacgcgccgcacacgctgcagcgcctcgccgccgtcttcgccgacgcgctggcgcggaagctgctcaacctggtgccaggcctgtcgcgggcgctgctgcccacggggccgggcagccccgcggaggcgcacctggtgcccgccgcgcggcgccacctcttcgacgtgctgcccttcatgaagctggcctacctcaccaccaaccacgccgtcctggaggccatggagggggagaggttcgtgcacgtcgtcgacctctccggccccgccgccaacccggtgcagtggatcgcgctgttccacgccttccgcagccgccgcggggggcccccgcacctccgcgtcacggccgtgcacgacgccaaggagttcctggccagcatggcctgcgtgctcgccagggaggccgaggcgttcgacatcccgttccagttcagcgccgtggaggccaggctggaggacctggacgcggacgcgctgcggcacctcctccgcgtgcgctccggcgaggcgctggccgtcagcgtggtggggcagctgcaccgcctcctggcggccgacgacgccggcggcggcaggagcagcaggcacgtgcacgtcccgggcagcagctgcctcaccccggtgcagatcatcgcgcgctccagccccagcagcttcggcgagctgctggagcgggagctcaacacgcggctgcagctgagcccggactactcgccggtgctctctatctcgccgcagtcgtcgccggtgcctgggcagcagcagcagagggaaaaggcgccgaagctggggagcttcctgcgcgcggtgcgggcgctgtcgcccaagatcatggtggtggcggagccggaggcgaaccacaacgcgcccacgttcatggagcggttcgaggaggcgctcaactactacgcgtcgctgttcgactgcctggagcgcgcgtcggcggcgcaggcgcaccggtgcgcgggggagcgggcgcgcgccgagcggctggtgctcggggaggagatccgcggcgtggtggcgcgggagggcgcggagcgcaaggagcggcacgagcggctggcgcggtgggcgcgccggatggaggccgccgggatggagcgcgtcgggcttagctacgacggcatgatggaggcgcggaagctgctgcagagctgcgggtggggcggcggcggggacgactccgcgtaccaggtggcgcacgacgccagcgggaaggccttcttcttctgctggcaccgcaagccgctctactccgtctccgcctggaggccggcggcgtgcccgcacacctcgccctgtgatcgcatcgcatcgcatgtagtatgtatgtacatcatcggcatatatatcactcgacgacgatcgtctgtctcatgccatgtttgctccctttgaattcatctgactattgcttgcagtgtgcaattggtttgctgatcgccaacacatggacgacgtcactttagttgagtccggaaagttcatgagaagtcggtggacaagaaaaggaaaaaaaaaaggctgcttcttggcctcatgtctccttgctttagactcgtgcacagtatacaagcaccagggcccggtgcaggtgcagccttgcagtgttggacggacctgaaattcaagtgaagctgctggcctgcccctgaacctaaaataaaacgagtccatcaaactttaggtaaaaatgttgaataaattataaattgaaacagagaggtataaaggaaaaggacaaaagtataactagagcgttttaatttatgggtcaagatgcaattgagcgcattcacaagttttattggggagacattaaattaggcttatttcaagtttcttttctcaacaattaaaacctaataaccagggtagcttcattctgggtatcagacgt

SEQ ID NO: 13873 - DNA, 590 bp, Zea mays
aaagcgcgccaaacaattccattccatggatgcggagatggaggacgcaggaagacagaccgagatcgagtggggcggcggcggcggcggcgccgaagcggtcctgggtcttgccggcggcgcctcctctgtgtcgctgtgctaccaccaggcgttcggtccccacgacgacctcgtgctcctcgaggccgctgacgacctcctccctgacctcctgcaaggccgggtgactgtaagagggcgtcctgatgaagatgctgtcctctgcacaccttgtgcaacttactccatgaagtttgttggcacatcaaattctatgtttttgataccacctggggaaccatctgctaaatgcttaagaccagacaacaccagtggcaatgctaatgcgttggctgctaccattaaactggcaccggggagcattgaattggtccgagtcgctccacgactagataaacttaagagccttctccgggagcggccctacatacttgatgaggatattggggatgatgacctccaacataagaataagaaggggctgtacttgcccttgatgattaatgatttctgttatacagttgctt

SEQ ID NO: 13874 - DNA, 1134 bp, Zea mays
atcttggcaatgggttatctatggaagtaaagcttatgaaaaggagggaggaaatgcttgtaagataggagcaagagataagtaaagctcttatatccaagaatggtaaaagcgaggaactcaccactcttcagcaacagctacagtctgcaagagaagaagcatcggctgctgtgaagaaactcaaagaagctgaatccgaaacacaagagttacatacaatgacacgcaggatgatcttaagcaaagaagaaatggaagaggttgtcatgaagaggtgttggttagcccgttattggggtttggctgtccaatacggcatctatccagacatctcaatgtcaaaacatgaatactggtcttcacttgcacctcttccatttgagtatgtaacatctgctggacagagagccaaggatggatccgaagcagaaggtaatggtttggaagacgtggacaagcttgttcatgatttgactgttacagcaggggaaggcaacgtagaaaccatgcttgctgttgataaaggacttcaagaactagctttcctgaaggtggaggatgcggtactttttgcccttgcccaacaccatcgtactaatgttgctggagcagctgatccagatattaaatcatctggggatgaaaaattcactgaggcatttgacctaagcaaggaggaggaagaagatgtacagttcaagcaggcttggctcatatatttctggaggagggctaagaccaacaacgtggaagaagatattgccgaggagcgattgcacatgtggatcgatcgacacggccagcaaccaacgtcacatgacgctgtggatgttgagcaaggcatacacgagctgaggaagcttggcatcgagcagctcctgtgggagctctcccgccacgaggcgaaccttgccaaagacagtccgtctgatgtcgaggacctgacctaacagtaacagcctgagcggacgacggtggccatctcccacccaaatgcagtccaggctccagccatatatttgtatatcatacagataactgggacatgtaaacattttttgtggttttggtttttcagctttgtcacaaacagttcactgactctccccgatgtacataacttccaccccc

SEQ ID NO: 13875 - DNA, 2705 bp, Zea mays
  misc_feature (946)..(946): n is a, c, g, or t
  misc_feature (2610)..(2610): n is a, c, g, or t
ttctctctgcccaagccccccgccaccagcccaccaccactgtacagcacaccactcctcgtctgctccctcaacaccctctcctctccctccttcaatgcgagaagctccgtcggcgtgcgagctctgaagccatggtagccggcgccgggaacccggggcgtcctgtcgcggttcttgccctcctcctcctcgccgccgccgcgccgcccggtgcctgggccgggtccgcggccgtgaacggggaccgcctccgggcagagcagatccggaagcaggcctcggacgcggccgcatccgctgccgcgctcgccgcggcgtcgcgccggctccacctggaccgcgcgcgacacctccgcctcctctcctcgctccaccgcaacctcaccaacacgctccgcgccctctccgtagccgccgacttcgcctcggacccttcctccgccaacgtatcgtcctcccgccagctcgacctccaagccaaggacctcatccgcgccgcgcgcgccgccctcgccgactcccagccgctcttcgacccgcagctcaagatccagcgcctcaaggacaccatcttcgcgcagaacgagctgctcgcgcgcgccaagaagcgcggcgccttcgcctccctcatcgccgccaagtccatccccaagccgctccactgcctcgctgtccgcctcaccgcggagcggattgcgaggcccgaccagtacgcggacccggtgccgccaccgccggcgctcgaggaccccgcgctcttccactatgcaatcttctccgacaacgtgctcgcggcctcgtgcgtcgtgcgctccgccgttgccaactccaacgatccctccaagcacgtcttccatgttgtcaccgaccggatgaacctcggagccatgcaggtgataatccgccgaatggacttaaaaggtgcacactatgaggtcaaagncatttgaggattacaaatttctcaactcctcgtacgttcctgtgctccggcaactggagtcagcaaacctccagaaattctattttgagaacaagcttgagaatgccaccaaagatgccagcaatatgaagtttaggaatcccaaatatctgtctatgcttaatcacttgcgattctatttgccggagatgtacccaaagctacaccgcattcttttcctggatgatgatgttgtggtacagagggatcttacaggactctggaagattgacatggatgggaaggtgaatggggcagtagaaacatgctttggatcttttcaccgatatgcacagtatatgaacttctcacaccctcttatcaaagcaaagtttaatcctaatgcctgtggatgggcatacggaatgaatttcttcgatcttgattcttggaggagggagaaatgtactgagcagtaccattattggcagaatcagaatgagaacaggacattatggaagctaggaacgctgccccctggcttgatcactttctactcgaccacaaaacctctggagaaatcttggcatgttcttggacttggatacaatcctagcatcagcatggaggagattagaaatgctgctgttgtgcatttcaacggcaacatgaagccctggctggacatcggtatgaaccagttcaggcacctttggacaaagtatgtggactatgatgactcatatattcgtcaatgcaattttgcaccgccatagaaggctttaattatcgacaacgaagaagaatcggtaaacgtggcacatacatacgccgcaagcacgttttctgtagagataaggagtttctagagtacaactgaagggaccaccacaatcttttctagctcataatgtttgccattagttatgatcaaagtaatgtttgccacatgactgcatgagcattattgtcgttgtgtgtgttagttatgtcagcaatactctgtatatgccgaagtcagatatatttctgttcacgtggatccaagaagtaaagtgtctgatgtatttacaaaaggcaccaaatactaattgtagattgaaactctacaatgtcactgtaaaaaaaaaaaaaaaaaaaggcccctaatttctccagaggttttgtggtcgagtagaaagtgatcaagccagggggcagcgttcctagcttccataatgtcctgttctcattctgattctgccaataatggtactgctcagtacatttctccctcctccaagaatcaagatcgaagaaattcattccgtatgcccatccacaggcattaggattaaactttgctttgataagagggtgtgagaagttcatatactgtgcatatcggtgaaaagatccaaagcatgtttctactgccccattcaccttcccatccatgtcaatcttccagagtcctgtaagatccctctgtaccacaacatcatcatccaggaaaagaatgcggtgtagctttgggtacatctcccggcaaatagaatcgcaagtgattaagcatagacagatatatttgggattcctaaccttcatattgctggcatctttggtggcattctcaagcttgttctcaaaatagaatttctggaggtttgccgactccacgcgtccggagcacaggaacatacgangagttgagaaatttgtaatcctcaaatgctttgacctcatagtgtgcaccttttaatccattccggcgtattatcacctgcatggctccgaagtt

SEQ ID NO: 13876 - DNA, 1365 bp, Zea mays
gaaaaaggacaatgactctctgtatctcatccttatcctttccccacgattccttctctcctctcctgcgccgccgctggcccagcgcggccgccgtgctccttctccactcgtgcttcccaagctgcttcgccggaagcaatgcgagggccctgccccggtggaggcgtctcggcgtcttttgccccgagcttcaacggctcccgcgccatgatctggccggcgacagtaaattgcacgagacggatccgcatttccttcatccaaacagccaaaacggggccgttccgcgcaggcgacaggtctacgggaggaatttgctatgctagccaggcggttgaattgctgcccactttgtaccctgaaatcgtggtccgagacgcacggctcgaggactgctgggaagtggctgacactcactgcagctcgttctttcctggttacaagttcccgttggaccttgttctccggattgatcgttacattgctctcctctctggattttcagttccacccgggtgcatgaggacttgccttgtggccgtcaattctaattctgtaaatagtagtttcaacatcgagtgtggagatgctactgatgccaactttgagaaatacaatctcagtagaggctccgtagctggcattcttacacttgatacagtggcagactatcttccgagaaggggacccctgaagcagagaaggacaggtattgcgtatatagcaaacgtcgcggtgcggaaggaggagcgacggaaagggatcgcgaagatgttggtccaagaagcagaggctcgggcaaggagctggggatgccggtcgatggcactgcactgcgacgtaaacaacgtggccgcgctacgcctgtacagaaaccaaggcttcaagtgcatacgagtgccggaaggagctaaatggcccgaacccaagatagctaaaggagcggagtacaacttcatgatgaagctagtgcccaaggcttgagtcttgaaccttataagatctgactagggaaaaaaagggtaaaggtttggccgtgtaggttctgcacggatgcacgatttgctctccattcatgtgtacagcatttggtgtatagtggaggctactttgtgaatggtatatataacagctacgtgttggtccatagtgggggactgagggtgtcggtgtttaaaccatccccagtcctgtgttgttgtgtgtatgttcttcagattctacaaggttccagccagccagaaggctgctggggcgaactgccagttctaaattgtcttttttttttgctggagatacagaccggcttgtcatatacggctggtttgataataaaagaattaaagggatatatgagggggg

SEQ ID NO: 13877 - DNA, 2588 bp, Zea mays
aactagctgccagccgcgcgcccgccgctacctgctcgcatccagcgccccgccgccacccctcgcggtgatctatgtgggcgacgtccacggctacatcacgaagctggagagcctgttccaacctctaggccgcactccccgccgacgccttggccaccgcgctggtcatcttcctcggcgactacaacgaccgcggcccgcacacccgcagggttctcaactttctcctcgcgctcccgacgcgctacccagcgcagcgccatgtcttcctctgcggcaaccatgacctcgccttcgtggcgttcgttggggcgctgccgctgccgccaacggctccctgttctttggccacctgcgcagcgccatctctctgtcctccctctctcgctcatcctcccccaccgccctgcttatttacgcccatttcttaagagaggatttgatagcctgtcagaataaaagagctcgaggaaattgcggcggccggaaattctggtcatggtgccacagaaacacgataatctgcttcgtcctcggcggaattgccgtgggggtccggcgattcttcggaggacaagcgcctcggtttcgttgagctggctaggtccatggggattagtcaggacactcatgagtcgatggcaacagatgcagccaattacctttgccaccagcttcagcatcttcttgggcctatctcttctgcgacgagccaaagtggcccctgggaggagaggtcggcgatggttaggttgactcagaagctgcagaaatctaagagaaataagcggtggcggcagaggagaaggaagcatgttgcggagctttttcagaaggagcgtgcggattatgatagagttgaccaggaagctgatgaatggagggctaagcaaatagccaaggacattgcaaagcggagggtggaaagcatgcagcagattgctagaaagaaaacaaatgaggaaagaaagcgcctagaatctgagctggagcttgccctaatggtcgagaaacttcaggagcttcggtctataagagttcaaaaaatgaagaaacaaggccattttcttcctgaagaggatgataaatacctcgagcgtgttaaggctgcagttgaggaagaggagcgccaagctgcatctgctgctcggactgatgctgttaaggatgctattctgactgctgaggagtcaaggaagcctctacaatatacaaattctcaggaaggtgattctgaacggcctaaaagtggaccatctgaagacgaggaccagggagatggcgggatgagtgagagaaatgaccaggcaagccaaaaaacagaacatgaagatgaaggtcatagatttgaggggaaagggcatggacatcatgaccctgtcagcaatctgccttttgagttctaccattattatcatggaagtgactatgacatggggacactcattgaggtccgcagaatgtgggattctttcatcagacctggaggaagccgtatacctgggcactgggttcaaccaccccctccagctgatgaggtttgggcatcttatttggtacagcacaagtaaatcaccatgggtatgagaaatggtcttttctgcttcaaaaccaccggaatctttaatggttcctgcaaggtaatctagatacttaagttagaacttcgagttttgttagaatcctcggaattccgagatgtattggttattcctgccattaattgtcgttagttaacttcagtaccttctcataaattatagaataggatgtattctacctcttggtacgtcatgtcaactaatgatatagagaagttgtataaagggtgcaagtgattgcagttacctgggttaaatttactacttcacccatttgtttgttgtataaacattttatcaattcttgattttcttccagactatgcatggattatctcgaagcttttagctgcaaaaaaaaccttataacatgtgtctgaaaaaaacttcacacgtctataccctttattacaggatgtgatattttacatcatatatgtccatttgtggcatgtgtgatgtcaactgctggactggacccctgagggcacgagtcgtggatgatggacgacacatgttgtgctggtgcaatggacatcggacgtgggccatgcgccaggagcgtatctacgtgctgcatgctgttctagggcctgttgtaggagaacaaaggctccggttctggtactcgcactgcagggcaactttgtacaatgacacatgggcttgtacacaccattgtgttcatctcgatgcagcttgtactgccaactgttgtgtcctgtgccggcattcatttgtacgtgcagacacaagtgttaaccggagcagcaagcacatctgatgctagagctcggctccacggtagcatagcatattatatattccagccattccagacagaagcggagtagctagctagaaggtgcgcgtgtgcagtgtgcttggcgggccggcggccataacaggagactggacgcatgcagctctaccctagctacgcgtctttctttggtccacacatcggagtccaggatgtctgca

SEQ ID NO: 13878 - DNA, 646 bp, Zea mays
gaattcactcctccctctgcctgtattcttcgtttcgcccctgggatcctcgtcacgactcacgccatccgcccccaccgccaccaccagccacaccatctctgttctccagtcacgccagacggccagaacccacaattttcatcacaccaaaccatccactcctcacctttccccccaaacaagtccaatctttacaacgacattgtcgccaactacaacccctttcccttctgggtgcctcaccagattacccactcaaatccagctaccaagcacaaaagctgcggcatttgccatactgtttcatccgcggaacccaatcttgccgcccgatccttcgcaaaatccaccgtacgtgcttgctgcccctgttccagtccagactctagacaatgctgtctgcgccgtggaatccgagcgttgccagctaattccgctcgggaacacgcacgaggagatccgccagttcgcaagaagcgatatccatccacggcgttgccctggctgctcgcgctccgccagctcccatgtcggacacggagctgtcccagagcacggtggtgtttgggctccgcatgtgggtgctcgtcggcatcggcgtcggtgccgccttcgtgctactgctcgtcctcatctccggcct

SEQ ID NO: 13879 - DNA, 2351 bp, Zea mays
cctctgcctgtattcttcgtttcgcccctgggatcggatcctcgtcacgccatccgcccaccgccaccaccagccacaccatctctgttctccagtcacgccagaacccacaattttcatcacaccaaaccatccactcctcacctttcccccccaaacaagtccaatctttacaacgacattgtcgccaactacaacccctttcccttctgggtgcctcaccagattacccactcaaatccagctaccgtgcacaaaagctgcggcatttgccatactgtttcatccgcggaacccaatcttgccgcccgatccttcgcaaaatccaccgtacgtgcttgctgcccctgttccagtccagactctagacaatgctgtctgcgccgtggaatccgagcgttgccagctaattccgctcgggaacacgcacgaggagatccgcccgttcgcaagaagcgataacctcccgtccatccacggcgttgccctggctgctcgcgctccgccagctcccatgtcggacacggagctgtcccagagcacggtggtgtttgggctccgcatgtgggtgctcgtcggcatcggcgtcggtgccgccttcgtgctactgctcgtcctcatctccgtcctctgcctcctcgccttccgccgtcgccgtcgccggcggcagcggtacctcgagccggccaaccccgcgcagcagctccccaccaccgccccgcccaagaatcccacgaatgccaaggcgcccaaggacatccaagaagtcccctcccacgccgccgccgccgccccagcgaagacgccgcttgcgctcgcgcaggtgctccagctccccacgccaccggtctccgagcagctcgtgaccggcaaggagcaccacgtcacgcacccggagcagcagcagcaccccagccaccggagcgacgggccttcgccgcacggcaacggcgagagccgcggtggcgccgcggagcgcgcgcccccggcggtgcccgaggtgtcccatctggggtggggccactggtacacgctcaaggagctggagaccgcgaccgggatgttcgccgacgggaacgtgatcggcgagggcgggtacgggatcgtgtaccgtggcgtgctcgaaaacggcacgcaggtcgccgtcaagaacttgctaaacaacagggggcaggcagagaaggaattcaaggttgaggtcgaagcgatcgggcgtgtgcgacacaagaaccttgtgcgccttctaggatactgtgcggggggtaatcagaggatgcttgtatatgagtatgctgataatgggaacttagaacaatggctgcacgggggatgttgggcccagaagccctctcgcctgggatgacaggatgaagatcatactgggaacagcaaaagggttaatgtatttgcacgaggggcttgaaccaaaggtggttcacccgtgatgtcaagtcaagcaacatccttctggacaagccatgggatgcttagctctcggatttcggacttgcgaagcttcttggttcagaaaggagttatgtcaccacaagagttatgggaactttcgggtatgttgctccagagtacgcagggactgggatgttgaatgaaacaagcgacatatatagttttgggattcttataatggagataatatccggtagggtaccagtggattataataggccaccaggagaggttaaggttaatttagttgattggcttaagacgatggtaagcacccgaaactcggatggggttgtggatccaaagatacccaagaaaccttcctcaagagcactgaagaaggctttgctagtggcgctgagatgcgtagaccctgatgctcttaagagaccaaagattagtcatgtcattcacatgcttgaagtcgatgatttcccatacagagatgatcgccgaggcactagagcaccaggacaagcaaggttaccagaaacaccggcaggcggatcaggtcgacctgagactgacagcagtggaaacggcggttccacacaagctgaacccttcagatggagaaacccagaggcttagtgttcatcggactactgaaaggaaagccaagccctcttgatttgtgaagcaacaagccaacaatggtgtcccctgaagtcgtgaaactctcatcttgctgatgataggcaaaggcatccatggatactgttagatcatctgtaaatgtaaaaaaaaagtaatttagccctagtaattctttcctgcttatatttatataggtggaggtatctatctatgacaaacccgttccccttaaaggcaaaatagaactttatttaaaaaaaaaaaaaatctctggggtgcctctggtt

SEQ ID NO: 13880 - DNA, 882 bp, Zea mays
  misc_feature (865)..(865): n is a, c, g, or t
agcattcatggagacaggacacaacaggaaagggagcatgcccttaggtccttcaagagcggagcaactcccatccttgtggcgactgatgttgctgctcgtggtcttgacataccacatgttgcccatgtgattaattttgacctccctaatgatatagatgactatgttcatcggattggaaggactggacgtgctgggaaatctggtcttgcgactgcattcttcaacgagagcaacactacgcttgcaaggccgttgagtgatctcatgaaagaggccaaccaggaggttcctaagtggcttgagggatacgctgcccgatcagcctacggaggtggaggtggtagaaaccgcagacaaggtagcagtgccagatttggtggccgtgatttccggcgagataggggcagtggtggaggatatggtggtggttcctacggaggaggtggtggtggtggatatgggggatcatcaggatacggtggtgcctatggtggcggtggcagcggcggcggcggctatggtggtggtcagagtacgagttcttgggactgaactgaactctgattagaagtgaaaaatgggccaaccttttgggcgtgaaaaatgggtcaaccgttatcgattagtccctgttggatggagcgaatgcttgaaatttgttgcttgacatacgattaatcttgcgttgtgttgtgctaagggattggcttatgttattatctggattggtggtttttctacgcctcatgcttgtgctgtctcgtttcacaaaaaatcttttttgcttatgtcatagatataatttcatctaggtctgtcatttatatcaaaaaaaaaaataaaaaaaaaaaaaaaaatnctaagggcggccgctaa

SEQ ID NO: 13881 - DNA, 1544 bp, Zea mays
tgtgcattttatttgttattattactagtatatcattagaaaaagagtacatatatcagaagcaattttgttacctatgttttttttaaattattgtgtatctgctaaatgaataaagctcaaaaatcaaaatctgagcattcaataaataaactcaaactctcaagtttgtttttttatgtttcttcagtacggtaaaagttgccattgatgtgtacgtttgaaatttaaattattatttttattggatagtgttattacggtattggttacatctagcaattggaatacaaaagaacacatcttctggccctattattttatttaccaaaaaatcactgttttctttggtgctcttggatggagaattaatcattccagtacaattcatgagtagaaaggtaatgagttgcatatttataaaatagattcacttttcatccacatggactcctttatttttaatgctatggctattattgtaatcctaatgttcgagattccttgatatttgaccatagcactgtttgttctttatacaggaaagggagcatgcccttaggtccttcaagagcggagcaaactcctatccttgtggcgactgatgttgctgctcgtggtcttgacataccacatgttgcccatgtgattaattttgacctccctaatgatatagatgattatgttcatcggattggaaggaccggacgtgctgggaaatctggtcttgcgactgcattcttcaacgagagcaacactacgcttgcaaggccattgagtgatctcatgaaagaggcaaaccaggaggttcctaagtggcttgacgggtacgctgcccgctcagcctacggaggtggaggtggtagaaaccgcagacaaggtagtggtgccagatttggtggccgtgatttccggcgagataggggcagtggtggttcctacggaggaggtggtggtggtggtggaggatatggcggatcatcaggatacggtggtgcttatggcggcggcggcagcagtggctatggtggtggtcagagtacgagttcttgggactgaactgaattctggttagaagtgaaaaatgggtcaacctgttgggtgtgaaaaatgggtcaaccgttatcgattagtccctgttggatggagcgaatgcctgaaatttgttgcttgacttgcgagtacggtgtcaggaggtttcccagtgccttaatcttgcattttgtgttgtactagggattgcttatgttattatctgaattggtggtttcttttctacgcctcatgcttgtgctgtcttcttcacaaagtatcttgtgctaacttctgatcatagatataatttcatctaggtctcatttatatcaacttctgactttgaccatcatcgctgtcaaaacttcttacacatacttttatgtagatatacctctgttctctctgtgttagatagtatatttttatagacatttgctgtttaagagtaattttttcaaaggacaaataacaaaaaataaaatcttttagtcccaaacaaagttgag

SEQ ID NO: 13882 - DNA, 1846 bp, Zea mays
tccaattagggataatatttttacaaagcccgttgttcgggtactgccgatccaataaaactcctgccattgtcctatctttttctcctccattccccactgcatgcgcgctctgtcactgtcagtctcactctcgctcgctaccttggcgacgactggttgaccgccgctgccgctctagagcaggtgcccactgcccaggtcttcttctggtccttcgccggcgacaagcacaaccagggtgattcaagtactctgctttcaccaatatgtctgacggtcaggaaactgacaagaacattgagatttggaagatcaagaagttgatcaaggcattggaatctgctagaggcaatggcaccagcatgatctctctgattatgccaccacgtgaccaaatttcccgtgtgaccaagatgttgggtgatgaatatggtactgcttcaaatattaagagtagagtcaaccggcaatctgttttagcagccatcacctcagctcagcagaggctgaagctgtataacaaggttcccccaaatggacttgttctctacactggaacaattgttactgaagatggcaaggaaaagaaagtcactattgattttgagcccttcaagcctatcaatgcatccctgtacctttgtgacaataagttccacactgaagctttgaatgaactcttggaatctgatgacaagtttggtttcattgttatggatggtaatggaactctttttggtacactgagtggcaatactcgtgaagtgcttcacaaattcactgttgatctcccaaagaagcatggaagaggaggtcaatctgcccttcgctttgctcggcttcgaatggaaaaacgtcataattatgtccgaaagacagctgagcttgctacacaattttttatcaatccagctaccagtcagcctaatgttgctggacttatattggctggttctgctgattttaagacagaactgagccaatctgacatgtttgatcaacgtctccaggccaaaatacttaatgttgttgatgtttcatatggcggggagaacggttttaaccaagctattgagttgtcagctgaaattctagcaaatgtgaagttcatacaagagaaaaagctgattggaaagtattttgaagaaattagtcaagatacgggtaagtatgtgtttggtgttgatgacacactgaaagcccttgaaatgggcgctgtggaaacactgatagtgtgggaaaaccttgatgtcaacagatatgtgcttaagaatactgcaactggagaaactgttatcaaacatctgaataaagagcaagaagctgaccagagtcatttccgtgatccatctaccaatgctgagctggaggttcaggagaaaacttcgctcttggaatggtttgccaatgagtacaaaaagtttgggtgcacacttgagtttgttaccaacaaatctcaagaagggtctcagttttgcagaggatttggtggcattggtggcatgttgcgctatcaactggacatccgttctttcgacgagctttctgatgacgaaggtgtctatgaagattctgattaagcaaacgtcattcatatggctgtgctggaccctggattgatgcaattgctcgttttgttcttctattttttgcttgattagtcggtttttgaggagattaccacttgagacacttgctttgtttccttgccgcagcttacaattgcaatgtcaaccacatcattagaatctggttgatacctcatgtactgctgttatgttgacatcggctctgtccaatatttatcaagatttggtgtagcgaatcaaaaaaaaaaaaaaaa

SEQ ID NO: 13883 - DNA, 1391 bp, Zea mays
atttaaattggagcccttgtgccaccggagcgtggcgacaagccgcaacgcgacgtgctcctccccggaacagcgccacccaaccacgcgacgaccgccaccgcccgaccgccgccgccccggttccgtccatcaccttcccctcctctcctgcttctcctccgcattattctcgcgcgctgctcacatctccctctgcgccgcgagaggaacgcgtccgcccagctgcgcgcggaggtgtgggcggcgctgagttacgtgcagcagcgcgagagaatggaggctgcggcagcggcagcggcggcagctccagcgcctgcgggggagagggaccccgagcaccaccacggatgtctggccgtcaggacgtcgctgccgcggtgcgccatcggcgccggcggcggctcctcgctgcctggatcttccgatgaaacatcatgtggatcaccgagatggatagggagaggcctctcgtgtgtgtgcatcaagcggaaaggcacatatgaaaggatatgcatgaacctcacaccagtgcaggaagaaaggcttcagagattgaagcatcgcatgaaggtttactttgatccatctagacgagatcaccaggaagccctgaaagctctttggcatgcaacataccctgatcaagaacttgaaggtttgatatctgagcagtggaaggacatgggctggcaaggaagagacccatcaactgactttagaggcgcaggattcatatccctggagaatcttttgttctttgccaagacgttctccgcatcgtttcagagacttctaaataaacagtgcggtaacagagccacatgggagtacccatttgcggttgctggtgtaaatattacattcatgatcatgcagatgctagatctccagtctactaagccaagaacatttgtgcgagccatttttatccaaatgctctcagaggatgagtgggcatttgatctgctctactgtgtcgcatttgttgtgatggacaagcagtggctggacaagaatgcatcttacatggacttcaatgaggtgctgaagtcgacacgagcccagctggagagggagcttatgctggacgatgtcatccgcatcgaagacatgccgtcatacagcctgctttgctagtaaccaaaataccaaattcgccggagaacagaactgagttgatggttcaactgtatagtacctccctttgtctgatttctgggaggattttttttagcaacaaagtagagtgatgacgtactggtatcatgcttaatttgggctaatgatggtgatatgcacattctcagaagtgttacaatgttctgtacttgtctaagcatttgtcagatatctaatattgttcatttgatcctttgatccacccaaaa

SEQ ID NO: 13884 - DNA, 2445 bp, Zea mays
tagcgtggtcgcggccgaggtaccttttatgggaatgaatctggagatgcgctcagagacgttgaattactgaacgctgtcgccaataattctcctaatgtcatcaagtttttgacagtcatgacactctgcaatacagtaattcctataaaaagtcctactggaccaattttgtataaagcccagtcccaggatgaggatgccctggttaatgcagctgcaaatttgcatatggttcttgtcagcaagaatggaagcaatgcagaaattcacttcaaccggcgagtgatgcaatatgagatacttgacattcttgagttcacatctgaccggaaaagaatgtctattgttattttggattgtcagagtggcaagttttttctcttgtccaaaggagctgatgaggcaatgcttccttgtgcttattctggacaaaagacaaagacatttgttgatgcagttgacaaatatgctcagctggggttgcgcacactctgcttgggatggcgtgagctggaaccagaggaatacactaaatggtctcaatcatttaaggaggccaatagctcattgaatgacagggagtggaaagttgctgaggtttgccaaaagctagaacatagcttggagattctaggtgtcagtgcaatagaagatcgcctccaggatggggtaccagaaactatcgaaatactgaggcagtcaggaatcaacttctggatgttaactggtgataaacaaagtactgccattcaaattgctcttttgtgcaacttgatttcttcagaacctaaaggacagctcttgcatatcaatgggaaaactcaagatgaagttgctagaagcttggaaagagttcttcttaccatgaggattacgtcatcagagcctaaggagctggcttttgtagtggatggctgggcactagagattattctatcacgctatactgaagcttttactgaactagcagttctttcaaaaactgcattatgctgccgtgttacaccttcacaaaaagcacagctagtgaagcttctgaagtcatgtgactatcgaactttggcaatcggtgatggtgggaatgatgtaaggatgatacaacaggctgacattggtgtaggaattagtggtagggaaggtcttcaagctgcaagggctgctgactatagcattggcaaattcaggttccttgaaaagttgattcaattcaggttcctgaaaaggttgattcttgttcatgggcggtactcctacaatcgcactgccttcctgtcgcagtactctttctacaagtcattgttaatttgctttattcagatacttttttcttttctttcaggcattgctggaacaagcttattcaactcagttagtttgatggcttataatgttttctacacaagcattcctgttttaacgactgtactggacaaggatttatctgaaaagacagtgatgcaaaatccagagatattactttactgccaagctggaaggcttctcaatccaagtacctttgctggttggtttggtcgatcattgtatcatgcaatcattattttcttaataaccatccatgcatatgctaatgagaaaagcgagatggaggagctctcaatggttgcactctcaggaagcatttggttgcaggcatttgttgtgacgttggagatgaattccttcacatctgtgcaacttctggccatatggggaaacctcattgccttctatgccctcaatttctttatcagcagtatacccacttctggaatgtacactatcatgttcggcctttgcagacaaccgtcatactggataacgctggtgttgatcagtggagttggaatgggtcctgtattggctctgaaatatttcagatatacatacagacctagcgtgatcaacattcttcagaaggccgagcgttcacgggggccaatgtacaccctgctgaatctagagtctcagttgagatcagacaaagatagtatgatggtagccggttccacagcgccagccaagaataagagctctgtttacgagccgttgctttctgactccccgatggcatccaggagatctcttgcaccagcatcttcatttgatatcttccagccagcacattctagaacatctcacccaagaaacataaaagccaattaattttttggaacaacagttaactcgtaacagtatggcataccagaatgacaaaaaaaaaagatgtcagtcgaattagatatgttgcatatttctgttaatgatttagtagatattgcccaaaaagatataacgaaaagtcatacttaatcctttatagctgttagcaaaaatgggtagtgaccatttatgttctctatggggaataaattaatttctccaatccaccagatgcaaaaaaataaacttatgtcccagtcaggccaaaaaaaaaaaaaaaaa

SEQ ID NO: 13885 - DNA, 2281 bp, Zea mays
  misc_feature (1595)..(1595): n is a, c, g, or t
actcctatgcgcctttgggcgcccgttggactccggccggccgcccccccaccaaacaaccatggccttttctgccgccctcgcctgggccgccacgcaactcctccgcgggagcctccctcctgcccgcttcgccgctgccgtctcgcctctcacatacagcagcagccgccaactctgcagtacccccatcgccaacgattcctccgccgcaggaccgtgggacgaggccgagacggagatcctccgcgacgtcgagcccatcgtgaatatcgtcaaggacatcatccactcccgcaggtataaaaatggtgaatttttaagcccagatgatgaaaaggttgtaagagaaaagcttctttctcatcatcctcgtgcagaagaaaagattggttgtgggcttgatggtataatggttgacaggcaccctgagttcaagtcaagatgtctctttgtcgttagaacaaatggcgattgggaggatttctcataccacaagtgtctccgggcataccttcaaaagaagtatccatcctattcagacaagtttctgaagaagcatcttgttaacaagagctccaatcttttccgtgttcagaagaaggccatggtggatcctttgcctgctggcagttgacaggatcttaggtttccctgctatggttagggcttagaagtgttatatggtcttcggtgaacaaatttaatgtgttttttttataaataaaaattaaactggttatgactatggcccaaatacatattttgggctgggatcgtaaggatgttgcatggtgaacagatttaatgtgttttttatagttgatacatgcatggatcgtgttgatccttgctgctgcatgatttacccacctatgatctgtacgatttaccagtcttggttctgcatgatttaccaaactctgtcgatcttcacatgtcctatttattgcaatcgctgtgcatttcctggagggtgggtgccggacagcttttgactccgtagctttgtccgctgagacgaggagcaaaagactatctccatccacggtctctgtacataaatatctatattagagatatatttatttataatactcttacatatattatataaattttagttttgttaaatctattgtttaaaatattataatggattcaggagaaaataggaactatatatatagaggatccaacattgtcttttatatctagagtactgttagattgtgtttggttgtaatgatgggatgagacgattctttagataaggttgtttgttttaaagttaggggctgagataggactatttcaatgttgtcccataaaattagagggacaagaggggatatcagatgacattgttggaggaatataggacgagaatctctcctaattatagggtacaatttcctttagcacatgcaagggagatggaggattggaggggctacaattcctttgcttccaaacaagcctttagaattcattgctagagagagccatgttgcttggtttctcctctatcggtctggtatttgttaatcatgtccagttgcattttcttgacgcctaaaaattagttgatatgntagtcgaatttgttcaaacttgtttaaacgtgtaggaaacccattgtgtgcacttcaatctattttctttataaaaaacaccgtgtatgaaaagatgttcacatacacgcagttacaccttactttcgtgaatggttacgaaagccttggtcagccatatctgtcctcactattcaccgctcttgtgcgagatcatatgtgtgcacggagcaccagtaatagctctagaacagggtctttattttttagtttctctaacttttagaatttgattggttgcatggggattagaggggcatcccatgcaaccaaacaagctcttaagtgcctatgttctcagctccattctagcaatggcctttaaaacagaattctcaaactcattctgatagagaatgacgtctgggactagtgaaccattgactaggtcaaaaggtaagagtgaaggcagatgcaaaccacgtcgtcaagggggagtgtggctagctacgggcttccaatcaatgctagaaatcgcgctctattaggaagttgcacaaggagttgtgttgaggctatgcctagtagatcatgcatatgttgaggctatgcctaacagatcgtgcatatgactgtgcaaaacattattttgcacgtttttgcacgacagactgtattgtttatagaatggagtttgaaataagaga

SEQ ID NO: 13886 - DNA, 859 bp, Zea mays
ctcgaggccggcccggccgcgattacggcggttcaagtaggtttgtcccgtcgtttcattccggccggccgccgccacaccaaagcaaccatggccttttctgccgccctcgcctgggccgccacgcaactcctccgcgggagcctccctcctgcccgcttcgccgctgccgtctcgcctctcacatacagcagcagccgccaactctgcagtacccccatcgccaacgattcctccgccgcaggaccgtgggacgaggccgagacggagatcctccgcgacgtcgagcccatcgtgaatatcgtcaaggacatcatccactcccgcaggtataaaaatggtgaatttttaagcccagatgatgaaaaggttgtaagagaaaagcttctttctcatcatcctcgtgcagaagaaaagattggttgtgggcttgatggtataatggttgacaggcaccctgagttcaagtcaagatgtctctttgtcgttagaacaaatggcgattgggaggatttctcataccacaagtgtctccgggcataccttcaaaagaagtatccatcctattcagacaagtttctgaagaagcatcttgttaacaagagctccaatcttttccgtgttcagaagaaggccatggtggatcctttgcctgctggcagttgacaggatcttaggtttccctgctatggttagggcttagaagtgttatatggtcttcggtgaacaaatttaatgtgtttttttttataaataaaaattaaactggttatgactatggcccaaatacatattttgggctgggatcgtaaggatgttgcatggtgaacagatttaatgtgttttttatagttgatgc

SEQ ID NO: 13887 - DNA, 687 bp, Zea mays
  misc_feature (354)..(354): n is a, c, g, or t
aggtttgtcccgtcgtttcattccggccggccgccgccacaccaaagcaaccatggccttttctgccgccctcgcctgggccgccacgcaactcctccgcgggagcctccctcctgcccgcttcgccgctgccgtctcgcctctcacatacagcagcagccgccaactctgcagtacccccatcgccaacgattcctccgccgcaggaccgtgggacgaggccgagacggagatcctccgcgacgtcgagcccatcgtgaatatcgtcaaggacatcatccactcccgcagaccagtgcttctaccatggtagggtcaaggcgagtacgaaatggatcaagtacacggccaccnagcactaaaagcagattccgttgacacttgcatagctcagacatcacgagcaagctagcccaagagaggatattcttctttgtgtgctttccaccatgctaatatgtcaaaagtgtgttgattacttttaccaacctttagtattggatctgccaaatattttctaagtcacttgtgtcaatagaatcatcatgaccttgtccatcaaatatgtagctatcaagctcttctttgatacttgacttaatcatgtcaactgctgaagttgaggaaggtgcaacagatgatgctgagggtgtagtagagacatagtattgatacatctttttcatg

SEQ ID NO: 13888 - DNA, 2459 bp, Zea mays
ccaaaccatccttttaaaaacattaaagtttttggggttaaaaaaagtattttcattttatggaccgccctaaggcgttaagaagtcccattctcaaacaaatgtttcccaaaaatttccaaaatctgcttgaaccagcacgaatggctttgtcaagatcatggttgatgtgcagaccgagcgcaaggtgcccgagcaattagcagtgatatcctctctttggtaaagtgtgtcattctcatctactgagaagtcaaatgttttcattttgaccaaacatacataaaaggaatacatttttataataaatctatttaaaaatataatgttgtcaataccttttacaaacccaatcaaacttaagaaaatttgaccagcacaaaccctatagcgacacttttgcggacaggagtattcagtaacgctgatgcataaaatgactgaattttttttttttttttggttttcttagtgcttccattcaaaattgttgcatcaagtacatgttcaacacgaccgtgatttcacgcagaaacaatactttcatttcacaggcgataaaactgggacaaaaatcaatgctaatgaaaagaattacggactacccatacaccactcacaagcagctcctacgaaacaccacggttatctgtacaacgcccaagacccaaaatgttgaatgaagggcctggtcatgattttgcaaacagctgagcagcattcagattgcaagcagccgttgaatccctaaggcagctgcagaaggcatcttcatcggtaggaaatgaagctggcagtggtcggtctggaatcacaccaaccttgtcaatgtcggtatgtgcaggagtttcatagcgtgctacggtaacagccaagccagatccatcagataatccgaaaaccgactgaatcttcccttttccatatgttggttccccatatacgactgccctcttattgtctttcagcgctccagcaaggatctcacttgcacttgcagttcctttgtttaccagcacaaccaacggttctgatgcagcaattgtatcagctccatcagcctcataaatgtcacgaacaccttggctatcgcatatatatacaataacacccttgtccatccaaatctttgcaatttgaattccttcaggaaaaaggccaccactgttattccgcagatccagcacaaaggatttaacattgttgtccctcaatgtcttaatggcttccttaacagattctgcagcattttggttaaatgttgtcaatttgatgtaaccgatctttgagctatcttttgaacctggaatctcacacatccttgacctcacggggtttaaattgactgtttgtctctttagaacaacatgcctggtattggtcccactacgaatagacaaatctactgaacttccttcagggccctgtaagcgttctgcggcatcatatatatccatatcttcagtgcttctgttgtcaattgccaaaatggtgtctccaggaagaatgccagccttttctgcaggaccaccaggggtggctgtcatgacagcaactcctgaaggtgatccattaattgccattgggtaaccaatcgataaacctacacccgtgagtgcgccttgcgtaccagaccgcaagctcttcaatttctcaggttctaagaaacgagtaaaagggtcatccaatgttgaaagcattttcttgattgccgcatatgtctcttcccttgtgttcatcggttcattgcgaagggcattttcacggtatctaaaccaactttgcccattaaaagatttgtcatagtatgctcgatcaaccgcgcgccaagcctccaggaaaagcaagttttcctctgtgagcgccgatgatgacggtgctgtataagaagctcccgagatggacatgacgagcaccacccctaaaacgacgcgttcgaaaccaccagcggacatgaagtgcctggataccccatctggccgcagcgcgctcatggccttgtagcaccggctgaggttgccgtgcaaagtgaccatcagtgaagagtaacgggacagcattctccttattggccgcgtcaatctggaaacggacggtccactcgccaaacactcggtggatctcctggagcattgcttcgttcgagcgaaacggcaggctgcagcccgcagtggtgggtggggcaggggttcccaaatcgatacgactgcgaccgtgtgaaggcggcgaaaggacgcccgagacggcgaggcggaggccgccgagttggagacgaagagcgggcgggagcacgtcgccatcgaccttccccttctcgctcaccaggcgatggcttttcgaatggaacggagactagcgaggtcgaggcctcccgttttctggggtcgccgcttttccaactccaaattgggggaacaaattctttttcgattaggatgttctaggtaatggtctcgtgc

SEQ ID NO: 13889 - DNA, 2559 bp, Zea mays
gtcgacctgcagttgattcagcaattgttcgaagttcaaacgatggctaggaatcgaagcttcagcatggccacagcataagcaatcgatagaaacagaacgcactactgcgctagtctctagctaccccctcacccagaaccgaccctaccgacaagcgccgaattgttttgatgaatgcagtatacaaacagctgagcttgatagaagggaggaaggaagggtgtgtgtgtggggcagcgacagaaagctaggtgagatcaccgtgcgaaggcggcgaaaggacgcccgagacggcgaggcggaggccgccgagtcggagacgaagagcgggcgagaacacgtcgccatcgaccttccccttctcgctcaccaggcgatggcttttcgaatggaacggagactagcgaggtcgaggcctcccgttttctggggtcgacgcttttccaactccaaattaggggaacaagttcttctgcgaggagaggagccgaggagtagataatggccacggaatcgccaggtgcggagacaccacaagctcagctctggaagacgacgacgatgggatggcgacgctggattgggcggccaagctgtctggcccaccactctgacgaggctgcacttttccgggcgggctgggtggctgggcaacggccacgcgacgcgacgcgtgtgtgggccagatcactcaggtggaaattattgggctgggccgtatctgtccgaggcccacttgtctggcctcgcttcgttgtcttgtattactgggccgttttgctgaagagacacacccgccggcgactaacaaaaccctcgccagcctttcccgtccgccggccgccgctaatggacgccggcgacgcctccaccgcgcttgccctcacggcggcggaaccatcaccgccgagccccaacaggaggggcaagaggccgaccaacccgcccaagcgcttcgtgcacaccccgatcccgccttcaatcctctcggacccgaccctggccgccgccgccacctccctcctcccggccaactacaactttgagctccacaagacggcgcaccgcatacggtccgcggccgctcgccgcgtggcgctgcagctccccgagggcctgctcctcttcgcgctcccactgtcgcacctcctcgcgccctacctcgagcccggcgccgacaacgacgtcctcgtcctcgccgacgccacctacggggcctgctgcctcgctgaccgccccgccagggcgctcgccgccgacctcctcgtccactacggccactcctgcctcgtccccgtcacggcctcactcctcccggtgctctacgtcttcgtcgagatccgcgtggacgccgcccgcctcgccgccgccgtcagagccgccttcccggacccagcggccgcgccccgcctcgccatcgccgggaccgtgcagttcatcgccgcggtccacgccgcgcgcgagatgctcacggtagagggctaccacgacatcgtcgtgccgcaggcgaagccgctgtccgccggcgagatcctgggttgcaccgccccgacgctcaagaagtcggaggaggtgggcgccgtggtgttcgtcgccgacgggaggttccacctcgaggcgtttatgatcgccaatcccggggtgaaggcctaccgtttcgacccattcctcggggttctcgtgctggaggagtatgaccatgttggcatgaagcaggcgaggaaagcggcggtgctggcggccaggaaggccaagagctggggagtcgtacttggcaccctggggaggcaggggagcaccaaggttcttgacagggtggtggagcatttggaggagaaagagttggaacacacagtggtgctcatgtcggagctttccccggcgaggatggagctatttggagattccattgatgcctgggtgcaaattgcttgtccacgcttgtcgatcgactggggggagggtttcaagaagccagtgctgacaacgttcgagtttgatgtcgcactgggctatgtccctgggtggtgggagaaggggagcaggggttgcggtagtgaatgtggtgttgggtgttgttcaggatcaggaactcgtggaaactgcaactgcagtgatggggattatggtggtgactacccgatggattattattcgcaagatggaggtgattggaatagctgctacatgaagaagaagccatctactggcgagaggaaactgcgggttcggattggcaacgaaattcaagccgaggagaagcgtgggaatcaggattctcgtgagctagtcaggtgaatagggataccgagaacagcttcatggctcaaaaaggatttttgacaccaggttttagtgtgattgtaacgatgtttagttaccagagggaaaatcttgtgactgtacctgtatcgatgtatccaccaccccatatactgtaaatttgttacgtacaatgtctcattgtaaacatcttgagaaggtatgaggtgttgtcatacccattggtgcaaccatccaaaaaaaaaaaaaaaaaaaagggcggcggacgcgtgg

SEQ ID NO: 13890 - DNA, 1932 bp, Zea mays
aggccggccgggccggggttccccactactcttcctcctccaggctccaacctcccctcctgtctctccctccctccctggcagcgactactccccaacccgcacgcacgccgtgagcataaagccgtcgcgcgcccacacgcccgttttcatttccatcggttccctttccaaactcaacggccgcggcagggagcaggcacggtcacctccctgacccgttgagccgtcaattttatcccgccccgcgatttcctacagctgccgatcgaggaggaggcgcattgcccgcattcttctccgcttccaccgagagggcctcgcctgatcggcgccgccttggcccccatgacgtgtgtgcgcgccgaggacgccgtctcgcccgccgccgccgacgacgtggcggctgccctggtttccaggggcggcttgatccagaaggtggctgccggcggcgggcggagaccggcaggctcggcgcgctcgctgcagcgctcagcacatctggccaccggggacggcaacgctccggcgccggcggtggaggccagttgctcctggtccggggatgggataggtaagagcaacggtggtgggaagagagatgatagacacaggatgcggcagtacaggtcgcagctcgaacaggaggtcaagaaattgcagaggcagcttgaagaagaggttgatctgcacgtggcgttggcggatgctgttacacaaaatgttgcgcctatactgaagtcttctatgaagcttccacacaaggcacaggagctactgattaacatcgcctccttggagattaccgtttcaaaccttgaaaagaagctaaatgatctgtactaccagctttgtcacgaaaggaacgaaaggttacttgctgaaaataatcagggatgcttgccatctacatcctccgatgagcaccagtcattgtcaacttgcacgtgtacgtgggaagagcacatatcatcgttgagagatttgaagtttgggggatctgaatcaatgagatcaatgagacaggacttattccccgagcttgaagatgaccaggatatgggagaagatcctgagggtcaacagatagtttctttaaacaggctgctagaaaagcaccgagattcttctttgaatagacttcttgaaaagcatcgagatgaagagatgcaagaatctggctccatggaaaatgaaggcaatgaaaatgagcagcctgacacgttatcctttgaacagtctattctaaagataactagcataaaaggagggaatctttggagcaacccaaatgagctctctgaggagatggttcgctgcatgagaaacattttcctacgcttgtctgaatccttgaagatatcgccgaagacatcttctgattgttcatcttcctccgtggagcgtctatcaggctccacgttagcatctttctcagattcatccataatgccctcaatgctacggagtccttcagttgattctaatcacaatgacgagacgatgaaggaagtcaggaactttgatccgtataaagttaatggaaaggaaacccgaagagatatcggaaactatcgttcagcagctgaagtatcttggatgtctgttggaaaggatcaactagaatatgcatctgaagctttaaagaagttcaggtttgctgctacagccttggctaaacctatgagtcctcatagatatatcacatgtctacaaactgtacaaaccttagtgcatatatacaaaaattttagcatatgatgtatacctttaaattttgttcagccttgttaatgttctaaaagaatatgcagacaatcgaaccagtctagggatttggattgggggaacaaatggatgctctattcttgttcgcttgcagtaaagcaatcagtttcaaaattggtttgcggaaaaaaaaaaaaaaaa

SEQ ID NO: 13891 - DNA, 2549 bp, Zea mays
  misc_feature (1878)..(1878): n is a, c, g, or t
  misc_feature (1987)..(1987): n is a, c, g, or t
atctaggccgaaacaaacatgagacctaagtggcacaaattaaaattgaactatatactggccacacaatcgagcggatcacctgccagttcatgtgactttatcatttggaaaaagatgtccaaagtaaatgtcaatgtcatggattgcaagtcctggatcttgattacaagctggaaaatttacggctgacgatgtttattgggctgttacaaactgtgaatcgataaactatgtacttgctagttgctaccatgttgcactctgacatctataagttagcatcaggattgacacaggagcagcgaacgaatcaatgctgattagtaaaagtatgcatgtatgggatcatcccctgcgcctatctaacctcacattggtatgcatgtcacgttgccccctcttgctcgtcagtgctcccagagcagcaacggctcgtcccaggacaaatcatagctacaagacgtcgacggcggcggcagcggcagcgcgaagccgaactcgagtaggatgtccggcagctcgaagaccgcgagattaaggatgtgcccgtcaccgtcagccagcatcgaatggtcagacggcgcagcccgctcttcgttctgggcattgtcggcgttgttgccggacgagctagatgcggccggcccttcgttttcgtcatttttgcaggcgccgtcgcgagactcgctagaagtgggcggcgccacgctctccatctccatcgcagccgcgagcgccgccgcggcacgcacgtcctcgggggccgccgatgcggcgcgaggcagctcgtgggacatctccgggaagttgaggtgcgcggcgcggcccttgatggcgagcgccgcgacgtcatgcgcgcgcgcggccatctcgggggtgtcgaaggtgcccagccagatgcgcgacttcttgcggggctcccggatctcggacacccacttgccccacgcacgcatgcgcacgccgcggtacgttggatgcttcagctcccggcgcggccgcttccggctgctcgagctgccggcgccgtcgctggtgtcgtccaaatactgcgacgacgagacaggggagttggggccggtacagccagagctgctgcaggtggtgctggaatcggacaccgggaacagtgcccgctcttccatgggcgatgaacactgggcaaagctggcagtcacaagcaagctcatgtgatgagtgatgactttgttacgagctccgagtgtgagcgagcgagctatatactggaagggaggaattaacaatttcgcttcgtccaagtggaaagtatcatggcctcatgggtaatagatttttttctactttcccgaaagaaatgtgatagtcatgagaggtggtgctaaaatgaatagaaaagggctagacaacgtattaataacacgcgctttgctccaaggtcgtgtattagtgtattactactgcagtgagtgaattgcaacttggtcaacctgatgaaccttcatggtgctgggtattgggtggcaagctctgcaccaataaacatgataaccttggaagatgccatttccagctggttctgtaacatgataaccttggaagtaccatggacatcggtgggggtggggggtctaattctcaataagaacttagattctcgcaattgacaaacatatgtagtttatgtttttattagaaatgcaattcccatgccagttgtttcactacgtttgtaaagcttcaaagccaagctagcaaagcgtttaaatttgctatagatatgttagcctccaagatccaaatatatggtttttggcatcttaaaatgatctctacaaacaaaaaacaaaccttctacaaatctaatgacttgttaagtaaagaccacgagcagcntctaacactactagaatctagctctttgtcaagtgtcaagtggtttgtcgagtattttttttcaaaacactcagcaaagagcttctttgccgaatattttttacactanataaagatcttctttattaagtatttttcgaccctggtaaagacagttatcaaatcacattttgaaacagtaaattaattcaaataaaaaaagattttaactacaaagatgtataactcatcaagatatacattttttgttttagtcatttcttcatataacaaaaaataaataaatttgttcataaaacttatctctctcttagtttataaaactataagagagatgtataagatttgtgaacaatattagaaataccatgttggatgaacaaatgatcaatcaaccaaaataaactttgtagatcttgagaaataatagaattttgtagttgacaatcttttgatttgaagtcatctcattaacgaaagctatgtatgaattcaaaaaaaaatcaaatgacctcggatggaaaaaccatcaaaatgaaagttttaggtcttgaaaagttaagaaactttatagttgataactttttgatttgaaatcaccttatcatgcaaaaatatgtttgaatttcaaaattcaaatatttcaagcgacctcggctggaaaacccacc

SEQ ID NO: 13892 - DNA, 2665 bp, Zea mays
taaaccctagccgaccgcgtcacgccgccccccgccgccgccgaccgcgtcacgccgccccccgccgccgaccgcgtcacgccgtcccccgcagccgccgtcgccgaccgcgtcacgccgtcccccgccgccgaccgcgtcacgccgtgccccgccgccgccgaccgcatcacgccgtcccccgccgatgagtaatcgaccgcgtcacgctgccccccgccggttagcctcgtcgtctaccattcgccgtctcatacaggacggtgacctggccgtccccggctcctctgcggaggacgtcgcccacgctctccgcaaccaccgtcctgagctccgccgcaagaggctcaagcccttgacggaagccgtccgccgtgtactatcctctgactttgatgacgacgatgatgacgactccgcctcccgcggtcaccaaggtgcccacgccaccctctcctccaccacctctctctcggacgaatccgcccacccgccgcctccaccctatttcgatgccaccaagaccatgcttcgctcccagtatgcctcgcagacgtccaaacagaacccaggcactaaccagcagctggaaatcgagatgaccgctgagaaggctcgccgcctcatcacatctgattgtggaggcggaggtggcgatgccaagccagaggctccggtctccgaaggagtggtcaatggggacaagtggccgcgttttgctgatctcggcgggatggatcaggtgttagatcagcttgtggtagaagtggtggtgcccctgtgccatccggagctgccggattaccttggggttaggcctgttgctgggctactgctgtacggaccgccaggttgcgggaagaccacccttgcacatgccattgccaatgagactggtgtgccgttctacaagatctcagccccagatatcgtgtctggagtatctggtatgttttctgacacttgcatcacagttgaaaaattctgacgctctgtatttggacaaataagtcccatatcatttgcattgtgaatttgtgatcatgaaatcattatctttctgaatagctgctgaaggatatgcagtttttgtccctcaacttgtgtccatggtctgatgctcctgatagataaagttgtgtgtcaggattcatgcagaagacatcacacaatgcttgtgtacttgcaggaggttctgaagaaaacatcaggggcttatttcagaaggcatataggactgctccctcaattgtattcatagatgagatagatgcaattgcatccaagagggagaatctgcaacgagagatggagcgacgaatagttactcagctgatgacatgcatggatgaattccaccagaatattggtggtgatggttctgatgccgattcatctgaaaagaaaccaggttatgttattgtcattggagctacaaataggcctgatgctgtggatcaagctcttcgaaggccaggaagatttgatcgagagatatatcttggggttccagatgtgaattcaaggaaacagatactgatgatgcttgctcggaagcttcgacttgaagggcaatttgactttttaaagatagcaagggccacaccaggttttgttggtgctgacttgaaagcattagtcaataatgcagggtatctggcaatgaagagattaattaataaaagaagagctcagtattgttctgaggtaaaggtaaaatggtggaagcagctgtcttgggatgcaggcgagatggagagtgtacatgtcaccatgaacgactttgaggtatacctttttcatatagagctcacgacaagaatcctgttttaatttacccattgtaagctggatttagattgtagcttgatctgtttccataaaaatctcggtaattttccccgctattaactttctgttgtttaagatgctaaattttgcaatattgcaactagattgataccctttccttcccagctgcgttcatgtatggtaggcacccgtttctcacctactttcttatgctactggaatttttatagattactgtggactatacaatttaaatatgcattttcaattctcatgcttttcttttctctctctgacttgattcacactggcgccgacctagcatcactggtaatttgtttgatatcgtgtcagatagacctctgtttgaatttgcccacagggtgcattagtgaagtttattaaatgcagattctttttggctctgaggaatgcattctgacttatactgtaataattgcagcactcttttgtgtgatgacaattgatgattttaaaacatgcaagaaatgaaactaacattatttttcatcaggtggatgaggcagccatgttagctttggaagatagatggaggtaccttgatagcgggacatcaatgagtccaccttttctgattgagccatcacactttgaacaagccttatcaaaggtgaagccatcagtatccaaaaaggtatgtgcaggatgacatgctacttcttgctaatctctgtttaccattgtgacatgtcagctgatttcatccatggctctttccttttgattacagcaaaggaaacattacgagacaatgtgaagtgctgagcgtctcgtgggcgtgctcgtcgtcgtggtggtcgagccagcactc

SEQ ID NO: 13893 - DNA, 1958 bp, Zea mays
  misc_feature (34)..(34): n is a, c, g, or t
tatatcttggggttccagcatgtgaattcaaggnaaacagatactgatgcttgctcggaagcttcgacttgaagggcaatttgactttttaaagatagcaagggccacaccaggttttgttggtgctgacttgaaagcattagtcaataatgcagggtatctggcaatgaagagaataattaataaaagaagagctcagtattgttctgaggtaaacgtgcggccgcccgggcagctgcccggggatgcaggcgagatggagagtgtacatgtcaccatgaacgactttgaggaagcaacaaaattggtccaaccctctttgaggagggaaggattttcttccattcctgatgtcacatgggatgatgttggaggtcttgattcgttgaggaaagagtttcaccgctacataagatgtattaagagccctgaagattgtgatgtatttggagtgagaatgcaagatggcttcctgctgtttggacctccgggttgtggcaaaacactcatagcaaaagcagtggcacatgaggcaggggctaattttattcatattaaggggcctgatatattgaacaagtatgttggcgagagtgaatcagaaattaggaaaatattcaaccgagcacgtattaatgccccgtgcacggtattttttgatgaggtagattcattgacaacaaaaagaggtaaagagggggggtgggttgttgaacgtctcctaaaccagttacttatcgaacttgatggtgctggtcagcgtaaaggtgtctacgtgataggagctacaaacagaattgatatgatagatgatgctatgctacggcctggtagattcgggaagaaacattatgtacctatacctggtgctcgcgaaagggtttcaatattaaaggcactagccagacgcatacccgtttcatcaaccgttgatttggatgtgttggcacttcgagaagagtgcagcaatttcactggcgccgacctagcatcactggtggatgaggcagccatgttagctatggcagagagatggatgtacctcgatagcgggacatcaacgagtccatcttctctgattgagccatcacactttgaagaagccttatcaaaggtgaagccatcaatatccaaaaagcaaaagagactttacgaaaaaatgcgcaagaaacacttgtcaacaacctgatcagatcaccatacatccatcttgtgtgtgtggcacaaactatgccatcgctacctatgaaaatggttctgccggcactgcagaatgctactataaatttgtgcattacaatcatgcttgaaatatagtgataaaccgtatactccctctgtttttttacttgacattttttagttcaaaaacacactatccggcgtcaaatatataagattggaggtagtaccagacatgccgtggcttatttgtactgtcttcacctgctggaatttttgcacgtgagctaccaatgcatggcttgttagttgtgccgtgcttgttcatgatgtaggaaaaaactcgaatttaattccccacctattgtagcagtccgctttgtccgtgcatgtgcttgttaccatagttgtggcgtgtctgttcgtccggtagggggaagaagagtcagacgactccgctgaatcaagcctgcgcttggaagaagtccaagctgaagcatgatgaggtccaggcgttggttgatgctggaatcctggtatcatccacatctccatttatgttcacttttgtgaggtgttcttggggattcgtcagtattggggacaagtccggaagattttccggctgaagccacaaccaagtgccataagactcccaagtagtcggtggcgcgggagtccagatgcgcgagaagatggacggagtctacttcaagtacaaactgattgactccaaccaggccaaatggttctacattgacaatcagcgtcctcag

SEQ ID NO: 13894 - DNA, 2216 bp, Zea mays
cattgggtacctcgaggccggccgggacacggcacaacaaaaccaaaatgtggcccctcgcccccgcgaccgcaccgcatctccctcccattccactccagtccaccaccgctcccattccccagccgccgtcgccatggccagcgccgcccactcccttctgcacacaccggaggcccacagggccgccacccgctcgcccttctctcctcccgcgcccactcccttcctccatctccgccctcaccgcctccccctccgcctccgctccacctccccgaccgcctccgacctcaccgccttccccccgaacccgaacgggatctttgcgtccgaccggcccatcgacgtggacgccgccacggaggccgagctgcgggagaacgggttccggagcacgcgccgcaccaagctcgtctgcaccgtgggccccgccacctcgcgcccggaccagctcgaggcgctcgccgtcggcgggatgaacgtggcccggctcaacatgtgccacggcgacagggagtggcatagggccgccatccgcgccgtcaggagcctcaacgaggagaagggcttcgccgtcgccgtcatgatggacaccgagggcagcgagatccacatgggggacctcggcggcgcatcctcggtcaaggcggaggatggagaagtatggacgttcagtgttagatcatttgaattgcctctcccagaacgaactattaatgtgaactatgatggatttgctgaagatgtgagagttggtgatgagctccttgtggatggtggaatggctcggtttgaggtgattgagaagataggaccagatgttaagtgccgttgcacagatcctggtttattgttgccacgtgccaatcttacattctggcgtgacggcagtatcgtccgtgagaggaatgctatgcttcctacaatttcatcaaaggattggcttgacatagactttgggattgccgaaggtgtagatttcatcgctgtttcatttgtcaagtctgcagaagtaattaggcacttgaaaagctacatagctgcaaggagccgtggaagtgacatggcagtcattgcgaaaatcgagagcatcgactctctaaagaacctggaggagatcatccgagcgtcagacggcgccatggtagccagaggggacatgggggcgcaggttcccctggagcaggtcccctcgatacagcaaaagatcgttcagctctgcaggcagctgaacaagccggtcatcgtcgcctcccagctcctcgagtcgatgatagagtaccccacgcccaccagggccgaggtcgcggacgtctccgaagccgtccgccagcgcgccgacgccctgatgctttccggcgagtcggcaatggggaggtacccggacaaggctctcagcgttctgaggagcgtcagcctgaggatcgagaagtggtggagggaggagaagcggcacgaggcgctggagctccggagcgtctcgtcctccttctccgacaagatatcggaggagatctgcaactcagcagctaaaatggctaatggcctgggagtggacgccgtctttgtgttcaccaagaccgggcacatggcctccctgctctcgcggtgccgccccgactgcccggtcttcgccttcacgacgtcgacgtccgtcaggaggcggctgaacctgcagtggggcctgatccccttccgcctcgccttctcggacgacatggagagcaacctgaaccgcaccttctccctgctcaaggccaggggcatgatccagtctggggacctcgtgatcgccctctcggacatgctgcagtccatccaggtgatgaacgtaccctgaggtagaagagccttacctttacctccatgccgcacggtcccgtatcggaaggaacacgcgtgttatcggcaccttggaaggacggtttcttccttccctgcgcctaaatcgctgccctttgttttcgctgtatcagatgctgctatgctatgctaggctctagtctggcccagggaactgtggcaataatctgtggctttcaggctggtgttagaactcttgtactacttgtaggcttaggtgatttttatcgtgcaagtagttggtttgatgtttttgtgtggtataaaagcgactcaagctatgggcctaggcctctttggtataccttttttttctgaagagtttttttagagaatctggattcgttgat

SEQ ID NO: 13895 - DNA, 2205 bp, Zea mays
ccccaccgcaccgcaccgcatctccctcccactccactccagtccaccgctcccattccccagccgccgtcggcccgtcgccatggccaccgccgcccactccctcctgcacacaccggaggcccacagggccgccacccgttcgcccttctctcctcccgcgcccactcccttcctccatctccgccctcaccgcctccccctccgcctccgcctccgctccacctccccgaccgcctccgacctcaccgccttccccccgaacccgaacgggatcttcgcgtccgaccgccccatcgacgtggacgccgccacggaggccgagctgcgggagaacgggttccgaagcacgcgccgcaccaagctcgtctgcaccgtgggtcccgccacctcgcgcccggaccagctggaggcgctcgccgtcggcgggatgaacgtggcccggctcaacatgtgccacggcgacagggagtggcacagggccgccatccgcgccgtcaggagcctcaacgaggagaagggcttcgccgtcgccgtcatgatggacaccgagggcagcgagatccacatgggggacctcggcggcgcatcctcggtcaaggcggaggatggagaagtatggacgttcagtgttagatcatttgaattgcctctcccagaacgaactattaatgtgaactatgatggatttgctgaagatgtgagagttggtgatgagcttcttgtggatggtggaatggctcggtttgaggtgattgagaagataggaccagatggtaagtgccgttgcacagatcctggtttattgttgccacgtgccaatcttacattctggcgtgacggcagtatcgtccgtgagaggaatgctatgcttcctacaatttcatcaaaggattggcttgacatagactttgggattgccgaaggtgtagatttcatcgctgtttcatttgtcaagtctgcagaagtaattaggcacttgaaaagctacatagctgcaaggagccgtggaagtgacatggcagtcattgcgaaaatcgagagcatcgactctctaaagaacctggaggagatcatccgagcgtcagacggcgccatggtagccagaggggacatgggggcgcaggttcccctggagcaggtcccctcgatacagcaaaagatcgttcagctctgcaggcagctgaacaagccggtcatcgtcgcctcccagctcctcgagtcgatgatagagtaccccacgcccaccagggccgaggtcgcggacgtctccgaagccgtccgccagcgggccgacgccctgatgctttccggcgagtcggcaatggggaggtacccggacaaggccctcagcgttctgaggagcgtcagcctgaggatcgagaagtggtggagggaggagaagcgtcacgaggcgctggagctccggagcgtctcgtcctccttctccgacaagatatcggaggagatctgcaactcagcggctaaaatggctaatggcctgggagtggacgccgtctttgtgttcaccaagaccgggcacatggcctccctgctctcgcggtgccgccccgactgcccggtcttcgccttcacgacgtcgacgtccgtcaggaggcggctgaacctgcagtggggcctgatccccttccgcctcgccttctccgacgacatggagagcaacctgaaccgcaccttctccctgctcaaggccaggggcatgatccagtccggggacctcgtgatcgccctctcggacatgctgcagtccatccaggtgatgaacgtaccctgaggtagaagagccttaccatgccgcacggtcccgtatcggaaggaaggaacacgcgcgttatcggcaccttggaaggacggttccttccttccctgcgcctaaatcgctgccctttgttttcgctgtatcagatgctgctatgctatgctaggctctagtctggcccagggaactgtggcaataatctgtggctttcaggctggtgttagaactcttgtactgcttgtaggcttaggtgggttttatcgtgcaagtagttggtttgatgtttttgtgtggtataaaagcgatttcaagctatgtcccaggcctgtttggtatagctttttttttctgaaagatttttttttttgagaattttgatccccggggtaatctaacttggcaaaaaaaaaaaaaaaaagcgggcc

SEQ ID NO: 13896 - DNA, 1377 bp, Zea mays
  misc_feature (1332)..(1332): n is a, c, g, or t
ccgggccccccgcaccgcaccgcaccgcatctccctcccattccactccagtccaccaccgctcccattccccagccgccgtcggcccgtcgccatggccgccgccgcccactccctcctgcacacaccggaggcccacaggaccgccacccgctcgcccttctctcctcccgcgcccactcccttcctccatctccgccctcaccgcctccccctccgcctccgctccacctccccgaccgcctccgacctcaccgccttccccccgaacccgaacgggatcttcgcgtccgaccggcccatcgacgtggacgccgccacggaggccgagctgcgggagaacgggttccggagcacgcgccgcaccaagctcgtctgcaccgtgggccccgccacctcgcgcccggaccagctcgaggcgctcgccgtcggcgggatgaacgtggcccggctcaacatgtgccacggcgacagggagtggcacagggccgccatccgcgccgtcaggagcctcaacgaggagaagggcttcgccgtcgccgtcatgatggacaccgagggcagcgagatccacatgggggacctcggcggcgcgtcctcggtcaaggcggaggatggagaagtatggacgttcagtgttagatcatttgaattgcctctcccagaacgaactattaatgtgaactatgatggatttgctgaagatgtgagagttggtgatgagctccttgtggatggtggaatggctcggtttgaggtgattgagaagataggaccagatgttaagtgccgttgcacagatcctggtttattgttgccacgtgccaatcttacattctggcgtgacggcagtatcgtccgtgagaggaatgctatgcttcctacaatttcatcaaaggattggcttgacatagactttgggattgccgaaggtgtagatttcatcgctgtttcatttgtcaagtctgcagaagtaattaggcacttgaaaagctacatagctgcaaggagccgtggaagtgacatggcagtcattgcgaaaatcgagagcatcgactctctaaagaacctggaggagatcatccgagcgtcagacggcgccatggtagccagaggggacatggggggcgcaggttcccctggagcaggtcccctcgatacagcaaaagatcgttcagctctgcaggcagctgaacaagccggtcatcgtcgcctcccagctcctcgagtcgatgatagagtaccccacgcccccagggcccagggggccgcggacgtcctccgaagccgtccgccagcgcgccgacgccctgatgctttccggcgagcggnaaaagggggaggtacccggacaggctctcagcgttctgaggagcg

SEQ ID NO: 13897 - DNA, 2016 bp, Zea mays
  misc_feature (1)..(1): n is a, c, g, or t
  misc_feature (107)..(107): n is a, c, g, or t
  misc_feature (2002)..(2002): n is a, c, g, or t
nctcatggactactcaataacggtccccgccgagttggccgggtatgctgcatctgactgctgtattgtaaaatgctgtgagggatggcatgaatttgataccgtantgagtacaccgtatgcaggcagggcaatgaggagcttgataaagctcagaggtcttaataagagctcatctcacacaagcacacttattgtgtctgaatttgtgggttgctctccatcacttagtggagcatgcaggggaaatccttggagtatggaagatgtggctgatgcattatacagtgtaacagacctgacacgatatgagaagaatctgcgccatgaaaagcactatcgctatgtcaggtctcatgatgttgcttactgggcacgcagctttgaccaggatctggataaagcatgcatagagcaatacagccaaagatgttggacaactgggtttggtttaaattttagagttattgccctttcacctgggtttagaagactgtctctagaacacctagcctcgtcttataagaaggctaacaggaggatgatattcctggactacgatgggacccttgtgccgcagacatcacacgacaaatctccaagcgctgaacttatctctacccttaacagcttgtgcagtgatatgaagaacacagtatttatagtcagcggacgaggaagagattccctaagcgagtggtttgcttcatgcgagaacctcggtatcgctgccgaacatggttactttatcagatggaacaaagcagctgaatgggagacaagcttctcaggtatttattctgaatggaagctcatcgcggaccctatcatgcatgtatacatggaaacaactgatgggtccttcatagagccaaaagagagcgctttggtatggcactatcagaacacggatcatgactttggctcgtgccaggcaaaggagctagtgagccatcttgagcgagtcctatcgaacgaacctgttgtcgtgaggcgtggccatcagatcgtagaagttaaacctcagggagttagcaaggggatttccgtggacaagatcatccggaccttggtcagcaaaggggaagtaccagaccttttgatgtgcatcggaaacgatcggtcggacgaggacatgttcgagagcatcaacagagccacctccctttccgagcttcctgccgctccagaagtattcgcctgttccgttggccccaaggccagcaaggcaaactactacgtcgatggctgcgacgaagtaatcagactgctgaagggtgtcacagccgtttcgctccaaaaggatactgccggccatagccatgcggccttcgaggatacgcttgaggttgtcagctgatccacacaagtagtcagtcagctcaaactagctacgtccagtgtgttcagcgtgccaatctcaaatctccactgcatgcaagctactcatcactccaaaccatatgtgccaagtggaactctaaattggacggagacaagtatcgccattgctgacacagagacagaacagcggtcacaaactgcaagttccagcgaatggcgtcgcagttgatgattcaatgacgacaacggaaatcacaaaccgcaagttttcaattcgtaggctaagacaactagtgggacgccatacattttgtaggcggctgatctggtggtgaaagggtggatgtccctgctagagccccagcttacggcatctgggagagccttggaagttggaccccgacgcttgtgctgcactgaggactgttacactattttctttgtacagaacaaacaggtgtggttaggcgattagcgctgtgacgattgattgtaattcacccacgtaccattgaggaaattaatggctgcgatggtgaagcgccgtgcgcatggcacattgtatgacgttcactcagtattcggttcgagtttaaagtaggatgatgcggggtccgccggcccgtttgtacccaattgataaccacaacccacatanagcatttttgtttg

SEQ ID NO: 13898 - DNA, 1777 bp, Zea mays
accactaccacgctgcgccgctgcccatagcttcgttgacaacctgttttcccaagccatttcctccactctcgttttttcccttcctgtccaaagatggctgaatcctttgttctcaataccggcgcaagaatcccgtcggttggccttggcacatggcaaatagagcatggagctgtcagcgacgccatctatgctgctgttaaggctgggtatcggcacattgattcagctgtagcataccgcaatcagaaggaggttgggctggctttacagaaactatttgaggatggcgtggtcaagcgtgaagatctgtttgtcacctctaagctatggccaggtaaccatgcacctgaagatgtgcaggaggatctttgctcggccctcgaagatttgcggctcgactacgtagatctgtaccttattcatggtccaatccgtatccagaaaggaaccatgtttatcccggaaaaccttatccctacggacatccctgctacatggggagcgatggagaagctataccacgcaggcaaagctcgcgcgatcggtgtgagcaatttttcctgcaagaagctgcaggatctgctcgctgttgcgcgtgtgcctccagcggtcaaccaggtcgagtgccatccagtttggcagcaagacaagctacgcaagctgtgccagtcaacgggtgttcatctttctgcatattcgcccttaggctcacccggatcacctggatacagtgggccaaacgtccttagcaaccccgttgtcatgtctgttgccgagaggttgcagaaaacgcctgcccaggtcgctctgcgctgggggattcaaatggggcagagtgtgcttcccaagagtgccgacagaacaaggatcggagagaacttcgacatatttgattggtccatccctcacgatctgatggcgaagttctctgcaatcaaacaggttaggctgctaaaagtcgagtttgtagttcacccgaacagtggatacaataccttggaggatctttgggacggtgaagtggaatacgaggacgaaagaacagagaatcaggaccattctgatttcttgagatgcttttcgtgaacagtcgagaatatcgccttcttcgcatggagaaacccctgagaaataatggcctctctgctgctcctcttatatgtatgtagagttgctgtgtttcaacaagattatccacatgtgactgctgcttgcttaacaaatactactacagttcgacttcagagtatagctacaaggtgttatcgtagtcaactatatttgtgtttgtctattcaggctctgaatacaagggaaaaataaaaaaaataaataaagcaaatacatgaaatggcattgtattcaaatggaagatgttcggagtctcggatggcaaaactacgaagcgcgatgtttatgctctctaacttctagatttaagaagtcgtcaaataatataggaagcaaaatattcctcttctccaacaattctctgaatattagactatctgcattcataatattctaaatttctactttaaaaagaatatatgtcctcgtcattaaaattctttaccctatatcacaatactccacagctatatttactttatatcttaactctatatcaactaccacatattatattatttattttcaattatattcataccaccgatgctatctcctagcgtttcccgtaggaaagagtgtaccctcgaaataccgtttcctgtggccactgtgaatttctagtagcatatacatcacg

SEQ ID NO: 13899 - DNA, 2520 bp, Zea mays
catttttgtatccacagtatagctacagtgctgtttaatatggacaagcttgataaatgtaacctaattaatcacgcataattatatcctaaacgacttctattccatatggagggagtacatcactgcatagctgcatatgcgtcgctttgattagccatttatgctacctgggatttcagctgccagcatcagtatccgtagtcaaaaattcaaaatcaacaaatcaacagaattatcggcccaaatggaaaacaagaatggaagccgtactgcaagattcaaagcacgtgaaacatcacatgatccagatttcgaagtttcaaaccatgtggttcccatgcactcgaaccacgtgtgacgcgccggaaggtctggcatatgactgcgaggcatgcttcgtttgtccacaaaattcagtgtgtttcctcctggttttcgccatgcgtcgcatctttttctccggcgcggaccgcggagaaaaaaaaaatagcccggctatgccaaaatcacccccggcacgctcttctctacgcgcccctaccgtcccggcggcggccagcgctgggctcttttgccgtgccccgcggcactgcccccacgccatccgcacacacccactggaaaaacagcagccgcgcgttacggcgttagcggccaagccactttacgccagtggccgccggcaagcgcggtcaggtcgggactcgacggagagagctctcagcttctcccgacctaagtaagctaggtggacaacgcctgcaggctgcggcaccaacgcggccttcgccgcgaccccctccccatctccctcctccctaccatgcgcgagggcgaggcccacgcccacgccctcccgtcgaaaacccagctactcccgtgcctcaaagatgacgagccgcgacaaggtggggtgctcctcgatcccgctgcccctcgaccgtgtccttgccgcgctggtcgccagcacccagcaactcgggagggggtgggaggcggccttccgcgtccgatgcgggaaggcagctggagcggcggtcggggaggcggaggggaaaggagaggttatagagatgcacacgccgctgttctacgctacctgcgccctcggcggcgttctcagcaccggcctcactcacctcgctgtaacgccgctcgacctcgtcaagtgcaacatgcaggtccgtcactgtcagcgataggttccttcgcttgttctccttgtccatgtctcaatgactaacacagctgctgcctgcttcaatgtcccttcactcaggtggatcctagcaagtacagggacattacatctgcctttggtgtcatgctccatgagcaaggaccccgtggcttgttcaggggatggatggccacactggttgggtaccagctgccagggggcctgcaaggtttgggttctacgagttcttcaagaagtgctactctgacatttctggtcccgagaacgctgaaaggttgaggactttgatctaccttgcagcttccgcgtccgctgaggtgattgcggatgtagctctctgccccatggaggctgtcaaaattcgggtccagacacaaccgggatttgctcgctgcctggtcgatgggcttccgaagattgtccaatctgaaggtgcctttgggtacagatactgcatgtcttgtatgatctgtgttattgttcaaggtttttggggagcaacaatcttttaacactgggtgcaaatttcaggctttacaaaggtctacttcctctttggggccgccaagttccctgtaagtcaaaaatggattgctagtttatacagttacttgttaagggcttatcggtgcttagctaatagttcagctattagctacttttagcaaattagctaatagttaactagctactcactacatctcaaattagtattcactttagggtctgtttggaatcatccagtttttaataaattgatttatgaaaactgaggtggttccaaacatactagtttatgtcccggtttatagaaactgagttttcaatttcttaaaaccaagaagctaacctctcttagctaaagtaagtttatgaaaactatggtgattccaaacattattaaccatttttctttcataaaccagtttctagaaactaaagataaaaattggattattaaaaactaggttgtttacaaacagggccttagctcttggtttttatgtctatattcaaatggatgatgataaatctagacagatatcatgttaggatcgtaagtgagacaaaggagacacagagtttaacgtggaaaaactcctccaatgtggaggagaaaaaaaacacgggaaaacagatctattatatggtatgtcgtacatggtacaagggggcttatttatatagggaatggagatagagatagagtcaaaaaatcttatccaacaaatctctccttgacgctaaatctataaaattgtttcctcaaacaccactagagtgctaagctccacgaacacctaccaagtcaagac

SEQ ID NO: 13900 - DNA, 1544 bp, Zea mays
aacgcctgcaggctgcggaccaacgcggccttcgccgcgaccccctccccatctccctcctccctaccatgcgcgagggcgaggccgacgcccacgcccacgccctcccgtcgaacacccagctcctcccgtgcctccaagatgacgagccgcgacaaggtggggtgctcctcgatcccgctgcccctcgaccgtgtcctggccgcgctggtcgccagcacccagcaactcgggagggggtgggaggcggccttccgcgtccgatgcgggaaggcagctggagcggcggtcggggaggcggaggggaaaggagaggttatagagatgcacacgccgctgttctacgctacctgcgccctcggcggcgttctcagcaccggcctcactcacctcgctgtaacgccgctcgacctcgtcaagtgcaacatgcaggtggatcctagcaagtacagggacattacatctgcctttggtgtcatgctccatgagcaaggaccccgtggcttgttcaggggatggatggccacactggttgggtacagctgccagggggcctgcaagtttgggttctacgagttcttcaagaagtgctactctgacatttctggtcccgagaacgttgaaaggttgaggactttgatctaccttgcagcttccgcgtccgctgaggtgattgcggatgtagctctctgccccatggaggctgtcaaaattcgggtccagacacaaccgggatttgctcgctgcctggtcgatgggcttccgaagattgtccaatctgaaggtgcctttgggctttacaaaggtctacttcctctttggggccgccaagttccctacactatgatgaaatttgcttgctttgaaactattgttgagatggtctacaagcatgctgttccgaaaccgaaagaccaatgcagtaagccactacaactagcagtgagctttgcagggggatacattgctggagtattctgcgcggctatatctcatcctgcagacaacctcgtatctttcctgaacaatgcaaatggagccaccgtggcagatgctgtaagaactcttggaatatggggtcttttcacacgcggccttcctcttcgtataattatggttggtactctcacaggagcgcaatgggcagcctatgacgcgtttaaagtgtttgttggactgccaacatctggcggagtggttcgtagctgtgctgctgtgcctcctattcgcgccaagagggtgcaccgagaagacgtgctaaaccaacggagagtagacgtaccgcattgagaagatgtgctgaaccaacaaagcagaataggaaatgtgttgcgatttcactgagttttgtaggagttcgaaaccagttgtttaagttttagctggtagagcaaaagagcattcactttcaaggggcttttattggaacctcttgaacaacagacattgtaatgataaacagctttagaaatgcgccatgcctggtgtagcagtacaccagcaccccgtctctactagtcagagtcaaaaaaaaaaaaaaaaaa

SEQ ID NO: 13901 - DNA, 2820 bp, Zea mays
cttgcttgaaagtgaacaatcaaggttgtgtgtatatattatgcccaacatttttgaaggatgttgcgagggccattgtatctgcgggaaaatcctttcaacttgtcgaacatgttcaagacgtacatcagattcaaactcacaaaagtacacatccgtccaatttgtatcaagatactaattgcagtcgtcaacagaaattttggccagaatatgtcaaatttaagaatccatgatggtcctccaagaaataaagatgctcttgaagtatccacaagtcagtttgggaatgattctcgtgaaatgggactcctaaccttgtctgagatcttcttgatatgcatatctggtctgttggaaaatggtgaccatgtatatgagtacttaagaacactgcatgctgataatgttccaaataacaatgcttttatggaaaatgagagcaacttgaaagaaacagagggtacatgcacagggaacatcattgagaagacttgggtaaagctcctaaaggatgctacatcaggaaggaaatgtaatggcatggaggagaccatacatgctgttatagataaggcaggatttgcctctggttgccccaaagatgcatcttccaatgtcgtagaaggggttttcactttatcttgttacgaaaacccagctatcactgcttgcagagaagtgctaatgaggaacccagcttcttggagtgaactgaatatatctgaaagttttcatctccctccactgaatgatgggaacatgcgaagagctatatttgctgatgggcattctgcaggaactagcactgattataagtttggtttccagtttgatgatctggaacatgtccgccaagaagatgacagaaggaccttggaggacctttacgcatttccaacccttcttccttgcgcaaaagaaaatgcgctgctgtcagaaattttacctatgcagaaagatagtacactagcatcgagagttttgaagtttattcagaatatgagcatgaaagatccccttcagccagtgggtatcatccaagaatgcctttccaaatgtataaagagacaggtcgatctcataggcaatcaaatcctgtgcaagctaatgggtgaatggagattaatggatgaactgtttgtgttacgtgctatttatttgctaggatcaggtgacatgttgcagcagtttctgataacaatttttgataagcttgatagagggaattcctgggatgacgactttgagttgaataatttattgcaggaatccataagaaactcagctgacaaaatgctcctgacagcaccagattctttggttgtttcattagcaaaatatgacacacacaatggtgaggaaggtctatcaacttccaaaaaaggtcgtgcacttggttttggcattgatgcccttgacatgctgaattttacatataaggtgtcttggcctcttgatctaattattaatacagaggcactgaagaagtataatcaggtaatgggattcttactgaaggtcaaacgagcaaagttcgttttggatgaaacacgaaagtggatgtggaaggccagaggcaggaccacgcacaatttcaaacaacacctaatagtggcacagaagctcctccattttgtcgatgcatttcatcagtatgtcatggaccgagtttatcatagtgcatggactgagctttgtgatggcatgacggctgctaccacactggatgaagtcatggaagttcacgaggcatatctctcttctattcaacgacaatgctttgtggcctctgataagctgtgggccctcattgccagtcgagttaagactattcttggattggcactggacttccacaatgtagaacaaactctcagtaccggtgggacggcttcagctgtgaggacacgatgcgagatggaaatcgaccggattgagaagcaatttgatgagtgtgtcatatttctcctgaggatcctatctttcaagctcaatgtgggtcatttcccccatcttgccgatctagttacaaggatcaattacaatcactatttcatgtctgatagtgggagcttctctgctattcctgggtcccggccacggtagtagactagtagttgagcaagcagtggacagaattgttggtgttgcacctgggtgatttttcctacccttttttgagaagaaccagaggcgtggtttgtttactttcgaaatagaaagctccagaacagtgctaatgcttctctctccaaattggaacaaaaaatcatgcctcgggcttgttacaatatctatatgtacattgttttcaaaaggatgacactaaaaaaggtggcattaaaggcgcctgaacctgttacattttactttatggcttatccgtggaatcaaccatatctccacaagttaagaaccggtagtgagatctggggttttgtccatgggatcgctctaaaatccacaatgaaacaacctaaggtgacgtttgatgcaccagtgctaatagttggcggctaaaattatctagagacatctaaacgtcatagctaatagtttagctattatttatatatattatttatatatagtaaattagttaatagttagctaactaatttcactaatatttttttagtcaactagctattagctctaaacacccactatgattgggtgacccgggaggattaggggattgagggagaaattagtttatttgcctctcaatccattcaatcctcatgtgattcatttgtcactaaattaacccaccaaatcaaccccaaggcatcagtcaaccactgcaggcatgca

SEQ ID NO: 13902 - DNA, 1929 bp, Zea mays
ctcgagccgacctcgcatccggcccgattcgactagggttttagcactcccagtcccggctcccgccgtcgcctcgacgcttcccccctcttcctccgccgccaacccagcgagagagctcccagtccgcgaagacatggcggggaagaagcgcaagtccggctccgagaagccgacgaagcaccgcctcccgctgggagccgatgccgacgctgtcgccgaagcctcgaagcgccgccgatcgggcgccaccaagcagcaccaggcggacgaggaagcgtccatcccgccctctctcagcgccaagatcctccgcgaggcgcgcaagcagcaggaagaggagatgcgcgccgactccagcgacgaacagcgaccctcagccgtcgaggcgaccgcggggccgtccacgtcgtcctcgtttcccgtccccgccgccgacggcgagaatgagggggacgacgtcgatgagttcgacgggtttgacgcgctgagcgagtacgatggcggtgaggtggagatcaacgaggaggacgagaaggccctcgctgctttcatgtcaaaggacaaagctgccgagcgcacccttggcgatatcattctccagaagatcagggagaaggacgccgaggtcgcaactggtgaaggacgacctcgtgtaaaattggacaacagcattattgaactttataaagaggttgggaagttcttaagccggtacacgagtgggaaaattccgaaagccttcaagcgcataccatcgctggagtgctgggcagatgttgtgcagctaacggagccagagaattggtctcctaatgccgtgtatcaagcaacacgcctcttctcttcgaacatgaacacaaagaatgctgagcggttctatgaagccattttgctaccccgtgttcgaaatgacataaggaagaacaagaggctgcattttgcactctaccagtcgctgaagaaggccctttataagcctgcggcatttaacaagggaattttgctaccactctgtcgggaaaggaattgcaccctacgcgaagcagtgattattgggagtattatccagaaagtttccattccatttctccatgcaagtgtagctctagtaaaactagcagagatggagtactgtggcactacaagttacttcatcaagctatttctagacaagaaatatgctttgccataccgtgcacttgatgcagtgcttgcccatttcatgcgttttgttgatgatgagaggatcatgcctgttatatggcatcaatcactgcttgcatttgtggaaagatacaagaacgagttagagaaaaaggataaggagaaacttgcacgtttgttggatcaccagaaacactatttagttactccagaaattcgaagggagcttcgagggagctgcaacaggggtgaaaaagatacaaatttgcatactttgtcacctatctccgtcattaccaagcctatcgaggaagacaaatgggacgtaccacaagtgccaatggaggaagattagccagattctccaacatcgatttttacacttcatttgtttttgaagcaaatttctaaagatattgctgtattttattgggcgtgaacttttagtgccaatattggggtaaaataggttcccagtagattgggcccccaatgttctgagggcattttgcagtcggaatgtgattcacacacggaaaagtttgttttgatcatttggagcattccaagggggcattcagcatggacatgtagcatactgtctttcgcagaagtgggtaagaaatggttgatcatgttactttgtagctgcgacaactaaaggtgtaccatacttgaaccagaaatgaaaatgaataacccggagttcgtttggttttttttggtttttttgggtcttaaaaaaaaaaactcgaggggggg

SEQ ID NO: 13903 - DNA, 1213 bp, Zea mays
  misc_feature (8)..(11): n is a, c, g, or t
aaaaaagnnnnggaacgacccacgcgaccgacgccttcgtacattcaaacgatccctacaccttgaaggttatgctgaaccatggatgagggggctgttagttattaatgttacaactggtcctgtacagacattcaatggtatatagaaaggcggtcatatagttcatgtcttaaagacaactggccacaacggtttccctgtggttgatgagccaccattttcagatacccctacattgtatgggctaattcttcgagaccacctgcttgttctattgaggaagaaggatttcatccgtagttgcacagcgtctacactgaatgctttaaaccatttctcacatgctgagtttgctaaacgtggatcaggaaaacatgacaggattgaggacattgaattatgtccagaagaactggaaatgtttgtagacttgcatccattcacaaacacatctccatatactgtccttgagactatgtctttggctaaggctcttatacttttccgtgaagttggattgagacatcttctggttctaccaaaatcttctaagagggcacctgttgtcggcatactaacaagacatgatttcatgcctgaacatatattgggccttcatcctttcctctttaagagtagatggaagaaggtgcgacttggcaaggtaaaagttaccaacatattttgaagcttgctggtgactggtgatttggggaggtcaccgaaggatcatccgaagctgtatacctggtgtcaaatcacgtattttgcagagaataactcaacttgaaaactagtggatcttacttcaagaaaataatttcgttgtaaatgctaagaaggggatggaacatggctgctaagtgctaacaagttattttcccacgaacaagaggaatctcactgtaaatttattatgcatactttagctaacctttgaaaacaaatgctatctgtagtgcctagatgcattccttattaggcccatcagtgcaaaagtaacttcagttccatcctccattcatataggctactcaaaatagctgctcatatcctgcatatggtgtgataaatacaatgtatttcctcagctttgttccatagcttctttttgcaatattcatgtgcctacattgtggtcccacaatggctgaaagccttagcctggtggttcagcttctgaaaaaaaaaaaaaaaaaaaaaaaaacaa

SEQ ID NO: 13904 - DNA, 2317 bp, Zea mays
gcacgagaccattacctagaacatcctaatcgaaaaagaagtccaaaaccgcagctcccatctctttccccatggccgcggcggcgccggaggctgcggacgaggttgcgccgtcggcgacgctgagcgtctacaaggcggcacggtgcatcaagcggcgggcgagcacgctgtacaacgcgctgcggagcgtggcggaggacgcggccttcgtggcggaggtcgcggcgctgtggccctcgttgccgctggtggccaacctccgctgcggtctctggtacgccccgccccgtgccttcgcagccacctgctacttcaagtccacggatggccacgccgggaactggtccttctcaactgcccgcctcaacctccacctcgccctcctcgctggggagagaggagggtgcataatagttgattcaacaaggagagggaaacgattccctgatagcatgtcaaagaccatacccatttggtgctctgtcttgaaccgagcgattgagaggcatcggctgcaggctatccacaaaagtgccgaagtgaattatcagtcgtctaccctgctgaatggagatgcagaaaacaactctgatctatctaattgggatagctcagtgcaccttcctgtatgggttctaggcacagagaaaaatgctatagaggggcgtattgaggaatggacagaccaatttgaatcatgtggtgcagatattcattctcttgcagtaggtttgcaaaaaccgctacgtcctctatggatctcacaaagaacacgcatatggttaaatgaagtgccggagcttgagtcatgggatttcactcctataattctaatttctgcatctgatgcagttgctacacaaaggatgtcttcagaattcagttggcactatattcctggagcaggagatgatgaagagagttgggcacgtggtctaactcctaccttattctggaaacattcatatgaccttattgatgctggaccagatcgttgtaaccagatagttgccgatattgttgaaaaagatagggtttatcgtgcacagagaggtgaacattgtcctcaaattacatgtaagtctctgaggagccttgctggtgccaaatgtaatgatgatcagacaaccgagatgtgtgctatgaacttggatcattgtaccagtacaatggatgcacactgttctaataatggccttctactcttttggattggaacatcaaaccttgcagtatcatctactttccatgttgcagatgccttagttggtgtggactgcatactgaactgtgacagcacgtcgaagctacctgctagttcatcagaaaattcttaccttgagctatctattgtgggctcaaaggatgaccgattttcattgatgagaaaccttccaaaagcagttgactttgcaaagaggaatttgatggctgggagaaaaatccttgtgtgctgtcaaaatggataagatataagtatttgtgtggccttggcaatattggccttgttattcgatgataacggatgctttgactatggaaattattttgtcaaaagagatgttacaaagttggagatgaggaggaggctggtattcatctgtaaatttgctgtaaacgcacggccatctagaggaaacttgaaacaggtgtatggtttcctcagcagtcaaaaggaactgctgtcatgtttgacatagcttggtcttctgtgatgtagatgaggtatcagttctgatctgctgcttgagtgataggtgtggagtacgagctggggcttctgagtttgtctttcacacagtctgttgatcagatggtgcattacgatcatgcccagaggttttcattggaattgccaccatggcaatgatctcattctgggatcagtatctcaagccaacgtcaatcaacatttatttggagaagaatgaacacaaactttggtagagtgtgattgcaaagacaagctgatggcttggataacctagcgatgattcgagtattatcaatctgtgacaaaatatagaagaaactaagttaaggacatgattcgtctgatggtgcctgccagattggaaagtcattagtgcttaatagaattatgagggaaataatagtgagaagttatcttatttattttgcggtcttttttatctgcaaatcgtgtttagcaaccatttccaatcgctttgttttagaaactggaccaactttcaaattgaagtgcatgacaaaaagcaagtgggcacttgaacaaaaaaaaaaaaaaaagaacttttctatgacaaggaatgggacaaattttctgttagac

SEQ ID NO: 13905 - DNA, 765 bp, Zea mays
  misc_feature (710)..(710): n is a, c, g, or t
gcacgagggcaagattgacaactctgggttttggcgcctactcacagttcgtgagggaagatgtccagcggaagctgttgtttcacagaatgcagaatcacaaatatctgaagtcatgcttattgtgcaggtgtgttcgacaagtgttgatgaagctcttatgaaagaagagtttgacaagctgtctgctgccctggtacaaggagcagcaacatgctcacctcccttgccactgacaactattgtagtgcaagatcataaagggatatcaaatgctgcacctactgattgcccactgagcccgctattggtaccaaagggagataagttggatggcacatcagaagataaaacaagaatccatgatcacataagcaacttaaagttctctatatcaccaacagcttttttccaggttaatactcttgctgcggaaagattgtatacccttgctggtgattgggctaatctcaattcagacacattactttttgatgtgtgttgtgggactggaactattggcctgaccttagcacagcgtgttggaatggttgttgggattgaaatgaatgaatcggcagtttcagatgctcacagaaatgctcttatcaatggcataaaaaattgtcgctttgtctgtggtaaggctgaagatgtgatggggccccttctcacagaatatcttggttcaccacagcagcaggctgcangcttctaaaagtaattctgaaatcgatgatacaagcaaaactgaggatatgattg

SEQ ID NO: 13906 - DNA, 2008 bp, Zea mays
cgaaaatgagcagaggaaggaggcagccaccaaacaaaagattgaacatctccgtgcacaatgtgcagtattgactgataatgacatatcacattttcagaaggttgcagataagaaaatgttagagttggaagcttcacgagatctttcaaagatatggcttcacactgacatggatgccttttatgctgctgttgagacattggagaacccatccttgaagggaaaacccttggcggttggtagcatgtctatgatagctactgccagttatgaggcacgcaagtttggagtgcgtgcagcgatgcctggttttattggatgcaaactatgtcctgacttggtttttgtcccaccaaactttgagagatatactcattatagcgagctgacaagaaaagttttccagaggtatgatcccaacttcattgcaacaagtctagatgaagcatacctcaacataaccaatgtttgcattgagagaggcattacaggcgaggaggttgctactgaacttaggtctgccattcaccaggaaactggtctaacatgtagtgctggggttgctccaaaccgtatgattgcgaagataggtggcataggtaaggtaacagaacagatgttacatcaggttcttggaatcagtacatgtcaggagatgctgcaaaaggctgcttttttatgtgctcttttttcggaaagctcagctgatttctttctgtcggttggtctcgggttaggaggtacagaaaccccagaacaaaggcaaaggaaaagtatcagttgcgagcgaactttcacagcaacaaatgattcttctttgcttttcaaaaaaattagctagccttgcagaaaatgtatctgatgatttgcaaaaggagggtttcaagggaaaaacactaacactcaaactgaagactgcagattttgaggttgcagattttgaggttcggacaagggcagtaactacacggaactacatcgactccaaggaagatattctggtctatgctacaaagttgattaaagctgaaatgcctatttctttgagattgatggggttgcggatgtctcagctacatgatgagaaggacgatccatccacttcaacacaaaagacactagatatattctttcgctcatcaaactgtaactcaaatggcaatggaaccactgttcagagaaccactaatgccccagggcaggataatgattctattagtctcacagccaaggaagagtacttggcacttgatgctggaacaagtgttcccacaggccaacaggagttcttcctacatgatgagatctgttttattcccgaacaacaacggagtttagacaacgatactaaagaggctgtcctaagcgacccgttaggtggaacaaagtcagatgatgtgtcttccagtgcaaaggttacgcccactaagaagttggatgaacctgatcccttgatcagcccgaaggctgtgtcttcatcaagtaaacctgaccagcagtcatggattgatggctacatttgttccatctgtggatttgaactgcctccgggcttcgaggaggagaggctggaacattcagattttcacctggctgaaacactccagcaggaagaagcagtggacggcacaagacacatctcaaacgagagctgggtggctgaaagaccacgctctactgcacccacgcccaagaagaaactcaagtcttctaaagaaggaaagcatattcctattgactctttcttcacaaagtgtaataagagcccgtaaccgtaaggtaggacttgccggcaactctgtaactatgggcatgctagccaagtgttgtacgtgttaactttattcttgatgagagcaatatatgtaaatatcaccctcaactctcaccaatagccaagtgttgttacagagttccacggtgtttccatatacgcaggtcttcatgaccaaaaaaaaaacctggaaagtttttattaaattcttttctttctaaaagaaaaaaa

SEQ ID NO: 13907 - DNA, 1505 bp, Zea mays
aggataagaggacgcggcgcgcgcatccacaagcagcggaggagcccgaccacgccagtgagcccgcccgattcgccgtcgcggcggccacgtttcccctccaatggccaccagctccaccgccttgctgcaccttgtcatcccggcctcccgccgccgccggcacttggtgcctcgggccgcacactccgagtccgccccgcccgccgcctccgtcgaccggcgccgcttcatcgcccacaccgccgccgcggccgccgtctcccctctcgtcttgccccgctggacccccgcggctcgcgcggacgaagtgccggcgctctccgagtgggagcgcatcttcctgcccatcgactccggcgtcgtcctcctcgacatcgccttcgtcccagacgacccctcccatggttttctccttggaacaagacagacaatactggagacgaaagacggcggcaacacctggttccctcgctccatcccttccgcagaggacgaagatttcaactacaggttcaactcggtaagcttcaagggcagagagggatggattatcggcaagcctgcaattctactgcacacctcagatgctggcgagagctgggaaagaatacccctgagtgcccaacttcctgggaacatggtttacataaaagctactggggagcagagcgcagagatggttaccgatgagggagcaatctatgttacctctaaccgtggatacaactggaaggctgccgtgcaggagaccgtttcagctactctgaacagaacagtttcaagtggcattagcggtgcaagctactacactgggactttcaacacggtgaacagatcggccgacggacgctacgtggctgtgtccagccgagggaacttctatctgacgtgggagcccgggcagccgttctggcaaccccacaacagggcggtggcacggaggattcagaacatggggtggagagcggacggtggactttggctgctggtgcgcggtggtggcctcttcctcagcagaggaaccgggataactgaagattttgaggaggtgcaggtgcagagccgggggtttgggatcctggacgtgggctaccgctcgcaggaggaggcctgggctgctggtggcagcggcgtgctgctcaagaccacaaacggagggaagagctggatgcgcgacaaggctgccgacaacatcgccgccaatctctactccgtcaagttccttgatgacaggaaaggcttcgtgctgggcaacgacggcgtgttgcttcggtatcttggctgacattctatgtatatgtgtgtacagcgaacggcatgtgctgctgctactactactgtaaaaggctgcttactgtgcttgcgttctctcttctgcaacccaaattgagtgtaaagatgcatgtgctgcttgctaggaacttgaaaaccttgtatacccgtatctactatctatatatatgctaccttgttgcaagaaaaaaaaaaaaaaaaaagcggcc

SEQ ID NO: 13908 - DNA, 4443 bp, Zea mays
taaaaaaagataagtggcaactgcgtccactgagatgcgacatgcgagcggtggcggggttgggggatcttcggctggttcgggcggggaggtggtttccacgccggaggcggcaactacgttcactgatgcaagcggcggcagtggtaggatgggtacgaccgtatgggggagaggcgtcatgtacgataaagttttgcgggaggtagaagcacaacaaaaacaatatagggcccgtaggctcggtactatatttgaggcctcactcaccgagtcctaaacgtgtttgacaaaattttgtaaaataagatctttgttggaagctatttttagccttgagtcctatattttaaaataggacccagtttaagacctttgttggagttgttctaatataacttagagggcctgtttggttttgttaaactaaattttagttagtttagaagctaaaatactaaacaactaaagttaaaaggggctaaaatattttagctccattatctcacaaggagctaaagtgggctaaaagccgtgtacccctccacccacgtggccacgtgtgagcaacggagagagagtgtggggattaggacattttagtctttgtggacagtattaattgttttagtaactgttttagtcagagaatctaaacagggtgggctaaagtttagactctaaattttagcccttttgtttcagcccgaaaaaaccaaacagttactaagcctttggatcataaatgcaataaagacacaatatatattaatagttatgtagagattgacttttacgaagagtctgtcgctttattttttttgacatttagctttgtagagaccttttaagagactatttatttaattgtgttttacatgtactcaagcaaacgaatgaacgaactggcttgtttgttgtgtttgatggtgactttaattcagatacgggtattacttctacaacattttgtttctatatattagagccgctgattattctctttcaccttgactcggaaatttctccggtaaaatcaccaccagatttcattgagcggcgtacgtccttttcacccactctctagtaacacctgtcgcccgcccatgcccccatgtctccgcccatcacccacgcacaagtccccgcgcagcaccagttttctaaagtcacgatcctccttgcgtggcaccgcgcctgcgctcccgtccatccctcgccgactcaccccgtcacggcacgtaagcacactgtccacgtcgccgctgactccggagcccgcgagctgaggtctcccacctcaatcaccccgaaaccgacacccggtttcctccgttttcacagcagtgccgtgcccgttgccgcgcgcgagggacccgcccgacctcggccggccccgcgattgcaacgcccactgccgatgacttccccatgcgcgacgggctgcacggggctggcgggacgcatagaggcggccaaagccgaaagtgcactcgttcggttcctctgtccgggcccccatgacgcgcgcgtctaattttgatccctgcggtggcatgtcttcccggcccaggattagttcgtcgaccgccgagtcaaactagacacgacacgacacgagccctcgtgccatcgtgtgcgggcgccacagccaatcccgtcccggcacgcagcgcggtcgcctttttgattactacaacgatcgcatcaaaccagggcggcgttttgccggagttaacaaaagcatcagaaattgccgccgtgcagaggggacacacgtcacgttgtttgttctccgcctccgcaccgagatcccgtgcgcggacccggaacactgacgcgccgatgcggtggcccaatcgccggccgccaacacgcacgcggggggcagcggttgcgtcgtctggtgcgcgattagatttgattaggttagacgtggtgcgcgataaatgatgcctgctgcttatgaccagcagaccggcgcgcgtcacgtgtcgcggcggggctgaacagctgcggcaacgtgtcgtgcaaggtgagcccgtggacggcccagatgcggtgggcgccagccggtccgcctcagaatgagatcgcgcgacccgactcccggcgccgcgcgagcccgcgagacaggggctttaaaaggggcgcccggcaggcaccacgggaccctctctcaactctcgtttcgccggagtatttagcttgcttcagggagcacgtggcggtggaagcttccctaggggtggcggaggcggtggtggtgcttggttgatgtcgatggcgcaggtctgctgtgactcggccgtagcggcgacggcggcaccggtggttggtgcggaggcggaggccagggccagggcgcgcgccgagaggcggagccgggccggagagtctggggcgtggaagcacgcggtggccgctggcacggccgatgctacgaggaagcggagtctcggggcaggggagctgctggtggcgcggaagcacggggcggcgtcggtggccggccgcaggagggagatggaggatgccgtgtccgtgcgcgacgcgttctgcgcggagggcacggccgacggcgggaggcgcgacttctacggagtgttcgacggccacggctgctcgcacgtggccgaggcgtgccgggaccggatgcacgagctggtcgccgaggagctcgccgccaccgccgccgacagctcagtctccgcggcggcggcctggaccgtggcgatggaacgcagcttcgcgcggatggacgccgaggtgacgtcggccggcgggcgcgccgccgccgccagaagcagcacctgccgctgcgacgcgcacaggtgcgaccacgtgggctccacggccgtggtggccgtcgtggaggagcacagcgtcattgtggccaactgcggcgacagccgcgccgtgctctgccgtggggacggcgcgccgccgctgccgctgtcgtcggaccacaagcccgaccgccccgacgagctggagcgcatcgagtccgccggcgggcgcgtcatcttctgggagggcgcgcgcgttctgggcgtcctcgccatgtcccgcgccgtcggggacggatacctgaagccgtacgtgtcgtccgttcccgaggtgacggtgaccgaccggtccgacggcgacgagtgcctcatcctgggcagcgacgggctctgggacgtggtgagcaacgaggccgcgtgcgaggtggcgcgcgcctgcctccgcaggggccgggccaagtggtgtgccgaggccgccgcgttgctcaccaagctggccctcgcgaggagaagctccgacaacgtctcggtggtcgtcatcgatctccggaggaggaatcactagttctgtgcagttgtcagctagtactagtactccctccgaaggatggctggtcgcacaagggatttcgcgggggtgcctaattgggttttttttcttccattttcattcaaaaagttttttttttttttgctgtactctccctgaatcaaaaagttcagaggagcccttagattaattattgtggtagagccggaatttggtccggataccattcggagaggtggtcgcgtagaaaaaactcagaggagagacggtctcacaagaaaatcagtctgtgtattgtatcatctagacatctaatgaaatagcaaccgaaacaaacaccacctccggtgtctggatgttctcgcataaaaaaaaaaaaaaaactaaactagacttgcgcagaaccagcatgattcacgttatatacagtatcggttggttggtgcaggagagcactgatgaaaaaagggaaattgcgcattgaaatgatgttggacaaaagataaactgacatgtttcaaatttcataccatacgtgaacgtgatgagcactcgacgcgagggaggcagatattttggcagggttacttgcaccgcccgaagcggattgcatgagcagacttcccccaattgcagaggcaggcaccgtggtccaaccagccacggccacctcaccctcccagctgttccgcatcgcacggcacgtctggtctggtctgtcgtccggcgaagcgagcgcacaggcacagctcgacgattctcagggatctctcgcgcttttcctgagagcgacgggcgacggctccgtgcggccgcgacacgagctccgattccgtgcaacgagcgcatcattaaaggcaggcagcgcgcgcacagtgggacgaggcagaaaggaacggcctctcctggtctggtgccgctcgtccaggtgtccgccccacggcgcatgcacttgctggtacgacagctgactgctggcgctccagctgttgagcgtttggtaccataccagcagaggcaggcagggatcgacggtggagtggacacgcgtttccgtgtccaggtggttgaagtctagctagaatgctagatgtgctaggaaag

SEQ ID NO: 13909 - DNA, 1611 bp, Zea mays
  misc_feature (851)..(851): n is a, c, g, or t
aactgttctctcgccgccgttctagttccgttttgccttgaggtgcacgtggcggtggaagcttcccgggcggtggcggttgttggttcatgtcgatggcgcaggtgtgctgcgactcggccgtagcggcggcaccggtggccgggccggaggcggaggccagggccagggcgcgcgccgagaggcgtcgccgggccgcggagaccgggaggtggaagcacgcgccggcagccgcagatgccacgaggaagcggagcctcgaggccggggagctgctcgtggcgcggaagcacggggccgcgtcggtggctgggcgccggagggagatggaggacgccgtgtccgtgcgcgagtccttcgccgcggagggcaacgccgacggcggcgggaggcgcgacttctacggggtgttcgacggccacggctgctcgcacgtggccgaggcgtgccgggaccggatgcacgacctgcttgccgaggagctcgccgctgtcgacggttccggctccggctccgcggcgacctggaccgccgcgatggaacgcagcttcgcgcggatggacgccgaggcgatgtcggccggcgggagcgccgcctgccgctgcgacccgcacaagtgcgaccacgtgggctccaccgcagtggtggccgtcgtggaggagcgccgcgtcgtggtggccaactgcggcgacagccgcgcgctgctgtgccgcgggggcggcgcgccgccgctgccgctgtcgtcggaccacaagcccgaccgccccgacgagctggagcggatcgaggccgcgggcggccgcgtcatcttctgggagggcgcgcgcgtgctgggcgtcctcgccatgtcncgcgccatcggggacggctacctcaagccgtacgtctcgtccgtgcccgaggtcacggtcaccgaccgcgccgacgccgacgagtgcctcatcctcgccagcgacggcctctgggacgtggttagcaacgaggccgcgtgcgaggtggcgcgcgcctgcctccgccgggggcgggccaggtggtgcgccgaggccgccgcgctgctcaccaagctggccctcgccaggcgcagctccgacaacgtctcggtggtcgtcgtcgatctccggaggagggatcactagctagctctgagcagttagtactaatacagtagtaggatggtgcacaaaaggatctcgcgggtgtgtgctaattgtttttctgtctttctcgtcaaaagttattttttgctgctctccctgaatcaaaaagttcagaggagcccttagattaattattgtggtggaaccggaatttgatccgggtaccatttgggatgaatgaaaccttgcatagatcagaattcagaggagttggtctcagaaggaatgatatgattcacgcgttatgtacagtatcggttgttcggtggagcactgatgatcaaggcaattgggcagtgaaatgttggatcaagcaggaggggctgtgaaagcccaactaaaattaattactcccttcatctcgaactaaagcacaatggtgcacacagattgagattattttttgctactccctgaatcaaaaagttcaaaggagcgcttagattacttattg

SEQ ID NO: 13910 - DNA, 1461 bp, Zea mays
cccccccccccccccccgcatcacggccgaacgctttaaaaggtgcgcccggcaccactggccgtcgcggcccccctcctctcaactgttctctcgccgccgttctagttccgttttgccttgaggtgcacgtggcggtggaagcttcccgggcggtggcggttgttggttcatgtcgatggcgcaggtgtgctgcgactcggccgcagcggcggcaccggtggccgggccggaggcggaggccagggccagggcgcgcgccgagaggcgccgccgggccgcggaggccgggaggtggaagcacgcggcggctgctggcactggcacggcagccgcagatgccacgaggaagcggagcctcgaggccggggagctgctcgtcgcgcggaagcacggggccgcgtcggtggccggccgccggagggagatggaggacgccgtgtccgtgcgcgagtccttcgccgcggagggcgaggccgacggcggccggaggcgcgacttctacggggtgttcgacggccacggctgctcgcacgtggccgaggcgtgccgggaccggatgcacgacctgctcgccgaggagctcgccgctgccgtcgccgccgacggctccgcggcgacctggaccgccgcgatggaacgcagcttcgcgcggatggacgccgaggcgatgtcggccggcgggagcgccgcctgccgctgcgacccgcacaagtgcgaccacgtgggctccaccgccgtggtggccgtcgtggaggagcgccgcgtcgtggtggccaactgtggcgacagccgcgcgctgctgtgccgcgggggcggcgcgccgccgctgccgctgtcgtcggaccacaagcccgaccgccccgacgagctggagcggatcgaggccgcgggcggccgcgtcatcttctgggagggcgcgcgcgtgctgggcgtcctcgccatgtcccgcgccatcggggacggctacctcaagccgtacgtctcgtccgtgcccgaggtcacgctcaccgaccgctccgacgccgacgagtgcctcatcctcgccagcgacggcctctgggacgtggttagcaacgaggccgcgtgcgaggtggcgcgcgcctgcctccgccgggggcgggccaggtggtgcgccgaggccgccgcgctgctcaccaagctggccctcgccaggcgcagctccgacaacgtctcggtggtcgtcgtcgatctccggaagagggatcgctagctagctctgtgccgttagtactaatacagtagtaggatggtgcacaaaaggatctcgcgggtgtctactaattgtttctctttgtcgtcaacagttattttgctgctctccctgaatcaaaaaagttcagaggagcccttagattaattgttgtggtggaaccggaatttgacccggataccatttgggatgaatggaaccttgcatagaacaaaaaaaaaaaaaaa

SEQ ID NO: 13911 - DNA, 892 bp, Zea mays
  misc_feature (886)..(886): n is a, c, g, or t
gagaaagaagaagaatctgtaactcgcaagaaggaaaacagggacaataaccagtgcggttcgccattgttgatgcgacacgaggtacatcagtcatccatcatcattattaaggctagaaaattgcctctgatgcatcatgtcgccaagaactcgaagagacgccgtgcacgctcgctgtggccaccggggcccgcgctggggctgccagggccacgcccaaacatcgggccagaggcgctcgccatgccacgcgcccgcgccggccgctggtccgcaccagcgacggtttccggatgcacgacctgctcgccgaggagctcgctgccgccgacggctccggctctgcggcgacctggaccgccgcgatggaacgcagcttcgcgcggacggacgccgaggcgatgtcggccggcgggagcgccgcctgccgctgcgacccgcagatgtgcgcctgcgcccgcgggatcggaacggttgcgcccgggccaacgtgctggaggacgcgcgtcgcgccctagcagcagccgcacacaccaaggcctgagcgcccgagccgctcctgcacgcccaccgcccggggctgctgggcctcgcccgtgcgcgcgtaggggcagcgcgctcgcgctgccaacctcgacggggcaccatggtcggacagccgtgccgccgagccgggggacgcgtgccggtgctcgtgcaccgaacagccgagggcgtcgcgggcccgcgccgggcaagcggaacgccgtcaaggggctgcctgcccgctctgccgcggggcctcacgcctgggcctccacgccgccgaccagggctgctggggactcgccctcgcgccgtcggggctggccgccgccaggaagaaagggaaatggttagggcnccggga

SEQ ID NO: 13912 - DNA, 2125 bp, Zea mays
ttgggtacctcgaggccggccgggaatatgtcctccagaaaggtctattctgcaaaaaagaacacaccgtaagctcccgtcccggacggggaagacctcgtgctgccgccagatctaaccaaaccccgcgccctcctcaccgtccggcgagctacggactcagcagatcaccgtcgctcgagttgtacctgaaggcgcgcccgtggaaccggccgcgagataagggcggcgggaaggcgggcgacgatgccggtggcagcgtcggccatctacttcctcaaccttcgcggggacgtcctcatcaaccgcctctaccgtgatgatgttgggggaaatatggttgatgcgttcagaatgcatatcatgcaaacaaaagaacttggcacatgccctgttcgtcaaataggaggctgctccttcctttatatgaggatcagtaatgtttacattgtgatcgtagttagcagcaatgctaatgttgcatgtgctttcaaatttgttgtcgaggcggtggctctcttcaagtcctacttcggtggagcttttgatgaagacgctatcaggaataactttgttttgatatatgaacttcttgatgagatcatggattttggttatcctcaaaacctgtcacctgaaattttgaagttgtatataactcaagaaggtgttcggtcaccattttcctcaaagccctcagagaagcctgttccaaatgcgactcttcaagtcactggcgctgttggttggagaagagagggacttgtgtacaagaagaatgaggttttcttggacatagttgagagtgtaaaccttcttatgtcttcgaaagggagtgttctaagatgtgatgtgacgggaaagattcttatgaaatgcttcctttctggaatgcctgatctgaagctgggattaaatgacaagattggacttgaaaaagaggcccaactaaagtccagaccagcaaagagtgggaagactatagaacttgatgatgtcacattccaccagtgtgtcaacttaacaagatttaactcagaaaagacagtcagtttcgtgccacctgacggtgaatttgagttgatgaagtatcgaatcacagagggtgtaaaccttccattccgtgttctgccgacaatcaaggaattgggccgaacacgcatggagatcaacgtgaaagtcaagagtgttttcggtgctaagatgtttgcacttggtgtcgttgttaaggttccagttccgaagcagacagctaagactagtttccaaacaacatcaggcaaagcaaaatacaatgcttcgattgattcactggtgtggaagatcaggaaattccctgggcagactgaggcaactatgagcgcagaggtggagttgatttctactatgggtgaaaagaagtcatggaacagaccacctatccagatggaattccaggttccaatgttcactgcttctggtttacgtgttcgcttccttaaggtttgggagaagagtggttataacactgttgagtgggttcgctacatcacaagggctggatcatatgagataaggtgttagcaacaaatccatacaagatcaagatattattgacaaatgatattcattggtctccattgagcagctatccacagagatcaatctgtggcatcatgcatgatcataaagcgcatatattgtgacacaagtatctgaaactttgtacttcaacagagggtggggcagggcagatcagacaattttctgtgtttcttatttccattgtagtctgggatctctgttcttccctccatgccctgtttgtagtagggattattttttgctcgtatatttggctgtagctttccttgtttgttgatcaatacacctgttcagtttgtattgttttctccctcaaatggatgtatggattcacttgcataacagtgtgaacaaacattcgctgccaaagatctggtacgttgttagtgtttgacaattgtagtgtctgataggaaggtacattgtgcccttaaatattgctgtatataaagtttatttgattgtgatgactgccggttttggcgcttatgagtcgagcactgcctcggcaagatattaatgtgaatttcagttggactgc

SEQ ID NO: 13913 - DNA, 1450 bp, Zea mays
  misc_feature (1035)..(1035): n is a, c, g, or t
  misc_feature (1220)..(1220): n is a, c, g, or t
cgcgcagcgccgtctcctgcgattcccggctgcctccacctcttctcccacagcgccggcgtgctcctctcctttcacgctacgttccctccggccccggcgtcgacggctaagaaacccttaacctaggaacgagttcgcaccctcgggacctgtggcgatgcatctcactctcgaattcgggggcgggctggagctgctcctggagaactccaccaaggtgcacaaggtggaggtcaccacgcccaaggacggccaaggcaaggtgacgatgaagttcttgctctcttgggtcaaggagaatctgatcaaggagcgcccggagatgttcctcaaggctgattccgtgaggcctggggttcttgtccttataaacgactgcgattgggagctgtgtggtggtcttgatgcagagttggaagagaaggatgttgtggttttcatctccactttgcatggtggttagtttgattacatcaggatgataccatcctatgattttcctgaaaaccgcaccttgtatcaagtctttggaagggatggattggtctgagttgtgtggctttctggagatactaattgcaaattgcggaactgcacttgttggtgctaatatcatcaaactgtagttccattttcttactgggacgcaggcacataatattgtgcacaaccgatcctgtatttttccagtactgctgtggctctcccccgtttgctgtatatacataaatgaaaggtcaagtgaagtacgtatttcttaaaaaaaaaaaaaaaaaaaaaaaacactgttcatgcttgtcaattggtggaatattcgctgcccccatgcatttacaagtgctgccttcaccccacgattcatgaaggtcacccggtattttggcagcctgcaaagaagcactagcacactcgttggaaatacagagaattcggttcacgagtctcttcatgctggggcatgttttgccaatcagtaaccctttattgcaaatgtgaaagttactgataagcacttgagagaaattttgaagngcaagagagcatgagaaaaaaggcgcacgtaaaaactgcatgcactccatggcgttagtgagtttaaaatccaaaaaagtcaaagccttcgagccttgattgagtactctagtatttaactcaatccacatatattaaaggcttgttcggttattttcgttctatgtggattggagggtattgantgagattgagatggatcttgacttattatggatctaaaccaacttaataccatccaatccacatggattcgcgctaaaacgaacaagtcctaagggcttgttcggttattcctatcacatgtggattgaatgagattggaaaaaaatatgaaagattttgacttgttcgggattgaaacccactcaatcccacacaatccacatgaattgagagcaaaacgaacaagcca

SEQ ID NO: 13914 - DNA, 1996 bp, Zea mays
cattgggtactcgctcacgcagtcgtggcactcgtcgcggcagtcggcgctgtcccctcccctcccgtcccctcccgccggtcgctgcagtcggcgcccaacccgtccatccgtccgccagagcacatctcacgctgcgggtcgaacagcccgtccgtcaatcaggtttcaggccgacggcggcacgatggcctgccccgccgccaccgccaccacggctcgcatcggggcgcggagaggaccgtgcctgtggaggagcgagaggagggccagcttcctcgtccgttccacgtccctgctcccggaccgcccggtccgggacacgagggcgcgcgccgcctcggagctgcagcaagcgcctcgaccagcctccgctaccgtccccgctcacaaggtcaccgtccacgaccgccagcgcggggtcatccacgaattcatcgtgcccgaggaccagtacattctgcacacggcggaggcgcaggacatcaggctgccgttcgcgtgccgccacggttgctgcacaagctgtgcagtccgaataaaatcaggacagataaggcagcctgaagcacttgggatatctgcagaactaaaagataagggctatgctttgttgtgtgttggtttcccatctggcgatgttgaagtcgagactcaagatgaagatgaggtatattggctccaattcgggagatactttgcacgagggccagtggaaagagatgattacgcgctagaacttgcaatgggagacgaatgagctgtgcctaagagaccttgccatctaaaatttgaataccatctcaaatttggacccatgtagttctgagtatgccggttatctttttgtggctccaaatctcactctcagccttctttccttcggctgttagcgtttagagtgacaaggacacttcctgagaggaggaataaagttctgctctgctctctattttccaggttgcccccttcccgcctttccttgttcggttgtcacttatcagcctggtgcgtggctgcgtgcagttctcgtttctcctctaatagatggcacacgttatgaagtgtgtaaaggtgtcaaaatccaaaaacatccagcattcacaatctttgtcgtgatgaagtgtgtaaacttgtaaaaatttatccaaaatcgcttccacgatcctacgagtggctaactagggctggttgaagttgttccaagctgttgtgtcgctagggtatatttagttcgccatcttatcatactttatctaacttttttttactaaccttagataaattgtaaattgtggcacagtcaggggcgaatcaaacatgtttctagtagagtggaaaatatatgacgtggaactatatataacactgtttgtagagataagtatgaaataggggatgatataagagattagatagaggagcgtttcggttgctaaaccagtgcgaacgaaatgtttgcgctcgctgtgtcgctatgtgccgagcggacctgacagtggcagcgtgcggcaggtagcagcggcttggctccagtccgcgcggggtctgtctgaacgaagagtcgaagacgaaacactccctcgcagcgcaaacgtgaaattccagccgagaaataggaatacttggtgaccaaagcttcagaaaccattatgaaatgcacgataatttgaaatggatcctagtcctatactcctatcctatatgatgcgaaagttaaccaaacataccaaatgtgatggtcaaattttgtcggcctcgtgcccatcctgtactcctctgcaactccaggcccttgtcatatttacatgtcctgcgaggtttcttctcttcctaaacctgtgcttctaccccttgtcatcgattacttgcttatcctaggtcccggaggtgctgcgcgagtcctttaatgtcgtgtattgcagcgacgcggtgatgaagaaggtgtccgggatgcaatcggctgattccaccgaggcgattgctgtcatgcaca

SEQ ID NO: 13915 - DNA, 1181 bp, Zea mays
gcacgagaccattacctagaacatcctaatcgaaaaatttcctttccagcgaccggcgagcgcacagccacacgcacagaggggtgttgccgtgtagcagagcagctcgcgccatgtccctgtccgtcggcggcgcgcggacctctctcctcccttcttcgttcaccgcctcttcatcccgcccgcgcttcctcgcgcttcctctccaccgccgctcgcacggctccctcacctcgctgccggccgcgtgcaggcggcggctccgggtgcgcatggcccggacggagtccaccggcgtcaccatcggcttccgcgcgccggatttcgagctccctgagccactgactggaaagctctggacgttggatgacttcgagggcaactctgcactgcttgttatgttcatatgcaaccactgtccatttgtaaaacatctgaaaaaggacatcagcaagctcgcctctttctatgtggagaaaggacttggtgctgttgccatatcgtccaactcagttaggacgcatccccaggatggcccagatcgcatggctgaagaagcagagctgttcaaatatcctttcccatatctttacgatgagtctcaagaggtagccaaggcttttggagcggtctgcacgccagagttctacttgttcaaaaaggatggccggaggccttttgaacttttctaccatggacagttcgatgactcaagacccagtaacaacgtgcctgtaaccggaagggacctaagccgcgcgattgactgtgcgctcagtggccaagaactgccctttgtgcaaaagccaagtgtcggctgcagcatcaaatggcacccatgaggtgctcacagtcacagcgtcatcctgtccaaacaggccctaaaccttgttcggcatttcttgtgtgacggagctgaagatgagacagagttgtgtgggagaaacagaaacatgggaacttctcctgtgtgacggcgaaatagtgtagcgctagcgcagcaaccagcaaaaggctcatgtaaagaattgttcacgaaacagaagagcttcacttctaccttctgtaggacatggtcatcgcaagaggcataaatcgcaaaaggcattggtattatttcctgctggaagtaagcgcccccgggacggatattcattttcagggtgaatttgaattttttt

SEQ ID NO: 13916 - DNA, 1492 bp, Zea mays
  misc_feature (1401)..(1401): n is a, c, g, or t
  misc_feature (1428)..(1429): n is a, c, g, or t
  misc_feature (1444)..(1445): n is a, c, g, or t
  misc_feature (1448)..(1448): n is a, c, g, or t
tgccttgtatggaaatctaccgagaatcaggtcagatatattgccgtgcgtggaagcgaagcacaacatgcacaaacagagcaaacagtttgatttctccgtcagaaaaaagagcacagagcactgataagcacgcgttcagaagaaactcgatctcctccccagaagcacaggcaattcatattcccgaatgcgatctgctcctctgcattgtgtgcaccccggtcccccccacaatcagagatgcctttcatggctggccaagcaaagcagccgtgccgcgcgagccctaccactagcaccagtctccctttgttcgtattcttcttgcaccagccggcctcgtgaagcctccggtacgtcagcgcccgcaggccgcaacgtggtacccaccagcttttttcactcctaagtcctaccacgcgctgcgttccactacaagttcccctcgcgcccccccccgccccgacaacggttcacacttcacagcccacatcaacaaatggccaggaaagaagtgacgctcctgctcttcctcgtgctgcttgtcgcagccgtcgaggcacagctgcacgacgagcctacggcggccgctgtcgggcggcggcgtggcgcgaaggccgccacggcgccgacgcacctccacttcttcttccacgacacggtgagcggcaagtcgccgacggcggtacgcgtggtgagcccgccggcgtcgtcgccgtcgcccgtgttcgggatggtgaacgtgatggacgacccgctgacggaagggccggagcaagggtcggcccccgtcggccgcgcccagggcctgtacatggggtccgaccaggccaagatcggcttcctgcaggccatgaacctcgtgttcaccgcgggggactacaacggcagcacgctcgcgctgctcggccgcaactgcccgctcgacgccgtccgcgagctccccgtcgtcggcggcacgggcgcgttccgcttcgcccgcggctacgcgctgctgcgcacccactggctcgacttcgccaccggcgacgccaccgtcgagtacgacgtctacgtcacggactagctaattaataacgtaccgccttgctagccctcaccctcactgatgagtgccataagcattactacaaagacaggaccacgcaacaacaatggtgccaataaaggctttgaagcatgcttcgccacagagcgcctgctttttcttttaaaaccagcattttcgtttcagcttatatatatatttatagaacgcatgatctgtatccaatacaagcttcagaacccctttatgttttcggaaaaggtcgtccaaaactccggtccagattatgttgctatttgaaaactgaggcaatatatagctttatatcattacatgtgagtgtgtgtttnctgtcagaccccccacttacgccactnngggcgaggccagagnnatnccaggaaaactgaagggttccaatattgttttgctttggtgtcc

SEQ ID NO: 13917 - DNA, 1927 bp, Zea mays
ccccctagcctaggcccctatccctatccggctcctcgcccaccaatctgtacacactccgacgccgacgcgaaatcgaaaggaccaccaagctcaaaaaagcgccgcccggcgccgatgttgctgcggcggatgcgatggatgtcggagggggacggccggtgggagctggatgcggagaccccggtgacgatggagggcacggcgcgccccgtcccgggggaccccctgccgctggggctctcacggggctaccgcatcacccgtcccaagcagctagacttcttccaccggttcatggcgtcccctctggtacccaccttctccgccatgcgcgacggcctctccgtcaaccacgcccacattttctacatgacagacaactggtcttctaccatcttggagaaaatcaatgttaagaagcttgtgtctgtcgtgaaagagaaattagcaaatcggcaggaagaggcctcttggaccaaagatttgaagaaccacttgcatgatgttatgtctttaggtgtaggcacggaaatcttgatcacaccagacaccactttgctgctggagttatttgatatcaagaaaggcaatcgaggaaaagcgatatttcaccacgaggcaaaaaatctggatgctcttaacctatttgcttcctcatcataatattacattccaagcatcttggcctggattatttgttgataagaagggaacatattgggatgtgccattatcattatcagctgaccttgcttcagttggctccagttctggattgagttatcatctattattgcagcagaatagtggggaaccaaaatgttttgggggtgatgaaacagatgatgttcctactgctctgttacctggcctatgtgctaaagtggctatttccatgaagaaaagcattgatgcttggaggaaaaaagaagataagctaaaaaatgttcagccatatgatgtatttctctcggattcacatgtttctctaactggtattgttggtggagtagccagtggatatttgggagactgttcaaggagagtggctatacgagatgaaacacacaagagtaatgcttttataatgtttgacgagaggaataaacgtgctgcctttgcagacctctttgcttctgttactttcactgctcaatacgggaattttcagaggctttttctggatttgactaaggcaagtgcccgatttgatatcacctctggttcattgttcttatgtggtgcttctcgccttgcacaagatttcttcttctctagaagacctgatgtagagacattctgcgatatttgtcctgatgtgactgtttcctttcaacaacagatagttgggcccttcagttttcgtgttgaatcctctgtagccattgaccccagaagccagaaccattttgttcgagtggatgatccgatcttcgcaattgattgggctctcaaagtcctgggttcagcaaaggccacagcgtggtattcacccaagcatcaggaggccatgatggagctccggttctacgaaacctgaagctgttcatcgtgaacgttgtataaaataatgcctggacttcatgatcgcctatggtcgctgatttcactaggatcagattgtatgaatggctgacgccgtgatggtcaaatgaatcaacccccgtgtaatatctattcatatcctgctttaccggtttgagccaaaaagaaaaaaaaaacttcaggtgatgtagcttgtgctgttctcggcgttaacagaggaagttaatactgtttgagtctttagtgaacttgctaggtgaaccagtctgagtttctgattgccttttgtcagtgtacaaaaaccatgcccccaccatttttatttctttaaatatatgaattttagggtgagcttattaaataattaatccttttttag

SEQ ID NO: 13918 - DNA, 1545 bp, Zea mays
  misc_feature (5)..(5): n is a, c, g, or t
  misc_feature (54)..(54): n is a, c, g, or t
  misc_feature (123)..(123): n is a, c, g, or t
  misc_feature (125)..(125): n is a, c, g, or t
  misc_feature (153)..(153): n is a, c, g, or t
  misc_feature (159)..(159): n is a, c, g, or t
  misc_feature (175)..(175): n is a, c, g, or t
  misc_feature (183)..(183): n is a, c, g, or t
  misc_feature (189)..(189): n is a, c, g, or t
  misc_feature (204)..(204): n is a, c, g, or t
  misc_feature (208)..(209): n is a, c, g, or t
  misc_feature (211)..(212): n is a, c, g, or t
  misc_feature (216)..(220): n is a, c, g, or t
  misc_feature (225)..(226): n is a, c, g, or t
  misc_feature (228)..(228): n is a, c, g, or t
  misc_feature (235)..(235): n is a, c, g, or t
  misc_feature (240)..(243): n is a, c, g, or t
  misc_feature (254)..(260): n is a, c, g, or t
  misc_feature (263)..(263): n is a, c, g, or t
  misc_feature (270)..(271): n is a, c, g, or t
  misc_feature (274)..(277): n is a, c, g, or t
  misc_feature (279)..(298): n is a, c, g, or t
  misc_feature (300)..(308): n is a, c, g, or t
  misc_feature (310)..(320): n is a, c, g, or t
  misc_feature (323)..(326): n is a, c, g, or t
  misc_feature (329)..(332): n is a, c, g, or t
caaangggggagggagagctcgcccagactgtcagaactcttaaaaggggttcntccaccggaaagggggtcttgcgggggcgaaaaccttcgaaggaaggtaaccgcaggggggaaccaagnanggaagggcgcgcgcgggaccccgcgacnaggttngcgagcgcccgggggncgggcccngcgggncggggcaaacccccncccnncnnggcnnnnnccccnncnaacaacnccccnnnnccccccccggnnnnnnnggnccccccnnccnnnncnnnnnnnnnnnnnnnnnnnncnnnnnnnnngnnnnnnnnnnncannnncgnnnnccttgggtacctcccccccccccgggcatctcattcctctcctctctcctccccccctctcgctcgagctctgttggaggcaggagggcaggccagggcgccaggccaggcgaggtggttcggttgacgagttcttcctcttcctcgacatcgccgatcccgccacgcgctgcccgcagcggaggtgagacacaataatcttaggtgaggagcatagttcaaaagtcaagatagaaagggcattggacactggaggaacgttgtgttggtggtaactgaggtttgtgcttgtttgtagatggagaggttaagcaccaaccagctctacagttctggtgttcctgtaaccgtaccaacatctctgccttgtataccagtctctctggatgagagcttcccgaggcttcccgatgcacagagtgttttgatggagagagaattgaggagcactccactaccacctcaccagacaactgttgctcctatccgtggtctgtttcactccaatactggatctgttggtcctttgtgctcacctccgtctgtaaggttctcttcgcattcaaatcctgagcaataccccaaccacaattcatacaattctcaagtaccaagcactgcaagttcctcaacgctgaattatgggtcacaatatggaggctttgaaccatccataaccgatttcccaagagacattgaaccaacttggtgccccgatccagttgagagcattcttggatactctggtgatgtccctgctgggaataatttgactgggaccacttctattggagcttcagatgatcttactaagcaaactgaatggtggacagagtttatgaatgaggattggaaggacatggttgataacccgacttccacagaaactcaaccggttgggcaacctgtgcaatcatccaactcagttcaccaatcagctacccaacaaacagtttcatctcaatctgttgaaccgttggcagttgtggcacccctcacccaattgctgggttccaataacctggcaagggaacgcatggaaaatggaccttcctgaaccttcaccgaggggcttttgggggaatgcttgctaaaaattactttgggttgggcaagggaaaaaaaaacaacacttccctaaaaggttgggtccccggaacagcttaaattggaaagggcaccaacaaattttgtaaccccacttttattgcag

SEQ ID NO: 13919 - DNA, 2110 bp, Zea mays
ggaccctcgaggccggccgggccggggtgaaatcgtcaccgcagaaaagaatttctgtttcccttcaatgagatggagaatccgagaatgggataagaccgcgccgcgcgcgctctcctctccgccactctcaccgtcgcctgccccgccatgacttccttgctgttgccgccgccgcaggcggctgccgcagcgtacggatgctgccactgtctcctgctcgcttctaccaccgtgccggcgaggagtgggtgcgtgggacgcgccagcagaatcacgctcgcgctccgctgcctcccgattaccgggcacaggctgaggagtcgaaaggttgcgtgccaagcgacgactgagaccgagcccgagggcaatggcgacgaggaggataagaaagagtttggagatgatgcttcatcaccttcagtttataatgttgcagaagcaaatgggccgggagaaaatgactcgagtttagacaataagaaagatgaaaccacgaatgcagaagcagcactgctgagctccggcgacacggtccaggacatggatgcagatgctacttctaccaatggcatacaagaaaatgtggaagttattgaagttgctagtggatctccattgccaggaatgaagcaacagcttgatgattctgtcaggatccccaaggctacaatagacattctaaaggatcaagtttttggatttgacacattttttgtaacaagtcaggagccttacgagggtggagtattattcaagggaaatcttcgtggtaaaccagccaaaagttatgagaagatcacaagtcggctacagaacaaatttggtgatgaatataagctttttcttctcatcaacccagaggatgagaagccagttgctgtggttatacccaagcagacattacagcctgaaactacagcggtcccagaatggtttgctgctgctgcatttggattagttaccatcttcactctgctacttcgaaatgtacctgttctacaggagaacttgctatcaacatttgacaaccttgagttgttgaaagacggactatccggtgctctagtaactggccttataataggggtgcacgaaattggacatatccttgctgccagggaaagtggaatcaagctcggcgtgccatattttgttcctagctggcagataggatctttcggcgggattaccagaatcgtcaatatcgtccgcaaccgtgaggacctactgaagctagcggctgctggaccattggccgggttttccttgggattcgttcttctgctgctgggcttcgtcttgcctccaagtgatggccttggccttgtgatagatccaaccgtcttccatgaatcgttcctcgttggtggtctcgcgaaacttcttctcggagatgttttgaaagaagggacgcagttatccataaacccgcttgttctatgggcctgggccggtctcctgatcaacgctatcaacagcatacccgctggggagcttgacggcggccgcatagcgttggccatgtggggaagaaaggtatcgtcccggatcagcagcctcgccatcgggctgctcggggtcgcggctctcttcaacgacgtcgccttctactgggtggtgctgatcttcttcctgcagaggggccccattgctcctctctccgaggaaatcacagaccctgagaacagctacatcggcatcggtgctgccattttgctgtttgggcttctggtctgcctgccctacccgttcccctttgacccgtcgcagttaactgatatggatttcaacttctgagaaaaggaaaaaaaaaaagcaattacaactcaccggatgagatgtatttaacctgtcggctctgtattctgttgtgtcatcttttgctcaattgctccttgtagtagccaataaaagcagagctttcttgtgttagcttgcctgttgtattagtaggatgctcgatcagagtagaatatagatgttaataccccgttttaaatagggtgtttggtttgagtaataaactcattcctcacttttttatttggttcgtggaatggaataagttaattcatcgaaaaaaaaaaaaaaaaaaaaaaggccccta

SEQ ID NO: 13920 - DNA, 2485 bp, Zea mays
  misc_feature (2413)..(2413): n is a, c, g, or t
agtgttagggtgaaccgctgcgggagataaaaaagtagtgatggactgttgatgatgtgacataaaaaagtgatacatgggagaaaaatttaggagaaatcgctgcgaatagtcttagcaggcggaccggcaaacgatctgcagaagaagatttgttcgagaattttattttaggaaaaaagatgaccgaactgaatcacacgttgatggtgctgagtttgaagcacagccaatacgagtcacacggcaccgtcggcacggcaacgcgtctgcagcaggagcgggtcatatcgtatccagaccagagccagtttccacccgcccgcagccaacatttattccgcgtcgccccaatgcaagcggcacggcaccgaaacatcctccgcagatgcacctcaattaactgctagggctagccgagtataatcaccactggtagtcctagcaccagcccaccgcagcgccgctcaccgtctccatttaattaatccccctcctcccttcatatatgccgtgccaccaactccctctgcaagtacactccacttgctagccatgacgaccctcgccgcgctgctccttctggttgccgcttccaatgtcgtcaaggccgtggagtaccacagctttgtagccaccccgctgtctccccacttgtacaccgctccgtccttggacgcggacgaggatgtcttcggcggcagccttgccgtcgcggaggaggcggccgcggcgtcagactcggccgtgcacttccgcgtggtccaccgggacaccttcgcggtgaacgccaccgcgggcgagctgctgaagcaccgtctgcagcgggacaagcgtagggcggcgcggatctcggaggcggccggcgccggcggtggcaacgggagaaagggcgtcgcggcgccggtggtctcggggctggcgcaggggagcggggagtacttcaccaagatcggggtgggcacgccggccacgcaggcgctgatggtgctggacaccggcagcgacgtggtgtgggtgcagtgcgcgccgtgccggcggtgctacgagcagtcgggcccggtgttcgacccgcggcgctcgagctcgtacggcgccgtgggctgcggcgcggcgctgtgccgcaggctggactcggggggctgcgacctgcggcgcggggcgtgcatgtaccaggtggcctacggcgacggctcggtgaccgcgggcgacttcgtgaccgagacgctcaccttcgcgggaggcgcccgcgtggcgcgcgtggcgctcgggtgcggccacgacaacgagggcctgttcgtggccgcggcggggctgctggggctcgggcgcggcgggctgtcgttcccgacccagatctcccgccgctacggccggagcttctcctactgcctcgtcgaccgcacctcctccggcgcgggcgccgcgccgggctcccaccggtcctccaccgtcagcttcggggcgggctccgtcggcgcgtcgtcggcgtccttcaccccgatggtccgcaacccgcgcatggagacgttctactacgtgcagctggtgggcatcagcgtgggcggcgcgcgcgtcccgggcgtggccgagtcggacctccggctggacccgtccacgggccgcggcggcgtgatcgtggactcgggcacctccgtgacccgcctcgcccgcgcgtcctactccgcgctccgcgacgcgttccgcgccgccgcggcgggggggctccggctctcccccggcgggttctcgctgttcgacacgtgctacgacctgggcgggcgcagggtggtgaaggtgccgaccgtgtcgatgcacttcgcgggcggcgccgaggccgcactgccccccgagaactacctcatccccgtggactccaggggcaccttctgcttcgcgttcgcgggcaccgacggcggcgtgtccatcatcggcaacatccagcagcaggggttccgcgtggtgttcgacggcgacggccagcgcgtggggttcgcgcccaaaggctgctgagcccccaggccggagtggtgaacccgtcctctctcgagcgaggagagagagaattaattagcgagtgattagctggtaatcaagtgagccgccttgttagtcataattaatggatgcggtggcttgtgggtttgctttgcttggccttggatgctgttaaaaaaaccgcgggcactgggcacttgtcagagttgtcttgtgtctctctgacagtgctgtgtagtagtttggttggatgcgcgagaggagggaagatatcagcagcagcaggcggttggtcgatgaatagctgtaaaaggcactgtcaaaagtgttggggttataaaaaaagcggcgcttttaactttaaaaaaaaaaaaaaaaatgcgcgactgggcgtccagcacccctgccaccccanccaaagtacccacgcgcagggggttttgagttggggggctatgcgtcgggtgcgggctgcgctgcgagagcg

SEQ ID NO: 13921 - DNA, 6484 bp, Zea mays
agcggcaccgcgacttcctccagcgcgcctcttgcgacaaccctgtgtgccttgcgcactctacactccaacatcgatggtagacgatgtctacatcgaactctccaatcccgatctcaatgctggctccctctcaatcaccttctgcgctattctcctgggttctagtagaaagggaggatgtcgggagcgcacgtatatactcttaggcggccaggaatcatcaacggaatcccgagatcccggtctcccatctgcacgtcgcggcgcgattcgcgtgaggtgaacgcgctggaagcctgggcctacccatcggcgactgtaacgaacgtggtgcgcatgcgtagcttgataggctccaagtcctactgggctgcgcggttttgctctccgcaagaatcgcggcggccgttgccgtggacgccgcgtgggtctgttgtggaggggaagacgagtccgaccatggggacccacatgtcagattgataggtgacttggtatgtgctcaagagtggctgtcaagtgggtcccacccgccggtgtaacaacccaagacagccagccacaggtatgacgcattggaactgggccgcagagagaaaggttgggatttgggccgaggcaggggaaaaccggcccaaagtcatttcaaggcttttctattttcttttcctatttcttttcaagtttgtgcttcaaattcaatttaaatttaagtttcctatttcaagtctcaaatatccacttcaaattcaaaaccctgtttgaatttttaggatctcaaatataattttaatgtaaagataaattctcctttcattattatttatttttctgagtttcgcattatgtttagaactttaaatgtccagtttagatttgagtcatcaaactttaatactatccttatatgtccatactcatttaaataaatgcttataatgtttcatttttaatgaaatgaataatcatttagttggatagaaaacctttctacattcattcttcgtttgaaaagctcagtcctcaaaatccaaagctcaagtatagattgaagatatctcactctactattttatttctttatttactttatgattattatatttttttttcttataccaatttctgggccttacacagggcctcttcatttaccagcgtcagtacaccatcaacattctagagtgggctggcatgtccgactgcaagccctgctccacgcctgttgacacttaggcgaaaatcttcgatgacgacggtgccccggtcgatgacgtgacgacctaccgaagcctcgctagggctctacagtatcccatcttcaccggcctgacatcgcctacacagttcaccaggtgtgccttttgacatgcacaccccacgagagccccacctcactattgccaagtggattcttcgctacctctgtggcaccctggactacaaccttcttcagcctctccgacctctaagttgttcgtctatacagatgctgattgaggcggctgttacgacacgcgtctgtccacctcttgctacaccgtgttcctgggctcttggtccttgaagcggaagtctatcatctcttgcgctcatctcctgcgctgaggctgagtatgcactgtggccaacgacatggttgaggcgtcttggtttcgtcagcttctccaggatctccacaagccccctcacgcatgccgtcacactcgtctactgcgacaatgtcaacatggtctacctctccatcaaccctgtgtagcaccaacgcacaaatcatgtggatatagacctccacttcgtccgcgagcgtgtcgccgtcggcaatgtatgcgtcctcgtaccgaccacctcgcagttcgctgacatcttcaccaagggggctccgctctacggtgttctcggagtttcggtccagtctcaacatctataatgcctagagttgagactaggggggagacatgtgtgtcttaaccgtaatgggcttaggcccaaccaatatactatttcatctattaatatagcagcacaaccctagttagggttagagtttttattctcccaacaataatgacgaacatcttttaacataattaaaacagttaaaacttgacaacaatacttttgagagaatccataaacagtaaaattggtaacagtagattgaccaaaacctgtgacgttttcagttactttctgtacagatgctcatgtacaggtatgctacaaaattataatcaatcgcaagggatttgggctggtgcataatctatctacaaactgagagcgttgaggagagagtctctgctctggatcaatttcctgaacaaagtctcgactctgctcccaagatatacaatggccaactgtctcttgcaatttctccttgcgaacaacttttcttttcttaattgccttggagacaagggaccatttgctggaatttgatatggcaggtattctgttgtttatattgagatctagatcatgagatcactgagcgtgcaaggaaacaagggaaagaacgattgacttgctagcttcgcccacagctgctgccttgtttcctggttgtttctcatgctggcaggtggaatcggtgctatgttgagcttgagcctgtgtccagcttgggatgtctagataaccggaagcagaatcacctgcacgattgtgtagtttaatgttagattagatcgcacgaagaaaggatagctggatgctgcatattagcagaagcaacatttgaattcaatgttcttgattattcttcatgttgtcttgcaatgctggcatgtttcgcacgcctgctgtgccgtcagcatttacaatgatctctgaaatctatgattgcaagatgatcaatatgccatccaaatttcttgagcatttggtgtaccgcgcacatgatcaatcgcactgtcatgttccaactattagcaacaagaatccgtatggcagcttactctagtgctgtgctgatcaacaattggttgcaacaaacttaaaatttgtggctggagctggcatgttattggttaaggagagcaagatccactttacaaggatcttgtgcctgttgttgaggcgtatcccatgtgaatataaacgtgggcttctcatcgactaatttctttgaatcaacaaaatacgaagagcatcttgtgagtatattttttcgaactaaacttcagaagctaaagctcccaatttcagctgatcgtttttctgttttcgaggtcaagttaggagaagaaatagagagtagcgggcagtttgggaacatgatattaatcaaaaccttgctctttcatcaactacttttctgtacactttgtctcatatatacatcaaaattgttctgatgatcagccaatcctctaaaaggcggaagctaatcgcaggccatcggagttggttggttggggcatgacctttctacaggctaagagcattcagaagagagaccctgcattggatcagtctcctgaagacaacctgaacctggctctcaaggtcagcaatctccaactccaacgcttgcagttgctcctccctgtactcgactcttttcttctggaatgtcttggagacaagagaccacttggaggcgctcggcatcacgatctcccttgacagtaggtacaatgtcgactctagcatcgagagagcgacctctctcgcttcagacaacagcttgaccaccctgcagctttcagtgtcgtcaagagcaatgttgctgctggtcttcttgaactgcttttgcgccttcttggccaggcgggcataagcctgagccttggcctggacagacacgttgtttcctctcttcagacccagcagcatctcctgggcgatcaccctgagatctgccagcctttcttgcatggcgctgcagaggtcgagcagaacgagagagcgctccagctcctcctccactgctttcctctgctgacgctggctgctggtgctgggcaggcacgcgagctcatcgatgcagctgtagatgctcccgagcctggacaggccattggtgatagtttggactgtcgcagagggtgaagagatggtcgccttcaggctctggagctgctcctcgacgctggttttgttggagcaagggcttgagggcacacttgcggatctcaggtggcaggccataatgcttgggatggaacggaagctacagaacctcttctcgctggagatggaagagaagtcaagctgctgcaactgctatggtgtcttcatagctttgggtgccctctttatatagggaaaagaggttgacgcaactgcacagctgaataagcagacggcaagagccaaggggcatcactagctgagcttgattaggagtctgtctgctgtcatgtctgcattatgggtggcaaaatgagcagcacgggtgaaggggcattgaattagcatcagattcacactaatatcatgtgatccgttaattaacatgcaagttgccggtggaagcatggacagctatttgacttcgctcacatccaggctcccaagacgggtgtaatcatctgattctagaccattaggtgcagctctgaataattagcttattattgtcgcactgtcatgttgcaagtatcggcagcaaaggatctggtctagctcataatatgcgcacgctttgccagagatgcccatgtctcttaaacattaaaacatcgtgagagaatagatatatcagttttctaagggcagacagcagaaaagagcaattccctattttgttcacagtggttctaaattttcctgaatttacatttgattactaatgcctcaccaattccagatcattcactccgacagaagtttaccttcagtccaagacatttgttagaacaaggatgaaagggatatttatagccctctccaaaccattttgcacaaaaagacagtatggtaataaagaagagttgcattggatgattcaataactggcagcaaaaccatctgcacgggagcatagtttagtgtaagattcagatcatgagattggagaacaaagatgtgcaactagaacagctgttgggtaggctggttgatatatgctagattgctagtggaaggaacagttgacttcagcgttcttgatacttcacgacagcttggtttgtttctcctgcctgctttgcgttaagcatttagaatctgaatcctgcaattccaagatgtccacatgccttccaaatttcatatgcattggcaccttaccatatgctgaacaactattaattgcaagtgcgaatcacatggcttgagttggcatgctatcagttaaaggagcaagatccactttgttaggatcttatgtctattgttaatattagcagcccaataatggaccaataaccacgagcaccttatgataatttattttcctgaagaaacttcaactgcagcactcccatttcattggtagtttttttttatttccatggcccggctggctagtaggtccgcttagtaaatttgttcaggagttcgcttctagtcttgtaagtcgtcttggtttcttgtaattttctgttagttctactccttctaatatattggagcggcaagtcttttgcagcactcccatttcattggtagttttttttatttagctgtcctccatgttgaacgagacgaaagaggggaaaatcgacatcaggaaaatagactcaaaactttgacttccagttgagtatatttctgtacactctcatatatgtacatcaaaattgtttcgatgatcagcagatcctctaaaacacggatgctaatcgcaggcattagagttgttgtatgatctatctacagagtgagagtgttcagaagagaaactctgctctggatcagtgtcctgaacaaagtggcaactccactctcaagatcaacaatgtccaactccaacgcctgcaattgctcctccttgcacacaaatttcttcttctcaaatgccttggacacaagagaccacttgctagcgctgggcaacgcgatcttcttcgagaggagatgtgatgccgattcgagcatcgacacagcaatctcccttgcttcagccaacaacatgactaccttgcaaccttcgatgtcagaggcagccttgctgttgatcttcttgaactgcttctgtgtcttcttggccaagcgtacgtaagattgaaccttggcctgaagagccgcgttgtctcctctcttgagaaccagctgcatctcctggacgctgaccttgagctctgcaaagttctcttgcatggcgttgcagaggtcaagcaggacaagggagcgctcgagctcctcctccactgccttcctctgctgacgttggttgccgagcaaggatgtgagctggtcaatgcagctgtagatgctcacaatcttgttgagaccatcaaccatggtttgaatggccactgaaggtgaggagatggttgccttcaggctctgcggtcgacgaaaggat

SEQ ID NO: 13922 - DNA, 6221 bp, Zea mays
  misc_feature (1620)..(1620): n is a, c, g, or t
  misc_feature (4706)..(4706): n is a, c, g, or t
atgaagttaaataccaaaatagagaggctagtggcttactaaaacttcacccatgagctggattgaacctcaaaagtaactaatagactgggcctaaaagtagctaatggtctaaaatgcataaaacactgcgttttacggtttagaacgccaaaacgccaaaacgtggtttcaacctctaattagagttttgacgtttaaacgtagtttaaacatcgtttaaacgtagttttaataacactggccctgacggctcgctagtgatggggggccaggctttggggattttctcggtcgggactatgtttcggtctctttttaatataataccgggaggacggtctttcctttcctgaccgagtttttttctgtacgggaaaatgggggtgtagaacagcagctttgcatcttttgcttggtagtgcaggaggcatatatgtgcaattagcctaggtgcttatatgaacagaataatgtaccaaattaggattatgtttatttgttaatttcttttatgaatttgaagtactagtagtagttttttttacgaaagtgaagtactagtagtagtacaataagagcataagctacaatcttcccggtttaataattaatactatgtctcaaggaaattatgtagttcttgtttgtcatggtaaatgaaacagaaataatgccatactactatggatagataagcttttttccatctgacttaactaggttctaacaaaagttctttacatcgcttcccagaactcaacaagggctgatgaataatgttggactggttgcttttcttagtgatgttacttttctttgtcgactggtgttcttggaagattgttagactaccactggactctttttacttgacacgtccttttttaacatcggcagttttatcagcacttgctggattcctttttgcaccagtcgctgatagtctgaagatccaccatttccggaggagaggaaagtctgtttctccatcaagtagaaagccaacccctggaatgggaggattattctttgttcctgttggtatttttgttgcaaaaagagaggttggttccaactcgaatggagttaatggagcagctatgattaccctcatatttgcgatggttgggttgcttgatgatatttctagtctagcagtagatcacaattataaaataccgcgatggataaggttcttggttcaagtgagttattcttttccaaagtgtgaatgtgaaaatatagtgtcctttcctattacactgaattgaactttctgactaccttgtgtactttgcagattgttgctggcatttacttctctaactggttgggttctacagatatttcaacaccatatagcatgtaagcattcatgtagcttatatatgccttactccttcagtccttctacagcttgattgattgcagtttatcaatgaaggaaatatctggttcctctgccgcctcctttcggccttgcactcattggaaaagtatatatggttctggctgctgcatgttcactttccatgggtccggcagtaacactcgttgatggtcttgatggtttggctggtggtattgctgctttggcactcatagcactatctgttncagctctcccgatttgctctggtaaactattcagcttcctaagctatttcagagtttatcaattcaaattttattttttttatagcatagtagcttctccaaaacaaatatgatggatactatctttaattttgtctagagatttttaaggtcgtgtattccaacaacaaaaaacagttagtttagactgcacctctgtgccttgtcattcacatgcctagtattagtagctgcaccaaaaatcaagatcagaaatagtcctattttgtcaagctgtcatacaatttttgagcttttccttggacaaaagggctatgtggatgggaactatcattttgagctttttaattcgtcatgtgatggtagttttttcaaagttgtaacatagttagattttcatgatttctgcagaattcagtgtttttggagcatcaatgtcaggtgcttgcgttgggtttctttttcacaacagatacagggcctccgtggttatgagccgggttggttctttcgcactcggaggagcagttgccacaattgcatcatgcagtggaatgtttcttccaatgttaatagcatgcagtctcttctttgttgagctactgtttgcaatattgcaggtgcgtcattctgttgtctacttcacttcagtggttgcagttcccaaaaagtgatatatgcttcaagttatgtttgcggtctgcttaggatcaccctgtcaaagttcaactagcatccatttcatatgtttgcgctgttgtagggccacgaccttcttctcaattcagaatattaacccacgtggtctaattcccttttgctgcccaggttccttttcacatggctaaaaactctttccgcggaacaagcagacatcccctgaaaatccgcccctcgcattactacctcagacttctagggatgaaggaaccttatatcgtggcgggcgcatacatgatatcatgcttcctaactctgttggcaggataccttggccttgtctcagcgtagatgaactctcgtcgcttcctctctctttcttttcagttgtggtacatgataaaatccaggcagccattattgcttcatttttatgccaggtctgtgtttcagtgacacagagaatttaacagatgtagtcgttctttaatgttatgtttatatattaggtgtagacgtagattatacggtgtttccataggtaacagtgctgccatcgcgtcaaaggcactgtaggcggtagagtagtttatctgtttgtttgttgtatttcattttcgcgtgaaaggagactttgcagatcagcagatggggacggggtgttgcgacttggtcgacgtgcatcccgaccctacttgcaatgcgaacaggaggaattcctgcgagcaagcgaccacgctttgtttaaggctgggagtggcgtttatcttacccctaacgatacgcatagatgatgcttttgcccgagtacagcaagctaaactatgaggttcgtggagttacttattaaaggaaaatgcagatgcgtgttgttagtgggtgaataacagagcaagtagctgcatctgattggttccagaatgaacgagtctgtctacttctgaccacttggctcctgtgtctgccaaatttcgcccatgaatcccaacatcatctgaatagcagcaccttcggccacattggtagtgttcggtcttgacaagcaacgtaggcaggaagccatgttttcctctgcgttgacattgatagttttatccttaatggttgtacctggcagctgttaatctgcagctggtcgcggggatttcagggttctctcttctctgcgatgcatactgcagttgagttgtgttgtgtgggatcggctctcgttgtcgcgtcagaaaccgttctactccttgtccctccccagtcgtcgcctcgctgtggtgggccgccggagcgggcccaagaccgggccgggaatgacgtgggtgcgtgcgtccagcggtccaggctgctagctgggtagtttatctggatggaacgcggatctggcaggtcagcatggagattgcgatgcaaacaagaagcgtcgaagcgagcggcacagacagggcacagcagtgtgtctggctggctggtcgcagcccgagcgctggcacggagaatactgtaggagtactactactagacaggagacagcgactcgttcctggcggccgtttccgtgcgcggcaccggtactgaccgtgcggtagttgtacgtgcgtgcgggagaaagagctccaaccgcacccccaaacctccctgcacggctgcacccttgctaccgtgtactatggagggagaaagagctccaacagcttcccccaagccacaccctctataggggagaggagaaactcccaacatatatagatgagttctaatctcgccctattttttaattattctattttattttaataatcactctttttaagtaccgtaatatgatagcaatgtatactagcacagtacaaacagtctattatttttaaaatttcaaaaaactgatgagaatatgttaaataactgaattatagtatataggggaacctgtacatggttaatggatggcgagttgcaccttcgcttggtggtctgaaactgaagctgcacttgggtagttgggtaggttgggcgcgcgagcctcgactccgcaccgggacggatcgggatccccgacacaaaacaaggtggggccttcgaccgcggcgcgcgcaggcacgcagagccaccggcaccgcagaccacccaccagaccacgggacccgcgccgcactactgctgtgttgtgtgcacactgtacatatcgtactacttgcgaaacaaacagtccgtctctttgtctcaccttccgggcaacccattcatgcgacgcagggacagtcacacaacacagtgcagtttgttaataaatctgatgttacaacacactgccgtttgttaataactcgtggaggatccctttggtgttacgttttctaagtagatgaaggtaacataattaagatattgattatgcagtggccgactcagttgctatgcttaggatgtgccangaaaaatataaaaaaacaaacaaaaaaatagacattatcaagacttgaacattgaccatcatcaagtttaaaatataacacttacaccactatgctaactactcttatgtaatcttaggatgtgtcgtggcctatatagaccactcgttaggtccgcccatgtaattatgtctcttaaaaggtctcagttaaactatcaaactatcagtataacttttcatctatttatattacagtttatgaattttttaacctgctttttaaatttaagacttattattcactagtaaattgctcgcgcctcggtcaatatatttacacatttaaaagatcgttgttttaaatatgtgggagccacaaaatatatagatatacataaagctgatagaattagataaacagacaattggccgcagcagtagaatagttcagtgtacaaatgttcgcgaggtcccttcctagcttagtccctgaggttatgtacgtgatcttttgaccgatgaaaatgaaatcaacccaacgccgccctagacagataatatgacaacagcatcacagaatgatgaaacgaggcggtttttttttgcatttctggccaaatttaccgacgaatcctccagcgcacgcactggtcacacagcacagtacagcactacacatgcggtcaccaacccacttgtactcaacagctgttcattcagggtactatgctagaaggaattaataataataataatattactattatcgcctggcctcgccgatcagcggccagtccaacccgacccaatttgtttttgtttgccaagaaaataattgaatggaccatcccggccggcctgagaaggaggaggcacgagcaagccaacaccacaacctacaaataaatcatcacaccaccaacaacaccaagcaccacgggagggagatggcccccgccaaggaatcgaaatgaaaaaaaaaatgtgggagggagcaggcaagaaccacgaagcggcagcggaaccgagagacagaggcaggagcgcaagaggacaagaaggcagctcaggattctcagaacgacggcaacttggcgcatcgctgcttgaggtacacggagcagccgtccttgggcacgatggtgggcatgtacaccgggtcgtcgcacccgggcgtcctctcccgccggaagtccaccaccgacacgaacagcgccatgaacaggacgaggtggttcagcgcgtaccgctgccccacgcactggtgcggcccggcgccgaatgccaggaagttgcgcctgtacgccacgtcctcccgccgcgcctccgagaagaagcgctccgggtcgaacgcctccgcgtccgggaacccctggaacgacgactcgtacacggacgggaacacgatggcgcccttgggcaccgtgtaccactccgtcagctggaacgcctcgcccgcgatgtgcggcaccagcgtcgcggggggccggtgccggcccacgcgtccgcccacgcgtccgcgcgcccctcggta

SEQ ID NO: 13923 - DNA, 1853 bp, Zea mays
gcacgagaccattacctagaacatcctaatcgaaaagaaaagcccattccgctcatcactgaacaacccccggcggcaaccctccccacagatggccggcgaacccagcgccgccgtggcatcggggcccgaatccgcggccgaggccgaccgcctcctggcgctggccgagtcggagctctccgcgggcaggctccgagccgcgcgcaggcacgccctccgcgccgcccgcctgtacccgacctccccgcgcgccccggtggtggccaccgccgccaacgtgctcctcgccgacgcctcctcccaccacgccgcgctgctgctgcccgaacccgacgaccccgacgcctcgccgctctccgcctccgagctccgccgccacttcaagtcgctcgtcaagtccctccgcgtcgggctcgacgccgccaccgcagccgcctacccctccgtcgccgccgccgccgaggaggcactcggccgcgccaccgaggcctacgaggcgctcaccgcccctgcccctgggaccttctggaccgcctgcgccgggtgccgcctcctccacgagttcgagcgcaagtatgtgggataccgcctcgcctgcccatcctgccgccgtaccttcatcgccgtggaggtcacacctccgccggaggacgaacccgttgcccgtaggcctgcgcctcagcggctgccaccggccaagaggccggagaaggtggagatgacgctcgccgagatgcagctccagctcgtcaagaagcggaggggcgcagaggttccggagacctcttcccgagacttggtggtggcggaggaggaggaggacgccgccgccgccgaggaggctgaggcggagaacaaccatttagacctgatgcccgtggaggactccgacttctacaacttcgacgccgaccgtggcgagaggtgcttcaagagaggccagctgtgggctctgtacgtcgacgccgatggcatgccgcggcactatgcgctggtggatgaggtgcagcgaggcacccagttcagggtgcagatacggtggctcgatggcgaggaggggaagccggggaagccatgcggtcagttcaatgttgggagagcagacaccgtggattcagtgaacgtcttctcccaccttctggcctgcgagagggcagcgagcgaggtgtaccgggtttatcccaggaaggcctcggtttgggcgctccatggtggcgacagggcgaagataaagtatgacgtcgtggtgatcctcagtggttacgatgatcggtatggtgccagcttcgggtacctggagaaggtggagggcttcaggagcatcttcacacgccgggacatcggaagccatgccgtccacttccttcagaagggcgatcttggggcgctttcgcatcagataccagccaggaaagtgcccaagggcgagggatcggccctgcctcccggggattgctgggaacttgatcctgcatcgttgcctcccgagttgctgtgcctgtgcatcgaaccaccgaaatgacctgcttatggtgtcaaaggttgttgcaggtgttttagttgttaggatcggctgtgtatatggcacataaatcgcagaggaaggctgctggtttgttctgccatgtcaaatagtatgaggatgcgtctgatttgccaactctagctgggcactgctcatgtttatgatccttcttcatgtagtttctcaggtagcatgattaaacttgtagctatttgagtgttatatcctggaaaaaaaaatgcatgacatgaatggttttttggtactgatggcagactaacactgctctggtatatggatgattcttatgaacttcctttatatt

SEQ ID NO: 13924 - DNA, 3494 bp, Zea mays
gacctgcagtctgacaaatatcttaatccatgtcatgattacagatgtctcatttaacgcggtgaatcttagacacttgactttgaatgaatggtgcctgaaacaagcaagtgttgcaggtaacaaagagttagtgacattcaggacaaaacaaattataggggtttcacttgtgtgtggcgacaataatgacaaccacaaagataaaaatcctcaacttcatgcgacagatatgaatgactcttccaatttccaaagccctgtacatgtttatctagacatgctagatttgccatggcgaatccatttccagatacatacatgtcacaatagcagatataagtgtagaccccagacatcttaaaatgaaaaccattaggaatagcactggggggatttttctatcaaaaaaagtgctgtaaacactttgcaacagcccaattcaccagtaatctccacatgaacagctgccactgttaaaatggtgaaatctgtacacatctcgtaatacaatttctcttcttgtgacttcagaggtaaatttcatccaactgtggcagtcatcacatacacgaaggttcttaatcactcgaagaggaatacaaggaggcaaagtcattaacccaaaagcaacagctaacttctcactatggacaaaagcagtagggtctttctgctcttgctctttttcatgaaacaaattagggttctcttgcttgtatcctattttggataacctatcatttagctcagacaaaaacttgtatatctgatcggacaaggggtgcgaccgatcaccaacaaagaatgcatggactgcattctttacttcaatccagcttcgacctggttcttttctaattcctctgtctttcatcatctttctgacctgatccctgttggcccacttcccagtaacagcatatgcatttgataggaggacatatgatgctgaatcatggggctctaactccaggagatgtttggctgcaagctccccaatttcgatgttcttgtgtactttacacgcactgagaagtgttcgccaaatcattgcattagcagtgataggcatttcatcaacaaatctccttgcacggtcaagttggcctgctcgtccaagaatatccacaacacaggcataatggtcaggtattggattaagtccatacacattagacatggatttgaagtaactaaggccttcctcaaccaaacccacatgactgcaagcagctaaaacacctatgaaggtgacatcatttggtttcagaccttcttgcttcatctgatcaaataaatccaaagcttctagtccacgtccatgctgtgaacaacttgttatgatagtattccatgaaacctcattcctcagtgacatttcagaaaagatcatcttggcatcttcaatactgccacactttccatatagtgaaatcaaagcattggcaacttcagtttcagaggtgtgccctgtcttaacagctctaccatgtacttgttttccttgttttatatctgcaaggttagctaaagcgctaatagcggaaataaatgtgaacacattgtacttggcacctgcttgacccatcttcatgaataccatgagagcttgttcataaagacgactttgtccaaaacctgatatcaatccattccatgtgatctcatccttgtgttcaatttcccgaaacaaagagaaagcttcttcacttcttccacatcttgcatacaggtttaccaacgtgttccaaattgaaatatcagctgcataaccagagacataaacccgagcatgaatctgcaggccctggcgcattgctttgatcccagcacaagcacttgcagcactagccagtcctatgttatctggccaaactccacagtcctgcatttctttgaatgttgcaagagcctcttcacaaaagtcatgctgcacatatccagcaatcattgaggtccaagaaaccacatctcttttttcaagcatttccagaatttttcgagctttatcaagacatccgtatttagaatacatatctatcaagacaccactaacatacatatcagattcgaatccattttttatgcttaatgaatgaatctgctctccaagttcaatttgcccagtgcaagtgcaggtcctcaaaatgcacgggtaggtgaattggttggggtgtatacctgtagcttgcatctgaccaaagatttcaaaagattttgctagatcactaatctgcccatatgccacaagcattaaattccacagtaccacgtttgtcctatcacccagattgaagatatcatgtgctgtttcaatgtcaccacatttcacatacagatcgaggagtgagccttcagttatgtaatcaaaagacatacctgctttcagtaaatatgaatggagttgcttccccttttgaagatctcccacagaagcacaggctgcaagcagactggcaactgtcacacaatcaggcctgagccctgacaactgcatctcatcaaaaatctgcaaagcacactcaccatgtccacattgagcatgtcctgagatcaatgtattgaatgtcactcgatcacagaacagcatgtcacaaaataccctttctgctagcttaaaggatccaaatcctaagtaaagtgcaataagtgcattgcccacaaaggtctccgaacagaatgcttgcttgtaaacttgggcatggatcatccgaccttgagcaaaaagttttcctttagtgcaagcactcagcacactagacaaaacatacggcgtaggaataacagcagtccaatgcatctggctgtaaagcctgaaagcttcctttccaagaccactctgtgcataccctgacagcatggcaacccatgagacatggtccctggaagaaagctccttgaatacctgccgtgcctgccacacgagcccattctttgcatacagatcgatcagcaagttgcctataaggcggtcagccccaagcccacgcacgactgatgtcgcgtggatctccagcacaagcggccatcggttgcctcgccccctgcatgcctgcagggcacatgtgaggtccgcagagccaagagctctatgatggctagccttggcagcgacaagcgacaggattttctctgggttgtcaggcacgataaacttggcaagcgatcggtgcagcgaggctgccacttcccggcatgtcattccgttgaacaactcggccacggcaaggtggagctcatcatcctagtgtctagtgaggtactgtatttgcatcttccatgtcctcactaccaacataaatccattatgtaccatacaagccaaatatagtagctcaaagcagtttatgttaaaatatataaataaataattattgagagtatctaatgtaacttaaaataattattgagaataataatctaacattcaaaaaggcatgacatattaaggagcagcataccagcagtaactagtgagcagtcaaccagtg

SEQ ID NO: 13925 - DNA, 2481 bp, Zea mays
caccatatgtactaagcttccatgtgcactagatatgtcctctagacaataatagggaaacattaaacaaaatgtggaggtttgatgtcatttttttaaatgactatctcatttatacgagtctatttagatgatatataaaaaacgtagtaatgcacgaacatctaactagtgatttctaatgcctcatcaatgcctgatatttcaccctgacacaagtttaccttcagtccacaacagttgttagaacaagcataaaagggatatttatagacctctccaaatcagtttgcacccaaaaaaacagtatggtaataaaaagagttgtattggatgtttcaataactggcagcaaaaccatctgcacgggtgcatagtttagtgtaagattcagatcgtgagattggagagcaaagttgtgcagctgttggctaggctaggctggttgatacatgctagattgctagtggaaggaacagttgacttcagcgttcttggtacttcatgacactatgacaggctggtctgtttctcctgcctgctgtgcgttaagcatttagaatctgaatcctgcaatttcaagatgatcacatgccttccaaatttcttatgcgttggcaccttaccgaatgctgaacaactattagttgcatgtgcaaatctcatggctagagttggcatgctatcagttaaaggagcaagatccactttattaggatcttatgtctatcgttaaaattaacaggccgataatggaccgaatcatcagcaccttatgatagtttatttttctgaagaaacttcaactgcagcactcccatttcattgattgtttttttttatttagctgtcctccatgttgaacgagatgaaagatggaaagcgaaaattgacagcaggaaaatagacccaaaacatcgatttccagttgagtatatttctgtacactctcatatatatacatcaaaattgtttcgatgatcagcagatcctctaaaacacggatgctaatcgcaggcactagagttgttgtatgatctatctacaaagtgagagtgttcagaagagagactctgctctggatcagcgtcctgaacaaagtcgcaactccgctctcaagatcaacaatgtccaactccaacgcctgcaattgctcctccttgcacacgaatttcttcttctcaaatgccttggacacaagagaccacttgctagcgctgggcatcgcgatcttcttcgagaggagatgtgatgtcgattcgagcatcgacacagcaatctcccttgcttcagccaacagcctgactatcttgcatccttcaatgtcagaggcagccttgctgctgatcttcttgaactgcttctgtgccttcttggccaagcgagcgtaagactgaaccttggcctgaagagacacgtcgtctcctctcttgagggccagctgcatctcctggacgctgaccctgagctctgcaaagttctcttgcatggcgttgcagaggtcaagcaggacaagggagcgatcgagctcctcctccactgccttcctctgctgacgttggttgccggccaaggatgtgagctcgtcaatgcagctgtagatgcccaccatcttgttgagaccagtcaaccaatggtttcaatggccactgaaggtgaggagatggttgccttcaggctctgcagctcgtcttcggtggtggccggggtggaacgagggctggaaggcacactcgcggacctaaggtggcaagccatgtctttgaatggaagctgaagttgtgaagcttcttttttctcttgaaatggggaagagaaggcaaggtgctgcaatggtggtcttcctggctctgtctttcctctttatatagcgaaagcgaaggaggtggaagcaactgcatagctgagccagcacccagcagacagcaagaatcgttctcatgtgtacccaactggtgaacttccgcagaagccaccaaacccaagaagcatcacaaacttagcttgattaggaggatgctatgtctgcaatatgagcggcaaactcgcctgcacggttgaagggcagcaagatgagcatctgatccagatcacgagatgatggatgaacagacaagttgtcagtggaggaaggaacagctagatgcccttgctcgcctccagcaccaggttcccaagttagtcgcatttaatcactcgattccaatataatcacatcattacagggtggattagcttgtgcagtagcagcgtatatgcttggccacccacgtgtttctgcaatttttatagtgctgaataattagcatagcattgcatttacctgaatacaagatatggtcaggctacttacaaaaacaatgtacgcactactgcgctgtgacacaactgcattttctgcccaaacagattgggacgaaggattgcttcaacaaagaccattatggtagacaaaaaaatatgtgcaacaataaaagaatt

SEQ ID NO: 13926 - DNA, 872 bp, Zea mays
gccggagccagttgcgcatatatgcactgctagtgtagctaggtggagcaaacttgcttgcacactcggtcagggagtggcctggcacggcagagaatcgagtcgaatcgactcgactcgacaatggcgaagctgcacaggctcatctccgccgtccctcaggcctggcgcggcgggagccgcggccgccgcagccgtgatcatggtgactagccacgagaccaccagcttgttcggcatagagatggaagccaagtactcctacactccatcattcgtcttcttcgtggtggctttcgctgtgaccttcgcctacagcctgctcgccgtcctcgtgcgcccggggaccaccgcctccagattagtgctcctaagcgacgtgacggtagggatgcttctgacgggcgccgtggcggccaccggcgccatctctcaggtggggaagagcggcaacgagcacgccgggtggctgcccatctgcgcgcaggtgcaggcctactgcggccacgtgatgggggcgctcatcgccggcttcgtctcgctgctcctctacttcctcatcatcatgtactccctccacgcggtcgccgaacccctgtgctcctgccattagaacacggccaaacgcgcacactattcgttcgattatattcactaggtcatcgacgatgatccaatggtcggtccccagtgatacgttgttttccgtctcactactatatatatctctgccgcactgttgagtcgatcaagggtcatttggtgctacaacactttactagcagctagctagtcgacaccactttggtgagctaactgctaatatagtaatatacatcgacctaccatcacttaaacaattcttttagaac

SEQ ID NO: 13927 - DNA, 5920 bp, Zea mays
  misc_feature (577)..(577): n is a, c, g, or t
  misc_feature (2618)..(2618): n is a, c, g, or t
cttgagaaggcaaaaagggcatcacgtgcattaacacattcccgggcctgtatggctgtgtatccaattgtaaataacgaatctggctttctattagttagggtacataatggaactctccttttttcccctttatcttttgttgatgaagtgtgcctttttgaataatatcctactggatcttattcctagttcacacactgcactgcacttcgcttggacctagtgaatagcttcatttcttatgtttcctttgtcgtattattatatagagaagaaaaaggaaataaaacaaaaggtaccatttgctttattgtatttccttagcatccaagcttccttctgaaacggtagccggctgccctttctgtagagtgttgtgcgccgcaagtttgggatggaatggaattggaaggtgggagtgccagtaaaaaaagcttccaccggcaatcaggtcaggtctcaattggggcgtgtgccttcgcctgatcgcacgcgttccgtgccggcgaaggagcctgattgatcctggcgtggtttggtcgacgtcaacgatggcagcatcaggtgagatcanagtggtgtgtgatgctagtatgatacaagcaggagtagagatgttctttttcaacttttaacctctgcacaagtcatcatgcacttaactaatatccttttattacaagtcaatcatcagtctgataatagcaagctaagacatgctacatgcatgtgttttgagagttgcagctaagagagaaaataatgcaagatgggctttttgccaagctggccccaaggtctctatgggaagtggcccacgaaaggcgaggaaggcccgaggagccttccggtcgtgtcttgggtactcacccggtcaccccactggctcgcatcggcatcggaatcggcgttgccacttccaccgcttctgctccccttcgccctgcttcatgttccgcgattcccttcgcacaccctcccgctgccgccgctgttctcctaccacccgtcctcccgcgctgggtagcggtactaatttaggatctgatacactttctgtgcggaagcgcggtcctgctaaatccgtgtgccggggttccagattgcaggagcttgccttgtagcgtcgggttatgctggttgcagcgagtggctaagcagagatccagtcgcggcgcgctgcttgcttgcttccaaccctgggtgcttgtgctactctttcaagctcgtgatctcatcatgggcaatgcagcatgctcgttcttactagttactaagtttatttatccatacaacccatgttataagttgggtcaggaactcaggatacggatactgttatgcagctgtgcaggcagggccacagaacaagtttgtttgtacacagactcaagaaatggaaaacaaattcttgttatttgggaaaacaacttcttgttatttgcgtttgcacaccattttgagttgatttcatccactgaagactaaagagtgaagtaataaggtcgtgtacacttgattttcccctcctctggttggttgcacaggaccatgatctggtcgttgagccgaggtcattcaccggttccactcagcccagcagaccggatgtaaggccatcgtcttcatcgtccagcgataatgccagggcacataattcaggtaaagtatgtatgttgtggacatccatcattttcttctgtcacagttgctgcactacctgtgctttgctgggcacttgataatgttgccagattccgaaggcttaactttgcccgatcctctttctataggtaaccgtatgtggatatgtttctgtatccttggcacagtcagtatccagtgccatttatcaatactgtcaatgtcttcttcaggagatacctggaagagccttgtctttggctgggtaaacacaaataatactacgctgagcctcctcagttcaaatgctgaaagcgccttgggttttcttcactgttctcgtatgtcttattcgaatctccataatgttctaaaattttaattatgtatgaggaactacgggagggatacatctttgacctgtatcctttctgtgttgcaggtggcgcggtagcataattcagacattcatgtactgggagctgagggattagtacgaggccatttatgctgttttgctgcatgtaattcttaacctctgcatctctgctggcaaacgtactgatttaccctgtttgctgtatcgtttcaatcccaagcgatccaatctatcttctgccctgctttttgtccatcaacaaccagctagaacttggttggcaataagaactaagaagtaggttattagttatagccactatcgtctgtcaggtgtattactgcttaccagtgtcccttggcatgcttgtatgttctgcaggcgttgaagccgatgtatcatgctgctcccgtgacatccagacgccccgttcctccttccagacgcccatttctgggatccaaatatggtggctctggtagggtggtttaagatcatgtatctgctgctgaatagctgagctgcccgggttgtctgcacagaacttagcacagccgctgtgttcttatgtaatgctgcagcagtgcgcggnataagttttctgcagaaaaatagcattcattgtatttgtctggaacgtatgatcccaatttgataactgtagcttctgctatttgctgtcataataagcagtctggaacgtatgcgtggcaggccctgctgcctgtacgcgtctctgcctctgtctatcctcgcgtttccttcaattcaaacaagtgatgacagatttacgccctggctgtaccggatccccgcgtctccatggccaggctcagatgccatgcgtcgcgacctccacaagcttcgtctgatgcatgcatgcacacgtgggacgccgcccctggtttgccggtcgccaaaatttgcggggacggaaagagagactgttggagtaaaattagtaaatgaaaatggtgtttctccgtcaaatataattttgggaagcttttacatattttcttggagatactctgatactgtttttatttgacggcggcacagtgttttctgttgccctcttcctctcgctgtgccgccggcgccaacgccgttcagcccatccactccaccactgctcccaccacacaggggttgtacaaggcatgtcgcgaggggtcagctctggccgccgcacgtgcttggagctagagcggatcatcctaaatcggcaccgctccggaagcctcggccgagaggacgcgctcaacctgttcgatgaattgcttcctcaggccagaccggcatcggtgcacgccttcaatagtgtcctcaccgtcgtcgctcgcgccgactcctcgtcgtcaccgcgtcacagcgctgcgctcgccgtgtcccttttcaataccatggcccggtccggcgtcaatatgatggccgccaaccgttacatcataggcatcctcatccgttgcttctgcactgttggccgcttggacctcgccttcgctgcctttgccctgttcctcaagatgggatggagggtgcagaacgtgaccctcaaccagctaatcaagggtctctgtgatggcaagaggactgatgacgcaatggatatggtgttcagacgaatgccggagcttggctatacaccggatgttttctcctacaatgctcttatcaaggggctctgcgtcgagaaaaagagtcaagaggctcttgagctgctgcttcacatgacggccgatggcggatacaactgttctcccaatgtggtgtcgtatagcacagtcatcgatggcttctttaaagaaggtgaagtcgacaaagcttacttcctgtttcatgaaatgattggccaggggcttccacctgatgttgtgacatacagctcactcattgatggcatgtgcaaggctcaagcaatggacaaggctgaagcaatcctacaacatatgtttcataaaggtgttatgccgaatacttggacatatagtatcatgatccgtggatattgctctttaggacagttggaagaggcagtgagactgctcaaaaagatgtctggtagtggtcttcaaccggatgttgtcacttacagtcttctgatacagtattattgcaagattggaagatgcgcagaagctaggagtgtctttgattcaatggttcggaagggtcaaaaacccaattctactatctatcacatcttgcttcatgggtacgccaccaaaggagctcttattgatgtgcgtggtctccttgatttgatgattcgagacggtactccgtttgaacatcgtgccttcaacatcttgatttgtgcatacgctaaacatggagcagtggataaggcaatgactgcatttacagaaatgcgacagaatggtttgaggccaaatgtagtcaactacaacacggtaattcacattctttgcaagaccggcagagtggaggatgctgtgtaccatttcaatcagatggtcagtgaagggttgtctcctgacaccataagttatacctcactaatacatggtctatgttccattggtgaatggaagaaggttgaggaactggcttttgaaatgatcaataggggcatccaccctgatgccatattcatgaacacaataatggacaacctatgcaaggaaggaagggttgtggaagcacaagatttctttgatatggttatacacattggtgtgaaaccagatgttgtttcatataatacactgatagatggatattgcttcgttgggaagatggatgaatcgattaagcaacttgatcgtatggtctccattggcttgagacctgacagttggacctataattctctgcttaatggctactttaagaatggaagggttgaagatgcattagctctttacatagaaatgttcaggaaggatgtaaaattttgtgctattacatctaacataatgctgcatgggttatttcaggctggaaggattgttgctgcaagggaattatacatgaaaatggttgacagaggaatacagttgagaatcgacacatacaacacagttcttggaggactctgtgaaaatagttgtgttgatgaagcgctgagaatgtttgaggacttgcgttcaaaagaatttgagcttgatgttcggactttcaatatagtgattaatgcattgctgaaagttggtaggattgatgaagcaaagagcctgttttcagctatggtgctccgtggtccagtgcctgatgtgataacctacagcttaatgatcaaaagtcatatagaagaaggtttgttagaggagtctgatgatctttttctatctatggagaagaatggctgtgctgcccactcacgcatgctaaacatcatagttagaagactacttgaaaaaggagatgtgagaagggctggaacctaccttaccaaaattgatgagaagaacttctcccttgaagcttccaccgctgcattgctgattcctattgtttcagagaagaagtaccagaaagaagtaaagtttcttcctgaaaaataccactctttcatgcaacctagggatgattgagacctttcccggtttttctgtgctggacattagagattgctaactagacttatttcagaagatcaatttgaaaacatgaaatcttctgcataacttgggcacaaatgaagtggagagttacctggccttgaaggattttcttgtttctagagattgtctttcatatttaataaccacgcttgcattcaaaaaaaaaaaaaaaactctgtgcctatcaaataccgtgtgcaggcttgtgtgggtagtgtttacccaatagcatccctatcggctatcgtgattgatggaaattctgaaactccattatgccttctacttttttgcgtcttcacat

SEQ ID NO: 13928 - DNA, 2550 bp, Zea mays
ttcttgtgctctccattcaaagacatcgacaaaatgttatcgtcttctttgtcgttttttttagaaaaagggcacaacctgcatctgtcttggtgattgagcaagagacagactcggcagatcaaggtcgaagagggtttgtgcatgtggctagcctaccatatgggagcatggatatgttcaaaagtctgaagagatgaaatccctaccttttgtcagcggcttcactggtactgccctccgagtggatagatccgatgctctccagtttggactgtgcggctgcgctcctgcgaataggctagaccaccagcttcaaccgtcggccaaccatggctgcttcggcaagtacaccgtccgccgtcgcttgggaacagatgcacgaggaagatcggtcgccgtcgctcgggagaggagaccgttgctcgggatatggatgtggccaccttcgattgagagaggatttggaggaggagacaacgcctgcacatttggaggagaggtctctgacctgaaaaagtacaggatgtgttacaagataccgctgcagctttacttgtaccgtcaaacccgtattatacaggtccaggatggtttacaagacaccgttgcaatcagtctgagaagctcacgttccatagtggtacgtacatctctctctcgaagacgtgacacgatatcgtagtgtcattagtgcactacagtacttgtctttcactcgactggatatatccttttgtgtcaaccgggtttatcaatttgagaacatatctagtgtacatggaattttagtgcacatgatgcatatattaaatcatcattatccatcttagatctaacgtctgtagttgtttgatatatttgctaagaacaccctctgatgtgttgggctgtagtggtggaaagtattatttgtaaattacaatgatcaaccagagacgttagatttcagatggatagtgatgatttaatatgtgcaccatgtgcacaaagctttcatgtgcaccggatatgtcctcaatagctgtatggactgaggaccattggatcgtggttaggaagataatgttgttcataaggtttaggatctagaaagagacgaattcctattattgtaacgattcagccgattctgcgttaatgttacttttgaatggtttttactaaatcgattgctataaaaaaaacagtctgaaaagttaagtgtttggcagtccgcaacagtaacttctagtagctagaagctgaaaaaagctgaaacaaacatgacatatccttggacacaatctggtctcgtggatctctcgcaatccacggtaacctgatccggcatcgaagctgaatacaaggttgtggctgatgcaactgcagaacttatctggatataagtccatcttcgtgaactcgatgttactctatctaggccaccgactctgtggtgtgacaatcttggtgctacttatgtttgcgctaatccgatatttcattgacgaatgaagcacgttaaagttgattatcattctggtcgtgagatagtttcatgtcgctagcttggtgttcaccctatttcctcccaggaccagcttgccgatgtcatgaccaaagccctgcctctcacgccgtccaaagcaattcgaaggcctaccatggccgcgtttctgcgccccgtaacttacgggagcggagcaccaacagcaaccgcgtctacgcggcagaaactacgtcgaaccccacgctgcaagctgctgcggcgaactaaacgacccacaaaagggggcaggggctgctcccccccgagtctcatttcgcaagtacctccaacaaccaccaagcccaacgacgaccccttgtcattggctcttctgcatccacaattccacacatcgctcgccacgcccacacctacccaccactcgatcctaccggctcccacgttccggtctcgccccaatcggccgggccgctacgctccatggcgctcgacctcctccggccaggcgtccccggcatgcagccggtcggcgacctccgcactgccaagtccgcgatcctgttcggggtggtcaacggcctcttcttgccgccgttgctggagccctgcctctgcaccgccagcgccctgtgcgacggcggcggcggcggcggcggcggcgaccacgcggagcagaggtactaccagctcgcgaactgcgtgctcaccatgctcggcgtcgccctcctgttcgtggacatggcgctgtcgcgggcggtccatcaggcctcgccgctgtggccgcccacgctcagagcgacggtgtggctcaccaagaccttgacctgcggcacgctccaattcggcgtcaacctcgtgtacttctgcctcaagatgctgtgcgctaggctcttgctcgttttcgcctgacttcgttcgccattgttttcactaggaagggacctagatccaccttatacgattcttttttttcttttcgcctaaattgaacctgtgctgtgtgtactcgttatggagttctgaaatcgggtgctcaaataaatctatctatgataacg

SEQ ID NO: 13929 - DNA, 2623 bp, Zea mays
cacctcacataatttatatgttatgtcttctctttattttttttcgctggattttaaagaaagttttaacggcagatcaaaccgcattctttctcgttttcatcgtacacgagtttttggagaaataaatatcgtccattgatctcaaaggtggattcgatgaagaagaagtgttacaaatattctatacgattctaatctaagagagtatcttgctagtcaaccaccttccccatataaggaagtttctcctccttggatttggaggtgcccatattacgtatatcatggtgtatatggcaaacgagtttctccttcagcatatatataagtattttatatattttagttttgtcgcaattattactaggaaagccgatggatagaacacgattgggctggccggccaacccccaacctcccgcgctcccttcgccaccaccgtcttaatggtcttcccagtggttgcacccacctggccaccccgcccagccgcccccacccgcgcgctagcgagtagggaagctctctctctctcttccggtcttcggtctcttccccatcgtctcctccccggtgattcatatatacgcgcgcgctctctctctccggccactactcgcggcctagctcgccttgcggaaccgcatcacgcacgccagcagcgctagccaagagcagccagcagatggaaaccacggcccacgccgccgcctccggcacgatccagaacgcccggcaccggacgagcgccctcaagctgtgctaccacctggcagtctccaacgcgatgtacctcctcctagcccccgcggccgcggcggcggcgcactggctctcccgccacagcgcggccgagctcgcgggctcggcccggtccgcggccgccgccaacccgcccctcgccgtggcgctcctggtcctgggcgcggtgctcgcgacggcgtacctgatgcggcgcccgcgcggcgtgtaccttgtggacttcgcgtgctacaagcccggcggcgagcacgtggtgacgcgggagacgttcatgcggcagtcggaggcggcgggggtgttcacgggcgacaacctggcgttccagcgcaagatcctggagcggtccgggctcgggcagggcacctacttccccaaggccgtgctcaactcgccgcccaacccgtgcatggcggaggcccgcgccgaggccgaggccgtcatgttcggcgccatcgaccaggtgctggcgaagacgggcgtccgcgccagggacatcggggtcgtcgtcgtcaactgcagcctcttcaacccgacgccgtcgctctccgccatgatcgtcaaccactacaagctccgcgggaacgtcgccagctacaacctcggcggcatggggtgcagcgcggggctcatctccatcgatctcgccaagcagctgctccaggtgcaccgggacacgtacgccctggtggtgagcatggagaacatcacgctcaactggtactggggcaacaaccgctccatgctcatgtccaactgcctcttccggatgggcggcgcggcggtgctcctcacgaaccggcgctcggagcggcgccgcgccaagtaccagctggtgcacacggtgcggacgcaccacggcgcggacgaccgcgcgtaccggtgcgtgttccaggaggaggacgagacgggccgcgtgggcgtcgcgctgtccaaggacctgatggcggtggccggcgaggcgctgcgcaccaacatcacgacgctgggcccgctggcgctgcccatgtcggagcagatcctgttcctggcgtcgctggtggcgcgcagggtgttcggcgcccgcggcgtgcggccctacatcccggacttcaagatggcgttcgagcacttctgcatccacgccggcgggagggcggtgctggacaccatcgagaagaacctggggctcagcgcctggcacatggagccgtcccgcatgacgctctaccgctgggggaacacctccagcagctcgctctggtacgagctcgcctacacggaggcgcagggccgcgtgcgccgcggccaccgcgcgtggcagatcgccttcggctcagggttcaagtgcaacagcgccgtgtggcgggcgctgcgcaccatcgaccctgccaaggagaagcccgccggtgggaacccgtgggtggacgagatccacaacttccccgttgaggtgcccaaggtggagagcgtcgtcatgtcctcctgacagtgacacccacggagggcaactactatatgctggtgatggagggcgtgcgccggcagagcgaacaatgatggtggacgtacgaggttatgcctaaaatactacagtattgttaatgaaagcattgcaaaaggttttttcttacactccaaataggttgctttggctatcaaattggcaagagcactaatatgagtcggttggtgggatatttagaatatgattggttcggttgtgaaccgtgaaaaaactattgtgaaatgtatgctattaaaagtatgttgtgagttatctgctgtaaaaaaaagttgaaagtcgtttagtcaaactgatgtgaattgtctattatgaacaatttgtatattgttcatatcttaatcaatttatctaatt

SEQ ID NO: 13930 - DNA, 3158 bp, Zea mays
  misc_feature (21)..(21): n is a, c, g, or t
  misc_feature (24)..(24): n is a, c, g, or t
aacatgaactgcacaacgtgnaanagccatctatgggtctttgttaatgcgctcattgacaatccggcttttgattcacaaaccaaggagaccttgaccactcgtcagggaagctttgggtcaaagtgtgagctttctagtgatttcctcaagaagttgagaaatctggtgtaattgagaatgtcctctcttgggctgatttcaaacttagcaaagaattaaagaagactgatggaagcaaaaagtcaagaatttctggcatccctaagcttgaggatgcaaatgaagctggtgggaaggactctgacaagtgcactttgatcctgactgaaggcgactccgcaaaagcactgccgatgtctggcatagctgtcgtagggagagattactatggcgtatttcctctcaggggaaaactgttgaatgtcagagaggcaaaccacaagcaaataatggacaacgctgaaattcagcacataaagcaaatacttggtttgcagcatggaaagcagtatgagagcaccaaaggtttgagatatggtcatctcatgataatgacagatcaggtttggcaggcaacatctccaattttatatcaactaatgaaactcaagttttgtttgctcatgctttgacaccaaaatttaggatcatgatggcccccacattaaagggttgctgatcaacttcatccactcattctggccgtctcttcttaaagttccatcttttttggttgagttcattactccaatcatcaaggtagattactgtacgattttatctattgacatatttttatgtattttcaaattttattcttgatagtataccattttgcaccaaagggatttccccctgctagatatgtattttttttgtaaacaatttgttttgactgccatgatggattcacttgtctaggcaaccagaggtcaaactacgaaatcattttacacaatgccagagtatgaagaatggagaaagaatttaggagcaagtgcaagttcgtggactataaaatactacaaggtctgcatttgtttgctttcctgattttccattgcctacctttgtcatttaaatgggtcattattatgttgttaatcatctaagttgttcattattggtacaggggttggggacaagcacagccaaagaaggccggaagtactttgaagatattattgatcacaaaaaggattttgtctgggtagatgaccaagatggcaaccatattgagttagcattcagcaagaaacggattgctgataggaaacagtggcttacaaattttcaggttagctctcacttgctcccttccaaatcgtaagacattttcatttctagaatcatgttttttactatgtatctagacataacatatatctagatacgtagcaaaagcaatgaatctagaaaagacaaaatatcttgtaagttggaaccgagggagtacatattttcccagtttggcatgctttgtatatgcaggatcaacactaaatgtgcaaactgattttcagcctggaacatacatagaccaacgtgagaaacaagtcaagtatagtgatttcatcaacaaagagctgatactcttctcaatggcggacctgcagcgatcaataccttcaatggttgatggccttaaaccaggccagaggaagattctgttttgttcattcaagaggaattttgtcaaggaagctaaggtgcgtcttttttttacctatctttacattacagattacctggggtttatttatttatctttgctgctatttctgttggccacaggtggctcagttctctggttatgtgtcagaacactccgcataccaccatggtgagcagagtttagcaagtacaattattggcatggcccagaattttgttggcagcaataacatcaaccttatgtcccctaatggtcagtttggcacaagagctcaggtgcgataacagtgcaaacttatgaggtgtttgttatggtacaacactgccaatttatagtcacaagtgtcttacatgtttgtatatcatttcagggaggcaaggacgctgcaagtcctcggtatatcttcaccaagctgtctaatattacacgttcaattttcccgaaggatgacgatattcttcttaattatctgaatgaggatgggcagtcaattgaacccacctggtaatgttattgtttcgcatgatctgtccttgttataatcacgtattcatagtgtagctaatgacaagccgtctttttcttaggtatatgccaatccttcccatggtattggtcaatggaagtgaaggaattggaactggatggagcacatatattccaaactacaatccaagagacattgttgctaacgtcaggcggttgttgaatggagagtctactgtaccaatgcacccatggtacaggggatttaagggctctatagagaagacagtcaatacgaaggtagctggttccacgtataccgtcaccggaatcattgaggttgttgacaacactacactgaggatcactgagctgccaatccgccgatggactcaggattacaaagattttctcgaaagtttagctccagatcctaagaacaaggacaaagtaacattcatagaggatgtcacatcacaaggtgataatgaagacgtctacattcaactcaaattaagtgaggcaaatgtgaatgtagctaaggaagaaggactagtgaagaagtttaagttgacaacaacaattggtacaacaaacatgcacttgtttgattcagatggtaaaattcggaaatatgacactcctgagcaaatacttgaggaattctttcaattaaggcttgaattctattgtaagagaaaggaagcattgttgaagaatatcaagctggacttaaagaagcttgaaaacaaagttaggtttatccgctgtgttgttgataatgaaattatagttaacaacaggaaaagggcagatctatttttggagctccggcacaagaattttgaccctttcccaaagaaaaaaaagaaggcccgaccgctcgcgatctagaactaggaagaggaggaaaatgaagagtctcctgaaactgcagcaggagtggatcctagtgactatgagtatctcctctccatgtcaattggtaccttga

SEQ ID NO: 13931 - DNA, 2435 bp, Zea mays
ctccagccgttcctcaaggaagaagggaaatgtgagggtgatcgataatgttcgttcttgggctgatttcaaacttagcaaagaattaaagaagactgatggaagcaagaagtcaagaatttctggcatccctaagcttgaggatgcaaatgaagctggtgggaaggactctcacaagtgcaccttgattctgactgagggtgactctgcaaaagctcttgctatgtcgggcatagctgttgtagggagagattactatggtgtatttcctctcaggggaaaactattgaatgtcagagaggcaaaccacaagcagataatggacaacgctgaaattcagaacataaagcaaatccttggtttgcagcatggaaagcagtatgatagcaccaaaggtttaagatacggccatctcatgataatgacagatcaggatcatgatggttcccacatcaaagggttgctgatcaatttcatccactcattctggccgtctcttcttaaagttccatcttttttggttgagttcattactccaatcatcaaggcaaccagaggtcaaactacgaaatcattttacacaatgccagagtatgaagaatggagaaagaatttaggagcaagtgcaagttcgtggactataaaatactacaaggggttggggacaagcacagccaaagaaggccggaagtactttgaagatattattgatcacaaaaaggattttgtctgggtagatgaccaagatggcaaccatattgagttagcattcagcaagaaacggattgctgataggaaacagtggcttacaaattttcagcctggaacatacatagaccaacgtgagaaacaagtcaagtatagtgatttcatcaacaaagagctgatactcttctcaatggcggacctgcagcgatcaataccttcaatggttgatggccttaaaccaggccagaggaagattctgttttgttcattcaagaggaattttgtcaaggaagctaaggtggctcagttctctggttatgtgtcagaacactccgcataccaccatggtgagcagagtttagcaagtacaattattggcatggcccagaattttgttggcagcaataacatcaaccttatgtcccctaatggtcagtttggcacaagagctcagggaggcaaggacgctgcaagtcctcggtatatcttcaccaagctgtctaatattacacgttcaattttcccgaaggatgacgatattcttcttaattatctgaatgaggatgggcagtcaattgaacccacctggtatatgccaatccttcccatggtattggtcaatggaagtgaaggaattggaactggatggagcacatatattccaaactacaatccaagagacattgttgctaacgtcaggcggttgttgaatgaagagtctactgtaccaatgcatccttggtataggggattcaaggggcccgacagcaacgcagtcaatacgaaggtagctggttccacgtataccgtcaccggaatcattgaggttgttgacaacactacactgaggatcactgagctgccaatccgccgatggactcaggattacaaagattttctcgaaagtttagctccagatcctaagaacaaggacaaagtaacattcatagagggcgtggtcgcggccgaggtaccattcatagaggatgtcacatgtcaaggtgataatgaagatgtttacattcagttcacattaagtgagaaaaatatgaatatagctatggaagaaggactagtgaagaagtttaagctgacaacaacaattgggacatcaaatatgcacttgtttgattcagatggtaaaattcggaagtatgacactcccgagcaaatacttgaggagttctgtcatttaaggcttgaattctattgtaagagaaaggaagcattgttgaaaagcatcaagttggacttaaagaagcttgaaaacaaagttaggtttatccgctgtgttgttgataatgaaattatagttaacaaccggaaaagggcagatctatttttggagcttcggcagaagaattttgatcctttcccaaagaaaaaaaagagggctgaaccagctgctgtaggtgctttagaagaggaggaaaatgaagagagtcctgaagctgctggagcggaacctagtgactatgagtatctcctctcaatgtcaattggtacgttgactttggaaaagatacaggagcttaatgctgagaaacaaaaattagtggatgatgttgaggaattggagaatatgtcaccaaaatcactatggttgaaagatcttgatgcttttgagaaagaactggatgtgcttgatcaaatggatctagcagaggaactgcaaagggaaaagaggataaatgctggcaaaaaaggaggatcaaaagctgcaccca

SEQ ID NO: 13932 - DNA, 1657 bp, Zea mays
  misc_feature (1520)..(1520): n is a, c, g, or t
ctccaactatcaaggcaaccagaggccaaactactgagtcattctacacgttgcctgagtctgatgaatggagaaataatttaggagcaagtgcaagttcatggactataaaatactacaaggggttaggaacaagcacagccaaagaaggccgaaagtacttcgaagatattactgaacataaaaaagattttctctgggtagatgaccaagatggcaatcatattgaattagcattcagcaagaaacggattgctgataggaaacagtggcttacaaattttcagcctgggacatacattgaccaacgtgacaaacatgtcaagtatagcgatttcatcaacaaagagctgatactcttctcaatggcagacctgcagcgatcaataccttcaatggttgacggccttaaaccaggccagaggaaaattctgttttgctcattcaagaggaattttgttaaggaagctaaggtggctcagttctctggttatgtgtcagaacactcagcataccatcatggtgagcagagtttagcaggtacaattattggaatggctcagaactttgttggcagcaataacatcaaccttatgtaccctagtggtcagtttggcaccagagctcaggggggcaaggatgctgcgagtcctaggtacatcttcaccaagctgtctcatatcacacgttcaatttttccgaaggatgatgatattcttcttaattatctgaatgaggatgggcagtcaattgaacccacctggtatatgccaatccttcctatggtcttggtcaatggtagtgaaggaattggaactggatggagcacatatattccaaactacaatccaagagacattcttgctaacctcaggcgattgctgaatggagagtctactgtaccaatgcacccatggtacaggggatttaagggctctatagagaagacagtcaatacaaaggtagctggttccacatatactgtcactggaatcattgaggttcttgacaacactacactgaggatcactgaattgccaatccgccgttggactcaggattacaaagattatcttgagagtttggctccagatactaagaacaaggacaaagtaccattcatagaggatgtcacatgtcaaggtgataatgaagatgtttacattcagttcacattaagtgagaaaaatatgaatatagctatggaagaaggactagtgaagaagtttaagctgacaacaacaattgggacatcaaatatgcacttgtttgattcagatggtaaaattcggaagtatgacactcccgagcaaatacttgaggagttctgtcatttaaggcttgaattctattgtaagagaaaggaagcattgttgaaaagcatcaagttggacttaaagaagcttgaaaacaaagttaggtttatccgctgtgttgttgataatgaaattatagttaacaaccggaaaagggcagatctatttttggagcttcggcagaagaattttgaccctttcccntattaaagaggggaaagcggaaggctgaaccaactgctgtaggtgatatagaagaggaggaaaatgaagagtctcctgaaactgcagcaggagtggatcctagtgactatgagtatctcctctccatgtcaattggt

SEQ ID NO: 13933 - DNA, 1602 bp, Zea mays
atcctcttctattctttctgcgacatccacgaaggttccggacttgagaagccccccaccccgcaccgcatggagctccattcgcctccaccatggtgccactgcgagcagctccgccccctgcccccccggtcggcggatcccccaccccgccaggtgctctgctaaggcccaccacagtgccagcaactccaccacccccttcctccgctgttggcggttcccccaccccgctaggagcaccgcccaggcggacggcttcaccttcaaagcccatgccacgcagccagcgtcgggatcacccccacctacacccctcgccagaggaccgcccccttgatgccagacagccaacggattcacccccacgccctccacgagcctgataaaggatgctaaaggtcgcggcaagtggctctactgccactccactccgcggcggtgccagcgttgatgaccacctctcggcctactgctacttcttctccagcatgggtctaatccatgtcgcgatacggggtttggacattttgggctaggttgttcagcatgggtctggtgaatgaaggcatcgacatgaaggagggaaacctagagatcggcatagcaattcttttgcatgacgattagtttttttttattaatctgtgttagatcttcaaatacacgcaatccaatcttgaagatctggttaaataagtatgctgcttgtaccataaaccgtgtgcgacgcaaatttcagtaagtgcattttgctgatgtattgtgatagtagaccgaccttccttctgcagagtggaaccaaaggtatttgatgagttctttggcatgccacatagcagatttgaccgggaagcttgcaggtctactatctgtcctgatttttgtatctgtgtgtcttccttcatgttcaaaatggtgattcagtttatatgagagtattgtcttagtgtttgtgtggataacatcaatatggtgtacgacgatgagtttcctgaacttagtactttcaagtgtgtgacaagaaaggaaagtagcaagctggaaagcgagaaccaagataaattgtttgatgcatatatcatgtatggttctgcaatacaatctacaacacaccagattatatgtgaaggtcagattttatcatctcagatttgttgatttcaatattttatggagtccctatggtttgccaacttcactaacgatggaattgattgaaatcctttttgagaaatgaatagccaataaatttctcatgggaagagggtaagcaatggccaatgttcagggattggatacatagttgcatttacatgtcaatgtcatcttcacatagtagatagaattgtacacaattttcagtaatattggcactgtagatatggtctgtatttaacagtgttgttgacttcttagtgatttgctgaaataatgacgcataactacgcttatatcgagaaggggagaaaggatcaactgtcaccgtctccgtcggcaacatcagccatgttgacagcccgcgctctgtgtgccctcctccccacgcatttgatggcctatgtttttttcttctccccacgctgcaggcatgcaagatgc

SEQ ID NO: 13934 - DNA, 2135 bp, Zea mays
gaacaatccgttggcggattgctgcacatccgctcgatctgatagagtggttgattcagacgtcctccgctgccagtctgcgttgtcataccgtggagtttgttcgtccaggatattgccttcggaggacgatagtcttgcaagggctcttcgctcgtgccactcgcagcctttctcattcgtagaggaaggagacaccggtgcatcagggatgataagcttagcagagtatctaggaactaatgtagctgaccacatccctgaaactcccaacaacctgtcagaggagatggtgagatgcatggcggggatatactgcagactcgcagatcctcccttggttcaccacggctcgtcctcttcaccgtcgtcgtcgttctcctcgactagcgcaatctctccgcagtatgtgggggacatgtggagtcccaaatacaggagagaggcgactctggactcccgtctgataaacccgttccatgtcgatggtctgaaggagttcagtggaccttacaacacaatggttgaggttcctatgattagccgggacagtcggaggctgaaagaagccgaggacctgctccagacttacaagttgattttgtatcggttggaagccgttgatctgaggagaatgacagatgaagaaaagatcgcattctgggtcaacatacacaatgctttgctgatgcatgcttatctgaagaatggcgtcccacagaacaatctaaagaaaacatccctacttgttaaggctgcctgcaaaatagccggacgcaacatcaacgccgccgtcatccagagcattgttcttgggtgcaacacacactgccccggacagtggctacggacgctgctttaccccaggatcaaaagcaaggtgagcaaagcggggcatgagtggcgggcctttgccgttgcgcaaccggagcctcttttacgctttgcgctttgttccggcagccattctgatcccgcggtgagggtgtacactccgaagcggctgttccaccagctggagtcggccaaggaggagttcatccgggcgacggccggcgtgtggaaggagcagaagctgctgctccccaagctggtggaggcgtacgccaaggacgtgaagctctcgccgcagggcctcgtggacatggtccagcgctacctcccggagagcatgaggatggccgtgcagcggtgccagcacggcggcaggtcgtcgggcaaggtcgtggagtgggtgtcctacaacccggccttccgctacctgctcgccagggacctcgcgttccctcacctcagctgaccgttcgttaatctttagtagtatatgcgtgtgtgccatagggttagaagtagagaagggatcatgtgcagtttttgtgtggtggttgtcaatggcttttgtagatgatgaacaggaaacaggggaagaaatgagagaaagcacgtttgaccaaaaaaaaaaaaaaaaacatgtgtcgtcgccttccttctcttgctcatgtcatcgccatggtcacctccttgcgctacagaattagctttgtcggatgatgagcgttgaagtacactttggaggcgcctaaaaaaactttgatagcgtattactggcggtttcaaggacgatacccaatatgggccagttttaccagacagccgaacagggctagatcagccgttggaaacgagagtctgggagggcccataaggccataaggcagcggatttgtgacccaacttgacacggaacttgggcaccagtggcagtgggctcatgaagtcgggactcgggagaaacccggcggcctggtagactttacgcaccagctcagatttctgagtcctcacttttctttgcaaaaggttgggacgcattcacggggttcttatgaaaatgttctattggaaattggacgtttatgcagctcactaaaatcaccgaccaaattagatggctgctgtttagctacaaggcatggaatttgtgatggttggtggcaggtatagcaatttcgcgtgcttattcaaactagtaagtgcccctgctaacatcatcccaacccttctcagcctacctccaagctccacagagctttgccgcgacttagccgcccgactagagatgacaacaggtacat

SEQ ID NO: 13935 - DNA, 1818 bp, Zea mays
gtctaaaggagtttctgaaaaatttactcaagcttcagataatcagaagttggaagcaaaatctcgccttcttgacctggtcaataaaggtgtagaggcatcgctagtgcagcttcttgagacaggcttgttgcatgctgatcctcatcctggtaacttgcgttatactcctgaaggccgtgttgggtttctagattttggtttgctgtgcatgatggagaggaaacatcagcgtgctatgcttgcaagcatagtgcacatagtaaatggtgattgggcttccgtcgtttatgatttgactgaaatggatgtagttccaccaaaaaccaatctacgtcgtgtgacaatggatttagaggatgcattaggcgaggtaacctttgaagacgcccttcctgctgcatataccttttaggtgcttggaaaaatttggtctgtggcatttaaatatcacttccgtatgccaccttactacacacttgttctccggtcacttgcctctttggaaggactagccgtggcagcagatgggactttcaaaacatttcaagcagcatacccatatgttgttcggaagcttctgtccgaaaattcacttgaaacaagaagactcttgaatcaggcaatttttaacaaaaggaaagagttccaatggcagaagattgacgcgtttctaaaattggcttcagcaaggaccaacttcaagtataacagtgaagttttgccagagcctgacatgaagtccatgaatgtggctagccttgtggagatcagtgatgcatattcacttgaccgtgctatagctacaccagagagagcattgcatactgcaaacctgtgtgtgaggcttttattatctaaggagagcattgtgattaggagacttattatgacagcgaatgcaaaatctcttgcccgtgatctgatctccagagatgctttgatgttccgggtgctccttagtaaggttattgcggatgttgtctaccaatggatgttgagtgccacaggcttgaaacgagttatggagaccaagatccagacgcccatgaccacaggaaagaacgagggacatctggtgctggctgaagaaccatcgaccctgatggtactccaggcggcagtaaaagaccgaaggattcagctcatgttcaccaagtttgtgagggagttgagagaggagcccgtcttgatgattagggtgagctggaacgtgttcctcatctcggtctcatctgccgctgtaggcctgcaccgtttcttggtgttcttcttgaaggaggatggtgccaggttcttggatgacaaggtcaagaaaatgaagatttggctgatggagttctcgaagcggacggctaatctggagattcaaggaattctgtgaatgttggtggcttttggttgaaggatttaatagctgcttcgcactctggtttttggagttactttctgcatcgagtgaatccagttcctgtttacgctggctgtctgagcttgcttggctgctggtgttcccagagatttataaaaacagggttttcctccgtcattccgccgcagctagtatataatagatggttcttggttgttcatgtactgtgtagctgtatataatagaaacattgcaggatcagtgagtaattctgtggccgagtaaagtgcagtggtggaaggcatgtgttacctactggatataaatatgatgatgtgaatgttcagttgaaaaacttgggtgacatgaactgatgaactatagctgatgcctccactttagaaatttagctgttttagtttgtctaaaatcaaaccttctttgac

SEQ ID NO: 13936 - DNA, 3369 bp, Zea mays
  misc_feature (3048)..(3048): n is a, c, g, or t
tacgtatgccgtataactttgaccacttaggagtaaagtatttttatatttttattttatcccatgagttgtttaattgtattttttaaacctaaccatggtatttttggagtattggaaactccactctaatctaaagtttttatgtaatgactagcttgtctaatattatggttttaataatgttgtatccaaataacatttcttaaaaccgtgatatttttagagcagccaaaactacagtagtaatactataaagtgtaatattataaaactatagtttcgagaaacgtttttgccaaatatatcccttcatgttgtcttagattgaatgaattgaggagagtaaagcggattaaattcttcctatttaaaatttaatagaaaaatatttaatttcacttctatctccatgtaagtgaataagggtgtgcacaacactatttaatggggtctcttgacgaatctctaatggcttaattggaaaagaaaaaaaatgagagaagaactcttcgcgaagagtctatctcttcatgattcttcgtatgtattgtctattaactatatttatgattcaaaggcttatgattatctatataatttcttgttgtgtcttatacttacaaaaccgttacacggtctcaagttttgtacgtgccataaggtctcaatgaaaaaaaccggcacggcctctcccgagaaaaaaaaacataaggtcgcaggtggcggcttggagcgataggtgcacagtggtgcgtgtgtgtgagcaacatttctttttcttaattgatcaccccacatgatttgtcaatgttactcggagccttaaatatgcttcttcccctcccgcaagctgcctacaaatccatagtgacactattattatctcaccttcctacttgagttacctggcagctcgggcagcgcagggaaccaattgcagagagcaagcatatccaacgcaattaaatgagtgtgctaaactcgctggggatcctactcctgctcacggcgccggcgtttgcggcggcactgtcggcggatgggctttcgctactggccttcaagtcggcggtgaccgacgatccgtccatggctctctcgtcgtggtccgacgctgatgcggacccgtgccgctggctgggcgtcacctgcgtcaacagctcgtccagcgacggactgcgcgtcgtaggggtggccgtcgccggcaagaacctgtccggctacatccccgccgagcttgggtcgctcgcgtttctacgccggctcaacctccacgggaaccgcctgtcaggaaccgtccccgccgcgctcgccaacgccaccgccctgcactccctctttctctacgataaccgactcacggggccgttcccggccgcgctgtgtgggataccgaagctgcagaacctggacctgtcgcagaacgccttgacgggcgcgctgccgctggagcttggacgctgcaagcagctggagagattgcttctcgccgagaatgcgttatccggcaacataccggcggctgtctggcaggacatggtgggcctgcagatgctggacctatcgtccaacaacctcaccggagccataccagcagaactcggcaagctcgccgcgctcgccggcacgcttaacctctcccacaaccacctctccggcggggtgcccctcgagctcggtcggctcccggccaccgtcacgctcgacctccgcttcaacaacctctccggcgagattccgcagtccggctccctcgccagccagggccccaccgcgttcctcaacaacccggggatctgcggcttcccgctgcaggtcccctgccgcgtcgctccaccgtcgtcgtcgtcgtcgttgcccccaccgcctccgtcgtcctctgccactaccaacggcggcgcgggcggtgcacggctgccgatcaagaccagcctcatcgtgctaatctcggtggccgacgcggtggccgtcgcgttggtcggtgtcatcgtggtctgcgtgtactggaaggtctgcgaccggcgccgcgccgcgaaagacaaaggcgacgacagcgagtacgaggaagggtgcggcctgttcccttgcccgtgctgcatgcgcgccgacgcgtgcggcgactcgtcctcggaatgctccgaggtcgacggcaagtgcaacggtggcggagggaccggggagggcggctatctggtggcgatcgacaaggggttcaggatggaactggacgagctgctgaggtcgtcggcgtacgtgctgggcaagggcggtaaggggatcgtgtacaaggtggtggtgggcaacggcacgacgcccgtggctgtgcgccggctcggcggtggcaccgcggcgcccgagcgataccgggagttcgccgcggaggcgggcgccatcgggcgcgtgcgccaccccaacatcgtgaggctgcgcgcctactactggtccgccgacgagaagctcgttatcacggatttcgtcaacaacggcaacctcgcgacggcgttgcgcggccggtccggtcagccaagcctatcatggaccctacggctgcggatcgccaagggtgcggcacgcgggctagcgcaccttcacgagtgcagcccacgccggtttgtccatggcgaggtcaagccctccaacatcctgctggatgccgactacaacgcgctcgtcgccgacttcggcctcgcccgcctcctcaccatcgtcggttgcaccgacgtctactctgtggcaggctccggcggcatcatgggcagcgggctcccgtatgccagacctgccgctctaacggacagatcctgcagtgcgtatcgcgcccctgaggcacgcgcgccggggggtgcacagccgccgagccagaagtccgacgtgtactcgttcggcgtcctgttgctcgagctactcacggggaagccgccggagcatgcctcgccgtccgcgtcgtcctcgtccatgccgggtcacaatgggcaacgggagctagagcaacaggctccggagctcgtgaggtgggtgcggcaggggttcgaaggctcgcggccnctgtcggagttggctgatgccgccctcctgcgggacgctgccgcacggaaggaggttgttgcggcattccatctctcgctaaggtgcgtcgaggcggacccggagcgccgaccgcggatgaaggccgtgtcagatagcctggacaagatcggggcttgacttgtcaccgtcgacccaaaaatggttatgatgtggagttgtatattgttcgtaattatacttatcattattattgcttttctttctttatttttatgtcctatccttggatgcatggattgtagaaatatacactacgcgagctggcaccgaatttgctcc

SEQ ID NO: 13937 - DNA, 2095 bp, Zea mays
gctaaatatagaaactaaaataaagttttagtttctatatttggtaattttagaactaaaatagaataaaatctagggactaaacattagtccctagaaaccaaacacccactaagtcatacggattaaagctagtatgctgtggactgtggttttgaacggaatgagaaggccacggccgtcgggctacgggagcacggatgttgggtgttgtcttgacgtctggtttggtaggagattgcttgctctatctctccgagcttggtttcgcagttcgcaagtcgcacgctgccctcgggccgtccggcgtgacccatgggccgcaagctgctgcaccagacagatgggacatggcccactaccgcatcacaactcttgacaccaggtggactctcagtaacgcctcacgccatgcgactcgtcacggcctcggcgtgccgcctgcgtgcccggtgcccgtgcggccgtgacgaacgacactgacgagcaaagcaaagccaacggagccgagcgagacgacgagaccgcgattgctagctagctagttcgggcagcgagcggggtgagacggctatggcgtgctgctccgccgtcctgcaccatccgctgggcttctcactcaccccgtgctccgcctcccgagccccaccgcgcatccagcgcgtgggcgtggcaactccctcggccgcctccgcccgccctctttctcgcgccaggatctcaccgcgctgcacctactccggtggcgccagcgctgcccctggtcctggggagctacccgcggcggcgctccgacgggtccttgagatgccgggtgcgcaccaggcgcccgcctgctacgacgcgctgagcgcacgcctcgtcgagcgcgccgagttcagggcctgcttcacgagcggtttctcaatctcttgccgcaacggtggcagggggttacttctcgttcataccatccaagagagattgcctagtcgccctccatttagggaacttgcagagagcgtctgcctgtaactgtatttgtgtatgcctgcgatgcattgctgataggaatcatagtctcttgcttcgtgagctcctgcagctgcctagaaaaggaggaggatgcacgattcttcactgaaagtcatacttttccgttgcaggtttctcaatctctgccgcacggcttggattaccagatgttggtctcatctcgtacggggaaatgatcgatcaggggcgtctgatcactgaagcagtttcaatccctgtgatcggtgatgcggataatggttacggaaactgtatgaatgttaagaggacagtgaaaggatttattaatgctggttttgctggaattattcttgaagatcaggtgtgttatgcttataaagtactacaacagataatggttacataactattcctgaatatcacaattcacacattgattttgttatgttctctgttctctatatctatatgttgaagggaccatttagagtttgcattttctggaccccaaaaatgtaagtgatgcagttgtagcaatcgttgtagtctaggatctggggcaggattcacatcacattcttaggtttgtactacacggaaccagtgtttgatttctctatgtatcaaattgtacattcaagctatgtaactcgtactgattatgcatggtgtcaggatagcttgttctgttctgttccttgaaatttcttttatagtgatatgatatattacattctgaaggtgtcaccaaaggcatgtggacacacacaaggaaggaaggttgtctcaagggaggaagcaattatgcacataaaagctgctgttgatgccaggaatgagagtggctctgatattgttattgtggcaaggacagattctcgtcaagctgtgtctcttaatgaagcattatggagagtacgggcctttgctgatgctggagcagatgttctattcattgatgccctcgcctcaagggaagaaatgaaggcattttgcgctatcgcgcctggagttccaaaaatggttagatatgttatgtgcatcaatgtttctggttttcatatacttgcaatgccttcatcttactcttgacctgcag

SEQ ID NO: 13938 - DNA, 1894 bp, Zea mays
gcacgaggtcgattgctagctagctagttcgggcagcgagcggggtgagacgggcagacggctatggcgtgctgctccgccgtcctgcaccatccgctgggcttctcactcaccccgtgctccgcctcccgagccccaccgcgtatccagcgcgtgggcgtggcaactccctcggtcgcctccgcccgccctctttcccgcgccaggatctcaccgcgctgcacctactccggtggcgccagcgctgcccctggtcctggggagctacccgcggcggcgctccgacgggtccttgagatgccgggtgcgcaccaggcgcccgcctgctacgacgcgctgagcgcacgcctcgtcgagcgcgccgagttcagggcctgcttcacgagcggtttctcaatctctgccgcacggcttggattaccagatgttggtctcatctcgtacggggaaatgatcgatcaggggcgtctgatcactgaagcagtttcaatccctgtgatcggtgatgcggataatggttacggaaactgtatgaatgttaagaggacagtgaaaggatttattaatgctggttttgctggaattattctcccacgcctccgggcaccaaaggcatgtggacatacacaaggaaggaaggttgtctcaagggaggaagcaattatgcgcataaaagctgctgttgatgccaggaatgggagtggatctgatattgttattgtggcaaggacagattctcgtcaagctttgtctcttgatgaagcattatggagagtgcgggcctttgctgacgctggagcagatgttctattcattgatgcccttgcctcaagagaagaaatgaaggcattttgcgccatcgcacctggagttccaaaaatggccaacatgttagaaggtggtggtaaaactcctattctgagccctgttgaactggaagaaataggttataaaatcatagcctatccattatctctaattggtgtatcgatgcgtgcaatggaggatgctcttattgctataaagggtggtcgcatacctcctccaagcagcttgccaacatttgaggagatcaagaatactcttggcttcaaccactattacgaagaagacaaacgatatgcggtgacaccagcccaatcattgtacgggactggctatgataattatacaagtgaaccgaacagtccgggagattccaggtccagggctgaaaaaacacaagaacctgttattgacatattgcctcagctctatgatattggttccagtgacagcagaggaccttcaactggaatgtggtctcgaactcttcgactaaagattacaggaagagatgggatccagaaaattgatgccaggatacctgctgggttcttagaagggatgacaagaattattccaggcttggctggagctaatattatggaaaggcttcggaatgctcctgttgatacagacaacccccagaatggtcaaatactgcttgattttgaggacgccatgggagataggatccaggtgtttattgcatgagctgatggtgtatttgctagaatgctcgtgcacagcaaactctggatgcatggacgtttcaagtagcatcagggtacatgcatcttgctattggcgcaaccctatctagtagttgaattagataatttggacatcgattatatcttggcgaactagtatttacaaatgacagacttgttcctattcatcgaggctgggtgtacatctttgggattccattaaaacacagctggggactgcgggataagtttttctccgtagcgttgtttctgtgttgaaaaaaaaccctgaagttgaatagaaataaagaagtaaactcttgttgagttaaaaaaaaaaaaaaaaaaaaaaagcggcc

SEQ ID NO: 13939 - DNA, 1200 bp, Zea mays
ctcgaggccggccgggccgggcgtgtccacagatagaagaatccctctccccatattccttttctctgcgccggcaccgccgtctcgtctggtctgctcttccattccgttcgcctttgaaaactacccacaccacaaagaaatcgaagaggggaacagaggagagagaagggagatggcggaggcgacggcgtacgaggagcagcgccggaggcaggtggaggcgaacaagcggaagctggaggagcttcagctccactacctctccgccgccgtcagagaggccgcagccgccgccaagccctcgccggtcaagaagcggaaggcgcgggtgccgcttgacgccgccgactccgtgatggagccactacggcggtccggccggctcgccaacctccccgataagtccgtgcaccgcgaggaggttccaactttttggagaaagattaggaggacgtatggatcagtgagaaaagatctggaaaaccgggtgtacgcgaccgacgaggcgaggagctacgccatctgtaaggcggaggaagtggagcaagagctggactccagcttccccgtcttcatcaaacccatgacccagtcccatgtcaccggaggcttctggctgggcctcccaaatcatttctgccggaagtacctgcccaagcgtgacgagacgatcaccctgctggatgaggatgacaacgagtcctacacgctatacctcgcattgaagcgaggcctcagcgctggatggagagggttcgctatccagcacaagctggttgatggagattgcttggtcttccagctgactgagagaacaaagttcaaggtaatcataattagagcaagttcttactatgaaagtgaggactgatgaaactaatagcttgtaatgcggtgtttggagcacagtttatggaggtgggctgcattggacaagcttgcatctggaaattgctgggtgtcttgaaccttttgggttacagaaagttatctcatgtacaaaatgtttacacagcccagtagctaccaattgctgatttgtgtacttcttgggctttaccacttgcacggttcagaaacctgcactatgtaagaggatgttgatggcaattgacctcattttgtaaatgatcctcgtttatcttggattcatttttagtgttcagtttggcagttgaccaccaaaaaaaaaaaaat

SEQ ID NO: 13940 - DNA, 944 bp, Zea mays
ccggccgggaactcttgaccctgcccctcgcgggccgccccggacgccaagcgactcgtcacggcctcggcgtgccgcctgcgtgcccggtgcccgtgcggccgtgacgaacgacactgacgagcaaagcaaagccaacggagccgagcgagacgacgagaccgcgattgctagctagctagttcgggcagcgagcggggtgagacggctatggcgtgctgctccgccgtcctgcaccatccgctgggcttctcactcaccccgtgctccgcctcccgagccccaccgcgcatccagcgcgtgggcgtggcaactccctcggtcgcctccgtccgccctctttcccgcgccaggatctcaccgcgctgcacctactccggtggcgccagcgctgcccctggtcctggggagctacccgcggcggcgctccgacgggtccttgagatgccgggtgcgcaccaggcgcccgcctgctacgacgcgctgagcgcacgcctcgtcgagcgcgccgagttcagggcctgcttcacgagcggtttctcaatctctgccgcacggcttggattaccagatgttggtctcatctcgtacggggaaatgattgatcaggggcgtctgatcactgaagcagtttcaatccctgtgatcggtgatgcggataatggttacggaaactgtatgaatgttaagaggacagtgaaaggatttattaatgctggttttgctggaattattcttgaagatcaggtgtcaccaaaggcatgtggacatacacaaggaaggaaggttgtctcaagggaggaagcaattatgcgcataaaagctgctgttgatgccaggaatgggagtggatctgatattgttattgtggcaaggacagattctcgtcaagctttgtctcttgatgaagcattatggagagtgccggcctttgctgacgctgg

SEQ ID NO: 13941 - DNA, 1425 bp, Zea mays
ccaggcagtgcaaaacttgggtcgcttcgatttaaatgccaagaggagcatcgtgctcacatggactggcatgttacaaagaacaggaattcaaagaatcgtaagaaatcttcacgtaaatattttgtcaccgctgttgaatggttaagagcagcagaaacagtaggaaacgatggagttcctgcttttgtgctctcagacccagtcccagacagacaggatgagaaagaaattgctgttcctgcggatgaggagcaaacatcctgtgcattatgtcaagagccatttgaagatttctacagtgatgagactgacgagtggatgtacagaggtgcagtttatatgaatgcaccagatggtaatatcgatggtttggaatggtcacagttgggacctattgtccatgctaaatgtcgatctgggcccggcaatacttcttagggtgggcatagctgggatgatttgatagttttttttcccgttgcggctgtaggcatgacctgtaaactaatggagactcagattttggtatggttagcttcttttccatctggctcccttaacagccagtgcatagaatgttttttggaacaaaaaggcaggagccagtgcatagaatgtcaatgtgacaatagtgtataactgtaaaatttttgtgtaattcagttgcacagtgctgctttttcattacaactatagtgtgatctatactgaagcttcatgtttagggtttctgcagcacagttgttgacaacggtatatgtatatgtaaccatggtttcactggacatgggaaacaatatatttcaatagtcctgttttcttccgttaatatcttgtgcagaatacatagcagttctctacgttggttggtagctttggaagggatcgcccaagatgaccatgagtgctggtgactatttatgcctctcctgaagtgaaagggtctagatgctgtcattaccttattgccaaaactttttagtattttcctttgtaagttgagagcgttgtttgtgacatattctcggtcgcttatatagttccgtattgctgatatgttcatgctccataatgtggatgagaatgtcttattagactttatactttattctagttggtatatgctctggcgaactattcaatgaaacaatttcgcaatgttttttgtccaaatttacctttttgctgccccatattgctgtgtgaatttgactggattcgccaccgttcttattatcttcattgtggtggtatgtgtgacttgggtattctgtaacttgtgatggtgggttctcatactaagctgaatgattttttagataatctcatttctgatgtcacatcgccgcatgactgctcttgtagggtcttcattgccgcgattaggttgcccaaaggttggcaggcagactcgcatctgca

SEQ ID NO: 13942 - DNA, 3566 bp, Zea mays
gcacaacataagttcaagcaggccaatgtggtgcaccagccagcagctcgggacactaggcaaatgactgatgtgcaggaggatctgataaatggattagcatcgaatagttcgtgtgaacggccttcaattgtccagaaatcttctttacagtatgctgatgatcctgatcaacaagagacgtttcggcctcttgctgcgcacaagggcagcatcaccacatctcttgagtacacatgcatctgatatgaatctagatgggccattagtcaattcaaggagaaacttgtccatatcaccacctcttgatgtgttctctaggaatgtgtcccccaagagagcactagagaggctgccaccatctcattctgtattgggacctgatcccagaaaattcactgatcgaaatggcaggtcaagatggggttcggatgatggtgcacaacggcctacaatcagtatgcttgatgaagagtacaggaagcaaagtgcaagggaacttattgatgcatatgggaatcgtcaaggacgagatgctgatgaacgacttcctaaagtgcagcgcctggatccaaatggtatggctagcagatctagtgcacgaaattggttaacttccgaggaagaagagtattcatgggaggatatgagcccaactttgactgatcgagtcagtagcagcatgccatcttttcctcctggaaccatgagaactggatttcctggggcaaatgcagggttactggaatctgatgttgggaggcacaatttcccaagccaagctactagattatcggttgatggttcaccgtttaatcttgaagataggttttcaactgcaagtcatgttaacatgtctacaaggagatatccaagcaattttggtgttcagaatggagctcttttgaaattccagaattctgaacatgccctaaatcatgggagaattgctaccatgccagctccaccttggcaacagcctactggtctgccattgcaaatgcaagcacctcaacattcttcagcacttgatagattaccacagcccgctgacagtgaaatgccagtcaagaggttggacattcgtggcacatacaatggtttgaatgtagatagatccttggcggagaagcataggtcatcacctgctcgtgctccgacagaatggcttccccttcaccatacaccatcacaaactttaccactaattatacctgagacaaaacatgttagaagtgcatcggatagtttagaaattagttcttttgttagccaaggagctagttcatcagtatttgttccgcatcatcagtatgatgccttggaccggaaaacaggtacccgtaacttagctcaaccaccatatcagcaccaagatttgttgctaccgggccccccgaggccggccgcgattttgggaaaccaagttcatcctcttctgccccaacagttacatccccattcccatcctcaccatcaggagacttttagaagctttgcccctggcatgactgtatctccattccaaggacaaggaggcaatgcaaccatgacaccagtttccgttctgccaactttttctgtaccacctgctgtgccaccctatggcgtgctgtctgcacctgggtttcctatgccaccattaccgcccggaccaccacctgtcccactgcagatgggttcatcatcatcacaagttggtggccctcaaccatttgtctctggacttttgagtaaccttatgcggcatggtgtaatttcactggaaccacctagccaatcccaggattctgttggagttgacttcaatgtagacctcaaggtacggaatgagcctgtcatcaatgctttgtatcaggatctttcaaggcagtgtaaaacttgtggccttcgatttaaatgccaagaggagcatcgtgctcacatggactggcatgttacaaaaaataggaattcaaagaaccgtaagcaatcttcacgtaaatattttgtcacggtggaggaatggttaagagctgcagaaacagtaggaaacgatggagttcctgcttttgtgccctcagacccagtcccagatagaaaggaagagagagaaattgctgttcctgcggatgaggagcaaacagcctgtgcattatgtcaagagccatttgaagatttctacagtgatgagactgatgagtggatgtatagaggtgcggtctacatgaatgcaccagacggtaatattgatggtctggaaaggtcacggttgggacctattgtccatgctaaatgtcgatctgggcccagcaatacttagggtgggcatggctgggatgacttgatagcttttttttccgttgcggctgtaggcatgacctgtaaactactggagactcagaatttggtatggttagattttttcctatctatggcttcgttaacagccaatgcacagaatgttaatgtgacaatagtgcataactgtaaaatttttctgtaattcagtgattggaagttagtaatcggcacaacattcactattgtcatattgtgcttttgcccctgtcattttgtccttccatagttgcacagtgctgctttttcattacagccgtagtgtgatctatacttaagcttcatgtttagggtttctgcagcacagttgttgtcaggacagcggtttatggagccatggtctcactggacatgggaaacaatatatttcaatagtcctgctttcttcctcgttaatatcttgtgcaggatacataccagttctctatgttggttggtagctttggaagggaccgtgcaagatgaccaagagtgctggccactatttatgcctaagtattgaaagggactagatactgtcattaccttattgccaatttttttagtattttcctttgtaagttgagagcattgtttgtgactattattcttggttgcttgtatagttccatcttgctgatatgtttatactccaaaatgtgggtcagaatgtcttatcagactttattctttattctggttggtctccggcaaactattcaatggaacaatttgggaatattttttcgtccatctcttttttttgttgccccatattgctgtgtgaatgactggattcgtcgaccgttgggtagtctgtaatttgtgatggtgggttctcatactaaagctgaatgatttttggataatgtcgtccggtcagacatgcatttctgatgtcacatgaccaaatggctactgctgtagtcttcggtgttgtttggttcacatatcgtgaattatatttatttaaatctaattgtaatctgataccattttagaaattaatattgatctattcaaacttgttactgctggtgctggtgtcattactgttgcaatttataatatattttgtgaaccaatagcattgcagtgattagctttaatatgaagccggtgctgtttggtttagaatttgtatgacaagcagcaattaaagtactccctctatttcaacaaactataagatgttttttttcttaaggttggcaatgggcaggtttgggtcaggtcccgtcggtttt

SEQ ID NO: 13943 - DNA, 3166 bp, Zea mays
caagtgcaagggaacttattgatgcatatgggaattgtcaaggacgagatgctgatgaacgacttcctaaagtgcagcgcctggatccaaatggtatggctagcagatctagtgcacgaaattggttaacttccgaggaagaagagtattcatgtggaggatatgagcccaactttgactgatcgagtcagtagcagcatgccatcttttcctcctggaaccatgagaactggatttcctggggcaaatgcagggttactggaatctgatgttgggaggcacaatttcccaagccaagctactagattatcggttgatggttcaccgtttaatcttgaagataggttttcaactgcaagtgtatgattgtctgatctctctttaaataatagtgaatcacagcattagcataacactttgtgtgcctatcgttacctcgtgctattcttgaaattattttctccttttcctttaaaagatttatgatgtccagtatgcaaattgattgttgctttctgatctaatatatttgtaaaaatcattgttctaaaaaggctggttgccaactagccatgtgttgtccagttgaattgggctggctaggtggccctaggcgcacatgataagctagttgggccagatgtgccactagagtggcagaagcagtagctagcaaagggccaacaagaccatgaccttttgtgccctctgcttccttcctctcctgctcacatccttagttaaggtcttatgccgatggcccatgtatgcaagttagcctgtgcagatgatgcagtattttgctgcctgcctagagcctagtgcctttagatcaatgataaaaatctgctatacaagtaatataggcttcagctggatgatctagagatattgttgccaaatttcaaatgacatgtatcctgcgacaatgcttgtttgaccgaaagaacaaaagagtagttaggtagaagttctgcaaataaattagttagagaaacaacattgtgttaccacatatgtatgctgttagggaaggaactgtataagcataatttttcagcagtttattcctttgtattttacaattggatataaaataatcaatgccttcagttactcagattttaaagcatgcaccatgagtaggactagcgcaatattttctagtagcctgcagcagtttttaggcactgtatgtattatttaactgttttcttgtcttgtgtttaactgaaaccctttgaacattttttgtccatgcaacaaataggatcatatgcagactcgtcaacatgatagtgctgtctcgatgaatctatgaacacctattgacacaggaacacctttacctcttgcagcatgttaacatgtctacaaggagatatccaagcaattttggtgttcagaatggagctcttttgaagttccagaattctgaacatgccctaaatcatgggagaattgctaccatgccagctccaccttggcaacagcctactggtctgccattgcaaatgcaagcacctcaacattcttcagcacttgatagattaccacagcccgctgacagtgaaatgccagtcaagaggttggacattcgtggcacatacaatggtttgaatgtagatagatccttggcggagaagcataggtcatcacctgctcgtgctccgacagaatggcttccccttcaccatacaccatcacaaactttaccactaattatacctgagacaaaacatgttagaagtgcatcggatagtttagaaattagttcttttgttagccaaggagctagttcatcagtatttgttccgcatcatcagtatgatgccttggaccggaaaacaggtacccgtaacttagctcaaccaccatatcagcaccaagatttgttgctaccaagccaacaaaatcaaggtacaattttgggaaaccaagttcatcctcatctgccccaacagttacatccccattcccatcctcaccatcaggagacttttagaagctttgcccctggcatgactgtatctccattccaaggacaaggaggcaatgcaaccatgacaccagtttccgttctgccaactttttctgtaccacctgctgtgccaccctatggcgtgctgtctgcacctgggtttcctatgccaccattaccgcccggaccaccacctgtcccactgcagatgggttcatcatcatcacaagttggtggccctcaaccatttgtctctggacttttgagtaaccttatgcggcatggtgtaatttcactggaaccacctagccaatcccaggtatttctcatgcttcatgcgttgttatatagtattattctgtttatatttatgctgttaattaaggggaaaattgtgaacattttattgtaggattctgttggagttgacttcaatgtagacctcaaggtacggaatgagcctgtcatcaatgctttgtatcaggatctttcaaggcagtgtaaaacttgtggccttcgatttaaatgccaagaggagcatcgtgctcacatggactggcatgttacaaaaaataggaattcaaagaaccgtaagcaatcttcacgtaaatattttgtcacggtggaggaatggttaagagctgcagaaacagtaggaaacgatggagttcctgcttttgtgccctcagacccagtcccagatagaaaggaagagagagaaattgctgttcctgcggatgaggagcaaacagcctgtgcattatgtcaagagccatttgaagatttctacagtgatgagactgatgagtggatgtatagaggtgcggtctacatgaatgcaccagacggtaatattgatggtctagaaaggtcacggttgggacctattgtccatgctaaatgtcgatctgggcccagcaatacttagggtgggcatggctggtgagtatctatctatttccttgtgctataacaaacatctatggactttaaggtggacataatgttttttagagctagtttgggaacctcattttcccaagggaaattgtatcttgaggttaacccccctgtaaatagaggatagtctccttgctagtatttggctgtatgcaacatgtttttggctacgaattatatatgttatctgactaaataaaaatgctggatgtgagttgttgttcc

SEQ ID NO: 13944 - DNA, 3611 bp, Zea mays
  misc_feature (2156)..(2156): n is a, c, g, or t
cattcttcattgtttatgaccaacgaattcaacagtaacgactggtcccatagacaaaatcatgttagcaggatacaccctcagcatggaaatgcactgaaaagctccaccaaaaatttcatgcagaggccaagcattggttgcagggagactcaatatgggtttccagctaaagaatccaagttaggagcaagtctcaatcattctacaggtccaagagaaaaaacttgtggaaaattaactggcggttttgataagacagcacaacagctttatttggacagagacctatccaatgctcttaacagcagtgaatcaatacgttgtgagacgagatcaatttcctcttctgaaccgacaactccaaagtctttaaaaggcaattatacttcagagtctggtgaatcaacagatattacaataggagctcttcccatgcagaaaagaagattgcaggatttagttcgaactgatgatgccagtgaaactatttctgggcgatcatcaccttgttctgagtcatcgacaactgaattaattgctggacatagtacagattcatctattgaagggaaccatggctgtcaagggctctgtaactctagaacacatctagcccagatgctcagggttgtaaacgatgcctgtaaagttcaggttggtgcagatgttctccttgctgctggttatccaatttctgatcttgagaaatttatatgctctgcaactcccgttattggtcgtgcaccttgcatgataagcaacacttgttcattggaccaagtagttagtgactcagtttgtcagcatgacatctctaatgtttccttgaggagaatatgggagtggtatgaagagccagggtgctatggattggaagtaaaagctcttagcaatctcagctctaaaacatccagcagcagcagttcagagttctttgcatactttgtgccttatctatctgctattcagttgtttgggttgtctaggaataacatgcatcacagttttggtgtgcaagggagggaattactgatatcatcaaatactgcaagctctatgagctctcatcctgtgcatgcaaaagcgcatacactgcttgaggaaagtaatgcatgcttgccagagtcatctttagttgtagaagatcctggagaactcatatttgaggcctttgaaacagagcaaccttctctccggcctccattatttgaaaagtaagttgtccacaggcctccattatgagtttgaccactggttccacatttttttctaagatcctgattgtgaaatattttctctctcttcaacctggtgccatttctttctcgaaatgcttcttggttcacaacacaatctttttctttgttagaaaaatgcaattgatttaacaattctgttacgaactgtattctaactgtcagtgagtttgtgagcaatggaacttttcatgaccaagtgaccatgagggatttctttttctggtattgtattggatcaactgatcaggatgtttatgaattatggcctaaagcaagagaacttattttgtgcccatgtgagtggcttagaactgggatttataagctgctaatgaatttttcataatacttctacatcgaattataagacatttttggcttttctagatacattgtacatagaaaaatatatgtatctagtagaaaagccaaaatatcttgtaatttggaatggagggagtatgtggcatgctatgtatccatttgagggtcttcctgatatagttattatgcactttgtgccacaataataaaggcttttacttaattaaattgtagctgctatttaatgtccgggttgtttatatccttttattgtgttaatatctgactgcaatctgtaggatcaaggagcttgttagcagtgcaaatgtttctgaccaccgggtttttggggacactgaaaaattgcaaaatgcgaaattgtgtgagcttcatccagcttcctggtttgttcctgatcttcgatgctttattcactagcatttccctcagtttttactgttatcagtactaaggttttttcgttatctgtctcgtgatgttgaatatatttcatttgtaggttctgtgttgcctggtatcctgtttatcgtgtgcctcgtgggaatttcngtgcggcatttcttacttatcattcactggggaagttggttcataaaaaatgctccatggatacgaatgacgggcatacacaagtagtttcaccagttgttggtctccagagttacaacgacaaggtaccatttggactcgatgttttccttgatgacaggaggatttttttttgcatatcaaagcatatggtccgtacaactgttaaattcaactgaaagatttaggggacaatgatggaaccaaattaagtcacttcgcagaagtttatttctagtgattgcttggtctacatgttcgagttatttttttgtgctttagatgatgatgatgtcatattaaggggatgattttatgcgtagcctgattggtttgcattctcttgttttatagggagagcagtggtttcccctgagatgcccagatttgaagcaattgccaatagaagattctttaaaaaccagtcctgctgaagttcataaagagaggctgaggacgctgaagatgggtgcattggccatggcaagagctgttgtcccaaagggaagtggggagtcggtgaaccaccatcctgattacgagttcttcctgtctcgttgcgcctaggctaagcggttgtgatatgaaggaagaggggcttttctgcttctagctcctgaatgtagtagtgaccatgaaaatgaaaaaaaaacccagagtagtgactaaccagagaccggctatagatacagtttatcttagagagaggagagcctggggtgatgcatatcactgactgtataggagatagactcgaatattagatactctaacctgattccggattaccaatgcaaaccaagttggtgagctgttgaagtatggcagtacccgcgggatgggtgctttattggggctgggggcaaagatgagaagataccacagatgagatgacgctgcaggtgttcatcttttgtacaaagaccacaccagaggagcagcaagaaatttgctaccagcaagaaatttgttaacacatttgcgaggttgggcttttgttgtggcttgtttgctttgcagacttgcagtgttgctgtttctaatcatgatactgtgctgcttctgtttctaatcatgatattgtacatgaatgtgtcaacgtctggtgctgtgctgctagcaaacgcaagtgaaagcgtgcgagtaattagaggcgtgcaacctcattgcttctcagggggctccttggtgtcgagcgctggcatcccctccattctttttttattagttcgctcacggtacatcagatataaatatatttttacatataaccctattagcttaatttatttgtgtctaaattataattattagaatagattttgatttcaatggtccaaatggagcctaagttagtttggataaaaagtagcaatattctgctacgtgtctcatagttaaaaaggaagtaacaaa

SEQ ID NO: 13945 - DNA, 1841 bp, Zea mays
gcacgagaccattacctagaacatcctaatcgaaaacttcagagtctggtgaatcaacagatattacaataggagctcttcccatgcagaaaagaagattgcaggatttagttcgaactgatgatgccagtgaaactatttctgggcgatcatcaccttgttctgagtcatcgacaactgaattaattgctggacatagtacagattcatctattgaagggaaccatggctgtcaagggctctgtaactctagaacacatctagcccagatgctcagggttgtaaacgatgcctgtaaagttcaggttggtgcagatgttctccttgctgctggttatccaatttctgatcttgagaaatttatatgctctgcaactcccgttattggtcgtgcaccttgcatgataagcaacacttgttcattggaccaagtagttagtgactcagtttgtcagcatgacatctctaatgtttccttgaggagaatatgggagtggtatgaagagccagggtgctatggattggaagtaaaagctcttagcaatctcagctctaaaacatccagcagcagcagttcagagttctttgcatactttgtgccttatctatctgctattcagttgtttgggttgtctaggaataacatgcatcacagttttggtgtgcaagggagggaattactgatatcatcaaatactgcaagctctatgagctctcatcctgtgcatgcaaaagcgcatacactgcttgaggaaagtaatgcatgcttgccagagtcatctttagttgtagaagatcctggagaactcatatttgagtactttgaaacagagcaaccttctctccggcctccattatttgaaaagatcaaggagcttgttagcagtgcaaatgtttctgaccaccgggtttttggggacactgaaaaattgcaaaatgcgaaattgtgtgagcttcatccagcttcctggttctgtgttgcctggtatcctgtttatcgtgtgcctcgtgggaatttccgtgcggcatttcttacttatcattcactggggaagttggttcataaaaaatgctccatggatacgaatgacgggcatacacaagtagtttcaccagttgttggtctccagagttacaacgacaagggagagcagtggtttcagctgagatgcccagatttgaagcaattgccaatagaagattctttaaaaaccagtcctgctgaagttcataaagagaggctgaggacgctgaagatgggtgcattggccatggcaagagctgttgtcccaaagggaagtggggagtcggtgaaccaccatcctgattacgagttcttcctgtctcgttgcgcctaggctaagcggttgtgatatgaaggaagaggggcttttctgcttctagctcctgaatgtagtagtgaccatgaaaatgaaaaaaaaaacccagagtagtgactaaccagagaccggctatagatacagtttatcttagagagaggagagcctggggtgatgcatatcactgactgtataggagatagactcgaatattagatactctaacctgattccggattaccaatgcaaaccaagttggtgagctgttgaagtatggcagtacccgcgggatgggtgctttattggggctgggggcaaagatgagaagataccacagatgagatgacgctgcaggtgttcatcttttgtacaaagaccacaccagaggagcagcaagaaatttgctaccagcaagaaatttgttaacacatttgcgaggttgggcttttgttgtggcttgtttgctttgcagacttgcagtgttgctgtttctaaatcaaa

SEQ ID NO: 13946 - DNA, 3687 bp, Zea mays
ttggccggggagccccgcggaaaaagaaggtgacgtttctctttcttggttccggcgccccaccgggagagtgagctgctgcctgcgcaactcgagcgccgcttgtcgcgagcaccgcggcctcgatccgtcaagctaaaagcatgtctggacagcaggaccacgctagtaaaagctctagctcaagcatcagcagcagtactcaagagagcgaggaggaagcacctgtccgaagcgtcaccattggtagcctccttgcccaagcaaatagcaccagtggacatagtcttgggaagcgcctgtcccatttggggtcaatcccgtatactccccgagttaatggaaaaatccccaatgttggtaatgcaacactggaccacgaacgattgctggaaaggttgggcacttatggtctagctgaatttcagatagagggggatgggaattgtcagttccgagctttggctgatcagatatatcacaatcctgactatcataagcatgtgagaaaagctgtcatgaaacagctgaaggaattcagaaaacaatatgaaagttacgtaccgatggaatataaggtgtacttgaagaaaatgaaaagatctggggaatggggagatcatctgaccttacaagcagctgcagatcggtttggtgccaaaatttgtttgctgacatcatttaaagacacctgtttaattgagatagtccctagggatctaactcccacaaaagagctttggctaagcttctggtgtgaagtacactacaattccttgtatggaatcgacgatctcctgacccgcaagacgaagaagaagcactggctgttctaggagggttctgaaggatccaaattctttcagcagctcctgctctgtccagccagcgcagcctctgtcttagtacttactagttggccaacactgtatcatatcctaagttgagtctaggctttacgcttttatgtacagtcgatctagatcttgtaaaattccctcaaggagcaacaggaactgtacaactcttagatccatgagattttggtgatctctcctccatgggaatgatagtgcttgggtgtatgtacattataaaagctaccaggggcattttgacgtgggcgtttggatgccattctccataatttttattctgaattcgtagagtggccatttccaggcatggggatctgccggattttgcagtataatttttaggattggaaaagtttcaataacgtcacctgtgaccctgtttgagacacgttctggctctagaaaatctctagaaatttgaggagttagggggtgtttgggactattcactccaccttttatagctctccgtggagtagctccactatggagtttgtaaagtttttgaactttctggcttgcactaattctaggagacgtcattcttcacagacatttcatcaaacaacaggctcgttgggggcacacatgttggctagatgctgtcgttggcactaccgttcctctatcctctttccaagacgcgtgccagatgttgtcgttggcactaccgttcctctatcctctttccaagacgcgtgcctcctatgttggccacctcgctgttatacgcgtagatgttgtcgttggcactaccgttcctctatcctcttttccaagacgcatgcctcctatgttggccacctcgctgttatacgcgtggccacgggccaccggcgatggacaccgggacgtgagcacgcgatcgccgtcgtcgggagagacaacgcgagtacggtaggtggtttttctgttatgatattccatatctcatccacaggcggccggcccaactctcatacgcaccctggcccacaaccctgatagacactcttccccgcccgacacaatgattcacagctttccacctccttcgctcacctcttcttctccagtcttctactgtcacttgtgtcttggacgtcaggcgtgacagttgccccctcccgagagcttgcttgtccctaagcaagggaatgaggaaaacgttcctgaagcacgtagaaatcctcccaggtcgttgaatcaggagaaagatgactcagaataagcacctgtggcacagctctgccgcccttcttcaccaaacgtcggtccaaaatttccttaggaaccacatcatgctgagccagatcctggtaatgaggtaatgtggtgaacactggcgtataattgcgagtgaatggcttgagttgagaaacatggaacacatggtatatttgagcagtagggggtaactccaagcgataagcgacagaggccactttctccaatactttgtatggctcgaagaatctgaaggcaagtttgggacatggtcgagacaccactgactgctggatgtaaggctacagcttgagtagaaccaagtcgcccactgaaaactggcgttcagtacgcaacttatctgcctgcatcttcatacggttacgcgcagcagccaattgttcctgcgaaagagtcgtgaacacagctctttcagacaacaaggtagccacatctttgtcagtttcagatgtcaacatcggagcgacagcaaatggtggttcgtaaccataaagagctttgaagggtgagcatcccagagtagtgtggtaagacgagttgtaccagaattctacaatcgaaagccaagacttccatcgttgaggttgggcatggacagcacaacaaagatacatctccacacattggttaactcgctcactctgaccattggattgaggatgataggacgtactcattactcaagttcaacttggtgcccagcagtttgaacaagtgagtccaaaaagcaccggtgaatatcctgtctcggtcactgaccatcgacttgggcagtccatgaagtctgacacttgatctaacatcacctgagcggccttagctgctgtaaaagggtgtttcagagccacgaaatgagcatattttgtaaagcgatcaaccaccaccaagatcgtgtcgtacacttcagatttgggaagtttctcaatgaagtctaatgtgatctcttgccacgccccttgaggcataggtaggggttgtaataaccctggtggatgaagtgtttcaaccttagcatgttggcagacctgacattgattcacgtaatcctccacatcaactttcagacccctccaatagaataacttcttcaggcgctgataagtggcttggaccccccgagtgcccccatatggcactatcatggagggcagccaccagtttggttcggagggcagaattgtcgccaatccaaatgaggtctccttttcggatcaatcccttgctaagatgatacccttggccatcaggactatggacattgagctgggccaagagttgttgggcctctgatttgtgaagtatgaattcaggacctcctggatccataaaggctgaacttcactcacagatgtcaaagtcatcaaatgtcccacccgagagagagcatcagccaccaaattatctttcccttgtttatataccaccttaaattgcattcccatcattttggtcattgccttgcgctgcagttcagagtagagttcctgctgtcctagaaaactcaatgccttgtggtcagtatgagtttcaaatacattttgctgcaaatagtgtctccacttgtccactgccatgatgagag

SEQ ID NO: 13947 - DNA, 3404 bp, Zea mays
gccggccggtcctggactgcaatctccatgcccttccttccttccttccccacacaccatctctctttcacatggaggatttctttcccttctttcttcccacaaatattcccaaagaatcttctgtgttgcttctctcctcggattcctcttcccctcctcgcctcccactccaattattcctctccttactgacttgcttcgcttctctgttatctctgtcctctcctcgtgtttgttcttcctaccagcggagcgccagctacgcgctgtgcctcgtgcctagacgaacggcataggcaccggacggtggcgtcatgtgcgtggaggagccggaggacgccgaacggtttggttttggagacccaggggtcgaggagcccgctaagtttcccttggctcagatggagagagtttgtgaaaatacaacttctgctgatttcaggcagaagttaagcaattttgtcccagtaatccgatcgggggattggtctgatattggaggtcgccaatacatggaagacacccacgtgtgcattccggaccttgctaagaactttggtttcccatcattagataatgaagttgtttcattctatggggtctttgatggtcacggtggaaaagatgctgcccatttcgtttgtgataatttaccaaggatgattgtggaagattcagatttccctcttcagcttgaaaaagttgtgagaaggtcctttatgcagattgattgccagtttgctgagacatgctctctccatagagcatcgtcctccggtacaactgcacttacagcaatggtttttggaaggtctcttctggtcgctaatgccggtgactgtagggcggttctttcccggtgtggcaccgcagtcgaaatgtccatggaccacaggccttgcagtctcagcgaaaaactgcgcgtagaatcgcttggtggctacgtggacgatggctatctgaacggtctgctaggagtcaccagagcgcttggtgactggcatctcgagggcatgaaaggagctggtgagacaggtggtcccctgagtgctgacccagagctcaagatgaccacgctgacgaaggacgacgagttcttgataattggcagcgacgggatctgggacgtcttctcgaaccagaactcggtggacttcgcccggaagcgcctccaggagcacaacgatgtgaagttgtgctgcagggaaatcgtcgaggaggcgatcaggcggggggctactgataacttgactgcagtgctggtctcgttccacctggaggcccctcctcggatcagagtggaccgtcctggtagggtggagaggagcatatctgctgaagggctcaatagcctcaggatactcctgggaaggcagtagctgcgttcttgtcgcgattttaggtgctgtgccgcattgccgagttgtaattgtatgtagtcatctcggctcctcattgtcgttagctgttacccgttgctgcgactgcgacacgtgttacgattcttgttggtgattgaaccaacaaacctgatattattcttgttggtgattgaaccaacaaacctgatactattcttgttggtgactgaaccaacagatttgagctccgtcctgtgagagattttaagcagatgaaagtatatctggcaaagaagctgtgagttcccagctcactgtgtaatgtttgccttccgttatgtaacaaaacaaaacaattcattgactgaaatgtgtcaggactgggtcaaatttcctgttctcgcacgactgttcactcgggtggtctttctcccatgatacaaaaactatgaagctggacacggttgagaacaatgtaagcaacagaatggttcggttgcggaaacaccggccgttgtcgcctgaccggtgtcgtcggtttgcaacgaggtcaaaacaatgccttttcgacatgccagtgaaacaaccgaactgacaagttcgcctgtacagctgtactttactcgaggaatgcactggggggaaaaaatatgcgcgctcgtgtacattcctctgcagacaagcgcacaagtttctaggggcagatgtatgtcacacctgagaccaggcagagtacttgccaagattataattctctttggtactttcaagcatgcattggcacctaatcaaggggggcaatggcctaaacaaggcccatattgtgggtagacacacctctgcaaaggccggcatagagaacataaactattgccacgtcttcgcattggtacttcaggcaacccctctgctgcagacatgagcacgccgatcactggatggggctgggggccagggtagtgttccagagcaaagatgtatatattcatctgagtcaaatggttcagcttcaagcagtagagaccacagctcttcagtcttctccattccaactgagcttcatcaccgaactggtccaagaccctcgcgcagagacaagatgaagaagagttcctcgccgttggtggcggtggcggtcgtcattgttctgttcctggtgatggcaagggtgcagggtattcggctggatgcagagagccatgaggcattcagcaaccagatggttcgtgtaagtaatcgtcattcgcgtgcgcattttgtactacacacagtgcattgactctttccgcagttcattaactgtagtgcgttcttgattatttcagaaacccggggagatgggagcgacgtacgctgacagtgagtcgcctggtgaaaaaatggagggaagcatctctgaagagaaagatagagctggccacggtttgccggagattcatgtggattactacggtccaaggggtcataaatctagacaccactgagcagataaaataagatcatctgttctttttccccctatcttcagatgcacccccttaaactagtgagcgcatcacttgaggctgcctactctagcagatagtaatacttaggatgtaattcatttattgtttcccctttgaagagggggaagaaacaccactgatgtactaattcttgaaggaaaaaacaatcaagaaatagcaaattgcatgattattagagagctgcagctgggtgtccaagttccaaagcaactgcggtattcaccatgtgtatctgttctttaggccaaacacttagtaagtttatttagcagtttatttacaaaagctagaaatatcccacgtctatattaggacaaaaagataaaagatagtcgtagttcactttttggtccgctttatggggctagggacggtaatggatctcgatctaaatgtttcttcacaattcgttagggctccaaaaatattttagttcagaaatgaatagaaatagagaatatatttttatagttactccaaccaccaattcctaaaacctgatccgaccctg

SEQ ID NO: 13948 - DNA, 2906 bp, Zea mays
tttttacgcttccgcggacccttggcctggggcctggtaagtacctgcctacattcagatcaatgctaatcttgataataacctgacagcctgcttcatactctagtcatggaagttaacaggaaaaaatagtggtcttagaattaaaacaactattggttgtgtaatttaatttttttaatgcactgtgctgattactggaatttctttgcactatttattttatttccatttactgtatatgattataacatatatgcattaggagctattgatctttggttttccagttataattatgttcattttaccagataaatagataataactgaaaattctggacggtaattctgtgtttctgtagttgaaatatccaactaagagcatctacaagagtttccaaaacccacttttgatctagattttttgtcaagattgaaaaaaaaactgctctccaaccactccctgtctcaactcccaatctttccgcacttggaaaaaccgacctcgctgcatggatatgtacgcgtgcataacttcaccccaatccgaaggtggaaagaggtgggaaagaataagtatgacagggtttctgatgcaaatatggaagacagaaggtatagaagtggttgaggtgatttagaaatagttctggatttctgatgtaaaattaacttttatctgctgtgagcgagatcttggaaactgtttgaggaagccaacaaatatgctttcaactttttttagtcacttgaaaaactcattaatttaccaagtagttttttttagaaactattggagatgctctaacttcagcaattctgctccgtgctttaaaaaacaggaggcgtggaacaaattcaactctgaagagctcttctaaacagcctcatgactgaacatagcatgacccatcagggtctgcacaaggtactctgggaaggaactcacaagctggagcagcctgaggttggtcggggggaaggggaaccatgaagcgaccaagcgaaacctgaactatggttataatcacagttgtttgtttcactcccccaattttctttcccaactatctgttgattggatgacaactcacagcgacatgtggcagctgcccaagctgaacctcatccagtaggtgcacattagtgccctgttttgtactgtttgtcctcggctgtatgtaccgtcagagctgaggcttctgaggtcagcgttgtgattttggattaggtacagggcttatttaccatggagagaatgaaaacaatagagatgacccataataatagattgattgattagagatctatctatatatttatataaatatataggggggagatttcgtggcttatgaaaacagaaccaaacgagatatttccttatctctgtaaccgtatataagggctggccggctatatctattatgtacatatctcacggttttcaccgattttccatggtttcatatttaatatttaaatggtaaaaaactgaaattgtacataaataagaatttgaactatggttgttagctctagatctgtatttacacctatctaaccaatagaacacatgtatgatattttatactctacacttataaatataaaccatcacaatgtacgtactatatatacacacttgaaaattcttcacgaacgacacattcatatgattggagtacaaccagctttgatctacgacttctattggcttttgttctaaactaatgaatcaagtcattatctatgtgattggttgcctaggcaactaatgcatggcacgcgcgggactggtttaccccaaactctatttttctgtgttcctgcgcatgcaaccaaaagagtctggtttggtataagatgcacccacacatgcaggctcaaccattctcatgcaagcatccaatcaaaagctgcgacatggtcaacgcatgcgcagaaccaggttggcgagtagcaggcaaccaatcagactgtatatgttcctagtcgtacctaagtctagcactggagtcatacgtgtagcagcgctcacatacacactatagggaatgatgatgcctaagagagatgagctagacaatctatgatctctattttttctttaatggggcgtttggatccctttattttagaggaattggaatgcacttaataaaataacctatttagcttggaatttgatattccatcactttccaaagttctgatataagcttatctcaaatttatggggtggaggatgggaactgattttatgtattactagaatttgtttctactctgtaacttacaagactgatctttgactcactcctctataacaaaaatgtaacacataagtatctccgatatcttgctaataatagtatactgatatattttccataaaaccgaattagtttaattgatatatgcctaatattactattattagaatggaattcaattccaatgatccaaacggggtgtaatcaaaatatatacaaataactaagtatttatatgtgcaactataattttgactaagtgttgttatctctatcctaaagagttatataatataggttttaaccttattcactagtaaaattctaagctagaaatgtgaagcacatgaccaagataatgcagcataaatataaaggcttaaatgtgatagagatataaactctagttgacgtgtcgatgtttttaaagcacataaactttctcttagttctttttagagccccatgcaatagaagcccacatgagggccaagctccctattaggtaactatatagatagcattcggtcctcacgcacaagtgtctccaattttgattctggatgttcatcgttgtctctaccatcgagtttttggttgaatatgccgcaaagtggcgaccacgcc

SEQ ID NO: 13949 - DNA, 2452 bp, Zea mays
gggatgaaagaggccatggataaagcagaggcaaagttcaaacatgcaaaggaggtacgagagagagagcgtgatgcgaggattagaaatagagaacaacgggaacaagatagtgtaacaaggtcgtatgcccaggatcgtgaggacaaagggagaaaggaaagactagaacaagaaagagagattaagcaaaatgaggaaaaggaaagagagcaaagaagacttgaagaggaaagagaacttgagcgacataaagaaagagaaagagctaggcaagcagtggagagggctacaaaggaggcacgggaaagagcagctgttgaagctcgtgcaaaagcggagagagaggcacgccaacgttcagaacgtgctgctgtgcaaagagcccaacaggaagcacgtgagagggcagcagtggaggctaaagagcgagcagagagggctactgcagaagcaaaggaaagggctgctgctgaaggtaaggaaaaagctgctagtcaagccagggatagggctgcagcagaaagagctgctgtggagagagctcagcaagaagcgaggaagagagctgaacgagcagcagtggaaagggctgctgctgaggctcgggaaagacaggctgctgctgcaagagataaaacgagcaaaccagatgatctagagtccttctttggtatgggtgctcgagctaatagtgctccgaagcaaagggctccgactgtggactctatgtttcattctcaaacgcaaaatagagggacttccacttcgacatcaatgaaaaaggcatcatcaacaacaaatattgctgatgacttgtctgcgatatttggaggagctcctacatcagaagaatttcaagaagtagatggggagagcgaagaaagaagacgcgctaggatggaacggcatcaaagaactcgtgaacgagcggcaaaggctttggctgagaagaatgaacgcgacatgcagcaacaaagagagcaggctgaaagacataggcttgcggaaacactggactttgagattaagcgctgggctgctggaaaagaaggcaatttgcgtgcattgctatcaactttacaatatgttctttggccagaatgtgggtggcaacctgtatccctcactgatttgatcactgctgctgctgttaaaaaagtgtacagaaaagcaacactgtgtatccatcctgacaaggtgcagcaaaagggtgcaaatctccaacagaaatatatcgctgagaaggtttttgatctccttaaggaggcgtggaacaaactcaactctgaagagctcttctaaacagcctcacgactgaacatagggtcgcccctcagggtctgcacaaggtactctcggaagaaactcacaagctggagtggcttgaggttggtcggggggaaccatgaagcgaccaagcgaaacctgagctatggttgttgtaatcaccgatgtttgtttcactcccccaattttctttcccaactgtatgctgattcaatcacaactcacagagacatgtggcagctgcccaagctggacctcatccagtaggccagaaggtgtagtatttatcctgggctgtatgcaccgtcagagcgggggttttcttaggccagtgttgtggttatagattaggtacaggttttttttaagcatggagagacgttttactagataatgatgaatgttgcttgtctgatgccattggcatcgtggcaagttcggttgtcttgtttatagtcaatttctggaacatcacttgacctatactctgattcctgttttcttttactcttgtacaaagttgctggtcgattttgattgcttgtattgtaatcatgtttggacgtttacgggttcagtggaatagtttccgggttcgtcattttcatttggtacacaagatcaagcagcgaaccctatatatttgggttccatgatcatgtgtcccctcctttttttacaatggcagtgcgacaatacccctttagagcttgttcggttctactctttagagcttgttcggttctactccaatccatatgggttgagggggattaagggcctgttcggcagctcaagaatgaatccaggctaggaacagttacaagccaggattcagtgaatccggccctttcacttgttccggacatgtaattaatccggctggaataaatcaagagaagcaatttttatctgtttggtagcaaaggattgaatcatgtcacttcagttgaaagaaatcaaattttcagccacacactgacagcggtagtaggcgatgtcggaccacaacaaaaaattgtgataaattttttttatccaactctggtatcattcctgtactatgataggcatcattccttttgaatcttaggctccaccatgatggaagggcaccagcagacaacaaatgcaggattactgtgtacaagaaataagcaca

SEQ ID NO: 13950 - DNA, 1006 bp, Zea mays
gcacgaggcttccacttcgacatcaatgaaaaaggcatcatcaacagcaaatgttgctgatgacttgtctgcattatttggaggagctcctacatcatcagatgaatttcaagaagttgatggggagagcgaagaaagaagacgtgctaggttggaacggcatcaaagaactcgtgaacgagcggcaaaggctttggctgagaagaatgaacgtgacatgcagcaacaaagggaccaggctgagagacatagacttgcggaaacactggacttcgagattaagcgctgggctgctggaaaagaaggcaatttgcgtgcattgctatcaactttacaatatgttctttggccagaatgtggatggcaacctgtatcccttaccgatttgatcactgctgctgctgttaaaaaagtgtacagaaaagcaacgttgtgtatccatcctgacaaggtgcagcaaaagggtgcaaatctccaacagaaatatatcgctgagaaggtttttgatctccttaaggaggcgtggaacaaattcaactctgaagagctcttctaaacagcctcatgactgaacatagcatgacccatcagggtctgcacaaggtactctgggaaggaactcacaagctggagcagcctgaggttggtcggggggaaggggaaccatgaagcgaccaagcgaaacctgaactatggttgtaatcacagttgtttgtttcactcccccaattttctttcccaactatctgttgattggatgacaactcacagcgacatgtggcagctgcccaagctgaacctcatccagtaggtgcacattagtgccctgttttgtactgtttgtcctcggctgtatgtaccgtcagagctgggggttctgaggccagcgttgtgattttggattaggtacagggcttatttaccatggagagagtgaaaacaatagagatgacccagaataatagattgattgattagagatcaaaaaaaaaaaaaaaaaaaaaaa

SEQ ID NO: 13951 - DNA, 1647 bp, Zea mays
  misc_feature (1050)..(1050): n is a, c, g, or t
  misc_feature (1059)..(1059): n is a, c, g, or t
ccggccgagtgcagacagcctaaaccctaaaccctaaaccctaaaccgctaaccggcgtccggcggtaagctactgccgcgagctccctcctgcctcgttctcacttcctacccgctggccggtaccacacacgccgccgcgccagccatggacaccgctctaccttccgtcctcataggcggcggactctccgtgtccgtctccatttccaccgccactaaagccggcagccaatccatttcctcccacctctcgacctcctccctccgtttaaccgctcgccatcggaaccggcgccgtttgcccctccttgcatcatcttccgagtctcctcccgcgcaactagccgccgcttcgactgagagccagtcgcgttcctccaggtgggtggttgtgatggatacgcccccggccgccgcgggaggcagcggggtgtcccgcgcagaggccgtggattactacgcagccacactggcccaggttgttggaagtgagaaggaggcgcagatgcgcatatgtgaggcttcgtgggatgggacctacgagttccgctgcgagatcgacgaggatgcatcgaaggagcttgcaaagatgcctggagtgttatctgttcaactagatatgggtaacaaatcagagaaggataatcacagcttgagtctctcgacagctaaccttgtaagcattagtgatggtgcttctacatcttcaagtgggaaaaatgagttttggcttgtccggatggagaagcccggagttgaagttgtgacaaaggcccaaatggtggatcactacacccaaatccttatgaaagtgttggggaacgaacaggatgctcaggttagtatatatcacgtttcatgggatagggattatggtttctgttgtcatattgatgaagaatgcgcaaaagagttagctgatgttcctggagtgttatctgttcaacccgatacgaactttggatcagacaacaaaaattacaaaggtgctggtggcgatggcgtgaaatcatctgaagggactgggagcggtcgatatcaaaaatnaaaaggctnttttgtttacagggcctttcattttatacatctgagaagaccctacgggcagcgtttgagcctttcggtgagctcgttgaagtgaagataattatggacaggatatcaaaaaggtcaaaaggctatgccttcgtagaatacactaccgaggaagctggaggtgctgctctaaaagcaatgaatggacagatcataaacggctggatgatagttgttgatgttgctaaaactagatcgagagaccgtctatctgggggacctaatcaagcatttcgaccacactatcaggctagatgactgttatatgtacagaacttacagctgtagagtagagataagcacgagagcgaggaattgctgggggatgccgagccgcctgatctgattgtagttcagtgcccttgtcttgtgctaattgctagaaaatgaatactcccagcaaaaaaatatgtaaatgcagctgaagtgtacgattactaacttctacttaattaagtcattctcagacaaaaaaaaaaaaaaaaggctttttcctgctcgtaagtttgaatatatatttaatatttatgatatgatggattttttatc

SEQ ID NO: 13952 - DNA, 554 bp, Zea mays
  misc_feature (548)..(548): n is a, c, g, or t
aatcaagtcaattctgaactactaccgcgagctcgcaatcccatctgcctcgttctcacttcctacccgctggccgctggccggtaccacacacgcggcacgccgccgcgccagccatggacaccgctctaccttccgtcctcataggcggcggactctccgtgtccgtctccatttccaccgccactaaagccggcagccaatccatttcctcccacctctcgacctcctccctccgtttaaccgctcgccatcggaaccggcgccgtttgcccctccttgcatcatcttccgagtctcctcccgcgcaactagccgccgcttcgactgagagccagtcgcgttcctccaggtgggtggttgtgatggatacgcccccggccgccgcgggaggcagcgggatgtcccgcgcagaggccgtggattactacgcagccacactggcccaggttgttggaagtgagaaggaggcgcagatgcgcatatgtgaggcttcgtgggatgggacctacgatttccgctgcgagatcgacgaggatgcatcgaangagctt

SEQ ID NO: 13953 - DNA, 2619 bp, Zea mays
  misc_feature (2463)..(2463): n is a, c, g, or t
acattctgagaagactctacgggcagcgtttgagcctttcggtgagctcgttgaaggtttgtgatagggtagcaaatttttttaacacattcatttatcgtttgcgtcttctgactcatttgactgctttgtcacatacagtgaagataattatggacaggatatcaaaaaggtcaaaaggttatgccttcgtagaatacactaccgaggaagctggaggtgctgctctaaaagcaatgaatggacaggtaggtgattagaattcctattccacgactagcattgtttcagttgtatgatgtttgcaaacctcttgaaactcacggttatacttttatctgcagatcataaacggctggatgatagttgttgatgttgctaaaactagatcgagagaccgtctatctgggggatctaatcaagcatttcgaccacactatcaggctagatgactgttatatgtacagaacttacagctgtagagtagagataagcacgagagcgaggaattgctgggggatgccgagccgcctgatctgattgtagttcagtgcccttgtcttgtgctaattgctagaaaatgaatactcccagcaaaaaaatatgtaaatgcagctgaagtgtacgattactaacttctacttaattaaatcattctcagatacaggctttttcctgctcgtaagtttgaatatatatttaatatttatgatatgatggattttttattaacaagtgataatcttcctccaaagaaaaatttattacaattgttcagaaatagcgaacggttcaggttcatatgcagctgatgtaatattatgtttcaaatcctccaacatatgataaataccctcgctttctatatgcagcttgtctgcagtggcaaaggaatgtacgcttccatctatctctatccagctgagcccaggtttcttggctactctatgttcctccatcctcctccgcgtcctcttcgagtcctcccattgttccgctcgtgcatatgtgttcgatagcagcacatacgagctgccatgacttggttttgcctctgccaacttcgacgcagtgagctctgccatctcgacgttgccatggctacggcaggctgctagtagcgagctccagattacaaaaccaggatcttcaggtagattgctggcaagattgaaagcctccttcaagaacccagcacggccaaggagatcaaccaagcagccatagtgctggatcatcggcctgatgcccatgctcctcattaggtcgaagtacttgaagccctcatcgacgagcccgccatggctgcaggcactcaagacggctacgaaggtgacaccattaggctcaatgcccacctgcctcatctcgacgaacaacctcaaggcattctctggttgaccatgtgctgcgaaacctgcgatcaaagaggtccaatgctccacattcttggtggtgacacttaagaagcaactgtgtgcagcacccatgctcccgcacctcgtgtacatactgaccagtgcaaccccgagaggaccatcaagtgagaactcccgacggagaacatacccgtgtgcgctcttcccaattgcaagtagaccaatgtcccgaacagccgacacgaagccaaccatcgtggcctcatctggcgctaaaccataagccacagtcatctcgataaacaagtccactgccaccggcgcccacccgttccttgcaaaaccagaaattatggtgttccaagaaaccgcattgcgctgcggcattttcacaaacacctcccacgcagcgtccaagtcgccatctctgataagcgcatcaagcagcacgttccaggtgaccaccgtccggtcggccattccatcgaacaccttccgcgcgtcgcacacgcggccgagcctcgcgtaggcgcgaatcagggacgtgaaggcttggacgtgggagacagcccgcgagccgcctgacttgacgaggagtgcgtggatctgctcggcctcggccacggcggagggcagccgcgcgcaggcggcgagcgcgggcatcagagacgggttagtgtggagggcgtggccggcgctgtggtgcgcgcggaaggcgcacagcgaggcgtctcccgagggcgcggcgcggcatcgggtagctgtggcgttcgtggcggccttggagggtaggggacttggcgggaaacctgaggtcgacggcgagagcatcgagagcgccaaattgttcatttttcgattaggatgttctaggtaatggtctcgtgccaacgtggacaaggataacatgtgctcagctcggctcttcaccccctcctccaattcttttccgttcccagagaaactatctcataggcatagccaatttaaatatttattttttaattaccttacatcttttcacctcaggaagaatatactcccaactaaagccaagacgcgctaaaggaccctcatcgaagangattgaccttacattccacgaggtcaacacgatttgtactctaggaccaggggaccctaatctcaagaagcggaagatttccatactaactacaaatcacacaagaaaatctctaacacaactcactagatcacatagcgtagcatatagaggacg

SEQ ID NO: 13954 - DNA, 1175 bp, Zea mays
tttgcattgctttgtgctgctggcttctttggttatatgcttgggatgctccaacgccggcttttaggaatgtcatcaacaacagatgatcctcaagcgcctccaagacccagcattgcaagtatccctccatcataccagaagcctttaaatccttatattcgtcatccattcatcccgagagaagaaactgcaaaacaggaaaccgaagaggggttcttcaccacagctggcaaactcatgggaggggcaaaatcatctgtgggtgagatatttggtttcaagaagaagcgcctgagcagcccataccatcatcagcagcagcagcagcgaagagctaacccgtggccagtgcaagaaagctatgccatgacacacgatgaaccacctccagcactggacacgagagcaccaaccccgcagaagaactacagcctcatgagaaaggagcccgagaagacccactacgtccgccatgggcacccgtatttcaatagctgggacggtcactgtcacccccagcagcagccggaccagcagctgtatcgccagcagcagcacctgcagcagcacaggcagtactctgcaggcccacagacattttacgagcagagctgcgagcctacaaaggagatcgtctttggcgcggtccaggaggtggacagcaagcggcgcatggtcgagatcaaggctgtgaactacggagacacattctatgagcggtacggaatgcggtaccgcaacaatttcatcggctacaacaacaataacaactactgaacagcctgcctatttcttcaacttttcctgcccgtctaggttagatttactggttgttgtttctttgtttgcaatcctccacattccctgtaacaaaaaaaaaagaaagaaagtgggggcagcagaagctatctcctgtttttgacttgtacaacggggaaaactgggttttggaagcacatcatgattgcatattccttagactttctgatgtgtatgtgttttactgacatatttcagactagtaggtacagcaataacttcttacattcctgcactcgtgcggttgagattccatgaaagtatatgccttcctgaccacctggtctggtctaccaaggtggataagaaataactagtagcatctgagagctgccaaacttgtcttgctgcag

SEQ ID NO: 13955 - DNA, 526 bp, Zea mays
  misc_feature (9)..(9): n is a, c, g, or t
taaatatgngaatttgtaagctttcttctcattttatcatatcaaacaattatttgtctttactctttgtattatggtgtgttctagaattttaaattatgataactagttattgaatcagttatgcctatattgtttatgcttaattatatgttatatatacaaataattacctatgtatgtcattagaaaaacttcagtctttaaaaataatcatcctagaattttttcgaatacccacactctaaatcctgggcccgtcactgccaggtcggcaggtccaaccgctgttcgcattctgctgctgttcgtattcacattctgctgctgttcgtatccaaaacacggtgcactgcgcagccagccagtgcgccagccaccttgcatatgcaatattgacgaatgctgctgaagctgaagtgctgatgctgtttttaatcatgctacagtagaatcgtccatcctgctcgcttgtctttctgagctgtgcatgcacaacgatttggggcttgggggggggggctta

SEQ ID NO: 13956 - DNA, 1205 bp, Zea mays
cgttttctcgtcatttagcatcaaagcaacgtctcaactaacctgctttttaaagttttgaaacaattattattaacgggccgtgcctacagatcgataataatgagtacaactaccaggcaaggtagacactgttactatacaagttacaagcaggaaaggcagacaggttaacaagaactcacatcatgcatggaagctaaggtaaagaggagtagataacctgagctaattaacactacgtgtaggtgcagtactgtcgcacgagaccattacctagaacatcctaatcaaaaaagtctatcgttgtccaatatataaaaggccaaataatcaagcacagcagcagccatacacagagcaagaaaagaatggacatggagaaggccctagccctagttctactggtatcagctgccatactcctaggcgcgcaccagccgacgagcgctcaggtgttctgccgctcgcagttcaacctggccaacgaggcgtgcagcatgcggaatttcatcccggggccgggggtgaggcgcgggggcctgccgcggcagcagcagctcaacgagacgacgtcgccgtcgacggccaccaccgccagcgctgtcagtcaggtgctgcagtcccggagcgacgacgacgacgacagccacggcgggaggcggtcccggcgccggcaccagcaccggcacagcgaggacggggagggcgaggacccgcgcgacacggcgtgctgccgcaggctcatgggcctcgacaactcgtgcgtctgccaggccaccgcgcgcctgccgcccttcatgatctccgtcaggcacgtcatcacgctcacgcccgtcgagggctgcgagatctccttcgagtgccctggcccgctcttctgagctagtcccacacaacgccgcccgccgtcgtgcagtgtctaacctcatctaaaggattgatgtggttattaataacttcggatttcgttgtgcgtattgttatgtttattattaatcatcaaatatataatacgtgtgataaaaaaaaaaaaaaaaaataaagccaagcagaataaatgggatttgcaagactgttgtgttgtggacaaacatctaggggtgtttggtttaaataatcaatccattttagatgatgtgatgcatcatgagttaattctacaaatttagtggaataaactcgttcctcgtactattacaaat

SEQ ID NO: 13957 - DNA, 1905 bp, Zea mays
  misc_feature (21)..(21): n is a, c, g, or t
agcgacgcccatggaggcggnggcggagctggcgctgcgcctccgggcggccgccaacgaccgcctcgctcgctacgagccgctggcgctcgtcgccgcgccgctcctggcgctcctcgtcgcgcggaccctccacgccacggccagcgccgtcgccgaccgggggctcgtcgccatcgccatcgccgccgtcaagttgctgccgggagtctccggctacatcgcggcggagaagaagaaggttgttgacaagatgcaatcaggtggggccaagaacaatcggcgagctgagttgccaactattggccttgccgagcaagtgatagaggaacttgaaacactgaaagccaaagatgtagactggcagggaaaatgctctggcacagtatatattgctggaagtgagtctgagggtcattttcaattgataaacaaggcgtactctatgttttcacacaccaatccgctccatcaagatgtatttaagagcgtagcaaacatggaagctgaagtcgttgcaatgacagcggctttacttggcagcaaagaaaaatcatctggtggacaaatttgcggcaacatgacatcaggtggaactgaaagcatattattagcagtcaaaacatcacgtgactatatgcgatcaaagaaaggaattacaaggcctgaaatgataattgctgaatcagcacattctgcatatgacaaagctgctcaatacttcaatattaaagtgcggcgtgtacctgtgaacaaagagtttcttgcagatgtgaaaggattcaaacgatgcataaatggaaacaccataatgatggttggatctgcaccaggatttccgcatggtttaattgatcctattgaggaacttggggaactggcttcgcgctatgacatttgcttgcatgttgatttatgccttggtggctttgtgctgccttttgctcataagcttgggtaccctattcctccctttgatttttctgtcaagggtgttacatccatctcatctgatgttcataagtacggattagcaccaaaaggcacaagcattgtcctgtacagaaatcatgaaattagaaagcatcagtttgttgctgttactgagtggaccggtggcctttacgtttctcccacaattgctggaagcaggccaggtggattgatagcgggagcttgggctgctatgatgtctctcggactgaacggctacttggacagtacaagccgtatcatggatgtttcaaagaaaatacaaagagggattggagagatcccagggttgtttgtgatagggaaaccggatatgaccgttgtggcgttcggctcagacgttgtcgacatatttgaggtgaacgacataatgtcatcaaaaggttggcatctcaatgctctgcagagacctaacagcttgcatatctgtgtgacccttcaacacacgactgtttacgaccaattcctgaaggatctgcaagactctgtcaacactgtgaaagcaaacccaggcccgattagcggcggaaaggctcctatctacggcgccgcagggaagatgccggacagaggcacggtgagggagctgctcgtggagttcatggacagctcttgctgaattcattatggcttgtgagaagaatttgttcttgtacatgaaacttctatttctttttcaactgaaaaggcagagctcctaccatttgtttcaaaaaaaaaacattatggcttgtgaaaaacagtcgcagggctgtgatttgttggcctaggtatacaaagttgtcattaggaaaagcggggaaagtcattgaggcgatacaaccacatgtattcacgattacaagaagtttgtccgtatgattgtatatcaatatcacagcatgcatatgcaatgtgtctggttatagtttt

SEQ ID NO: 13958 - DNA, 2442 bp, Zea mays
gatgaatggacatcttgagatcaacagtgcaaatcttgctcgcgtcttaagagagttttcacctgaggaagttacagcaaatatctatacagtggttgatgtgcttctgcatcatatccaatgcgaggtgcaaagggggcatctagcacaggatttactatccaaagcaatcacaaatctttctttttttatatggacacatgaactccttccgctggatattctattgctagctcttattgacagggatgatgatccttatgctttacgccttgtgataagtctgcttgaaaaaccagaacttcagcaaagagtccagaatttctgtaatactcgttctccagagcattggctgaaaaatcaacatccaaaaagagctgagctccagaaagctcttggcaccctccgggcctgccgggaccgctatccacccttcttcgatgacattgctgcacgtctgcttcctgttattccactgattatttataggcttattgagaatgatgcaactgacattgcagacagagttcttgcattctattcttccttgcttgccttccacccgctaagatttacatttgtacgtgatattcttgcgtatttctatggtcatcttccaatcaaactaattggtaggatcctcaacctgctgggtgttagcactaagacccccttttcagaatcttttgctaaatatttagtgtcatcaaattcttcaatatgtccaccaccagaatactttgccaacctgttgctaaacctcgttaataatgttatacctcctttaagtagcaaatcgaaatcaaacccagcagacacaacacgctcgactttcaacaaacatcatgcatcttcacaacctggtggagttggtaacaccgatggccagagggcattttatcagaatcaggatcctgggtcgtatacacagcttgttttggaaacagcagctattgagattctctcacttcctgtgcctgctgctcaaatagtgtcctctttggtccaaataatagcacatgtacaagcaatacttatacagtcaaatagtggccaaggaatgtcaggtggtttggggcaaagttctgggctgccaacttctccttcaggggctgctgaatcctcaggtcccaaccaagcgaacagtgctgcaactggcatcaatgccactaactttgtttctaggagtggttactcctgccaacaattgtctgttttgatgattcaagcatgtggtcttctgttggcacaactcccaccagaattccacatgcaactatactcagaagcagctcgagtcataaaagactgctggtggcttgctgatggttccaggcctgttaaagagcttgactctgctgttggatatgcactgttggatcctacatgggcttcccaagacaatacatcaacagccataggtaacattgttgcccttctgcattccttttttagcaatcttccacaagagtggctggaatctactcatactgtcatcaaacaccttcggccagtcaattcagttgccatgttaagaatcgccttccgcatattgggtcccttgttacctcgtctagcctttgctcgacctttgttcatgaagaccttggctttactcttcaatgttttgggtgacgtgtttggtaagaaccctcaggtctcaaatccaaatcctgtggaggcgtcagaaattgcagacataattgacttcttgcatcatgcggtgatgtatgagggccaaggcggtcctgttcagagcacgagcaaacccaagctggagatactgacattatgcgggaaagtaatagagattttgaggccagacgtgcaacatcttctctcccacctcaagattgaccccacctcttcaatctatgctgcaacgcatccaaagctcgttcaaaacccatcctaataatgttatagcttacaagtgtattctaatgatgcaagatgcttcgaaccactgcagaagtctcaacatgtgatgctgttggatgagtagaattgcagtaactgtaacatgtgattcaggggcgtattctcaagtgattcgccgttgtcagttgtatcctttagttagaatgttgtaaatgctatctgcttagtgcatattaggacataactacatagtgtaagcagtaaccatggaggttatcttgccaggctaagaattttggctgccttgcctgtgagccatgcgacatatgtatcctgtcgcattaggatgagcgacaaccgacacggtcgcatgatgcaagatttgtgccggttggccgattgtcaccgtgcagatctcttcgtaacagtgctgcacgtggaaggtttgaccgagtgactgcatcaccagttaatagtgtaaactgtatcaaattcttgatcatcttgcttattatgaaatgcctacgttgtgtcaaaaaaaaaaaaaaaaaaaaaaaaaaa

SEQ ID NO: 13959 - DNA, 2900 bp, Zea mays
aattcggcacgaggctccaatcccggcacccacccttagctcccggacgggcggttcagaacacaaaatcaacggaccaccggaacaggaagcaacagcagcggggcgcgggtgccgtacccttcactcattccgcccctgaaagtgaaacgtacccagatctacaagctactccactcgacttccataaataccactcctgcgattccacccggcagttggaccggccgttgttgctttgcgtcttcgccaaaaacagaataagcctgtcttgctccgatcaggcgtgttcttaggcttcgctgcccctaccgcgtcttcgccgggatcggtccatggccggcgccgagcgcgcggaggcggtcgcgctggaacaagggctcctcgatccggaggaatccaaccaagtagtatacactggagatggatcagtcgacttttctggaaatcctgttgtcaaggaaagaacgggtagatggaaggcatgtccattcatattaggtaatgaatgctgtgaacgactggcctactatggcatctccacaaaccttgttacttacttgacaaaaaaactgcatgctggcaatgcctctgctgctagcagtgtgactacatggtcgggaacttgctacttaactccacttattggagcaatcctggctgatgcatactgggggaggtactggacaatcgcaacattttccacagtatacttcatcgggatgacactgctgactctttcagcatcagttcctatgctcatgcctccatcttgtgaaggatccttttgcccagcagcaagcccttttcagtatactgtcttttttcttggtctttatctgattgccctgggtactggtggaattaagccgtgtgtctcatcctttggagcggatcaatttgatgatacagatccagctgagcgaatccagaagggctctttcttcaattggttttatttttcaataaacattggtgctctcatatcaagcagctttctggtttgggtgcaagacaatgtaggatggggactggggtttggcattccgactgtattcatggggctggcaatcataagcttcttctctggtacatcactttataggttccaaaaaccaggaggtagtccaattacacgagtatgtcaggtgattgttgcctctttgcgcaagtggaatgtgcctgtcccagaggatagctctctcttgtatgagctacctaatggggtatcaacaattgaggggagtcggcaaatagagcacacagatgaactcagatgtttagataaggctgctacagttaccgaagttgatgtgaaaacggctgacttcaacaacccatggcggatatgcactgtcacccaggtggaagaactgaagatactagtaaggatgttccctgtctgggcaacaacaatagtgttttctgctgtatatgctcagatgtcaacaatgtttgtggaacaagggatggtgcttgacccatccttgggctctttcaagatccctccagcttcactatctactttcgacaccctaagtgtcatcatatgtgtcccgatgtatgattacatcgtggttccgatagccaggagattcactggcaacgagaggggctttacagagttgcagaggatgggtattggcctggtaatttccatcatggctatgtcagtcgccgcagtcctcgaaatcaagcggctagcagttgccagggaagcacacctggtggatcagaatgtcccggtcccactgagcatattctggcaaatccctcagtatttcctgattggtctagcggagattttcacattcattggggcgctcgagttcttctatgaccagtcaccagacgccatgaggagcctctgcagcgcgcttaatcttctcactactgcgtttgggaactatctcagcacgttcattttgacaatggttgcgtactttactacgaggggaggtaaccctgggtggattcctgacaacttgaacgaaggccatcttgattacttcttcttgctcatcgctggcatcagttttctgaacctgattgtttatgtcctctgtgctggcaaatacaagagcaagaaggcagcttgagttgtgaaggccaggggctggatggcgtgctgcgcgccatgttatggtggacacttcagttcaaaatctgtatatatgtttcccgcattaaccaccctagctgaagcaaccatctgcaattgttgcaaagtttatattcttcattgtgctggactaagttgattatacattcgtgcttctactttgtgtatgtatatatctgacctaaagttgctgaacatagacaatttcacttgcctctggtatccaaaaaaataattgtcttttaacctagatatgtgaggtcacgttttaacttttgtacgtagagtaaagcatcaatgtgctggttgaacaccaggagggcttggggcgtagttatggagtgtttggttggacgtggatggaaggggtggtcacatttctagtgttcggttacgcggggggcgggataaacgctttattcactttaatctcaaacaaacacattcttacttttccgtacatattacatggtagcccattctgacattctctgatggcacgtcgtgagttgagagttgactggttttggtttggttaaattcgctatcagaacgcgtaattggctgccgccttgtttgttatggtttcactacggaaagatgattactggaagctgacggaacgtgcaggctaattggcagtagtaatacatgagcgaatgtaggttcgttccaaccttccaggacagtcaactctccgcacgttgatccctgttgccctcatgcctgctacatcagcaaccggaccgcaatgagatcctctgcaccctgcaggtcg

SEQ ID NO: 13960 - DNA, 3681 bp, Zea mays
ttcggtgaatcagcaaacagtgtacaataatagctagttgaatattctaattggcgcattccgtaactgacatggcactagatagtccggtgaatcaccggacaacgcccacgtcacctagccgttgacgcgctgacacccatcgggaaagagccgttggagaggctttccggtacacatcaaatagagtactatagatgtctggtgaagtattaaataatttaccgagataggggacataggttgaatgcccactggatagttcagtgcgccaccggacagtccgatgagtcctagacttaccaaactttggatcttttgagccaaacttctccaactcattttgactttccttgctagcttccctacgacttagaaaaacatagttaacacttaatctaattgactaagtgtaggaaacatacattttctccttggtttcaccagaatttgcaatatggcttgtttcaggtccaaaatgcgcttttcttgtataaatgaattagtagccaaaacaaagtgttaaaaacatatagtaaggtatgtgcaacttattgaaacacttaaacctcatgtttatgttgatgtgcctagagctgcacttttggccctacattttagctcatttggacttaatctcttcaacttgccttttaatgacttgtacacatgctcatatcaaaatagttagtccaatgtggtgtgttgagcacttaatcaccaaaatagatagaaatggccctatgacacaattccctttcaagggtccatccttaaactgcacatacgccgaataaaccctcgagcaatccacatgaattactcgggggctatatctagtagatgcacttgtacacacccgagaattcggtcctcaatgaaagcctgtgcacacctccaaaaagttgcacaaaggctcggggctgatgtcgggtactcgggaattgggtgcccaaagtaggcccaaggcctcttaacgacccacttgccgaccaagcctctaccagcaacccaacaaggcggagcggtcgactagctctctgtcgaccaacctagtgaggcagagtggtcgtctagctctctgtcaagcatccctgtgaggtggaacgatcaaccaactctccactgagcaaatcagcgaggtagaccaacccaccaactacctaccaagcaactcagcgaggcgaaggccgcaatcccgtattgttgacccacatcagccacgacgagacacgtcatcatcaaaccacgtccaggcatacgtgcgcataccaaaggggcgctaggatgtccatgtcgacacgacggaacgccactgtgtacggtctcaagcgtatccccactgccttgtggggtcagtcaatcccattcttggggaacctcagcgacggagtctccacaatgacctgcacacctagaaatgatgggacgatacactatatcgggtgtatgtctacgcacacaggatggtgacacaagtctcatgacaaaagacaaatccacaccacgcacgactttgaagcatactgtaaatccaccctgcgagacatgccatgcgctactatgtcaacatcggacttgctacatggacccgcatatcggacggatgaagcagtatgccataccgggagtacggctacgcatgaccctactagagatgtcagaaagactaacgtcactcgaggtcgagggcaacatgccacaccctcatcagtagagtacgagtccccactgtaaggtcctacccttgaactataaaagggcaggacccctccttcacacacacgcagctgtaacgcatccctcaagcaatactacgatccgcattgcattggactagggcgtaagcctgaatcagtataacctctgtgtcaaatcccctcctcgagtcccaacgattgaccattcgaaatgagtccacgttagcatcccaaccgaacataaattctattgtccccgatttatggaaccacgacaggtatatcgaaccgatggggagaggtatattgaactaaaaatagtttaaagaattatgatactatttcttttagcttatttccgccgtgataagttgatgcagactgtcaattcttagcttttcaacccgtttttttgtaagaatcgtttcagtgaaaatcgtccaaaatcaatctggacacaaaatcggtcgagtcgttacgataataggaatttgtcactctctatatcataaaccttatgaacatttttatctctctccgtacgtactacaactagattttcagaaaagcttctcgaataaaccccaaaacaaatagccctagtatcgtctattagagtaggcaaccactaatatgcaatcagtcattaagtgcaagcgtgcaagcaactcacttgatctgttggatctagattcaaccgtatgtgtaatcatggtttgttaggggcttttttataaagttacacgaggcgctggtaggaggaggcgatcgttaaatacatcatacggttagatctagatctaacggactaaaaaatttgcttgcacgtttgcaaataatgacgacttacctattagtcgttgttattagagtaatctggactttttcagaaaacaattgcatcttttagaactagtttgataactgcattttcgcaagggactctcctgtctccaaagaaaaattaactaatttactatagaaaataaaattctgttaaaaaatggggcaatgttaccgggataaaagatctcacccctccagagtcccgggataattcgcttcgatccccagaggcacagacgagacgacagagatgaaggacggaacgtcgtcggggggaggggcgttcgctgcgggcagcgatccaaggcagccgtcgacggcgaagccatacgcgccgccgaagctgtcgccccaggacctacccatcgactatgcaggcttcctcgccgtcgccttcggcgtcctcggcgtcatgctccgcgtacgtaaccatcccaacccctcagatctgagtttgattttcgagtaacgattagatctagacaagttaatggtagatctgcatgctacagcagtcccgtgtgagtgatctgttaccatatgagctattgatgatggtgttgtgcttgccttactgggctgctggctgtcgccccaggacctacccatcgactatgcaggcttcctcgccgtcgccttcggcgtcctcggcgtcatgctccgctacaaggtgtgctcgtggatcgcaatcatcttctgcgctcagtcgttggcaaacatgaagaactttgagaacgatctgaagcagctttctatggccttcatgtttgctgttatgggtctggtgacgaactattttggccccgctcgtccaggcagtacaaagcgctaaactgcggaagaacatgtgctacattcttcataggactttttggtgcttccgatagctttgccatcggtgctgacattatgtatgtccaatttgagcaaacgtcataggtatgggcatcaaattaatggaccggtacatgtatgatgctcaataatttatttgtgcaatactagtaaacgcatagactgtttgaacgagtacttggtttctccggatatgttgatcaatgttttctgggacttaaaaaaacggtctaaaaaatccaccccaaaatgccggtagatggactgacgttttggcttt

SEQ ID NO: 13961 - DNA, 847 bp, Zea mays
actcctataaagatctcacccctccagagtcccgggataattcgcttcgatccccagaggcacagacgagacgacagagatgaaggacggaacgtcgtcggggggaggggcgttcgctgcgggcagcgatccaaggcagccgtcgacggcgaagccatacgcgccgccgaagctgtcgccccaggacctacccatcgactatgcaggcttcctcgccgtcgccttcggcgtcctcggcgtcatgctccgctacaaggtgtgctcgtggatcgcaatcatcttctgcgctcagtcgttggcaaacatgaagaactttgagaacgatctgaagcagctttctatggccttcatgtttgctgttatgggtctggtgacgaactattttggccccgctcgtccaggcagtacaaagcgctaaactgcggaagaacatgtgctacattcttcataggactttttggtgcttccgatagctttgccatcggtgctgacattatgtatgtccaatttgagcaaacgtcataggtatgggcatcaaattaatggaccggtacatgtatgatgctcaataatttatttgtgcaatactagtaaacgcatagactgtttgaacgagtacttggtttctccggatatgttgatcaatgttttctggacttgatgcttcggtcttatcagtttaccccaaaatgccggtagatggactgacgttttggctttttaaaatatgttacttttattgtgtatctatatatagtttatgtttgggtaaaaaaaaaaaaaaaaaaaaaaaaaaaaaaaaaaaaaaaaaaaaaaaactcgagactagttctctctctcctcgtgc

SEQ ID NO: 13962 - DNA, 711 bp, Zea mays
cccgggaaaagctctggcccccgccgggccggccgggaattcgctttcgatccccacagaggcacagacgagacgacagagatgaaggacggaacgtcgtcggggggaggggcgttcgctgcgggcagcgatccaaggcagccgtcgacggcgaagccatacgcgccgccgaagctgtcgccccaggacctacccatcgactatgcaggcttcctcgccgtcgtcttcggcgtcctcggcgtcatgctccgctacaaggtgtgctcgtggatcgcaatcatcttctgcgctcagtcgttggcaaacatgaagaactttgagaacgatctgaagcagctttctatggccttcatgtttgctgttatgggtctggtgacgaactattttggccccgctcgtccaggcagtacaaagcgctaagctgtggaagaacaccatgcgcttcattcttcataggatatctagccgatctttttggtgcttccgatagctttggtgctgacattatgtatgtccgatttgagcaaacgtcataggtatggacatcaaattaatggaccggtacatgtatgatgctcaataatttatttgtgcaatactagtaaacgcatagactgtttgaacgagtacttggtttctccggatatgttgatcaatgttttctggacttgaaaaaaaaaaataaaaagaggacaccgaattttttttttt

SEQ ID NO: 13963 - DNA, 1441 bp, Zea mays
aacattgcgacgccgcgtcctccttggctccttgcctccgtgccgcatccgcaggccgtagcgtcgtgcccgtgtcctcccggactcccggtcctggcctccgcgccgcgtccgcgtccgcagtgccgcgctcgcgtcctcccggtcccggcctccgcgctgcatctgcagcgccgcctccactccaccggcaccgggtggtgggcatcgtgtcgccgtccgccgccacactcccgctccagaagcgggagctgtccgtcgcgtcttcatctaggactggaagtctgtgaaaccgccgaggacgacgacgccgcttccatctgccatcaccgccgaggacgccgctagcatcgtcaatctaacagccatttcatcttggtcatttgatgacatctctctgaaatcgacggagtcaacagatcaagatgacagaaccatcatcatcatattcattgccctctaaaaagcgacaacgctctcctgatgataatgaacattcactagacagaggtcgaatttgtttaagccttgatgataatcttacgttcaatgataccatgatagcacttcaattgatgcgcacacagtttccaaagctggataaggttttggcgcagccattcattttgcagtcacaattgtatagcagcgtgaaggatagaacacaagttgacagagacttggagtcatttaagaaagacaaagtgttacggatattcaaacttagttctgggcaagatgatcatgcaatcatgttcatggatgattatttgaaacaggtctcttttgctattaaacggtcaggtggtaaagaccaagatggtagtgaagtatttgagtggtttgagagatatgtggtcccttcaaaactggatgttagcataactcaactagagctgtgctcactgttatcacagggcggtgatgtaacagacaaacatatcacactattgatgaatgctggtctcttaactcgtcaacttattgatccaaatatttactggttttctattccaagaattggccccatattgaaaggcctatcccagggcaggaaggaaattctttcgctgttgaaccgtagaaagtacaaggagatgccgctttcttcactggagaatacaaagttaagattatcacctcttgatacgcggttcctccttcgcgatttgattggatctgggcacataaaaacagttcaaacgcccactggtttgcttgctcgcgtatcaagagattaatagagctctctgtcataatcctacttatctgtctgccttatctcttatctgatcatgaacgatttggtgattctagtttcgttttgcattttacctgttttcaaacagtattcaacatgaccccaactcgtcgatagtttttttttcattttaagagggtggttgggactccactctacgttttaaaaaaaaaaaaaaaa

SEQ ID NO: 13964 - DNA, 1017 bp, Zea mays
tattttggtttcggtgagaggcagacagacagcagcgagtacacggcacagtggctgaccaagtgggccgccctcccagcacacgagcctcgagtcgctcgccacgaacacacagaacagaacaaccacatccttcgtggaccgaacacaggcgttcttcaacctcggggctgcggagccgcctcttggcctcttcctgttcctgttcgttctagcctagtaggctactaggctggagcagaaactcctctctcggtaagcatgaaaccctacccaagtgccgtctgattgtaattgagcgagctttcttgagcgggtgcgtgagcaatcgaaccccctttctctgttccctccatcgccgcgtggaggagggcggtgctgattgattcttctccggacctcgattgtattgatttcctgctttctccgtcgctaccgtaccacccacgcaagcaaggaagcaaatcacccaataggatccgttactacttttagtagcgatttttctacttatatactcctcctgcctctatctttccttgcatcttcgtgagaatttggaaatcaggcttcaatccctagccgcacattgcgacgccgcgtcctccttgcctccgtgccgcatccgcaggccgtagcgtcgtgcccgtgtcctcccgactcccggtcccggcctccccgccgcgtccgcgtccgcagcgccgcgctcgcgtcctctcggtcccggcctccgcgctgcatctgcagcgccgcctccactccaccggcaccgggtggtgggcgtcgtgtcgccttccgccgccacacgcccgcgccagaagctggagctgtccgccgcgtcttcatctaggactggaagtctgtgaaaccgccgaggacgacgccgccgctgccatctgccatcaccgccgaggacggcaggacgccgctagcatcgtcaatctgccttgggacacggagcagaggaaggaagcttgaaatgcaggatagcagacgtaccaccacggcgatggggag

SEQ ID NO: 13965 - DNA, 908 bp, Zea mays
cattgggtccctcgaggccgcccggtgaagggtcaactgatcaagccaaagccgaacaccaccacaaggcagcagccgaacaccaaggcagcagccgccaccacttcattgcgcgaatcggagcccgtggccgtcgcctccgccctcgcgattcgccgccgttgcccacgagcgaggcttcctcctcttcgtcgccgccgtcgcaggaggggaaagaggataaactgccatggcgggcaggctcctcgcgaatctaatcgtcatgggcggaaccgtggttggcagggccatgctccaggcctaccgccaggccatcgtcaatgcaaacaaaactggagctgcccaagaagctataaatggtattagacgggctagcaaggccatgactgagcaagaagcccggcaaattcttggtatcagtgaaaattcgacgtgggaagagattgtccagaagtacgacacaatgtttgagaggaataacaaaaacggcagcttctatctccagtcaaaggttcatagagcgaaagaatgcctggaacctttatatcaaaagcctgatgtactgaactgagattttgcagacgccctagcttctgtttgaagcggtatgcctaattgatcgatttattagtgtgctcagagatcaacgttcagtttattgatcggtttgccaatgcgcccagagatcaacgttcagttttgagttatgtgttgggcgcatcaggttggttccttgtaatgccagaataatgtttaacaaacataccgaattttggctgattctcattggcaacgtctcagtcactggttttaattcatagtatgttaaaaaacactttgtcaaccaagcaacactttgaaactttttgtcgataataaatggttcggttcgttctcgagctcagctt

SEQ ID NO: 13966 - DNA, 4520 bp, Zea mays
ggtgccggtcgcacagatctgagctacgacctgctcacctgcagggaacggtagtggcaccgccgcactggccgtacgcaagctggaacgcatggggagtgaaggaccgccgttcgtgaatgcaaacatgtggggagaattggggaatagggaagcagtacaggttagacggggttgccagattggggaggctagacaaacagccgagatgggccacaacgggaaattagactatctatggtctgtgaattggttctaaaccctagcgacccacttgttaggttacttaaacggatattcgagtatttggatatggatactgatttttcataccagttttataaatatctatggatatcaaatgctgctactcgtatctgtatccatgtacagactcgtatccgaaaccgtgtccaacagattttttatccgcgggtacaaaaataaatcacatccattgccaccggtacataggactaaccaatgtttccagctgtagacataactatatatcaaaaaagaaacccttttatacacttaacaaatagggggggactttgctttaatttctttttgtaaaggttcaatcaagtatacaagaaatcaatctggtttggtgaaaaaagaagcagataaagaaaaaccttaaatctacctcttgtcgaatctgcatgcgctccagcaacttgatcacatccagaccgaccttgtacgcgtacaccttgcactccacaagacctaccatggtggatgcgatggcgatctgttgcccagcttcgcgggttgccgcacgacgaacttgcccatgtaccatgtgtttccttgaagagcgtcgtcaagcgagcaacaatggcagcctcaccgctagcaaagatgctgagggtggaattgcaaactcggtcaccggctcaccgccagggataaccgaggagcgcgacagcagtggctatcccgctggcggtggtgagggtgggatctgatttttacaagagtcaagagctaaagaggcaaacaacaaccacccagccccatgccacacgtggtggacccaaatacccaacgatgcaggccttgccgcgtcgtgtgcctagcgctaatacatttaagtttaatttaattgacttcatgaaattagaaaaaagaaaaaactaaaacatagaccgccagtccccaaatccgccacaattctggatggctcggtcgtgagccaatcatggtgttgtctaataatatactacctccattcataaacatatgcatcattaaacttttttaaaaactttgacaactaatcttattcaaaatacttattcaaaaaatgtaaaattttaagttaagcacagactactttaaatgataaaacaaaccaaaaaacaaataataactcattattttttaaaataagacgagtggttaaagttcttttttttaaaaaaatcaacggtatcatatatctataaacggagggagtagtaatactctatatagtcacaacttaagcgtaataaaaagttaatgctaatagagtgtagcttgcctttttctaattatttcttttatggatagaacaatccgcaaaagtttaagctttatacagtaacaaaggatattatcatacaaaaaaattgaagcttttttgtcattataattatttatcaattttgatagcttatatagtgccgaagaatcccaagttgacgcagctctttcagaagaggaggagggttcacagcatagcttgcctttttctaattatttcttttttggatggaacaatccgcagaagtttaagctttatacagtaacagaggatattatcatacaaaaaattgaagcttttttgtcattataattatttatcaattttgatagcttatataatgccaaagaatcccaagttgacgcagctctttcagaaggggagttcaagttctacacatactcatgcaaaattactgcaattacaatacaacttttggaaaacattttgtacctactgttagatgatatgtgtattcagttcttatcccgtagaagtcgtgtgctgttagtagattagttgcaggatatcttgttgtaaccctagatctctgctttaatctcggcatggttgtttcacggatgcatcctgtaagccacggtgggggctattcccatcctatattaacacgcacagcggcctctacggaggttcaacgcttccacctaatctcatatggtaccagagccaactgcctctagattacatctataatggcgacctccaactcttcccttggtcaggccattgtctcaccatttgttcttcccgtcaccgagaagctatccaacaataatcttggtctatggaagctccaggtgctgccggccattcgaggtgccctgatggaggggttccttgatgggtctactgcggcaccatcaaaggagatcgacgtcaagcacggcgacaagaccgtcaaggaggtcaacccggagtatgcctcatgggtggcccgcgatcagcaggtgttgagctatctgctcagcaacatgaccagagacgtcatggcacaagtcgccatggcaaaaacagctgccgaattatgggcagcggtggaggagatctattcctcccaaagccgagtgcgttcggtgaacacccgcatcgcgctcgccacgacaaagaaggggaactccactgcctcggagtaccttgccaaggtgaagtcatatgctgatgagatgagggacgccgggagacctctcggcgacgacgagttcacatcatacatcttgacgggaccggatcaggaggagtataatcctcttgtctcggctgtcctcaccaggatcgagccgatctcctacaccgagctggtcacccggatcaccagcttcgaagcccggttggagatgcaacgtggtggcggtggatctcagtcctctgtcaactcagcctcgcgtgcacgaggtggcttcaacagaggaggcgaccgtggtggctgcaatagtggtcgtggttgtggctatggcactggaggccggggtcgtggcaacggcaatggtggacaaaagcaaaggtacaatggcaggcgtcaagtctgcctcatggagggacacagtgcggtcaactgttggcatcgcttcgaccaagactatgtccccgatgaaaggaacatcaatgctgccaccaactcctatggcatcgacacgaattggtaataccgataccggtgccactgatcacgtgacgggcgagcttgagaagctttccacccacgacaagtacactggaacagatcaaatccgcactgctagcggatcaggtatgaacattaaccatatcggtcatgctattgttcgtacccctactcgcaatttgcatctaaataatgttcttcacgttccacaagccaagaaaaatcttgtttccgttcatcgtcttgccaaagacaataatgcttttattgaatttcatcctgattcattctttatcaaggatcaggcaacgaggagaactcttttggaaggcaaatgtagatctggtctctaccccttaccgaagccaagcaaagacgccttcagtgctgtcaaagcctctaccacgagatggcacagtcggctgggtcaccctgctttttccatagtccagcgtgtcattagtgaaaataagctgccttgtgctagggaggttcatcaacactccatttgcaacgcttgtcagcaagctgagagtcaccagcttccctaccccaagtcatccagcacctctaaatttcccttagatttaatattttctgatgtatggggacctgcttctacttcggttgggcgaaataaattttatgtgagctttattgatgattatagcaagtttaccttgatctacttactcaagcataagtctgatgtttttcaatgctttaatgacttccaaaatcttgttgaacgtctgtttaatagaaaaattgttgctatgcaaacggattggggaggagaatatgagaagctcaattctttcttccagagggtcggcatcactcatttagtgtcttgccctcatgctcaccagcagaatggagcagcagaacgtaagcatcgacacattgttgaagttggcttatctctattatctcatgcatccgtacctcttaaattttgggatgaagctttccttgctgctacatatcttattaatcacactcccagtaaggtgattgattttcaaacacctcttgagcgtctattccatgagaaacccgactactctatactgaaagtttacgggtgtgcatgttggccgaatttgcgtccctataattctagaaagctagcctttcgctccaaacgttgtgcatttcttggatacaacaatcttcacaaaggattcaaatgccttgatatctctaccggacgcgtttacatctctcgagatgttgtctttgatgaagaagttttccctttctctgagcttcatgacaatgctggtgcaattcttcataaagaaataagcctccttccacctgatttacttagtc

SEQ ID NO: 13967 - DNA, 2910 bp, Zea mays
  misc_feature (2875)..(2875): n is a, c, g, or t
  misc_feature (2877)..(2877): n is a, c, g, or t
tgcatgtagattttccattaccttctgtgttttaattatgaacaaaagtcagtacaataacaaggatagtttccatttgaaatagctaaatataatcatgtgacattcatcattcgctcagttctttttttttcacgaaagccaaaacaccgaatttcatatccttgcctttttcttctcaaaatgtatctccgtattccctttaccagtacaaaaaagtatatagaatcaacgacttgacacaagccagtggcttagctccttgcctttttcttctcaaaatgtatctccgtattccctttaccagtacataaaaaatatagaatcaacgacttgacacaagccactgttggagtggcttagcattaatcttctccatttcatgggtggatttggagtggataagaggttgttcttcttaatccatcagcttgaccggtttattttccatctacgtacccttcttcctcctactagtactttttcactgtttctgtcaatttcccatcttttgtggtcggtgatcatggttagactgtacgaagtctcctttaagctcaagattcaactcaacaatctcttcatcgatcttgtgtgcctcaggattagatctctcttgtcatcaatatcacccattgaatatctctacagtacatctcctttaagctgaagattcaactcaacaatgtctccatcgatcttgtgtgcctcaggagtgagatctctcttgtcatcaatatcacccattgaagatatcttggtaaacaagaatacaaatgtagacactgcgatgcaattttctggttcaatgaacgcaataaatccatgacgaggcacaataatcaggaaccaatatattcaaactgctgcaaaaatggcaaaatcagaataccaaaatataaagaacccccaacttttcttaatgaattaatacaccagaaaatggatacaagatgtaaacattttctacaaaagataagacaatataatagcatgtttgcatttacttccatggggggaaatattgataaaaaaattaatgatggtgagggaccatatgtgtttcgtgtcaatggccaaatacatcatcgaataggatcattactacctttaccagacaattgccctaaatttgcagaactatatatttttgatacaaagaatgaaattagtaatagaattagggctctaacaaatgaagaaccaggtgagcaagacatagatccagaaatagtgagagggctaaaaaaaatgctcgacgaatataatccattagtaaaaatattccgccaagctcgtgattttctcgaagaacacaaaggcatagatgtaagcattagaatagtaggcgctgacaaaactgatagaattcaatatgagatgccacatcaggaagaattagctatgctgattgtaggtgatttatcacttgagaactacaaacgagacatcattgttagcacacaccaaaatagccttcaaaggatatctattttccatccagcatatatgcctctacaatacccgctcctatttccatatggcgaacgaggctttcaactaggtattaaataccatggacaacacattagtcaaaacagagatgactccaaaagagatagagtaactttgcatgaatttttgaaatatcatgtgcactatagacctaatcagcctaatccctggttatgttatggccgattatcaaaacaagtagtagtagacggtcgagcaatggaggatgaagacaggcttgattatattgttagaaatcaatcaaaattacgagctgaatatgtacaaggtatttttgatgcagtagaaaaaggaatatatgacgccagtcgaataggcaaaaaggtgttattaccatctagccatgttggatcaaaacggtatatgatacaaaattaccatgatggcattgctatttgttgtgcctatgggccaccagatctttttattacatgcacttgtaaccctaaatggcctgagataacaacatgtttattactaggtgagcatccaaatgatagacctgatattattgttcgtgttttccacatgaaactacaacaacttttggatgacttacaatcaggaaaggtatttggcctcgtactggcacttctatattctatagaattccaaaaacgaggtctaccacatgtgcacacattaatttggttagacaagaaaggttgtgaaataactacagaaacaatagattcgtggatatctgctgaaataccagatcctgagttagatcctttgggatatgctcttgttgctgaacatatgatgcatggaccgtgcggagataaaaattggaattgtccatgcatgaaaaaaggcaaatgctccaaattttaccccaaagattttgaagaaaacactacattctctgaaaatggctttacaatatatcgaaggaggaacaatgggattttcatcagaagagaacaacacaacttagacaacaaatgggttgtgccacataatttaaaactattaaaaagataccaagctcatataaatgttgaatatgtaaacaagagtacagtcttgaaatatttatgcaaatatgtaaacaaaggacctgatagagcaaaggttatattcaaaaaatccaaaaaggagaagaatcacatgtaaacaaagaagcagaaactatagatgagatacaagaatatctagactgcagatatatatgcgagcaagatgctctttggagattattaggatacgagatacattaccattggccacctgtagaaagactgtcagttcatctaccattgatgaatataattaagatgaaatcaaatgataaattggaagacatagctaaagatccaaagtatagaaaaacaanantaactgaatggtttaatgcaaataagcaatatg

SEQ ID NO: 13968 - DNA, 1296 bp, Zea mays
ctgcaggtaccggtccggaattaattcccgggtcgacgagctcactagtcggcggccgcccttttttttttttttttgaatcaaagctttagcaaaacattggcatgtagattttccattgccttctgtgtttttattatgaacaaaagccagtacaataacaaagttggtttccatttgaaatagctaaatatattcatgtgacattcatcacctgttcatttctaattttttatcaatgaaagacaaaacacctccatatcattgcctttttcttctcgagatgtatctctgcattccctttgccagtatagagacaacaacgactagacccaaccttttttcttgaagtggcttagcattaatcttctccatttcatggatggatttatagtagttaagagacttcttcttattcaatcagcttgaccggtttcctttccatctagcacacccttcttcatgttcactgtttatgtccatttcccatcttttgtgatcgatcatcatatttaaactgtacaaagtctgcttcaagctcaagattagattcaacaatctcttcatcaagcttatgtggctcaagagtgatatcccttatatatcgtcatcaatatcatccattgaagatctttgcagcatgaaattgtgtcttaatagtgaaagactgaagaaaatgcctttaactctaaaaaagatagataatgaggaaaatcaatatgacaatagctcttaaaagtgacctttaatcaataatggcagactatgagaaagtataaaaataaaagttggaacgaaagcatcaaatttttaaacaagaagtagaatattgggtgcaatccaaccaatgtataacgaatatttgcatatagcctacataatctaaatgacgagataagcttgatgttgtagagcggggtaccttatgaatgacgagataatccttgatgttgtagagcgaggtacctgggctctacatatgctcaaatatgtaccctctcttctatttcaaaacacctctcactacaggaaacgcctaaattttcgtggaccaaaaacccacgaaaataagcctaaaccgacgaaaatagaatattttcgtcggcaggccgacgaaaatagccgccgaaaataaattcgacgaaattaggcaactattttcgtcggtcccgacgaaaatattgctattttcgtcggctttcccaaggccgacgaaaatagtgagtggaccaactattttcgtcggccacaccgaggccgacgaaaattgatgttcccccccaaaaacagatttaa

SEQ ID NO: 13969 - DNA, 3266 bp, Zea mays
  misc_feature (1780)..(1780): n is a, c, g, or t
tttttttttttttttttttgaacagaataactgatgctcgtgccgttttttttttttttttttaaccatgggaaagaaaaggcactgaatcgagaaacagaatgctccacatatacaacaagttcatttttcacttctgcccgagcctgaaatcacgtctcaagtagtcatgcaccgtggcctgcttgctacccacacagggccataggtacacaaaaactacaagtattaaggcaatatagacgagggacaactctagagacctatggctcaacagtcgtcacttgctgccattcgccgtccacagcttccttccacagggtcacattgttgttgccgtcagacaccgccagtatattcccagtcagtgaccacgacagcctccacacaggggtcctgaaatcatacagcaaccggccttcccactgctcgccttcttttgctgctgtccagataacaactgttccatcctgagaggcgctggcgatggtggactttggaaggcccaggtttggcgcccacgcgacgtctctcacccagtccttgtgcatctgtagggcggggaaacagtccatccgccaactgccgttgttgagcttccacaccttcaccgtgttgtcacagccaccggaagcgagtttctgaacatactcaaactgaccagaagaccccgcgctgattagagctcccggtgccattgcaggagcccaagaaactgaggtcacaccaaccggatgcgcctgatcaatacgcgtggtatcccaacctccatcagaacgagcagtgaagactgaaatgttcccatctgatgaaccacaagccaagcatagacccagctcatgaggcgcccacgcgatggaattcacggaggacttgtgctcagcaaaggtgtgtaccagtgcccattcatcaggcttgcttccttccttccagatgatcactcggccgtcgtagctgcaggatgcaagcatggaaccaaacttgggatgagcccatgcgacttgccatactgggccctggtgtccactcaaagttgcaagctgctggtgtgaggttccacttacgccaatgatctttattgtattatcagaggaggatgtagctaggcgcttgccatagtaatccatggcgacatcatgcaccacatcttggtgccccgtctcgatcttatggggcggcattgctccaatgatctaactttaacttagcaaaatgacaaccttcttccgcgttcaccacttcagtctcctatacgaataaaaagtgaggatatcagatagatgataaatcaaaaaataacataagtacaaaaggtatgcacacttagtagctaaaaatgttaccgagatatacatcatatattcatatgaagttatacagaacactgatggtctacacaataccatgcgtgcgtggacgtgtgtggatgttttccacaatgggccaagttcatcgttcgccagattgcatgctaaaacacaggacgatttgattgaggatacacctctgaacaataaatttcatctaaaattagcttaccaagctccagatactgggcaatggtatatctatcacaggatcaggaaaataacgccaacccaccagttagcaatgttccagaatggcgacggggcattatttttggaagagaagtaggaaaacatagtccagcattatacacataaaatgcagtacatctggcaagataatgtcttttgcacttgtttgaaattttcaaaccatgcctattcgtaaccaaaccctgaaatagacccaaaantagcttaaagagctgagacaacagaggtttgaagcaaaaatatatgcagacagtgatgtcactaataaatactaatctcacgaagataactcatcttcgtaactttatgatgctacaatagaagactggatcgtttaggtttttttttgtgaaccgaagacggcaaaagcatacttgttttgcagaaacatccagcacgaatcaatacaagtgtagaacacactgggacttggttttgagaaggaaaaaaaacaatatttgcatctatcttcaaccaacctagcagcatacatttgcagcagaagggtgtagaaccaaataccacaacctaaataagtagctgcagtccctcctctgcctcactgaaaaaatctgtagctgcactccctcctctgcgtcactgctagacttgggtatgctcagaaatccgaatcgacgaacacgagcgctagcgaacacgtcccggtgccagacacccaaaacagaaagggtcgaagggttggatctgcgagatccctataatatgctgcctatacgaaactaataaaagcgttttcccaaaaaaatccgtccctacggtgaacaggccgccccgtaggacttgcggcccgacctaggctaggctggctgggcgtggtaccacagatgaaacgaccaaccgattccacgcgggtcaggaccaaatcgatcgctgggtacacccgaggaggtggggaggaagaagattgagccgagagttcttgccttacccgcggacgatgaggagccgacgccggcgccggcgtccagggacagggaggaggaggaggggattgctgccgctggcggcggaagccggaaccggaatgggaattggcgaggactggacggcgcggccctcaggacgcgtgctgggcctatacggccttttgggtgatactggtaccgggcttgggacgctttaaccggttgcagatcgcggccgaaatggcccaacgaggaatgcagttgggctaggcccactgtttgtttgtcgttgccgtgatatcaggccacggagagagtcggagaaggtggtccagccagcgttcggctccctctccattgccgcttgcatgcatcgtccgtcccccgcgcgcacggcctggcctggcctggtcgaattggagcggccggcggcgggtgctgacgtcttcttctccgcttcctgtgggctcgtagtcgtagccggtggcggtgctgcattggattggatctgaagcaacaagcaaacgcacaacgcagcaaccatggtgatgatgacggcaccgtgcgtgacgtagcctgacgccaccaaatattccctagcacatgtttccagagagggagccttcttctccaggccaaaaaggcaaaagccactgtctcggcttctctgccaaaaacgccctcgatcatcccaacatcacgcgcactactgctgataacactgaaacgtcagcattactacccgggccaaaggcgattc

SEQ ID NO: 13970 - DNA, 930 bp, Zea mays
  misc_feature (48)..(48): n is a, c, g, or t
cccagcgtccgccccgcgtccgtgggaaaacagctcgccgccactagnaaatctcgtctccccagccggcccggccgggaggccgtgccgtcacgagactcctagcgaccgagagagagagagagagcgcgcacgcgcgtggtggaagagacttcgttctagagctcccgcgaggatggagcgcggcagttcctggcgactcccggcggtggtcgtcggcatccttgtctgcgcggccctcttctcgccgcccgccgccgcgctcaacatcggcatccagtccgccggcgacggggtgagcaagcagcaggcgtgcagccgcacgtgcgagtcggaccactgcacgacgccgccgttcctgcggtacggcaagtactgcggcatcctgtacagcggctgccccggcgagccgccgtgcgacgcgctggacgcctgctgcatgcaccacgacaactgcgtccaggcaaagatggactacctgagcacggcttgcaacgaggccctgctggactgcctggccaggctgcgggagggcacgtccacgttcaacgggaacaagtgcatgatcgacgaggtcatcgacgtgatctcgctcgtcatagaggccgccgtcgtcgccggcagggtactgcacaagccgtagccgcgccgcgcgcagggacatgtgaacagcagcctgcggttggtgggcgatacatctttttcgtgcttggtttagggcgtcctttccggctggccggggcccgggctctgcgtcggctcacatggcggcatgtgtgctactagctggcgagctcccaggctcccaacccggccaaaactgacgacaaggtatatggagattattaaagatatagcttgtttggttttgaacaaaaaaaaaaaaaaaaactgtattaccgtacaaaataagtataagaaagtttcctc

SEQ ID NO: 13971 - DNA, 726 bp, Zea mays
tgtgcggtcgctcgaggacggccgtttccaatcttcctccctccctcatttctgtccacctcctggcctggccagccactgccgcaagcccgcaccgcaactgcagttgagtgagaccagttcgccgcccctagataatctctcctctccagggacggcaggccgtgccgtgccgtcacgacagaccagaccagagagagctagtgcgtgccaacgcgcggtgggaggacgatggagcgcggcagttcctggcggctcacggtggtcgctggcacccttgtctgcgcgtccctcttctcgccgcccgccgccgcgctcaacgtcggcgtccagtacgccggcgacgacgcgagcaagcagcaggcgtgcagccgcacgtgcgagtcggaccactgcacgacgccgccgttcctgcggtacggcaagtactgcggcatcatgtacagcggctgccccggcgagccgccgtgcgacgcgctggacgcctgctgcatgcaccacgacaactgcgtccaggcaaagatggactacctgagcacggcctgcaacgaggcgctgctggactgcctggccaagctgcgggagggcacgtccacgttcgaggggaacaggtgcatgatcgaccaggtcatcgacgtgatctcgctcgtcatagaggccgccgtcgtcgccggcagggtgctgcacaagccctagccgcacgcgccggggcgcccggcgtggtgg

SEQ ID NO: 13972 - DNA, 2221 bp, Zea mays
tcggtacccctggcgcgaggtcagtggtggacgggtgcggcgcggcattgacgccgccgacgcgggtacataccatgccaccgcaatcattgaccctcacccccacacggacacggtgggttgcatggggaattggatccgtggaaggaagaggaaggcgtggcccggcttgctccacgcgaaaatgttgtccgatcgctcgctccgatgctgctgggagccttggggacgggctgtgtggggtgcacagtgcactgcaggtgcaggggtgggtgggtgttgttggaaactgctcgttttcattggacaagattttggctgagtagttgcactatttattcgcacgtgtacggaacggtcgttttcttttttgggcgccaactaaacttgcggttctccgtaagccgatatcatgtcatgacacagtgtagtacctgatttgagcttcggtctgcttccgaaaggccgtctgggccgagcacgcgatgtagtacctgatttcagattcagggaatggtggctgaagctctgtggatatacatcaagctcgtccacatgtgggataaaatgcaccatgtaggatagcaagtctacgccaacaccatccccctgttgtggccctagcacctcagtgaacaacgaattaaacatgggaacgaaaaggcactgaataaacagaatggactgtataacaagttaattgttcacttttgcccgagcctgaaaccatgtctcgtgcactgtgcctcgccaacagctgtgaaccacaaacagtcccacatgctacccacaggggcataactttaccttacacgaaaactacaattattatttagaaaatacaggcgaggaataactcgagaggacctatggctcaacagtcgtcacttgctgccattcgccatccacagcttccttccacagggtcacattgttgttgccgtcggaaaccgccagtatgttcccagtcagtgaccacgacagcctccaaacgggggttctgaaatcatacagcacccggccgtcccactgctcaccttcttttgctgctgtccagatgacgaccgttccgtcctgagaggcgctggcgatggtggactttggaaggcccaggtttggggcccacgcgacatctctcacccagtccttgtgcatctgtagggcagggaaacagtccatccgccaactcccattgttgagcttccacaccttaaccgtgttgtcgcagccaccagaagcgagtttctgaacatactcaaactggccagaagatcctgcgctgattagagctcctggtgccattgctggagcccaggaaactgaggtcacaccaaccggatgtgcctggtcgatacgtgtggtgtcccaacctccatcagaacgagcagcgaagactgaaatgttcccgtctgatgaaccacaagccaagcatagacccagctcatgaggcgcccatgcaatggagttcacggaggacttgtgctcagcaaaggtgtgtgctagtgcccattcatcaggcttgcttccttccttccagatgatcacccggccgtcgtagctgcaggatgcaagcatggaaccaaacttgggatgagcccatgcgacttgccatactgggccctggtgtccactcaaggttgcaagctgctggtgtgaggttccacttacgccaatgatctttattgtgttatcagaggaggctgtagctaggcgcttcccgtagtaatccatggcaatatcatggaccacatcttgatgcccagtctcaatcttatggggcggcattgttccaatgatccaactttaacttaacaatatggtaaccttctgtgtagaccacttccagtcagcggacggagcgggcgaggatgaggagaagccgcggcgtcgaggaggggagcgctgccgctgctgcagcggaacgaaactggcgacgactcgtgtcgttgtgtgccctagcctatgcgggctagctcctagtccctcagcccggcctaaaccgacgacaagatatatggagatcactccttaaagaaagcttctttggttttaagcaactcgtgtccctatcacactgtattaccgtacaagtataaagaaagtttcctcatgctggttttggtttcttggagaatccgtattcgacacactacagtccacacaactgtagcttacgctgttgcaaatgatgaataatacagagcgtgtacttcgattaagg

SEQ ID NO: 13973 - DNA, 1418 bp, Zea mays
gaccatgggaaagaaaaggcactgaatcgagaaacagaatgctccacatatacaacaagttcatttttcacttctgcccgagcctgaaatcacgtctcaagtagtcatgcaccgtggcctgcttgctacccacacagggccataggtacacaaaaactacaagtattaaggcaatatagacgagggacaactctagagacctatggctcaacagtcgtcacttgctgccattcgccgtccacagcttccttccacagggtcacattgttgttgccgtcagacaccgccagtatattcccagtcagtgaccacgacagcctccacacaggggtcctgaaatcatacagcaaccggccttcccactgctcgccttcttttgctgctgtccagataacaactgttccatcctgagaggcgctggcgatggtggactttggaaggcccaggtttggcgcccacgcgacgtctctcacccagtccttgtgcatctgtagggcggggaaacagtccatccgccaactgccgttgttgagcttccacaccttcaccgtgttgtcacagccaccggaagcgagtttctgaacatactcaaactgaccagaagaccccgcgctgattagagctcccggtgccattgcaggagcccaagaaactgaggtcacaccaaccggatgcgcctgatcaatacgcgtggtatcccaacctccatcagaacgagcagtgaagactgaaatgttcccatctgatgaaccacaagccaagcatagacccagctcatgaggcgcccacgcgatggaattcacggaggacttgtgctcagcaaaggtgtgtaccagtgcccattcatcaggcttgcttccttccttccagatgatcactcggccgtcgtagctgcaggatgcaagcatggaaccaaacttgggatgagcccatgcgacttgccatactgggccctggtgtccactcaaagttgcaagctgctggtgtgaggttccacttacgccaatgatctttattgtattatcagaggaggatgtagctaggcgcttgccatagtaatccatggcgacatcatgcaccacatcttggtgccccgtctcgatcttatggggcggcattgctccaatgatctaactttaacttagcaaaatgacaaccttcttccgcgttcaccacttcagtctcccgcggacgatgaggagccggcgccggagccggcgtccaggaacagggaggaggaggaggggattgctgccgctggcggcggaagccggaaccggaatggaattggcgaggactggacggcgcgccggcctcccgataagtttcgttctgcagtctaaactgacaagcatttttcacaaccaccagagcaataataagcacgaagaaatcaaatgtactagattcccggccgg

SEQ ID NO: 13974 - DNA, 1487 bp, Zea mays
tgggtaccgggcccccccgcttgtttgtctgcgcccgccttttgggtttttttttgcactgaataaacagaatggactgtataacaagttaattgttcacttttgcccgagcctgaaaccatgtctcgtgcaatgtgccttgccaacagctgtgaaccacaaacagtcccacgtgctacccaaagggcataactttaccttacacgaaaactacaattattatttagaaaatacaggcgagaaataactcgagagacctatggacctatggctcaacagtcgtcacttgctgccattcgccatccacagcttccttccacagggtcacattgttgttgccgtcggaaaccgccagtatgttcccagtcagtgaccacgacagcctccaaacgggggttctgaaatcatacagcacccggccgtcccactgctcaccttcttttgctgctgtccagatgacgaccgttccgtcctgagaggcgctggcgatggtggactttggaaggcccaggtttggggcccacgcgacatctctcacccagtccttgtgcatctgtagggcagggaaacagtccatccgccaactcccattgttgagcttccacaccttaaccgtgttgtcgcagccaccagaagcgagtttttgaacatactcaaactggccagaagatcctgcgctgattagagctcctggtgccattgctggagcccaggaaactgaggtcacaccaaccggatgtgcctggtcaatacgtgtggtgtcccaacctccatccgaacgagcagcgaagactgaaatgttcccgtctgatgaaccacaagccaagcatagacccagctcatgaggcgcccaggcaatggagttcgccgaggacttgtgctcagcaaaggtgtgtgccagtgcccattcatcaggcttgcttccttccttccagatgatcacccggccgtcgtagctgcaggatgcaagcatggaaccaaacttgggatgagcccacgcgacttgccatactgggccctggtgtccactcaaggttgcaagctgctggtgcgagtttccacttacgccaatgatctttattgtgttatcagaggaggctgtagctaggcgcttcccgtagtaatccatggtgatatcatgcaccacatcttgatgcccagtctcgatcttgtggggcggcattattccaatgatccaacttttaacttaacaatatggcgaccttcttctgtgttgaccactttcagtcagcggacggagcgggcgaggatgaggagaagccgcggcgtcgaggaggggagcgctgccgctgctgcagcggaacgaaactggcgacgactagacggtgctcagcctatgcaggcttttggatcaagcccatcaaaccgagcttgtccgcacatgctccttccgtgtaattctggtcctgtttggcccgccgcaaaacatttggcaaatggtgagagaaaggggaaaagaagttttc

SEQ ID NO: 13975 - DNA, 1502 bp, Zea mays
  misc_feature (1311)..(1311): n is a, c, g, or t
  misc_feature (1339)..(1339): n is a, c, g, or t
  misc_feature (1384)..(1384): n is a, c, g, or t
  misc_feature (1400)..(1400): n is a, c, g, or t
  misc_feature (1454)..(1454): n is a, c, g, or t
  misc_feature (1470)..(1470): n is a, c, g, or t
  misc_feature (1474)..(1474): n is a, c, g, or t
aggaccaaacgcgcgcccgccctgcccaatcttcactcacctcccccatttctgtccacctcctggcctggccagccactgccgcaagcccgcaccgcaactgcagttgagtgagaccagttcgccgcccctagataatctctcctctccagggacggcaggccgtgccgtgccgtcacgacagaccagactagaccagagagagctagtgcgtgccggcgcgcggtgggagagagagactaattcgttctagagctcccgtgaggacgatggagcgcggcagttcctggcggctcacggtggtcgccggcacccttgtctgcgcgtccctcttctcgccgcccgccgccgcgctcaacgtcggcgtccagtacgccggcgacgacgcgagcaagcagcaggcgtgcagccgcacgtgcgagtcggaccactgcacgacgccgccgttcctgcggtacggcaagtactgcggcatcatgtacagcggctgccccggcgagccgccgtgcgacgcgctggacgcctgctgcatgcaccacgacaactgcgtccaggcaaagatggactacctgagcacggcctgcaacgaggcgctgctggactgcctggccaagctgcgggagggcacgtccacgttcgaggggaacaggtgcatgatcgaccaggtcatcgacgtgatctcgctcgtcatagaggccgccgtcgtcgccggcagggtgctgcacaagccctagccgcacgcgccggggcgccgggcgtggtgggcgcgcagggacatgtgtagcacagcagcctgcgccctgcggttggtgggtggcacacatctttttcgtgcttggcagggtggcggcgtcctggacggggggccgggctgcgtcggctcacatggcagctcgtgtcgttgtgtgcctactagctggctagctcccagtccctcagcccggcctaaaccgacgacaagatatatggagatcactccttaaagaaagcttctttggttttaagcaactcgtgtccctatcacactgtattaccgtacaagtataaagaaagtttcctcatgctggttttggtttcttggagaatccgtattcgacacactacagtccacacaagtgtagcttacgctgttgcaaatgatgaataatacagagcgtgtacttcgattaaggatcttgtacttgtctgtttctgggactgagagggcagccgcggcgcacccactgaaacgtttggcctcggcaaaaaaaaaaaaaaaatacgtccttcggatgcttcatgcatacaaatattgaactagtatctcgttgngtccgtcataccctcataagctcagcanacagcagtcaggaatgaccaaaactgcaaaaggtgaacgcctaanaacagaacagagcagntgcacgcctgcgccgaaaagcagggcagcattcccgtgtttacaggcgaaacanaaacagcatgcctcanctgngtaaggaagcgatccacaaatcacttgc

SEQ ID NO: 13976 - DNA, 2610 bp, Zea mays
gcggggtctcctcagtaactgcacccacctcccacctacacccgagaggcggcggcggcagacacagacaccgtctctctcctccctttgtcgtcgtgcctctctgcatggaagcctccgccggctcgtcgccaccgcactcccaagagaacccgccggagcacggtggcgacatgggaggggcccccgcggaggagatcggaggggaggcggcggatgacttcatgttcgctgaagacacgttcccctccctcccggacttcccttgcctttcgtcgccgtccagctccaccttctcgtccaactcctcgtcaaactcctccagcgcctacaccaacacggcaggaagagccggcggcgagccctccgagcctgcttcggccggagaagggtttgatgcgctcgatgacatcgaccagctcctcgacttcgcgtcgctttccatgccgtgggactccgagccgttcccgggggttagcatgatgctagagaacgccatgtcggcgccgccgcagccggtgggcgacggcatgagtgaagagaaagccgtgccggaagggaccacggggggagaggaggcctgcatggatgcgtcggagggggaggagctgccgcggttcttcatggagtggctcacgagcaaccgcgaaaacatctcggccgaggatctccgcgggatccgcctccgccgctccaccatcgaggccgccgccgcccggctcggcggcgggcgccagggcaccatgcagctgctcaagctcatcctcacctgggtgcagaaccaccacctccagaggaagcgcccgcgcgacgtgatggaggaggaggcgggcctgcacgtccagctccccagcccggtcgccaacccaccaggatacgagttccccgccggcggacaggacatggccgcgggcggcggcacatcttggatgccccaccagcaggcattcacgccgcctgctgcgtacggcggcgacgcggtgtacccgagcgcggcaggccaacagtactctttccaccagggccccagcacgagcagcgtggtcgtgaacagccaaccgttctccccgccgcctgtgggcgacatgcacggcgcgaacatggcctggccgcagcagtacgtgccgttcccaccgcctggggcttccacgggctcttaccctatgccgcagccgttctcccccggattcggcgggcagtacgccggcgccggcgctggccacctctcagtggccccccagcgcatggcaggcgtggaggcctcggcgaccaaggaggcccgcaagaagcgcatggcgagacagcggcgcctgtcctgcctgcagcagcagcgcagccagcagctgagcctgggccagatccagacctccgtccacctgcaggagccgtcccctcggtccacgcactccggcccggtcacgccgtcagcaggcggctggggattctggtcgccgagcagccagcagcaggtccagaacccgctctccaagtccaattcctcaagggcgccgccttcctcgctggaagcggcggcggcggcgccacagacaaagcccgcgcctgctggtgctcggcaggacgacattcaccaccgcctcgcagcggcttcagataagcggcagggcgccaaggcggacaagaacctgcggttcctgctgcagaaggtgctgaagcagagcgacgtcgggagcctcggccgcatcgtgctccccaaaaaggaagcggaggttcacctgccggagctgaagacgagggatggcatctccatccccatggaggacatcggaacgtcgcgcgtgtggaacatgcggtacaggttttggcccaacaacaagagcagaatgtatctgctggagaacacaggggaatttgttcgttccaacgagcttcaggagggggatttcatagtgatctactccgatgtcaagtcgggcaaatatctgatacggggcgtgaaggtaaggcccccgccggcgcaagagcaaggcagtggttccagcgggggaggcaagcacaggcccctctgtccagcaggtccagggagagccgcagccgccggtgctcctgaagacgccgtcgtcgacggggtcagcggcgcctgcaaggggaggtctccggaaggcgtgcggcgggttcggcagcagggagccggcgccatgagccagatggcggtgagcatctgaaagagcagcagactccgccatatattgatcgatcgaccaatcgatcgttagttctccaagttactattagctagctatagctcgaaacagctgaactgatgatgacgatggtaacctccgtcgtgtgtgctaagcatgtagcgtgctaggagatgatatattaaatataatcgagtagtagagccacccgctgtgtgacgctaaatttgtgtgcatttggtttggtttgtgagttgggcccgtgcgtggctgtgtcatgtcgtggttaattagctatactagtcctgtctgtacatgcatggacatacctgatctctcggccattggtgtcggcgacgtgccattcggctaacaagacgccagctgcagcctgcagcaaaagctagaacattctccacatgcccccgtgtatgttatgctttgtagt

SEQ ID NO: 13977 - DNA, 651 bp, Zea mays
ccggccgggaaaaccatggatgccatcgtttaagaaattcgccgcttgatgtgtggatccgtcgcggctgccgtcaagcatagacaccaagaaccagacctcggggtggatcatcggggtcgcggaggtctactggatggggtcaagaagtatccgggcaagtcgtctctgggaaccctgcttattgctcgccggatgctagcgccgccgtggactgcgcggctccgagaagtcgaggtcgtcgcgacatatcccaggaaccttcggacttggaacgaagctgtccataatatggaaagcatgattgggacgaaggtcgaatcaattctgaagctatgcgcaaggaagcttcggctcagtagcagaaaaaggaaccgacctaaaaaggaaaaggctatttagtcctcgatagattgtccttaagtcaattgtaaacatgaagagcatgaatgcaattttatacaggttgtgccctatgcgtataaatagatgaacaataccctcgtactgttcatgctgacttgtattcgctcgtgcgtcacgcttggacttttgccttctatcaagccgaaggtacaaatgtaattcaatgttgttcttgtccatccatgatgagataataaagctatattgatgatgttatataaaaaa

SEQ ID NO: 13978 - DNA, 562 bp, Zea mays
gatggatgccatcatttaagaaatttgccgcttgatgtgtggatccgccgtggctgccgtcaggcatagacaccaagaaccggacctcggtggtggttcatcggggtcgcggaggtctactggatggggtctagaagtatccgggcaagtcgtctctgggaaccctgcttattgctcgccgatatgttttcaggcgtcgcgatgcagctgtgtgccgtggctgggtctcattgccgtctttcaatcgaggtgaggccacgaggatctgaagaatcaccctggtaactggaatctcaagtgccagccttacgcatcagatgaactcccacctttggagaagaataggtggttcaagaggagccacaaatcgaggagttcgattcgatctagcatgcgtctcacagttgactttcttgcgccaaggatgatccttagttcgtgttatatttatcttttatttttgtaagacttcctctatgtaataagtactctgattatattgtgacatttatctctatacactctgttattataaaaaaaaaaaaaaaaaaaaaaaaaaaaa

SEQ ID NO: 13979 - DNA, 2050 bp, Zea mays
gtcttctgcaatctgcaaggcgtcttcattttctgtccgctataaaaacaaaccctggtcagggcatggcaatggcgtgagatctcaccttcgcctatctgttcatcgtccccccttcgtcctcctccccgaccccgacgtgcgacatgaacgggaagcagagcccgcggaatggccgaactgcgtgcccccgccggccggccgggtgctggctgaacagacccaaatgggcctctgtaccacaagggcatgtaccacatgttcttccagtacaacccgcacggcccgacgttcggcaccgggaagctctcctggggccactccgtctccggcgacctggtgaactgggcgttcctgggcaccgcgctggacccgacgtcgccgttcgacgccgagggctgctggtcgggctccgccaccacgctggcggacggccgccccgccatcctctacaccgggcgcgacgcaagcggcgtgcaggtgcagaacgtggcgttccccaagaacccgtcggacccgctgctccgggagtggcgcaagccgcccggctgcaacccggtggtcccgcagccgggcgacgtgacgggcaacaacttccgggaccccaccacggcgtggctggggcgcgacgggctgtggcggttcgccgtcgcggccgaggtcggcggcgtgggctccaccctgcggccccgcagcaaggacttcgtgcgctgggagcggggctccgcgccgctgcacgcgtcccccgacgtgcccgtctgggagtgcccggacctgttcccggtggcggagcgcggcgcggaggggctcgacacgtcggcccgcggcggggccggggtgaggcacgtgctcaagctcagcaaggccgccgacgaggactactacgtggtcggccggtacgacgacgaggcggacacgttcgcgccggtggagggcgtttttgactggcgccggatcgaccacggccacctgttcggcgccaagacgttcttcgacgcgcgcaggaggcggcgcgtgctgtgggcgtgggtggacgagacggacgacggcgttgacaagggctggaggggcatccagacgttcccgcgggcgctgtggctggacgccgacgggaggcagctggtgcagtggccggtggaggagatcgagacgctgcggaagggccgagccgcgctggcgggcgcggtggtcggcgccggcggcctgcgcgagatcgccggcgtcgacgccctgcaggcggacgtggaggtcgttttcggggtccccgggagcctggacgacgccgaggagctggaccccgagtggctgcagcacgatccccacaagctgcgcgcgtgcgcggagaagaaagcctcctcgccgggcccgcgcggcggcgtcgggccgttcgggctggtggtgatggcgtccggcgacatgcgggagcagaccaccgtcttcttccaggtgttgaggcacggtggcacgtacaaggtgctcatgtgtgccgacctgacgaggtcgtctacgaaagagggggtgcacaagccattctacgcaggattcgttgacgtggacgtcgagaaggacaggggcatatcgctgagaacactgatcgaccactctgtcgtcgagagcttcggaggcgggggccggacgtgcatcacggcgcgagtgtaccctgagcacgtggcggcaggcggcagtagccacctgtacctgttcaacaacggagctcacccagtgaccgtgtccaagatcgaggcctgggagctcgggacggccagcgtcaacgttgaacaagacgaccgtgcggatccactgtgatcgcccgcccgccctgcgtgttacagacttccagtcctgtcggatggcgctggaggcttaatagataaccatcacgcgtggagtgaagcatgtgttaaaaaaaaaaacaagaccattgttgccttattggtggtctcgtgttctgaataatgtagctttgctaaagtgtattgcgtctccattgtaacaccaaatgcctgtttttgctaaaatgtacgttgcatgcaacgtaaaaaaaacaacc

SEQ ID NO: 13980 - DNA, 1613 bp, Zea mays
gtaccctcggggtcggcccgcacggcacacatcatcctagcaaacgtccttatccggctacaactttcgcgacgtctgcgacatcagaaaactgagctcgccccctcttgccttccctcctccgccggaccgctgctgtccgcctccaaccctccagttcgacgcaggcggcgacggcggcgcgccgagatgaaggtctccgtgaagacgctcaagggatctagcttccagatcgaagtggagcccaccgacaaggttgctgctgtgaaaaaggtcatagagaatatgcaagagcaggcttcctatccagctgaccaacaagtccttatacatcaaggaaaggtgctcagcgatgacaccacattagaggaaaatcaagtgactgagaataatttccttgttataatgctcagacagaacaagggatcatcaagtgcagcaccggctaagacaactgcgaatcaggcacctcctactcagacagtgcctgttgttccacctcaaacgtcagcagccccagctgcaccagcacctattgtacctgtcagtgcactggctgcaactgctacagcctcagcagctcctgctgttgctgtatccaccgaggcagatagttatggtcaggctgcctcaaacctagttgctggcagcaacttggaaggaacaattcaatccattcttgaaatgggtggcgggatatgggacagagacactgtactacgtgccctgcgggttgcgtataacaacccagagcgcgctgttgagtacttatattctgggattcctgaacaaatggatgttcctacatcacctccgagtatccagccagtcaatcctgtccaggctgcacaagcagctcaaactgcagctccatctggaccaaatgctaaccctctagacctctttccccaatctcttccgaatgcttccgccaatgctggcacaggaaaccttgatgttttgcgcaataacgtacaattccaaaacctgcttggtttggtgcaggctaatcctcagattttgcagccattgcttcaagaattgggtaaacaaaatccccaggttatgcagctaatccaggaaaaccaagcagagttcatgcggatgatcaatgaaccacttgagggagacgaagagaatgaaatgatgctggaccagatggcggatgcagctgagaccattgcagtgactccagaggagaacgaagctatacttcgtcttgaagggatgggctttgaccgggcactggtcctggaagtgttcttcgcgtgcaacaagaatgagcagctgaccgccaactacctcttggatcacatgcacgagttcgacaacgatgacgggctcggagggccaccgctatgagggcgctctcgatccctacatcatgcgaacgaaggctgtagggcagtagtaggaaaacgttttgggattcgtcccgtctgttcgctcactctacatattcgtttggctttgctgtttagtacagaatttctagatttacggacttactacttgatatcctgatatagaggtcacggccaagcttactttttttaaaaaaaaaaaaaaaaaatagaaaataatactacaaaaaaaaaaaaaaaaaagcggcc

SEQ ID NO: 13981 - DNA, 1724 bp, Zea mays
  misc_feature (1)..(1): n is a, c, g, or t
ngggcgggagaatgttttctaaggtaatgatcagcatggaagggggaaaggggggagagaaacctcctgcgagttatattttttcccagtgcggggagaatgaaagaaagatacgaggggacacggtgtcttctatgaggagaaagcgcgggtgagtgctcccatagattcgccagagggtttgttttttcgcggggggggaggggaggatgcacatataacaagaggggggggccgtcaagatgttttaccgactctggaaaaagggggcacgggggagcggacagggcaaggttaaattaagggtttgagggtagaccccctaggagggggcccgagggcgattttcccttttttttgtttaccgggtgtgtattgtctttttgggaaattgggaggggggatatcatttttgcaccgcgggaggcaggattttgttccaagatttggccgaagcttggagttcacccctccttaaaggagtaaaaaaactggacctccccagcggtagtgggccctcaaaaaaaaaatggataccccggggtccaaaaaggaagggagagtgatgagagacccctcttttgtcccccccccccccccccccacaacaatccagagcgtgctgttgagtacttatattctgtaagaatgattctttgtcctcgttactttctaggccttacatgcgatgaactttcagcgatttatgtgtgcccaggtacgtttaactagtgaacacatctattatataaagtagattgaagctgcatgcacatatgtttggtttgaatatttcgtgaccttagaagtgaattgccgttttcaacctgcaacatgaggatacaattttgttttacaattgtagacactaatgtccttcatgttctgtttaggggattcctgaacaaatggaggttcctgcaccgcctccgagttcccaaccagtcgaccctgttcaggcggtacaaccagctcaagctggaccaaatgctaaccctctcgacctctttccccaagaaatcttgatgttttgcgtaataactcacagttccaaaacctacttggtttggttcaggctaaccctcaaattttgcagccattgcttcaagaattgaggaaacaaaatccccgggttatgcagctaatccaggaaaaccaagcagagtttatgcggttgattagtgagccactagagggagacgaagagaatgaaatgatgctggatcagatggcagatgcaactgagaccattgcagtcactccagaggagaatgaagctatacttcgtcttgaagggatgggctttgaccgggcactcgtcctggaagtgttcttcgcctgcaacaagaacgagcagctggccgccaactacctcttggatcacatgcacgagttcgacaacgatgacgggctcggagggcctccattgtgatgcgatgcgaaggctgtggacagaaaataggaaaacgttttgggatttgtctcgtctgtccgctccgctccccctacatttctttgctgtttagtacataattctagatttacagaaaagacaaagtttactcttttctggatcatatgttttgtgctacttattgctgttctggccgcattgggccagcatgcagttattcacgggttcaaccaaaaaaaaaaaaaaaaactcgagggggggcccggtacccaattcgcccttgtttaaacacaataaagttggaacgtga

SEQ ID NO: 13982 - DNA, 829 bp, Zea mays
acccctcgttagcgtggattcggctcgggtcttctgtttaggggattcctgaacaaatggaggttcctgcaccgcctccgagttcccaaccagtcgaccctgttcaggcggtacaaccagctcaagctggaccaaatgctaaccctctcgacctctttccccaatctcttccgaatgattccgctaatgccaacacaggaaatcttgatgttttgcgtaataactcacagttccaaaacctacttggtttggttcaggctaaccctcaaattttgcagccattgcttcaagaattgaggaaacaaaatccccgggttatgcagctaatccaggaaaaccaagcagagtttatgcggttgattagtgagccactagagggagacgaagagaatgaaatgatgctggatcagatggcagatgcaactgagaccattgcagtcactccagaggagaatgaagctatacttcgtcttgaagggatgggctttgaccgggcactcgtcctggaagtgttcttcgcctgcaacaagaacgagcagctggccgccaactacctcttggatcacatgcacgagttcgacaacgatgacgggctcggagggcctccattgtgatgcgatgcgaaggctgtagggcagaaaataggaaaacgttttgggatttgtctcgtctgtccgctccgctccccctacatttctttgctgtttagtacataattctagatttacagaaaagacaaagtttactcttttctggatcatatgttttgtgctacttattgccgttctggccgcattgggccagcatgcagttattcacgggttcaacc

SEQ ID NO: 13983 - DNA, 901 bp, Zea mays
cggaataaaaatctcctcgcccccccccccccccccgcctgacctctgctgtccgcctcaacggtccaaccctccggttcgacgtaggcgccggcggcgaaatgaaggtctccgtgaagacgctcaagggatccagcttccatatcgaagtggatcctaccgacaaggttgccgacgtgaaaaaggttatagagagtatacaagagcaggcttcctatcctgctgaccaacaagtgcttatacaccaggggaaggtgctcaaggacgacacaacattggaggaaaaccaagtagttgaaaataattttcttgttataatgctcagacagaacaagggatcatcaagtgcagcaccagctaaggtaaccgcgaatcaggcaccctctactcagacagtgcctgctactccacctcaaacgtcagcagccccagatgcaccggcacctattgtacctgtcagtgcaccggctgcaactgctacagcctcagcagctcctgctgttgctgtctccactgaggcggatagttatggtcaggctacctcaaacctagttgctggcagcaacttggaaggaacaattaaatccattcttgaaatgggtggcgggacatgggatagagacactgtactacgtgctctgcgggctgcgtacaacaatccagagcgtgctgttgagtacttatattctgggattcctgaacaaatggaggttcctgcaccgcctccgagttcccaaccagtcgaccctgttcaggcggtacaaccagctcaagctggaccaaatgctaaccctctcgacctctttccccaatctcttccgaatgattccgctaatgccaacacaggaaatctttgatgttttgcgtaataacgcacagttccaaaacctacttgggttgg

SEQ ID NO: 13984 - DNA, 4854 bp, Zea mays
agacacatccccttggtgctacggcaccccgcgcgctgtacctggtcttggcttgccgtgtttatttttatatatatatgtaggcaccccccagctgccgctcaaagcgacaggtggagatcggagggaggaagaagaactgagctgcggatcgagggaagggaacaagcaagcagccagagccaggtcgtgggggagccggcggcagtgatcttcttgcgtcgaaggcgaggccggagcgtcggtttgagcgctcgtgcgatatgggggagcaggagaacaacaagatcggcggcagcggcaacgacaacgccatggcggtggacgaagcgggcgcgggcgcggccgcgaacaaggggaagagcctcggcgccgcggacccgcgcctgcaggccatttccgacgccatccgcgtcgtcccccacttccccaagccagggatcatgttcaacgacatcacggagctgctgctgcggccgggcgtgttcagggacgccgtggacatgttcgtcgagcgctaccgcggcatgagcatcgcggccgtcgcaggcattgaagctagaggattcatctttgggccagccattgcgctagccataggagcaaagttcataccactacgtaaacctaagaagcttccaggtgaggtattttctgaaagttatgtacttgagtatgggatggattgtttggagatgcatgttggagctattgaacccggggagcgcgtagtggttgtcgatgatttggttgcaactggtggaactctttctgctgcaataagacttctcgagcgcgcaggagctaacgtggttgagtgtgcatgcctcattgggcttcccaagtttaaggtaccaaaatctaagttcgttcaaaaaagctaccaaatgtatatttcttttttctcaaggtgcaccaatatgctccttacatgcacttcagttagctaaaggaaattgaggaagtattccatctcggtctgagggaggaaagacgcaatagaacaaggccagtgtaaaaaaaaactagtctgcctgtaactattcctgtacatgtgactgcagatttttaataaatgaaatggtatcatctagccgatatcttttcctcctacgagtaaaaccgagagcaacctcagcgtgtgtttgaaaacaaagtattttaaaaaccatggtgttttgaggtaaagtatctcaaaccatggtattggtatgcatgtgcaagaagctagttattcaccaaaactttgggttggagcaaagtttcaaatacttcaaaaatacatgctcagagttttttacaagtaggcaaacaaccactgtattctccaataacatgattttatcttaaaacaataaaactccaaaaacattttgcttcttaacaccctccttaaggtaaaaaaacttgtggatatcttttgtatgtaacttcagtgacagataggtgcatgtggttagggtaaattattttttgttataagaattatatgcctagtgtgcaatggtgagagctcaccgggacgtggggttcaaagcagcctcttcacatttgcggatgaaggtttgcctcagtttatttcttctccaaatgtcatttgggttttttctttcctaaatcacacatatggaagcgtctgggcactggttatgtgcttttacatatgtgataagaatagcctaccttaatttataactgtaaataccacgcgaccatgtattttttcctatggatgagatagctgataaccattagccacaacaaaagggatatggctaggttgaactctttggaatctagcatatgtagcaggacttgatatttccagatatgatgatagagagagggttgggaaactacgctagtgccatagtccactcaagtctgcctattcagtaaggatattttagatgcgaggatgactatttttttttaatccaaccttttcttatgaaagagaggcatatcaaggagtgtatatactattccctcatatctactgaggttccattttttttttcaatgtgcaggatttctataagctcaacgggaaaccggtttacatcctggtggagtcccgcaaataggacgcagtaaaatggtcagacaagtaaatgctctcaagctccttttatacttgaaacttctctcaacattcatttcgaacatatcatgaaattccaaagctatgcatgctcgcagaatcgagctttgcacattgagtcaaatttgatttcctggtgaaacaggagcagtagcagcggtagcgtccagccttaaagcatgcatggctactgacactaatttctgcctcgtgaccatttcagaaaaagctttctagcttcccgtccaaagaagctcacagcttcactcatttgcacgcgcaagcaaggtggtatgggggcaccgagaaactccgcagtaatctgtgttgaggccacggccagatgatgctatgtatcttcatggagagggtgatggactgggtgaaacgtagtcactgtacctttgtagcacgtcatgtctagtgtttcttagtagccatggctgaagagagtttgtagctattcccggcttcctgcagccaggaacatcagtgttaggcagagaaggaaaaggatcttatgttgctgctcagttttctaccagaatcgtcttcctttttttcccctttgcagaatcaactctttggtaaactttactaagctcgttttgcctaaacggccgttcaatcatgaagaaagagcaatcatacgtaatgccagcgtaaggaggacatgtcttttttccaatatattactatattcaagctcccagaatcaactctttgataaaatttgcatctaccttggtgcttgtacaccagactagcctaacaaagtgtcgcccctgcacttgcagatggttcccaaaccctatgccgtcgaaccacacttatctactatgtctacgactaatagttagatgacactatggtttctatatattagttgattatacattactatagtttttatatatcatatttgtaaacatttcccatgagtcaatgataggtggagtctatgatatatatataaagttgtaatcttttaatgatatagatccaattatttctttattcaaacacgattttttaattttcaaattattatcatctaccttttatataacacaaagtagcaagagctgtagtggttaaggcgtggggcttagatccttgcatcctgtgtttggatcccacttgtctcattttttttttataattccgggcggctggataagcgccaggtgggagcgacacaaaaaccactgatggcgatgtctaacgttggtctggcacccatctacttaattcttctgtatctgtatgagtcgtgatcatgtgttagattttgcttaagatcctatgtacatttgctatatgtttatgtaccatatgcttatgctaagatcagttttgacacttgcatgtttatcaacgacacgtggaaatggtggaagcctgtcacagaagttcctagcaccctgatccagtgatccctgcattgttccatgaattccccccccgcgccggccgcccgtttttttttttttcgaatgaaaagatgtacaccaatatatttctccagcaagagcattagctgcattacacggttacaatacaacttgaagcaaatctgaactcaactataatacaggcgaggcatggaccagcgtccggatgcaatgaatagaactgtgatggaacaagtggaaacaaaaggcaagcacaattcgtgtgagcgcgcgagatcgatcgatcgatcatcacagcatggggaggaccatctggagcaggggagcctgccgggaccgccgctgccgcgccttgaacttcctgatggccgccttgagcacccacctccacccctcctgaaccgcccccaagtccaaccaatcagtggaaacccgcgtgatgctcaattgctcacgactatttcagcaaagcttaatgaaggcaagtgggcggctactaccttcgcgggggaaggtgccggcggcgagaagtcgagcctggccctgccagtctcgtggaggtccaggaaggacccgtctcgccgcagccgcctgcgcctccacctggacctcccgccgccggccgagtccttgggccggccgccggccctcgccctgcgcttcgggttggcgacgaggaagtcggtcgaggagttggtggcgtcggccgtctcgggctcgcacgcgccgccgcgcgggaccttgttgagcggcgaccagattccgctctgcgagtagtcgaagtcgaaggcggatgggtccgggaacttgcccagcagctcccgcgacatggacggctccaggtactccaccgtcaccacgcgctcgactaccacaacgcgcgtcggggtgctgccgccgccgccgccgccagtgttttcctcagctgtgttactcatgccgatcacttgtggggacgtcaggcgtcaagattttgggagtggggcagagggggcgtgggaacagagggttattagcgcgggtgtcggaactgggaaggggaaaatagaaaagctgttagctgcgaaagcggccgctggggccgcccggcaggggcggatggcgggcacttgaccgttgccatatggatcactgggtgtctctgacgagtgggtcgtctcttcgcagagaggagcaggcctctgaactcggcaagaggggagggccatgtgcgtccaaggtacagcaaatgaatttctcgcgtgcaagtataccgtgccaatataacatgcacgtgcttgtccattttttttaaacaaacgaaatcacgtgcttgtcaacctgcacccataaaag

SEQ ID NO: 13985 - DNA, 2740 bp, Zea mays
agcaccaccaccaccgcggcggcgcgagcgtcactgccctgccctctcctcctcctgtcctgctgctctaccgtcctctccccccgcgccgctgccgcaaccaaaaccctaaaagtcgctttctatccacttgctccgccgcctccaccaccgggcgccatggcggacacagtgcagtaccgcctggagcggatgaccgacgaactggacgacctggagcgccggggcctcttcacgcgcggcgaactagctgacgtcgtccgcaaacgccgcgacttcgagtaccgcctccgccgccactccccgctccgccaggactttctcgactacatcgcctacgagctccgcctcgactctctccgcaacctccgcaagcgcgccatcatacgcgccgccgccgaagacgacgatgacgacgaggaggagcctcagcacgacgctcgcagcagcgacgacgagggaggccggaggaagaggaagaaggataaatccaagaagaagtggaagaagtccgtctccgacgtcgcgggcgtcctccgcgtcctcgacatctaccggatggccaccgtcaggttcaagggcgacctcgacctctggttccggtacctcgagttctgccgcgacaagcgacacggcaggatgaagcaggttctggcacaagctattcgcttccatcccaaggttcctgggctttggatctatgcagcagcatgggaattcgatcagaacctgaacgttgccgcggcacgtgcactgatgcagagcggtctcaggtcttgccctcagtcagaggatatgtggatcgagtatcttcgcatggagcttacctaccttaacaagctcaaggctcgaaaggttgctcttggagaggatgtcaagacgctgcaaaagaaagacaacgatgcgagccagtggaaagaggaaaacaaggaactgttcatgccactgaatgaacaggtcaaagatcctaaggagccaggctcggctggagatgccctggaggagaaggaagacctgttttggcgtcaagggttgttaatcattcagaccatatatcatggtgccgtggaagctcttccgtcaagcttaaccttgcggaagaaattcttggagatactaaacagtgttgacttggcacattctgatgagttaaaactggaggtcctggatgaccttaagagagatttctctcatagcgaggactactgggattggtttgctaggcttcagcttagcaacttgaacagttccagtaattcgaatagaaaggatgctatatcaaacaagttgaacagatcaattcaggtgtatgacgaagctatcaggaagctaccaaattccaaaatgtactcattgtatgcaaagttttggatggatgttatatatactgacagagaagattcagtcacattattccaggattctgaatttgatgcttcagagttcacttcatccatactgaaagtttatgaaaatgcagaatcatgtggatgtcttactgaggatcttgcttgccaatacatatcactttacttgaaactagaaagactggaggaagctaagactctcgcagaaaagctttgtgatggtcctctttcaaatgctgcaaatttgtggagcctgagatttactatggagataaattcaattgcaactgctcctggcagttcttccttgagcaaggagaacctgagctctctgcttgatctatttagcactgtactctccaagttgtctgtaactgaggctgagagactgtggcatatggccatgaagttgttttcccatgataaggtctgtttcgagaagctggtgaagtgtgcgatgctatcattaagtctggcaggtggcagtgattcaggagcatcagtttcttctgctatcgttggatggtatttgcaaagagatggtgtgaagcatgctaggaagatgtataagagattgcttgctttacctcggccaagcctcaagttcatgcaatactgcatagcgctggaggcgaaccttgcatcgctcggagacaacggcgccctcaaagatgctcggcggctatatgattcagcgctcgacctgtatccccaggaaagagaagtgtggcggagctactacgacctggagctgaagatgggaacatcggagtctgccaacgccgtgtactcgcgcgctcgtaaggtgctgggtgactccactgccttgactgctccccggggctaggtcgcagcatgcaatgtattccaagatgcaatgtgattttttttgtttggatctgtgttttccaatcctctctgtgagtctgggtcagcaagcaattaagctgatgcatcgaaattttggctctaaatgggagtggtaagctgctggggaacactgtatatcttgttcaaaaaacaagagtactgcagctgctggtggctgtctcctttcagaacacttgcctgtgtcccttttctttctttttcttttttgtttgagcagtagctgggctgttggtgatgctgttccttagtgttgagttgctatggtgtaacagtgtcaattgcgacttgaacaaattctgggatctcgaaccatttgttgagattttgaaagtgtactggtggtcataatttttgttgggacctcgaaccatttttttttagattttgatgtgttccttttatttatttatttattttttgtatggttcatggatgagccacatttgcttttgtgtcagtcttgctgcagattcctggtatta

SEQ ID NO: 13986 - DNA, 1055 bp, Zea mays
tcccgcgatatgggcacaccaagcagcaggcagctgctgctcgtcgcagccgtgtgcctcgtcgtcgtcgccgtggacacggcggcggcggcggcagcggcagcggcagcagcgatgcgcggccggcgtcgcgtgcacctgcgggtgtacatgcacgacgtgatccgggggccggggcagacggcgatccagctggtctggggcgtgggcccgccgcacgcgaccatgccggggcggtccttcggcgacacggcggccatcgacgacctcctcacggagggccccgacatcggctccgcgcccgtcggccgcgggcagggcacctacatgctcagctcgcagcgggaggcggtgctcgtcgtggacgtcacgctcgcgctcaccgcggggccatacaacggcagcaccatcgtcgtggccggccgcgaccgcgtacaggacgagacgagggagctcgcggtggtcggcggcaccggggacctccgcggcgcctccgggtacgtgctgtggaggacggccaaggtgtggtcggaggtgcacatggcgctggagatcgacgtgcacgcgtccgtgccactgccactgccggacgacgacgacaacaacgaccttgttcttggcagcagggatgagtgacgtgagacatgcatggttctctatctatctctgtctagtgtctaggagaacctccgattccatttatgattacataaatataaaaggagcttcaattttagctctgcatacggttctcaatgcatgagaaatataaacaccagtaccaaatttagaacttgatttaaatggagccaactaatctacgaggggcacagtaatgctcgtaccctcacaccatgtgttgagtttgtgatccaaatgttgtgcaacatctttcagcaattggtatatatagtgttcagccaatgtatattcttctaatacataggagtatctgtctattcaataattagtagatatagattcttcaaagctgtaatatatttctcatgcattgagaatatatagtctgagctgaaattcaagctccttttaag

SEQ ID NO: 13987 - DNA, 3596 bp, Zea mays
gcacgagaccattacctagaacatcctaatcgaaaaatcaatctctttcgctgcttgctttccattgaaaatgatgtgttctcccacaccctgcaacctgaaggcaacatgcctagcacaaaattctcccaaggattcccatggtttcctagcccaagatgtgcatggagccttgcttcttgatctccagcagaacagaagtgaagcactgtggccttgcatgcccaagttttgttgttagcgttaccaagatcatagctaccactgatgcagtgcgttcgcgatgaactgtgtagagcaggttctgaagagagtgttacctgcatctgcatggaagagggaggagacccgcagcttccgagcatctccgtggcacgcaccacgtccgaaggcgcgggggccgtcgacttggatctccttgagcagctactgtccggcgacaacggttggctcgaggtggtctcgcgctcgcccaactcggtagcgtttcctccaccctcggccttcttctcggctgacgcgacggccaccacagtgacgacgacggcggcgccggccgcgaacgccagctggttgattcagacgggcggcgcgagcaccccctccgtgcgggagcggttcagccaggccctgtcctacatccgtgatacgcagagcgacggcgacgtcctcgtgcagctctgggtgccggtcaaccgcgatgacgggaagctggtgctgaccaccagcggtcagccgttcacgctcgaccaccgctccgacagcctcatccggttcagggaggtgtccaccaagtaccagttcccagccgacgttaggtcaggggagtcaccagggttgccagggagggtcttcatcggcaggctccctgagtggtcgccggacatcaggtgcttcaccagctacgagtacgccagggtgacagatgcaaagtacctcgatgtccacggcaccatggggctgccagtgttcgagaaaagaagttacagttgcctgggcgttatcgagctgatcatgacaaagcagaagctcaacttcacctctgagctcaacaccatctgcagtgctctacaggcagttaatctcagaagtacagaagtttcgagcattccacgcaaaaagtttagcactgcttcctacaaagatgctttaccagagatactggaggtcctgagggcagcctgcttgacccacaagctgccattagctcagacatgggtcacatgtactcaacaagggaaacgaggcagccgacattctgacgagaactacaggtactgcatttccaccatcgacgaagcatgctttgtgaatgaagccgagatgcggggcttccatgaggcctgctccgaacaccatctgctgcgtggcgagggggtggcagggaaggccctcacgacaaaccagccatgcttcctgccggacattggatcctcaactaaattggaataccccttgtctcaccatgctaagatcttcaggttaaaaggtgcagtggcgatccgactgcggtgcacacgcactgggatagcagacttcgtgctggaattctttcttccaacagattgtgaagcactggaggagcagaagacagtgctggactccttgtcaggcaccatgcgaagtgtttgccagaccctacgtgtggtcacagatagagagatggaaggcgaagcggcgctggaaatgaacgagctgaactcttttactcctcctgagaaggacaaagatgagttgtcctttggaggcaattcagcagatcgtagaggggcctcttggacaagtctggcaggaacttcacagcaagaacccgagttagctgcattgcggatgcatggaacgttctcacctgtggggcagggtccatctctatctggtgttcaggcaactgctgaaggcagtaagacaaaaaggcgcacaaaggccgagaagaccgttagtttgcaggttcttcggcagtacttcgctggtagcctcaaagatgcagcgagaagccttggagtgtgtcccacgaccctcaaaagaatatgcaggcaacatggtataacccgctggccatcacgaaagatcaagaaggtagaccactctctaagaaagctccaacagatcattgattcggttcatggtgcagagacagctttccagctaaacaccctgtacaaggatctcacagacacctcaatatcatctgacaacaatttgtcaggaagtgtcacggttcctccaactaaccagagcaatctcaccgacttcaacaagcaccaaccccacaagtcaagtagcaatatgccatcaacttcacactcacactcctcatgcagccacggttctcagtcaagcccctcgtgtagcgttggtgcaacagaacatgcacaacagggtataattgatctgatgaagtcagaaaatcctgtgaaagacagctctattcagactatgcaaacagaaaacacttcattatatgagcatttctcagttcatgaggctccaattgatcttctacaggatgttactgaaaaggctaatggtgcacatcattcttctcgaagcctgtcatcccccaaccccaagcagaacacagatgcaaatatgagagtaaaggcaacatttggctcagaaaaggtgagattccgactaaacccagagtgcaattttcaaggactgaagcatgagctagcgaaacgtttgagtatagtagacacaaaccccttggttttaaagtacttggatgatgattcagaatgggtcttgatgacatgtgatgcagatctgcaggagtgccttcatgtatacaaactagcagatatccaaacaatcaaaatttcagttcatttagctgttagtccagctacaagggtcacagctggtcacactggtttgtcatgacaacagtatgagcctcaccactttgtgaggtttaatcaaattcaaccaggatcacatggttttgtgcaggggaaaccaaagattccaggagtccagggttggtagctgtgcaatactgcaatgtactatgtaccaccacgtcccagttctactgttagatcaattagtcttgtttctgatgctcaggttaggaactaatgatcaaacaagaatacttgacaatgagagagtcaagaaatcaggataaacagaagtaagcatgcattgcttgtaaatacttattgatgaacctgaatctctgaatgacaatgcaattgattgaattaatagggtgacgtatctacaaatcagatttgctccaactccaagtatgttttgtttctttgagtgctgatgtgcaacaatcattgatggcttctttctgataattgatcagctacaattgtcccttaagatcacagcattccttcatcgcctgagcgatcagcatgctctgttcaatgcacatgaaattctgcttctgaaattgtaattttctgcagcaaggattagatctagaataggatgataggatacttagtttgttcaatatgtttgtccattgcaaaaaaaataaaaaatgaatggtacactgaattatgggcctctttgaaagaacgtctgctgctgtagacattatagattgttttcctttaaaaaaaaaaaaaaaa

SEQ ID NO: 13988 - DNA, 1575 bp, Zea mays
gtggaatttgatggtcgatggctatgtaaagcatggaaaaattcatgacgctattgagttgtactcaaagatgtctgaaaagaatttggaagcttctactactttgatgtcttgttttatagacaacggaatgcttgataaagctcgggatgtgttctacagtatgcctcaagtagatgtggtttcctgcactactttactctttggatatgtgaaaggagggtatatatatgatgcactggaccttttctgtaggatgcacaaaaggactgttgtcacatacaatgtgatgatagctggtttgcttcatcaaggtaaggttaccgaagcttacaagctctttgatgaatctccaacacgagatttagtgacctggagctgtttgatcaacgggcttgctcaaaatggtttaaacaacgacgcaattaagctgtacaagaagatgctactgtcaaatatacggccaagtgattccattctttctagccttattagttgcttttcacatcattctatgattgttcatggccagcagtttcacgcttctactatcaggcttgggtttggatcacatttattaattcaaaatgcactcattagtatatattgcaaatgtggtgaaatgattattgcacaagccatttttgataggatggacaacagagatacagtgacatggaacacaatgatttgtggttatgcattcaacagctttggtcaaaatgctattgagacatttgataacatgaaaaaggcccaagttgatcctgatgagatcacatttctcggcatacttactgcatgcaatcacatgagacttttggaggaaggcaaacatttcttcaatatgatgacatgtaattatggaattttaccaaataaaatgcattatgcttgcatggttgatctgtttggtaggacaggcatgcttgaacaggctgaagagttaatgaagtcaatgccatttaaaccagactttgcaatttggacttccctcttgagcagttgccgattgaatggcaatgacaggttggcagagcatgcagcgagtcaattaatttccatcaaacctactatcaaaatgccgtatctgcatctcatcagggtaaatggatcaaccaaaagatggaatgtgatggaaaatttgagaaatcaaattagaaatgctgctactgacaaagaagttggctatagctggagttaactgatgtgtactacataacaggagcatgtcaacaaggtaccagaatacaagcctgcctgtagcctaccgctgctgattattgaggtcattttttaacttttttgtggtggagccactatccatggatcagttatgcagaaacttgtcagtttgtcactaagcaggtaaaatctagtacattatgttgttagctaaccttcccctgacattgaaggcattaccaagtagatgattactttgttgcttttcagtgccatgctgaatgtgtgaaattcttggtgttcaaaattcatgttggacgtgtgggcacctaagaaaaatgctgatacataccttaaattagtataaagattacattattatttgtcatg

SEQ ID NO: 13989 - DNA, 1508 bp, Zea mays
attcagcactgcagtcctagttcgtgattttgcatggaaatttgtatgtttctccatcgaaatggcacatgtttaatgttcttgcttttgatatgggcttttgggtcgtaggtctataccgatacagactgggagatattgtgaagatagcaggcttccacaacgcaacaccagagctccagttcatctgccggagaagcctagtcctcagcgtcaacatcgacaagaacacagagaaagatctgcagctggccgtggaagccgcggagaagctcttggccgcggagaagctggaggtggtggacttcacgagcctcgtggacaggtcgagcgagccagggcactacgtcatcttctgggagctgagctccgacgacggcgccagcgaagacgtcctgagcggctgcgcgagctgcatggacctggccttcgcggacgcggggtacgtcgggtcgaggaagacccagaccatcggcgccctcgagctccgggtcctccggaagggagccttcgcgcaggtcatgaaccactacctgagcctcggcggcgccgtcagccagttcaagacgccgcggttcgtgggccagtccaacagcaaggtgctgcagatactgagccggaacgtcacccggagctacttcagcactgcgtatgggctctgatcgacgatgctacggcgctacgcaccaagtactggtaataggctggaagtatagtgatcgagagtgcatggcgcacgacgacgatccatcatgctgggagcctgggagttgcacgacgactgacagatgtatcatataattgtcagtgtaaatatagctgttcgacagtgtatgtaggcgaaggttgctgcgttccgtttagcagccgtgtcatcgctcaagaaaactcagaaagatcacatgtgttctgatttctgaatcaaaaaactgtgtacaagaagcagcgaactcactcgatcatattccgcgcgctacagccttcgcatatcagaaataccgccaaaagtttccatgtgctttacatacaaatctggctcgtacgagtcatacagagagtgagctagctcccggtgtcccacactgccttgccattgacgacgtacggtacgctgctgcctcctgctccctccagctcgggatgctccccgagacatgacgctataatcagtggatttatatcgcgcacggcaactgttccgataaaaacaaccttccaataggatatatatacaagcgatgcattttgtatgccctcaccgcggagagctaaaaatgtgcatcctttctcctcaatgcatatggcgcacgagcggctgcgggtgctactgtcgcgtgtcaaaagcattggatatgacatcttgttgtctaataaatgtccatatatatgtttgggttggaactgtagtatttttgcatgcccacccaaacactatagcacgaggcaaccatgtcatttgcatgctgcttttgggtgtctcctttatctttaagatcagtctgatagcc

SEQ ID NO: 13990 - DNA, 2311 bp, Zea mays
ccacgcgtacggagtagtctctctatcaaagcacttccaggcattggtcatacagtttcatctaaactgaaaagcaaagaaattgaatattgtagtcaacttcgcaatgtttcaaaggatgccctccacaaggatttcggaaaaaagactggtgatcttttatggaattattgtagaggaattgatcattcaattgttggatctgttcaggaaacaaaatctgtgggtgccgaaattaactggggagtcagatttaatgacaacaaagatgccgaacattttcttaacaacctttgcaaggaggtttctctacgcttgcagggttgtggagttcagggacgtactattacccttaaggtgaaaacaagaagggaaggtgctggggaaccaataaaatatatgggatgtggtgactgtgaaaccacgagtcgttctatgacgattgcaggtgcaactgacagttttgtcactctccagagaattgcaaaacaattattttcagctcttcatcttgatgtgaaggaagttcgtggaattggactgtcactatcaaagcttgagcatgcagatttgggccggggagcatcgcaaggacatatgcttgaatcgtggcttgcttcaccagccgccaagctcaagaaacagcagagtgagatactggggaatgttaatgttgcagggaccagcggactgaaggatttgagatctggaccatcacatacagcagaagcgaaccttagaaatgataggtctactgtatttcacaatgtcgagctgcctccgttgtcccaacttgatttggaggtcctgaagaaccttcccccagagataatgtctgaaatgaatgaaatgtacaagggagaattacaaagtcttgtggacaccctcaatagtgacaagggcaaggaaaatagttcaaaatctcttgctttgcctgcagttattcgtaagtctgtacctgccgatgcaaagcttcaaggatacagagaccacagagactccatgcatttggaggaggaacatactaaggtgagctgtgtcactggaaataaagtggcgctggaactttttaaacaaagtgcaagcacgtgatttagttgctgtcacctcctcatcttgatatttggaagttggaacctgtttcacactattctaattttacctttacacccgtagggaaaatctgacaaacaactatcagaagctaaaccagccaataatgcttcatgctcaagagttagtgcatcaattgagaaaacaacaaaaagtgttacacaacttgatttgatgcctgattcgctaagccaggcagatctaacagttctgcaggaattacctgaggatgtgaaggctgatttgtttagtgcacttccactgcatagatcaggagatcctgcatgcagcacttccaatgtatctgaaagtaaatcacctaatgtggttagagctgaaaatagatcttctaatgatggtggaactgatgatctgaaaaccccaaggtcttttctcccaccaggaagttctcaaaaatggatcgaacagtttagagttagcagttgcctgattttgaacgtaattgcagagcaacacacagattccagctgtcaacgaccattgtcttctgttctagagcctgtagcttcgttcctacctttgtgtcctaacccaggtagtgaagaatggaatgaaactcattcatgtctctccgagcttcttagacactacatacaactgaaagttgaatatgatattgaagagctctacaaatgtttttgccttttgaaaagattctcgtcagcatcagagttttttctggatctacatgatagcatccttcctttcctacaggattctatcagccagcattacggtgggacactgcaattctagctccttgctcaagttgtagccattctattttgctagaaaggaagaagcaatgccgtgaatgtgcggagagacgtgttatgacaatctgcgcctccaagcagctactcaaatcccgtgctggcagattccttggacgcgtttataactttattataactaattgatgccaatgctggaagttttattgatatattcattgcatctatggatcaatagatgccatgtggttcgatatatcattcgtggagcaatggtttgaagggacctttgctgtgctttgatgttcccaggcgaatttcatgtttgcttcataacccatatgaatttcatgttatctttgtgttgctaccaaaaaggttcctggtttgaagttctttgcgtccaaaaaaacaccaaaaaaaaaaaaaaaaaaagaaaaatt

SEQ ID NO: 13991 - DNA, 2773 bp, Zea mays
agctgtgggacgcggaaacaggtgcttgcgaggcaaccctccacggccaccgctccgctgcctccgccctccgcttcggcccctctggcgccgtcctcgcttctggcagcaaggactgcgatgtcatcctctgggacgtcgttgcgcaggctgggctcttccggttgcgtggccaccgtgaccaggtcaccgatttggtgtttctggattctggtaagaagctggtgagctgctccaaggacaagtttattagggtttgggaccttgaaacacagcactgtctccaaatcgttggtggtcaccgcagtgagatttggtcaatggatgttgatcctagcgagaggtttttagtgtctgggtctgctgatccagagctgcaagtgtttagaatccggcaatcagtggaggagggtgaggattggagcaagtgggatgtgctcaagctatttggtgagattccacggcagagcaaggaacgagtggcaaatgttaggtttaatagggacggcagtcttgtggtatgccaggtggctgggaagacagcagatatttatagggttcttgatgaaacagaggctgcacgtaaggccaaaaggcgggtgaacagaaagaaggagaaagcatctgcgaaatccatgattgctgaagagaatggcactatcattgatcctttaccagttcaaaacttacaaaatcctactgttattgtcaccgatgtatttaagctatttcaagttttacgtgcaagcaaaaaaatatgttcgattacattctctccaagtaatcctccaagaggatgccttgccactttgtctctatcactcaacaataacatgcttgagacatattcagtggataaggagaaggtatcaaagatgtactcagttgagatgcatggacatcgttctgacatcaggagtgtctcccttaattcggaggacaacctccttatgtcgactagtcataacgctgtcaagatatggaaccctagtacaggggaatgccttcggaccattgactctggatatgggttgtcaagtgctttcgttggaaatcggtatgctcttgttggtacaaaaagcgattgtacctattccagatgaagatggaactgttggtgcacgaggctttgtcactggaagtgctgatcatgatgtcaagttctgggaataccaattggtgcagaagtctgataatgactctaagcagctgactgtaactaatgtgaggaccttgaaaatgacagaagatgttcttgctgtctcgatcagtcccgaaggaaagcacattgctgttgctctcttggattgccatgtcaaggtcttctacatggacacactgaaaccatctttaaacctttatgggcacaaacttccagttctctgtatggacatatcatctgatggagctttgctagttactggctctgcggacaaaaatttgaagatatggggtatggattttggggactgccacaggtctatatttgctcactcagacagtgtgatggatgttaagtttgtgtatagaactcattatatgttcagtgtggggaaagatcgcactatgaagtactgggatgctgataaatttgagttattgttaacacttgaaggacatcatgctgaagtttggtgcctcacactcagcagtcgcggtgattttgttgtaacaggttcacatgatcgttccattcggcgttgggatcgtactgaagaacaactgttcattgaggaagagaaggagaaaagattggaagaaacctttgaggctgatttagaaaacgataatgactatagatatgggcagaaagatgatgcccctgatgaaggttctgtgggtgttcctggtaggaaaacaaaagagacagtaacttctgctgatgcaatcatggatgcacttgacactgctgaggaggaactaaaacgcattaatcaacataaaatggaagagcaaattactgcgaaggcagctaaatttcaacctaatgttataatgcaagggcattcaccttcagattatgttctgaatgtagtttcaagcatccgtccaaatgatctggagcaggccctcttggcattgccgttctcggatgcactaaagctcatgtcttacttgaaggagtggtctttggttccttcaaaggttgagcttgtttgtagggtttgcttagtgctccttcagacacatcacaatcaattaactgccacgccagctgcaagatccttgttgacagaactgaaggatattctttactgtagagtaaaggaatgcaaggatactataggcttcaacctcgccgcaatggatcatataaaagaattgttggcgttgagatcagatgcacctttccgtgatgccaaggcgaaactcatggaaatcaagaaggagcagtcgaagcggtcaagtagtaggcttgacggagatgaaaaaaggaaaaagaagagaaagaaagcgtccgctgaaagctgagccaacaaacaaaaacaaaagaatgttgtattgttgttcttaccttctgcaactactacatggacgtgctcgtttccttggttcacgagcacgcagaatttttgttagatgggtgtaatcggaaagtgcgtggacataaagatttctagaggttcgtcttgcgtatctgatgaaagggaatatatcaggtggaacatatacattggtgtagtgtagtcgtgtaactaagggtgtgtttggtagggctttagcttgcccaaacacggttctagctctacttttttctaaaagcagcttgctg

SEQ ID NO: 13992 - DNA, 677 bp, Zea mays
gcaaatacccgaaaccaccctcgcaagacttggaaaccgcaacgcccccatccgtttcttcctccttgccaggacaggagtctcaactctcaagtctcaaccacgtggagagtggagtagtggaccgaccatggccaccgccgccgacatccgcgtctccatcggctaccagacccgcttcgggctccgcctcgccgccgcgctctcctccccacccccatcccccgccagcaactccgccttctccccgctctccctccacgtcgcgctcagcctcctcgccgccggcgcgggtggcgccacgcgcgaccagctcgccgccgccctcggaggcgacgcgcccgccggggccgacggcctgcacgcgctcgccgagcaggtcgtgcagctcgtgctcgccgacggctccggcgccggcggcccgcgcgtcgccttcgccgacggcgtcttcgtcgactcctcgctgaagctcaagccggccttcgaggaggtcgccgtgggaaagtacagggccgacacccagtccgtcgacttccagaaaaaggctgctgaagctgctggtcaagtgaactcatgggtagaaaaaattacttctggtctcatcaaagagatcctgcccccaggtttctgttgaccacaccaccaggcttgtgcttggtgttgccctctattttaaa

SEQ ID NO: 13993 - DNA, 2069 bp, Zea mays
  misc_feature (1777)..(1777): n is a, c, g, or t
tgggaccctcgaggccggccgggctcaccatgtggagagtggaccgaccatggccaccgccgccgacatccgcgtctccatcggctaccagacccgcttcgggctccgcctcgccgccgcgctctcctccccacccccatcccccgccagcaactccgccttctccccgctctccctccggcgccggcggcccccgcgtcgccttcgccgacggcgtcttcgtcgactcctcgctgaagctcaagccggccttcgaggaggtcgccgtgggaaagtacagggccgacacccagtccgtcgacttccaggaaaaggctgctgaagctgctggtcaagtgaactcatgggtagaaaaaattacttctggtctcatcaaagagatcctgcccccaggttctgttgaccacaccaccaggcttgttcttggtaatgcgctctattttaaaggagcttggactgagaagtttgatgcatctaaaacaaaagatagcgagttccaccttcttgatgggagctcagtccaagcacctttcatgtccagtacagacaaacaatatatcgtggcttacaacaacttgaaggtgcttaagcttccataccagcaaggtgcggacaagaggcagttctccatgtacattcttcttccagatgcaaaagatggcatctggagcttggctgaaaagctgagctctgaaccagagttcctggagaaccatgtcccaatgcacaaggttccagtcggacagttcaaagtccccaagttcaagatatcctttggatttgaggcatctgagttgctcaaaggtctcgggctccagcttccgtttagtgctgaagcggacctgtcggggttagttgattcaccagagggacggaacttgtctgtttcgtccgtattccacaagtcatttgtcgaagtgaacgaggaaggaacggaggccgctgccgcatctgctgcaacagttgtgctccggtcgttcacgatgcctcaggatttcgtcgcagatcaccctttcatgttcctgattcgcgaagacttgactggtgtggtgctgtttgtcggccacgtggtgaatcccctccttgctccatagtgtgttgttcagaagtgtggccttggtgcggttccatcccctcacagatgtgtggctttgacagctgatcaagctttatgtgtaatctgccatgttttgtttttgaataaatagatgcttgatcgatgtatgtaaggctgcgagatgatagttcagaattggtatgtgtggtcatggactcatggtacttactgtttccttcttcctctctgatgtttctggttctagtgacctttttccagtgacatctgtaagactgataacatatagattctgttgtgaagcacgtatcggttactgatgattatatttactgtttactttcgagttccacatcctgcttgattctgatgttcagtctttttttatataaaaataatgaattaggtttgtgccaattgtttcacaatgacacggtgttcacgatgataaggcaggcagaaatgagtagtttggtacaaatctctttgaatgaaaatacgtgaccctgaaaactgaacaatccgtttattcgttcggttatttctatacctcattggaagggattgaaaaaaaatataaaatattttgactcgatatgaattaaaacacactcaatcccttacaatccatacggaattagaaaaacctagctggaacaacgattttggcgcttcaattggccttatttctactaccgcagnatgctagaatagttcggtgaagtagccggggacaccaccgaggtgtagaataccgaaaaattgttgtgtaatcaagttttatatgcaactgccttgtaatcaaactataaaaaaatcttttaaaaaatatagatatattttattatttactctaccaatatattaaattttaagtaattacgatattttatagtggtgcacaggtaaaaggatttttttctctttttttttatttcgaatcttctattatgccatgtaaatattagagattgagttgtatacatttcgggtg

SEQ ID NO: 13994 - DNA, 1883 bp, Zea mays
  misc_feature (1219)..(1219): n is a, c, g, or t
gcctaagtcagtacagtacctctcgagaaaaaataaaaataaaaggcgcattttgatctccctcggcccacggaggatatttgggtcttggcacctggcagcaagcaaccaacccatgggccctgcccctgacgcctgttgcttagcatagaagaagacctggcacaaggagtgagcatcttgcattctcgctgtccagcaaaatactcgaaaaccacctcgcaagacttggaaaccgcaacgcctcttcctccttgccaggacaggagtctcaactctcaaccaagtggagagtggaccgaccatggccaccgccgccgacatccgcgtctccatcggctaccagacccgcttcgggctccgcctcgccgccgcgctctcctccccacccccatcccccgccagcaactccgccttctccccgctctccctccacgtcgcgctcagcctcctcgccgccggcgcgggtggcgccacgcgcgaccagctcgccgccgccctcggaggcgacgctcccgccggggccgacggcctgcacgcgctcgccgagcaggtggtgcagctcgtgctcgccgacggctccggcgccggcggcccgcgcgtcgccttcgccgacggcgtcttcgtcgactcctcgctgaagctcaagccggccttcgaggaggtcgccgtgggaaagtacagggccgacacccagtccgtcgacttccagaaaaaggttgatttgatccccttcctaccgagctccctaacacttgcgtacttctaccgcgatgtatgaatcaaatcttgctgtttctgctacgggacagattggctagtgccttctgaattctgattcattttttatgtgcagttttacattgatactcttgtcagagttattaagtggcttgtttctccttaactcataattaagtgtaataatgttatgtaagagttattaagtgcctggtttctccttaactcatagtaattaagtgtaataatgttatctctacttctttcctgatctttgtggcctaacacttaacggtgcttgaacttgtaacatactatacttttttttagaaataataagtctaagccttttacaatatatgtttagacagatataattactgacttgtttctctcaccaaattgtgctatttagtgttcactccgattttttccatggaatttgttattttcagtcattattcgatgggtgctggcntgctaatgagtaatatgtatggatgtggttgttgtaggataattagaaaactcaggatttatgaccctcttttggatttttcagttctcactaggtgtatacttgagattttgaaggcttggaccagtgacttctattatttcaggatctagagctaaatatttagtacttacggcagcaaacaatctttagtacaatagttgttacagttacagtaacacgcagtggtggagctgcatctgtagctgcagcaatatgttctgaccacagccattatttagaagctactaggacatttaaatgatgtggatatacagttgaatgtatcagctgtttccctggtaggtttgtgccgcggctcttactactatccatatattattgtatcttgacagtttagatgattatagtcacatgaactgtctcttgttgcatgtaatttccttctcatctgaatgctctgtgataatagtgctacacttatgcttggtttacttgtcaatttctaaagtctgtttgatcgggaacagttcctttttttgtttaagtttgtgtcaggttaatatataatggttacctcagtttctttacatacttatatccttgcactatgtcagttattttggaaacttcagcagtgattttgtttcatgcttttggcatg

SEQ ID NO: 13995 - DNA, 2943 bp, Zea mays
ctgcaggatatttctagtgctcggagatgctccatcgaagacacaggtgttttgatgcttctaaagccaccaagccgcaaggattaccaacgtgttaaaaccttttttcttctctttagatacctggccttcggcatttctccaccaatcttggaaaatcatgtcattttggtcatattattgtgtattctgtgtgtcatttcattaagaagactgtgttaaatatgcaatgcacgcagaatacacaatagtatgatcaaaatacagtcattttggtcattcggtgtttccaaataccccgagctcatagtatgatcgaagtttgagtccttggtgctccttgtacaatctcttgattgtcctgttccactagctggagaaggaaaacagcatctgtgattgtggagatagggcttgcagttaaaatttctgaaaaacagtgtaccacaattccctggtgaccattttaggggctgttcgttttaatctcaatccatgtggattggaagaaattgagtggatttaaatccgcaacaagtcaaaatctctcttgattccttccaattccgtctaatccacataggatgtgaataaccgaacaaggccttagttggcagtttctgaaaagcagtgttctttcttggttggtggcaaaaaataacaatcattgttttgtttttctgaaaatgtagaagagtttcaattcattgcattaatagaaggattttttttaggttacaggccctagctgcatatacaatttacaacagatgtgccactgtcatgacaaagatgacctggctaaactaccacacttgcttaccacacacacacacacacacacacacacaagaacacaatacacacaaagaaccttcagtaatcattaccagtcattggtagtttttcaaatcctggattgcgcaaccaatgaatgatgtattgtttgttgggaattacttaagaaagaaacaatttgatagcaaaatcttgcttaaaaatcacaataaggacttgtttgttttggtggggattggagggcgattgaaagggatcccttaagtcaaaattgccctcatctcctccaaaccccttggtgaggttattaactgaacaagccctaaagattgcattgcattatggaatgcatttttatgcttatcccacaaaatttgctgttttatctaatcaaaacgatcgctatcttctgatctatccagatatggagtgagatgcagacagatttcttgccgaatttcatcttatgtaataccacacagcggtttgtccggtccgcaaaaggaactcaccactcttcgcatagatcaagcgcttctactgggaaaccttacttctattgtggatcacatgatttgaccatggcataccagggtcttgctgggctgtaccgtgacttttttggagtccctcatatgtttgcagttgttaaacttcttggttccagatcattacctgcaatcatccgtgctttactggatcatatatcaagtaagattacaggtttgctaccgaaaataaatgcactgcaagaagcattaccaaaatctattgggcttctttcatttgatggtggtatagcaggttgccaaaagatagttcatgaaattttgacatgggaagcaaaatctgaagttaaaactgaagttcttcatgaccttaaggaaattggaagtgctttgtattggatgagcattctggacattgtgttgagacaaatcgacactacacagttcatgcagtcagctccgtggctaggattggttccaggaaatgatgggcaagtgaagcatgcctactctgataatactccatttaccacacttttaagtgctgcctctaatgctgtgacatcaagccctacatgtccaaatccatctacgtttcttgtcatgtcaaagcaagctgaagctgcgagtctgctgtacaaatcaaacctcaactctggtagtgtgctggagtatgctcttgcattcacaagtgctgccctggatagacactatagcaaatggagcgcaactccaaaaacaggctttattgacattactacttcaaaggatttctatcgcatttttagcggtcttcagtatagttacttagaagatagcattaacaatccttcgaagaaacaagaaatgctgggtgattctgtagcctgggctggctgtacgataatgtacttactgggacagcagcagcacttcgagctttttgatttctcctatcaatttctcaatgtggcagaagtagaaagtgcgacagtatcacactatcaatcttcagagaggactaaaagttcaaatttcttgcaaggctacgagggcatcctggaagcgatgaggaaggctaggaggctcaataaccatgttttctccatgttgagggcacgatgcccccttgaggacaaggttgcatgtgctatcaagccaagtggggcaccgcttcaccggatgaagtttatgaacaccgtttctgcattcgagacattgccacaaagagtcacctaaccagcttccaggcaatgtgcagaatgtactcttgtatgcggggttatatgttatgttgtaaggtaaatgtatattatgtaacaaccatcaaccgtggatcctggacctgaacaggagaatgtgtttgcttgctatatatgaaaattaggtgggtatgttgaggttgaccctgagttcgcaagtttagctttcaactttgagactatctcgctgaaccaaatatgtataccagctggagagttgagccagaggacacgtgctagttagctgttcttctcgtgtctgtatttctcagtctgctctcaaagtatatttaatgtatgacgattcaggttagcttaaaaagttgtgttatctgagaactcaaaaaacaaaagcgccgtctaaaaaaaaataaaaaaaaaaataaaaaaaataa

SEQ ID NO: 13996 - DNA, 3599 bp, Zea mays
  misc_feature (3199)..(3199): n is a, c, g, or t
ccggccgggatttttaggtgcgtgtcacccccgcgccccggggcgagagcgtgctacggcggcggcggcggcacagcaggggaagaacgtacacccgcagtcgaaagaggacggcgagacagctctcttcctatccacattctatataatctatggctaatcaggtagagattagagtgattgagagagcggggaaggaagttttgtacagagaagagaaagaggtagttgatgggaagggtttgatgtgattgccctttcttttctctttgcttcctggacacaacagccgccgccacttcctgccatcctttcgtcgttgattcggtgttcttggatcggatgccttcatctgcctagatcggagctagagcaaggtgcgtggtgtaaatcccgagaggaggaagaggggagggggtccaggccgcttgttcttgccgcgtacggttcttccaagaacccgcggcggggatggatctctacgatgagggagaggagatggccttacaagacggggactcctgcctcgcgccacgggcttcgcggggcggatgcgaggtggacttgcagtgggcggatggcctcctcgaaggcgccgaccggaagcggcgtgcgcgggaaggcttcaaggatgaggtccatttcgtccaggaaatggacgaggtggatggcagcggcaagcgcagcaagccgccgtcgccgcaaccgcacacaccagatattcgtgaagctcatgcccctggccgccgtcgcaccgtggtggccggcggtggggagctcagctgtggcggtggtgatctcataggacaaattggccgggacctgtccatcaactgcctcctccggctgtgccggtcagaatatggctcagtggcatcgctgaatcatgatttccggtctcttgtgcgaggaggggagatctacaggctgcgacggcagaataacatcgcggagcattgggtgtacttctcctgtaatgttttggagtgggatgcttatgacccttaccgcaagcgttggatctcggtgcccaagatgcctcctgacgagtgcttcatgtgctcagacaaggagtctttggctgtgggcaccgagctacttgtgtttggaatggcacacattgtcttcagatacagtatactgacaaactcttggacacgaggtgaggtgatgaattctcctcggtgtctatttgggtcagcaagcgttggggagaaggcatatgttgctggtggcactgattcttttggcaggattctcagctcagcagagctgtacaactcggagacacatacttggacaccactccctagcatgaataaggcacgtaaaaattgctctggggtgttcatagatggcaagttttgtgtcattggtggtgtgacaaacaacaacatgatcttgacctgcggtgaagtgtacgatgtgcagagcaagacttggagggtgattgagaacatgtctgggggtcttaatggagtgagcggtgcacccccacttgttgcagtggttaagaatgagctgtatgctgctgattacagcgggaaggatgtgaagaagtatgacaagcagaataatgggtggatcacacttggtaaattgcctgagcggtctgtgtccatgaatggatggggccttgcattcagggcatgtggtgagaggcttattgtcattggtggcccaagaacaccagttgggggcatgattgagctgacctcatggactcctgatgacaagccacctgtgtggaatttgatggacagacggccatctggaaattttgtgtataattgcgctgtgatgggctgctgagctcgcttcatcaagggtctgcatagtgatgtttacaaagagaggtatgcacaggcaggcttgtttagcttcagcactccttgatgggtttctgcctttgaccttgtagctgatgtagttggcatccacaggaacaggatctttgtaacctttttcatacatcagtttctgccccagctaatccatttctttcatttacatttggatcagtcttatgatctagaagatgataccatgcaaaagatgtcataccaataatctagaaacatcaaatttcagaggctgtccatcattgatgatgacagagcaagttattttggtcattttcccttgtctctgtctgcaacaaagaagtgaccatcttgttattagcgtgttcctaatatttgagttatcatatatgttgcactttgatggctttctttatgcatttatttggatgaatgaccttaggatgggtgagttaaactgtttgagtggaacatgattaaaaaatgactcctatttggagttggatcattatggctttccctcaaaattagatcagataaacctctggaaagttttcctgtctcacacaagctggttttgaatgcaattttttttattcattcagttgttttggaatgattttagggctcatgtggggtttcaactctagcctatctgaacttgcttgggactgaaaggctttattgttgtttttggttttcaattgttttggaatattttccttttaccttatctgctctgaaatgctgcgtttgttatgcactaatgctctttatttgaactttgcatgcttgctggttgttttggtgaaaacaactacaaaatgtgaatctgttgatgttgtttatggaatgatttggttatttgaaaaacatcaatctgttgatgttttttatggaatgattttggttgttatttgtcttataggtaagtttatcttatatggtgaataacgtaagtattattttgatcaggttgagtgaggatgagatgaaaaatcagatgtaggttttgtttctatattatggaatacatccttgtaatcacagccttaattatcactataaatgtctactgctgccttcttcccaaaagcatggtttagattaaaaaaatgttctaaaaaactttgttagctcttaggtgacgtttggttccaaaatgtaacgtaaatggtaacggtaatggtttgcattcgattaccaacggtaacaagtttgaataggctgatatcaatttctagtgtggtatccgattacggttatacttaaacaaacatgatctaacgttatttgttacctattacattacaaacatataaaccaaacagcaccttagagatagattgggcccatatcagcttagggcccgttcngttgtacaggaataagccaggattcgttccaactcattaaaatctatataaattaaagaagtaatccggctaggaatcaatccggggctgcaatccttaacaaccgaacaggccttaagattacagtctgcatgcatccatgcattccttttaacgaggggtctattccttaattagcatgtttcatattcaataaatagaaaagggtacatgggtaatttccattgaacactaacctgccctgaaaatactaaaatatggaaaaaggggtagagggagtataaatttgcagaatctgatcagtattgaaacccttaacttcacatgattgttcctctatttctttttcattagcggcatatgcatgatacggttttctttgtaggcactcttattatgt

SEQ ID NO: 13997 - DNA, 998 bp, Zea mays
gcagtgaaacagatggcttgaccggttcctatgcggcggcggcacacgccatacagcagggaaagcattcgccgcagacccgtggtagaagaagagggtgagaccagtccatctatttctagctatccatcttctatatatatacgcagttatattatatggccaattagatagagattagagagggagttgggaatgaaattttgtacagggaagagagagagagagggtagttgatgggaagggtttgatgtgactgccctttcttttcgctttgcttcctggatccaactgccgccgccgcatctgtcttcgttgattcggtgttcttcgatcggatgcctttatctgcctagatcggagcaagagcaaagcgcggggtgtaaatcctgagaggaggaagagaaggaggagaggagatcgagaccggctccccccgtcttgcttgtgcttgtcgcgtacggttcttgtaagaacccgcagctgccgcgtccggttctttcaagaacccgcggcggggatggatctgtacgacaagcgagaggacatggcgttgcaagacggggactcctgcctggcttcccgggcttcgcggggcggatgcgacgtcgatttacagtgggtggatggcctcctcgaaggcgccggacggaagcggcgtgcgccggaagacttcgaagacgaggtccagaaaatggacgaggtggattggcggtggcaagcgcagcaagccgccgtcaccgcagccacacacgccagatattcatgaagctcatgtccctggccgccgcaccaccgtggtggctggtggtggggagcacagcggtggtggggggtgacctcataggagaaatcggtcgggacctgtccatcaactgcctcctccggctgtctcggtcagagtatggctcagtggcatcgttgaatcatgattttcggtctctggtgagaggagggggggatctacaggctgcggcggcagaataacatacggagca

SEQ ID NO: 13998 - DNA, 5883 bp, Zea mays
ataatagtatttttatgaagtaatcaagtatatgttagtaattatgtgttactaggatatagtccgtgctagcgctatgatcttgggaaggggagagggaggatcgacgatggcgatgacgcgagagaggtgccggtagcagagtcacaagtgagggggagagggaagagatgttgggtcgtggagagaggggccagcgacgttagggagggatcgacgatggtagcggtacgagtgaggtggaggggcggtggagtcacgtgggatgggaatcagacgataagaggggagggggtgtgggtcgctgtagaggaagggagatgagagatgatctaaaataatagtgatcattttatttaatgaagagaaatgaatcaaacgatctgaatcgttgattttgatgatgcgttaagtctgtttgtattttattggatgagttttgcaaaagtttaaacggatgaattataaaatggtctagacataaatatataattatattatacctgtttaaaatatttaagaacgatttcacacggtctaaaccgatgcagtgaaacagatggcttgaccggttccatatgcggcggcggcacacgccatacagcagggaaagcattcgccgcagacccgtggtagaagaagagggtgagaccagtccatctatttctagctatccatcttctatatatatacgcagttatattatatggccaattagatagagattagagagggagctgggaatgaaattttgtacagggaagagagagagagagggtagttgatgggaagggtttgatgtgactgccctttcttttcgctttgcttcctggatccaactgccgccgccgcatctgtcttcgttgattcggtgttcttcgatcggatgcctttatctgcctaggtacgtgcgccgattcttgcgtcgggggattcaattctcggatgggtggagggggattcgtcattcgtgttactgagctatgagtgggtggatgggttcgtgaggtgcttaccagatctcagcttctcgatctgtccttcgcgatttgtcgcccaattcgtttacctcctcctatttctgctcgcagatcggagcaagagcaaagcgcggggtgtaaatcctgagaggaggaagagaaggaggagaggagatcgagaccggctccccccgtcttgcttgtgcttgtcgcgtacggttcttgtaagaacccgcagctgccgcgtccggttctttcaagaacccgcggcggggatggatctgtacgacaagcgagaggacatggcgttgcaagacggggactcctgcctggcttcccgggcttcgcggggcggatgcgacgtcgatttacagtgggtggatggcctcctcgaaggcgccggacggaagcggcgtgcgccggaagacttcgaagacgaggtccagaaaatggacgaggtggatggcggtggcaagcgcagcaagccgccgtcaccgcagccacacacgccagatattcatgaagctcatgtccctggccgccgcaccaccgtggtggctggtggtggggagcacagcggtggtgggggtgacctcataggagaaatcggtcgggacctgtccatcaactgcctcctccggctgtctcggtcagagtatggctcagtggcatcgttgaatcatgatttccggtctctggtgagaggaggggggatctacaggctgcggcggcagaataacatagcggagcattgggtgtacttctcctgtaatgttttggagtgggatgcctatgacccctaccgcaagcgttggatctcggtgcccaagatgccgcctgacgagtgcttcatgtgctcggacaaggagtctttggctgtgggcaccgaactacttgtgtttgggatggcacatattgtcttcagatacagtatactgacaaactcttggtcacgaggtgaggtgatgaactctcctcggtgtttatttgggtcggcaagcgttggtgagaaggcatatgttgctggtggcactgattctcttggcaggatccttagctcagcagagctatacaactctgagacacatacttggacacctcttcctagcatgaataaggcacggaaaaattgctctgggttgttcatggatggcaagttttatgtaattggcggtgtgacaaacaacaacatggtattgacctgcggtgaagtgtacgatgtgcagagcaagacttggagggtgatcgagaacatgtctggtggtctaaatggagtgagcggtgcacccccacttgttgcagtggtcaagaatgagctttatgctgctgactatagtgagaaggatgtgaagaagtatgacaagcagaataataggtggatcacacttggtaaattgcctgagcgatctgtgtccatgaatggatggggccttgcattcagggcatgtggtgagaggcttattgtcattggtggcccaagaacgccagttgggggaacgattgagctaacctcatggattcctgatgacaagccacctgtgtggaatctgatggacagacggccatctggaaattttgtgtataattgcgctgtgatgagctgctgagttcacttcatcaaggattctgcacagtgatgtttacaaagagaggtattcacaatggaaggcctgtttagcttcagcactccatgagtttctgcctttgacctggtagctgatgtagttggcatcagcagagcagcagcaggatcttgtaaaacttgagttcatacgtcagtttccgccccgactaatccttttctttcatttacatttggatcagtcttaagatctagaagatgataccatgcaaaagatgtcataccaataatctagaaacatcaaatttcggaggccttccatcattgatgatgccatagcaatttgttttgatcatattcccttatctatgtctgcaacaaaagaagtgaccatcttgttattactgtattattatttttgagttatcatatatgttgcactttcattcctttaaaaaaaacctgcccgggcggccgctcgaatgggttccagctaaactgtttgaacagagcatgattataaattggactcctgtttggagtttggactattatcgctttcccttaaaattagatcagataaacatcttgaaagttatcctatggcacacaagcagatattgaatgcatctatttggttcattcaaattgtcgtgaaatattttccttttccttatctgctctgagatcctgtaattgtcatgcacttgaatgctttatttgaacttttgcgtacttgatggttgttttggtcaaaacaactacaagaatatgaatctgttgatttttgtttatggaatgaattggctatttgaaaaacatcaatatgttgagtgaggattatacaaaaaacgagatgtaggtatcattttgatgccaattttttgagtgaggattatacaaaaaacgagatgtaggttcctttctatattatgaaatatatccttgtaatcacagccttaattaccactcaaaacgactactaccttctttccaaaaaaaacttgatgttttaggaatttaaaaacgccccaaaaaacttgctcttagatgatttattgtgcccatatcagcctaaggttacagtatgcatgcctccatgcattccttttaatgaggggtttattccttaataagcatggttcatttttaataataagggtacatgggtaattcctgttgagctctaacctgtcccctaaaatataagtttttctgggatggagattttgcagcatcagaccttcattactgaaacatttaatttcacatgattgttcctcatttcgttttcattagccacataagcatgacattgttttcttgtgtagccagctttatgatgtctgtgtcttttgacctcttttgagtgttcattcaaggtgaagcataatatttatttaataactgacttaacttcacatgattgttcctctacttccttttcatcacccacatatgcatggcatggtttttctgctgtagcgacctgtattctgtttctatgtttttgtgacctcttttgagtgttcatttaaggtcaagcataatatttatttgataactgctgttttacaccttgcagaagctgatgctcatgaactgaatacaaacaaaagatttccatgacacttaaaccagtgactgttgtgagtgctgggttcttttttggacaagtacctctttggactgttcttttttgagtaaggaaaaagggcgctagatttgacatggtaatctgaatttcaaaggattttgattccttgttctcgatggaaatctagctggtttgagatgctcaccagtcaccattttgtttgacaaaactaactggtataatccgttattggagtctgactgcaaaaaggtatatttccatgtgtttcgtccgcagcacagggttattgcacctggtagaaatcaggtgctgttccatcactagttcgacttgagatttgctctgttttttaaagaataaaacagtgaactcttgcaccatttcgcttttgttacatagtgattttctgacttgagatttgctctgttttttaaatactatctgacggaggaatgtaaatgtgcaagttggcgtaaggttctcgactctgaacctctgacattaaccgttctcttccaacatagtgattttctgcactttaccaagtttttacacctctgcagcagctaatcatttttttgctgaattaatagttttttatgcggtagtgtgaactactttttttttcatttttgttgggagtcttaacatgaggccatgacccataagcactcaattgtcgcacatatacggcatatttttattttgctagcgaaggaataccttagtggagaatttcgttgaagatagattaaaaagcgctatctggtggaatagattgaaatgtgtgtgaaaggcaacattggatggtcagtctggaaaagttgtttttgcctttttgcggggcgtggagaagagatggacgacgtaacggctgctgtttctggttttggtttctcatcgtcagcgtcaccatcttttttgtctttatgtttttctcaacctgtttctgagctttcgatctcgtcggcggagccccatccgcaacagaaaaaaggtctacctatcttactgcaagtttatgtggctacataatactccatcctgattcctaattcatacttgagttatagtaggcattgtgaggagtaattagttaattttttattctaatattggtgaacctatatgaattaaggtggctggtttcactttcatgtaagtattttttctatcaacatttgcaaaaagtttcgggtccaactgaacgtgttgtcggtgcatctagaaaagagcacaagaattcatggggctaagaagaccgtaggataaaattaagcaagaccggaaaaaagtagtgttgaatataatttaagttttacatcaatatatgatcagattcaaaaagaaaacaatataaacaaaagaaataaatatatcgctaaatttttgctgacttaattgaagtcagatctatcttgttgaatacggatctcctctaagcgtgagggcactggtaaaggggcagggccaagtgacatcttcggttgagagatatgactcgtgggtttaccaagctcgtcattcgccggagacagtcaaattgtcatgacaagcgagatcagacctgttgggtggaccgacgtcgtgatgatgagcaagatgggggcactgagagtggagtgtggtcgggcggcatcgattgtcggacgacgtcgagaatgagacatcagggcatattggtttgagctgcgtcagaagaa

SEQ ID NO: 13999 - DNA, 1593 bp, Zea mays
  misc_feature (1490)..(1490): n is a, c, g, or t
aagccggccggataactacggccaccagtcttctcccactcccagtgccagccgccttgcgcttgccctctctgcgacgactgggtgcgccgccgccgccgctgtcctacgtcaggtgtcgaagccttcgccggcgaagagcgctcaccagattatccatctactagattcacccctggtggaggaggagaagaaggtaagcgaagatgctacggcggaacatacgtcagcgtcgggagtacctgtactccaagagcctcgagggcccccagcgggcgctgttcgagaagaagcgccggatccgggcggcgctcgaggagggcaagcccatccccaccgagctccgcaacgaggagcacgacctgcggaggcagatcgacctcgaggaccaggagcgtcaagttcccaagagcatcgttgacaacgagtacgctactgccaccattcgggagcccaagatactattgaccacttctcgcaatcctagcgcgcccctaactcagtttgttaaggagctcaaggttgtcttcccaaactcacaaagaatgaaccgtggtggacaggtcatatcagaaattgtggaggcctgccgctcacatgatataacagatcttattctggtccatgaacaccgtggtcaacctgatggtttgattgtctcccatctaccacatggtccaactgcatactttgggttgctcaatgtggtgacacgtcatgatatcaaggacaggaagacgatgggcaaaatgtcagaagcttacccccatttaatactggacaacttctcaacccagattggcgaaaggactgcaactattctgaagcacctctttcctgtcccaaagccagattcaaagcgaataattacatttgctaacagagacgattacatctctttcaggcatcatgtatatgaaaaaccaggtggccccaaatcgattgacctgaaggaggtcggcccccggttcgagttgcggctgtaccagatcaaactaggaaccgtggaacaaaaggaagcgcagagcgagtttgtgctgcggccctacatcaatactgccaagaagcaaaagacgcttggagcgtgagctacactgcagtacagaacttaatttttttttggtcttcatcgtttatgctgtagtagcaacattcacagggtgattagatcaatatctgtcaatctaatagaagccgcaatgtacccctgactcgaacccaagctggctgacttttttttttttgtcaaaaaaaaaaaaaaaaaacggatgtgggttccacatgtcagtcctttgtgtctaaaaaaaaaaaaaaaaaaaaaaaaaaaaaaaaaaaaaaaaaaaaaaaaaaaaaaaaaaaaaaaaaaaaaaaaaaaaaaaaaaaaaaaccggggcggccccactaaagggacaaaaaaaaaaaaaaacacaaattcaatgctcctaaccctttcttttttggggaaacggattgggaaacccttgcccttngtccaacctaattgggttggggaacactcccggtttcccaactaaggggcaagagaaaaaaagcccttcccaacagcttttccttcaataaaaaaaagggaaa

SEQ ID NO: 14000 - DNA, 4127 bp, Zea mays
ctgcagggggcacttttgcgctgtattcattgatttgcagatacgcaaaagttagcctgcttccgaatcagcagcgtgtggatgaagatatttctagttttaggcttaagttgcctactcctgaacttgagcgtgctatctctgtcaaagactgcctagaaaagaagccactcttcaagaacattctcctgtttttagttctgatgggtacctccatggtgattggcgatggcattctcactccgtcaatgtcaggtgttctatattctctttggtcctagttttctccttcaacagatgttatgtaactgctagtaacacctgagccttcttttttttgtgtgtttagtcatgtctgctgttagtggtctccagggccaggttccaggatttgacacaagtttgtactctttgctcaatcccattctagttactacaagaatttacattttgtctttattggtttactgacattaacatttatttatttatttggtagaagtaatataagtggcttattttccattatttcttcccttttcttttgcagatgctgttgtaattgtctccattgttgttcttctgctattgttcagtgtgcagaggtttggaacaggcaaagttggattcatgtttgcccctattttggcattatggtttattaatttgggatccatcggaatatataatcttgttaagtatgacatttctgttgtgagagcattcaatccagtgtatatatatttgtttttcgagacaaacggcattaaggcgtggtcagctcttggtggttgtgtcttgtgcatcacaggagctgaagcaatgtttgctgatttgggccatttctctgtcaaatcaatacaggtagcatttaccgccgtcgtattcccctgcctgctaattgcttacatggggcaagctgcttttttgatgaaaaacccacttgttgtagaaagaatattctatgattctgtaccaggggttttattttggccagtatttgtgattgctacacttgcagctatgattgccagccaagctatgatatctgcaacattctcttgcataaagcaggccatggctcttggctgcttccctaggattaagataatccatacttccaagaaagtgatgggccagatttacatacctgtgatgaattggtttctaatggtcatgtgcatcatcatcgtggcaacttttaggagtaccaatgatattgccaatgcatacggcattgctgaagttggcgtcatgatggttagcactgcactggtgactttggtgatgcttcttatatggcaaaccaacttgttccttgtgctatgcttccctattctttttggtgcagtagagtttgtttacttaactgccgttctgtcaaagatacaagaaggggggtggttgccgctggctttctcatcactgtttctctgcataatgtacacgtggaactacggaagtgtactgaagtaccagagcgagatgcgcggcaagatatccctggacttcattcttgatctgggagccacacttggcaccgtaagagttccaggcattggactcgtgtacaacgagctggtccagggaatcccatcgatctttggccagctattagtcacacttccagcgatgcactctacaattgtctttgtttgcataaagtatgttcctgtcccttatgtccctcttgaagaaaggttcttgttccgaagggttgggcagaaggactaccacatgttccgcagtgttgcacgctatggttacaaggacgttaggaaagaagaccatggcttctttgagcaacttctggttgagagcctggaaaaatttctcaggagggaagcccaggaaattgcgctggaggcgagcacaatggaggcagagcgtgatgacatatctgttgtatccgaggtgcctcagactcctgcaggtgacggggacctgcaaactccactgctttctgaccagagatcaggcgataacaacaggatggccgccacagatggaagcgaccctgtgctcccctccagctccatgtctttagaagaagatcctggcttagagtacgagctgtctgctctgagagaagccatggcctctgggtttacgtatctcctagcacacggagatgtgagggcgaggaaggaatcagtcttcacgaagaagttcgtcatcaactatttctatgcgttcctcaggaggaactgcagggccggcactgcaaccctgaaggtcccccattcgaacatcatgcgtgttggtatgacgtacatggtctgactgggactctgctactgttgcgtcacaggactgtaccacgaatcttgtatggactggtgctgcaccagctcgtagtttaggggctgtactgtggtaccgattacattcattgctgcctctggccatctgcccggaatttgtcacagaaatgactgtatttgttcgatgtgtgattccttccgcctttggtcgtcatgtggtctgtatgatatatgtggatactgtatctgtatgaacaggtatttgtgcaaatgctccttgcatttgttgccccctcaaataatgcagtggggggtaaatgccaaatattgggcttggctccccacatgctaagctgtactgtacataattctttgtccatttcagtttcatgtgtccgacatcttattgagatgatgctgctaaaagatgttccagtacacagatcgcaaatggagtttcagtgctgcatttatagatggccaaatggaccatccggcatgatactagcactattaggcacaagtgtatggttccaacaacagcccatgtggatgtgtctctgtcgagcattatccttggctgggctttattttgctatatatcgggagaatgtcccaatgatttgtcaaccgcgcttttgtgcacctgttcatgaagccaattatccattccagacagcctcacacttacaagttagtactaaaaattttgtcacgtccctctgaattcttcagacagcagtctggagaagacgatgcacttttgcttctccgaggagatacacactgtacttggattcttggaacgatagaggtcacgcgctgaatcaatgctagctccatgtatctaccgtggactctatttgattttctgaactctgaagaccagagagaagtgggagacggtgtggccatatttcaggtgttgttttcagcgtaattttcagccatcatggcatggctgtttaaggttcggttgagtgttgtgctgggactcttcccaataatgctgtcccggtgacagcaatcaatcacacagcgctacgtgcccagttatccgacactgagagtcagcatgccgtgtaaacggccgtgtaaaatattattttacaccgtaaattatactgatttatagagtgcaatttgaaatagagagtgggataaggaatttattggacgttggtctccgcacacattcttggtctcccaagacggggttgccttttcagatataaattggtttacctctgccgttgcgtcctctatatatctgtttcatccatgcatattgtgctgtcaatttattctatactaaatttattctatctgtttcatccatgcaatgttgtttcagataaataaaaatatactggaatggtggttcatcatcccgcccgactgctagtgtccagcttattacacgacgtctcaaggtttccagcgtgttgttgctgtcaatttattctacactaagtccgtttaagtggcgacttggaagaggcaaacaggctagacgattacaagtctacaactttgtttgtccgggacaaaaatatatattccgtcacagtatatgctactaacagcctgagctgcaaggctagacgatgactagcatccaaatccatgctctgattcaccaaagccgagtaaactacccagggtaatttgcaagcaaaaggagagctgtctgtcttctgcatttttttaacaaggctgaaaagggaagcatatataggaggaatcgtgctctctgccggagtctagggatccgttaacctagagacaaagagtccatggatccaggttccaggtcatctgatattataaggccacgcatgtctcatctgcaggcatgcaagc

SEQ ID NO: 14001 - DNA, 3112 bp, Zea mays
  misc_feature (82)..(82): n is a, c, g, or t
  misc_feature (180)..(181): n is a, c, g, or t
  misc_feature (188)..(188): n is a, c, g, or t
  misc_feature (270)..(270): n is a, c, g, or t
  misc_feature (285)..(285): n is a, c, g, or t
  misc_feature (321)..(321): n is a, c, g, or t
  misc_feature (337)..(339): n is a, c, g, or t
  misc_feature (2880)..(2880): n is a, c, g, or t
ggcgccaaaaaaccaaaaaacccgctcccccccgcgggcggggggcggagttccaaaaaacccaccgggcccggcccagganttaccgggccgggaaaaagcggcacggggagcccaaacccaaaaaaaaggggagggaagcccccgccccaaaaggcccccgcaaggggggaacccccnnaaaaaancccgggccggaaacagggcggggaaaagggagaaccggaaaaccaaaccccccccagggaaaccaaccaaagccccacaaanaccccccagcccggnaaaaaaacccccccccaaaaagggaaccaaaacccnaaaccccccacccccnnncccccccaccccaaaaaccgtcgttccccccccccctcgcgtgcgccccctctcccccccccggcgacgacttggcggtccccgctgccgccgtgcccaggcctctacttcgggagttcgggaccttcaccggcgacgagcacccatcgggttgcttcgcaaaacttccaacatccaggatacaattaattacgattccttcaactttatctcgatttataggaggttgcacagagcccatccaacagggtgtctcagacatactgatggatggggtgcccaatatccttgagaaatcatcacatgaatgcatgtactcttggtacttcaccagggaagaactagagaaattttctccatcaaggaaagatggtattactgaaaacaaggaatcagaaattcggcatttatattgttcatttatccgggatgttggcatcaggctgaagctacctcagatgacactagcaacagcagtcatgctttgccatcgcttctatttacaccagtcccttgccaaaaatggatggcagacagttgcaacagtatgtgtatttctggcgtcgaaagttgaagatactccttgtcccctggaccatgtagttagagtggcctatgaaacaatgtataggcgggacactgctgcggctcaaaggatccgtcagaaggatgtttttgagaagcagaaagcgctcattttgatcggagagagattgcttcttacaactattcgatttgatttcaacattcagcatccttatagaccacttcttgatgccatgcaaaatcttggcatcaatcaaaaagaagtgaaacaagtagcatggaactttgtgaatgactggcttaaaacaacattgtgtctacagtataaaccccagtacatagctgctggttccctttatctggctgcaaagcttcacaatatcaagcttcccttgcatggagcgcatgtttggtggcaccaatttgatgttgcaccaaagcctctggaagccgtcattcatcaaatgatggagcttgcggctttgaaaaagttgatgcctgctcgacccaatccggttaagctgaaggaaactttatgtgaagctaaactgagcttatctaatagcccagactctgtgttgaatcaatcaagcttgttaataagcagctcaagtcctgatattggcgagcccagtgacaaagtgcaggtggattcctgccaatacttgataagcagtcacatgggtgattgtagggtctcaggtcctgacagcagttcgttgaatacttgtgctaatagaaatgtctcttgtaaagcacatgatgaagagagcttggatcaggccttaataatcaaacatgacagtgggatgatgccttctagtaatcagacatcattatatgctactgtaggcactgagggcagtgctgaactgaagcaggatgtaagccattgtaatgacttcaatatcagagtcaatgacgaaagcttgaaccaggtgttaagaaatcagcatggtgatgctatcccattacctgacgtggtatcgctggatgccaaggtggacaaggaaaggagttggtgtgtggaaccattaattgcaaactctgattgctgtactgacagtgttaatgtggatagcttgtgcactgatcagagattggctgatgctccttcaggccccacagctgatgcaccatccatgctggccgaggaggaatcttatccttttagtgcaaagcttgaaaatattgatgttgccaggatcaaaggtttattgatgaagaggaagagccggagagagatccaagaccgagccattgcttcagatggtctaagtgaagaagactggatcgagagggagcttgaatctgggattgttacaaaccaagaagccaattgtgctgccatctcagacgagctaagtgacgaagcctggattgagagagaactcgagtcagggattgtggtcggaccaagaaatgagcaagcgatcacttttgatggtttgagtgaagatgattggatcgagagagagctggagtctgggatcatcgttgagccagcacctgctaccaagaagcggaagctggagtcaagctgttagctctgcattcgaaggccagattccaagcaggtgaataataacagatggttgcgagtaggaccacatcgaagccaagagatacatgtcgcacagatgggaggatcaatattatcctttttttttatttctttataaccaaacaccttggagtactttgacacaaggggtgtgttcacagtgggatctccccagtttcttgaatgcagaaccgtatccgttgtatttgttccttcttgtcgtgagtgtaaatctagcgtgtccgaagttcggttttagattgtaggtgtaactgtagcagggattatctggtgttaagcccaacgagaaaatgattcagtgtaactgttactgtaaggaaagaagttattcagtgtagatttatggttaacacaagaggctaaaaaaaaaaaaaaaaaaaaaaaaaaaaaaaaaaaaaaaaaaaaaaaanaaggaaaaaagggaaaaaaaccccggggggggcccgggcccgggggcccggaacccaattccccctaagggggggcgaattaaaattcccgggccggcgttttaaaaccgggggattggaaaaaccctggggttacccaatttaatcgccttggaaaaattcccccttttcccaggtgggaaaaaaagaaaaaggcccgaaccaattccccttcccaaaggtggggcagccg

SEQ ID NO: 14002 - DNA, 3831 bp, Zea mays
  misc_feature (3674)..(3674): n is a, c, g, or t
tacgtagctacaaatctacaatgttataggaatgcttattttttagaatctactgtgttgcatcttactgttacaacttaatcaagtttgactgtttgacatactttgatggatcatcttgcaaattacatattcaccagtaagttctaagttctatagaaatggcttactttactgcatttcttttcttagttttgtaagatatgtttagttcatatttactagatcacttgtccagaagttatctctctgttatcttgcagcccctagttatgtcaaacactagtaggaattcctgtgttattctgtgttcataatatttattactctgtttgaagtacatgatctgtttgtggtttgctcttgtggaccagtagttcttctggaacatacttttatttccttttactagttttaattgttccttttatcattactttatttcagacaattgcaacagtatgtgtatttctagcgtcaaaagttgaagatactccttgtcccctggactatgtagttagagtatcctatgaaacaatgtataggcgggacactgctgcggctcaaaggatccgccagaaggtaccactaaattaatttttgtaactttctgtcgttgcccattcagtgtttgatcagcatctattatacaggatgtttttgagaaacagaaagcgctcattttgattggagagagattgcttctgacaacaattcgatttgatttcaacattcagcatccttatagaccactttttgatgctatgcaaaatcttggcatcaataaaaaagaagtgaagcaagtagcatggaactttgtgaatgactggtatatgataagctttttcaatatttattaacaccaaatatttctaagatagcatatcgggtgtattaattatgctacttatgttcaggcttaaaacaacactttgcctacagtataaaccccagtacatagctgctggttccctttacctggctgcaaggcttcacgatatcaagcttcctttgcatggagcacatgtttggtggcaccaatttggtgttgcaccaaagcctctggaaggtatgtggactattaggtgggtcatatcaccattgcactctttgctttttggaacatgaaaagaagacactatcttcctgcagctgtcattcatcaaatgatggagcttgcggctgtgaacaaatcgaatcctgttcgtcccaatctggttaagccaaaggaaactttatgtgaagctaaactgagcttatctaatagcccagactctgtgttgaatcaatcaagcttgttaataagcagctctagtcctgatattggcgagaccagtgaccaagtgcaggtggattcttgtcaatacttgataagcagccatacgggtgattgtagggtctcatgtcctgacaacagttcgttggatacttctggtaaagctcatgatgaagagagattggatcaggccttaataaccaagcatgacagtgggatgatgccttctactagtaaccagacatcattagatgctactgtaggcactgagagcagtgctgaatatatgaagcaggatgtaagccattgcgatgacttcaatatcagagtcaatgaccaaagcttgaaccaggcgttaagaaatcagcatggtgatgctgtcccattacctgacatggtatcactagatgctaaggtggacaaggaaagtagttggtgtctggaaccattgattgcaaacttcgactgctgcattgacagcgttaatgtggatagcttgtgcactgatcagagattggctgatgttgcttcaggccccacagctgatgtgccatccgtgctgctggccaaggagaattctgatcctttgagtgcaaagctcgaaaatattgatgttgccaggataaaaggtttactgatgaagaggaagagccggagagagatccaaaaccaagccattgcttcagatggcctcagtgaagaagcctggattgagagagagctggagtctgggattgtcacaaaacaagaagccaattgtgccgccatctcagatgagctaagtgatgaagcctggattgagagagagctcgagtcagggattgtgaccggaccaacaaacgagcaggcgatcacttttgatggtttgagtgaaaatgattggatcgagagagagcttgagtctgggatcatcattgagccagcacctgctatcaagaagcggaagctggagtcaagctgttagctctttagctgctgcattcagaggccagattccaagcaggtgaataattacagatggaggtaccctgcgactagggcacatcgaagccaagagatgtcgcatagatgggaggatcaatattttccttttttttatttctttaaccaaacacctcggaatactttggcacgagggttgtgtgtacagtgggatcttcccagtttcttgaattcagaatcacacgagggttgtgtgtacagtgggatcttcccagtttcttgaattcagaatcatatccactgtatctgttccttgtttgtgtaaatctagcatgcccgaagttcggctttaattagattgtaggtgtaactgtagcagggattgtctcgtgttaagcccgacgaaaaaatgattcagtgtaactgttactggtaaccaaagaaaattagttattcactatagacttattgttaacaaaaagaaaaagacaggttactggtgtacgatgtttataaattgatggcgaatgctatgctcaacggagctgatcgcatccgatctcctattgagctgcacgtcgtcgtcaattgtatcctaaattttcgcgtgactgtcacgctgttcatttagggcatgctttcaacctatctggcaaatagtttatcggctgattttagtaccttgaattccaaattagttggctaattgttagctagagggctggcaaattgtttgctatccatgtcgatttctttcctttctctcaacagtaaaaaggtaattttccgacagcttttgccgttggaaataagacttatgccatcgaatataagttatttctgatggtttaggtttttttatgacggcatgagtctgtcgtttataaaaggtcggaaataaacttattttcgacggccgccgtcggacgagcttacgttcgacatccgttagtgatcctcatagttaaaactggttaacggccccgacggcgtccagtgggcccacaaaacaagaccgttagtgactgtcgaagttaaatcctactgcatgcaatgtgtaatgagcctaccatgtttgacttcattggtcataagaacaatagagagcagtgaataatagagagcagagagcgctggccacaggaagacgactgcaggcgaggtcgggacggccgatggttccggggcggctggtgtcgagcggggccaccgaagggatagggcggccaacgtcgggcgatgccggggcagtcaggcgcgggcggggctggggcggccggcgttaaggcgaccgacgacgggcgaggtcggtggcggcggagcgagcacgagcgtatccatgcgtctcgggggcatgagcgtgagtagagagaatgtaacgtgcccacgtcgttccatatatctcgtcactttcgacggctcgatcctgacagtcgttgaacataagcttatgtcngacggtcactgaagatccctcgaaaataagtttatctctgatggctgtcaggacagaccatcagacataagttggcgtccaacttttgtgtgttccctgttgtgtctcctagctaattgtttgttgtgcaggggtaaaatggactatttactgttag

SEQ ID NO: 14003 - DNA, 1980 bp, Zea mays
cggccgggatggaagctgaagaagtagcgtggatttgtcatctcgcgctgccacgtttgactttggacttgctgccacgtttggtagttgctacttgctacaccggaggaagaagaacaagtagtgcttttcttctcttgtcacgttcacggggcggccgatcgaccgttcacctcgcccgacggcccaagcagcccatgtcttcgtcgggcccctccccggcgacgggaatccacgcgtcgccgccgttgggccttttgccggcgacgggaacccatcacaccaggtcatggggcaaaacaacctccacaagttttactggttctaccaccaaacatgagcagagcttgcatggaaatgttaagccgttgcaattggcggcaaatgaatcctctcgtttggcttacagaagtccagcacttaaaaaccagtggaatcttcctgctagttcttcctccactaatgtggttaccacctttgatgataacgaacacgtgtcttccagtgttattgaagaaaaagttggagtactgttattaaaccttggtggtccagagacacttgacgatgttcaaccatttttattcaacctatttgctgatccagatatcattcgactccctaggctcttcaggtttcttcaaagaccactggccaaacttatttctacttttagagctcctaagagtaaagaagggtatgcttcaattggtggtgggtcgccgttaaggaaaattactgatgaacaggcgaatgctttgaagattgccctggaaaagaaaaaattgaacgcaaacatatatgttgggatgcggtattggtaccctttcacagaagaggccattgatcaaattaaaaaggataagattaccaagctcgttgttcttcccctttaccctcagtactccatatcaacaagtgggtcaagcattcgtgttctccaagacattgtcaaggaagattcatatttttctggtttgccaatttccattattgaatcatggtaccaacgagatggctatgtgaaatcaatgtctgacctaattgaaaaggagctctccgccttctccaatcctgaagaggttatgatattcttcagtgcacatggtgtgccacttacctatgttgaggatgctggagatccttacagagatcagatggaggattgtattgctttgatcatgggggagttaagatcaagaggaatcttaaatagtcacactttggcgtaccagagtcgggtggggccagttcaatggctgaagccatatactgatgaagttttagtagaacttggtcaaaagggtgtgaagagcctcctggctgttccagtaagctttgtgagtgagcacatcgagacattggaagaaattgacatggagtacaaggagttggctctggaatcaggcatcaagaactggggtcgggttcctgctcttggatgcacttcaacattcatctccgaccttgcagatgctgtcgtcgaagccctgccctctgcttcagcgctcgcgaccagaaagcctgacgacatcgattccagcatggacctgacgcattacctcaccaagatgctgtttggctcaatcttggcatttgtcctgctgctatcaccaaggctagtttccgccttccggagcaccatgctttaagtttttctccaaagcactaaatttgagattgagaatgagatatttcattttggacctttttttcctccttaatagaatgatgtgcagttcttctgctcgttccagagaaaaaaataactgctaggaactcacaaggtagtaggggattgcaaaagggatgtgaacagctgttttgatcgaagttgtctataaataccgtgctcacggactctgtattttaaaaaaaaaaaaaaaaagacaaatctagatgttcttgtccaaaacaaaaaaatataaaaaaaacttcaaaaaaaacggtttttatgggcagcggatttaaaaatatcaa

SEQ ID NO: 14004 - DNA, 1732 bp, Zea mays
aaatagcaatgtattttctcctccataaatcttctataattttcttatcactaaaccaatcccaaaggctagtttagtaacaccattttatcaagggatttttatttttctaagtttattttcccatagaaaaatagaaattacttgagaaaatagaaggtgttccaaactagccataaattagaaaatccattgatattcaacctcttcaaatccccggtcagccccgacgccgccccgggccacgcctcccggccttcgtcatttcgggggctgtcgactgacccagcaggccagcatttcttcgtcttctcgttcacgcaatcacgcccccgccaaacccaaaccgaccgaaagcggaaagcaaatagcagacggcagacaacagtcgaggggacacaggaaggcgcgaagaagaccgagatcctcgcccaacgccatcacgccactcccccaatactcaggtgtcaggacagcgagcaggcacaagcagatctcactccacgttgctccttccgcccttcctctccgccgctccccggaaggatcatggagcgcgggattcttggctccaggggcgccgtccaaatcttggggtcgaagaccggggccgcgatgtcatgtggcaaaacaacctctacaagttttacttgttctaccaaacacgagctgaacttgcatgtgaatgttaagccgttgcaattggcaacagatggatcctctcgtttggcatacaaaactccagtgcttaaaaatcagtggaatctttctgctagttcttcctctgcaaatgtggttaccacttttgatgatgacaaaggtgtaccttccagttttgctgaagaaaagatcggagtactgttattaaatcttggtggtccagaaaccctagacgatgttcaaccattcttgttcaacctatttgctgatccagatatcattcgactgcctaggctcttcaggttccttcaaagaccactggccaaacttatttctacttttagagctcctaagagtaaagaagggtatgcttcaatcggtggtgggtcaccattgaggaaaattactgatgagcaggcaaatgctttgaagattgctctggaaaagaaaaaattgaacgcaaatatatatgttgggatgcggtattggtatcctttcacagaagaagccattgatcagattaagaaggataatatttccaagctcgttgttcttccactctaccctcagtactccatatcaacaagtgggtcaagcattcgtgttctccaaaatgttgtcaaggaagattcatatttttctggcttgccaatctccattatcgaatcatggtaccaacgtgatggctatgtgaaatcaatggctgacctaattgaaaaagagctatctgccttttccaatcctgaagaggtaatgatattcttcagtgcacatggtgtgccacttacctatgttcaggatgctggagatccttacagagatcagatggaggattgtatttctttgatcatgggggagctgagatccagaggaatcttaaatggtcacactttggcgtatcagagtcgggtgggaccagttcaatggctgaagccatatactgatgaagttttagtagaacttggtcagaacggtgtgaagagcctcctggctgttccagtaagcttcgtgagcgagcacattgagacactggaagaaatagacatggagtacctcggccgcgaccacgcta

SEQ ID NO: 14005 - DNA, 2152 bp, Zea mays
cagtgcggatactgaaaagtgctgcctggcctgcagtgctgcatctgcatgccatgccaactgtctatatatagcaggccacggagcttcacacggcaggcacacaccaggcaaggattgcattgttagcatccatcgccggtcgccatatcgatctgtggacgaagctactccagatggatcggttggcgccgcctgtcgccgtggaggtgccggtggtgcatcgacagcaacagcagcagttcgtccatcactcacaggtccaccagcagcaacgtacgcaccagcagcagcagcaccagaacggcggcggcagcaagcccggcggccgcaagtgctgcccgctgcgccggtcgcgcaaggggtgcatgaagggcaagggcgggccggacaaccagcagtgccctttccggggcgtccgccagcgcacctggggcaagtgggtggccgagatccgcgagcccaaccgcggcgcacgtctctggctcggcacattcggcagcgcgctcgaggccgcgcgcgcctacgacgccgccgccagggcgctctacggagactgtgcgcgcctcaacctgcagctacctcctccctcggcggctgcaggaggaggaccggcaatcgtggcgtctccgtcccctgacaccgtggctggccctgctgctgctgctgctggcgggcacagccgccaccaccagtacctgcagcagcagcagccctccatggcggcgcctatgatgatggtgcactcatcctgctgctccgccgacgcgtcgtcgtccaactccgactccaactccaactccaactcgtcgccggtgaccatggcggccgcggcaacctcgcccacgtacacccaccaccagacgacgttccaaatgccgccgccgccgccgtcttcgtgcggcgtgatgatggctgccgtccagggctgccacgtcgacgacaccaccaccaccacgatggcgatgcagcgccatcagcagatgttgcgcgagctggcggcggctcctctgcatcaggaggcagatgacttcgaggacttcatgacgcggctgcccaaggctgaggacttcggcctgcagggcttccaggaggtgcctcccgaggtgttcgacgaagccgccggcatctgggaccacacggccgcctggtcgtcccccaccatgatgatcgactccgccggcgcccagcgccagcaggtcgtcgattcgtcgtccctcttcaactctcgttgatcgatgacgccgtgcgccctgcaccagctacttcgttgctagctgcatcgagagctgccagtgtacgtggcgaagcgagtcgatgcgcgggcccactggttcgtgagttacttacacatcaagtctcaagacgtaccagatggtggttactcgtgggttttatatttggataatgtttcatatttgtaaaatatatatactatagtagtggtgtcttaaacatatatactttgatagctatatagtcttttgggttcgctatctgcatgagcggctagctacctcttgtacagtactaccatatatagatatatcaatttcgtttttcctgattaaaaaaaaaaaaaaaaataaaaaaaaaaaaaaaagttttgtaataaaatatatactcttgtcctaaaatatactcatacagtctttaggtttgtaatatacttgtggtatatgggcggctagctagatttgtatattatacgtgctacgtagtacccttttcgtttcaaatccggaaaattctaagaagtagtactctttccgttcgaaattccgaaaattctaaggggccctttggatcctgaataaatttactcagcatagtaggttatttacgctttctaaagtttgtaaagtttagatatatctctattccaaatttataataggggtggaaattgatttttatgtatcgacagtctatatgtttccactataacttataacacgtttatataaatggtagtatataaatatattatactccatccgactcaaattaaatctcgttttactttttcactgaattcatacaataattaatgcatgtgttatatatatatatatgtctaggttatcatctatatgaatatgaatataaaaatctatagctaaaacgactactatttagaacggatgcatat

SEQ ID NO: 14006 - DNA, 3815 bp, Zea mays
tgcctactgtcacacaaaaaatacagtatattattactgatggagaaaacaaggaaggatgggccggatggggatggccgagggcaaagccgtccgtcagtccgtccttgttgcgtgtgcgtgcatacggagaccggagtcagcggtatgatgcaggcaagcagaccattgcacacgcagatacagatcccagccgagcgtccagctgccaagccatgcatgtggctcgcggatcggcgcagtccatggatagatggagatggatccatccatggatagatcatagatagatagataggcagcccatggccgtggctgcatctgcgggctgggcgggctgcatcagcgtgacgccgtgacctcaccctggttcggtcgccccccggccgccacgtggcccagcggccatgacgtggaccccacaggggcttccatgtgtcaagccccgctggcccccaccacttcgtgtcacccgcctccttcacttggcgtgccgcacccccacgcgtggccccacgcccaggccccgcatccctacacggaggcgtcatgcagtgccatgcgccggcttcccccctgccccctccgtccgcccgccttcattccgcacaccaccgaaaactggtgcccggcctgcagtgcagtgcaagccatgccagctgcctatatataccaggccagggagcgggagcctcacacacagtcacagcacacgcagccaccgaggactgcattgctagcatccatcgccatcagtcgccataccgcgccgcccgccgccctagcggtccgcatggatcgggtgccgccgccggtctccatgcaggtggctgcgatgcagcgacatcagcagcagcagcagttcgtccaccacctgcagcaggtccaccagcaaggtacgcagcacgagcaaccgccgccaccgcaccagaacggcagcagcagcagcggcggcaggaccggcggcggccgcaagtgctgcccgctgcggcggtcgcgcaaggggtgcatgaagggcaagggcgggccggacaaccagcagtgccccttccgcggcgtccggcagcgcacctggggcaagtgggtggccgagatccgcgagcccaaccgcggcgcgcgcctctggctcggcaccttcggcagcgcgctcgaggccgcgcgcgcctacgacgccgcggccaggacgctctacggcgactgcgctcgcctaaacctgcagctagtgcctccgtcggcggctgcggcagccgccggaggaggaggaccggcggtcgtcgcgtctccgtcccctgacaccgtggctggccctgctgctgctggtggtggtggtggacacaactgccatcaccagtacctgcagcagcagcacgccatggcggcgcctatgatgatgatgcactcctcctgctgctccgccgacgggtcgtcgtcaaactccgattccatttccaactcctgctcgtcaccggtgaccacggcggcctcgccagcctacagccaccaccagacgacgttccaggcacctgcaccgccgccgtcatgcggcgcaatgacgatggcggccgctgcgccgcatgtgcagggcttccacgtcggcgacgacgacactaccaccgcgatggcgatgcaccgtcatcagcagatgatgcgcgagctggcggaggcgcctctgcaccaggaggcagacgacttcgaggacttcgtgacgcggctgcccaaggcggaggacttcggcctgcagggcttccaggaggtggccctcgaggtgttcgacgacgccgccggcatctgggaccacgcggccgcctgggagccccccaccatgatgatcgactctggcgcccagccccagcagcagctcgtcgtccctctttgactcgctcgtcgatgacgccgcgcgccctgcaccagctactgcttcgttcccagctgcatcgaactggccggtgtacgtggcggagtgatacgacgcgcgcgccatgcatgacaccactgcacaggtggttcctgcatgtgttgcttacgcctcgagacgtacgtacataataccagtatgtatgtaccggatggttactctgatatgactgtatttctcctagttattcgtgagtttcatttggataatgtttcaggttttgtaaaaaaaaaaaaaaaatagtagtggtgtcttaaatatatgctcctagctatatatctagtctctgtgtggtatatgcatggccgctagttagcttgtacaatattaccatatatagatatattaatttcgcttttactaaatatttatggtttcatttaatttgattctgtttcaggttttgtaaacaaaatatatgcttcagtggtgtccttttgggtttgtactatatgtgtggtacatggaccgtcgcagctagctttgtatattttacgtgctaccagtactctctttatttaaaattcaaaattgtaaattgtcctaggcttttttaggttttaactacatatccaggttcgagagctcggcgttttgtcgagggcaatcgatcgagtgctcgctcgagtgctcaggttcgagcgctcggcgttttgtcgagggcaatcgagtgccaccctcggtgaaatataatatgattcgacatagacattatatactcgacgtagaaagacactcgtgtcaaaccttcggcgaaacatgaccttcgacaaagaattgtctaatcgttaacttcgccgagtatcaatatgcaccttcggcgaaacatgaccttcgacaaagaattgtcgttaacttcgccgagtatcagatattgataactcttgtcgaaacgtggcaccgtcagtagtcgttcatagttgatgatcgttaacttcgccgagtgtcagatattgataactctcggcgaaacgtggaccttggtaaagagccgtcagcagtatagttgagttgactaccgttaactttagcagcatagttgagttgactaccgttaactttgccgagtgttagacgttggtactcgacaaaatatcttctttgtcaaatgtcaccagtactcgataaaatatcttctttgtcaaatgtcaccacggaaacactcggtaaacctatattttatcgagtgtctttccttgacactcgacaaagtatatttgtttttccccaaactttttatggtgtgtttgtacaatatgtagacctatatgttcaattttggcacaattatcaaagtgtttgctataacaattagatttagttcgtttaattgaatttcttcgggtaatcactacaacacatagggccttttatgacaaatgctcaatgacaatagtagaatttgtcactagatgactatgtttatgacgatttctaggaagcaaagcaatttagtaacgaaaaattgagcctcgtcataaaaaatgtcataactgtttgtagcatcatgtttatgacaatatgttatgacaatatgggtgcgtcatatgagggaatcgtcataaattgctatacatcatacgtgatgacattgcatgacgacacatgtttgtcataaatatttgatttagttttttttaaaagaaatgctatatatattccatgttgggactatttcttttctttgggtagtaaaattatttctttgtagtagtaaaattaggttgaaaacaattcaaatgaaaagggtgccattaatttaggtgttgtggctgcgttatttttcttaaaatgcaaaaaaacatgaagtaaccaagagtcgaacctgtgatctagagtaccatgagtacaactttgaccactaggctattaatcaatatttatcaaccagatggaatat

SEQ ID NO: 14007 - DNA, 461 bp, Zea mays
tccattgatgagagcgtccacgtcaccagcaacgcgaagcatgtagcccagaggagcccgtgcgtgtggaacggcatgaaacggccctgctacctgttcgcgcgcaagttctaccccgaggcgcttggcaacctgatgaacatattctcgaacttcaccgtcatctgagcagctgaatggaggcaggaacacagctaagcaactctgtcggatcagagtccagacgtcgccaactacctgctgccgcaactctagtagatagattgctggtgatggctgctgagctaaggttatttgccagctcttgagacggcaagttttgctggtgtggaacgatggctaggttggtgcgatttgcgaatgtgacgtgtggacttctgttgttgatactgctgcagatgaattgtgattaaattttatgatctttcatctaaaaaaaaaaaaaaaaaactcgagcccgg

SEQ ID NO: 14008 - DNA, 2613 bp, Zea mays
  misc_feature (3)..(3): n is a, c, g, or t
agnatggagaaccccaactggtccatctccgagatctcctcgccggaggacgacgacgaggacatcttggccgccgccgccgccggccgccgcaacaaggggggccgcaccaagaacgccaagcagatcaggtgggtgctgctcctcaaggcgcggccaggcgcagggtggccgcggggagcaccgacggccgaggccggcgtcgtggccgccgccggcgagagccccgtggtgcgctccaggttctacgccttcatcaaggccttcctcgtcgtctccctgctgctcctggccgtcgaggtcgccgcgtacttcaacggctgggacctcgccgcctccgcgctcgcactccccgccatcggcctcgagtcgctgtacgcctcctggctgcgcttccgcgccacctacgttgcgccggggatacagttcctcaccgacgcctgcgtcgtgctcttcctcatccagagcgccgaccgactcatccagtgcctcggctgcttctacattcacatcaagcgcatcaagcccaagcccaagtcgcttgcattgcctgatgcggaggacccggatgccgggtactaccccatggtacttgtgcagataccaatgtgcaacgagaaggaggtgtatcaacaatcaatcgcggccgtgtgcaaccttgactggcccaaatccaacttcttggtccaggtgttggatgactcggacgacccactcacacagactctgatcagagaagaggtggccaaatggcaacagcagggtgcccggattgtgtacaggcaccgtgtgctgagggatggttacaaggctggaaacctcaagtcggccatgagctgcagctatgtgaaggagtacgagtttgttgccatctttgacgcagacttccaacctcatcccgactttctgaagcgcactgtgccacatttcaaggacaatgatgagcttgggctagtgcaagcaagatggtcctttgtcaataaggatgagaacctgctgactcggttgcaatatattaacctttgcttccactttgaggtggaacagcaggtgaatggagtgttcttaaacttctttgggttcaatggcactgctggggtgtggaggatcaaggcattggaggactcaggtggatggttggaacggacaaccgtggaggatatggacattgctgttagggcacatctccatggctggaagtttatattcctgaatgacgttgagtgccagtgcgaattgcccgagtcttatgaggcttacaggaagcagcagcatcggtggcattcgggtccaatgcagctattcaggctttgtttaccggacatcatcaaatgcaagattgcattttggaagaaggcgaacctgatattccttttcttcctgctccggaagctcatactgcctttctactccttcacgctgttctgcatcatcctcccgatgacgatgttcgtgccggaggccgagctccccgactgggtggtgtgctacgtcccggccctgatgtccctgctgaacatcctgccgtcccccaagtcgttccccttcatcatcccgtacctgctcttcgagaacaccatgtccgtgaccaagttcaacgcgatgatctccgggctgttccagctggggagcgcgtacgagtgggtggtgaccaagaagtcgggccgctcgtcggagggcgacctcatcgcgctggccccgcccaaggagcccgtgaagcttcacgcgacgaggacgggctccgcgccgaacctcgacgccgtcgccaaggaggagcacctggcggcggcatcgaggaaggacgctgccgccgccgccgccaccgtgaagaagaagaaggagaagcacaaccggatatacaagaaggagctggcgctgtcgatgctgctcctgaccgcggccgcccggagcctgctgtcgaagcagggcatacacttctacttcctcctgttccagggcgtgtccttcttgctagtaggccttgacctcataggcgagcaggtcgagtgaaatgtgtaaaacaggaaattgataggtgtggggaaaaaaaaacggtgagtcaccatggatggaagtgctgggagaggagggggatgtgttatttctggctggctgccatggcacggcggcatggcatggcatggcagcagctcttgggcgcttcttggctgagattcggaacatgcgtcgtgcggttgagccttcccggatctgtcctggctgcacggcatggtatcccacacgtgagagagcaacctcctccgcctgtacggaggtgtagatacagttttctcttgttttttcatgtgtgtgggcctgttcgcctgtacgaatggtgaaggtaaacagagagtcgccgctggattagggagacgcccgtgtacttgctgctggacgctgatctgttgcttgctgctccacttgtgcgcacaagtagggagtagagatccagatcccgcgctcgtccgatacgtgtttgttgtacctgccccccgtcccacgctggggaaacctgggagttgtcgagcgcggtgtcacatgattggaagatctgtgtctccttcatatgccccgtaatcattgtggatcaagattacttccagcagcgggtca

SEQ ID NO: 14009 - DNA, 306 bp, Zea mays
agcttcacgcgacgaggacgggctccgcgccgaacccccgccctgtcgccaaggaggaggggcagcagcagcagcagcagcatctggcggcggcgtcgaggaaggacgccgcggcgaagaagaagaaggagaagcacaaccggatatacaagaaggagctggcgctgtcgatgctgctcctgaccgcggccgcccggagcctgctgtcgaagcagggcatacacttctacttcctcctgttccagggcgtctccttcttgctagtaggccttgacctcataggcgagcaggtcgagtgaaatgtgt

SEQ ID NO: 14010 - DNA, 2254 bp, Zea mays
  misc_feature (6)..(6): n is a, c, g, or t
ctctgnggactgcgggcttaactccctggcaccggggttaacacgtgcatggcggcgtggaggccaggccatgctttcggttcgggttcgggctctccgttcctaggcagccgagattagaagagctccgattcctggcgcgaaaccgctacaaggtccgctgcgtcgtgattgccaagggacggggagattcgatgcgctggcggcggcggccggttacggcggagagtgcgagtgtgagctaatgttaacgtgaccaagttccacggaagtttctaaggtttgacagatgaagtgctgtcaggatccaagaacaaataacttgatgggcggtttaacaaggtaacacctaatctaccacacccatgagtaattcacccctgtcacgtcaatgtcgtaccacatgtctgatgtggcatccttacctctaccaaaatggttcaaaccccacctgtaccatggcagtaacacaaggaaaggagcagtgcatcaagacaacaagtgatgacgtccactccatatcataatcatcacagtaccgccatgaactccacaggatgccacccctcagccgaaccataaaaaataaaaaagctctggaagcgactggatccacacaatgacacacagccatatagaaatatcacagccttcccccgctatcacactcacaccctgctctgtttccatataagtagcccactctgctcccgcctcacgccccccccgcccgaacacacggtccaagcacatcgacacacacgagcacagaagagaaacgggcacacgcaactgatcaaggcaaccaatattcaccgtcggcaatgggcgacctgatccctgggctgccggatgaagtggccagggagtgcctcgtccgggtgggcttcgaccagctgccggtggtgcgccgcatctcgcgccagtggaagtcggaggtggagtcgccggactaccaccgccagcgccgggcggaggggctggcgcgcccggtgctcgcgctggtccaggcgcagccgacagcgccgccggatgacgacgacgacgccggccccgcgcacaagcgctcgacggcggccaactcgtaccggctggtgctgctggaaccggccgagggacggtggacgccgctgccgcccccgcctgggccaagccagagcctgcctctgttctgccaggtggccgccgccgtggacggcggcgggcaggggaggaagaggctgctggtggtggtcggcggctgggacccggagacgtgggcgccgacggacgcggtgctcgtctacgacttcctgtcgggcgcgtggcggcgcggcgcgcccatgcccggcccgcgcaggtccttcttcgcctgcgcggccgtgggcggcgccgtgtacgtggccggcggccacgacgccgagaagaacgcgctgcgctcggcgctggcctacgacccgggcgccgacgcgtgggcggggctcccggacatggcggaggagcgcgacgagccgcgcgggctctgcgtcgccggacgcttcgtcgtcgtcggcgggtactcgacgcgggcgcagggccgcttcgtcgcctccgcggagtccttcgacccggcggcggcggcgtcgcccgcctggggctgggcgcccgtccacgaccgcctgctgcccgaggacggcgcgtgcccgaggacctgctgcgccgcgccgcggtccgtcggccgcatgtacatgctccgcgacgggcacctcgtggcgcgcgacggcgccgcggcgtggcgccccgtggcgcgggtgccagacgacgcgctcaccgcgccggccgtctccgccttccctgacggccgcgtcgtggtcgttgggtccgggtgccacggcggggaccagaccgtgtacgtgctccgcgaggagggcgggagacctgcgtcctggtcgcgcgcgccgccgccgccgccggagttcgccgggcacgtgcaggcctcctgcttccttgaactctgaactctgaagtggagggtgtgtacctacacgtacgtggtggctgtgcatacatgacggaactacgctaccgtacttgttgtgccactgctgcagtgctgctagtctgctactcatcacggttgtatatacttagcaaataaatcatcacggttgtatgtacttagcaaataaagcagcggaacgggaatgatgtttattaaagaacatttccaggctagtgtaattaattagcgatgtcttcgttggattggatcacaatttgtttgatccgatctgca

SEQ ID NO: 14011 - DNA, 839 bp, Zea mays
  misc_feature (811)..(811): n is a, c, g, or t
gccggcccggccccacagcccaagcaagctcattcatcacagacgtaaaacacctatagagggctcaaaggcacgcgcgcgaaacgcggagcgaagagaagccaagggaggctgttcttcatcatggtcgcatatgcaaccacgtcatacgtcgcagctcaagccctggcgagctctttgcagccgcaggtggtggccgccgtcttcttcacgtcggccgcgtgcacggtagcgctcgccgtcctcctggcctcgctgcggctgcggccgccgtggtggtgcgcgtgtgcggtgtgcgaggcgtacgtgacggcgtcgtggacagccgagttcgacaacctctgcgactggtacgcgcacctcctgagccgcgcgcccgggcggaccgtgcacgtgcacgtgctgggcaacgtgctcaccgccaacccgcccaccgtcgaccacatgctgcgcggccgcttcgacaactaccccaagggcgcccccttctcggccatcctcgccgacttcctcggccgcgggatattcaacgtcgacggcgactcctggctcttccagcgcaagctcgccgccgccgagctcgcctccccggcgctgcgctgcttcgcggcgggcgtcgtggcctccgagctgcggtgccggctcattcctctgcttcactctgcggccggcgacgagaagctgctcgacctccaggacgtgttccgccgcttcgccttcgactgcatatgcaggatctcgttcggccttgatcccggctgcctggagctgtcgctgcccatgtcggcgttcgcggacgcgttcgacacgncgtcgatgctctccgcgcggcgcgcgac

SEQ ID NO: 14012 - DNA, 858 bp, Zea mays
cagtgggtaccgcgtcgccccggcccgacgattccgatcccttcgcgtccaccatcccgtctcgctatcggtctcgcgctccacgccggcgaccggagaaggggccgcgcatgtgacgcccacggcgacggagacggcgaatccctcccctcccctcccctccggtgccgccttcagccgacccgcggcgacgtgccaggattgaaggggggatgagaaggtggacatcgttgctctagtgatttgatcaccagagatggtgttggtggtgaagcagcatcgctgcacgcactctgtgagctgtgtttgcatcaagggccatctcagtgaggatgctctgttcctcgtcttccgccacatgaactggaacccaaggctgattgctatcctgtcatgtgtgtgcaagtggtttgacgaggttgccaagcaggtgctgtggaaggagttctgtcatgcaagggcttcaaagatgatgctggatttgcattcaggtggtagccacattgttgatgggaactggaaagcgctggggaagctgctcatctattgcaatggctgcacaaaaggggggctcttcaataacatccatgttccaggccattttgtgttcaggacacgcttttctaggactgcgggcaggagtttcctgcctctgccatgcaagtcagacgtgttgtatgtgtcagatccatgcgagcatcttgatcaaggggaagaaggcgacttaggtttctttcgaggcatctttaagtcattcgccacttcaagagtgaagaagatgttgattgagaagcgggctaggtttcatcccagggagttgtgctcttatttgtaggcgaggctatggaaacatgttca

SEQ ID NO: 14013 - DNA, 1547 bp, Zea mays
ggttctgcccctggccccctcgcggcgcacgcacccgtctggtggccggcctatctggtgcggtgcggcgcggctcgatccggcccgacgattccgatcccctcccgtcccgtccatcccgtctcgtctcgcctcgccctccacgccggcgaccggagaaggggccgtgcagcgcaggcgacgcccacaacgaatccgtccccccgcgccggcttcgcccagccccgcggcgacgcaccaggattgaaggaggcatgagaaggtggacatcattgctatagcgatttgattactggagatggtgttggtggtaaagcagcaccgctgcacacactctgcgagctgcgtttgcatcaagggccacctcagtgaggatgctctgttcctcgtcttccgccacatgaactggaacccgaggctgattgctatcttgtcgtgtgtgtgcaagtggtttgacgaggttgccaagcaggtgctgtggaaggagttctgtcatgcaagggctccaaagatgatgctggatttgcattcaggtggcagccacattgttgatgggaactggaaggcattggggaagctgctcatctattgcaatggctgcacaaaaggggggctgtttaataacattcacgttccaggccattttgtgttcaggacacgcttttctaggactgcgggcaggagtttcctgcctctgccgtgtaagtcggatgtcctgtatgtgtcagatccatgcgagcatcttgatcagggggaagaaggcgacataggtttcttccgaggcatctttatgtcatttgccacttcaagggtaaagaagatgttgattgagaagcgggcgaggtttcatccaagggagttgtgcccttattgtaaggccaagctatggaacatgtttcaggaaaatatgatcccaaggagtgcttccgcaaggctgggtgcctatgatgactctgtggagtattttgtatgcctgaatggacatgttattggactcggtaccctactaccactctcagactcagaggaggcagcagatgagtgatcatcaagaacatgaatcaggtttagaagattgaagcccagggcttgtgaaatggtactgaatcttggttgtgactagcagataatgacattggttctgcaaactgttgcacgacaggaacctgtgatgggatctgcatcgaactgcagctgtgttcttcagggggtgccttgcatcagattgaaaaaaagagctactttatagtgcctctcctttatttattgatatgtcattacttgtttttgtaactgcaatcaagatactgggacgctacccgcttgcctgtttagacatgttcacatcatgtgtagtgaggtgttttatttaacgagatgttaaatttgtgctcatgatattcatgtgctgttatctttaaaaaaaaaaaaagccaaaaaaaaaaaatcaaaataagacggcctgtggtggatatgttgtctctaatctagcagcaggtcttgagttcgagattttatttttgaaaaaaaaaaaaaaaaaagcggcc

SEQ ID NO: 14014 - DNA, 2397 bp, Zea mays
attgggtagcacgagaccattacctagacccccgggatcgccaaaaacccgaaacccactagtaccgccacacgaattcccgaccccgatggcgacatcgccaccgcagaaccctagctccggcgagccctccgatgcgtcgagcctcgcagccgcggcgctcgaggcgcccgtgcgcgtatggagatccctcgtcgcgcgcttccctcccctcccggactcctccagcttccttgctggcgtctccgacctccagctccgctacttcggcaacagccggccccgccgccgcaggcgctccgctctacctctccctctccgcccggtggccgcgcactctgctcggattgctggtgagatgcccaaagcctttgtgatcttagatgatgttgtgcaacacaccctgactaatttgcacagtattcacaaaagcttactattttggcaggccaaggctgagggaacaaattctcagaaagtgtactttatgatatttgagagaggtccaagggcctttgttgatgcaacatatcaaacactcactagactcgggagcaatggacgccctgtccaatacattttgcattctgcatctgatatggtgtcaacaaaactcgctgccctgacaagtatgcaacactgcttggccgcttttcttgcagaggttcattctgaagttgataaatgcagggaaggattaactgaaaactcagataaatcgctacatacattattcattgttttgaataccacattctccaagttggaggtatcacttagaaatgcttgtgagggtcaagatgaactatttatagatgatggaaacttgcatgaactgtttgggaaattaccagaagttgatgtagagagttcagaatggacagaggccttggcaacagatggtacaagtttaatctatcaaaaccttcagaagctagatagttttctgtcctctcagctctcaagccataaaagaccaaacaaattgaccatatattggttaccctatacatgtggagcagtaggtctctctgtgtgttctctgtggcttttacgccatagcagtttgatgggaagccctgatatcgacaattggattcgagatgctaaggagtctgtggctggattttgggatgaacatgttgagaaaccaatcatttccattagagatgagcttttcgagacattcaagcaaagagataaaggtgtaatggaaaagcaagaggtccaactaactgaagattcattgcgcaggatgttagttgccttttgtgagcaaacagagggtcaaaagttgctggaagatttaccagtgcaggcgatgttggagactctcacaaagagatacgagaaggaattgatacacccaattcaaaacctgttcagtggagaattagcccgtgctatgcttattcagattcaaaagcttaaactggaccttgaatcgggactactggaaatggatcagattctaagggcaaatgctataaactttgctgttcttgcagcgcttcctgcttttggtctttcacttctgttgcttgtgttactgcgagcatgggttcagcgtgaccatggtgctgagggaagaggtaatattgcacgatgtcaacggaggctgcttcttgttgatgtagagagaaggcttatggagtttcaacattacagggataatggaatggaggaagaggcacggtgcaagtttggcttagtactttacacgcttgatagactctgcaaagctgttgagtcacacgcaaaagaaacaggcgaatggttaagcttgagacaagatatttttgatctgtcgaagctcgacatgggaatgccagataagatgattgtcgtttcacggttgaagtggatgtataactgcttgcttccattctcatcgagccgtttgccacgcctctagagcagtgagcaactggacgtcgtgtgttgcattttggataaagattttgacacggatacctggaactctatgtcggaaggatggttctttcatgcccacaagatgttctgtagattttagcagagctggatgaagcatatcggaagggggcagattgggtggatgcagtatccatcgagccctccgttgacaattcttgcattgctaggcatgttgatttggattggctgttgcaccgaatggtttgcgtcgatgggctacatctacatgtgtgcgagcattgtaccctttggccttgttccacttgcaattccaattccaatggttgttccatatcccatactagttcataagtcataacatgacaacagaatgctcttcttttatctattccgcagagatgggtacaatcttatttaactgtttcatttgaaaaaacaagaaaaaagtcctgtgccaaaaaaaaaaaaaaaaaagcggcc

SEQ ID NO: 14015 - DNA, 866 bp, Zea mays
  misc_feature (824)..(824): n is a, c, g, or t
cattgggaccttctcccttgatcggcacagccacaacctccttctccaatactctctccctcgccgccggccacctccgcctcctcccacgcgccacctccgcctcctcccacgcgccacctccgcgacaaaccactgaaggagggagaggactcgctcatatcgtccgatggaggaggactcgatcaaggggatgatctccgcgatatcctgggtgcccaggggcgccgccaagagcgtgcccgtcgttgccgacccgcccactcaggaggagatcgccgaggccatgaagaccttcgacctgggcagagactccgggagcgacgctgacgaggatgatgatgctgccaccatggaactcgacggtgcggcggaaacggtggaggaggttgatgaggctgcccgagccaaggccgtagccaaggcgctctgcaagggctctagcaaggcggacgacgtcgctgatgagctccgcgaactcaacatggacgcgtacgatgatgaagatgaagaggtcgatattttcggctctgggctgggggacttgtactatccgagcaacgcaatggacccatatctgaagaagaacaatgaggatgatgaggaggacgacgatgatgatgaggaaatcgaagataagatgatcatgcctactgattttgttattgtctgtgcacatagtgaggacgatatcttctctcttcaggtcaacattcttgaagaaacaaatgatggtgaacaaaatatctttgtgcatcatgacgttcctctcgctgattttccgctatgcacagctttggatggattttaatctgaaaggtggntgaaaaaaggaaaatttgtagccgttgggaaccatggatcct

SEQ ID NO: 14016 - DNA, 2046 bp, Zea mays
gatcattacaaacgagctccctacaaagtatacagactaaaaaaaatagaaaaggaattccgcataaacccctcccagccaaaaaaaaaccacccccgccgcggccgccgagcgagcggtaagcagccgccgcaccacgagagcgggatggcgtcggctccggagccggagaacgggagggaactctacgcgctgctccacctctcgccggacgcctccagcgaggaagtccgcagggcgtaccgccagtttgcgcaaatctaccaccccgataaataccaggacccgcagatgaaggatgtagcaactgaaaacttccaacgaatatgtgaagcttatgagatactatcagatgagaacaaaagacaggtgtatgacatctatggtatggaaggtttaaattctggcctggaacttggtcccaagctaactaaaccagaagaaatcaaggaacagttagaacgactgcggcggcgcaaggaggaagaaaaacttttcaagcatgctctacccaatggctcaatcattgctaatttctcagtgccacaatatttaaatgacgggagcatcatgagaggaatggcgatgcttagtcaagttgagttgccagtgtccaagcaaaatactgtcgttgttggtgggaatttgattgtaaatggctcagctggatctggagcagcaaccactgtgctgcgacaccagttgtctcctgtttcctctattgagtttatggccacagctggactacgttctgttattggtgggcagatgtttcgtcaaatttcaccacattctacagcaacttctggacttgctgtttctttgagagatgggtctatcaacttgtcaaatgcctggactcgccaattgtctgacaatactgttggaaatatacagctagtccttggcgatgaatcaagtatttctgttggatggcaaaagaaggatgaaaaacgtactgcaactggagaagtaaagtttggaactaatttttttggcgcatctgctcattatacacatcgcttctcctccaaatctcatgcacgcatcgctggtagagttggaagcacaatccttgattttgaaattggaggagggaggcgaatatcagaatttagtactgtaaggatgatgtataacataggaattcagggcgtatcttggaagtttgagttacatcgtgctggtcaaaagttaatcatcccagtcttgctttcaactgatttaaatccattatttgttaccagtgcatttgctattccttcaacactgtattttctacttcagacatatgttgtaaagccttactaccttaagcgagaaaagcagaaaacactagaaaagatggaaggcttatctacacagctaactgaagccagaaaggcagctgaaaaagctcaaaaattactggaacctgtctccaaccgtaagaagaatagacagctagagaacaacggattggtgataacaaaggctctatatggcagtcgccaaaaaatcaaaatgagcagtgaattgaatgatatacacaatgacatggcttcacaagtatttgatgtgaccatcccactgaatttcctcgttactgaggcaggccagctcaagcttcatgacgggataaagaagtctggaataatgggtttctacgatccttgtcctggagacccgaagctattacttgtcgagtatacgtttcatggtcataaatacaaggtcatggtagatgactatgaggcgctgttgataccacaagatatccatcaattttgaacggttcctgatgtaaaagccacatcaaaacgattttgggtcatcagctccctttctcacattttttgttccttttgtgttgagctatctctgttttcggtcattccttaatgcgcctcgtatttgtatacacatgtcggtttgtgccacctcgaggtcatacacaccaacagcaggtaataaagctgtagccagtagttttccagaaaaaaaaaaaaaaaaaaaaaaaactcgagggggggcccggtaccaaaaaaaaaaaaaaaaaaaaaaaaa

SEQ ID NO: 14017 - DNA, 1033 bp, Zea mays
  misc_feature (1020)..(1030): n is a, c, g, or t
accacgcgtacagtgacacttgatgaccaagcaccgcgagcgcttgaaggtcttggaggcagtagatgctgctgtagaacttgggtatagccctgttaaggtcaactgtgtcatcatgcgtggtataaatgatgatgagatctgcaattttgttgaattgacgagacacaaacccatcaatgttagatttattgagtttatgccatttgatggtaatgtttggaatgtgaagaagctagttccttatgcagagatgttggacaaagtggtaagcggcaaagttataaaggagtagagagacttcaagatcaccccacagacactgcaaagaatttcaggattgatggacatgttgggacaatttcatttattacatcaatgacagaacatttttgtgctggctgcaatagattacggttattggctgatggaaacctcaaggtgtgcttatttggcccctcagaggtaagtttgagagaacccatccgtactggtgttgatgacgctggactgaaggagataattggtgccgcggtgaaaaggaagaaagctaaacatgctgggatgtttgatattgccaagacagcaaatagacccatgatacatataggtggctgaggtgtgcagaatttcctcatgtcgaatatgagccaataaaatggatttgccaactgctgggttgctggcttgctgcctggtttttacctgaccgaccatgaaaaagttctctgatgcaatggaccaaactctttccgagtggtttaaacattagaggaggaagtggagtgtatggtcactgcagtcatacaatttagatccgtatacttgaacagcgccacagaaactcactcagtcttcgcgtgccaaggtgttttggttgtgtacttgtatgttgtatgctcataatgtcacgttgtgtaagctctcttttgagatcttaccgtttgtgaattaaactgctaccttgagatcaatcgcacatcctcgtttccgttttagaaaaaaaaaaaaaaaaaaacnnnnnnnnnnnccc

SEQ ID NO: 14018 - DNA, 1919 bp, Zea mays
tgcgcccctccgccccggccgggaggttggcttctccttcctaccctttccgcgctgctaccgccaaattctccgactgcctcgcactctcgcagacagcacgtggggggtgattctctctttcttctcttcctcagccgccaggaaggtggattcttttcgagctcttgcccagctgattataggtaggtacgtggctggatagaccctactgctggatagagcgtctcagggacgggttgactctttctggccgcatcagcggccggctattcttcttgtccggctatccgttccaggacttcggattaagaggcgacgagatgatgcgacgctgcgtctcggcgttggcccgccgccgccgtccagatcgcacggttgatactatgaaggcacgattccaatgtttggttaacatttcctcttcaataagggacactgacagccaaaggtgctcaagtacgtgtgctacttcctgtgctaccgatccagatgttttatcgagagaaacatcgtcatcagaaatgcttgttgattcatttgggaggttccacaattacttgaggatctccttgaccgagcgctgtaatctgaggtgccagtactgtatgcctgctgaaggagttgaactaacaccaaagtcagagcttctgtcacatgatgagataattcgaatcgctgacctttttgttacttctggtgtgaataagatccgattaactggtggagaacctaccgtacgaaaagatattgaagatatttgtttgcatctttctagtttgaagggactgaaaactcttgcaatgaccacaaatggaattgttctttcaaagaaactcccaaagttgaaagaatgtggactcaatgctttaaatataagtttagatacactagtacctgcaaagtttgagttcatgacaaggcgtaaagggcactcaaaggtcttggaatcaatagatgctgctgtagaacttgggtatagccctgttaaggtcaactgtgtcatcatgcgtggtataaatgatgatgagatctgcaattttgttgaattgacgagacacaagcccatcaacgttagatttattgagtttatgccatttgatggtaatgtttggaatgtgaagaagctagttccttatgcagagatgttggacaaagtgcggcaaagttataaaggagtagagagacttcaagatcaccccacagacactgcaaagaatttcaggattgatggacatgttggcactatttcatttattacatcaatgacagagcatttttgtgctggctgcaatagattacggttattggctgatggaaacctcaaggtgtgcttatttggcccctcagaggtaagtttgagagaacccatccgtactggtgttgatgacgctggactgaaggagataattggtgccgcggttaaaaggaagaaagctaaacatgccgggatgtttgatattgccaagacagcaaatagacccatgatacatataggtggctgaggtgtgcagaatttcctcatgtcgaatatgagccaataaaatggatttgccaactgctgggttgctgcctggttttacctgaacgaccatgaaaaagttctctgatgcaatggaccaaactctttccgagtggtttaaacattagaggaggaagtggagtgtattggtcactgcagtcatacaatttagatccgtatacttgaacaaatgaacagtgtcacagaaactcactcagtcttcgcgtgccaaggtgttttggttgtgtacttgtatgttgtatgctcataatgtcacgttgtgtaagctctcttttgagatctcaccgtttgtgaattaaactgctaccttgagatcaaacaaaaaaactcgtttccgttttagaaaaaaaaaaaaaaagcgcccgcgtacttctag

SEQ ID NO: 14019 - DNA, 795 bp, Zea mays
gccggccgggcctgaaaaactcggtaaaccattcccctccccacctcttgtccagtgccccaaatgctggcgaccacctgcagccggccgccgtgcccgtgcgcgcggtcgcggcggctccccgcggcgaccttcagcgctaggcgcaccagtagcgcgaagcaaagggcgccgaggagagcggcggcgttgcggtgcgggctgctgcccgtggacccgtgggcgccgacgatggactcccagagcgtggcgtcgcagctcttcgccgtctcgctcttcccctacctgggattcctctacttcatgaccaggtccaagaccgcgcccgggctcacgctcttcggtttctacttcctcctcgtcttcgtcggcgccaccatacctgctgggatttacgcaaaagttcattatggtacctcactgtccaacgttgactggctgcacgggggcgctgaatcgctgctgactctcaccaacctgtttatcgttttggggctgaggggagccctgaggaagctggaggaagagggcacagacgagattgtttctgaagcttctcaagaaaaaagttctgtctagatgggttcatcatcagtacccctgaaggtgcactcagtaactaggagtgcgctgtttttcttcttctgcagctcaactagctcgtagtgatgttttgggtgtaaggaaatctggcagatctactctctgcatactatgctgataagaaaacaatgtacaggcatctcctgtaaaaaaaaaaaaaaaattcagctgttgatagtagcagtacacagt

SEQ ID NO: 14020 - DNA, 1184 bp, Zea mays
aaaccaaagaattccttaacacgggcatgagaagtctggatgaacacagtgggtttcaccgcaagctgaagcatttcgcagagcagtgccaaactgatgtttctttgttgcaagaggaagaaaagaaaattcggtccttggtcaggggcactgttgattatttccatgggagtacagggaaggacgagggcctgcggttatttgtggtagtacgagatttccttgcgatgctggacaaggtttgtaaagaggtgaaagaagcatcaaaagtggctccaaagaaaacaaagacccgctcagccatctcaagcatctttcaatgatcccaggcgcaaactattcccagcaattcaagacctaagggcagacagttcgagctctgatgaagacgattagctgtataccgaatcaaggagtccattgttttcaccttcgaatgcactgaatttgacccttcaaaacaatagtgcggtgatacataatacatggaaactgatgggaaatggtgaagtgacgctattttttgccatccactgatcaaaaaggcaacaatcaaattgggaaacctggcttggctttacactgacatgttggtaatgacaaatcatcagaccagatctggcattcttggccaatgggtttgtatggcactctcctatctagcaagaaggatgttcatatggtcgagacagcatctatataaaaggtgtggctggtggaaaatggataattcaaaggaaatggaagaaaactggctctagtttagaaccggtgtaaatgcaggaggaagtctgactaatactatttttctgttcattgtacacatgtaccattgtaccgaacgcagagaaatgcagcgcaaacttgtgaatccggtgccattacccttgcaaacaggaatacaaatgaagtgtttggtttgagaaataagctagtttatcatcttctcactcctcattatatttgtttgatttttaaaataaaatgagttaattcatcaccacatcattccttatagttaattccttatagttagttagtactattgaataatggaatcaaactactaaatttaaaaaatgaacccataatacatcactcaatttagatggagtgatttctaaaaccaaacgccctaaaagtgtgtcaacaagtccgttccatcattcatgctgttgctgcag

SEQ ID NO: 14021 - DNA, 2501 bp, Zea mays
ctcgctgtccaggttacaagaagcaattctgttgattcctcgtggtataacagttctcatggacatgcttatggaccgtgaggtcataaggaatgaagcactgttacttcttacttatttgactcgggatgcagaggaaattcaaaaaattgttgtatttgagggtgtgtttgagaagatatttagcattattagagaggagggctattctgatggaggtgtagttgttcaggattgccttgaactgttaaataatttaattcgacacaatgcgtcaaatcagatgcttttgaaagagacaatgggctttgacccattgatatcaatactaaagattaggagaggcagtgcatttaattttacccaacagaagacagtaaaatcttctcgctgctttaaataccgggcccccccttttgatggggggcccatctggtgaagcaggtaaagacgctaacaagaatgcaaatcaaacggcattggctcagaaaaacattctggaccatcttcttttgttgggcgttgagagtcaatgggcccctgtcgttctccgctgtatggcactgcgatgtattggcaatttggtattaagaaatcctcagaatcttgattctcttgcaagaaaacaaggtggagaagagcctcatgttcaacctgcactgaatgccatcttctctataatcttgcggacctctgtagcgcaggaatttgttgctgctgattatgtattcaagtgtttctgcgagagaaatcctaatggccaggcattattagcatcaactattgttccacatccgaaccaaggaaatatgcatgaacctgctatcgacatgccttttggaagtgtacttctgcaagcactggtttcaagtgatgtcaatggagatatggaggcatgttgcagagcatctagcgttctttctcacattgtcaaggacaacatgcaaagcaaggatcatgtattgcaaattcagcttgagacacttacaccgtccttggggcgcactgagccagtattgcatcgtattgtcacatgtttgtccatcgcagcctcaacagagggagaaaacaaccaaaacaaccaaccagaagaaccgtacattcaacctgttattcttcggctactcatcatatggcttgttgattgttcaaatgctgttaactgcctgttggaatcagcagtgcatctgaactacataatagagcttgcttcaagcaaacgttacactgcttgtgttcgtggactggctgctgttgttctaggtgcttgcatcctgtacaatgctagccatgagaagggccgtgatgcttttgctgttgcagatgctataagtcaaaagattggcctcacaacgtacttcttgaggtttgacgaattgaggagaagcttggcacatcctttgccagagcagcatcatcgcaaggagctttcccgatcaagtgcgaatagcatgtcagatttccaagaaattgaagaggatgaaacaaataaagatgatcaacaccctgtcctctcagaaatatttgattcacagtttgttaattttcttagtaagctcgaggctgatattagagaaaacataatggatatatttagtcggacaaaaactgcaactgcactccttcctactgaattggagcagaagaacggggaggttgatggagagtatatcaaacgactaaagtcgtttgtagagaaacagtgcaatgagatgcaggacttgctggctcgaaacgcaatgttagcagaagagttagtgagaactggtggtggtaccaccacagatacttcacagagaccgaacaacgggcgagaaagggtccagatcgaagccctgagacaagaactggagggagcgagacgacagatagaggcactcgaaactgacaagtcccagatcgaagccgaagctaacaaccaacgaaaccttgcagtaaaactggagtccgatctcaagagcttgtcagaagcttacaacagcatagagcaggccaactaccgcctggatgccgaggtaaaaaccttgcggcagggaggcagtgtgccgtatcctgacgtggaggcaataaaggcgcaagccaaggaagaggctgagaaggacagtgaggcggagctgaacgatctgcttgtctgcctcggtcaggaacaaactaaggttgagaagctgagcacaaggctggcagagctcggcgaagatgtggatgcccttctgcaaggtattggtgacgacactgccattccggacgatgatgacgacgacgatgaagatagtgaagagtgatatgtttatgtaaccctgtaggtctgttggtgcacacaacctcacgttgggtcatgatattgtaatggcaattggcattgtacagtggataatgtgtagacaaaggcaccgttccaatttaagttatttgtggagaaactagttgaaaactaagtggcggaccgtccggtcccggacggtccacacctcgcgatcagattaactcgaacgattatcctt

SEQ ID NO: 14022 - DNA, 5358 bp, Zea mays
  misc_feature (3459)..(3459): n is a, c, g, or t
  misc_feature (3577)..(3577): n is a, c, g, or t
  misc_feature (3808)..(3808): n is a, c, g, or t
tatttatagtgtttgttgttagcagacttatatcttaatgaaaggattaaagagaataaagggtctattgaggctattatatatatcttgatgattaaagagtgtaaagggtctgttgaggctaaagcactaatattaagtagaaaagtatggagaaaagagcaaaaggtatgaattagacatttcggtagggaaggttttatgcatagtcacaacaagaagtataaccgccttggtggtgagcagcaagagatgagatagtagagatgttttggaaatctaattaacagaatattttaaagcactatggcaaatctaatttgcaatagatacttatacttaattactttatcctgttccacacttagtgtggaaacatacacagcaaatcgttataggaagtgtttgacattagcatatatttacacatgcatatactcaattactttatcatgatcgtgtgtcaccatgattatattgacttcattagaaaacataaacataaaactataaacataaacataaaactatattacctgatcaggattgagaagttgccttatgtctgtccagtcccacactttatagacaaaacctattgctaccttggagcacccaacagtttgcaaccagtgagccagtagtgaccatcaagctggaaataaaaagaattgggacatgaactgtcaatgcaacagagataaaaacaaaaggaataaattcgataaacggcatgaacataatcatgtgtcattagctttgtacacaataattaaaacactcttcgacaccaaataaaaacaacacagttactggaaaacaggaagtttctcttaagcagttgcacggtattgtagagaaaaatgtctcctatcgtcatgtcctatgacccaaccgtgcttatctcattctgaacatatttagctggagcagttcaggttgttgagggcataaacttcaatgtcttaaaacggcgccagtatttttagtaccaaatcacccagtgcgtaggtatgctcctaggtacaccgcaagcatattcctcccttccaaggctctctcctctgttctgacccatcaccctctccctctctctgtttctgttctggctcccatccatccatccatccgttcgttcgtctcgttgcttcttcagagcagaaaaaaaagagagagaagatgatgatgcagatcgatgcacgcactgcgacgacgaccaccaccaccaccacccaaagaccgtcacgaataatataattggcatgtagcgggaaaacaaataatgctgcagcaaagggtacaccctttgtagttaccttatgttgtctcatagcttaattggttgttgtttaagtactcagttctcagtggtttaatcttacctgataggtggtaatggctctaaaagtgctcgtgctgagtctgtggctgaatttatgggtaggaatgaaacaattccgtctatgaaggtagggtcttgcataaactggatctattttctcttcatgactgttgctgatgcacgtgttattcctaccatttgtttttgttgttcaatccaatcatatgtggtgaaagcatcaaaattagatacataagtgataggattcagggttccacatcttttctatatgctttaaaaacattgaagaaacccaatttattaaccaaaaacaagctgattcatgcaaactcgggcatttccttgaaaaaatattttagatagcatggttctcttaaagttaacttctgaattgttgtgctagtgaccatacataattgtttctagattaatgggttcatttctgggtgcctgttgttgccagtgtttttcagacactgttgtacctgaacgtgcgactagcggcctctggagaaaaacagtgcaatgagatgcaggacttgctggctcggaatgcaatgttagcagaagagttactgagaactggtggtggtacgaccacagatacttcacagaaaccgagcagtggccgagaaagggtccagattgaagctctcagacaagaactggagggggcaaaacgacagataggggcactcaaaagtgagaagtcccagattgaagctgaagctaacaaccaaagaaacctttcagtaaaactggagtctgatctcaagagcttgtcagaagcttacaacagcatagagcaggccaactaccgcttggatgccgaggtaaaagccttgcggcagggaggcagcgtgccatatcctgacgtggaagcaataaaagcgcaagctaaggaagaggctgagaaggacagtgaggcagaactgaatgatctactcgtctgccttgggcaggagcaaacgaaggttgagaagctgagcacaaggctggcagagctcggcgaagatgtggatacccttctgcagggtattggcgatgacactgccattccggatgatgacgatgaagatgaagatgatgaagagtgattggtttatgtaacctgcaggtctgctggtgtaatctaccttcatgttgggtcatgatattgcgatggcaactggcaaatgtacagtggatgacaaatgccccgttccaagtttaagttatttctagagaatgggactaaatagcctcttgttttcggtgattgccttaagatataaaatcattatcatttcaacagagaataaaacatgacaggatgacatctttgtatggattgggtgtacatccatttagtgcatatttggtgtcccacaacaagttaaggcctcaaacagaagagggtgaattatctcctaatggtgaaatgaaagaggaacacttctgtgtttgctcagatgaagctatagatggaacttctaaacaaaatgaaggttctaccagcagatttaatggaaatgaatcattttatgttctgttcaggctacatcaagttagtttctttttcttcaataacctctatataagtttgtgcttatgtggtctcattggctaacctttattgattgcagatcttttatatgagagaatattgtcagctaagacaaactgttccacatcaaacaataactggaaagcttcaaggcacataaattctccagatcaatattcaaagtattttagtgcaggtttatcagtgcactatacaacttacttgatggttcttctgaggagaagcccgcggcggagaagacgaccgccgggaagaagcccaaggcggagaagcgggtccccgcgggcaagtctgccggcaaggaggacggcgagagcaagcgtggcaggaagaagggaaagaagaacataaacataaaattgttatagggagtgtttgacattagcatatattaacacatgcatatacttaattactttatcctgtttcacacgtagttagaaaacattaacatcaaattgttatagggagagtttgacattagcacaaatcaatatacatgataaaaacgaattccacaagcagaaanttattaccttggagcacccaacagtttgcaaccagtcagccagcagtgaccatcaagctggagataaaatgcttagtctgaaaaagcaaatgcataataagttaatcacttggacagnattgcagatgctcagcattaaaaatcggtttcccaagatatattaggatatactgggatacaatgcattcgaacatggaattttgacaatgtattactaactgatggattgtttgagcctaaaatcaacttagttaaactgcatcttcctgttttcttcctaaaatgttatcttagtgtctgagcctagaatagaatagataagttaatacaaaggtaactaatagcaacngaatagtactccactcaattttgctacattgcaatctcacatcaaaacttgataacttgatatattgcagctgcacaagactccactcaatagtaatgataagtttagtggtttcacagaaacaaacagtggtaggagtatgcatacgaagcaacttcactgaagcaaaacatgtggcctaatgtaacttgctaagatacgtagtagagcatatgagcacagatataaagtggtctagatatacaggagcagtataatttaacacgtgaagtctgaagctatctgaatatggctatgggctatggctagaacataaaaacatgtggatgtataaaccagataggtgcaggcccaaaattcatccccacccatacagcaaaaaccgatgtgtgttatttattgttgagacagattaaaatttgtttaaattaatatagcaagtgcgttgtagatcgaattagtgtgatatacatggtaaaaatgaattccacgagcagaaactattttacctgatcaggattgagaagttgccttatgtctgtccagtcccacactttatagacaaaaccttttgctaccttggagcaaccaacagtttgcaaccagtgagccagtagtgaccatcaagctggaaataaaaagaattgggacatgaactgtcaatgccaccgagataaaataaaacaaaagggataaattcgataaacggcatgaacataatcatgtgtcattagctttgtacacaataattaaaacactcttcgacaccatataaaaacaacacagttactggaaaacaggaagtttctcttaagcagttgcacggtattttagagaaaaatgtctcctatagtcatgtcctatgacccaaccgtgcttatctcattctgaacatatttagctggagcagttcaggttgttgagggcataaacttcaatgtcttaagacggcgccagtatttttagtaccaaatcacccagtgcgtaggtatgctcctaggtacaccgcaagcatattcctcccttccaaggctctctcctctgttctgacccatcaccctctccctctctctgtttctgttctggctcccatccatccatccatccgttcgttcgtctcgttgcttcttcagagcagaaaaaaaagagagagaagatgatgatgcagatcgatgcacgcactgcgacgacgaccagctgtagatggaacttctaaacaaaatgaaggttctacagcagatttaatggaaatgactcattttatgttctgttcaggctacatcaagttagtttctttttcttcaataacctctatataagtttgtgcttatgtggtctcattggctaacctttattgattgcagatcttttatatgagagaatattgtcagctaagacaaactgttccacatcaaacaataactggaaagcttcaaggcacataaattctccagatcaatattcaaggtattttagtgcaggtttatcagtgcactatacaacttacttgatggttcttctgaggagaagcccgcggcggagaagacgac

SEQ ID NO: 14023 - DNA, 1976 bp, Zea mays
ccccgcgtccgccccgcgtccgcccacgcgtccgggcaatttggtgttaaggaatcctcagaatcttgattctcttgcaagaaagcaagttggagaagagcctcagggtcccccggcgccggccgccatcttatctataatcttacggacatctatagcgcaggaatttgttgctgctgattatgtattcaagtgtttctgcgagagaaatcctaatggccaggcattattagcatcaactattgctccacatccaaaccaaggagatattcatgaacctgctagtgacatgccttttggaagtgtacttctgcaagctctggtttctagtgatgtcaatggagatatggaggcatgctgcagagcatctagcgttctttctcacattatcaaggacaacttgcaaagcaaggatcgtgtattgcaaattcagcttgagacatctacagcatccttggggcgtactgagccggtattgcatcgtattgttacatgtttgtccatcgcagcttcaatggagggagaaaatgaccaaaacaaccaactagaggaaccgtacattcaaccttttattcttcggctactcatcatatggcttgttgattgttcaaatgctgtcaactgccttttggaatcagcggtgcatctgaacttcataatagagcttgcttcgaataaacgttacgccgcttgtgtccgtggattggctgctgttgttctaggtgcttgcatcctgtacaatgctagccgtgagaagggtcgtgatgcctttgccgtggcagatgctataagtcaaaagattggcctcacaacatacttcttgaggtttgatgaactgaggaaaagcttggcacatccgttgtcagagcagcatcaccgcaaggagctttcccgatcaagtgcgaatagcatgtcagatttccaagagattgaagaggatgaaacaaataagggcgatcaacaccctgtgctttcagaaatatttgattcacagtttgttaatttacttactaagcttgaggctgatattagagaaaacataatggatatatttagtcggacaaaaactgcaacagcagtccttcctactgaattggagcagaagaacggggaggtcgatgaagagtatatcaagcgactaaagtcatttgtagaaaaacagtgcaatgagatgcaggacttgctggcacggaatgcaatgttagcagaagagttactgagaactggtggtggtacgaccacagatacttcacagaaaccgagcagtggccgagaaagggtccagattgaagctctcagacaagaactggagggggcaaaacgacagataggggcactcaaaagtgagaagtcccagattgaagctgaagctaacaaccaaagaaacctttcagtaaaactggagtctgatctcaagagcttgtcagaagcttacaacagcatagagcaggccaactaccgcttggatgccgaggtaaaagccttgcggcagggaggcagcgtgccatatcctgacgtggaagcaataaaagcgcaagctaaggaagaggctgagaaggacagtgaggcagaactgaatgatctactcgtctgccttgggcaggagcaaacgaaggtcgagaagctgagcacaaggctggcagagctcggggaagatgtggatacccttctgcagggtattggcgatgacactgccattccggatgatgacgatgaagatgatgaagagtgattggtttatgtaacctgcaggtctgctggtgtaatctaccttcatgttgggtcatgatattgcgatggtaactggaaaatgtacagtggatgacaaatgcaccgttccaagtttaagttatttctagagaatgtgactaaatagcctcttgttaaatttgattgtctgaataactttttatattacctttgataaatagccccttgttgaaaaaaaaaaaaattcataaaaaaaaaaaaaaaaa

SEQ ID NO: 14024 - DNA, 766 bp, Zea mays
ccggccgggagtttccagagctaagaccccgcaacagccgcaagaatcgcgagcgccatctgactcttcatcgtcgcctttgcccacctcccaagcttccgcctcctcccctcccgcgctttctccgattcttccacgagcttccagatcgcgaaaccaccatagccgcagtcaggcgagacgagtgcccacccgcgccgcgggattcatcggaatggcgtacgtggaccacgccttctcaatcaccgacgacgaagacctggtcggcggcgcggtgggaggcccgcgtggcgccccggtcaaggaaatcgcctttgctgccgcgctcctcgcttttggcgtcctcggtgtcgtcgcgggatccttcatggccgcgcaccaagtcggcggcgaccgcgcccacggcattttctttgcagttctgggaggggtgatgttcatcccagggttctactacacaagaatagcgtattatgcttacaaagggtacaagggtttcaccttctccaacatacctcctatctgaagaagcaattggattggctcatccaactatccaacacatggctgtctctctctctctctgtctctcttttttgtttcttattaacctttgtataaagtcgacagcgtggcaagtgatctgtacatataaaaacaccaccgtaatgtaatgtgtcatcacaacattatgttaccacgtgaagttgttcgttatgagatataaacgttgacctaaaaaaaaaaaaaaaacttgcgtccgaat

SEQ ID NO: 14025 - DNA, 1055 bp, Zea mays
cgtttttgcggcggtgtgcacgtcgcggtggggcaggaccccctcccacccggccggcgagcaccagtgcatcgacgcgaacgtggagcccggggccggggcggcggcccgcgtccgcgtccgcgtggtggtggaggtggacttccggtcggagttcgaggtggcgcggcccaccaaggcgggccgcgccgcgctgcaggcgctgccgccgctgttcgtgggcagcccggagcggctgggccgtgtcgtgggcgtggtggcggacgcggcgcggcagagcctccgcaagcgcgggctccacttcccgccgtggcgcaagcgcgagtacatgcgcgccaagtggctgtccccgcacgcccgcagcagcagcagcgcggacaggacgccggcgcccgccacgccggtttccgccgccgccgccgccttctccggcgagttcgagctgcggttcgacgagaaggagaaaccgaaggcggcggactacggcggcggcattcctggcggagaagacgacggggcgggcaagaaggtcacggtcatggtgtcgccgacgccgacgccgtggcgtgcggaagagcccggggcggctagcaagctgtgcccgcaggccaagcggaaggtggtgaccgggctggcgtccctgctgccgctcgcaagctgatcaacatcaaaccaagaggagagactccgtccggctccaaaaaagttttcccttttcccacctctacctccagaagatttccattccccccgcgttcgtcgatccgtccgagggccggctccaggtgttttagcggttttccggcgcctcggaacagagagtgaaaaaaaagagagagagagaaacgcctccctttttccgtcgaatttttttcctttgttttgttcctgcgaaagaacaaaattttcagttgtccgccgccgggggaacgggaggaatccgggcagatttgggttccctgtcctctgttcttgggagggagagaaattatgaagcatcactgctgctatgatctataaaagcgggttgagtactcgaaaaaaaaaaaaaaaaa

SEQ ID NO: 14026 - DNA, 775 bp, Zea mays
actccatagggccggccgggcccgcgggcccggccggggtattaattaattctagcagcaaattaaagagggatcggattggaactcgatcggaaggaaggtcctgcaggccggctggccggtcgtcgatcgaggaaccaagctgctgctgctgctaccggacgacaccaaccatgatacggaggacgacggtgtgcctaggcctgctgcttctactactggcggcgtcgactgcgacggcacatttctcgatcggcgacgtggacgagtacttgaacaggcgcacgcaggagtcccgccacaggaaccacggcggcgcgcagatcaatgacctcatctccagtgctgcgcgcttccacgccaacgtggatgcacgcgcgtatggtcgccgctccaacctgcagctgcaggaggaggaagcagcagctaccgcggggcgtgtaaccaaagcagaagaacaggaggcttctactcaaggtggagattaaccgcccaattattgcaattgcaattctcatcacccatttatattttctgccatcatttattcttcttttacacgcgtacgtgtgcgtaccccgatcccatcctttttggattattaagcattgtcgatggattacttatattactctctctttctctatgtgtatatatatatgtaagcaagcatatttggatgttttataatatagaaatattttcttacaaacaaaaaaaaaaaaaaaaaatttgcggccccccccgctccctgcttttttttgtgcagcaaact

SEQ ID NO: 14027 - DNA, 1534 bp, Zea mays
tgggtacctcgagaaacagaggaaagaaaaaaccgtcagagcgacgttagtcggctcagctgtagtgtagttgcaggtgttcgccggcacacgcgcgtggccgcgaaccctagatgacgccggcgaacggcgccccagcgcgggcagcggaggcgggcccccacgaggtggagtcggaggccgacgcgttccggcgccaggtcgacgacctcgtctcgaagaccgacgtgctggagcggcgggtgaaagaggtggcggacttctacgatggcaaaaagcacggaagcggcgggaggaagggtggtggtggtggcaggtatggggcatcctcgaggggaatgccggaccttatgcgccagttcggcgtgcttttgaaagagatcacctctcataaagatgcatggccatttctggagccggtggatgttgtaactctacagcttcctgactatcacaacattattacccaacctatggacttctctaccatccaaaagaaaatggaaaggaaggatggtacttgttacaccaatgttagagaaatatgttctgatgttcgattaatttttgccaatgcgatgaagtacaatgatgatcaaaatgtcatccacttgatggctaaatcattgcttgagaaatttgaagagaagtggctccattttcttcctaaagttgagagtgaggaaaaaagacaaaaggaggaggaatcaaagggtgttgcagccacaaatacttctcgagaagttgcaattgtaaaattagcaaaagacactgatgatgagctaaatcagatcaacaggaagctggaggagctccggaaaatggtggttcacagatgcaggaaaatgacgacagatgagaagaggaagctgggtgcaggtatctgtcacttgtctccagatgatcttagcaaggcgctagagattgtcgcacaagacaatcctagcttccagactaaagcagaagaagtggatcttgatatggatgcccagagcgagacaactctatggaggctgaaattctttgtgagggaagcgctggaacgacaggccaacgttgcctctgggaagatggacgaaaacgccaagagaaagagggagatatgcaatgctctggccaaaaccacctcgagacggatcaagaagcagccctagccatcttccatatctttcactcgcgtcctctgattgtttagaagttctttttttgatactagccaccagctttgtgaaacgttttcctgcatttttttgtggagatgtgtatatagtagtatagtgcactgtccagtccagtaacaagtgatttcgtgtgtaaccatgagctggtcgcattcgcgtcccctctgatccaacaacaaacattgtctcacaatgtgattgattgtagaagcaagcttttgtcacagggcgatgttgctcacttgtggaatcagatgatgcatacatttcgtaactgttcattcattctccaccttggcttgaaaattaaggtgagaaggcctgcggatttacatgcaaaaaaaaaaaaaaaa

SEQ ID NO: 14028 - DNA, 752 bp, Zea mays
gggctcaccggtcatcggctcgagatcgatggattaggtgcaaaagtggatcgcgggccgacgccagtacagctgtcagctcggcccaccttctcggcccgacgccctgattccgctcctcttgctctcgcacccttcccactgccggcggcggctgaaggcggcgcggtatcagcttggtgatttgtgagcgatggcgccgccggggtcgcggcggtgggcttacgtgcgcgtgatggccggcaccatcctcggtggcgtacttggattctacgtcatgcaccgcgtcgagacctcgtacaaggcgaggatggaggagaggctgcggaggtacgaggcgcatatgctcgccaaagccaaggagtcgcagcagttgcaggacgaggcacagcgggaggataaagcccagttcctgcccgactcgtgacaccgacattcttcccctcttgcgcctgctcttttccaagctgttagaataacatagggcactggggccaaggagtccgtccactcgtttttttcagatgtagagacataagatcgacatgtactttttgcttgttgctgtcttctttttttggtatcaagaaaaatgcaccattcgagcgcaaggttggggtcaatgtatgaacgccaaatatgaatatactttgatgtctatccgcacgtactctgctttgcaatctattggttatcaacaaaaatatacaaacagtgaaatttgccaaaaaaaaaaaaaaaaaaggccccta

SEQ ID NO: 14029 - DNA, 486 bp, Zea mays
aagaactgtaaaaggtacgaggggccaaacaggaaaagtgagcccaaaccctagacccatggaagcgtggccgcctctagcccccgcggcggccgcagccgccaccccggtcgctgcctccgacgatgcggcggtcactcccgccggttccggggcgtggggaccagcggcaacggcgcagcggaaggccgtggagcaggagtcagcggcgcaggcggtgagccgcatcgtggcgagctgcgccaactccagcggcgtggcggtcgccgtggtggacgccaacgccgttatctccggcgcccccgccctctccacatccgcggggcgccttgtcaccgtgccggaggtgctcgaggaggtccgggacgcggccgcgcgccgacggctcggactcctccccatccccgtcgagaccgttgatcctgcgcccgagttcgtgaagaaagttaccagctctagtctctcgactgcagcatgccatcacga

SEQ ID NO: 14030 - DNA, 771 bp, Zea mays
tatccaaagaattgccaaggaaaggaaacacaattcagcagcacacgcaccaccaaaaagagggagaagagtcttcgcctcgcggagagacgtgctgcctagcataatatatagccacgaaatagagtgctgggtctagctatagctaactagccagcagcagcagcagcgtgcgtgcgttcaaggcagcagaggtagagaggttttgagagagaatggcaagcaggcaaggtgtagccgcctccatgttcgccacggcattgctcctcggcgtctttgcatccatcccacaaagtgctgaggccatcggcgtatgctacggcatgagcgccaacaacctgccggcggcgagcacggtggtgagcatgtacaaggcgaacggcatctcggcgatgcggctgtacgcgccggaccagggcgcgctgcaggcggtgggcggcacgggcatcagcgtggccgtgggcgcccccaacgacgtgctgtcgaacatcgcggctagccccgcggcggccgcgtcgtgggtgcgcaacaacatccaggcgtacccgtccgtgtcgttccgctacgtgtgcgtgggcaacgaggtggccggcggcgcggcgcaggacctggcgccggccatggagaacgtgcacgcggcgctggcggcggccgggctgggccacatcaaggtgacgacgtcggtgtcgcaggccatcctgggcgtgtacagcccgccgtccgccgcggagttcaccggcgaggcgcgcgggtacatgggccccgtgttgc

SEQ ID NO: 14031 - DNA, 551 bp, Zea mays
  misc_feature (8)..(8): n is a, c, g, or t
  misc_feature (19)..(19): n is a, c, g, or t
gcacgagnccattacctanaacatcctaatcaaaaaaaggaaacacaattcagcacacgcaccaccaaagaggccggagaagaggggatctcggagaagagtcttcgcctcgcggagagacgtgctctgcctagcatatatagccacacgaaagagagtgcttggcctgccggccttcatctagctagctattgctaactagccagcagcagcgtgcgtgcgttgaaggcagcagaggtagagaggtttttgagagagagaatggcaagcaggcaaggtgtagccgcctccatgttcgccacggcattgctcctcggcgtctttgcatccatcccacaaagtgctgaggccatcggggtgtgctacggcatgagcgccaacaacctgccggcggcgagcacggtggtgagcatgtacaaggcgaacggcatctcggcgatgcggctgtacgcgccggaccagggcgcgctgcaggcggtgggcggcacgggcatcagcgtggccgtgggcgcccccaacgacgtgctgtccaacatcgcggctagccccgc

SEQ ID NO: 14032 - DNA, 607 bp, Zea mays
ccacgcgccgaggcgaagggcaggcccggctccgttcgggtccatgaaggcctaacccgagcgggcaggcttttaagtagggcgcgagtgagagcgagcggccaatcggccgggagcgaagccagcgctagctgccgcctccctccccggtcctcgggtccgccgcgcgcgcgccggccgccaccaccgcacgacgccgaccaccacaattagctagcagcggcgtcgactaataaacgacaatggcgtccatctccctcgaggacgtccgcaacgagaccgtcgacctcgagaccgtcccggtgcaggaggtgttccagcacctgaaatgcagcaaggaggggctctccagcgccgagggagacaatcggctcaagatcttcgggcccaacaagctggaggagaagtcggagagcaagctgctcaagttcctgggcttcatgtggaacccgctctcctgggtcatggaggccgccgccatcatggccatcgtgctcgccaacggcgggggcaagccgcccgactggcaggacttcgtcggcatcgtcgtcctcctcttcatcaactccaccatcagcttcatcgaggagaacaacgccggcaacgc

SEQ ID NO: 14033 - DNA, 5237 bp, Zea mays
  misc_feature (5127)..(5127): n is a, c, g, or t
ctttagagtcgacctgcagctgtacaactttccaaaatgaaataattgaattacatatcaaatgttctgactctaaacccccccccccctccccctgaaaacagagaaatctttttttactatctttgagtaagtttgatctagcattgtaggatcgaagaccatattgcacatgctacttatagcaaccataagaaacatcacactcatatgttccttccattatggctaagattgctgtgctactggtcgttttcctcccattttgtcatgttgaagaaaatctgcaacgaagtatgcctcattgtgtccttatctactgctcaaacattttatgatttgtttttcaggggaaaatgagaagaatgatagaagctgaaccacccatagatgaggctgctcttgcaaagctggttccagaggtaggcatggaatttgtgagtgaggaaaaggcatacgaattctacaacaaatatgctgggcatgttggctcccgcgcgtccgcccgcgcgtcccataaatcttcagaaaatattaccaaagttagaacttttgtgtgctcaagagaaggctacaacagggataaaaaatcactggaagccaagaagccaagattggatacacgaatcggttgcccagcgagattgattataaaagtcacaccagagtgcaagtatagagtaactgattttaaagcagatcacaatcatcagctggccccaccttcaacgatgcatatgttaaggtcgcagaggatattgacagaacttcagcctggagaagcagaattatcagatgattctgtagtgacaccaacaacaaaggcaactggtgatcttgttgtgagacaagtcagttttcttcggagtttatctctcctcccagctgattacaagaattatctccgttcgaagcgtatgaaggccatgcaacctggtgatggtggagcaatattgaaatatttacagacaatgcaaatggataacccctcgttcttttacactatgcagatcgatgaggatgacaaactgacaaacttcttttgggccgaccaaaaatcgagagatgacttcaactatttcggtgatgtgctctgcttagacacaacatacaaaataaacggttatggtagaccgcttgcgttattccttggtgtgaatcaccataaacaaacgattatttttggtgcagctatgctttatgatgaatcatttgattcatacaagtggctttttgatagttttaagatcgccatgcatggaaaacagcctgcagtagctttgatagatcaatctattccattgagcagtgcaatggcagccgcctggccaagtaccactcaacgaatttgtgcttggcatgtgtatcagaattctcttaagcacctcaatcatgttttccaaggttcgaagacattcgcgaaggacttcggcaaatgtgtctttggctatgaggatgaagatgaattcgtgttttcatggagaagtatgctggagaaatatgatcttagacataatgaatggttgtctaaagtgtttgctgagaaggaacagtgggccttggcatatgatagacatatattttgcgctgacatcataagtgcacttcaagccgagagtttcagtagtattttgaagaaattcttgagtcctcaactggagctgctgtccttcttcaagcactatgaaagagcagtggacgaacatcgctatgctgagctgcaagccgacttccaagctagtcagagctatccaagaatacccccagccaagatgttaaagcaaactgctcatacatataccccggtggtatttgagatctttcgtaaagagtttgagctattcatggactctgtgttattcagttgtggggaggctgggacgacatctgagtacaaggttgcttcatctgagaaacccaaggagcactttgttcggttcgattcaagtgattgctcctgtctgtgcacttgtaggaagtttgagtttatgggtatcccgtgctgtcacatgttgaaggtgctagattacagaaatatcaaagagcttcctcaaaaatatctgttgaaacggtggagaaggaccgccaaatctgcaaatgaagacaatgaaggcaatgcaacaaacgccaacaacgggtcattattgattgtccctgctcctcctacaaatcaccatgggcttcagagcttcagtgcaatgattcaagtaagcagcttctgatacttgtccatgcaaagtgttttttccctggttttattccagctgatgccttcttttaatgcaggatgcttcagtttctagcatgcattagaatgcatctcatagaagctcttaatgcaggaacttgcaggtattagaattcgtttcggtaatttcctattttttacgctcgagaaatttttgtatgctcagcacctccttttccagttaattatatctggattagttccccgtccatctggttttagggagaccgccgtagatagcctaacaaatcgaaacttttcgtgcgtgccaacaagaaatcatctttgagctccattcatttgtgacttttggctttgtggctgttgaattttctgtgcgctgttgtgtttggccttatgggagatcctgacgttctcctagaaaggcagcctaaacattctgataaaaaaaacagtctcatctctcacgagctttcgatcctgttgtctgactcatcaacttgcttgaaccgtcgtgacgcagggtcaatgccaacgacgcgtttataccttgcaagactccacagcgttggccactgaagaagcattggatgggccggccaccgtcaagattcaaccacgcatgtgttcaccgtgtaagactcggcgccgttggccactgaagcaacagttaggcggccgcccgtcaaccgcgcccttggataagttgggtgggcggacctgtgttgtacattgttcagccgtaggggatttcagtcaccgaggcaccggtccttagcctaggctgtagagtagatttttttttttaaattttagttttaaaaggcataatgcttgtatttgcgctgccaataatccaggaattttgtgcgcgcctaataaatgctagcccgtttattaggagcaaaaaaaaaatgcaattcaggcccttgtactgtgctggagaagagagagggtgcgtgcgtgcgtctgaaacctgtgtgcagacagacaggcctctgaccttgtggccggccgccggcctgtgcagagcaagtaggcgccctcactcatgatttgatacggaggtgagtacagtttcagttagattcagatctggggcttcattgcattgaagcgttggcggcaagccatggggggcagccttggcgcgccagcacagcgatgctctggcctggtggcatatacatctttggaaggtggtgttcttgccccatgggctcgtgactgtgtgttataccacatttgcaaatagaacagcttgcaaatgtggtccgtacctcggatcgttatctcaggtgcaaggtggtgtcagagcatgtggccccccatgaagccaaccaaggaacaagaacccattgtgacggcacggcacggcacggcaccaacgcaaacgacgcccatgaaatctttgagcatgtggtcgtccattccatggtacagtcacgcgcacatactttggcagcaggtcgccagctggtgggcccgccaatgacgcagcagcaccgtacctgtgcctgcgtgtggttcagtgatctccctccctcccgggctgctgagcgaggtggaccgttcggaatggtcctgtgtcctgctgcgacggtggtgtccgtcgatgatgagccagcgaccgttaccactactgttccattggctccgatcccgtccgcgtccgggggcaaccgaggctcaaagcacgcggcggccagcggctggccgccgaccgggacggcgcagccgacgactggactggactgatcgatgcgcggtgtacgtgggcagagggtgaccctgcggtgcaggtgcaggtgcaggtgagcattggcttgttgtcctcggttggagctggaaccgcgccgcagcgtgctgctgggcgcccgggactcaccaaccgggaacagagaagatggttgggtgttgtgggctggtggtggtccacggctgatgcttattagtgcttttcccagggtgatggccggcttgcgtcctgcttaattctctgtgatttgatctgaagatgatggatggatggatgctgaaagtggagacagtggcaagggcgtgcatgccctctcgtcccgttgctcacacgctcgtctcgctccaatcctaccctaccctaccctaccctaccctcggtgtgactgagtcggtggccaacctctgagaaggtgccaaaaagaaaggtacgagtgttgcaagccaccgcccaccgacaacgctgcgcctgcaccggccgcccagaccccagtgcgccggaggccagagctcagagtcacagcacagcacagcacagattgctctgcgcccacgccacgcccacgcaccggacacggcgcatgtgatgtgacgccagcctgcgcggccgccccgccctcggcttttcaccgccgctagctgccgggagtcggtcacgcactgctgtgctggtggtgctggagtggagcgggcacgggccgtagtagaaccttgctattattgctgccgcttccatgcatccaaaggctcagcttcctctgaggcggactccagcagtccacctaaatcttattataaatattttttgcactgttctatatggtagactgtactgttcgtagaatatagttcaaatataggtatgagtatagttaaactgctggagagagtatgagttgacatgtacatatacattgataccggtagaaatggttaccatctagctaagagaacgccacattacgcatgctgttccaaaaacacgctgaaaccctttttcgtttttctatcgacaagggacgggacctgaccaaaaggtactctatcttgcaccgtaccttcagctcaggctcagctccacgaacaattaagggaccaaaagattcactgatgattagcaggcaaacctttaatcgtacgagaccatatgcacctatctntgacgcagatgttaaagaaacttgcctaggctaattctttttcttattatacaacatctttcatcgtcgtaaattaagtcgtagcctgagggctaaaggatcgaacgaag

SEQ ID NO: 14034 - DNA, 1155 bp, Zea mays
ccgccgctcccgcggccggccccgggacaccaaaaaaaaaaacaaaaaacaaaaaaccaaaaaaccccacgcctttcctcgccggcgaaggagaagccgcagcgctgctcccacgccccctaggagcgcgtgcctccattccatgtgcgcccgcccaccggaggataacctttgatcatttcgtttgctggacattggatcaactggtgctgttatacatagaaaggatttcattttaaattctcatctatatttggtggtgccataatcatttttccactagcgtttggcaataatgtcggagagcgagttagcagtaataaaaccagaggtgttgaagacatatatctggcttcagtgctttgatggttccatacagcaagtggaggaggaggttgcaatgttctgccccatgatatgtcaggaaattgtgaaaaatggcacagggtcatcaaaaaatcatgctattgctctcccggaaagagttaatccagccaatttgagtttgattcttgactactgtcgatttcatcagatcactgggcgttcaaacatggagcggaagtcctttgatgaaaagtttgttaggatagaaacagaaagactctgcgaattgacttctgcagccgacagtctacagttaaagccacttgttgatcttactggccgagcgcttgctcgaatcattgaaggaaagacacctgaggaaattcgtgacattttccatttaccagatgatttaacagaggaagagaaattggagcccctaaaaaatataaatgatggtcctgctaggattcgcctactgaaccggttgtatgccaagaagcggaaagagctccaggagcgccataagctgaaggatgttcaagtacagaaagagcaaaaagatgagagatctttggatgagttacttagttttattaatggggatggaggtatagctacagttcaggaggcaggaaagctaccaagagtaagaaaaagaataaaaggaaggatcatgttgagaaccccccaaaagctgactctgagcctgtaaatgcgaatccagatatgcaagatgatgccgagtacccttttgaagatgctgacctcgatgatggacttgatcctgcaatgaaagaggagcttgataggtttgtttttaacatg

SEQ ID NO: 14035 - DNA, 945 bp, Zea mays
cggacgcgtggcggacgcgtgggcaagtacagaaagagcaaaaagatgagagatctttggatgagacacttagttttaataatggggatggaggttcaggaggcaggaaagctaccaagagtaagaaaaagaataaaaggaaggatcatgttgagaaccccccaaaagctgactctgagcctgtaaatgcgaatcctgatatgcaagatgatgccgagtacccttttgaagatgctgacctcgatgatggacttgatcctgcaatgaaagaagagcttgatagcgaggttgaggcctttgcgaagaggttggattcagtttggaaggagtcacatattggtggtaatggttctgcacggagatttcctgggtttaatcacatgtgagtgttaagctggtaggatcagaaggcagaagcagaggagatttgtggacatacagcctggaagagagtaaaaaataccaaacagtcgacttgctcctgtgtgtttgataagggcatgtacaaccctgaaatcatggatcggttttgcgaagtacaaaagacatgttaagagactataccctgagcctttggatcataaatgtaagtaagaggcaatgtgtgtagagaattgtgtagagacagtctcttcgcgaaaagagagcctgtctattgtattttttcaattaaccctcaagagacttcatattgaacgaggttgtacatgtcagagccaagcatgcagacatgctattttgttggggaggaggctgcctagttgggatgaagcttagcatggttcaaggaaaaagtgtagttttttttctttggaaagggaggattagaggtctgtcttgtctgtgttgccagggaggaggctgcctagttgggatgaagcttataatgcagtatatagtgtaaaacagaattttgaatgactatatggctgaactgtagacaca

SEQ ID NO: 14036 - DNA, 1714 bp, Zea mays
aaaaaaaaaaccacgcctttcctccccgccggggctctccactctcgctccaacgccgacggagaagccgcagctctgctccctcgctctctcttccgggagcgcgtggctctattccattcgccgttgaagccaaaatttattacgataaaattttgatcctttcatttgttggacattggatcaactggtgctgttatacatagaaaggagttcattgtaatttctcatctatatttagtggtgccataatcatttttccactggtgttcggcaataatgtcggagagcgagttagcagtaataaaaccagaggcgttaaagacttatatctggcttcagtgctttgatggttccattcagcaagtggaggaggaggttgcaatgttctgccccatgatatgtcgtgaaattgtgaaaaatggcacagggtcgtccaaaaatcatgctattgcgctccctgaaagagttaatccagccagtttgagtttgattcttgactactgccggtttcatcaggttactgggcgctcaaacaaggagcggaagtcctttgatgaaaaatttgttaggatagaaacagaaagactctgcgaattgacttctgcagctgacagtctacagctaaagccacttgttgatcttactagtcgagctcttgctcgaattattgaaggaaagacacctgaggaaatccgtgacattttccacttaccagatgacttaacagaggaagagaagttggagcccctaaaaaatgtaaatgatgatcctaggattcgcctattgaaccggttgtacgcgaagaagcggaaagagctccaggagcgccagaagctgaaggatgtacaagtacaaaaggaggaaaaagatgagagatctttggatgagttactttgttttattaatggggatggaggttcaggaggtggggaaagtagtaccaagagtaagaaaaagaataaaagaaggaaggatcatgctaagaaccccgcaaaagctgactctgagtctgtaaatgtggagggagctgcttgtgtggttccgtgcaaagtggatagcagtaatgtttctagacttccatgccaaagtccagatatgcaagatgatgccgagtacccctttgaagatgctgacctcgatgatggacttgatcctgcaatgaaagaagagcttgatagagaagttgaggactttgcaaggaggttgaattcagtttggagcgagtcacatattggtggtaatggttctgtgcagagatttcctgggtttaatcacaggtgagtgttaagctggcaagatctgaaggcagaagcagaggagatttgtgggcatacagcttggaagggattaaaggccaaacaggccaccttggctcctgtgtgttgtaaaaccttgataactcaggaaccaagcatgcagaaatgcgcaagttcccttggccattttcctgggaaggaggccacctagttgggatgacccttttttttttctttgggaagggagggttagaggtctgtcttgactcaattttttgttttccttaactgctgtgttgccagttttcctgaataggggaagagaggagtgttgcctgttagctctgttacagatgtccatggaattctgttgtaacactgtattgtggtgcacatagaaatgtgattccctgtattgtggtgcgcataaaaacatgccgatgtttggctggttt

SEQ ID NO: 14037 - DNA, 1748 bp, Zea mays
gcacgagaccattacctaacatcctaatcgaaaaaattagaaagcaagagagaaacagatacgtgggcccagcttccatccatctccggtgaactggtccctctagaaaattccccaatcccacactgccactctgccagatcaaagtcacgcgctaggttgagtcccgcccaattcaaatttcaaaagcattccgccatgacaaaacccacagctggtttccagacgccgcgcccttcctcccttcgcgcctcctccaccgccggcgcccgctcctctgcagcgaagctcgcggtcgccagcgccgtccccagggacctcgcctccagcaccaaggtggtgcgtaagtgtctggactacgacggcgacaccaccctccctgctcccgcagcctccacgacgcctctggatgacgtcctggaggacgacctcgcgcctctgctggacctgccagaccctgacgtctccggcgattcctcctcctccgtcatcttcgctgctccggatgacgcggtgatatcttccgccgactccactgtcaccgagctacaggtcgccgcgcccaccgactccaccaccaacagcgacgcagacctcccagtcctggagcaaatcaacctcgccatgtctgagctgcatgcagccgacagcctcagcccgcgctccaagcgcctccttacggcgctcgccgaggctgctaaggccgagctcatcccctcggccaccgcccgccgcctacgtggcgccgccttctggggcaaggtgcgcgtttgggtcctcgccgcgacggtcaccaccgtgaccaccatcgacgtcgcgctcgccgcctacctctatgcgcgccgcgtcaacaaccggtaccacgtcatgcccccaacctgatcccagcacgacgtaccccgaccgccgccgcccgtgcgcctcgaccacgatcgggtcgatcgcccagacgaaactgtgatcgatccccctcagttgtttagttctataattctagcgcgttgcatcattaagacattagcattggtggcagtgtggcaccctggtggaggactacgggtcagaaaagtatattcagaagagtacgatttaacaaaaaaaaaaaaaaaaattttttttttttttttttggtccacatcttcaaaccctcaaaactataaacatcactcatacagcaacaaaggcatgtcaaccctgaaatcatggatcggttttgcgaagtacaaaagacatgttaagagactgtataccctgagcctttggatcataaatgtaagtaagaggcaatgtgtgtagaattgtgtagagacagtctcttcgcggaaagagagcctgtctattgtatttttttcaattaaccctcaagagacttcatattgaaagaggttatacatgtcagagccaagcatgcagacatgctattttgttggggaggaggctgcctagttgggatgaagcttagcatggttcaaggaaaaagtgtagttttttttctttggaaagggaggattagaggtctgtcttgtctgtgttgccaggggtttccttcaatataggtggggagggaggagtgttgggtgttagatcattcagtagcttactcatctttatatccatattcaaactttactctacgaataatgcagtatatagtgtaaaacagtgctttgaatgactatatggctgaactgttggacacagtttgtatcaataaaatttcgttgattcactgaaaaaaaaaaaaaaaa

SEQ ID NO: 14038 - DNA, 1135 bp, Zea mays
acatcccgtcgcgtcgcgtcgcggattacggaggaaccctctaggctccggttccggaaacagcgggcgccattcccgggcgaggaggccggcccagatccgagtacggcggcggcggctgcggcggcgagatgactggtggcggcccggccgcggcgtcgcaggcgtacggcgaggcatggtactgggacgagcgctaccgcaaggaggccgggcccttcgactggtaccagaagtacccggccctggcgccgctgctccgcctctacctcgcgccgcaccaacgcctcctcctcgttggctgcggcaactccgtctttggtgagaacatgattgacgatggttatcaagatgttgtcaacattgatatatcttctgtggtaattgagcaaatgaagaagaaataccacgataagcctcaacttaaatacatgaagatggatgtaaagaacatgtcagattttgagtctggttcttttgatgctgttattgacaaaggaacactggattctcttatgtgtggtcaaaattcccaagagaatgcaacgaaaatgctagaggaggtcaacagaatcctcaaggaaaatggtgtctacatgctgatcacttatggggatccaagttaccgcttgcgtctcttgaaggacatggaaaaatggacagtaaagctccatgtcatagaaagatgggagaaaagttcgaatcagaacaaatgggaactgacaaagccattgcctctagaggaccatagcacatcactagctgcacttcttggccccaaacctgatgtccactacatctatgtctgtgtaaagggcaacggtggcgcaagtgtggattctaaagctggagaagctgccaattgatttctcctataaccctctgaactgacgtgcgtaaccggtgtagcaaataatgtagagaaatagaacagatgttgtacctcgaattgatcgttgttgttttattggataataaccagcgtgtgaattgtagaacagatatcgcacctcaatttgcagttgtttcattgaataaccagtgtgtgaataatgtagaacagatgttgtaccgcttgtttcagtgtttcatgaattcgattgaccctgtcagtgaaacaaaaaaaaaaggttag

SEQ ID NO: 14039 - DNA, 3442 bp, Zea mays
cactctcgctggctttggaggcaggagagagctagcaccccattattgattaatcagcggttagctacgcgctaacccggggcgacggccggccggattaacaaactagtagtggtcggcataattttaagtggcctttacctttcaaggtcggaccaatgggacagcgaaacgaggaccaatgggaggacgagtcttttgggcgagggcgtgggtggccacatcgagggatatgatatactgtagcagcaggcagcagcagctgcgttctgatcatgcaggattaattaattaattagtttagcggtcgcacgactccccagaaccagcctgtctgtgagagctagtcattaagatgcgcgcttggctgatgccgcctgttggcgtgcatctaccggaaaaagggggggagaggaaaaggaggttgctataggagcctagctagtttagtcagatgccctagaatcagctggtggttgacatgagaagtgtcttgcctcctcctccttgcttgggctgctacagggctgggctgtagcggtgctggcgtccctctcgcagtctcagacaccacagcccagcagccatgcactcatctgcagctctctcctctcctagttctagcttccctgttcctgccccgataattcgctaactgttcgatctgctcctcccgggcctccttgtgtctactgctgctccctttgctttcgttgctactgttccatctcgtaggtttcgttgctgtcccctgcagccccccccctgcgcccgccctgcgcccgtaagattgaggccggcggcctccgaaataaaaaagatcctgcaagaaaaaaaaaagaaagatctagggcgagagaggaagagggagggagggaggaaaaagaataacctagcaagcaagcttgtgagatcgatcgtggtcaagattatggatccggtcacggcatccatacacggtcattatctccctccgccattcaacacccgcgacttccaccaccatctccagcagcagcagcagcaccaccaccaccagcagcacctgcagctcaagaccgaggacgaccacggcggcggcgcgccagggctgttcggcgaccgcggcacgcagggcgaccacgagaacaatgacgagaacagtggaaacagcaacgggagcggcggcggcgagctggcgctggttcccccgtctggtggcggcgggcccgagggcggggatgccacccctcgccgcccgagaggccggccggcggggtccaagaacaagccgaagccgcccatcatcatcacccgggacagcgccaacacgctgcggacgcacgtgatggaggtggccggtggctgcgacatctcggagagcgtgacggccttcgcgcggcgcaggcagcgcggggtgtgcgtgctgagcggcgcgggcaccgtgaccaacgtcaccctgcggcagccggcctcgcagggcgcggtggtggcgctgcacggccggttcgagatcctctccctctccggctccttcctcccgccgcccgcgccgcccgaggccacgggcctcaccgtctacctcgccggcggccagggccaggtggtcgggggcagcgtcgtcggcgcgctcacggcggctgggcccgtcgtggtaatggccgcctccttcgccaacgcggtgtacgagaggctgccgctggaggacgacgacttgctcgctgcccatcaagcgccgcaggcgcaggccgacggtgtcctcgcggccgcgcagctcgccgccggctctgtggatccggccctcttccagggactgccaccgaacctgctcggcgacgtgcagatgccgccagagccggcctacggatggaacccgccgggcgccgccggtggtgcccgtccggcgccgttctaataattattgcacgcagcttggttagatgatggtctcgtctcgtcgagtgatttagcttttcttcttccgtgtttacttgaatctgtatcgtgaagaacgaatttccgtgggaattgcatatgatttcgcatgttaatcagtagtaagtcatcttactattgttccagagaatatgtagcttctgtctgtcgtttcctttcgctatttcttgtgtcgtacgtcataactcttgtcgctgttgactagcttcaagccggttttgtatcaaaaccatctcttttgttcctctattcaatagagcttaattaatagtcatttttccggtaaggctaccgatagcacatcatatgcatataagcatatagtcgtgtaaaacattcttttatactactataaagtacattgtttatagagtgtaatttgaaatgagggacgagataagtaaactggggagatatatagtctactagacattgctatagcaagaagaagggcaagagaggaaactgatcgggaaattgaaagaattgaggggaaggataaaatgacatgggggataggcttggggagcatgtgtggaaagaaagagatgtgtatacttttaccctgctggcctgtgcaaacttctctgacttccaagccttggaagtgaaggtttgatctgtacgagaaatgcctgtcctgacaccaccacacacacaggcaccaacaccagcatcattgcatgctaccacaaattctgccatttcttccgagttccgacacgctcccatgcatggacactgactctcggaataactgaaagtcactgaccaattactaccgtacgtcgtgtcctgcaggacaatactagcagtggtagtaacttcgattgcacgaattactacctcagtctcattttttagtatatgttccatcgtcgcaaggttgtagcactagcacccgataccgcctccatcgcgccgtcctccgtcatggtcgtccctaatcagagttcctttgatctccttcatatccggcacgaactctctcgtctctaccacgacagcactccgcgccgtcaccatgcttgacctcctcggctcctcccccatgcttacaccaccatgctgccggctagctgatttatctatttcaaccaccaatgcaacaccgtcgttgatgaattgatgatcttttgatctaccgcggtctccccgatccctccaccccttctaagagcaactccaacagactctgtaaaatgatgtactcgataaaagaaaatcacggtgaaaacccgttccaacagactcactttcatctttgcctcttcatcttgctccgcatatgctccccttcgctcggtatctttgccgaggctatgacactcaccatctctctccctcccgcccttcgccgtcgcgctttttgcgcgctccccttccctaccctcccgcgcactgttgcgcttctgggcaaacaattacactgccggatgtgtgcgtgtggacacgacaataaagacgagctgaacaacatcaggaggaggaggagcatctcgatctc

SEQ ID NO: 14040 - DNA, 835 bp, Zea mays
  misc_feature (730)..(730): n is a, c, g, or t
caccagaacattcgattctaaaatttacaatttacaatttacagctgtgcggaggcgggagcagggggcagcgagcacctagcagcgcgcggccggcgactccaccgagacacctcagccggccgcgcggtcgcggttgcctccggctggctcctcgcctcgatggtggggatgtaccagcaccaactccgcgacgaccccttcgacaccctaagcggcggccactgcgaggtacatggcggcggacagccgcggcagcgggtcgaggcgcttgccgacggaagaagcatgttgcgcggcgggggaagcggtatagttggcgccgcgggtggagatctaggggtgctagtgcggtggatgcgggaactcgcagcggatcccgtgggtccacttccggcgccatcagagcacagggtgaggaagcggcacgtgctggcctggcggcgcgctcgctacctcagattggaggacgtggcggacgcagaagagcttcccagcttctccaagaaaaggaagctctactgggatcaaaaaaagaaaggctgcttgaacatgccaacaaggaaatctgagaggcttgctaagagaatgaaactcatggcatcattgctcctcacgcaacggaaaaagattggagtaggtgagcactttcaggcagaggtacctggttggactgggcagccttcagggaaagagccttcatgttacaggaatgacccagagacatcanagatggggggggactagaatgtggcctccctgagggtgaaagttataaaaccgacattgtagctgtttgggcagggaaggcctggatcatgtaattgcctctacc

SEQ ID NO: 14041 - DNA, 1090 bp, Zea mays
aaaaaaagcagtccaaacacgcaacgcaacactcgccttcccctcccaaccctccgaaccgaagcagcaaagctagacgatgacgctgacgatcccggacgaggtgcgcgccaaggcggaggtgtacgtgggcgacgcggcggggcaggagaagacgcggctgctcctccaggagacgggcctcccgagcgggctgctcccgctgcgggacatcatcgagtgcggctacgtggaggagacgggcttcgtgtggctccggcagcgccgcaaggtggaccactacttcgccaaggccggccgccacgtgtcctacggcgccgaggtgtcggcggtggccgacaagggccggctcaagaagatcacgggcgtcaaggccaaggagatgctgctgtgggtcaccctccacgagatctgcgtcgacgacccgcccacgggtaagctccactgcaaggccatcggcggcctgtcccgcagcttccccgtcgaggccttcgaggccgaggagccggcgccgcccggagccggcggtgtcgttcccagggacgcggaggaggaggaggaggtggagaaggaggagggggagggggacaagaacccggagcaggaagcggcggccgagaaagacggcgacgcccccgctgccgctccagcccctgaggaagcagaaaaggggctggggattttatatcaactcgtgctttgttcattgtcagtcgctgaactcgttgacttggcactctccaacttcccccagagtcaacaataagagcattgcagaagcagttggagactggttctttgacagaagagaggtgaaggagatagattgcgaatacccctgcaacccgacgtgccacaacttggtcttcgcaaggcctttcaagatatgaaattttatctctcttcttccgctatgattttgttgtaaaatcagaaaaaaatataaacttgttattataaatcattttacccaaaaaaaaaaaaaaaaggagaagcttgagaagcagccttgagttcacagttgccaagccccccctttttttagggcgccggtttttcgggacactacccaggagaccaggcagcatgc

SEQ ID NO: 14042 - DNA, 1105 bp, Zea mays
  misc_feature (928)..(928): n is a, c, g, or t
ttgggtacctcgaggccggccggcgtctcccctcccggtcgccagtcgcgtcgaccccgagtcccgaccggtgcgcgcgcaggcgcacagccaggacacgaccgagcacggagcaacgtcgccctcccccagtagcgcagcccggccacgccctcatcgcccatcctgccgggccgcgtcgccgactcgccgccaattaccattcgcctctgcagacccgacacggcgcgcggctcctcgccgatttgttcccggcggctcatcagaaaggctgtctccttggggggatcgattactcgcgtggctcgcacgatactcgggggttctgacttggttctaaacagcatctgcatcttctcgaccccccaggctttggatctggccttcgtctcagttcagcgagccgcgaagaacagccttgatttggtgccccaagtgatgtagtgtgagaggctaacttcttgagagcgcgatgagcagccagggattcggtgcggggagccccaagtccttccgctaccccagaggcggcgacttcgatctcgagtccgggtccccacgcaagggccgcaagcccaagaaccctcacctcgagacctcgatcgtcatgaggatccgctacttctacgaggcgcaccccgtggccgtcgccctcatcctcctctccttcgggctcagcgtgctcatcctcctctccgtgtacgagacccggttcaggacgatgaggagcgtcagtgcgtggtccagtgacggtggggattatccattgccaatgctccggaaccttgtcatggtggctgggcattcgatctatacgagctcaagatgcggggagaccgagagtgagaattcctggttcttggagccgtaccagaagcacgctggacaggcggccaccttcctggctcacatcaaggagggggtgggngatcgcggcgagggatgagggggcactcctgttgttcagcggcggggagacgaggagagatgctggcccgacgagtgaggcacagagctactgggctattgccgagtcgaaaggcatgtacggaaactgatacggctgtagaagccgagcactcaccgaggagcatgcacgagatag

SEQ ID NO: 14043 - DNA, 1648 bp, Zea mays
  misc_feature (1632)..(1632): n is a, c, g, or t
tcgcgagtcccgaccggtgcgcgcgcaggcgcacagccaggacaagaccgagcacgccgcgacgccgcccgcccccagtagcgcagcccggccacgcccccatcgcccatcctgccgggccgcgtcgccgactcgccgccaattaccattcgcctctgcagacccgacacggcgcgcggctcctcgccgatttgttcccggcggctcatcagaaaggctgtctccttggggggatcgattactcgcgtggttcgcacgatactcggggggttctgacttggttctaaacagcatctgcatctcctcgaccccccaggctttgaatctggccttcgtctcagttcagcgagccgcgaagaacagccttgatttggtgccccaagtgatgtagtgtgagaggctaacttcttgagagcgcgatgagcagccagggattcggtgcggggagccccaagtccttccgctaccccagaggcggcgacttcgatctcgagtccgggtccccccgcaagggccgcaagcccaagaaccctcacctcgagacctcgatcgtcatgaggatccgctatttctacgaggcgcaccccgtggccgtcgccctcatcctcctctccttcaggctcagcgtgctcatcctcctctccgtgtacgagacccggttcaggacgatgagtagcgtcagtgcgtggtccagtgacgttggggattatccattgccaatgctccggaaccttgtcatggtggctgggcattcgatctatacgagctcaagatgcggggagaccgagagtgagaattcctggttcttggagccgtaccagaagcaccctggacaggcggccaccttcctggctcacatcaaggagggggtggggatcgcgacgagggacgagggggcactcctgttgttcagcggcggggagacgaggagagatgctggcccgaggagtgaggcacagagctactgggctattgccgagtcgaaaggatggttcggaaatgatgagggtgtaaggagccgagcactcaccgaggagcatgcacgagatagttttgaaaacctcctatttagtgtgtgccgtttcagagagctaactggaagatacccacagaacataactgttgttagctacgatttcaaggaggaacgttttgcacaactgcacagaaccgcactcggattcccggaaggaaggttcttcttctcaggtacaccagctacgccttccgcaagggaggctgctctgaaaggcgaagcagctgtccgagctcagttccttgaagacccgtatggatgtctaggatctcttcatgtaaagaggctgaagcgggacccattccaccgaaccattccataccctgccggttgcccagagctgaagggtcttttctcctattgtggccctgtgccttactctggacacctcccttggactgagtagtagtgtaatgtacatcagccttggatggagctccccactgccacttcacgatgtccagcagccttgcactgaccttgttctgaattgagggagagtatatgttacactatcaacatatggatttttaacctttttgtttcttctcgaaaaaaaaaaaaaaaaaaaataaaaagtaaactaaaaaaaaacngaaaaaaaaaaaaaaa

SEQ ID NO: 14044 - DNA, 1779 bp, Zea mays
gccagtcgcgtcgaccccgagtcccgaccggtgcgcgcgcaggcgcacagccaggacacgaccgagcacggagcaacgtcgccctcccccagtagcgcagcccggccacgccctcatcgcccatcctgccgggccgcgtcgccgactcgccgccaattaccattcgcctctgcagacccgacacggcgcgcggctcctcgccgatttgttcccggcggctcatcagaaaggctgtctccttggggggatcgattactcgcgtggctcgcagttcgcacgatactcgggggttctgacttggttctaaacagcatctgcatcttctcgaccccccaggctttggatctggccttcgtctcagttcagcgagccgcgaagaacagccttgatttggtgccccaagtcatgttgggtcagaggcgcacgccccggcagcgccatgagcagccagggattcggtgcggggagccccaagtccttccgctaccccagaggcggcgacttcgatctcgagtccgggtccccacgcaagggccgcaagcccaagaaccctcacctcgagacctcgatcgtcatgaggatccgctacttctacgaggcgcaccccgtggccgtcgccctcatcctcctctccttcgggctcagcgtgctcatcctcctctccgtgtacgagacccggttcaggacgatgaggagcgtcagtgcgtggtccagtgacggtggggattatccattgccaatgctccggaaccttgtcatggtggctgggcattcgatctatacgagctcaagatgcggggagaccgagagtgagaattcctggttcttggagccgtaccagaagcacgctggacaggcggccaccttcctggctcacatcaaggagggggtggggatcgcggcgagggatgagggggcactcctgttgttcagcggcggggagacgaggagagatgctggcccgaggagtgaggcacagagctactgggctattgccgagtcgaaaggatggttcggaaatgatgagggtgtaagaagccgagcactcaccgaggagcatgcacgagatagttttgaaaacctcctatttagtgtgtgccgtttcagagagctaactggaagatacccacagaacataactgttgttagctacgatttcaaggaggaacgttttgcacaactgcacagaaccgcactcggattcccggaaggaaggttcttcttctcaggtacaccagctacgccttctgcaagggaggctgctctgaaaggcgaagcagctgtccgagctcagttccttgaagacccgtatggatgtctaggatctcttcatgtaaagaggctgaagcgggacccgttccaccgaaccattccataccctgccggttgcccagagctgaagggtctgttctcctattgtggcccggtgccttactctgggcacctcccttggactgagtagtagtgtaatgtacatcagccttggatggagctccccactgccacttcacgatgtccagcagccttgcactgaccttgttctgaattgagggagagtatatgttacactatcaacatatggatttttaacctttttgtttcttctcgacgacttggctactgtctttactcacaattcaaacttgtgattttgtttttacacgcacaccttattctgtggtgcaatgcaaacagtgaagaacttccccttcgcagctgaagttaatgaaccttccctgtcagcagaacctgaacagaatgatatcctgctgttcttct

SEQ ID NO: 14045 - DNA, 2404 bp, Zea mays
atctaacttttaattaccatacatttttatgtcacacttgtctaagataattaaggttaagcgcttaaattcaacgccacagtttgtcatgtctaagagaagtttatcatagttttaaaagtcattgacgaatgaaacctacgtagtaggagaaaaatgttgccacaactatgattttaaaacaaacatatatctaactttacctagccttactcatgacaaatcttgacaagtgaggcatttttccgtcgtagtcggttctgtatggtgagcgggcgaaggaaggtgaagcagcgtctcccctcccggtcgccagtcgcgtcgaccccgagtcccgaccggtgcgcgcgcaggcgcacagccaggacacgaccgagcacggagcaacgtcgccctcccccagtagcgcagcccggccacgcccccatcgcccatcctgccgggccgcgtcgccgactcgccgccaattaccattcgcctctgcagacccgacacggcgcgcggctcctcgccgatttgttcccggcggctcatcagaaaggtggggtctctacttccgagatcactggagcactctctcggttttaatccgtaatcgtgctgcttggcgtcgatttctcatctccgcaggctgtctccttggggggatcgattactcgcgtggttcgcacgatactcggggggttctgacttggttctaaacagcatctgcatcttctcgaccccccaggctttggatctggccttcgtctcagttcagcgagccgcgaagaacagccttgatttggtgccccaagtgatgtagtgtgagaggctaacttcttgagagcgcgatgagcagccagggattcggtgcggggagccccaagtccttccgctaccccagaggcggcgacttcgatctcgagtccgggtccccacgcaagggccgcaagcccaagaaccctcacctcgagacctcgatcgtcatgaggatccgctacttctacgaggcgcaccccgtggccgtcgccctcatcctcctctccttcgggctcagcgtgctcatcctcctctccgtgtacgagacccggttcaggacgatgaggagcgtcagtgcgtggtccagtgacggtggggattatccattgccaatgctccggaaccttgtcatggtggctgggcattcgatctatacgagctcaagatgcgggggagaccgagagtgagaattcctggttcttggagccgtaccagaagcacgctggacaggcggccaccttcctggctcacatcaaggagggggtggggatcgcggcgagggatgagggggcactcctgttgttcagcggcggggagacgaggagagatgctggcccgaggagtgaggcacagagctactgggctattgccgagtcgaaaggatggttcggtgagttttcggcaacttcattatttcttggttgatgtactttagtaagatttgtgtcatcgtgagtctctgttgctctagtcgaagttaggataggtcgtgcagttacttatgactgctaaatgctaccctccccctgctctagtaaaatgcaaaacaaacaagcttgtctttggggctatgtattcataggatagtgatttagaattgagagtgggtgattcaaaatttcaaatagtcacttgtggttcttcatttattctcaattcaaaaatcatattatgtttctgtaaggcactaccgataggcaagccctaaaatgctggtttctggttatgtcaaaatatacacttcaatgcacatttccatctctgcatgctcaaacaagttaatgttcctgatggttaatattttttagctttctcactgtcatcactcatcagtgtggtagttaaaccttattcatgcttgcagctacatcttgatgttctttcattttctgtaacactgaatgatttcccagttgtccacttgtccttgacagtcttcttaccgattgtgtggacatgcacaggaaatgatgagggtgtaaggagccgagcactcaccgaggagcatgcacgagatagttttgaaaacctcctatttagtgtgtgccgtttcagagagctaactggaagatacccacagaacataactgtaagctttgcttcttttgaaaactttgaatcaactgtttacttgttcataccagtataacaatggatatagatcttctgaactttgaatccaagctcttcgagttctggttatcgccattccctaatcggcacacttgaacgtctgttccttaggttgttagctacgatttcaaggaggaacgttttgcacaactgcacagaaccgcactcggattcccggaaggaaggttcttcttctcaggtacaccagctacgccttccgcaagggaggctgctctgaaaggcgaagcag

SEQ ID NO: 14046 - DNA, 2478 bp, Zea mays
  misc_feature (2285)..(2285): n is a, c, g, or t
ctgaaaattctctttgattgcttcgtttgatatatttacatttccactgtcactattcagctgcttgcatgacatgggacttggctgagtcgggtaaagactttgttacctccatcgttaacagaaatgacctagtgccatcacttggcctagtttctgctgccaagcttcgggcagaggtacctctcggtctattcatttgatgatatttgagtatctaagcaaagtggaacactgagttatattgaatggttaagtagtagtttagaaggaaggataattattcttcaaacaatttcttcgcttaaaagaaaacatatatttactcttgcactgaatgttggcaggttatgtcatcgtcttgggcacatgaccttcgcaaacaaattcagcagactagattcttaggttttgtgaaccgttctgtgagtttcataaggtctcatgtgccctttgtctctgatccaagatcgaaggttgtggatgttgatatgatgcaatctcagagtcctgaggtataacaagaactagttcttaaacagataaaatggcaaatctattatgtctagtacttatgggtcgattcctcattgtttttggtaggctgggagtaagccttcagcagatacccatgctgtggtgaagaaacgccctgcactggcttgctggtcatgtgtggctgcacccaaacagagtatggaatcgtcaatacaaattgagggcacgaaagttcaaaccgacactggtgtccaaactgagaaaactaccgaagcggcaactgctgcgctagtctcaatccatcttggtgaactaaaccttcaagaaccagataacagagaggaaaagggatcagcattgacagaaacagatgaagacgccatggagcttctggagtccttgaccgacgagaagcagttgccatcatcgtcaagctctggtcaagagccacaccagctgtaccccccagggaaaatactccacatggttggattgccagcagcggaagaggcaaccacgagtcagcaaggagcccaggaggaggtcatcgccctatatgagacaccccgacatttgtacagtaagattcgcctggcgaggtccatgataggagaacattacatgcccaagtacatcaagacaatggagcagttgatagacaagcttgcagaggacatcgacgaccagctggactccttgtagcatcaaaagtgtgtacaggataattattgtacagatcatgaaaaggaaagtcattctttcagattgcttgtgcgtaattgtagttggtttaagttttgtgatggcgatctagaagatgtacaacactgccagttgggctctggtctgtttattcttggtcattccactttggcaggcacctcaagaaaagctcaaagagctgcgcctggtgatgatctctgtaatttcaacagcactagttttctttagctgtgaatatttaatatattaaccattaatttgtgggcatcatctctttcaggagactagggatggtagtctagctttcgtagccggggtatggatgtgaaattctaccatgggcatcagcgagttgggtacccaaaacaagacgagtagggtacgtgaaagatccagattggttttttattgagtaataacaactaatgaactaatgctttccttaagataataagctatgttagtccacaaagtaagattgagcaaggattgaagtatggtggatatccagtttttttacttagtaataaaagctagtgaacaatgttttacttaagatgataagctacgttagcccacaaagtaaagactgagcaaggaattcttattcttttcttcttatatatatatatatatatatatatatatgaaagccggttcaaaacgacttctctcaccgtgtccacgtcgccgcaaatgtttgcaggcgttggattactaatcgacggtcaaaacaaggtttcccttctataactttgttctctacgcctctagatccatcttgcatgtatactcttggtcgcctccactccattcaccctcgcgctacagatcctgctcatcctcgctctctctgtcgcctctttgtcctagcgtcatgcgccgctccacgctacaggtccttctcctccactctctctccgtcatttcttcctccacgctacaggtccttgttcaaggtttccatgccttcctcgttttagagttcatgttattcgtcaatgacatccatcggggaaaaaaacttggaaatttcgtttctccctcttctcttctagccttcnggttctggccatagcggcgcttgggataaaaatgcaatcgcagctgccgcgaaatctgcttcacgcatgcgttgattttcctggcctccgtcgacacagcggctcaagttccactacattcctattccattccggcttcacgcatgttactccacgaagtaagatgagcaaggaatgaagtatgctgagaaaa

SEQ ID NO: 14047 - DNA, 2754 bp, Zea mays
  misc_feature (2722)..(2722): n is a, c, g, or t
  misc_feature (2726)..(2726): n is a, c, g, or t
  misc_feature (2737)..(2737): n is a, c, g, or t
  misc_feature (2741)..(2741): n is a, c, g, or t
  misc_feature (2752)..(2752): n is a, c, g, or t
ccatagaaataaaaacactgaactttctgtccattagtataagttcggcagcagaaagtctgccgcctggggttgtggctcggattgttccggttattggattgcatggtggtgctttacttggtgtcacataccgtacatctcgtagaatcagtcctttgacagcaacagctatatcaactgttcaatcgatgcccttatcaggttttggtggaagtggatcatcttttgcatctgatgatccattttcctctaaggaagggcctccacaaaatttccaactgtacagctgggagacctatcagcctgttagtggcctacttgcacaacctgagtggactgtgtgggaccaaactgttgagtattgtgcatttgcttatcagcagtatatagtgatttcttccttgcggccccaatttaggtaccttggagatgtttcaattccctttgcaactggtgccgtttggcatcgaaggcagttatttgtgtctacaccaacaacaattgagtgtgtctttgttgatgctggagtggcagcgattgacattgaaacaaaaaggataaaacaagaaatgaaagcaagagaagctcagagtcgggcagctgaagagcatggagatttggctcttatcactgttgaagctccccaggttactgtgagtgaaaaagtatcattgaggccaccaatgttgcaggttgttcgtttagcctcctttcagtacgctccatcgataccaccatttatagtaccaaagcaatccaagttcgatggagatgattcagtgtttcagaaagaactggatgacagaaggtatgctgaagttgctgtcgctggaggaggtgtgtctgttgcagtaactcgcttccctcctgaacagaagagacctatcggacctcttgttgtggttggtgtaagagatggagttctctggcttgttgacaggtatatgtgtgcacatgccttatcactcagccatcctggtataagatgccgttgccttgcagcatatggggaccctgttagtgctgtgaaatgggcaacgagacttggcagagagcatcacgatgacctggctcagtttatgctgggtatgggctatgccactgaagctctccatttgcctggaatatctaagaggctggagttcgaccttgcaatgcagagcaatgacctgaaaagagcacttgcttgtctattgacaatgagcaatagccgagatgtgggacaagaaacagctgccgctgatgccactgacgttacccagattcttaatttggcggtagctaagcaagctaagcaggaaagtcttgcagatgccgtgcagggaatagtgaaatttgtcaaggagttctttgaccttattgatgcagctgacgccactgggcaatctgacattgctcgtgaagttttaaagagattagcggctgcagcttctgtaaagggagcactccatggacaaatgctgcgaggcctggcactccgtcttggaaatcatggggagcttactagattgtcgggtctggtaagcaatttgattacagctggccatggacgcgaagcagcatttgctgccgcagttctgggagataatgccctaatggagaaagcatggcaggacacaggaatgttagctgaggctgttttacatgctcaggcccatggtcgtccatcattaaggaacttggttataacatggaacaagatgctacagaaggaactggatcacacaccgactgtaaaaaccgatgccgccgccgcattcttggcttctcttgaggatccaaagctcacaagcttgggggaaactgagaaaaagcctcccattgaaatacttcctcctgggatgcctcccctatctgcacctccgatcgtgattaaaaaggctggagcaaaacctggtctccctaatgcagcaaaggcgtcaaatgggcctataggtgctcctatggctcaaggtgctcccatggctcatggtactcctggggcacaaggggtccccatgaatcaagttactccatcacagggcagtcatgacgaggcaaggccatcagatgctacagtggctgatgcagctgccacggttgcagaaggtacagcagctcccccggctgcagaaggtacatcagctcctccggctgcagaaggtacagcaactcccagcagtgaggaagctaaagcagcacctggtaatgaggaaggcacatcaaatccaatcaacgaggaagccacagcagctgcagtttcagttgctgcaggcagccctgactctgctgctgctcctgcagctgatactagctcggacgcacctgctgttaatcccacggaagataccgtctctgccccctcaacggaggcaccaccagagttgacggataagccatcttcagcagaggcatcgttgccacctccacccagtgtttctggtgtataaatatttctgattctcttttagcagtgtgccgaattttctgtattctggttcgttcgttccaccacgcgcgctggtataggtatttgttgcctgtggtatacagatttcgcagacgccaggcagtatgtgagtagctttgtacatctgctgtctgcgtctcacgagaacgtgctaccgttgtgtcactgacactgtgtggccatatcttatgttgttggtgaccacagttcaattcttgcttgatgagttaataaaaaaaaaaaaaaaaaagcttctcgtgccggtacccnattngccctatagtnagtngtattacgcgngc

SEQ ID NO: 14048 - DNA, 2376 bp, Zea mays
aattcggcacgaggggcgtcaccacgcctccgccctcgccctccccgtcccccgcaatctcacagcggactctcttccccaccgcgtcgaagccattccccacttccccgccgcggtccccccttccccacccactagagaccgtgcccttcccccttactcggcaatctcgcagcggtgcccgccccatccccgcggagctcactagtcccccccccccaccttccatccctcgtgacctgttcatgccgtcgccgcctcgatcctgtggatctccctgccgcctcccacgtccgtgctcatgacctgttccgcgtccgctgtcacccccagatcgcgcgaggcccatgtccacgcagtcatcgtcgccgccccctggccacgcgagatgctagcgccccctccaccttgcgtgagcgaccccttcatctaccttcaccaccatcttcaatccacctctgcatcaccgccaaaaccctacccacttccctgctgcccaacaatgaatccgcctccgcaccaccgccaaaactctagcaactatggcagtgaacaacatccggtttcaagtctttggcagctatgctcatggaaaatacgtctatgttgatggtgaccgatctgttctcgcagaatcagcaaaggcttgatatcattgttgttttgctttatcatttgggcatttgaagcaaagctctatggagaaaaggcagggaaatgttttctttctcatttttgcaggctgacgaatttaatgcagtggcaagagttggggttgctgctgaccatcgtggaatcatctgcagtcgtcgtgtgtccacactccctaacatgttgagcctcttgctgatcagatcaggcttgagaaggaaaatttggttttaataagtgttcttgtctggttcgattaaagaaagattcagtaattgtcttttttaggaacatagattcttcatctgtgtataatgtatttttattatctagattgtgatagtaaaaaaaaaaaaaaaagatcgtatagcttgaccattgattgatgattatctgctgtcttaaggaatggtacattgtatgtgttctttggtgttggtggtagtttgctgacttctctatttatggtatcaaatatatctattgagtgttggtacttcaggtgcactatttagactattgggatcaatgctgtcagagctcataataaattggacgatatacgagaacaaggtcaattctaaaatatatgcagtattgcaatagtggatggaaacagaacaaaatagttgttccttgcaggtattgcaatatctcaaaccagataaaagtaaatttttactcaggtattttcacctatcttattacaattcatcaaggtattttcacctagcttattacaattcatcaatcttgcttcactacccatggtaacttgattattttcatgcactaactttttgacgtcctatttcttttcttttcccctttcacctcaaaacactcattttcatctcaaagcactaattaccagatacgccaatgtcatttaaattaattttcagcagtgctattattttttctgctatttgttttggaccgattaatattttgtgtactcttcctatttcctcgcgggactgtaactgcaaagcttgtaactcaagtcatatgtgtcttgtgcctgttgttgtagctatggagcagaaaattcatgtgaacccactgaagatactaagcgaaacgaagtgtacacatattcagaattctagctcaagttgccctaatcaactgaggaggataaggatgtcgtggattttgagagggaggagcctgccaaatgccagaagtctgtgcaagctgatgcaaatgcgaaagaacatcagtgaagacattcttactgatttactaaggctgttggcttcttcgggaggacattatacaccacattaattctgcttgttgcgagccttccagatgtgtatgagccatgtgatgatttctttgcccttgttgatgcactactctcagacaaagcacaacttttgacactacaaccaaggttatgtatgtagctttttcgtcagacgatgacactatcatgcaaggcccactatcctctttgttgtcctctcatggatcctggtccagtggtggaggctgaggaatcagaaaggccccagatcatggccagtcatcgacgcaacggtggagcttatggctggaagtaatatgaagagtctatatctgacaaaaaatcatctaaaattaaatagtaagataagctttgaatagctgatgtaaaattatggagtaacattgtattagttgttgacaaaaaatgtgagaaatttaggtcaataataatatatgtattggttgttt

SEQ ID NO: 14049 - DNA, 2517 bp, Zea mays
accgcatgttaataccgagggcgtccaccggcgtcaccacgcctccgccctcgccctcgccctcgccctccccgtcccccgccaatctcacagcggactctcttcaccaccgcgtcgaagccattccccacttccccaccgcggtccccccttccccacgcactagagaccgtgctcttcccccttactcggcaatctcgcagcggtgcccgccccatccacgcggatctccctgtcgccccccaaccaccttccatccctcgtgacctgttcatgccgtcgccgcctcgatcctgtggatctccctgccgcctcccacgtccgtgctcatgacctgttccgcgtccgctgtcacccccagatcgcgcgaggcccatgtccacgcagtcatcgtcgccgccccctggccacgcgagatgctagcgccccctccaccttgcgtgagcgaccccttcatctaccttcaccaccatcttcaatccacctctgcatcaccgccaaaaccctacccacttccctgctgcccaacaatgaatccgcctccgcaccaccgccaaaactctagcaactatggcagtgaacaacatccggtttcaagtctttggcagctatgctcatggaaaatacgtctatgttgatggtgaccgatctgttctcgcagaatcagcaaaggcttgatatcattgttgttttgctttatcatttgggcatttgaagcaaagctctatggagaaaaggcagggaaatgttgtctttctcatttttgcaggctgacgaatttaatgcagtggcaagagttggggttgctgctgaccatcgtggaatcatctgcagtcgtcgtgtgtccacactccctaacatgttgagcctcttgctgatcagatcaggcttgagaaggaaaatttggttttaataagtgttcttgtctggttcgattaaagaaagattcagtaattgtcttttttaggaacatagattcttcatctgtgtataatgtatttttattatctagattgtgatagttatttcaaggcctggtgatcgtatagcttgaccattgattgatgattatctgttgtcttaaggattggtacactgtatgtgttctttggtgttggtggtactttgctgacttctctatttatggtatcaaatatatctattgagtgttggtacttcaggtgcactatttagactattgggatcaatgctgtcagagctcataataaattggacgatatacgagaacaaggtcaattctaaaatatatgcagtattgcaatagtggatggaaacagaacaaaatagttgttccttgcaggtattgcaatatctcaaaccagataaaagtaaatttttactcaggtattttcacctatcttattacaattcatcaaggtattttcacctagcttattacaattcatcaatcttgcttcactacccatggtaacttgattattttcatgcactaactttttgacgtcctatttcttttcttttcccctttcacctcaaaacactcattttcatctcaaagcactaattaccagatacgccaatgtcatttaaattaattttcagcagtgctattattttttctgctatttgttttggaccgattaatattttgtgtactcttcctatttattcgtgggactgtaactgcaaagcttgtaactcaagtcatatgtgtcttgtgcctgctgttgtagctatggagcagaaaattcatgtgaacccactgaagatactaagccaaacgaagtgtacacatattcagaattctagctcaagctgccctaatcaactgaggaggataaggatgccgtggattttgagagggaggagcccgccaattgccagatgtctgtgcaagctgatgcaaatgcgacagcggccccggctaaggctgttggcttcttcgggaggacattatacaccacattaattctgcttgttgcgagccatccagatgtgtatgagccatgtgatgatttctttgcccttgttgatgcactactctcagacaaagcacaacttttgacactacaaccaaggttatgtatgtaggtagtgtcagatagtggttacgtcgtcacctctattgcaaccatgttttgtacacaatatatgttttatatatggtgcacttggttccgtctctatttcactttttctcttaccctcttcttttcatgctttttcgtcagacgatgacactatcatgcaaggcccactatcctctttgttgtcctctcatggatcctggtccagtggtggaggctgaggaatcagaaaggccctagatcatggccagtcatcgacgcaacggtggagcttatggctggaagtaatatgaagagtctatatctgacaaaaaatcatctaaaattaaatagtgagataagctttgaatagctgatgtaaaattatggagtaacattgtattagttgttgacaaaaaatgtgagaaatttaggtcaataataatatatgtattgtttgtttatatgt

SEQ ID NO: 14050 - DNA, 1657 bp, Zea mays
gtgatgtggccgcgcgagccgcgaggagccagccagccatcagccatggtcgtcccagtcccgccgccgcctctcctcgcttcccacgtggccgtccgggccgcggcctccgccatatcccacggccgccgggtcctccttaacggcgaccacccgccgcaggtcgcggccctcgggcgcggcgactgggtcaagctcatctgcggcgccagctttgaggatgcagctgatgtcaggaatctctcccttgtctacactcttgctggagtggattgcattgattgtgcagcagatgcatctgtggtgggagcagtgaatgaaggtattgaagtagcagcatcaattgtaccaacagttcaaaggccttggctgatgattagtgttaatgatgattgcagagatcttcatttccgtaaagctgagtttgatcctgatgattgcccactggattgctcaaagccatgtgagaaagtttgcccagctgatgcaatatcactaaagcatcccatggttgatggagagcgcacactatctgatcccttacgtggtaaatatgagggtggtgtaattactgagcggtgctatggatgtggtcggtgcttgccagtttgcccgtatgacagaataagagctgtgtcctatgttcgagaccctactatgactgctgaattattgaaaagcgatgatgttgatgcaatagagatacataccactggaaaaggaactgatatgttcaataccctctgggacaacttgagtgggtccatcaataacgtgaagctggttgcagttagtcttcctgatataggtgaatcaactgttgatctcatgaacgcaatatacacaataatggagtcccattttaaagggtataatctttggcagttagatggccgacctatgagtggtgacattggccgaggtgcaacaagggagacagtttcttttgccgctcatgtggcttcaatgtcagaaagacctcctgggttctatcagttggctggtggcaccaactcatacactgttgattacttaaagaaagctggtcttttccaatcatcaaattggaattcagggaccgcaacctctgaaatggccagttctcaccaagctttaataggagggattgcttatggtggctatgctcgcaagatcgttggacgggttttgcgcaaaataccagaacagtttggccgtgtgcacatcgaggatcatcctgatcatctactggaggctctacaagaagccatgtcattagtaggacctgtgaagggttatatacccagtcattccaagcctttcatgaaacaagtagatagacaataggaagtaggaaaagcgcaggatatacccttcaacccagttttgggcgaagataaggcgcatcgtactttagctgtgacagtgaggagttcaatgtggtcattgggccaggaatctagtggttgctgtcggtcgctcgttctagatggattatgggctatggaacctggagtgccgtggtgctgcaaacatctcatgtttcattctgaaatctttttagatgtataatacgtagtagttgaattttctgtaaaaaaaaaaaataaatggtgtttgcctttccaattggctgataagcctggccaaaaaaaaaaaaaaaaaaaaaagggggggg

SEQ ID NO: 14051 - DNA, 1629 bp, Zea mays
aaccttacccactgccatccctacccccaccacggccgaaacggatcgcagcgagcgaaaatggatgcacggtttgtgtgcgccgccgactctgagctccagctggcgcgggcccggtgcgtcgcgctgcaggaccacctcgccgcttcgccggacctgccacgccatcccgcgctccgctccctccttcgcctcgtcaacgccgagctgcgcttcctctcctcgctccgcctcgccccggccacgccgctctcctccaacctgccccacctcgtggcgctccacctcgtcctcacccaccctgccatacggagcccgtcccggctctcgccgctccccggcgtagatttctcctgcgccttccgcggccggcccgcgtgggtgctcgtgtccgcgagcaaccccgccaggctcgcctgggccccgcccgggggtctccgtgcccgcttcgcggcggcgctagaagccgcgcgcggtgccccgcccgctacgcggcccgagaagctgcttgtagtcttctcccgcggtgtcggcgtggatatcgcgcgggggctaaccgaggggttcgaggccgtggaggctgacttgctcgaggagttcattggcgactccgaggaggagaatgagcacgggtgggttgtcatcagcttggactcgagtgaggagctcaggaatttcagggcgttcgagattgatgtcgtggagggtgctagtgaggttttgcttccatcagacgtcgcggtggacgaggtaagtgctgatgaggaagagcttttgggtttctggggatcctttgctgcctttatggagaagatgtggaaagtatcgagggagctggtgaatctggacaccacggcactggtcgctatagtgtcagggatcagcaatggcggggtagggaagctgatggctgcacctgaggcagagaccagagcaaggttcaagtgcaactacaagttcgtcatggatcaggcacaatacgaactgcagtttccaatactcatagagttacggaaagcagtggaggggaagcaatgtatcatatgtgaaactgtcaacttggaattcaaagaaattgtttctatgtgtggtgggcctgaggagaacaccagagcaagacatttgttgaaacaacttaccattgtcccagacaatccttcagcacgaatgatggatcttccaaccacaaggaagctcgcgatgaaaaataaaattgtttttggcacaggtgaccattggcgggcccctactttgactgctaacatgggttttgtaagagctgtttcccagtctggtatgtccttgctaaccatcgagcaccgacctcgggcgctgattggtctgtgacagttagtatgccataactattctataggtgttttgagatcctaacgtttgtaattctgccccttctgaacattaaacaatatgaagttctggcaaaaaaaaaaaaaaaactcctagaactatggtgtagtgtaggatgtcctagtttactccagtgtctagtactgcgagctttgtccatgactgtgtaactggtccagatccactggagtttattcgagcgagaatgcttactatctgtacttgtatccttgacgtcaaagtcaagcaaagcatatgtac

SEQ ID NO: 14052 - DNA, 2166 bp, Zea mays
tatcctgcacacaacccactccgcaggccacggcggcatccagaaaaccctgcagaggttgaggacagatttctttgttcacagggacagggcactggttagagattgggttcgttcttgtgcagtttgccagcaaaacaaaacagaaacactccatccagcaggactatggcaacccttggaggtaccagctcagatttggtcagacatctcaatggatttcatcgaagccctaccaaaggtatatggcaaatcagtcattcttacagtcgtcgatcgattctccaaatatgcccacttcattccattgagtcatccatacacagcagccacagtagcaagggcattctttgatgagattgtccgactgcatgggttcccaagctctatagtcagtgaccgagacccagtgttcacgggacacatttggagggaccttttcaagctagccggcgtcaaactaaggatgagcacagcctttcatccacagactgatgggcaatccgaagtggtcaataaaactatcgccatgtacctgcgctgcatcacaggggatcgtccgagggcctgggttgactggattgcttgggctgaatattgctacaatacctcttatcactcagccctgaagacaaccccgtttaaagtggtctatggcagagacccccctccactcatcccgtaccagcaaggagcagcagctacaccaactatagaagaaatgtttcgcgaacgggactgctttctcgcggaagtcagagacagactcctacaggcccaggaacatgctaggcggttttatgatggccatcaccgagatctggagttcaaggtgggcgactgggtttggctacgcctgttacaccgacaggcacaatcactggtcagccgaccaaaagggaaactgggaccaaggtatgcagggcccttccaagttctggaacgcatcggctcagtggcataccgtctggaattgcctaaaggagcccgcatccatgatgttttccacgtaggactactcaaacctttcagaggatcacctcctgttctaccaccagctctgccagtactagaaaacggcaggcttctgcccacaccacaaaaagttctcaaagctcgacttcagcgtggtaaatggtccatcctggttcagtggaatgcagagcagctagagcaggccacatgggagcccctgcagcaattcaaaacttcctacccacaatttcagctcgaggacgagctgttcgtcgagggagggagagatgttatgactggaaaagtatatgggcgccggcctaagcagccaggggaagataagctagactgagcagataagtactcagataagatagctagagttgtttagattttccttaaataaaggtagtttgtttagatccccttaaaaggaggaagtcttgttaggccagggcaatatataagccctctatgcctttagtctgtaatcaggaaagatcaatcaaagaaagagattgagtcttgcctccctgctgttctcaactccattgctgcgcctgaaccctaggtcaggcgtcaccacggcaatctctcacacctcttcctccaaccctccaaccattagccactcatacaacctccgcagccggggtaactctatcacttccctgtgttcgtccgcccccgcccttgtacggttcatgcacccagagtgatcagtgggttcaaaccccacttcaagtttcccaggatcagagtgtccaccgatttcaaaccctgcttccagtttcccagacatgacctgctctaaaatctgcctgaggacaagctctacactagggttagctccaatgctccattgagcacaatattgttgcagtgcttccacaccgtccagtttccaggatcatagcattcattctcttgatcccttctaccttgggtatttgattttctaggttgaattgtcctctttctccttacaatacacacatatgtaattgctatatcagtggggtctgtgtgtgttttgcaactcttctattaatgcaatgatacacaactttgctgcgtgtttgaaaaaattttgtatggagcttgtacatgttatttttaaaattttaatggtttccatgcacaagcaatagtggaaatgttttgcgtgcaggtcttggctgcaggcatgca

SEQ ID NO: 14053 - DNA, 2150 bp, Zea mays
attgtgctcgctgcgctgtgtgtttctggataataaaaaacccgccagcccccgcatcggagggccgcgcaagtgggtcaactcgcaactgaagaccaaaggcgagagccggctgcccggattccggaagcgcccaagcccccaacgcgaccgtcgctgtcgccaccgcgctcggctcgcccgcgtccacagaagccgccagggccatacgccgatgaatcctgccgcgacggcggatcccagcagctccagcacctcggcggccacgctgcggaagcggatgatctctatagacacggctcgacgaggagccgacggcgcgtcgcctgagaccgcgcccaggccagatcgggcgggtagtgataaggcgccgcaggagcgggaggaggagggctcgatggcggcctccgcgcctgcggcggcagcagcgagggagagtgacctggaggcggtgggcgagccgatgagccccgcggggcggctgttccgcgagacgcacttcaactgctacatcgtggccgtgatcgggctgggcgcggcggtggacgtcgcggcggcgcgcgcggggctggaggtcacgctcgtccgccacccacgcttctccagcgtccaggtgaatgatggtgatgcgagaaagaacgccaagccgcggtgggtgcggaccacggttaacctggatgatcacatcatcgtcccctgcctggaacccgctgccacgtcgaccaagccggaccaggccgtggaggactacctgtcctggctgtccacggcgcccatggaccactcccgcccgctctgggagttccacgtcctggacttcccgacgtccgaggccaccgccaccgttgccatccgcatgcaccactccctcggcgacggcgtctcgctgctgtcgctgctcatcgcgtgcacccgcagcgccgcggacccggcgcggctgccggagctgccgcccgcgccgcgccgcgcgagccctgtctacgccaggcagcgccccccgctttccgcgggcctcgtggcgttctcgctgtggctgtggtcctacgtcttgctcgcgtggcacacactggtggacgtcgcgtgcttcgtggccacggcgtggttcctgcgcgaccagcgcacacccttcatggccgcgtccgagggcgtcgagttccgccgcaagcgcttcgtgcaccgcacgctcagcctcgacgacgtcaagttcgtcaagaatgtcatgaagtgtactgtcaacgatgtcctgattggagtgactaacgcagggttgtcgcggtattattttcgaaaaaccagtgataccaacaacgagaggaaaaaatcgcagaatattcgtgtccgatcagctctccttgttaacattaggagaacacctggtttacatgcattggcggaaatgatggattctatcaagaacaatagggcaaaatgggggaacctgattggttacatgatactgcctttccacatagccatgcacgatgatcctcttgaatacatccgccaagggaaaaggacagctcaaaggaagaaggcttcattagaagcggttttcacgtactggagtgggaacctaatagtcaaactatttggcatgaaggctgcagcagctctctgctatggtatgttcacaaatacgaccatgtcattctcaagcatggtcggacctgctgagaaggtggagttctacggccatccaatcgtctacatcgctccctctgtctacgggcatccacatgctctgactatacattaccaaagctatacgaactccatcaagcttgtcctcgcagtggatgatgctcagtttccagactctcatcagcttttggacgacttcgccgagtccctcaggctcatccgtcaggcagcttcaacaagatgacagacacaaataagagcatttttttccggtagaatgtagactgttggcgagaactcgcatagaaatgctggacaataacttatcaggaaattgatggcctggttacctgactggggactcttgaactttcaagaaatcattagaggcaaattgtaaagtgtaaagactagtatgtaatatcaatattgttcaaccaattgcggtggaattacgaaaaaaaaaaaaaaaaggaattcagcatcgactatgggtagctgtttgggct

SEQ ID NO: 14054 - DNA, 1453 bp, Zea mays
gaatttttcatatgttcatcttccatttcgctgtacccctagcattttagccttcgggggcttgaaggcatgcgattgtttccatctctcctttacactcctaaatattttttaatatgtttgtcaaactcatatttagaatcgttcaagataaaaaaaaacaaatgatttaaaaatttgacgagcgccaacgtgccatgtcgacgtctctttggataagccacgggcccacgcgatctccgccatcctctcgcgggtcgcctccaacacacggcacacgaccacggaccacctcgccgccaccgccccgtccgcgtgtcaccgacggtcgacggcgaccatgcttccctcattcctctcgtgcgtggcgtcccctctcctcaccaccgcatgcaccccgaccgcctcgtcgcagcaggcggctgccgcagcccctcccctgcagtcgctgaggctcccgcctcagccagggaacaactacaggcccgtcgctacgacgctggtggctgcggccgcggcggggctcctgctgctgtccccggcgacggcgccgtcccgcgccgaggcggagttcacagtgtactatggcacggcggcgagcgcggcgaactacggcggatacggcgggaacgcgagcaagaaggacacggcggagtacgtgtacgacgtgccggaggggtggaaggagcggctggtgtccaaggtggagaagggcaccaacggcacggactcggagttcttcaacccgcgaaagcgggcggagaaggagtacctgacgttcctgtccgggatccgcgcgctggcgccgctcagcgccgtgctcgacaacctggcgctctccgacgtcgggctgctggaccagatctcgtccgccgacgacgtgcgctccgccgagcgcgccgacggcgccggccaggtgtactacgagtacgaggtggcgggcgccagcgcgcacagcctcatatcggtgacgtgcgcacggaacaagctgtacgcgcacttcgtcaccgcgcccaacgccgagtggagccgcgacgaggccatgctccgccgcttgcacgagtccttcaagaccatccagcccggcgccccgccaccggccacggagacctagctccatctgagcacgagcgagaaacctactgagcgattcgcggtgcgttgtaattgctagtaaaaatcatcagttttgtataggctactctgcctttttcctcagttcctctgccacggagcttggcctattcattttcaagtgtaagtgtaaactttgatgtatacacgaatgactccagacagttttgcaagttcttgcattagatatctgataatcacaaaggtattgtttttaaaaaaaaaaaaaaaactctaatagcctggatcaagcatctctacctaactatttctctcagtggcccatacttatttcatcatggtatcaaaaaaaaaaacc

SEQ ID NO: 14055 - DNA, 1754 bp, Zea mays
  misc_feature (155)..(157): n is a, c, g, or t
  misc_feature (269)..(269): n is a, c, g, or t
cgacaaaaactcgtaagccgtacgtactactactatgaacccgtgagccctgcacaccctagctaacactaatagggcctacgtcgccagattttatttgtccgctttcacgcaagataccagagttaggatcattattaactctcgtctggtcnnnaggtgttgtgctacaaagctagggtttggttgaataaaaccagatcgcgcgatgaaatgtcatgtctgtgttcaattatcatccgaggggagcgagtcgacggcaacaacanctcgaggagacgcgccaccgcccaccagctagcgcaccacgccaccacccccgcccccgatcaacgcagcagcagggacgcctataaaccttggggtcctcgaggcccggcggggacgccccggcgccttcctgctagcactacgccactaccagtcagggcaagactcgcagcccggacaaggtaaggcgacgtacggcggcgatggcgccggtggtcatgatgagcatgtgcgtcgtcgtgtcgctggtggcggtgcagctgcaggcgacgagcagcgacggcgccacggccgccacaccgtccgtggtgctgccgccggtgacggtgccccgtgtgcgcggccggttggaggccggtcgtaagctgcaggccgtcgacgccgtcgggatgggcatggactccgtggtgcgtcggacggtggtgctcaccacgatgcagacgagcaactcgccctccctgggctacggctcgctccgcccgaacaacgctgtgtgcgggtccagctgcgccggcagacctcctggtgagccgtatctgcatcagatccgcccgtgtggggagtattatcagtgtccgtctacaccgtcttaattagatctaggcggcgcggcgtacgtttcatcaaattcaataaacataaatatgtataggtgagaactctatgaaatatatatgaatgtgtcatgtatatgcacgatggattatgaaatatgtatgttatattattctataatagtacacaaaatgtttctaccaaaaaaaaaaaaaaaaaagcggcgtcactggtgtttcttagaacttagaacccctagtgaaaatcgacgtcttctttttaagaactgccgatataaatatttatttacaggcacgtgtggttttgttaagaaaaccaccaaggtttgattaatctgcgtaataaaaaaatggagtcggtctatttaattaaaggttctagtgtttgatgatcaccataattatttgaactaatatatttctctagtgtttatgtttatagtgtaaaggatgcggcgtggatttggacgaaagcaaatgggtgagcatgaagattaacacctcaaagaaatacattagaaaacttattgaagatctgtcaagatcatgcaggagtataaaacatgagacaatagaagcccaggaaggcaagaaaagaaatgagaagtcatgaagaaaacaggctgcacagagtgcagtggatgtgtccgatggcacatcggatagacatgcgtgtacagatgtgttcatgagcttttgtagcaaaggacatgctctacatcgtcctaatcaatctctagaccagcttcaataatctcaaagttgcttacttatatgtgatagtgaaagggaattaggcttgcacctagttcctaaattattttggtggttgaattgcccaacacaaataattggactaactagtttgctctagattgtatgttctacaggtgccaaaggttcatctac

SEQ ID NO: 14056 - DNA, 1101 bp, Zea mays
aattcggcacgaggcggcccctgcccgccatcgactcttcgcgtctccgccgccgccaggctaccgctgcgccggcgggtcggcgatggacatggacatggagatgccagatcccgacgagctcgagtggatggagagccacggcctagtccctgaggaagaggacgcctacttcgacgaccccgacgagggcttcgtcctggcccccggcgattcggatcaaccgtgcaattccccgcagccgcaggagtccgccgcgccaagagcaaatgaagcgccgggcggtttgaagcggcctccgccaccgccaccgccggagcaggatgaggaagaggagaggagcaagcggagaaacgttgagcaggaggacgaggattggctgcgctactcgccgcctcccgcccctgagattgtcgtcgccgagaagacaatctcgcggttcgcgtcggagatccatggagactctgtgcccgtaactgctcccaatggtgagagagtttatgccaagcttgcgatggaggggttggtcggtcgaggaattagcggaactaggcaaggggttcagttctccaacccaaacagcaatcacaagggcctgctctcagaatcctttgactcactaacaaggcgtgctgagcaggaggctttagcaaaggcattgcaagaaagtacagactcaatagaccgtgtggcttgttcagcgactccactagtcacagaaaaactttgggtggaaaagtatgcaccaaattctttcacagagctattgagtgatgagcacacaaaccgagaggtacttctatggctaaaacaatgggactccattgtttttggatcccatattcgggctacaggtgatgatgtcttgtctgccttacgtcgacactcttcaaccatccaaaagaatgcaagtaacagaaatttcttttccaagagtaaggggggtcctgttgcaagtcaaactggcacacctctgaatgcacaaagcagcaatccagaaggtttaggtggctccttcagcaaaaagtcatcagttgataatgcaccagaacaaaaggtgttgctattatgcggtccacctgggctcggaaagaccacact

SEQ ID NO: 14057 - DNA, 1823 bp, Zea mays
atttttctgaaaataggacttaaaaacaaaaaattcggcccagttgggagttgcccacccagttccgaacttcgaacacgacgttctccctcaccccaccctccaggctccgagctccaaaaccctagctatgcagaaacagacgggcaagtccggcgggaccggtgggggcacgccggcgaagcgcggccgcccgtttgggagcaccaccggcggaggggccgctgctgctgccgcggcggcggcggtcgttgacccgggtgcacccgccgctctggtcgggccgtccctccaagtcctatcagccctgtcagatcagaacaacaaaagaattgtccttgcattgcaaagtgggttgaagtcagagatactgtgggcactgaatgcccttacagtactctcatttaaggagaaggatgacctccgacgtgatgcaacacctcttgctaaagttcctgggctcctagatgctcttcttcaagttattgatgaatggagcgatatttcaatgcctaaggaccatacgaaaccacccagactaagaactttgggtgccaacacaacactctcgggctttggccaggagaacatggaaaaagtatactctgacactgccactacctctaatgaccaatcaaaggcggaagattccagtgtcacaaagaagcgcgctgcaagcttttggtttgatgaggatgggttgtttaacaacgatgatgaagggagggcggaaaggcagcagtgtgctattgcagcctccaatataatccgcaatttctcttttatgccagaaaatgagattatcatggttcaacataggcattgcttggaaactatatttcattgcttagaaaaccagaatagagaagatgatgagctcataacaaacatgctggagacccttgtcaatttagcacctgtgctggacctgaggatcttcagctcatcgaagccttcgttcattaaaatgaccgagaaaggtgcaattcatgccataatgggtatgctttcttcttccgtaaagccatggcactgtgctgctgctgaattgattggccgtctgataataaatccagacaacgagccatttcttcttcctatcattccacaaatatacaaacgactcgttgacctattgagtgtaccagcatatgatgcacaggctgctgctgttagtgcactctacaatgtagccgaagtgaatatggattgcaggctcaagcttgccagtgagcgatgggctgtcgatagactcctaaagattgtgaaaacgccgcaccctgtgcctgaggtctgcaggaagacgtcgatgatactggagagcctcgtctctgagccgcagaacaggatgcatctcctcgtacacgagaacacttttgctgagatcctgacatcagaagggaaatactcggacacatttgctcggatcgtgtatgaactgacagcaaggccaagcaacaaagtgacctcaggacacgccatctggggaaacataaactgatgcgacgcgatggcctgtaatgtgttgttgggatctagactagatgagatttatttaatgtaggtgcttcgttgatcatgtattatgttatgtaatagacgctttgctgtatcgagatgcaggcttgcagcttggcaacctggccgaatttgggcagtttctttcatgcttcttttatcagtttgttggtggaaagtagcgtgtagcagctatgtatttgttggaatcagatgcctcaggctggtttagccgcgttcataatagattattaaaaccgctgatggtttgcttcgtgctgaaaataaaaaaaaaaaaaaaagcc

SEQ ID NO: 14058 - DNA, 1680 bp, Zea mays
acctagtatttccacgtatttccgctgcgcgtctcagctctcgggggtcccgccacacacccccatgccgcttctccacctctcgctcccgtcgcaccgcctcctcgtcggcggccgaggtcggctgttcttcccgtcgtctccccgtcgtatctgcctatctgtcagggcggctggggatgcggcggtgtcagttgcggcgggggcttacggactccccttccggccggagggcgccgctcaccaccgcgagctctccgcggcagtggccgtcgtcgagcgcgcctgctgcctctgcgttgacgtgaagagatcactgttttcaggtggcagcagtattcttgagaagaatgaccaaagtcctgttacagttgcagatttcggagtgcaggcccttattagtttggagctccagagattgttcccatcgatacctcttgtggccgaagaggattcagcttctctaaggtcatccaaagctgatgataatagcagtgatatacttgttgagtcgatttttagcgcagttgtagacaaagtgagtaacaacggttcacatttaactcaagatgatgtcttgagagcaattgatagaggaggcaaggacgctgtctcatttgattcaaaccctgctacttattgggtgcttgatccaattgatggcaccaaaggtttcttgagagggaatgatgctctgtatgtggtgggtctggcacttgtggtgaatggaaaggtaacagttggagtgatgggatgtccaaattggaccaacgatgacatagtcaacaagaaagatgatagcgctgctgcatgtaatggtcgtggtattcttatggtctcccatattggctgtggcacatggtctaggcgtctgtctgctgatattggtcagttcaatacagctcaggatatttggaaaagatgttttgtggacacttgttcgatcgcacacatggcacactattgcattccagatagccaaacatgggatatgataccgttatctgctacctacgattcaacaacggatgcaactgatcctagaaatgagaatgaaatccttctcctgtccgttttttgtggcagcttgtgcaagtatctcacaattgcttccgggagagcctcggtttttgtccttcaagcactgccgacaactcagatcaagtcttgggatcacgctgttggggtaatctgcgtgcaggaggccggtggtcagaccagtgactggagtggagaaccgttggatcttgcagctgacctaacatcgcgcagaatcatctaccctcggggcggtgttctggtgacaaatggtgcgctgcatgacaagcttgtcgaaatgatctcagcaagttacaagtagctgcatagcttcacaggccaacacaccttgtcttttcgaatttgaatcattttaccttatctattcgatcttcagtgaaaccgtattcgatcttcagtgaaatcgtatttgatcttcggtgaaattgtatttgatctgcacattcagtatagaaaccacaagcatgttcacttgttcagatggcttccattgccacaagagttacaggaatgaaaacacactgtttccttgttgtaccgtgatgaactattgcttaagcaacttcattcagaagcaaaaaaaaaaaaaaaagggtcgtttttccaaaaagaaaaaaaaaa

SEQ ID NO: 14059 - DNA, 5610 bp, Zea mays
cttcctccgtagttcacttcaaaataaaattgatgtgtgacgggcaaattagggttcaaagttcgatgggattagttttttattcttttttcttgaatacgcaggaggaattgttttttatgctgagcagcagatctgtgttgtgtcagtatgtaacctttaaattccatctggatatggtgggacagatttcattgtttgacatctcacaataaaatgcctgagctccatttcgcctgttcgattgtgtgtctcaacaggtgaagagatcactgttttcaggtcgcagcagtattcttgagaagaatgaccaaagtcctgttacagttgcagatttcggagtgcaggcccttattagtttgggtaatccatagcaaaatttcaaagttcagatttgtgactttgtctaatgccatattttgccatgttgctattgaaagagctccagagattgttcccatcgatacctctggtggccgaagaggattcagcttctctaaggtcatccaaagctgatgataatagcagtgatatacttgttgagtcgatttttagcgcagttgtagacaaagtgagtaataacggttcacatttaactcaagatgatgtcttgagagcaattgatagaggaggcaaggacgctgtctcatttgattcaaaccctgctacttattgggtaagaagtaagttgctgtgttttggttatcataaatcgagatctgtgaagttgattcataatttcatacattgggtatctgccaagtcatatcataaactttatgctttggtttgaaggtgcttgatccaattgatggcaccaaaggtttcttgagagggaatgatgctctgtatgtggtatgattatctattctgatattgtccttacatactatattactgttgatcaaggaccgatatgctttattcaggaatttttacaagatgttctttaattacacaaatatttatttgctgcgtgttttgacactttaaaaaagtcattccacaagcatggtgtgtcttgtactttttagtgccacatttatgccagacatgtccactatcttggggattttttatattgatatcatcaaccttgttttatcttgtacttcttagtgccacatttatgccagacattccattttttatattgttctctactattaatttatctcaaaattgtgaaattccaatgtatgtgatttgaggatttccagaaagactctcattgctgcagaacattcataaagttgtccgcaacaaatcgtgtaaaataggagatttgcacggtagattacattgtttgcagagtgaagtttgaaatatgggatgagctataggatagctgctggagacagcctaacgataccacatcatcaacgattaagtaatattaagaatgttaatacatttttttagagtgaaaggtatcgtaggtccttaaactttccccgcattctcatctgggtcgatgaactctttgagtgatcatgtgggtccttcaactttttaagtggttcattttaagttcacccttaggtccaattatggacttgaattcacacctggaatgaaccatttgaaaagttaaagaacccagatggtcacattgagagttcatgaacctagatgagaatgcaggaatagtttaaggacccatgatgcatttcagtatttcactctattgtttttaggttgtctccagcagctaccttatctcatcccttgtctcatcactatctcaaacttcactctacaaacagtataatctacagtgtaaatcccctattttacacgatctgccgcggacagccttatgaggcaccttttgtccttagttcatgaacctttatgatgcaccttctgcagcactttgttctttggtagcaaaattcatgcatctgaatgccaagcttgtttgcccctatatggttgtcattcagcatggactggttaatccatgatcagcaaattacatattattgacctcagttgcctattttcatgatccttttcttataagttctagcctacattttttgtccatttttaaggtgggtctggcacttgtggtgaatggaaaggtaacagttggagtgatgggatgtccaaattggaccaacgatgacatagtcaacaagaaagatgatagcgttgctgcatgtaatggtcgtggtattcttatggtctcccatattggctgtggcacatggtctaggcgtctgtctgctgatattggtcagttgaatacagctcaggatatttggaaaagatgttttgtggacacttgttcgatcgcacacatggcacactattgcattccagatagccaaacatgggatatgataccgttatctgctacctacgattcaacaacagatgcaactgatcctagaaatgagaatgaaatccttctcctgtcccttttttgtggcaggtttgttgcactctccaatctccattaatgggttgatacttgcacattaattcacgccactagtcagttgatatatgatgctaacaatgattgattttctccaacatatggcattcacggttagcaaaaggcatttaaagcaacgattgatatattctccccatccacaagttagctctggatactagtttgtttgctgtaagactttttcagcattatctgaaacgttaaatgtctttctatattcttgtgctgtcttgctatcatactgtttgtggatttcctacaaaaaaatatctggctgaggttgataatgagtactatctcgaatatttgtcgtccaatagttcatctttgaactaaaacgcgacaaataaaaaagaacggagggagtatattacagccattagtgattaccgattggtcttccgcacatgagttcatgatgatgtgctcttgttgctattctatagcttgtgcaagtatctcacaattgcttccgggagagcctcggtttttgtccttcaagcacggccgacaactcagatcaaggtgccatgttgctcacaattttatgctgtcctgcatgacaggttaaacaactttgttgacttagttaaccagtgcactgatcaccctttcttttcatattgtttacgtagtcttgggatcacgctgttggggtgatctgcgtgcaggaggccggtggtcaggtatttaccttgcttgctaaaacagacaaactccaactctgttccatcagttcatctctcttagcactatagcacggtgatcttctaactctctgaaaccgacagaccagtgactggagtggagaaccgttggatcttgcagctgacctaacatcgcgcagaatcatctaccctcggggcggtgttctggtgacaaatggtgcgctgcatgacaagcttgtcgaaatgatctcagcaagttacaagtagctgcatagcttcacaggccaacacaccttgtctttttgaatttgaatcattttaccttatctattcgatcttcagtgaaattgtatttgatcttcggtgaaattgtattcgatctgcacattcagtatagaaaccacaagcatgttcacttgttcagatggcttccattgccacaggagttattatacgaatgaaaacacactgtttccttgttgtaccgtgatgaactattgcttaagcaacttcattcagaagcaatacatgcaagggaaggtcgttttccaaatttttttcacaaaactccagaacctttttttttttggcttcccaatgtgtgaatttgttgcgcagccctgatgctctactctcatggtcgtacgacgcccacgcacgcacacctgaatcctgcaaaaaagaaaaaaaaaaacaaaagcgtgatgtttggtcaccaattcagactgatgaaaaagacgcggaaaggactgcatcctcttccaccctgatgcatgtcctaaccaaggacgcgatcggcagcttctaaggcatgattagcccaacacgagagtcgctgtagaagacaagtcactggccaaatcagcaccgcttttctccaacgacggcacgtcagtcagggtcctacaaacgaaggtttcagtagatggcttgcggttggcttcttgttgcaacccgtgctgacttttgcccgggcctcccctgcgtaggaagaagaagggcgggccactgagctttcggacgctctacctcgtggaggggaaagtcgcgcttgcattgcgcgtttccaagaatcgttcaggataattcttgtacgtaactgtactgtaggcacgcagggtgaaaactcccctgatgcgcctcgcgctgccgggtacctgtcgcttgttgtctcagacatgcatatgggccatgtttgctccggccgggtagtagtcaaccattccggcagatgatcgtgcctgccgaccgacgaacggagatcacatgtacgagtggaccaacagctcgcggactgcggaccggatacatcgtcgtacagtgttccagacaaccgggatacgaattggcagtgcggacgactgcagagagagataaataaagctcgcactgtattcattcccgaggctttagggggggaaattagcttaattttcctcaacatctccggaaatcttggagggaatttaagtttgtaaactagtcctaacgatcctacactgcatgcggtggtaattcaaattgaagtgagttcttatgtatgatcttcagatcgatcgaggaactcaaaaactgacccgcaaaacatgcatgggccggggtcaccggagtgtgatcttggctaaccaactggatcggagtacatacgtatgaacatctgaaaaaccatatgtcgtacgtggaacacggctgaatatagaattcagtcatatcactccatattatttgtcttcctggcccctcgtccggccacttctgcatgcatgccgccgtgcttctcgtgtgggtcgtgaagcttctgctccgtcgcacgtccgagggcgccgccggaccgatcgagcaggagcatgggacagacacagtcagaaggcgatcgaggaccatgcaaataagcaacaagtgtgctgtccggccggtcgcgaacgctgccatcgccaccaccaactattcctgatccagagatgtgtcaataatggcgcataagataccataccaccgcacccattttaattttgatcgaataatggagtacgtccctctgttgccgtttggagccacgaacttaaacaaatgggcgggagcaagtacgcgcgcgccctgggctggcgtgtgcatgggccatgcactcgatcgattgcatttagggatggatccgaatatttattcggatgtcaaatttttgatcttctttcttcaattgtgaacaaataacatatagaatttaatatataaatttatattcttgtttttagcattgaggttcttaatcttcacaaaaaaataaacattaaattcgttttatatctttttaaataattgatataaaattcggatgtctatgcgaatacggattcggatgttttttcaccttttttgttgtagggagaaaataatgtacataaaaaataatacaaaaatttatttaaatacttcataatattcttaataacactgccaaaaattagctttaaattc

SEQ ID NO: 14060 - DNA, 7266 bp, Zea mays
  misc_feature (1369)..(1369): n is a, c, g, or t
  misc_feature (2040)..(2040): n is a, c, g, or t
  misc_feature (3629)..(3629): n is a, c, g, or t
ctgcggcatcttctggatcagaatctcctgctcaaccgagaatgaattcattttcattgtattatgtggcagtcccactactttcaaccatggaagcgaatcgatgatcctgtccagagtatctttatgaagaatatcctagcctagtcatagctttctttgtaaatgatctctcctctgcatcgctggaaaagttctcaaccggattatcggagaacaaccgcactcaaccaagagcagggccaagccaagccggattagcagaagaaaaaaagaaagagaagggatacccttgcatcccttctctttccattttcaatattacagattatctaatctttgttgctgcttaggactaggcgaacatcagatgagatgaaagctagtactacctcatacgatacggtgaagaaattctaatctgctctagaaaaccacttttcatgttccagatatagcacgtaggttgtgactccacatggggagctgagggacataacatgataatagaaggtcatcctaggtagagctgtagcacagatcccccgcgcgcctcggccgcggccacgctaagaataccaccataaaagaaaattgtgccctcttgagccctaaacctaggagcaatggtttctctccttcccaaactgcaaccgcaaccagttctaattcaaacagtgtggtggagttcaatcagaaactctccttcatccctcttcaaatgcattcctcactacgagattgaatatgttttcccagcctcccaccagtaggcgaatccctccaaccaatgactacactaccttggttatccgctttcatgtcttggattgagctttctaactcttattatagttgggtgggcggaaagaaaggacaagattcctgcttcgttcaaagtcctagtcctgtctcctgatatctcgcccgctatttctatctccgctaaacctagtcacttggctagctatacttctataggaactatctaagctatactttacttgacatgactgcctatcctggaactaaaagtcttaaatacgtctctcttggctacccgtgacttgcgttgacctatccctactacttggttattagcttacccttttatacctattagaaaccctagctagcttgtaaacacctatctcgtgctttacttctatactgacctaaacgtgaactgaacaatatgcctaccttttttatgtttctcaacaataagcatcccgtggtgacaacaaaccatatgccaacaaacaactccttaaaatgcttatatgtatacagcttggccttgctattcacaaatgtctatcagcttctcctgcttctatacttgcctatctgtgacatgacctattcntacttgctttgtcaactactttacgatacttaacttaactttacgatactttactttatccccagacctataaacaatgggtctcaattcgggaggaagaaccggtaaattgtacatacgaatgtcaatcttcatttaatacactggtaggggtcgatcaggcaaatcccaaagccccgaactgctctactgatcttctctctcttcagactcactgaaccagactccttttgcactgagaacacaattaagaaccctccttctcacatcacaagaaggcaaaccttgtacgttgatcgaatcttctttcgcatccagaagagaggctgtgggctatccgagagagtggttcaggtgactaccggagtcattgattaagcaggtcagatgggcttagtagggctcgaacctacaatatcaccgttatgagcggtacgtttcaaccaattaaactataagcccaatcggatctctacatgccgggaagagcggacagaaagaggagaccctttgctctatctccttcttcctcttcccggggccccggagggcaagccctattaaagaagctaagtgactttcgtcactcaagtagtgagtttgagagtggccgttagggcgaccacttgtacttctaggccttggcgacctatagtcttgttacgcaacanagcttcactcgattcagtaaatcaatagttcaaaccagcccactaatagcttagatagtggcccttccactttggtttggtatagttgaccctacctattgactcaaggtaagacctctgactcaaggttcataggaagggggaacccagacgtagtgggatgtaggcttcagttgttttggtacttttgcactacctacgtcttattatttattttgtaaccggcttttcaccggcaggtcagtaggccttttagaaggcgaacaaacgaaagttctccgcgggcgctagcgctatcttgttcgcttttgtcaactgaagtcgcgcgtagcgccaactaactgatagctgatagagcgcggagccccgagtctaagcgagcagagccatttctttgtcgtcaaaagaaaaaaaaagtactaaaggcgaagggcattctgttgtacagctactttggttttggtatagttacaaaggtaaccggtaggtgactgttgaatcgacagtagttacgaaagggggaaaatagctcagttggttagagtgctggtctgtcacgccagaagtcgcgggttcgaaccccgttttccccgcacgatcttcctcttcctgcccgactcattttgtcttcactggaagctgctgatcccagcgtagcattcaagacaattgttccttcttcggtctccctccacccccttcgtttgttgtgggtcgcgtctcaccgcaggcacttaatgaaaatgaatgagtgaagatcttccttccccccttgtgtcttaccaaggactgagttcccacttgtggcgaaaaaaaagtataccatcccacccggcctccccccggggggttaaggttcctctcggagactgccagtctacaagaagctggcagagctttagccattggaccacatccatccatcctcctacctaaacagtgacgccttttcttgttcgttcttcgaattacgctagtggagactaattccttccggctaatgaagatactaccccagtcttcccattcattcccagtggatccttttcattgaacgaaccaagttcacctatacgagagtgaggaatagaaatcctacaatcaacttcccactttttatgtcccgtttgacgattctgctgcgtctttagaaaagaaaaaggagaaggacagggtcagaaaagcgataactatcaattcgaattcagaatgaatcaaatctccccaagtaggattcgaacctacgaccagtcagttaacagccgaccgctctaccactgagctactgaggaagaacggacttaaggaagctgactctcgttctttggaccaaccaaccgaaaagaaaaaaagttagtcactttttctcttttccgggagaaagggtgacgatagcaatcccctttgcctccccggccggggagcccccaggacaggacaaggggggcggcggggattaataaagaatgggttggcaaatatctcacttaatggtgggaggggagtatttagtcttagtctgcctttaggttagggttttatttgaaatctaaatagaaatgcctcctagaaatgaaatagctgaattntttatccttaaaagactggaatccctccaaccaatgactactcaacctttatcacaatctcaactgctttccacagaaagtattacctgaggttgaacatttatcccttcaacctgattgccttaaacattcatagcttacagttgacatcgtctttccttaataaaagaagtcaactatttaacggttttagtttgtcagctttcaccacttctgttttgtcttcctcgacatatacattctcttactccaaaagggtctaacccagacagagattacttttcgatcacacacctagttcgggggttgattaacaggaaagcccgcggcctaccactacgaatttatagctataaagggtcacagtatgaaactgctacccatttgatgcacaaggatgctatggtgaaagctaatatctactcagctgttccccgacttaggctatataatccatcttaggtacagtaacctagactcgaactcactatacaggaaaccaaccgttcaacgaaatgtgtgctcaatttattagaatacgcttgtaaatcctcttctaaattcttactgtaaaagaataagggaaacagtcattgttgaatctgcatggaaccctatatgaataatcattattgtattctaccaaacatcttatggggttggtaaaaccaacgcattggtagctataaagcttgctaccatgatggcagtgccgacactcgcttcatagcaacattattatccatgttctcggcttggttaacgttaaaaacctccgtaaaggaaaggttggatcattcataaatgtactaagataagaacagtattcactatgtctttattgatcaagaaagtcaccctcttgtaaccattaataacggcttctgggttcttaaaagcattcaaatttgccaatgggtgagctatttcttgggggataataaaagggttatcacactgaacatacctgtaccaaactacaactcctatccccattaatacaaggatattaaacataccccagacaaacttattgtttgatttgttaaaagtgcaagttctaacttgcgttatagcactagaaaatactgtattgtatccaacaaaatacctttcaatcctcggcccacttcagttttcgtgataaaaactcattatggggatagtctgccccttcatatatagtatcaataacaggatctcttattggatcgtctctaagatctcctaacctctcccatgcatttttagctactaaacgaatgtttgtatttttttgagataatatctcaccgtcgtaaataagggtttgaccgcagcatgttaaaacatgaggcaattcatgaaactcttctatcaaatcatatacattcgagactccatataggtctatctatatagtatagtaactgaaagcagtctcattggtgtattccatttgtggtaatactttatattcattatggaaaactctatcgcacagcttcttagcaagtaaagattgcttatacatgttgattttagcaaagctgttaagaatgctctcttcatcagtttgcaacatatgtttgatattgctgtagttttgggtaagtccgaccttgaagaataatccgaccatgaggagtatggagtgtttgccatgttttgtatcttttcagttgttctatttatggatttattgggattttccatgagtttagttgtatctacccgattgtggtatccccacctctatccttgtaattggtcagagagatacaactctattaaaagaaaataacccgagattttgaccctaaagaaaaagaagtgtctctatttagagatttatctacttagatttagatttagattaaaaaataatactccttctatattattctagaatatgtatcccaatccatctcgagggggggccggctccgccttcgcggtagatccttttttctgtgccaggaaccagatttgaactggtgacacgaggattttcagtcctctgctctaccaactgagctatcctgaccatttcttgtgcatcatcctagtagagtacgtacttgtatctatgtgggactaaaaaagaaaaaagtattctaaaattggacttagtaaatgtcaggataatgataatgacttacttaataatagggattacttgcctatactatactataatatgttcatttgtatgaatgggataagatccaaagaagtaagttcggatccgtttgtgaaagagtagaataagaaagatagtgaatcttgtttgaaccattaatgaaaaatagaggttggtacaatagtatagtatagttaggaagtaaaatgggctttttattggggatagagggacttgacttgaaccctcacgattttgaatagaaagtcgacggattttcctcttactataaatttcattgttgtcggtattgacatgtagaatgggattctctctttattctcgtcagacttgaacctaacgaagaaagaatgaggaagaaaaagatatcgtgatgtacgtctaaaaacggaaacttaagaacgcttttaccaaaccaagaaagcgtatcacttttcaattgattggatcatcataagatcgactgtgtttcacctcccaacccacaccgggttatgttcctcaattccaacaagggtataatcagccgccccggcacatcgaccggctcaacccatgacgagccaccttcaccaaagcagctacaacctccctattaaagtgacccccggacctataccatacccttttagaatctccgcaaattgccaattaccattcccaggctagaccgattaaagaaactaaattcatacccatcctctggtctaaagaagagttttttttactttacttaactttacattagagacctaattcaaggcgccgcatctcagcccttctcaatagaatccatgtgccattgcctgaatgtcaatcagcccctcctgtccgaaaagaagcatatccgaataaagcaaggtaacccacaaagcatttttagctattaaggactgacttcaaaaggctcaaaaaaactggaatcagttggaggaaactaagggccaggttcacattatcagtgagcgcggataagaacgtttcctggaattccacatcccatattgactctaccatcccggcacgttggccactaagtccaatctgacctatctcaaataagatcttttaggataaattttataggcatccctcgcactttgtttcgctagcagcagcccggactcgtatgccagtgctcgctatccagccagtctaaagagttcgcctagaaagaacttctcacttccaggcttagcggctgacctatgaaccacttctactggtggctgctactgctatcaatcgtataatagactgactcctttttcgcaaagcggaaagaaacatcccaagtcaacattgccaaaagtggaccacttctgcttgatacttgcttgccaatcctttactctttttgttccgccctggcatctttacccgcctaccagaaatgtgtatcacaaggtatgatgggattagaacagttccatgtccatgcattaaattaaatgccgctccaatcgatgaagggcacaagatctcgtcctaaca

SEQ ID NO: 14061 - DNA, 2189 bp, Zea mays
gttggaatctttgagagcaaaatttgttgaactacagtcagagatggaagaaagagacaaggagattatatttgcacaaaggaatatgagcttgctatatgaagcatgcgcaagttcagttgctgagattgaaggaattagtgatatatatcctggtaaacacagctatgctgttgaacattctgcagatgaatgtataaaatcaatcgttgaacagttagttatggctgtaaaaacttctcagaacagtaacggaggtagcacaaagggagctgaaggctattgttcttgagttgcagcaggagcttcaagctaaagatgtccaaattagcacaatcagttctgatctatcatatcagttaagggtggctgaatcttctgcaaagcagttctcagttgatcttgaagatgcaagaatggagctccaaaatttggagaaacaagttgatgtgttgcagaatcagaagaaggatttagagactcaattaaatgagcttaaaaatatggaatcaatggcaagtgaacaacatggaagaattgagaaattgactgatgaattaagcagaaaagatcaagaaattgaaggtttggtgcaagcactcgatgaagaagaaaaagagcttgaaatcttggagaataaaagccttcagttggagcaaatgctgcaagagaaagaatttgccttgaagacctcagaagtttctaggaccaaagctttggcaaaacttgcaacgactgttgacaaatttgatgagctgcatagcttgtctgagaaccttcttgctgaagtggaaaaccttcagttgcaattgcaagaaagagattctgagatctcatttctgcgaaaagaagttacaaaaagcactaatgaactgctaaccactgaagagagcaacaaaaattattcatctcagctaaatggtttcatgaagtggttagaaagagaactgttgcagttcggcttccattctgagagtgccaatgattatgattacactcaatttcctgtctatatggatatgttggacaaaaaaataggatctctgatagccgaatcagatgatttaagggttacagttcaaagcaaagattctttactacaggttgagagggccaaaattgaggagttgatgcgtaaatcagatggtctagaagcttcattgagccaaaaggattcccagatagggttacttcgccgggacagagcatccaatcagcagagcagatctataaatttgcctggcacttcagagattgagcaaatgaatgacaaagtaagcccagctgcagttgtcactcagattcgaggcgcacgaaaagtcatcaatgaccaagttgctattgatgtagagatggagaaggacaagccttttgatgatgaagatgatgacaaagcccatggtttcaagtcattgactatgtcacgctttgttcctaaattcactcgaccggtatcagacagaattgatgggatgtgggtctcaggcgatagattgctcatgaggcaaccgaccttaagactcggcgtcttgatatattggattgcactgcatgctttgcttgctagttttatttgaactctgtaaagatgtagccatctcctggcgagtgactgtacagtactctgtgtctatagcaagttatatctaaacagaagcagtttgcactgataccgtgattcctttcgaaaatgttaccgaatacttgagccgtattggcagctgcagaaatcttcatgatgcattttcacccttcatcctggtgcaaatcctgtctagcttagtttgtgttcaattgatacaaatggatggaagagaactgaaggaagcagcagcaaagaaccccctgtacatacatttttgtttgctctattctttgcttttagaaaaaagatggagggcattctacatgctagcgactacttactacactatatgatacaggattacagggaagtgacatgtagttttggaagttagggttttgggatggtagcaggtcatcccctcccttgagttggccccctcaatcccatcatgccttctaatctttttcgtttacatgtataacacagtgattatatcatttattgtaatccacatagtgtgcaatgggggagcttgcacattttattaacgtcaagtgaagcctgagtgctgaaagttcatgtcaaaaaaaaaaaaaaaaaa

SEQ ID NO: 14062 - DNA, 1792 bp, Zea mays
accgcgacatcactcactccgccaccgccctctacacctcgcgctcccaccgcccggtgtcagatctcgccgccgcgatgggctccgcccactcgtccgtctccaccgccggcggcgaagacgaagaagacgacgaggatccgtccgcggcagccgtctcctccgcgggcgcacaggcgccaccgcccgctctgtcgccgtcgccggtccgcgtgcccccggcctccgcgtccaaagtgctggagcaggagcccgaggtgctgccgtgcctcgccgcggactcgccgctctcgccgcagccctcggcggcgggcaccccgcgcctcctcgcgggtcccggcatcaaggtctgggacccctgccacgttctcctgcccccgccgccgccgtctccgcacgcagggaggcaggttgacgccgcggccatcgaggtcgttgtggtcagccacggcgagtgcgcagccgcgatgcgcccggaccttgtcggcggccggtggccggccacggcgctcacggcgcgcggggagcgtcaggcgcgcgcgctcgctgtgttcctgcgctcccgcggcgccaggctcgccgccgcctatgcgtctccgcttgaccgtgcgcgcgccaccgctgctctcgtctgtcgggaacttgatttcccagaggagcagatccaactatcagatgctttgactgaaatgagtcaaggtcagtgggagggctgcccaaaatccgaaatttataccccagaaatggtcaatctgatggaaagcacccaacctgatttctctgcaccatccggggagtcactcagacaggtacagtttcggatgatggaattcctcaaccggacagtcctaagactaccagaaaaggtggcaatgggggacacactgtcacaacaaaatgagttgaaggggttctctcggcagagctccagcaattctgtccaagatggccctccttgggattcgctttacaggctcaaccgacatagcctccaacgaaagaaatctgggaaaagccgactccagtttgtcacttcaggggacaatgaagctgaagatgatttctcccctaaagaagtaaatcagaggcatctccttcatgaaggaagtgttggcagctcagcagcgacctccattgctattttcagccacgtgacccccatccggtgcctcatcgcaggcctgctagactgcaaccctataatgtccaagagaatatgtatagacgattcctcggttacggttcttgagcattccctgaagacaggatggcagataaaaaggctgaatgatactgcacatctcaggcttctctagctgatcagtgtgtcactgtaaagaaactatctgatagcattctgcaaatcagatgctgaaaccacttgctgcacgcatgtactatgcggccatcacaagtgtggtctcgtcactgtatttcaattgtacctatcgaatgtttctactcaatgtagaagggttggcctgtactggcgttgtgtagtatttgttgttatttttatcaagattatttctcaaattgtagttttccatcagtgtctagttactttttcttggtgggtagttagtggggacacatattagcgcaccattctttttggcagaatatttagcaagtttgtatacttcaggggtatgcagaatgaagtgctgttgcaaacttgctgtgtaactgccaatggcacaattgtttgtattttgcactataatgttgcacaaaatgtcggattgcaatcctctatccaaatgttttctacctctgggcccctcgggcc

SEQ ID NO: 14063 - DNA, 2157 bp, Zea mays
cgtaagatttcgatcatatggatatgggtcagaaatcgggtgttcaaaccagtggaaagacccgatttttgaaaatccttcgtaccggttgttttgagttgtctcaactgtcaacagtatagtacatgtacactcggttgttggcagtagtcgtggagtcaaccgaacgacaggtacacagtcacccttatgttgctgcgtcacatgcactgggtacctcgaggccggcgcttgcaaacgccgcattctcgacagacgacagatgctttgcaacatagacgccgatgcacccgtcaccctgcaagaaaagaaatctacaggaagactctcagctcgccggtgatcgagtggcatggatgtgccaaacgcaagcgtggaggccgagccactgctcgtgccacgcagctccaccgaaggtggctcggcggcggcaaccgagtcgaagagactgctgcggctcgctgggccactggtcctgagcttcatcctgcggaacgccgtccagatggtgtccgtcatgttcgtcggccacctcgggaagctccccctcgccggtgcctccctggcctcgtcgctcgccaacgtcacgggcttcagcctggtcgccggcatggccggcgccctcgacacgctgtgcgggcaggcgttcggggcgcggcggtacgcgctgctgggcgtctacaagcagcgctccatgctggtgctagcgctcgccagcctccccgtggtgctgacgtgggtgttcgtggagcagctcctcctggccatcggcgaggacccggacatcgccgcggaggccggcgcgtacgcgcggtggctgatcccgtccctcgccgcgttcgtgcccctcacctgccacatgaggttcctgcagacgcagagcgtcgtggtgcccgtcatggccagctccggcgtcacggcgctcgcccacgtcctgctgtgctacacgctggtgtacaaggtgggcatggggagcaagggcgccgcgctcggcgccgccgtctcctacagcgtcaacttggccgtgctcgctctttacgtcaggctgtccagcgcttgcaaggcaacatggacagggttctccaccgaggccttctctttctctgggctgcgggagtacgcgaagctcgccgtcccgtcggcgatgatggtttgcttggagtggtggtcgtttgagctgctcgttcttctctctgggtttttgccaaaccctaaactcgagacttccgtcctgtcaatatgcgtcaacaccgctattctgctgtacatggtaccgctgggccttggcacatctgcaagtacacgcgtctccaatgagctcggcgcagggcagcctgaagcagcaaggctagcagcgcgagttgtggtctgcatgaccttgtgtggaggggtggtgttggcaaccatcatgattctcctgcgcaacatctggggatacgcatacagcagcgaggaggatgtggtggcatacattgccagaatgcttcccatccttgctgtttccttcttcgtcgacggccttaacggttctctttcaggggtaatcataggatgtggcaaacagaagattggagcacgcgtaaacctcggcgccttttacatggttggcattccaacagggctgttgcttgcgtttgtgttcaaactaaatggaatgggtctttggcttggcattgtgtgcggtagcatcagcaaactggcgttgctcctgtggattgcactgcgcatagattgggagagcgaagctatcaaggccaagaacagggtcctccgttcgtcagggcaaacataatgatgagggtctcctacctttgtcgcataaccatatgtcatatgtcagggatatttagtggtaaggatccgtttggcattgctgaaccacccaatctcagtctcagctctacttcaaagccttcatcatgaagttagagaaggggaaaaaaggcgtgcaactttgacgttaactccagctactgccggtcctgcttttaagggcatgcgtgtatttttatactatgttccagcaagtgtgtgtattttttatataccatctaatttttattgtctcctagtttacttttaaactacaacacgataaataaaaaagaattgagagagcaaaaaaaaaaaaaaaaaaaaaaaaaaaaaaaagcggcc

SEQ ID NO: 14064 - DNA, 2640 bp, Zea mays
cattgggtacctcgaggccggccggggtccgttcatcttcttctgttctgctgctcctggccggccgggactttttatcctagtaaaaaaaggaattctgccttcttctctcatcttcctgctcaacatcagtagcagctttagctgtagcagcgccaccggccaccgccacgccatggccaccacgttgcacaagcccctgggggcgatcaccgttgacgacctcgccgcggcggcgcctgggtcggacgccaccgcgctccacgcagcgctccggcgcgcgctcgactcgcacggacccaccgaagtgtggggcgagctctgccggtccgtgctctgtccgtctgtccccttcgccgtccaccggatgctctactacggttgcttcgccgggttcccgtctcccacgccgccgcctggacgcccgaccccaaggaggctgtcttgaccaatgtcggccgtgtcctcgaggcgcgtggtagggacttcatcggcgacgcgtacaaggatcccatcaccagcttcccagacctccacaagttctccaacgagaacccagaggcgtactggaagatggtatttgaggatatgggtatccaattcagcgtagagccatcctgcatctggagagagaacactgcatatcctggtggcgagtggctaccaggcgccgagctcaacgctgctgctaattgtttgactgctaaacccgggaggagctccgacggtccggccattgtatggagggatgaagggaaggactctgatcctcttaacttcatgtctctggaggaattgaggaagaaagtttgcctcgtgggcaatgcaattgatgccctggaactgccgaagggatctgcaattgctattgacatgcctatggatgtcaatgctgttgtgatctaccttgcgatcgtgttggcgggatatgtggttgtctcaattgcagacagttttgctgcacctgcaatatcaatgaggttgaagttatcagaagcgaaggcaatttttactcaggattacatccttcgtgatgacaaagaactaccattgtacagtagagttgtggaggctaaggcccctatggcaattgtgattcctgtaagggggtctttgctaataaagggactacgtgttgatgacctttcctggcaagatttccttggaagggttaattataccgaggctgaaaattacactgctgttaaccaacctgcctatgcattcaccaatattctattttcatcagggaccacaggggagcccaaagcaattccatggacacatataacacccctaaaggcagctgccgatggatggtgtcacatggatattcgtaaaggagatgttgttgcttggccaacgaatcttggttggatgatgggcccttggcttgtttatgcctccttgctgaatggagcttccatggctctgtataatggctccccaaatagttcaggctttgcgaagtttgtacaggatgctaaggtaacaatgcttggactggtacccagcatcgttcgtacttggaagaatacggactgtacagctggactagactggtcctccatccgatgctttagctcctctggggaggcatccagtgtggatgattatttatggctgatgggaagagctggttacaagccagtaatcgagtactgtggaggcacagagattggtggtgggatttgttactggatcgatgctacaacctcaagcgttgtctgcattcagcacacctgccatgggttgtaacctgttcattcttgatagcagtgggaatcctttgccacaagactctgtcggcattggtgaacttgcacttgatccaactttatttggatcatcaacaacacttctaaacgctgatcatcaggaggtttacttcaacggaatgccagaatggcacgggaaaatcctccgcaggcatggagatgaatttgagcgtacttctgacgggtattatagagctcatgggcgtgcagatgatacaatgaaccttggtggaattaaggtatgcaatgcgttgtggaaatatgcaactacgtgttgcaatgtggcatttcctgatccacacatggagtttcatgatcactttcaggttagttccattgagatcgagaggatctgcaacagagtacatgacgccatccttgaaacagcagctatcggggttccacctgtagggggtggccccgaacaactaaccatagccgtcgtgttgaaggaccagagctctcaaatagaggacttgaaccagctgaaactagcatgcaacatggctctgaagaaactgaaccctctcttcaaggtttcctccgtcgtcatcgtcccgtccctccctaggaccgcctctaacaaggtcatgaggagagtccttcgcaaggagttcagccaggccgcccaggcaaagcattcaaaaatataggtagttattagaaataattagtgttttctgctgcaaatgcacctgcagaaagagtaaaacaccaaactgggcatatcgggaagtcctgttgtttgccaccaaaacggataaatgagatgtacttagatttcgggaaataagggagctgtattcctgccaacgttcagcactcacttgatgtgctgcactaataaaacactaatgcaatc

SEQ ID NO: 14065 - DNA, 1619 bp, Zea mays
ccacgcgtccgtctagatcgcgagccgccgccactccttctccctccccctttctctctcttctctctctaccgcccacctctctccacctcctctccccaagccgcgccaccaggagttcagcagccgctagaagctgccatccgcccgccaggagttcagtcaatctcctgtctcctgagagccgccgcccgccgagtcccgctcgccgctcggtcgctcccgtgaggcgctcgatctcctcagcgtcgcgcccacccagccacggtggagccacccttcgtcccgtcgtccggcggccggccctcaatccctcacgccctagcttctctgccatttccggtcagcccctcacgccctagctttcctattaggcgctcggtcgctccctttgccacgcgctcctagcttctctggtcggctcttcctccgccatttccggttggatcctcctatggatgctaaggtaataatgcttggactggtacccagcatcgttcgtacttggaagaatacggactgtacagctggactagactggtcctccatccgatgctgttgctccgtctgcgtgcgccagccagtgtggatgattatttatggctgatgggaagagctggttacaagccagtaatcgagtactgtggaggcacagagattggtggtggatttgttactggatcgatgctacaacctcaagcgttgtctgcattcagcacacctgccatgggttgtaacctgttcattcttgatagcagtgggaatcctttgccacaagactctgtcggcattggtgaacttgcacttgatccaactttatttggatcatcaacaacacttctaaacgctgatcatcaggaggtttacttcaacggaatgccagaatggcacgggaaaatcctccgcaggcatggagatgaattcgagcgtacttctgacgggtattatagagctcatgggcgtgcagatgatacaatgaaccttggtggaattaaggttagttccattgagatcgagaggatctgcaacagagtacacgacgccatccttgaaacagcagctatcggggttccacctgtagggggtggccccgaacaactaaccatagccgtcgtgttgaaggaccagagctctcaaatagaggacttgaaccagctgaaactagcatgcaacatggctctgaagaaactgaaccctctcttcaaggtttcctccgtcgtcatcgtcccgtccctccctaggaccgcctctaacaaggtcatgaggagagtccttcgcaaggagttcagccaggccgcccaggcaaagcattcaaaaatataggtagttattagaaataattagtgttttctgctgcaaatgcacctgcagaaagagttaaacaacaaactgtgcatatcgggaaatcctgttgtttaccaccagaacggagaattgagatgtacttagatttcgggaaataagggagctgtattcctgccaacgttcagcactcacttgatgtgagttcacagatgagggcatgaggcactaataaaacactaatgcaaccacttgcattaaaaaacaaaaaaaactctaaagagtttcttaggatctgctagtttttttggcccagc

SEQ ID NO: 14066 - DNA, 1854 bp, Zea mays
gcacgagaccattacctagaacatcctaatcgaaaatatgtagaatgagaaaacgaagtgccatcaagaatacttagactcaatcagaatactggaggagaagtggaaagtacatcaacaatcacccaagaaacaaaatgaagaggccgagtctacatccaatgataccagagaagtgcataacttactgcagaatgagaaaatgctacgtcaatcggctgaagatgaggccagtgacctcaagaatcaagtatcacactggaaaaaactggaggctacagctacagctgaggtagtaaaactacggaaaatgctagatactgaagctagccagaaagagaaacttgaagcagaaatagatattttgagaagtcagttattgcagttgagtatggaagcagatgaggtagtcgttgctatcattgtcaagttttttcttcctgggaggagctgctattgtaacttatttctatttctcatttgaactgtgatgctaccctaacataatcactcttttctcttcattccgatttggtcacatcagacagggagtcttgataaaggaaatggaccaggaaaaatatttcctggtttagattcattggtgtctcagactcgaagctcacaattcagagagcagagcaatgaaccaaagcaaccaattgccaaactctttgaacaagttgggttacaaaagatattgtcattgctcgaatctgaagaacctgatgtccgcgttcatgcagtgaaagttgttgcaaatctggcagctgaagaggcaaatcaggaaaagattgtagaagcaggtggcctcacttccctccttatgctacttaggagctctgaggatgagacaattcgtagagtagcagcaggagcaattgctaatcttgcaatgaatgaaacaaatcaagatcttatcatggcagaaggaggtgtaaccttgttgtctatgacagcatctgatgcagaggatccacaaactcttagaatggtggctggagcaatagctaacctttgtggcaatgacaaactgcaaatacggttgaggggagaaggtggaattaaagcattgcttgggatggttaggtgtgggcaccctgatgtccttgctcaagttgcacgtggcattgcaaattttgcaaaatgtgaatctagggcagctactcaaggaaataaggtgggaaaatcactattaatcgacgatggatcgcttccttggattgtaaaaaatgccaataacgaagctgccccaattaggcggcacatagagctcgcactgtgtcatttggcacagcatgaagtaaattcgaacgacattatcaatgaaggagccctatgggagcttgttcggatttcaagggactgttctcgagaagatataaggaagttggcataccggacactgacatccagccccactcttcaagcggagatgaggagactgggaataaaactgtgacgacagaacaacaaagtgcagctggggctggctctatgaagttccatttctcgtgcactttatagaggtacccgttgctctgagtgctggtaatcgacttacctggtttcggcaggcaggcatacacgggcaccgcaccgactaatcacaagaggcagtggaacaactttctcctcgagagttcatttttctttgttctgagggcggcagttgaaagcctggacaacactagcaattcatttatttgtaatgatcctagcatagcagatgttgttacctacccaatgcagcgtttgtaatttttttgctgtaaaaatatcaaaggcagaaaaaagtactttcgcagtgtacctgttttccgtgaacactagaaagtttttttgtttttgttt

SEQ ID NO: 14067 - DNA, 4633 bp, Zea mays
cgaaccttttttttttcgtcacatcgatagcacagcggtcttgtggattaaaggctactgctgtgtttgtcttaaattttgcttatgttgctggttgtgtgttctaaacagaagctggaagttgtatggagattttgtatcatcttaatgtattgttttttatatctataaaatgcttcttttctttcatcgaaaaaaggtgacaaagcgaggcagcgagcgattggacttctccatgcaggggttgagctacccaatttgtcgctccaaccacctgaaaactaacaaagaatatatgcggcaggggagctagcaacacacctgccggccgacacttgccactgtttcaggcaaggccatagaaattaaagcggcggcgaagcaaagggacccggccggccggcgtccatgtcgaaggtgacggtgctcaaggtggacacctcctgcgccaaatgcaagcgcaaggtcctgcaggccgtcaccggcctccatggtacgtacacggccggtacacacgtgcgagctagctatcccgcttatttcttcgtcgtcgttcggccatgcccatgcatgcactgcacgcgcgcgcgcaccatagattccgttcccggcaataatgtaaagatcgtttgggctgggtgatgtgcggtgcgcgcgcaggtgttgacaagatcgaggtggactcggagaagagcacgatgacggtgacgggcaccgtggacccggtggacgtgatcgtgcaggcgaggaaggccgggaagcgcgcgtccgtgctcaccatcggccctccggcgccgcccaagccggccgaggagaagaagcccgctgagcaggataagaagaaggcggaggagaagaagacggcggcggcgggagcggagaagaaggcgcccgagacgccggccacggtgttcgtccaccacgtcccgtcgtggcctccgtgccccaggtaccaggagagagtagtgtacgagcaggaccccccgccttgctccatcatgtaatgtaactatatacggatttgaccaggagtatacatgttcgtttggaacgtagaacgcaagaactttgtaagatcttgttcttttgtattctataaacttatagatgtgccagtgtcatggtctgctggcaccgggacagacacgcacgacgtgccacatggcatggatcgagccaggcttcatgactgaccgactgttgacatagctcatcgaatcacttttcatgccaggtttgtctaaaaaaataggccctacgaaacctatgagactagcccgatcgaggcccgcgtgttaggaagagagagagagtcaccgcgttcgtgctcgccgtcgtcaatggctcaatgcacggcgtgtactcaacgcaatggatcgatgaataaaatttgatgttgatatattagcacatcaatcctttttatattagacatgttgtctttattttttagacaaaaggtagtaccagtgacagtgacaaacacaaagacgaaaatttatgggaggacatgaagactgcatgacaaaattatgaccataagtgtccatataattcaagttttatatcaatacacgatacaactttaaataaagaagttatatgaataaaagaagcaaacataccgttaaatttttgttgacagagacaattgcatccttcttgttttgagatgtcgaaatcaccgaataatgaatttgaagatctctttgagtataacaaaccattaaaacgttccaattatcttcaatcttgttacgcagttctctcttaattagctgaaaaagttctcccaacacttgcccttgacacatgtaataacatggccaactcaattagcttgtagagtaaaggaaaggcaacatatgttttccggttgaaccgtcttaatagaaatagatgcaatatcttcccaaacactaaaagcagcatgtcttctcacatgaaagaatatatgtctcgagagttactctcttaactctgcacgttcacacaactgtgaaatcttgatcatataactaactaagattatctagattaagtaaacatataaaaggattttttggatcaaagcaagaaaaaccaactatcggctcacttgaagcttcactaaaccgatgacataactctgtattgattttatcaaaaataacaaagaatatctcgatgtggtagtggtaaagttgtaaaggtttgtgactatgaatccatctcgcctctcataacttctgcatctacgtggattaagatccataatctaatttttttgcaagccattaaattcacctctcatattcgatgaaccgtcatattcctattctccaatcttggatatagataagccctgatgatccagaataaaaacactagatatcaaatccaaggtgtgtgtatagtagtatatcttgtcgaatgtcaatcttgttgaagggcgtcgaagcgtcgggatgggggcatgaatagggaaaaaattgctgcaatccggctgcaaactagaatgtttatagaccctcacaaaaataagtatagacctcacctgcaggtacatcagataacgttttagttacgcgggctgccatgcatgaacgcacgcgctaaaactttgaaagacacaggcggctaatgatacttgactctactgctagctactgaaaacgtgcggtgagcacctttcgtttctctcctttatccctgtcccgagcattggtttgcggttgtcctccaattcaatttgatctgggatcttgcgggaccatgcatgcctcctcccccatcttcttccccttctcgttcttcaacagggtctcttattactctcttttgggcacgtgagattttgagttttgaaagaccttgttgttgtgtcacgtgagttttcgttatgatgatttttttagaactgttgttgtttgatgaaacttttacgtgtccacatcaatgcatgacccgttgcctagatgctatcgttgctaatttgctattctcaactgcggcatttctgcacatatgatttaaaactgtggctgcttgacatgtaccgtagtttgctgaatcatgtgtctgcagcaagcatttacacctgtcatttgtacgtctgtggatcgttgtggcggccatggaacgccttgagctcatataccagccgtgcccagtcaccggaagacgagccaccctccgccacggcggcgcgcgccgcggccccgagctcccgagatctggctttcctcgccgctaacacctcctcgtcctgctggtcatcacccatgagcctccccacggcgcgcaccaccgcatcagccggcaccacagcctccaagtccgactcgcgtacccgcacgcccacgcggagcacctccacgaggaacagctcgttcaggaactgctccgcgcggagcggccacgtcgcgagcgggactccggcggacacggcctccagcaccgagttccagccgcagtgggtgacgaagcctcccaccgcgcggtgcgccaggatctccgcctgtggcgcccaccgcccggccaccaccatgccgtcgttgctggacgcgcgcgcctcccgctccgcgcagccgccgtccccgcggggcgtcgtcgagaccacccagacgaacggccggcccgacgcgcgcagcccggtggccagctcacgaagctgggtctcccccagcgagcacgtgctcccgaagcacacgtacaccaccgacccctcgtcccggccgtcgagccactgcagaatcgggtcccgctccgtaccgccgctggcgacggcgagtggagatggagagaccgtggggccgacgaggaacacttccttgggcgtccccgggagctggctacggtagtacgcggcgaagtcggcgtcgagcgcagcgacgctgttgaacacgacggcgcagctctgggcctccgcggcacggaagagagggaggtgcgccagcgcctcctcgttgacctgcgctctgtggatcgtcacggggcgcgggaagcccccggggacggcgaaccggtccgtgtgcacctcggggcggtagagatggagcgcgaccatggccgccgcggcgaaggcgccgatggtgtggaaggtgacgtgcggcacgccgcagtcgcgcgcgacgcgcggggcccagtagagcacggcgtccgagacgaccgccacggggcggccgccgccgccgccggcgcggtgggcgccggtggcggcggtgagcgccggcgcaagggcggcctcggcggcggcgaagaaggtcggcgcggcggaggcgtcgtccgggaggagggagaagtcctcgtacccgccggggcagcggagcggcgccgcgtggactggcacggacgccggtgcgagggccgcgaagtgtgccgtggtgacgatggcggccgtggtggtggcggcgacctcgtgctctgcaccggcggctgcggaggaggccgctttggccgcgagcggggcgaagtggctgcgctcgaggaatggcacgaagacgaggtggagaggcgagtccgcgtgcgatcgctcgggttccgactgcgacatgtcgaggtctggtgtcgtgggacgtggcgcagctgggcggcttggtgagttggtgtcgtttcgctttcgcgggggtggaacttggctagtcttcttttt

SEQ ID NO: 14068 - DNA, 2156 bp, Zea mays
cgtgattctaaacttacaagattgcttaaagattcatttggaggtactgcaagaacatcattggttgtgacaattggtccatctccaagacatcgtggggaaactaccagtacaataatgtttggacaaagggcaatgaaagttgagaacatggtgaaattgaaggaagagtttgattacaagagcttatgtaggaaacttgatattgaattggatactccggtggccgagaatggaaggcaaaggaaacattttgacgatgaagttgagagaataagagctgaagctcaatgccgcattgctgaggctgaaagggaatgcaaaatcacattagagaatgagaaaatgaagtatcatgaagaatacttagactcaataagaatactggaggagaagtggaaagtacatcagcaatcacccaagaaacaaaataaagaggctgagtctacatccaatgatactggagaagtgcataatttactgcagaatgagaaaatgctacgtcaatcggctgaagatgaggccagtgacctcaagaatcaaatatcacactggaaaaagctggaggctacagctacagctgagataataaaactacagaaaatgctagatgctgaagctagccagaaagagaaacttgaagaagaaataggtgttttgagaagccagttattgcagatgagtatggaagccgatgagacaagaagtcttgataaaggagatgggccaggaaaaatatttcctggtttagattcattggtgtctcagactcgaggttcacaacccagagagcaggacaatggacagaagcaaccgattgccaaactctttgaacaagttgggttacaaaagatattgtcattgcttgaatctgaagaacctgatgtccgcgttcatgcagtgaaagttgtcgcaaatctggcagctgaagaggcaaatcaagaaaagattgtagaagcaggtggcctcacttccctgcttatgctacttaggagctctgaggatgagacaattcgtagagtagcagcaggagcaattgctaaccttgcaatgaatgaaacaaaccaagatcttatcatggctcaagggggtgtaaccttgttgtctatgacagcatctgatgcagaggatccacaaactcttagaatggtggccggagcaatagctaacctttgtggcaacgacaaactgcaaacacggttgcgggtagaaggtggaattagagcgttgcttggaatggttaggtgtgggcaccctgatgtccttgctcaagttgcacgtggcattgcaaattttgcgaaatgtgaatctagagcagctactcaaggaaataagatggggaaatcactattaatcgatgatggagcgcttccctggattgtaaaaaatgctaacaacgaagctgccccaattaggcggcacatcgagcttgcactgtgtcatttggcacaacatgaagtaaattcaaaagacattatcaatgaaggtgccctatgggagcttgttcggatctcaagggactgttctcgagaagatataaggaatttggcataccggacattgacatccagccccactcttgaagcagagatgaggagattaggaataaaaatgtgataacagaacagagtgcagctggggctcacactatgaagttccatttctcgtgcacatacagaggtgtccgttgctatgggcgctggtaatcaagcacatcttcccttgatctacctgattttggcaggcatacacgggcaccgcactgactaatcagaagaggcaatggccttcgcaccaactttctcctcgagagttcatttttctttggtttgagggggcagttgaaaatctcgacagcactagcaattcgtttattttgtaaaataatgctagcatagcagatgttacctaccccccaatgcagggtttgtaaattttttgctgtaaaaatatcaaggccaaaaggagtgcttttgcagtttgaagcataactgtattccctgatccctagaaggtttaacttttatttatttatttatttcagatgagccatatttgtaactgattttgtttctttcttaagcgttgacactgccatttcttttaccatatctgttctcagatgatctatgtgaggcacagcttttggaatgcga

SEQ ID NO: 14069 - DNA, 817 bp, Zea mays
ttttttttttttttttgacataaaagttaatgcaaatgcttataatcagagttttagttatcgtaacactaggggtgttacaggaacaaactccttgtttgaacaattcccttctatgatcacatatggccttgtcctgacatgcatcatttttatgtaaactttgtcatccgaaggataattgccttgaaggaaagatacaatttctgttctccaatccttgctgtgcacaggtaaaattgtaagtaccgctcgctcgatgagctcgaccgaaggtgctttgagagtttcaaagaatatttctgaggggagtgggagctcctgtgccgctgatttagctagtaaatctgcctgctcgttgtttcctcttgggatgttttcactgaaaaaccttcgaaggagacctccatccttcgtccatggccttgggcccacatgtcatagagataaaggggcttcttcttccctggacaactggatgtgagcagtactgctgctgcgtgctccggctcgctgcaggttgggggctccatgcacgacgtgctcgagtagagggggagctgaggagccgctcgacctactgcgccgaggggaggagatccggcgagctcagccatggtggggaagaggagcttgggctgggcgccgtgggaagggaggaacagggagcgtcaacatgttgtcttgtcgcacggaggagggagctcggctggagcttgagggaggcggccatggaagagaggaggtgccatgggtggctacatcggtgggggaggaagaaggccgactagagcaggcaatagcgtggagggtaagt

SEQ ID NO: 14070 - DNA, 910 bp, Zea mays
caagaagctcattcgcattacccagtgtttgcatccacaagtgtttgtgccatatccctcccaagcccctgtagaaagaagttggacattgccgacatcccacatctcccatactcatatttgcagcagatatcaccttatcttttgctgcgacagccatatcagcaaaaacatcccacattgtcatctccttattgtcttcatccagctcccagctgaactcttcttccgggaagtacccaccattgcaacgaaaccctctgtgccaatcctcgctggcctgcgctgtcataggcgggacagaaacagggacccagatgccggtatgatcatgaagcaggttcaagacatttacaggttccgactctacagaagtttcggttgtttcagtgttgcatcctttagcaatgggagtgcagttagtatcaaggctgttggccatgtcgtttttggttggtgactcctctgcctcttggtcaaatatgtggagtcccgccaagccttcgacacgtccgccgccgccgcagtcgtcgttatcgtcgtcccacctcgccggcgagccaccagcaccgaccacgacggagcggctgcccgcgggccgcggcgggtcaatcgggcggtggagccgctcggttccggccatgggccactcggttgggtcgattcaccagcgatcaagcggagcaatccgggaatctagcttctgtttctggtaaaagatacgcctttttctgttgccacggattgtagtttgggacggagttgattggagttggaagggatggatcaacggatgtggagagcgagacgacagacgatagaacgagttgagcagagttttctgggaatttaattgccggccggcctcgaggtctgtttgcctttaacgacacatagcgtgtttcagtgt

SEQ ID NO: 14071 - DNA, 2011 bp, Zea mays
gttaggagctccatgttattgcccacaacgtttgaagcactacaaatctttctgccgtagaggaattactatctcggtgcatagttttgtattcatcatgagtgaagagatgaagagacttattgcttatgtggaagatctctacgaggatacaaactcatgcaacatggtcaaggtacaatggttcgacaaagttgatgaggttggtgttcccttgcccatggatttcgatgacagggagatcttcttctctctgggtcgtcaagatctcaatgtagaatgcattgatggattggctgcagtcctgagtgtccagcactacgagaagttcaagggtgataccagatacaacttgtggcaaccttatttttgctgtcggcagattgataatggtgacatcaaaccttttgatgtcacacagctgcaaggctactggagccaggaagtacttaggaccatgttcaatgcaacttcctctctgaaggtgcgtttcaaggtccctaaatccagacccagttcagatggagggctgaagaggaagcgtgatgcattcaacgatgatgctaatccacagaagttcatttcttctggtgcttctacttctaggttttatggtgagaacatccaacaattgtgtcctggttgccatgtggaagtactctctcaagatagtggtataaggggatgttggtttagatgtttgattctgaagaggcataaagataaaatcaaggtgcgctacctagaacttcaggatgctgatgagactggaaacttggaggagtgggttatgctaacacgagttgccaaacctgatcaactgggtgtacgtttccttggaaggccaatggttcgtccacagcgcgtggaacaaagcaaggcctcatgctttgatgttggagccattgttgatgcgtggtggcatggtggctggtgggagggaatcgtgctgtaccaggtgggcagtgggcgtctacaagtttattttccaggagaaaagcgaacagctgaatttggtgaagatgagctgaggtgttcccttgagtgggttggtaacaaatggaatcctttgaagggaagaaaagatgtcacaagcaagctgacctccactgcagattgtggaagtgaatatttgattgcgaaacaagatccactgaattttcatgtgcctaaaaattcagaacctcaactagagggacatcaatatgacaagaggggtattgagaaatcttcagtcagcacaatttcacgagatcagaaacgtgtccttgccgacctgactaatgatttgaagttagataacttgaggtggaggccaagaaagaggagcagaagatctggctcaagaaagcagtcggacacaagcagtggaagcagcagcggggacatggacctgttcagccccagccccagtggaagctttggtcaacataatttagtgcctgacgaggagacatgcaagagcagtggagagcagacttttatgggtgtgcctgtgcaggttcccaatcttgtgatgtccaggtgaaagccatcttagcaccggttgaagattaacatgttagcttctggagttacaccgaccttggcgagatgtggttttgtgcatccccaggttatttttgccagcacaacccagatccagttttctgcagtttttttggaggctcatcagctgtgatcagttagatgtgaaaatgtctcaccaagaaccagtatacagtttgtatgtagggagagaagaaaatgctcggtttggttttggttttagagctttcagttttttttcttttcttttcaatcctagtctttgttgtttgaaggacaggtcctagatttgacatagcctctttacatcggttattctttcccaaaaaaaaaaaaaaaaggtagtccttgttttttatttgtccacgcagtcttgtagcagtcgcgccccttacgtaaaattatcctgaactgaactcagtgaaatgtcacaaaatagtgcttattgcctatttctgtgttc

SEQ ID NO: 14072 - DNA, 961 bp, Zea mays
gggcggtgaggtcgcgtgtcccggtctgcagtatcgggcaagcctacgggcccaaacggaaaaagaggacctgagccgactccgccgaggtcggtggcggcggcggcggtgagcatggccgcgcagagggagaagtccgcggccgtcgcggtcggcccagcacacggcgctgcggtatcggggtctccttctccttcgtcctcatccggaggcccggcggcggcgtcctcgtcgggagagcggtggagcgccgcgatcgggaacctgggggagctcggcgccaacgtggacgcgctgcagaagatgctcgggcggaaggctgtcttcgtcgacgatgacatcttctccaaggcctccctcgccgccgaccaggcccgcaccattaaggttcttgaccagagggtgcagtctctggaacgcgaactcgatgccgccatttctgcagcagctcgagctcgtacagataaacgacaggccgaagctgcgcaacgagctgcagagttacgcacacaggaggtcaccaaggaactggagaacactgcgagagtgtttcagctgcacatggaggagttgcggctgaagcaagaggagattgcgaagaaagatagcgatatcaaggtgttggaagcgataatacgaaccctcggtagcaaagatgatgatggatccagcgaataattgtcatgaacagggagcgaggcttttatgttcaaatatctcacggcgtgtttatgattatgtatttccttttggggtttaatccctttgttactcagatggatgtaacttgtttcgacaagattgagcgtgtccgcactcatactactataaatttgtattctaaaacaaatattttatcatcgttagcaagattatctactatataccaaacaaaaaaaaaaaaaaaactactctatatctcaccactataccaaatatcatatattatattttttttttc

SEQ ID NO: 14073 - DNA, 857 bp, Zea mays
gccggccgggctcgagatcgcagtgtctgggtcaccgaggctgtgttgcctgtctgcaatttcgggcaagcctaggggcccaagcggaaaaggtaagctgactccggcggcggcggcggcggcgatcatggccgcgcagagggagaagtccgcggacgtggcggtcgccccagcacacggcgctgcggtttcggggtctccttcttcctcatccggaggcccggcagtgtcggcgtcctcgtcgggagaccggtggagcgccgcgatcggtaaccttggggagctcggcgccaacgtggacgcgctgcagaagctgctcgggcggaaagccgtcttcgtagacgatgacatcttctccaaggcctccctcgccgccgaccaggcccgcaccattaaggttcttgaccagagggtgcagtctctggaacgtgaactcgatgccgccatttcagcagctgctcgagctcgtgcagagaaacgtcaggcggaagctgcacaacgagctgcagagttacgcacacgggaggtcacacaagaactggagaacactgctagggtgtttgagctgcacatggaggagttgcggctgaagcaagaggatattgcgaagaaagatagcgatatcaaggtgttagaagcgatcatacgaacccttagtagtaaagatgacacccttagtagtaaagatgatgatggatccagcgaataattgccatgcacagggagcatgatttctgttaagtatctcaatgtttatgattatgtacttcgttttgggggtttaatcccgtctattactcggttgtaaattgtttcgattaaaaaaaaaaaaaaaaaaaaaaagtcgacgcggccgc

SEQ ID NO: 14074 - DNA, 4692 bp, Zea mays
acatttcaagacctacaacttttattttggtagtttttccatccgagacagtttgaaaaattcatatttcaaaattcaaacatagttttgcataacaagatgatttcaaactaaaacattgtcaactacaaagttttataactcttcaatacctacaactttcatgttggtggtttttcctttcgaagtcgttttcaaaattcaaattttaaatttttaaaattcagacatagttttcgttgacaatatgacttcaaatgaaaaagttgtcaactataaacttctataacttctcaagatctacaaagtttattttggttgtttgataatttgtttatctcagatgatggttataacaatatgcacaaattctatacgtctctctcgtagtttcataaactacgagagagatataggttttgtgaacaaatttatttttattttgtcatatgaagaaatgttcaatatataaattgtacatcatgatgagttatacaaatttgtagttgaaaactttttcatttgaattaatttactactttaaaatgtgatttttaaattgtctttcttatgggttaagaaagatcctaaccaacttataaagtggactctatctctatgagtatcatttgtgaagttggaaaagatgacatgtgtgtgtcactcgcacgagctcgctcgccgagacgagacagatggataggacagtgcgaacgtgtgaggtgttgtgctagaatttgatttttgcagttacgaataacgatggtgaccataatgatcgatctgggcattaacatgaatgttactagcaacttctggaattaatcctatcaatagcgcccaagttcacgtattatgaacgaactgtgtctagtttcttcccctcgatcttaagtgtgcttaggagatgcatggctcccttctccctcaaagctttctgccatcactgagaacaccacatctccataaccatagctcagcgcgtggcaagagcaggcctccggaaacccctatttatttgttgaagatactgctcgatcgggatgataggaccaataacgcacgtgaagctgctgctactggttcgatctctggtagcgtgcacgtacatacacgtacgcacgcatcttgcttggagatcgagttttccgttttggatcctactagttaatttaattgaagtttaagcaaagcattgaccactagccatatcgtattaattagcttaggtagctaggtcaaggtcaagcgcactagctagcaagtactacagctacgtcaatttaattatctgtcagtaacatttcagtaaacctaggcgacgactgattcgaggatcgctacttgagttccatggactggagtccgcttgccattattattattattatgaatccacgatctgtacgtgcatggcccagcgcgcagggcaatatgcaagctagctaggtcaacgtactggagctaattagtagctcccagatgatagtagtgtgtgccaatgactcacgtacgtacgccgcattgggtttttccgccatgaactaacttgcattgtttgcccttcggtttcactgctagtataccatgcatacgtatatgtttggtttatgcatgcatgcatgcatgccctttccatcaagtacaaataacaaacgcaatgtaagcacgtcgtcgcttatattaattacctgtttcagtacaggcacaccaaggtcagctgcctaactccaggttagtactttttttgtcgttcaaaaatagcacagttagctgcaggggtccaatggatcgactttaatttgaaacgaacgacccagtgttacagaaagggagagacagatttaaaaaacattcagtggaaagagttttactcggattcatttctattaagaatttcttcttgttgttttttttttcatcccaccacgtacctgtttgattcaaacagggactatacagagaatatatacatctgtgtggagaaataaagacaccttccgagagttagctgataatgatcatatatatgtgaaatagcaccggatcggatctgcacgtcgtacgacgaatacagaaaggaggagagaaaaaaaaataacagcagatcaataattaactacgtacgtgtgtacgtgcgtcgtcgtgcaactgtacaaaaatcattcatgtggcaaatgctggtacgagagcaaagttcttgcactactgcatcgtatagacgaacaaactggcgcgtacgcgcggtacgcgctgattcatcagttcgtgctagctagcttcttgaccgccccaaaccaaactagcgttcgacctggaatttccggccagacggctgagaaatggcacacgcaacaaatgtctcatcatggatctacattgttttgtagggtcctactatgaccgacctcggtaacgaatccaaattttgtttgtgttctacctattttttgtcggttccatattataaattgttttatttttttagaaagtcaaaacatctcaaatttaatcaaatttgcataacaaaataataataataataataattagattctttattaattatatttttatagtgcttcccacatcccaaagtccaactttatcaattttgcataacaaaaaaaaagtcttggtcattatgggtagccgccgcgtagggggggtatccgggcatgcacaggaaaactgaaaattggagggtccaatgcgcaagaaatgggaccctcgacgccctccagccggccatctccagttctccacctccaatccctcctcctccataagagacaagaacgaggtcgtctcgccatcgccgccactcctatttaagagctgccggaggtgggggcagatccggcgagccgttcccgctgtccagattcaggaactagactcctccggtccggtcctccccctcccgccccgtctcgctccagcggctccacgccaccgtttgccattcactgccagaatggcgctcaacaaggagtacacgtacgcggagctggagaaggagccgtactggccgttcgagaagctgcgggtctccatcaccggagccggcgggttcatcgcctcccacatcgcgcgccgcctcaagggcgagggccactacgtcgtcgcctccgactggaagaggaacgagcacatgcccgaggacatgttctgccacgagttccacctcgtggacctgagggtcatggacaactgcctcaaggtcaccacgggggttgaccacgtgttcaacctcgcggctgacatgggtgggatggggttcatccagtccaaccactccgtcatcatgtacaacaacaccatgatcagctttaacatgcttgaggctgctagaattaacggcgtcaagaggttcttctatgcatcaagtgcctgcatctaccctgagttcaagcagctggaaactgtagttagcttgaaggagtccgatgcttggcctgccgagcctcaagatgcctatggcctggaaaaactcgcgactgaggagctgtgcaagcactatacaaaggattttggcatcgagtgccggattggtcgctttcacaacatatatggtcccttcggcacatggaaaggtggaagggagaaggcgcctgctgctttctgcaggaaggctctgacctccacagggcgctttgagatgtggggtgatggcctgcaaaccagatccttcacatttattgatgaatgtgttgaaggtgtccttaggttaacaaagtccgatttccgtgagcctgtaaacattggaagcgacgaaatggtgagcatgaacgagatggcagaaatagtcctgagctttgagaacaagcagctgcccatccaccacatccccgggccggagggcgtgcgtgggcgcaactcagacaacacgctcatcaaggagaagcttggctgggctccgactatgaggctgaaggacgggctgaggatcacgtactcctggatcaaggagcagcttgagaaggagaaggccgagggcatggatctgtctgtctacggatcatccaaggtcgtgcagacacaggccccggttcagctcggctccctccgcgccgctgatggcaaggagtgaactttggctgcgccggtcagttgcagggcatgatataccagtaatacacagttgtttcagtttccatgatttgtagtcaccatttcttgattcacatttgactccacaagagaagaccatttggacgatggatattttgtcacaagttacgggatttagttcaaatttgaactgaatacaaaatatcctgacacgatatctgtcgtccaaacacttataataatttccacgctgttttttccctcttgtgtgcctgtacaatagaaatattgcagacttacaacacacatgtaaactggtgtcactttatttcacagaaatagcaatgaataaaataaggttaagcagtcttgaaaaaaaaaaaaaaaaaaaaaatcgacgcggcaaaaaaaaaaaaaaaaaaaaaaaaaaaaaaaaaaaaaaaaaaaaaaaaaaaaaaaaaaaaataaaaaaaaaaaaaaaaaaaaaaaaaaaaaaaaagggggggagagtttaggggtccaaggtttaaaaacgtgtgattgggaataaaaatttttttattggggtcccctaaatccattttattgcccattttttaaaaacttcttaatgggaaa

SEQ ID NO: 14075 - DNA, 757 bp, Zea mays
  misc_feature (5)..(5): n is a, c, g, or t
  misc_feature (739)..(739): n is a, c, g, or t
cgggntaagttgaatggcccatgagcgtaggccatgcttccagtggagtcacagaatggaaatcctcaaattcttcggagcaaggtctgggtatgccaccaattccacctagccaaaaccagttttcttctcgtgggcggatgggtgtccgatccagatatgttgacacattcaataaatcaggtgcttctggagcggtgccatcatataacaaaccagctgctccatccgtgacaccaccagctggtgccaagttcttcataccgactgcagcacctgttgctgcagatcagatgatgccacaccaagcagcagagatacacagtgaaaccatgcaacaggatgagagggcagcctcaccgcctgctggaacatcattctcttcaaccccaccacccacacaattttcatcgcccccaccacacacgcaattctcgtcaccaatgcaatcaacaatccatcggcaatctagtatggcgaacatctccaccccttaccagagttccggggtatcatcattaagcagcgacacctcattctcaaaatcacgagctgcatcctggagtggaacatactctgagcagttcagtgctttttgcgggcacaagatcacccgatggacagacggtgcgctcaccactcatgcctggcaaaccatcacacagtcgttccaacagcaactcatcagtgcagctcaatggattgacagaggatcttcatgaggtcgagctctaattgncggctgctcagcatgact

SEQ ID NO: 14076 - DNA, 3629 bp, Zea mays
gccttcttcaggtcaccaacctaactacatgggatttgacacctctgcaaaccaccatggttatactgatgtcaatggtgttgcgagtactcaaggctttgtcccaatgcaaaccacgtaccagggccagaaacaagcaaatgcaacctcacaagggcacctgtcaaatagctatttgggtactgacaactccatgaactttaatcagcaacaatttctgggtgcaaatgcctcaaatttgcaattcggtcactccccgcatgaaggtaggtcatcggctggacgaccaccacatgccctcgttgcttttgggtttggagggaagctcatagttatgaaagaaactacctccatgcctgcaagttttaacagtggaaatcagggtaactctagtagcacagtgtcggttcttaatctgttggaggtagtctttgataaagttgatccttcaagtgtcactaatggtagtgcacttagttatttccatgctctatgccgtcaacctgttcctggccctctggttggtggaagtgctgcatcaaaggatgtaaataagtggcttgatgaaatgattgcacggtacgagtcttcctctagtgaattccatagaggtgatactcgcaagttgcttatttcattgctgaagatactgtctcagcactatggaaaactgcgttcaccttttgcgtctgacccatcgcaagaggagacagatggtccagaaatggcagtaactaagctattttcatcgtgtaagagaagcactgttcatatgggagattatggatcccttgtttcttgcatgaaaaatattccttcagaaagtcagatgcaggctgttgcacaggaggtccaaaatcttctagtttctgggagaagaaaagaggcccttcagtgtgcccagggaggtcaactttggggacctgcaatcatactggcattgcagctcggtgatatgttttatgtggatacagtgaagaaaatggctcacttccattttgtatcggggtcccctctgcgaacgctatgccttctgattgctggacaacctgcagatgtttttaatgtagagaacaatgtcaacagtgactatggtgcatcccatcaacctgtggagcctggtcctaatatgttggatgattgggaggagaatttggctattattactgcaaacagaacagaaggtgacgttctagtaatcacccatcttggtgattgcctctggaaagaaaaaaatgaggttgcagctgcccattcatgctatttagttgctgaactaaacattgattcatactcggaaagtgcaaggttatgcctcattggtgcagaccatttgaagtgtcctcgaacatttgccagccctgaagccattcagaggacagaggtttatgaatatgcgaaggtgcttggtaattctcaatatatcctactatcctttcagccatataagctgatatatgcatacatgcttgtggaagtggggaaggtttctgattctttgaggtattgccaagcgtctataaaggtactgaaagcctctggtcgtgcccctgaattggaggtgtggaaacaattattttcttcgctggaggagaggatacgcactcaccagcagggtggatatggcacaaatcttgccccaggaaaaatagttgggaagatttttacctcgcttgataaatctatatcccgcatgatgggtacaccatctgcaccacttccaccgttgccacatggatcttttagtgataaagagagccactctatacctgcggcagcaaaatttgttaatagccaatcggtaatggtcatgccatcgttaataccatctgcttcaatgcagtcaatgactgagatagcagaggatagtggtggcactggcaggaaaattgcacacaacagaagtgtttctgagccggactttggtagatcatccaaacagggtgctggtggatcagatggtacacagagcagtgcatcaggatccagcagttctcgatttggttggctagtgcagaagactatgggattagtgtcaaaatcccaccgccaggcaaaattaggggatcagaacaaattttactatgatgaaaaattgaagcggtgggtggaggaaggtgctgctgttcctgccgaagagcctcctcttcctccacctccaacaaaaccatctttccagaatggtatgctagacaataagttgaatggccccatgagcgtaagccatgctcccaatggagtcacagaatggaaatcctcaaattcttcagagcaaggtctgggtatgccgccaattccacctagccaaaaccagttttctgctcgtggacggatgggtgtccggtccagatatgttgacacattcaatagatcaggtgcatctggtgcaatgccatcatataacaaaccagctgctccatctatgacaccaccagctggtgccaagttcttcatgccaactgcagcacctgttgccgcggatcagatgataccacaccaagcagcagagatacacagtgaaaccatccatcaggatgagcggtcagcctcaccgccagcagaaacatcattttcttcaaccccaccacccacgcaatttccatcaccagtgcaatcaacaatttatcggcaatctagtatggagaacatctccaccccttaccagggttccggggtatcgtcattaagcaacgacagctcattctcaaaatctcgagccgcgtcctggagtgggacatactctgagcagtttaatgcttttgcgggcactatatcgcctgacagacagacgacgcattcaccactgatgcctggcaaaccaccacacagccgttccaacagcaactcatcagggcatctcaatggattggcagaggatcttcatgaggtcgagctgtaactggcgactggtcagcatgaccgtcgcaactcgtgtcttaaaggcagcgatgacaacccctccccaagcaggtgacagaaaagaaggtgcccttaaaatgctgaccacggggatgccgcagctggaatgggcttggtgtgactttgcacgagattctggggcgcgctctaaaccaccgaggtgcgtcaggcctgtactaatagagatgcagggtttttttttgtagccatatatacatatatgttggttttgtgttttagagagaagggaaagggttgggtgggcctttgtttacaggtgggaagggaagagaagcagcatgcagatgcccttgtacagataatctgcccctacccagtttgtttaaaacgcaaacaacgccattttggttttagttccctggagaaggatagaggagaaggtgtgtgtctttgtagtgtgagaagcatggctctgtagtgttgttgttatagtgtactactactgtgctagccagccgcatacacagactgtttattctttggagacgaatcaattctttcatcttgactagggcattattatttgttaacataatgctgcatcttgttatgtacgtaaaagtcaagagaaggtacaaattaagccatatgttatgtactagtaaacaatgatacaggatgcagatgcttatcgattgatacgttgatgtagcaagagtggcggcggtacgcgtggttttggttaattg

SEQ ID NO: 14077 - DNA, 2252 bp, Zea mays
gtcctaattcattcgccggtccctcgggccggccggggcgttcatttcgcccttcccattcctctccactgcgctgccatcgtctcgcgccggccccccgtggggaactagaactgactccctcgatcccagcggcagcggcggaagcgaacggtgaccgcgacctcccctgaggctgcatatactcggatcgggtttcacatctccggttttggattggttggttgcccgcggcgatgggaggagagctgtggtggtatccataggggatcctcggttgcgtccttgtgcgatggcttcgacctccgttcctgagttaaccgcggacaagaaatgcgacaaagccatcgcggatacggcggcaccacttacttctcagggacactccgaagaaccgactgggaaagtcagcacactagtgcctgctttgccggttgtaattgcagcaggcgatggggctgcatccagtggggtgatagaaaacagaaatggcatggacaattctgctgatggttctttgaagcgggatgacagtgaaggtgctgagaagagctcgctgcgggggagcgtcaaggatagctcggtgtcggctaaatgcagtgacagggcgagcagcctgtcgaaagccagtgggagcgccaagatcagcggtcaacctgctgacatgatcgagagtggcaagagtagtctctatcgggccagtggtggaagtgatctgagtgatgagagcacctgcagtagcatatgcagcagtgtcagcaagcctcacaagtcaaacgactcaaagtgggaagcgattcaggttgtccgaaccaaagaaggttctgtaggtctaggtcatttcaggctgctcaagaggctcggttgtggtgatattggcagtgtgtacttatcagaacttagtggcactaaatgctattttgccatgaagatcatggacaaggcgtcattagcaacccgcaaaaagctgcttagagcgcagactgaaagggagatattgcaatgcctggatcatccttttcttccaacattgtacactcactttgagacggataagttctcatgcttggtgatggagttctgccctggaggtgacctacataccctaaggcaaaagcagcctggcaagtatttccctgaacaagctgccaagttttatgtagcagaggtgcttcttgctctggaatacctgcacatgcttggtatcatataccgtgacttaaagccagagaatgttcttgtgagggaagatggacatatcatgctgtcggatttcgatttatccctccgatgtgctgtgagccctactcttctcagatcttctaaccccagtggggataaccaaaagggcaacccagcttactgtgtgcagcctgtgtgcattgagcctgcctgtatgcagccttcttgtgtcacgacaaccacatgcttctctcctcgctttttctcttccaaatccaaggagaaaaaagataaaaaggcaaaggcagacttggcaaatcaggtcagaccacttcctgagcttgttgcagagccgacagatgcaaggtctatgtcttttgttggcacccatgagtacttggcacctgaaattataaagggcgaggggcatggaagtgctgtagactggtggacatttggcatattcttgtatgagcttctcttcggcaagacaccattcaaaggttctgggaatagggcgacattgttcaacgtagttggacaacccttaaggttcccagaatcacctgtagtgagttttgctgcaagggatcttattaggggattgctcatcaaggaacctcagcatcgattagcgtataagcgtggagccacagaaataaaacagcacccgttctttgaaggtgttaattgggcattaatcaggtgtgccactccacctgatatccccaagccagttgagatccctcgttctgtagcttcatcaagccagaaggctacatcagccgctgagaaaggctcagattatcttgaattggagtttttttagtggtcacgcatgatctcccatgtgcaagttgtaaagctctaccttttccacttagacttcttttttttatgggttttaataactttatatgtagatgcatattgtcgtacgtagtgctgttctcttcagttgatttctcagttcattcctttagatgggatcctcaatctggtggagtctgtaatcctttattggctgccgttcactagattctctcaataacatggaaacattttcgttc

SEQ ID NO: 14078 - DNA, 2327 bp, Zea mays
gcagcaggatctggcagttctcgatttggttggctagtgcagaagactatgggattagtgtcaaaatctcaccgccaggtatttttatttactgagttatgaaaagactatctccagttcttttccccatcttgtctcttctatatgcaatgtcaaccttaggatcctatttctgttctgaaggcaaaattaggggatcagaacaaattttactatgatgaaaagttgaagcggtgggtggaagaaggtgctgcggttcctgccgaggagcctcctcttcctccccctccaacaaaatcatctttccagaatggtatgccagaccataagttgaatggccacatgagcgtaggccatgctcccagtggagtcacagaatggaaatcctcaaattcttcggagcaaggtctgggtatgccgccaattccacctagccaaaaccagttttcttctcgtgggcggatgggtgtccgatccaggtagttcaacagtagcagcgtcgtttactacttttaattatattttctatattgctatccaaggtattatctggaaacctgatggctttctgtttttcattttagatatgttgacacattcaataaatcaggtgcttctggagcggtgccatcatataacaaaccagctgctccatccgtgacaccaccagctggtgccaagttcttcataccgactgcagcacctgttgctgcagatcagatgatgccacaccaagcagcagagatacacagtgaaaccatgcaacaggatgagagggcagcctcaccgcctgctggaacatcattctcttcaaccccaccacccacacaattttcatcgcccccaccacacacgcaattctcgtcaccaatgcaatcaacaatccatcggcaatctagtatggcgaacatctccaccccttaccagagttccggggtatcatcattaagcagcgacacctcattctcaaaatcacgagccgcatcctggagtggaacatactctgagcagttcagtgcttttgcgggcacaagatcacctgatggacagacggtgcgctcaccactcatgcctggcaaaccatcacacagtcgttccaacagcaactcatcagtgcagctcaatggattgacagaggatcttcatgaggtcgagctctaattggcggctgctcagcatgactgtcgtcttttatccacaaaagacagccatagcaacccctgataaaccccttcccaagcgggtgacagaaaaaaggtgcccacgaaatgctgatcacgggggacgctgcagttggaatgggcatgtgggacttttgcacgagattctggggtgcgctctaaaccaccaaggtatgtcagacctgtactaacagaaatagaaatgcggggggttttggacattttgtagctatatatatatgtgtgtgttttgttttatgttttagagagaagggaaagagttgggctggcctcgtttacaggtgagaaaaatggagcaggagcagcatgcagatgcccttgtacagataatctgcgcctacccagtttttattttttttaaaaaaaaaacgcgaacaagttcacacccgcactccattttgatgttcgtttctgggcgaaggatagaagagaaggtgcgttctagtgtgacaagtatggctctgtagagtactgttgttttggtgtactgcactagccgcagtatattgtctctgttttattctttgggtacgaatcgattctttcatcttgaaacaattgtgttacgccttgttgtgtattcttgtgccctggccgatgtggcggatgcaattgtacgtgttcttcaggtcttggttgtgctgtcgctatatccttgagcacacgtgtgtgctgagctgttttgttgacaatgcgcatcgtaatactggatctttttttaataaactacacgatttgcagttagttgtttgtcaatctatttgcatgaacaaccccttcatcagaaagattgtaggtattttacagcttgctcaactcaactgcataccggcaacacagcgggcgaatcgatatagaccgcctaattaagcgccagatatgatggagctgctgcatgcgatttggatgcagatgcgttcatgcatccagtcgcccgatccccaaccaaactgaaactgcatgcagaatcgagctgtgttttgtttgttgctttcaaatcgttaccacgcgcgaggcaatgaacgttagtttctggcgttactagctacagtacaaacgagcatgcatgcaaacatgccagccatgttctggacttatgactgttagtggatcggatcggattac

SEQ ID NO: 14079 - DNA, 4118 bp, Zea mays
cacccctctccgcttcgaaacccccgacgcgaaggaagctagggaaccctcgcgagtcgcgttgcctcgcccccgtccccttcagctggcccgccgccgcctcgaatccgccctggctcggagggcctcgcgcccccacggatcggattctcgaggttggtggatttggggctagggtttggggattgactacaatcgtggggttgtttggcgtaatttgaggagcaatgtacaacatggttaggaagtggacctgaggaggacggagggatggtggcgatggagggtaagggggacgcgtcagtgacgccggtgaggactagtgaccggctgcggcagcgtccaaagtactatgctcgtggctatatgtactacaatccagccatgaggaagaaggttaagtctaagaagcgaactgctgcatcacagattgctaagaaactgcttcgcaagccagctgcacggccaccacctgccgattgtgttgcagcaaatttgcgccgttcaacgagaaagcgaaggatttctgtaaatctggagggctatgatacagatagttccagtatggaagatgacgatcttatgagacctagatatcgatcttcaaagagtaaggggggaaacaatgctgcacataatgaagtgtcagctagaccaaagcgccagaagttgtctaactccatacctcgtcgtgaaggtttacggcctagaagatctttgcgaggacaaagactgcatccataccatgaatctgaggatgaccaggaaagctctgatgaacaaggtgcagaagatcaaagagaaaatggcaatgagattgaagaggatgttggtgatgaggaggaggttgatggaggtgatgaagctgaaggagatggagatgacgaagatggtgaggaagagcaagaaggaaggaggagatatgatttaagggaacgttcagaggttcgtagaccatcccctcgtaaggaaggaaagcacagaccacaatctcctcgtagagtactagttcacggaattggtccaaagaacagcaagtatttaaaaaaaggtgggtcgcgcatgcataagcgccctcgtttctctttgccagatgattcagatgattcccttcttgtggatgagccggacgagggcccatccatgccatggatgcgcagtgggaggggaagtatgccatggttgatgggtgggttggacatgcatagtccagcagcatggggcctgagtgttggagcatctggttggggtcatcagggtgacacttctacttcactcatgcctggggtgcaaactgctggaccaagttctaagggaggagccgacattcaacctctgcaggttgacgagaatgtgagctttaaagatataggtggactttcggagtacattgatgctctaaaggaaatggttttctttccattattgtatccagatttttttgcaaactatcacatcactcctcccagaggtgttctgctttgtggcccaccaggcacaggaaaaacattgattgcccgtgccttagcctgtgctgcctctaaagctggccagaaggtcagtttttatatgcgcaaaggagctgatgttcttagtaaatgggtgggtgaggctgaaaggcagctaaagttactttttgaggaagctcaaaagaatcagccgtcaattatattttttgatgaaatagatggcctggcacctgtgaggtctagcaagcaagagcagattcacaattcaattgtttcgacattgcttgctttgatggatggccttgattcacgtgggcaagttgttttgattggagcaactaacagaattgatgccattgatggagcattgcgtagacctggccgatttgatcgtgagttttattttcctttacctggctatgaggctcgagcagaaatactggatattcatacaaggaaatggaaggatcctccaccgaaggaactaaagatggaacttgctgctagctgtgtgggctattgtggagctgatttgaaggcattatgtacagaagcagctattagagcatttagagagaagtatcctcaggtctacactagtgatgacaagtttgtcattgatgttgattcggtcagtgtcgagaagtaccactttttggaagctatgtctacaataactcctgctgctcacaggggatctattgtgcattcaaggccactttcaacagttatcgctccatgtctgaagagtcatcttgagaaaataatggaacatatttctgatattttccctttcctttcatccatagattttagcaagttctctgctctctcctatggatcttccatccctcttgtttatagacctcgccttttgatatgtggtggtgaaagtgtcggactggatcatgtgggaccagctgttttgcatgagcttgagaagttctctgttcactctttgggactgccgtctcttctctctgatccaagtgcgaagacacctgaagaagctcttgtgcatatctttggggaagccaagagaacaaccccgtccattctatacatacctcagttccatctttggtgggatacggcacacgaacaactaagggctgtgttgttgactctgttgaacgagttgccctccaaccttccagttttattgcttggaacatcatcagtggtttttactgaccttgaagaagagtgtgcttccatattctcttctcgcaatgtgtatcaagtggatcaaccaagttttgacgatagattgaggtacttcagtatattgtttgagtcattgctctctttccaaatggaagaatcaagaaacaagtcaaagaaacagaagtctgctattgaccttcccaaagccccgaaagaagtggagggccctaaggtttctgagctaaaggctagggcagaagctgagcagcatgctgttcgtcgaatgaggatgtgcctccgagatatctgtaatcgcattttgtacaacaaaaggttcaatgtatttcacttcccagtattagaagatgaggtgcctgactatcgatcaataatccacaagcctatggatatggctactgtcttgcagcgggtggactctggacagtaccttaccagggcagcatttataaaggatattgatcttattgtctcaaacgcaaagacttacaacggggatgactacaatggatctaggattgtcagtagagcatgtgaactcagagatgtggtccaaggcatgttgtcacaaatggacccatctttggtgtccttctgtgataaaattgcttcacaaggggggccactgcaggctgtggatgatgaagatagagctattcttcaagcagcacctgttgctcagctggtttctggtactagaataagtgcaaggcttcgaaatgtacagcctgaagtaaacctgtcacaaagttatgaagtgctaaggcggcaaaagaaaagtgcagaaaatgaacaaagcatgactagagatgaaaagtctcctgaagatgtagatttgtcgaagccaactgacgcagaagaagctgcaaaagaaccagagtcaaatggcactacgaaagaagccaacgattcaccagccaaagaaccagaagtatctacttcccctgaacccatggagagtgacaacggcaaaattgccgcggctactggcgacgacttgttagaacagctagaagccctgaagcaacgcttcatggaactcactgcaagctatggcgtgccgcagctcgagaggctgtattccaagataatgaaaggagcaatagagttgacaagtaaagaaagcaacgaggatcataggcggttagtagttaggtatttgtggacattcgttgagaacagcaacaatttttaacctggcgccaataagattcttgttttccttgtacatcctctttggaacgaaacaatagtagccgttcatcttgggagttgtccccgttccatgccttgtaacaaatcttccaaatgctctagtgtcagtgacacagttttgccatgaaatgatgtagcaagtgaacccttcctagatttgtacctcagtttgatgaatttatgaggtggaattccctcttaatgcataacatgtgttcccatgaaactagagggggggcccggtaccca

SEQ ID NO: 14080 - DNA, 1753 bp, Zea mays
atcggcggacatggtggtggccgtgcagctggccgctcttctcgcgctgctgctcgcgctgtggcgcctggtgtggcggccgcacgccgtggcgcggtcgttcgccaggcagggcatccggggcccgccctacacgttcctggcagggtccttgccggaggcgattgggctcctcgaggccggccggagagggacggcgcccctggacgccggctgccacgacatcatgcccgtcctcttgccgcagtttcacagatgggtcgcggactatgggagaacgttgctgttctggatcgggccgattcccgctgtcttgtctactgatctacagctgattaagcaggttctgacagacaggacgggcctgtatcagaaggacttcatgatccccgtgctcaagttcctcttcggcaacggtgtcatattgataaacggagacgattggaagcggcaccgcaaagtggtcctccctgcgttcaaccatgagacgatcaagagcatgtcggcggtgacggcagaggtaacggagcagatgatgcagcaatggcgcggccagatacacggaagcgaagaggaatccgccgagatagacatgatccacgccttcaacgacctgacctccaaggtcaatggccgcgtcgccttcggcacgagccaccgggaagtcgaggaggtcattgtactgatgcgggagatgcagaagctcgccactgcggccacgctcgatgctccaatactctggtatctgccaactcggcgtaacctgcacgtccggcgtctgaacaaacagctgagaagcaagatcatgtccatcatgcaggcgcggctggccgccgacggagctgataggcgtggtgggcgcggcggcgccgtttccggcggaggcgacctacttgggctgttgctagaggcgtggacgccgcagccgcagcagcacgggaacggcggcgagacgctgacaaccgacgaggtgatcgacgagtgcaagaccttcttcgccgcggggcaggaaaccacagctaccctcctggtctgggccatgttcctgctcgccgtgcacccggaatggcaggacaaagtcagggaggaggtcgtcagggaattctgcaccggcgacgacggcgaggttccccatgccgatgtcctcgccaagctcaagctgctatacatggtgttgctggagacgtcgcgcctctacccgccgatcgtgtacatacagcggagggctgcctgggacgccgtccttggaggcatcaaggtgccccagggcaccgtcatctccatccccattgccatgctgcaccgggacaagcaggtctggggccccgacgccgatgagttcaacccgatgaggttcgagcatggcctcacaaaggccgccaaggatcccaaggcgctgctgtctttctccctgggcccaagagtgtgcactggccagagcttcggcatcgtagaagtgcaggtcgtcatggcgatgatcctcaggaggttctccttctccctctccccaaagtatgttcacaagcccaagtatctcctgtccttgacacccaagcttgggatgcctctcatcgtcaggaatgtggatggctgagagagataatattgtaagagctcgttttgtgtgtgaaaatgaatacatgactagtgtgtgataaatggtactctctttgttttaaagtataaattgtttcaatttttctatgtatattgctttaacgactatacatttagacgaaaaaaaaaaaaaaaa

SEQ ID NO: 14081 - DNA, 942 bp, Zea mays
  misc_feature (885)..(885): n is a, c, g, or t
  misc_feature (912)..(912): n is a, c, g, or t
ctcgaggccggccgggccgggatcggcggaatggtggtggccgtgcagctggccgctcttctcgcgctgctgctcgcgctgtggcgcctggtgtggcggccgcacgccgtggcgcggtcgttcgccaggcagggcatccggggcccgccctacacgttcctggcagggtccttgccggaggcgaagcggctgctgatggccggccggagagggacggcgcccctggacgccggctgccacgacatcatgcccgtcctcttgccgcagtttcacagatgggtcgcggactatggtaaacttggtgaccaccggtggtgctgattctccatttttttttcccgtttcttctctactagaagaaattgtcaagaaccatgtagtaggcgcctgtctacagttgttggaaatgcatggttggccgtgagtgactcgtcatgaaccagtgccgacaagacattatctttaagattttgattaaacggaacctcaaatatacatatatattgttgggcattcgtgcagggagaacgttgctgttctggatcgggccgattcccgctgtcttgtctactgatctacagctgattaagcaggttctgacagacaggacgggcctgtatcagaaggacttcatgatccccgtgctcaagttcctctttcggcaacggtgtcatattgataaacggagacgattggaagcggcaccgcaaagtggtcctccctgcgttccaccatgagacgatcaagagcatgtcggcggtgacggcagaggtaacggagcagatgatgcagcaatggcgcggccagatacacggaagcgaagaggaatccgccgagatagacatgatccacgccttcaacgacctgacctccaaggtcaatggncgcgtcgccttcggcacgagccaccgngaaagtcgaaggagtcattgtactgatgcg

SEQ ID NO: 14082 - DNA, 2436 bp, Zea mays
cattgggtacctcgaggccggccgggctctgtcagtctatcttctcggctcgcacacctcagacacagccaggcagcggagcgctcccccttcccctcgattctttcgcttccttctagaaccttccgctcccgccctggcctcccttcccccgcgcccccccctccccccaccccgaagatgacgaccatggagaacgtgatcgtgctcgtgaaccgcatccagcgtgcctgcaccgtcctcggcgaccacggcggcggggacgccgccgcctccctccctaccctctgggaagcgctcccgacggtcgccgtcgtcggcggtcagagttcggggaaatcatcggtgctcgagagcatcgtggggcgagacttcctgcctcgaggatcagggatcgtgacgcgtaggccactcgtcctgcagctgcacaagacagaggccggggtgcaggagtatgccgagttccttcacatgcctaagcgccgcttcactgatttctctcttgtgcggaaggaaatccaggatgaaactgacaggttgactggaaagacaaagcagatatctccagttccaattcatctcagcatatactctccacatgtggtcaacttaacattgattgatctgccgggcctaaccaaagttgcagttgaggggcagcctgaaagcattgttcaagatatcgaaagcatggtgcgttcatatgttgataagccgaattgtattatattggctatatctcctgccaatcaagatatagcgacatcagatgcaatcaagcttgcccgggaagtggatccaactggtgagaggacatttggtgtgttgacaaagcttgatttaatggacaagggaacaagtgcacttgacgttcttgaaggaagagcttacagactgcagcatccctgggttggaattgtgaaccgttcacaagcagatatcaacaagaatgttgacatgattattgctaggcgaaaagagcaggagttcttcgattctagtcctgaatattctcatcttgccagcaggatgggttcagaatatcttgctaaacttctttcacagcatctagaggccgcgatcagatcacgcattccgagcataacctctctgataaacaaaactattgatgagcttgaatctgagatggatcacctcggtagacctattgcttctgatgctggggctcagttgtacctcatcttggagctttgccgtgcatttgacaaaatatttaaagaacatcttgatggcggccgacctggcggtgatagaatttatggggtctttgataaccaactcccttctgctctgcggaagctcccatttgatcgtcatctctccgtgcaaaatgtgaagcgggttgtttcacaggcagatggttatcagcctcatttaattgctcctgagcaagggtaccgtcggctgattgaatcttctctcaattattttagaggaccagcggaagcctctgtagatgctgtgcattctgttttgaaagagctggtgaggatatccattggggagacacaggagttaaaacgatttccatctctacaaacggagctagctgctgcatgctataaggcccttgagagattccgcgaagatggcaggaaaactactctacggctggttgatatggagtctgcatatttgactgtggagttcttccgcaagctcccacaggaagttgataagactggaactggaaatcccagaaatgccaatcctcctgctccttcggacgatcgttacactgatgcacatttcaggaggattgcttctaacgtgtcctcatacattggcatggtatctgaaacgctgaagaatactatccccaagtctgttgtccactgtcaggtccgcgaagctaagcggtccctgcttaacgatttctatacccaagtgggcgggaaagatgctaagcaacttgcagtattccttgacgaggatcctgccctcatggaacgcaggctgcaatgctttaagaggcttgagctgtacaagtctgctcgggacgagattgatgccgtgtcgtggacaagatgaaggtaacgcgtgccatgcttgttaatatattcgctttcttcattagacacattgtagttctactagtgcagaattagcagctagccattgtgcacactgattgtcaagtatagcagagcgatcacctgtcttgtatcttagcctgttaatatcagtagttgtgtgcttgactgcttgtgttgtatctttgtctcaactcccaactgttatcaggtgcaaatttccgtccttggtaacccatgtgcaaacctgtatgcacgaacgatacctggattctgtaggatgcacatgccgatcttcgtcccatgctgtagttaggtgtagactgcagaactgggacttctaatgtgaaaaatattgttttatgcaaaaaaaaaaaaaaaa

SEQ ID NO: 14083 - DNA, 797 bp, Zea mays
gacgcctctgtcagtctatcttctcggctcgcacacctcagacacagccaggcagcggagcgctcccccttcccctcgattctttcgcttccttctagaaccttccgctccctccgctgcaacagtaacactgagcttcctcctcctcccaccccgaagatgacgaccatggagaacgtgatcgtgctcgtgaaccgcatccagcgtgcctgcaccgtcctcggcgaccacggcggcggggacgccgccgcctccctccctaccctctgggaagcgctcccgacggtcgccgtcgtcggcggtcagagttcggggaaatcatcggtgctcgagagcatcgtggggcgagacttcctgcctcgaggatcagggatcgtgacgcgtaggccactcgtcctgcagctgcacaagacagaggccggggtgcaggagtatgccgagttccttcacatgcctaagcgccgcttcactgatttctctattgtgcggaaggaaatccaggatgaaactgacaggttgactggaaagacaaagcagatatctccagttccaattcatctcagcatatactctccacatgtggtcaacttaacattgattgatctgccgggcctaaccaaagttgcagttgaggggcagcctgaaagcattggtcaagatatcgaaagcatggtgcgttcgtatgttgataagccgaattggattatattggctatatctccccgccatcaagatatagcgacatcagatgcaatcaagcttgcccgggaagtggatccaactggtgagaggacatt

SEQ ID NO: 14084 - DNA, 716 bp, Zea mays
cccgcccgcgtcggcccccaggacataatactgaagcaggctgcggctgcagtaacaagtcaaggaggttgaaggcgaactagagagaagaggaagatgttggcggcgacggatccgatgctgtggcacaaggtggccgccgtctccggggttgccgctttggggctcggcacctacggcgcgcacatgttccgccccaagaaccccgcgtacaaagaggtttggcacacggcgtccctgtaccatctcgtccacaccgcggcgctgctcggggcgcccatcaccaagcgccccaacgttttcggagggctcctcactgctggaattgtgctcttctctggaacgtgctacaccgtggcttatcttgaagacaggaagttttcttcaccggcaccattggggggctttgcgtttattgctgcttgggccagcctcctcttctgattaaattgtgcttttccaagaaaacaaaaaaaaatcataaacctctctatctggtgttttatcaggttgtgaaaaatatacttgtaaagtgtatacagtggacagtatgcgcctctgtttaataattcaatctgtgattcctatgtttctattcaaaaaaaaaaaaaaaaaaaaaaaaatgtttgcggccggacatgccagtgaaattgcgcctctggttaataattcaagctgtatgatgtttatgtaaaaaaaaaaaaaaaaaagcggcc

SEQ ID NO: 14085 - DNA, 637 bp, Zea mays
  misc_feature (429)..(429): n is a, c, g, or t
gtacggagagtcgagttgctatcttcacgctagtagtgtatcataatacggtcagcgccgactagcaagtgacaagtcaaggaggttgaaggcgaactagagagaagaggaagatgttggcggcgacggatccgatgctgtggcacaaggtggccgccgtctccggggttgccgctttggggctcggcacctacggcgcgcacatgttccgccccaagaaccccgtgtacaaagaggtttggcacacggcgtccctgtaccatcttgtccacaccgcggcgctgctcggggcgcccatcaccaagcgccccaacgttttcggagggctcctcactgctggaatcgtgctcttctctggaacgtgctacaccgtggcttatcttgaagacaggaagttttcttcaccggcaccattggggggctttgcgntttattgctgcttgggccagcctcctcttctgattaaattgtgcttttccaagaaaaaaaaaatcataaacctctctatctggtgttttatcaggttgtgaaaaatatacttgtaaagtgtatacagtggacagtatgcgcctctggttaataattcaatctgtgattcctgtgtttctacgaaaaaaaaaaaaaaaaaaggccccta

SEQ ID NO: 14086 - DNA, 1159 bp, Zea mays
gcacgagccagcatcagtttccccaccggccccccacgcgcccgggagccaaccagttcccgcagcagtttcagaaccagaacttcagtggcggcgcaggagccaaccagttcccgcagcagtttcagaaccagaacttgagtggcccagggaccaacccattccagcagcagtttccgaaccagaacttcagtggcttcccaaaccaaatgcccatgccctttcttcagaccatgcaccagaccggaatgcctgcaaatccaatgccgttcggtggcagaccaccagcgaaccctccatctggtccagcgtctattgcccctatggggcaaggcaactttggtcagcctccaaatccacaaggatttacgattccggcgccacccggtgaagatgggaaacaaggctcgcctccgcagttcagttccaggcagtttcatcaagggagctcgtcatcctttggccggggaaggacgcagcaccgcggtggccggcattcctatggcagaggtggcagaggcggccggcaccccagataggtatctggagctttgcccccggtgtagattcagtatgagtgttccagtcataatcgagacactaaagattatgtaataccagaagtatgtttcttgtaatgttgcttgctgaatggattggacaccccgtcgaatgacagcgtgctgtaatacacttcctgcgcccagtatgcgtatctctggctccatgtcaccatgatctagtggaaagaggataatttttcttctcatgcaaaggaaattggagtgcaaaaaaaaaaatctatttataatggtgtgacaggttattgtcgtgctatcgtagtgcgttttttttgtggtggtggcattgcacataattattctgttttttttaaatactggattatttctagagaaggaataataaaattcagtttcaaaaggtaatctaaaatatggagttgacgagctgcattcccgactggttaatctggttaaacggcgtatctgaaaacttagttttctattgtggatagcacagtaaaatagaaggtatctctaccagcttattcatccttatatttaaactctagtatatgatcagtgtaatctatagcaccaggccaccagcaggaggtgcatgacgctgcaggcatgca

SEQ ID NO: 14087 - DNA, 1207 bp, Zea mays
ttttttttttttatttctttttaacattataattatttagatctatttcaacacaggtgcccagctcagtagctgtttcatcattccatatcaatcaccagtcattaccagtttaccacatcaaggtcaagaaggcacatagaagtcaggaaaactatgatccactctcggcctgagcttaaacatctgagaaactgtcctctaagtttaaacatatgagaaaatatcatcttgtcttaaaacaacactacattactgccaagaaaacatgcaccgaaagatctgctcaccctcggagttacctctagtaagaacaaagagctaaactgaaattcacaccttggcccaagctacagcgagatgccagattcagcgatcagaaattgagctgttcagtcgaaatctggcaccaagatcgccttctctgccgcctcctcgccgtcttcatcgccttgcgcccgtctgggttcactgaccccttctcgcaccccctcgacacatccatcatccttccccagcttcttctccctgtccctaggctgttccccgaccaccacgactgtatcctcctcttctgcgcgcccaccgaccactaccgcgtcctcgtatccgcctccgcgtcctccgccgacgaccacgacttcgtcgacgctgccgacgcccgcaacgccgccgccgacaagggagacgggggcggccccgcagtcgagtccggcgtcatccacgcagcctcctccgcgtggtgccgagacgcagtcctcctcgtcggagtcttcggagaagggcagccgggcgaggcgggaggagacggccgcggcagcgagggagaatgcctcagcgatagactccggcgggagcgcgcagtcctcgagccccgcgtcttccagccgcggcggccggatgggcacgccgccgcctacagtgagctcttcctcgcccgccattggattcaccgcccgcttgcgtcgaatcttcgaggttagggacggacctaccgtaacagcgaggtggggcggccgccccaggtaaccgccggcgccggctctagtacccttacggcccgtcctcagatctgcaagactgcgaggccgtgacgaactgaatgagcgctgtccgagccgctgcccgctgccacggatgaggcgtgttgctgaacgaccgtcgtgtaaaggaggaccctgatgttacggtggagatggctataggc

SEQ ID NO: 14088 - DNA, 4626 bp, Zea mays
gcagctacttctttgttgccaccccgatggcaactttgagctttttttttccttccaagtgctatttttacatcagatacctgtgtgaggcaattttggtaccgcgggctaacacccttaaatggacggttcacaatatcgatcggctacacatgatagatccaatggttaggtttacttcgtgcaatccattttacaaaatgaataaagtagtcatgagaagaataaacacttcgataaataaagtattaccttgaacaaaataaaaagaaggtgtagtttcacatgatttagataaatgtgtgccgataacgtattaaggatcatttgctaccaaatgtagtcgaaggactcttgagacaaacgagtaaattacttgtggctgtatttcaccctttctagtcttggtttaatcttgatttacacggtgaagaagactcctctattttaagctaaaagtaggattacaggtatatgggccttctttggcccgttaggcccattaggtttctcaacagtagcgtccgtaggaggaggaggagtaaaatacatggtccaacggttagttaatgctacagtaccttgccgttgcaacagtttatggaggaaacactgaacaattgagaacgaccgctcggcattcaacaacgtcgcaggagtggaatggaggcaacctctgtagacttgccgagatctaccccggccccggccccggccccggccgtatttcattactgcctggcatttttgtgtgtgtgtgtgtgttggcggcaggaaattaaacgaatagaatcaggagagctgtcgacaaataacgaagaagatttagactggacaaacaacagcatcgaaagaagattttttttaaaaaaaaaagaacaaacaatgacgaactacgacaactctggcaaaccgaagtcgccggcggccggcgtcgacagggatgggatctcaacaggtgacacagcacgatgcatggcgattgccatgccaagtgagcaggctaggggcatgtttggttcagcttttttctgaccagcttttctgagaatctgtctgtgaggagaatctagctgtgaggagaatcttagtattattaggattacgtgctgaggaagataaaagtgtccataagactcaggatatagaaagtgacggattcatactattgcaacgactcaactgattatgtgtttatgttaattttgaatgacttttactcaaatgaattttatagaagctgactaaaaagctgagcgtttggcagttcgcagcagcttttggtgagccgaagctccaaaaagctgaaacaaacacgggctagttcctttccttggtagctgcatgcaggaatccaggaacaggaactgtgccactgcaaatttgcatgtgttgctgcgctccagtgacttgtccaccttttcatgggtgtaagaaggaagtgggtgcagtgcagtgcatgccacatgccagcttcataaagcgcagctgcttttcttgctacgtcggcctcggccatagtagcgttctctcttcttgaaatcaggtttctttgtgtagcaggcaccggttgttacgctgcttcaaccggtctgtgtctaacgatgcggttgttaggctgcttcaaaccggtctgtatcaactgcatctacagtcttgtcgtgctacgtccgctatcgatcattcgatgcatatctccttctcagtaaaattataggaacaaaaaggacgcattttcttttcttttttttttgtctctcaggagtacttcgacaagtgaagctcgtggatagcattgccttgcttcgtcgtagttgacagttgacacctatactcctacgtgccgactcgagtccccgtccaggcgtctatggaaagtgatcagtcatcgctcacatgcgatcgcggccgtcagcgtcatggcccccgtccctgccggcctcaactcggcgcaggtgcgacccctcacagtcacataaagacgtccgcgtccccgcccccgccgggtttttacctttcctcccgtctccgtctcctcgctggctcgctatgctggccgcctccaccgcgcctctccgtcactcccccaacgccatgagtctgtaacggcacacgtaccatgggcaggaccagaggcaacaggggcgtgggcggcgcgaagtcgttcccgtcgccggcgtcgtcctcggcctcgtcgtcggagttcgagttcacggtcacgctgtcgccggcgtccaagcagcggtcggcggagcagctgtgcccggccgacgagctcttctacaagggccagctcctgccgctgcagctatcgccgcgcatctccatggtgcgcacgctgctgctgtcctcggcgtccacgtcgtccgcctccgcgtccgactccaccaactcctcctcccgcgactccaacggcagcacgtcgtcgtccttctccgccgactgcggcgcgctcctgggcccggactcggcggcctcgtcgtctcgccccagctccgccaccgaggacgaccgccacctgcatccgccgtcggccgccgcggggctgctgccacccgccaagcgcaccgggaagcagtacctctcgtccttcgccacgcgcttctcctcggtcttccaccgcggcggcgccggcgctccggccgcgaagaagcagccgtccaagtcgctcgccaaggaggtgatcaagaagtacgctaagaaggtgaaaccgctctacgaaaggctctcccagatccccaacaagaaccagaacaacgtcgtcaacggcaacagccaaccgcagcagaggttcaagaagcccttcaccttctccatccgcaagaaaaagggcgacgccgtcgcggcagtggtggaggcggcagcagaggttggcggcaacaagtacgcgcactccagctccttctccggaaacctctggttcccgcgccagaagcgggccacggcgagctgcccgtcatcgatgcagtcgtcgcctagccactcgggtctgctcacctttggcggggctggcggcgtgggcttccccgacgtgccggccgttgccagcggcattggcgtcggtccggtgtcgttgtccacggcatcgtccatggaggagctccagagcgctatcgagggcgccattgcgcactgcaagaacacgatgggcggaaccgtgtcggtcaaggcggcggcggcggccgccgacgagatctgcacgttctgagcgcgaccacgctaggattccggggggagctaagtaaagcaggctgttttaatcggtagcagtacttatctgttattagcaaatttaatttcgtccgtctcctttttttttttttgggtaagactctatggtcatggtcgtaaataggggtagttcggagggggttaagatcatagtcggagcctttttcgatctctccttatccttccttggtttggaaatttgcattagcgccctctaaattgtagctctaattgcattagcacccacggctacaccactgaacaaaatgttggggcaaccttaacacagtactacataaaattcacaaaacagcctcaagcgttcatcttaatttgatgctagcttccaatgcattgcaaagctccgtagtagttcatgtaaaagctgggggatctgggactctgatgtggcagtaggtggtatcgattttatttttatttttatatttttgctgtgagtttaataatataataatactataagctaacgctagtagtatagtttggctttaaacctgtggtacttggcatgattgattgcttcaaaaagttcgccttgtctgctctccgcgccgctcaatgtattcgttttgtttgcttcaaaaaaaggaaggcttctttattcttgctcgctgtgaccgaggaaaggaaaagaaaggggtcgagcttttgtttattggattgatgacttgtgtgttttggtaaactgcatctcatatatataaaaaaaatacccacaaggagttaaaagtggttgcaacaactagtgggcttcgctagatctggcgggcggggcattgcattgcattgcattgttgcatatagatgttgtagtattcacatggttacatgccctctgataggtccgtgaaacaatattattagctactactaatcttagcttgtacccagagatcatcagagacgttgaccgactgactgttgaagcagacagaggcagaaggtcggttagggctggggggaatctctaggtagggggttcattcaacagccggccaggcgggacgtgccatgccatgccacccctcctctcatgattcgtacagccacgacaaggagatcgagaggcttgtgactagaatgtgatgtgatccacgcacagcacaggtcatgtgcaaactgcagagcatgcagggtgtagtgctgcagcccgatggatcggacatgacgagacgttgcccctgtagactattaagctagctggaccggtcagcacacagcgccgtgcccgtcgatagccatgtggctgtggccgctggacgtctgttaatgccgattaataaataataaagtagtgtggggggttaccttacctagtggcaaacaaggtccccgtccccggccatgcatgccgccgagcggcgcggtgaggat

SEQ ID NO: 14089 - DNA, 3758 bp, Zea mays
  misc_feature (2174)..(2174): n is a, c, g, or t
  misc_feature (3674)..(3674): n is a, c, g, or t
  misc_feature (3691)..(3691): n is a, c, g, or t
tgacacgatttttttcacaatcatggcagattaaatttaattagatagaatatagtaagtcttaggatggagcatattgtttctattgttttctatttaagtaaccaggttggacaaatcaatttggctatagggtactcgcttaaactagatttagtaattagaaacatgcatacaaatcattggtggagcatgttggtggtgtcaacaatatccacaacaaatgtttaaagcattgtgatgattttaattataatgatttcaagaattaaagacagagaataacaaggcagcacactagaacatcataagaagccataaaaattacctaagctctcaataaatcttagtctagctcagccagagtttgcaccagatgctcagctacatgatctagcacccgttataaatggcgtacgtgtagtatatcaaaagcgattttgtggttgaaagcgaccggaccgctctctcaagttccccacctaatcattgacctacctagttcttccacgagcctaattaacgcggagcaacgtgacagcgagactaagacccccactgaagtactggccgtcgaggggagccgggattagactgcactaattggtcccgttcgccgtcgtcggcgggatacagcatgctgcttgacgccgaccgccagctcctgcgcgttgcggttgcgccgtctcgcgattgaaaacacagggccgagtggccggccgttgcccatgtgccgcgcggcgccggcggcacctaccgggacgtacgtggtgcggtgcggtgcggtgcggtggtggacgggatcggtgcccgtggcccgtgccgccgcgcaccagctatttttagacgcgtgcgtctcggctgcgccgcaagccaccatgcatgtccgcgcagccggcagcgctgtgtgatttttgtctgtgcttggtggttgcgcgcgcctgcgagtgatactgtgtgctgatgtgcccgtcgttttgtgcctcctttttgagctacgaaccaggaatgaacgaagagaatcttgtatatgtgtgtgtttttcttttgggtagcaatacattttgaggaaaaacacagcaggaacgttgctgttttttttaccttccctttttttaacaagttcagtagctactgaccgaactttcaacgtcatcaaagaagggcatcttgatgaggaatatttgatggactggactcgtaggaggagggaggcgttagcttgcattggtggtatcttttgaagaacaaattggataatttcgtcggaggcatgacccaataatcatgacgagcacgttggtgcttcattcgacatgagatttggacccctcccaaaagatcttgcgtgactcgaaaggcatgtctgtacgtggacttgcttggctggacacggggagagcgccccctgaccctgatgatgatttgtatcgcaccgcgcaccacggaatctgttctaggctgtctaacttggcattagccagtgtggtttttagagccaatctgttcgtgcaccggccgggcaaaagatatcttccccaaaaaaacgcagctactcgtagtactccctacggacgtgtgcacggatttgcacgggacgtgcgggcacggtgcacgcatgcatgccgcgcgcggccgccgaaagaagcgctggtgttgtcatagcttgacgccaccgagcgggtacaccgtacacctgcatttaattgacacattatgttacggccctaggagttacttaaacaggagcaaaggactaatcccagttcccggatcaagctcgagccggaaatttccgtgccgagatgcggaaccccacacaagcacagctcgcgcgcgcgtccgaggattgtcaagcacacgtgcggtacaaccgttgacatcgcggccgcactacgctcgcgtgcgcgtggcagtagacacggcacgataccaacgtggaaaccagcgagcgggcagcgacgctgtacgtgctctgtacgcctgctgctcgcagtcgcagcctcgcactcaggccacacgggctcagcataaaagaagggaagggccgaaggggtcagcaagggagaaaaaaaaaaggagactgggccaggcgtctcggtcacgacttcaagaccgacatgcggaccccccgatgctgtcccccacacggctcattcccgccccgcacgtgnggcggcagccttatcggtagaccccaagtcgggatcgtctgtgaccctaacgacgtgttgtgcctgttcctactgtgtttctgtgaacaaactgagcacggctgctgctgtctcccgtgccctgtgcgtggatctctggttccacgctcgcgcgtttcggttcgttctccgccggcttctcacttgccacacgtactactactactaggacgaaagggaaggaggaaaaggaaccaaccaaggttaaactgcaggagtaggacggtttatgttgttgctcttcaaccacagaagatccccgcgcaactgctggccacctttgccaatggcactcccgtagatagcttgtaagttgacgcccgctttccccgctccgaaactacacgccgttcagccccttatcacaggctccgacgctccgtgccgttgccccgctctttttcaacagcgacgctggtaacgcactaacgcccgtcccctcacccacccgcgcagaccgcagagagaagagagcgaggcagcctaggaggagcaaccgcgtgagtcgatgaaggcagcggtggccgcggtcgtcgtcggcggcggaggaggcgacgaatggaggtgccggaagcaccctgccgcgagatccggcggcggggtgtgcccccactgcctccgggaccgcctcctccggctctgccccaactgcgcgcacgtgcggccctgcgcctgcgccgcggcgtgcgcctcgccgtcctcctcctcctcggcctccggcgacgcggtcggccgcgtccacagcctcatcgagcgggagcaccggatcgcgcgctccaggtccgtggccacgggctcctccgccgcgctcgccgccccctcggcggcgaccgcgtccgggggcggcaggcggaaggcgcgggtctgggggtggccgccgttctggaagcccgcggcgcgggaggggggcgcggagccaggggaggaggaggacgacgacgaggggatggggctgccgcgctcgagctccgtgtccgccacagcggtggaggccaagagcgcggccgcggcggcgcgggcgcggtgggggtggcacttcccgagcccgctgaaggcgttccggcaccgcaggttgtcggcgagcgtggcggggcgggcgtgagcgaggtgcctcacctccagatgcccggaaagtggttagtgtgggggtcatgtggccgggatcattacctattaatcactagttaactatatcaaggcggtggattagaggaggagcgttcgtgctcctttttctgcttttgcgatcgcgtcgcgtgccgctaattccatgattaagttagacgaaacctggaaagcctgtgatctgggcgtaatgtgtgcatattcgctgctagtgggtgggtgaacccctcatggtctcttggcttttgtagcgtgcttgtactccactctgtagcaacaaattggatgttttgagctctccaatttgatcttatcttgtgttgctgtacaaaaaanaaaaaaaaaaaaaaaanaaaaaaaaaaaaaaaaaaaaaaaaaaaaaaaagggcggcaccgctcgccaatcttaaaacatagtcc

SEQ ID NO: 14090 - DNA, 1708 bp, Zea mays
aattcggcacgaggcccccttctcaccagggcatcacacaacacctcccggacctcccctcccggtcgacggtccgctccctcccaaaaacccacagcccgccccgccgcgcccgccccaaacccacagcccgccccggcgctccctcacaaaaacctaccacctgccactttcactccaccacacacccacacccccgcgccatggcctctcctcccccgacctccctctcctccccccacctcatccatctccgcctccaacccctacccagcgtcccgccgctccacctcactaccctccccttcctgcgctccctcccgctccacctccactcgctccgcctcaaccgaccccacctccctcccctaccgctcgcctcttccggcagcggaagcgacatcatcggaagcggcggcgaggacgaccttcctccctcgggcgggggcggcggagggggaggaggcgagggcgatggtgagggcgagggcgacggcagcgagggcgactcggtcaacaggagggaggccctgtttgttctggcgcaactcggacggaagctcgagagcctgccggccgacctcgccgcggccgtggagggcggccgcatcccgggcgagatcgtgcggcggttcgtggacctcgaggcctcgccggtgttcaggtggcttctgcagttcggtggcttcaaggagcgcctcctcgccgacgacctcttcctcaccaaggtcgccatagagtgcggcgttggcatcttcactaagactgctgcagagtatgagaaaaggagggagaactttgtcaaagagcttgactttgtgattgcagatgtggtcatggcaatagttgcagattttatgcttgtatggcttcctgctccaaccgtgtctttacagccaccactagcgatgaattctggagccattgctaagttcttctacaactgcccagataatgccttccaggttgctttgtctgggacatcatactcacttttgcagagagtaggagcaattttgaggaatggtgcaaagctttttgctgtcggaactagtgcctctctgattggcactggtgtgaccaatgcactgataaaagcaaggcaggctgccagcaaggattttgccggtgaagttgagaatattccaattttatcaactagcgttgcatatggtgtgtacatggcagtttccagtaacctcaggtaccaggttttagctggagtgattgaacagcggatgctcgagccactactgcaccagcacaaactagtattgagtgcagcatgttttgcagttcggacagggaatacgtttttgggttctctactgtggatcgactatgccaggtggataggcgtacagtaggctcaagcatgggtacacaaatgcagttgctcggagttccagcaatatgggttcttcgtgattttatattaccacgcttcctccaactggcaagtactcgtttgcttcatgggagactcttaggacagattttgatatcattctttaaacaatgccttgaggaaagcgtgatttatcgaaattattcccgcaagcaagagagtgaatttgttttgagggcttaaggttgtgttgtgcgtgttggattggattgattaaaattcgtagtttcgtacagttttgtcaaaaaaaaaaaaaaagcggacgcgtgggcggacgcgggggcggacgcggggatacaa

SEQ ID NO: 14091 - DNA, 6508 bp, Zea mays
  misc_feature (119)..(119): n is a, c, g, or t
tttcggtgcaagggctctatggaagacgtatggacaactgtgatgtgcgtttggtggcatagaatatgaacagacggttcgtggaagttgaagcattgttgggcattttttataatggnttatggaagcttaagtaccacaaagagtttcattacaaccgacagaatttaaagcgctagttcaacaaattgaacgagtcctagatagtgagttgagtctatagactcgagggccatgccggggacacggtcgaagacggatcaacatagacttgagagccatgtcagggacccggtcgaagacagatcaacatagacacagtaaattcaagacatttttagaatattcaagaagagagtcttatttgtctgaatcaatgactcgaccaaataagatttacggtctacttttaatataatatgtactataaaacacatgggatcggcgatcatgaccagaaggaggtgtaccgcgaggcggacttcagaagcacaaatacatcgatgatcttatcaaaacaaaagatatagcaaagattataacagataaggaagagtacacttgtgaagatagagttcaacttatacacgactcgggactgactcgatcatgactccaactagataatccgactcgatgtctattctaaaaaccatcgctccttcttagaatacaaaaggaaggtggagagagccctatgagggtagatccaatcagatcattagatcataatacaacaattaccacaaacacgacgtaggatattatctcgcgtcgagaacttgaacctatatatatcattgtgtctcacatgtctttacttttagttttcgaccacatgacatatctcatataaatacaaccgaacaatctttaaccattgtcatgtttaaggactagaaagaattatccatctcctataatccgtcatctcagtcttatcaatgatctcattagaaagaattgttcatctcctctaattcgtcgtctcgacccaatcaatctcctctaattcgtcatctcgacccaatcaatgttctcatcatctcaaatccaatgacaaagatcattgacgcaaaagatatgtcgatgcaaagggtcttgtatgaagctaaagtaatagtctattctttagcaggtgaggcaaactcttactgcctctttggaatggctccggggagctccggctcccggctgaccaacgtccgacagctcatatgcgtagacgagaaacactgcagcggctccggctccgttaatcccgtaaaatgtattctcacagtgaatgactccctcccaagagccacaagaaagtggctccatggccagagctggagcccgagcattttggagcccccaaacacgctcttattcaaattctccatcgcaatattctcgtgcataaccatctaattagaaaactatgcctaggtctaaatttcctacgatgcctcgatggctattcaaggctccaatagaaatagcaaaacaagcattggtgtttcagttcttcctcagcctactaggaccctctctcatgcttcctttttcaggtgactattccaaaagctttggatctctcgagtcagaacctcaagacccaaattttggtgctaagctggtggcagctcttcaagaggtgaccctatttagcgacgattaaatattttaagggctagtttggcaacattattttttcataggattttcaatttccaaggaaaaatgaactaatttgctttaggaaaacgaaaaacacttgggaaaatagagtttccaaactagctcgaagtgtgatgttctcatctccaattctcaactatgtcctgcgattaaaaaaatgcatgtaagtttgttttttttcaacaaaacaacggatcgcttataaaatgtctctaaaatcgccatctgttctgacacgatggatcatctgcagtgcagcagtagcgctgaccttgttgatgccgttttcatctttgtttcggaacgttagattgctcgatggggcacctgcagcacggctgcctgctctggcccattctgggcttctggcacgcccctccgtacacgtaacacgcgcgcgcgccaccctgcggagtacggcctgtgcacgcgctgacgcgcgcgcgccacccatccttgtgaccgtgtccgtcgggcgagcctgcggtctgcgcgcttcaagtagcaccctaccggtgcgcgcgcacctcaaaacgtagtcaagtgagcggtctcattctgctctgctgctgcaactgcaagcgcggaatctgttcgatgatggcgcggggcgccgtgctgctcctgctcgcggccgccttcgccgcggcgctcctgccggacgccgcggaatcccgcatcctcctcacgctccacgacttcggcgccgtcggcgacggcgtcgcggacgacaccaaggtacccccgcagcgcccgtacgcacgcttcagcgcggccccaatgcgactgagactgaccgccaacgcctcctcgtctctctccccaaggccttggccggcgcgtggacggccgcgtgcgccgccgcggacgacgtcatcctcaacgtgcccgccggcgggacattccggatctggccgctcacgctcgccggaccctgcaggagcgagatcaagctgctcgtaagcacgctcagcaaccgtataatccgttaccgtctctctgctcacgcgcactggctctgttccgttcttgcctcacccaccctcccgtcgccgggcgcgttcttgcctcgcggtctctcagatttccggggacatcgtcgcgccggaaagcccccaggactgggggcaaggccagagcgaccagtggctccacttccacaaggttcgggacctcacggtcaccggcgggggcatcatcgacggcagagggcagcagtggtgggcgcagtcgcttgcgcgcgcgcagcccgctcccaaggtgagcttacgcgcgcgctgttcgattggaggttggctccaatggaactggagccggccaccgaggttagggacggagttccgagcagcaagccaggaactcaccgcgtgttgtcttctgctgctgctgcgtctttctttcatccgcaggctgttcacttcgaggactgccaggggatcagcgtgaagggcatcaccttgcagaacagccagtcgtaccacctgacgttcacccggagctcccacgtcgccgccaattacctcagggtgacctcgccggagcacagcgtcgacaccaagggcattcacctcgttgactcgtacaatgttcacgtcatggataacctcatctccacaggtatctgtaatcttccgaccctccattcccctgcttcatacaggttcagcagacgagtttggttttcagaaaacaatctcgcaacaatgtatgcatgtgccagggaaaaaaaagtacgcttcactgaagttggctagagattcagtagaacgaacactggaaacacttactcattgcacaaactttgggtactgttaaatcgttgagcatgtcatgtgatttgccccggtttcccttcgtttcgtgcaggtgatgactgcgtctccatagtgggcaactgcacggatgtccgtctaagagccatctcatgcggacctggccatggtatcaggtaccttgctagctgactgtcgtggtgttgcctcttcagatttgtatctccccacaatttcctggtttgctagcacagctaagctaatagtactcggctgcgattagcatcggaaccttaggagtaaacagctccgtcgattacgtggagaagatcaaagtcgacaccttgttcatctcaaacgccgagaacggcgtgcgcgtgaggaccaccgaggtaacagcagccgacagtttcgcaatttctccacctgaatcagagtagcctgctcatatgcgcgaggaagctcaggtgaaaacaccgtaaaagtaaaacctttgtggtctgtgtcttctccagaacggcggcggcggcggcttcgctcgcaaggtgaagttcgagagcatcgtcatgaggaacgtcaccaaccccatcatcgtcgaccaggggatctcctctgacgatccgccaccttcatcgcctgaagcagtagcactggtacaccacacactgatcagacttccatcactgtctgcctttacgccgcgggacgccgcagcatacattagtgtccggcaagcagtgtctctgaactcacgcgccggaaaattctgcgccgcccaggccgcgaccgcgtcggcggcagtgcaggtggagaagatcaactacatcgacatcacgggcacgtcggcgtcggagcgcgcggtcacgttctcgtgcagcgacgcccggccgtgcaggcgcctgtcgctcgtcaacgtgaacctgacccaggtggacgggagcgaggcgtcgtcctactgccgccaggcgttcgggaggagcgtcggcaccgttgtcccggagtcctgcctctccaaggaggacttcgtccaccacgtcccgccgcagcgttctgaggaagacggagaagactcagaatcgtgaatctgtggcggttcctgcttggctctggccagattagttttgtcaagggatctctgatactggttgcttcggatttttgttggaactataggtgttgttggggcttttcccctaggcctagtcctctagctagtgcagtgcagatctgtctgtgtgaactgaagaaccatgttgctgcccaactttggtttccagtattcctaaacatttccagcctttctgtgacaaaaaaaaaaaaaaaacatttctatgtatgattcagattcttttgatatatagggcatatatacacgttcagagcatatcggactagctcagtaggattaggattggatggtcgatcatggcatgaatacacgtctttctgttgtccagtttggcaacgcaagcagaaatcagctatgtttaggcctttaggggccggggagcgagaggctaaaaccaagctaagagaccatggcggccggggaaccacgagacgcaaggaaaagccatggccaaagctgtggccgccatcgttcgtctcccctatataaaccgaacgacgtttggaagcggaagcggaaccatcagcctgtacattctctctctcctctctcggccttcttcgcgtgtttccctctttttcttaggccgccctctacacttctcgacataaccatcgagagggcggtcgagagaaacgagagcggcagacaccatggggagctcgaggaccatcgttgcgtcccccctgctcctcctcgccctcctcctcctggctttcgcggccaccgccgaggcccgcgttgtccccgagctgtttggcgaggaccaattccagcggacatgcaaccaggtaggcgcggggcgccgcgcgcgtcgatcaccttttaggcttttactgtgctgggctgtgcaacgcatgagattttcggataggtcgatcgatcggtcggggcacgggatttgctaatgctccggcggttcttttgtgccgcatcactcgcaggtgcacttcaggaagatgtgccagagcttgacgaggctcccgagggtgacaacgccgcgcgagctgctgctagcgtcgatgcgcgtcgcggcggagaaggccagggaggccaagagccgggtggacgagttcgcggcgaggaaccacgagggccggccgatggagtccatcctcggagcctgcagcaacgggtacgacaacgttgtgcagacgctcgaggaggcgcggaagatcgtcgccacgcggccggcggcgggcacccaggcccaggccgacgacatgaacacgaagctgtcggccgccgtcacgagcgccagcgactgcgacaacgccttcgccgacttcccggcgattaggtccccattcttgcccatgcagcggaacgtctaccgcctcgtcgacaacgtcctcaacatcttcgtcgtcgtcaaccagccggagcacgcgcacaagcacgggcactagccgcgtgcgcgctggccggcctgccagttgtaagagccgggatggtgttgtatcgatctcctttctgcacttgaatatatatgtgaacaaggcttgagaaaaatctgtattgctagttgtagtgtaacttgatcaggttactgctaacacggaatttcaggtttagcttcttgttcttggtttcaaaaaaaaaatgtgtctcgccaaaagtacgacttcactttttggcagccggatgttagctgttgaaaattaactcatttttaattgctggtaacatacacctaaggggctgtttgggaacaaagtttttctgctgttattatatattttgaggtggttgataactcatcttaaatctatgtatactactccgtactcgatactcatctgaaactatagtattgttaatactgcacttgttttgcagttttggaaccaaagtttctcccaaacatcatgatgtattggatactttgtaatcgaaaactgaagtattgtaagcaatagtaata

SEQ ID NO: 14092 - DNA, 1655 bp, Zea mays
ctgctctgctgcaactgcaagcgcggaatctgttcgatgatggcgcgggtcgccgtgctgctcctgctcgcggccgccttcgccgcggctctcgtgccggacgccgccgagtcccgcatcctcctcacgctctacgacttcggcgccgtcggcgacggcgtcgcggacgacaccaaggccttggccggcgcgtggacggccgcgtgcaccgccgcggacaacgtcatcctcaacgtgcccgccggcgggacattccggatctggccgctcacgctcgccggaccctgcaggagcgagatcaagctgctcatttccggggacatcctcgcgccggagagcccccaggactgggggcaaggccagagcgaccagtggctccacttccacaaggttcgggacctcacggtcaccggcgggggcatcatcgacggcagagggcagcagtggtgggcgcagtcgcttgcgcgcacgcagcccgctcccaaggctgttcacttcgaggactgccaggggatcagcgtgaagggcatcaccttgcagaacagccagtcgtaccacctgacgttcacccggagctccgacgtcgaggcgaattacctcagggtgacctcgccggagcacagcgtcgacaccaagggcattcacctcgttgactcgtacaatgttcacgtcatggataacctcatctccacaggtgatgactgcgtctccatagtgggcaactgcacggatgtccgtctaagagccatctcatgcggacctggccatggtatcagcattggaaccttaggagtaaacagctccgtcgattacgtggagaagatcaaagtcgacaccttgttcatctcaaacgccgagaacggcgtgcgcgtgaggacgaccgaggacggcggcggcggcggcggcttcgctcgcaaggtgaagttcgagagcatcgtcatgaggaacgtcaccaaccccatcatcgtcgaccaggggatctcctccgacgatccgccaccttcatcgcctgaagcagtagcactggccgcgaccgcgacggcggcagtgcaggtggagaagatcaactacatcgacatcacgggcacgtcggcgtcggagcgcgcggtcacgttctcgtgcagcgacgcccggccgtgcaggcgcctgtcgctcgtcaacgtgaacctgacccaggtggacgggagcgaggcgtcgtcctactgccgccaggcgttcgggaggagcgtcggcaccgttgtcccggagtcctgcctctccaaggaggacttcgtccaccacgtcccgccgcagcgttctgaggaagacggagaagactcagaatcgtgaatctgtggcggttcctgcttggctctggccagattagttttgtcaagggatctctgatactggttgcttcggatttttgttggaactataggtgttgttggggcttttcccctaggcctagtcctctagctagtgcagtgcagatctgtctgtgtgaactgaagaaccatgttgctgcccaactttggtttccagtattcctaaacatttccagcctttctgtgactaaaaaaacaaaaaaacatttctatgtaaaaaaaaggacggccggtcgagccgctctcaaaggataccgtaggtgaggcaacgcgtgcaagaggtgtcat

SEQ ID NO: 14093 - DNA, 1176 bp, Zea mays
tggtgaccatgtgttggtggtgttgttggcgccggcgcgtgagaccgtgttgacctcctcgaactttttccttgacgacgtgctgctggacgccgcctccgtggcggcggaagccggccggggccaccgacctcacctcctccgagcagtagtccacctcctggtagtaagccattggtgccgacgcttggtgtgtctgtgtgcagcgcccgtgcgacgtcgaagtgcttgtgtggattgctgtgtgatggtggatcccggccggccgagagaagacacacacgtctgcctgcgccccccagcctgtacattctctctctcctctctcggccttcttcgcgtgtttccctctttttcttaggccgccctctacacttctcgacataaccatcgagagggcggtcgagagaaacgagagcggcagacaccatggggagctcgaggaccatcgttgcgtcccccctgctcctcctcgccctcctcctcctggctttcgcggccaccgccgaggcccgcgttgtccccgagctgtttggcgaggaccaattccagcggacatgcaaccaggtgcacttcaggaagatgtgccagagcttgacgaggctcccgagggtgacaacgccgcgcgaactgctgctagcgtcgatgcgcgtcgcggcggagaaggccagggaggccaagagccgggtggacgagttcgcggcgaggaaccacgagggccggccgatggagtccatcctcggagcctgcagcaacgggtacgacaacgttgtgcagacgctcgaggaggcgcggaagatcgtcgccacgcggccggcggcgggcacccaggcccaggccgacgacatgaacacgaagctgtcggccgccgtcacgagcgccagcgactgcgacaacgccttcgccgacttcccggcgattaggtcccccttcttgcccatgcagcggaacgtctaccgcctcgtcgacaacgtcctcaacatcttcgtcgtcgtcaaccagccggagcacgcgcacaagcacgggcactagccgcgtgcgcgctggccggcctgccagttgtaagagccgggatggtgttgtatcgatctcctttctgcacttgaatatatatgtgaacaaggcttgagaaaaatctgtattgctagttgtagtgtaacttgatcaggttactgc

SEQ ID NO: 14094 - DNA, 2652 bp, Zea mays
gcacgagaccattacctagaacatcctaatcgaaaaacagtgcagtgcattcaatctcaaataaaaagccctgctacagtgctagcagtactcggatccacgaccttctccctccctccgctgctgctccgtcaaggaagggaggaaagaaagggcaggggaatggaggtggaggaagacggccgagccgcccgagtgctgctgagctcccagtgtctctgtctctgatgagatgactggacttatttgatgctcttgccgttctcgacttggggcgcgagccgatggatctcctccggatgaaacttctcctgccctccttcatcagctgccttcttctgatgcaggcagcactatgtgatggcgccgccgccaccaccaccaccaccggcgaaaacggaacggcaaactggacatgtgtgtgcgcagctcatcctctcggtgaaccagactccaacagcagcttgctgtccaattgctcttcctcctgccattgccaccgagatgagaacggcggcggcggcggcggcggcgcaggctcgtggaactgcacgtgtgcctctggtgatgagggccttcagaaggaagagcatgctgagctacgtgacgggagctgtttcacttcctgcaactgcacgtcgggtactggaacttcagaggaagggagaaagcgtgtctcaagcaaaacagtcatagctacgctcctggtctgcgtggttctcaccaccaccgctttcctcgtcaccaccgtatactacttccgccgcaaggacgccctctctccgcgatcgcagatatactccttcgatagatacactactagctggagcagcaggtcgaacctcgtcagcagtcgatcgtctccgcttccccagatgaaacccaaaccaaagcttggtggtctgaaagagtttctgtgcagctgcaatcttgtcatctgtgggggagagagcggcgcattccccggtgtcgtcgcccggttctcgtacgcagagctggagcaagcgaccgggagattctcggacgaccaccttatcggagtcggtgggtcaagcaaggtgtaccgcggccagctcggcgatggcagagtcgttgccgtgaagaagcttaggccgctaggaggcacggacgaagacttggagttcctgtcagagatcgagctgctgtcgaggctgaaccactgccacgtggtgccgttgctggggtactgctcggagagccagggccggcagctggagcggctgctggtgttcgagtgcatggccaacggcaacctgagggactgcctagacctgaagcgagggaggaagcccatggactggcagacgcgggtgagcgtcgcgctcggcgccgcgagggggctggagtacctgcacgaggcggcggcgccgcgcatcctccaccgcgacatcaagtccaccaacatcctcctggacgacaagttcagagccaagatcactgacctcggcatggccaagtgcctgatgaacgacggcgtgaccagctgctcgagctccccggcgcggatgctgggcacgttcggctacttcgcaccggagtacgccatcgtgggcaaggcgtcgctcaagtccgacgtcttcagcttcggcgtcgttgtgctggagctcatcaccggccggcagcccatccacaagtcgtcgtcgacgagggccgacgagagcctcgtactctgggcgacgtcgcggctgcgggacagcgggctggtggtcacggagctgccggacccgacgctgcagggcaagttcccggcggaggagatgcagatcatggcgcacctggcgcgggagtgcctgcagtgggaccccgaggccaggcccaccatgacggaggtcgtgcacatcctcgccaccatcgcaccactccagcacggcgccaagcgtcggaaccttcccatcgccaccgccttcaacctcacgccatcgccgcacgtcgggcggtgtgacccggagcctaaagacgacgacatcgagaggcagatgcagcagcaggagtgctcgccgacgacggctgtccagtggcaacaacaacaagcgcgctgcacccacgcgccaacgggccgcgcgtcgtggcccggcgacagggggaacgttgtgagcagaggcgcggcggtgtcgggcgagctggtgaacgggacggtgctgatgaacccccacgggcggggcagctggcggcggccgccgccgcttggcgacgaggaggcagtggacgtggatctgacggagccccggatggaggcgttcacgcagccggcggcgtttcagcctttcaggtgacggaaggattaggatcaggtggtggtggttctgattggtgcggcggcggcgggtgctgctgtacatcttcttgttcgtgcctccacgatccacaccaggatcatctgcttctgcatctgcgttcatgaatgtacagtacaggcaaatacatctagattggcaacgggaaaagaaaagaaaggcatcgagatcgttatgggatataggacctagattgaacacgagatcaatgcatgaatctgaatccacggcgcgcgtcattggacacatcactgttgtacacaagcaaacagacaatgagtgttcacagaagcaaaaaatataagaccgagttcaatgcaaaaaaaaaaaaaaaaaa

SEQ ID NO: 14095 - DNA, 4793 bp, Zea mays
  misc_feature (303)..(303): n is a, c, g, or t
attatatttatttagatgtacaacaaaaagattttctttcttgtatgccgaaaatgatttatggagtaattaaaatatttacattacatcatctacagtactatattttcatggtacggaaacgaaaatgtaatccaactaggtgatgtaaatttagttagttttggtcagatttagatatcattcatatttttaacacctccgtacataaaacgtcaaaaatcttcactgcgtacatgaatcaacagatatagcggtggtgtacatacatgcatcaacaaatataaaacaacttcatgcaanaacttcatggcgccgcgggattcagcgtaggcggcccgcccgaacgaaacgcaccatgttgtacgccttgaggaaacttgtatcatttatatgtagtggaccgtgccttttatcagatattgttgaagatagacttagtgacaccaatgaatccatatcacgagcagctatcttcagtacgaggggagtctactttaattttaatttttttagaagaatctatcacactgatttgtcattaggccctcgtatattatacagttgctgcattatattatcaaatataattgatgtgctgttgtaacgcatatacattatgttattatatatatagagtagaactattcgtcaatataaatgataatcacctattccgaaaatgatttaacaaatgacttataaagatcgtgaataatttaaatttattaagtcattctaagatatagatatagagagatacacttgcgcactgaaataattgttgctttaaatttctatgacagcacgcagaaggtttacagggctaatgagggcatgtttgctttgaatgattaaagattagtttttttagtctcatttagtctctaaattatcaaatagtaggactaaaacagagactaaactgtttaacttcctagtcccttaaaggtatgtacaacccacacaaatgtcccgtaacataaaggggtatcaaggggtaagtgcaaaaaatatatggcggtatcttggtgatggaatatctctagcactgttctctaagtttagatacggttttagccatacaacccacataattaaataagttgtatgttgagaggttctagtgtataagatacaagacataaatatattatgttatatgaaggggtttattatgtgtatctaatgcttgaagaatcgcaacgtagtatctaagttgtacatgccctataaaatgactaaaagggacaaaactatatgcattccacattttgttccttatttatttcaattgcactaatggtgagagaatgataagagatatttttattttcttaggagtcatttaatacgttcggaatacttttagtctctttaattatataagatagggactaaactttagtttagactaaaatttagcctcttgactaacagatcctttttgtttactcgtggccggacttgcctagcccaggcagcatttcccggcgttcgatttcgaacatcaggttctgttgcctgacagcaactgcctgggagggtacgaaccaaaacgagtcctaaatccaaattctccgagaacacagaaggtttcccctatcagagtatgcgggaccagtaaatccgcacacacgttttttaaatgacgaggagctagctagcaaatgacccgagcagtcagtttcacgccggcaacatcctgccagctgcctggcggtccgaaacggttctcttatatcatttatttatatctctttttttttctttatccactattcccctaaatcacaactctcacaacgattctctctaaaatggtatattgtatttccaaaaaaaaataaatttgtttttctacatatgtatttattatagtctaaaatggtgtgtgtatatatatatatatatatatatatatatatatatatatatatatatatatatatatatatattaattttgtgtttatttcataatttagagtataaaaatatttaggaagagaatattgaatacctagatataggatgtccgctacagatcatgtaaagtagaggctttataatgtagatattaatgtttataaaatgaggtttaaaatataggataagataggaataggataaaatacctgctgaaaacaacgagggcgagagaaagttgctgccgtttaggggtgggagaaagggtaccgctaagggcctaccttaaacacgcgtaggggcgtgggctcagcctagagatgtacagaaagcactgttgatgggtgttgcactgttgctgaagctggctggcctcctcgtcccgctgctgctatatataatctgtggcacggtgggcatggcaccagcatctcatatcctactgccggcgttccagagttcgagctgagcagttgcacacagctgctcgtgaagctagctagcgaagccacaggcccacagtgactttgctcccccacaccgtagcggccgtataaaccagctccaaccgatccatcgaaatcgaagcacagtacgtgagcccgtactagagacatatggcctccgcgatcaaggctgcatcgacctcctcccagtggtcttcttccccggcggcagtccactcgtcgccgttatcgaagcggctaccagctgcagtggccatgccggggcggcggaggtctgtggccactgtaagggcggtcgccgcggtagctccggctgccccggcggcgccggccaagctcaccgccggtgccggcggccgatgcctgccggtgtcgcagaccatgtccaggctcagggcgcagggcaaggtatgcacatgcgtggttctgtccggccgatgcctgccggtttcgcagaccatgtcgtctgcatctgcactctccagtactattatgtaggcacagccatgtacgggtcctgacttggaactccgttgtgacgtcgtggttctcgcagacggcgttcatcccgtacatcaccgccggcgacccggacctggcgacgacggcggaggcgctgcggctcctggacgcctgcggcgccgacgtcatcgagctcggcgttcccttctcggacccctacgccgacgggccggtcatccaggcgtcggcggcgcgggcactggcgagcggcgcgacgccggacggcgtgctggcgatgctgaaggaggtgacgccggagctgtcctgccccgtggtgctcttctcctacttcaaccccatcgtgcggtggggcctggccgacttcgccgccgccgtcaaggaagccggcgtgcacggcctcatagttcccgacctcccgtatgggaactcgtgcgctctcactctcaggaccgaagccatcaagaacaacctcgagctggtatgtatcaaggagaagcacgtgcgtctcctactagttcttctgcgcaatataaaattgagaaagcagcgtctgtctcacgacatgaacaatgcctgaacacatgcaggtgctgctcacaacaccatctacgccagcggacaggatggaggagataacacgagcttcacgaggattcgtctatctcgtaagtgacacaaaactttccgtccaggagtttttgctagcgactgaacttgccgatgacatgcatgcatgctcatgtatcctacttgaccatcacaggcgagcgtcaatggagttacaggtccacgcgcaaacgtgaacacacgtgtccagtctctcattcaggaggttaaacaggtaataatacgtcatgtcaatggaaaaggagaagagagagagagagagaagatgccatttttattcgtttttgttgttaccaatcacaatcactgagctggctggcttgtgttttttttgtttgctgcaggtcactgacatacccgtggctgtcgggtttggcatatcgaaacctgagcatgtaaagcaggtaggcaaaacttttttaaaaaaaatgcctcaaaaacttattcacatatttttttatagtaacaaattctaacagtatatatattgcacagatttttttatagtaacaaattctaacagtatatatattgcacctggacagattgcagagtggggtgcagatggtgtgatcattggtagcgcaatggtgagacagttaggcgaagcagcctctcccaaggaaggattgaagaggctagagaaatacgccaggagcatgaagaacgcgctaccatgccagtgaactagtcgtattgacgcgatataggctgtgttagcaagcacgttggagaacaatgttgcagaagtagcacaattaataatgatccattcggcaaggttgcttttttacaaattgcaacaataagttatcaatataaaatcaacgattcctttgtttaaaaaaaaggaagaaatgttacatcattgcatggtgctgcgattcagtggtcactccattcattctaaattacagttcagttcgagtttgtcctggctcagcccttttaaagattgtcggtttggaataataacaataataataatacaaagtggctcattacattcttcaaaaaatcttgatatgcatttatttgaacttgcagtgatgttatcataactttctaagcaattctcaaatgcagagaacgtttgtgaatcccagtataaaagaactaaaactgagctacaatttcaaaacggaaggtaatatcaatgtgtgtacaccactatagaaacgacgacccctcggttccaattaaatttaggctccagactaatgtgaccattagttttgattctaggtttttgggcatcatcggaggacatttatgtcggtgttttggg

SEQ ID NO: 14096 - DNA, 1397 bp, Zea mays
cggccgcgtgggcggacgcgtgggctactgccggcgttccagagttcgagctgagcagttgcacacagctgctcgtgaagctagctagcgaagccacaggcccccagtgactttgctcccccacaccgtagcggccgtataaaccagctccaaccgatccatcgaaatcgaaccacagtacgtgagcccgtactagagacatatggcctccgcgatcaaggctgcatcgacctcctcccggtggtcttcgtccccggcggcagtccactgtaagggcggtcgccgcggtagctccggctgccccggcggcgccggccaagctcaccgccggtgccggcggccgatgcctgccggtgtcgcagaccatgtccaggctcagggcgcagggcaagacggcgttcatcccgtacatcaccgccggcgacccggacctggcgacgacggcggaggcgctgcggctcctggacgcctgcggcgccgacgtcatcgagctcggcgttcccttctcggacccctacgccgacgggccggtcatcccggcgtcggcggcgcgggcgctggcgagcggcacgacgccggacggcgtgctggcgatgctgaaggaggtgacgccggagctgtcctgccccgtggtgctcttctcctacttcaaccccatcgtgcggtggggcctggccgacttcgccgccgccgtcaaggaagccggcgtgcacggcctcatagttcccgacctcccgtatgggaactcgtgcgctctcactctcaggaccgaagccatcaagaacagcctcgagctggtgctgctcacaacaccatctacgccagcggacaggatgggggagataacacgagcttcacgaggattcgtctatctcgcgaccgtcaatggagttacaggtccacgcgcaaacgtgaacacacgtgtccagtctctcattcaggaggttaaacaggtcactgacatacccgtggctgtcgggtttggcatatcgaaacctgagcatgtaaagcagattgcagagtggggtgcagatggtgtgatcattggtagcgcaatggtgagacagttaggcgaagcagcctctcccaaggaaggattgaagaggctagagaaatacgccaggagcatgaagaacgcgctaccatgccagtgaactagtcgtattgacgcgatataggctgtgttagcaagcacgttggagaacaatgttgcagaagtagcacaattaataatgatccattcggcaaggttgcttttttacaaattgcaacaatatgttatcaatataaaatcaacgattcctttgtttaaaaaaaggaagaaatgttacatcattgcatgatgcttcgattcagtggtcactccattcattctaaattacagttcagttcgagtt

SEQ ID NO: 14097 - DNA, 1033 bp, Zea mays
gcacgagctgcccactccgactaatatcccggggccgcccggctatgcccgccgggaaggaagcagggaagcatcagcagcgccgccgccatcactgctacgctgccggcgctagagccctaaaccctagctagggctaggccatccatggccgcctctccccagactctgtcagctcccccgcccgccgccgcggccgtcccgaacctcggcggcaagcgcaagaggcaacccaagggcaagaagaataagaagaacaaactcgcgcgctccgaccaggatgactccgtccgccgccgccgcaacaagccgagcgccaagttcctcaagctgctccgcaagcgggcccgcgactacaactccgacgacgaggatgaagctggtgacgaccggcagcaggagcacctgccgaatcctcaacgccgcgttgacgaggacgacgacgaggccctctctcactccgagccggaggagggcgaggacgaggacgaagaggagggggcctccagctcggccgtcacgaggttcgagcaaggctgcagggcgttccgcgtcgcctttctcaagatcatggccaagaagctccccgatgatcccctgggtccaatcctgtcagcgcacaagacattggttgccgccaagttagccgaggaggtggaggagcacaagcccaagcgggaggctcggaaggagaagcgcgtggcagcagagaaggggcatgtcatacctaaagaccacttggacagcaaagagaaggagctcatcaaggttgcaaccaagggggttgtcaggcttttcaatgcggtgagcaaggcacagaaatctcgaaaagatttgaacccatcaaggactaaagatgccaaagttatagcaaaagaaagaaaaaacaccttcctagcagaactgaagatgtcatcccatcaagataaaaagaggaatatatcttcaaatttctcaaagcacgccgtcaaagatgaagatggaccagcttgggcacctcttcgtgacacatacatgcttggttctaaattga

SEQ ID NO: 14098 - DNA, 3317 bp, Zea mays
  misc_feature (1153)..(1153): n is a, c, g, or t
ctccctccctcctcgtattgcgttgcgtggcagctggctatgcctgtgcctgtgcgtgcgtcgggatggcatactcctagtcctacttggagtgtgattcccgtttccgtcccgttcagttccctagtctagtctctctgctgtgaatctctgtgcttggagttggagtacattaattaatacagtcctataataattaattcacgcctcctccttccgcacggcaccgcaccgcagtactcctggatctaaaaataaatatacttctgatgtactgctacggtgtatataggtcatatttagtttttttaatcacactcttaaactttagagacgaatggcatctacaactctatttaatatacgatcctgtgagtacccaaatgaccaaatcccagatccatttaccgttactgtgtcgaatccaagaaaaaataaaactatcgtagcaatttgatttccaggagcttccctttggttttttttttccttcctatctgtatctaccggcatcaaaagttaggttgcttttggcacggagaaaaaaaaagagttgccagcttttaacagggcacaataatttgagaggatagctgctccctgcattgaactactcgtagttcgtactaccgtgctagtagttctgtctggcggaaaaaagaaaaaaggaacaaaaggcgtgacgagtgccaatcgaatgcagagtgctgaaagacgagacccaacacatgagtgaaggcagctgaccaacatcgctccatcagttcgctccattctgttctgttggagacagaaacacaactactagcactgttcgactctacattgactagggtacagactttatctttttatatagacgaacggatacaatcgattcaatcaaatttatcttatttctactgtacttttcattttttaagagtatgattaatctatccttaatattagttttcctcgatctatttcttgatcgttgttcgactctacgttgaccagaagcgttttgagtagcctgccgaccccgatacgaccctctggaactctcttctcgacggggtccctcacgggaggcgagatttagatttttcgcggagaagaagaccctccgcgccatcatggaccatccggctccagcgcggatcgtccgaangcacgcaaaggagaagtcgttcctacgccgaggtcgtacaccgtcccatcccgtgccaccgcgttccgtagagagcactgcgagacgattcacttgtttggtgccagatcagcgtcaataaattattattttatatttaacctcttcctcctaaaacctgatacctattttatatttaactcctatataaaactgttggatttgaattagaagctctacatagtttgagattgcacgtttcccgcgactaattgcgcctacgtttgctccctccaaattaaaaaaaaatctattccgcaagggaatcaaatcgactcggcccattccattgagcccagtagccacggacagagaggcccaggcctgcccactccgactaatatcctggggccgcgcggctatgggcggagtgaaggaagcagggaagcatcagcagcgccgccgccatcactgctacgctgccggcgctagagccctaaaccctagctagggctaggccatccatggccgcctctccccagactctgtcagctcccccgcccgccgccgcggccgtcccgaacctcggcggcaagcgcaagaggcaacccaagggcaagaagaataagaagaacaaactcgcgcgctccgaccaggatgactccgtccgccgccgccgcaacaagccgagcgccaagttcctcaagctgctccgcaagcgggcccgcgactacaactccgacgacgaggatgaagctggtgacgaccggcagcaggagcacctgccgaatcctcaacgccgcgttgacgaggacgacgacgaggccctctctcactccgagccggaggagggcgaggacgaggacgaagaggagggggcctccagctcggccgtcacgaggttcgagcaaggctgcagggcgttccgcgtcgcctttctcaagatcatggccaagaaactccccgatgatcccctggtaattcgtaattcccagccttcatttcttgtcatttctgcttggctgacgggcaatcagttgtgacgaaacaaaggaagcgaaacgtgagtgctagactgctaactggtttcccctctcattagggtccaatcctgtcagcgcacaagacattggtagccgccaagttagccgaggaggtggaggagcacaagcccaagcgggaggctcggaaggagaagcgcgtggtacggctctcactcacgcacagcacacccctcgcacattaggtgcagtccttgaaatgtggttactgcaagccattagttaatttgctctcgcttgctggaaacctaaaattcaggcagcagagaaggggcatgtcatacctaaagaccacttggacagcaaagagaaggagctcatcaaggttgcaaccaaggggggtaatgctctgttttaactccagcgtcatttttgcatctctcaggttgctgatttatcattaccaaattcaatgtgttattgactaatttgtggtattttttacatggattgtttggccgctggtcaatcagttgtcgggcttcttcaatgcggtaagcacaccaatcttatatcagtctctgtcacttttaaactctgcaggctactcttcactattgtagtgagctgagctgtgtttagtccacccattcttgcttctgaaatggttttgggtgtttcacaccaattatacgaaagtagacaaagtaccattctaggtcttaggatcgagaaccctctggccgctccatgtttgttcatcagatgcattattccgtccaatgtccaaaatggcttcacctatatgtgctaaatgatggtgcaaaacaatttatgtgcatatgaatatatatttgctttttgtatagatgagctggaagttattgacagtgccttttatttccaggtgagcaaggcacagaaatctcgaaaagatttgaacccatcaaggactaaagatgcaaaggtaatgttacctcatttatatgttcaccgtcttctattttgactatgacctcagattaaatcaacaatattatatttgttatgcacccaactgacaaagatcaacttggcatatgggggcagatctttataattttgagttattgaagtgtgaaactgaaatcggctgagctggcccaaatttattgagcacttatcaaattaggccctatttaaaa

SEQ ID NO: 14099 - DNA, 1122 bp, Zea mays
ccagccctccctgtcggtgatttagcactcccgaggcagttagcttcccaaacccaaaacaagcaggaatcaccacgttcaggtccagctcaccgcgcacccaccaaaaccgaacccgaactgtctctgccacgcgggtcccataagccccgcactctagaaaccgcctccccggcgaccggctgcacccggtcccagccagcggctgaccggcagccttcccgctcggcgctcccttcttctcacctctccgcaggccggccggggaaaaacttcttttccccctcccctgttaaacacgcgcagcgaagcaacgcagcagcaacaaaccttttcgctcgcagctgccaccacctcgtcgtctcgcctccccctcggcctccgcacgcgcgcgcgggatctcgccctcgcccgcctcgccgctcgcgcgcgcgcaccgaggaagggcgcacccacccgcaggcttcctggcgggccgatacggcggcgatggcgagccgggtcaaggaggacgagaggcacgagaagatccttcgcggcctgctcaagctgcccgccaacaagcgctgcatcaactgtaacaatttgggaccacaatatgcctgcacaaatttctggaccttcgtttgtaccaattgcagtggagcacatcgggagttcacgcatcgagtaaaatcggtttccatggccaaatttactgcacaagaagttactgcccttcaagaaggggggaatgagcgtgctagagaagtatttttcaaggagtgggatcctcaacgaaatggataccctgacagcagtaatgctgacaaattgagaaatttcattaagcatgtgtatgtggaacggagatacacaggagaaagaagtactgataagccaccaagggcaaaggatgacaaggatgagtatagtgaaaataggagatctgatggaaatgggggtggttcaagaagtccgccagatggaagttactctgatcgtcggagttatagtggacggagtgatgacagaaattccagatattcctatggggaccggagtcctggctatgaccaaaatggccttaagaaaagtcctcgctactttgaggttgtcgatgatagatctggaaaacaactc

SEQ ID NO: 14100 - DNA, 1246 bp, Zea mays
gaaagcaacgactccgcgtccccctgacctgacgtccgcctgatgaccgattatcttccttctccgtccgagtaaaggaaagcaacgactccgcgtcccgcttccctttccccgcacggcggagttcacaatccccaccggccggcgtagcggatattgcgagttacgacggggaaggagaggaagatccgtcgatccgcgcagattcgtttcgatcgtggtttggtgacttggtaagaggggaggggagaagcggcgatgtcgggcgtgttcggcagggtgttcgggaagtccaaggagcagagccaggcgaccgcgctggcctcgctcgacaagctcaacgagacacttgaaatgttggaaaagaaggaaaacttgctagtgaaaaaggccaatcttgaggtcgagaaggctaagaattttaccaaagccaagaataaaagagctgcaatacagtgcttgaagaggaaaagactatacgagcaacagattgagcagcttggaaatttccagcttaggatacatgatcagatgattatgctggaagcagcaaaagctacaacagagaccgtggatgcattgagaactggagcatcagcaatgaaagctatgcataagtcaacaaatattgatgatgttgataaaaccatggatgaaattaatgacaatatggagaacatgagacaaattcaggatctgttgtcagcgcctatgggagcagcagctgattttgatgaggatgaactagaagctgaacttgcggatcttgagggggaggagttggaggcagagctgcttgcacctaccacaacagctccgtccacagctccagtgcgtgtgcgtgtacctactgctcagcagtccactaggccatctggtcagagtagcaaagctgaagacgacgagctggcagcactacaggcagaaatggctatgtaaatataggcattggcatggtcatcttggatttcagattctgcggttatctcgcaactctggtatactcatgaggatcttcctaggaagacaagctttttcagaatcacaaacacaagctgcataccagcctaactgcttatgtatcatagcatgctatgttattgttttgtaatgaaatattttataggctaataaacatatttctattaataaattggttcgtgtcagtattatgttaaaaaaaaaaaaaaaaacgctcgagactagtctctctctctctctctcgtgccgctcgtgccgctcgtgc

SEQ ID NO: 14101 - DNA, 1201 bp, Zea mays
cactcctatgggcgattggttaccccggccccgcccccggcgcccccccccgggccgccatccgctgatccgctgctcttctccgttcgcccgcccgcccgcccctcccctctctctgtctcgccgcccggggagaaggagggctccgccgctcccggggaagagcgcgccattgccgccgccgcgctgactggggaagatggttgtccaggagttcacagttgatctcaacaagccccttgttttccaggttggccatcttgaggaacggtaccaggaatgggttcaccaaccgatcgtcagcaaggagggtccacgctttttcggaaatgatgtcctggagttcttgactcgcacgaagtggtgggctgtgccaactatatggctgcctgttgtctgctgcctgctcgtgaaatctattctgatgggtcatactgttcaggacgtagctatgatggctctgtttgggatatttatttggacgctgatcgaatacactttgcaccgcttcctgttccacatcgagaccaagacctactggtggaacaccgcacattaccttcttcacgggtgccaccataagcaccccatggactcgctcaggcttgtgtttcctcctactgcaacagcaattttgtgtttcccgttctggaacctggtcgcgttcttcgcaactccgtctaccacacccgcactgttcggaggcggtctgttgggatatgtgatgtatgattgcactcactactacctgcaccatgggcaaccatccaaagacccagcaaaacatctcaagaggtatcacctcaaccatcacttcagaatccaggacaagggcttcggcatcacctcatcgctttgggacgctgtctttgggacattgcctccatccatgacgtctgggaagaagaactgacgcacgtaactcaattcttggcatgagagattctaggggacctgtaatatatattcaagctagggataatcctggatctgtcttcgtgcgatgggttgacatgttcattcagttctcaaagttcttgtagtgtactgattgtctgttgatctattctgaatgtgatgatagtacttcgctgcctcagccttctgtgcaatgccagctgtcccgaaaacggcatgttttacttaactctttttgtctagttcttaaaatcagagcatcagactcttgcaaatgcaagat

SEQ ID NO: 14102 - DNA, 2405 bp, Zea mays
aattcctgtctgtgcgcgcgcgcgcgtggcgccggccgagcggccgttgacccgatgaccggcgcggcggccgtcgatcccccggtgcctcggccgcggcggctcacggtcctcccgctcatcgcgctcatcttctacgacgtctcgggaggccccttcggcatcgaggactcggtccgcacgggcggcggcgcgctgctcccgatccttggcttcatcgtcctcccagtcctctggtcgctcccggaggcgctggtcacggccgagctcgcatcggctttccccaccaacgccgggtacgtggcctgggtgtccgccgccttcggccccgccgtggcgttcctcgtcgggttctccaagtgggcgtcggggacgctcgacaacgcgctctacccggtgctgttcctcgactacctccgctccggcggcgggctggcgctgccgccgccggcccgctcgctggcggtcctcgcgctcacggccgcgctcacctacctcaactaccgggggctccacatcgtcggcctctcggcgctggcgctcaccgcgttctcgctctccccgttcctcgcgctcaccgtgctcgcggcccccaagatccgcccgtcccgctggctcgccatcgacgcccgcgccgtcgacctcaggggctacttcaactccatgttctggaacctcaacttctgggacaaggccagcacgctcgccggcgaggtcgaggaccccaggaagacgttccccaaggcggtgttcggcgccgtcgggctcgtcgtcggcgcgtacctcattccgctgctggctggtaccggtgcgctgcgtcggagacggcggccgagtggaccgacggcttcttctccgaggtcgggcagcggatcggcgggccgtggctgcgcgtgtggatccaggccgccgccgccatgtccaacatggggctcttcgaggccgagatgagcagcgactccttccagcttctcggcatggccgagatgggcatgatccctgccatcttcgctcgcaggtccaagtacgggacgccgacgttcagcatcctgtgctcggcgaccggggttgtgatcctgtccttcatgagcttccaggagatcatcgagttcctcaacttcctctacgggctgggcatgctggccgtgttcgctgccttcgtgaagctgcgcgtgaagaacccggacctggcgcggccgtaccgggtccccgtcggcaccgcgggggccgccgccatgtgcgccccgcccgccgtgctcatcgccaccgtcatgtgcctagcgtcggccaggaccgtcctcatcaacgccgccgtggtcgtcgccggcgtcgcgctgtactacgtcgtggagcaggccaagaggcgcccgtgggccgagttcttggcgcccgtgccgcccgctgacagctcccacggaccagccacggcgcctgatgacgccgacgccgccgacctcgaggatgtccgcgccgggctgctcgccggcgagccggccgacgaagaaggcagcaaggtcgagtactcaagactggagattcgtgcatgaacccgtttgccgttctgtgtacagtaattccagcgaatacatggcgaatcattgtgtgaaattcagaggaggaggtcaggtgatcgatcgcgctcacaagaagattcagaactgcaaaccgactactagataagtctgaaccatgaatcggagaagtgagaacagatctcaaattgtagaagctgtttttgttttgaccttttaagtgtagtgtgatgccaggcgaggtggtgccggtttgagaagaagctgtatttttccagcaagggggtcagataggttgtactgtacttgcattgagtcaacttgataattcagtaaagtaaccagcatagaaaatctgtgtcgtaactacgcagaaatgtgatcgtttgattaggcggatagttcgtctgataacagagtgtcgtttgacttggtatggctgtttcctgccagtgccagattatctcaacttgaatacttccgaggtgttcttctgaagcttgagcgatgggcagttgaatctgagattatcccaactgcccattgccccattccatggattggagaatggtttggtacggaaattaaaaaacaaaagcaaaggcacgtgactgaaccaatctttttccattactgaaccatccggttccttcaattggccatgtcacagtcacctcctttataaaacataccacgtgactgaaccagcaattttcatcacaaggagcagcatcgctgatgcgaagaagggagcggactggtttcacactcgacgaaccgaggccgaattgtggtgcaagtggatgcatgtcacatactagtctgtttgtttgcaaaagggtaattaacaaagttcacattacatacataaag

SEQ ID NO: 14103 - DNA, 2043 bp, Zea mays
ctgcatcacagaatcctcccggtcgccgggatcagatgcctccggccccgccgggcatctacctaacaaactcccataatatctctcccagttcagtcccgtatccccggtccccaccaggcaatcaagaacaccacctaccgctgacttgtcaattcctgtctgtgcgcgcgcgcgcgtggcgccggccgagcggccgttgacccgatgaccggcgcggcggccgtcgatcccccggtgcctcggccgcggcggctcacggtcctcccgctcatcgcgctcatcttctacgacgtctcgggaggccccttcggcatcgaggactcggtccgcacgggcggcggcgcgctgctcccgatccttggcttcatcgtcctcccagtcctctggtcgctcccggaggcgctggtcacggccgagctcgcatcggctttccccaccaacgccgggtacgtggcctgggtgtccgccgccttcggccccgccgtggcgttcctcgtcgggttctccaagtgggcgtcggggacgctcgacaacgcgctctacccggtgctgttcctcgactacctccgctccggcggcgggctggcgctgccgccgccggcccgctcgctggcggtcctcgcgctcacggccgcgctcacctacctcaactaccgggggctccacatcgtcggcctctcggcgctggcgctcaccgcgttctcgctctccccgttcctcgcgctcaccgtgctcgcggcccccaagatccgcccgtcccgctggctcgccatcgacgcccgcgccgtcgacctcaggggctacttcaactccatgttctggaacctcaacttctgggacaaggccagcacgctcgccggcgaggtcgaggaccccaggaagacgttccccaaggcggtgttcggcgccgtcgggctcgtcgtcggcgcgtacctcattccgctgctggctggtaccggtgcgctgccgtcggagacggcggccgagtggaccgacggcttcttctccgaggtcgggcagcggatcggcgggccgtggctgcgcgtgtggatccaggccgccgccgccatgtccaacatggggctcttcgaggccgagatgagcagcgactccttccagcttctcggcatggccgagatgggcatgatccctgccatcttcgctcgcaggtccaagtacgggacgccgacgttcagcatcctgtgctcggcgaccggggttgtgatcctgtccttcatgagcttccaggagatcatcgagttcctcaacttcctctacgggctgggcatgctggccgtgttcgctgccttcgtgaagctgcgcgtgaagaacccggacctggcgcggccgtaccgggtccccgtcggcaccgcgggggccgccgccatgtgcgccccgcccgccgtgctcatcgccaccgtcatgtgcctagcgtcggccaggaccgtcctcatcaacgccgccgtggtcgtcgccggcgtcgcgctgtactacgtcgtggagcaggccaagaggcgcccgtgggccgagttcttggcgcccgtgccgcccgctgacagctcccacggaccagccacggcgcctgatgacgccgacgccgccgacctcgaggatgtccgcgccgggctgctcgccggcgagccggccgacgaagaaggcagcaaggtcgagtactcaagactggagattcgtgcatgaacccgtttgccgttctgtgtacagtaattccagcgaatacatggcgaattattgtatgaaattcagaggagccgaggaggaggtcaggtgatcgatcgcgctcacaagaagattcagaactgcaaaccgagtactagataagtctgaaccatgaatcggagaagtgagaacagatctcaaattgtagaagctgtttttgttttgaccttttaagtgtagtgtgatgccggtttgagacgaagctgtatttttccagcaagggggtcagataggttgtactgtacttgcattgagtcaacttgataattcagtaaagtaaccagcatagaaaatctgtgtcgt

SEQ ID NO: 14104 - DNA, 3295 bp, Zea mays
cttgtgccatctcgacagtgatgaaacgcgcggtcgcacgttgttccgcgtcgtcgacgcggtgcgcgaggtcgtcgtagcattgctcgaggtggcgaccgagggcgacgcagcgatcgtcgaagttgcgctcgagaaggccacaacgcccttcgatggcgctcgtcagacggatttccatttgctgcaactcctccagcaccttggagacggaggtctcggctggtgccatggcggctgaacgtggtcgacgcggaatcggaaccgtgagatccagggtgtaggctctgataccagatgttaagatcagggaaggggatcggattgttatagcatgtgcaaggggaagaacaagagggaatacggagggacacgagagccagacggcgtctcgtatattcagtagtattttcttccaaaagttcatcccacattacaatagagcagcatatataataggtcttagccaacgtctagcagcctatttggcccacattggcccagtaacaagcacatttggcctgcgtgtacgcttggaaagcctctgcttcacgttgtcttctcctgcttcttccgtttcaccattcccagtatctccattgctgacacagacatcatataatataatgtgctggtgctaaattcaagcacacattgcatttacacgaaaaaaatagaaggaaaaaagcattccagcagtactgcagtttcgagctgagagtaactcgaggataaatttgcactgcaaataaaatgagcagggttacaaacgaggtgaaagaacctcaccagggcctcccaccgcctcctggcggcagcctgctccttggtctgtctcagctcctcgtcctcttccccctcctttcctcctccgaccaccgcccccatcctcaccaccccgctccatctctggacagtggacacacagggccatgaatgaacagagcacagccaacgagagggagatgctcaagtaaaagccccaacctttgaagggaggagaccacgggcaaggtgtcgggggaggaagccggaatgcgccacggccggggtggtgaaggcgccggcgaccctgcaagcgaggccgagaggtggcgctgccatctttttgttgttgatgtgcttgcttccagttccaggccagaggaaggtcccgccgcggttgtagctgtggagcgttatccccgttgcgtttgcaattggtgcaacgggaggccggtggggcccggactgaagactctggaaacgtgaaacttcagcacggctcgacaaaagcacaagaactaccccccaccttccccaatccgcagcaattccattccccatcccaccgcttccccacctctcccccacccgcgcgtccggccgggtgccccaatccgatggcttgactggtcccacaacgcaccgacggcgccgacaagctcccgtcacgccgccgccgccgctggcggcggcggcgctcgtcgcgctggctgctacggcggcagcatggacaccgcgctctgcgacgacctgctgcaggtggtgttcggccttctaccgccctccgctgcaccggccgtgtccctcgtctcccgccgctggctcgcactcctcagggccgcgacgtcgtccctcagcctccgcctgcctgcctcctcggcggcgaccctcgccgccctgctgtctcactaccccttcctcgccgccctgaccgtggtctccgctggtacgccggtccacgacgccgacgccgtgctgctcgctgtcgcggccgcgccggccgcttcccggctctccacgctgcggctcttgcccgattgggcggtctcccccgccgcgctgctcacggtctgccctgcactcgccggtctgacgtcgctccacctcaccgctgtccgccccctatctttccgctggctcaagctgttgccgcgcctcaagtcgttcgccctcgtcaactccgccgccaccgttgactccgcgggctcgagctcggatgacgccgacggcgaggccgaggacgtcgcagggacattgccgctggagaagctgtcactttgcggcatccgctccggcgaccgcgggcttgggtggctgtggcggcggtgcgggagcctcaagtggttgcagctgcgcgcctgcgacggtaccggggacgggcccgcgtcgctggccttcgcgggttgccttgctggcttgctcgcgcttgagcttcgtgcttgccgtgctgtcgccgaccgtgtactcctccttgcagccgaccattgccgcacgctaacgtccctcctggtctatgacggcggcggcagcgaggcccttcaccggttcatccagcagcgtgctgctggtctgcacaccttggaccttcgcctcccgcttgacctgcacaacgatcatctcctcgccattggagctgactcagttcacaatgctacacatggcctagcttcacttcgcctccagagctgcgtccttatcacaggggacggcctccggtccctggcacgcacagccgccggagccggcatagaagagctcgccttggtgagttgcgacgtggtggagcgggagcccgggttgctgacattcctcagtcagagcatgccgcggctccgtcgacttaacctgtcttacaatgagacactgaacgacaaggtgatcggcgccatgctttcatcctgccggaatctcatcgacatcagactcagggggtgccggggcctgacgggaggctcgctcctctcgctgcttaggcactgtgggcagtcactggagatccttgacatctcccgctgtccgggcattgctgtaggtaacgttgagctctttgcccagcgcgccgctaggttgaatcatgtgatcatcgaggagagcgcgatgtcggaggaattgaaggcaatcgctcagaagaaaggcatgaaggttggctcattgccgtgcgaaggaggaccattctgaagtaaggttgtatctccttcagaatgcagttccatgttctgtgcaactcgatttgtgaatgtaaccttcactggaatgttaataaagtattgctgcttagtacttgtgtatgcagctttgtatctgccttgtaagcttattatgactagcctcttggtgcctgcttgacatgtaaattgagcgctaaaggtgtgctgttgtatatgttcaacaattgccatggaatagtacagaaaattcaaaccaagagaaaaatgagccatccggccatttgatgttgggacgatgtgactatcagttgttggaatcatcggctgatattgtattagaatgagtaacacgaattgtaatg

SEQ ID NO: 14105 - DNA, 4031 bp, Zea mays
  misc_feature (157)..(157): n is a, c, g, or t
aataaagcacaaaaaaatatgtatgttatgttggttagatgaatgtaaatctggagctaacaactatgacaatgtgcgaagttgaaaccaaatatgacaatggagtcatgtgcaggagtaaaccgtgtaatatcatcataaacaattactacctccnttcataaatatatgaaatatatgatactgttgattttttgaaaaatttgatcactcgtctcattcaaaatattttttaaaaagtcaacggtgtcatatatttatgaacagagggagtagaaaatatagcccttacaaggataatgcatcaagatagaaacaagagatttaggaagtaagacaaaactaaaatcaacttgacaagggaaaaaatatgaaaatagcttttcaaggatcagagtttctggatcacctctcacctgaacttccaagtgcttgtacttttgtgaggcaacgtagttcattttgaaatctctggatctcattttgcagtaccacttgaaacctgactgaagctgctagatctgactgcaattgttcaatgcctagttccttggacacaagcttctcctttagaaccctacttatcatagcttcctctcttagcttaatttcaatggcatcctgtacaaaagaaaaatacaagagatgtggattgatttagcttcctattctagctttcggcttgaattaccaaagctagtatattattccagcaacttctatgctacgaaaatgtattttcatattcaacaaaacagatactacactagaattattttacaatgagttgcaagaaaatgtttgtcatgttatctaaatggaactcataactattaacaacacctaaacataagaaaccaaaagataggccacataatctggataacttctcttgtcctgaaaggttaccttcagttctcttctctgttcaatctcttcttcgttttgcttctcagtcaacaaagatttgatcatacacagactctgttttgcattgtcaattcctgctagctcatcatgatttggtaccttcatggctactagtgcatcaacgtctcaacatcactgttgtactagatggctagtaatagtcagactatagtttatgacacaatagtttagtagcggagtatcacagagtttgcaactacgacatgtccataacctgatcactgaacatgttagaaggaattttaaggtgatattgtaatatgtatatttttatttacttgttgtttaatatgaataattttagatgtatattgggtgtttatattggtaacatttatatatataagtaactagaagaacccctaatttaaatcttgctctggactcctaaaatgtcatgaccctgccggcgatggccggggcggccgtgtctgccccatgtggacttcgctctctttaaattatgcgcgattgtgggctgcacagctaggctggctgggccaattggtccagatcagtaacacaaagacgacgatatgaacaaagcaagcacatgacatgattccatggtattgttgcaatttctggcgaatacatttacagacaaatcgtgctagtacgtgccacagcgtgcggtcatttctaaatatcaccctcagcaaggaaatgctagacacaacacaagagagttatgcactctacaagcagcgccgccgtagatcctcactggattttctccatcccgtaggtatcttcagctccactggctacatttcttcttctctctgctatcatctcggtgtatgcctgagagaaggcaccacagggtcagttgttaagaacagggtgaggcggttgccggttaggccaaaggtatttgacatggaagaaatgcttcattggcaggtatgctgcagttagaggttggagctggtaacacagacgatgctcctgaccactaatagccatctcaagatatggaactagaagctttgggagccagctcagcattccaagttttggcatggatgatgagtagtggctaccctataatttgtatatggcaaactaaggtaaatctgcatttattaagtccatttgcagtttgaaaacaccatatgccaaatacaatactgggtcttttttaataaagctatgtcagaggacatggtgtaatgagttgcttaagtgatactacctccgttcataaatctatgacaccgttgacatttttcaaaaaactttaatcaatcatctaaaaagcgaaaatgtagaacagaaattaaattattagataaaatgatgtgcaaaccttagggtacgagtagagaaatatgtaccaccatgcggatattacaaaagaaaccccagcagtaattacaacagattggataagcacccaactacaggcaacggcaccagttcccgtaagcaatattgtccaaggctgacacctgaaaaaggggaaaatatagttgtcttgattataacactttgagcatagaagctaagcttatagaagaaacgttatcttcacatatggccaaactcgtgatgtttggtaaaaaatggcaacatgagaagaggtgtggaaaaatctaatagctcctttttagactgtagggcaccattctcacagctatggccattagttcatgatgacctttggaagctgaatgatgttattgtgtacaagaaagacaggcaataaaaattatcatcaattacatcatcatgcaaacaaaaaaaaactgaaagggctaaatcatggagctgacactagaacataatttggtgagctattcatttaaataaatatataagttcaaaagagatttatctattgtgttagtacacacgacattcaaaaatggttggcagagccaatgttgataataatagtaaagtaatttagaatcttttttttcttttaaacgaacaagcaggaggaacaatttggaatctagctacatctgacaataaacacagctacgataacaaatttgggcaatctctacgatatgcgttggaaacaacccatgctacaccatcataatcttcgccaattttgatcaatgcagcgtccagcaagaaacaactacggctacggaggagcaaagggaacggaccaggcaggcttggtgtcccagacagagtcgtactcgagggacaggtagttgaggtacccgtccatgtcgtccaccaccccgtcctcatcaaagaacgccgccgcgccgttcttgccactctcccccttgcccccaccgccgccgccacctacccgcgccacgccgccgcgcctctggctcctgccgcagagctgcagccttgtttgtgcaccggtggcagcacatgatgagaggaaaggggaaggcgcgaaggccgcgggcgcgtccgcgcgggcgccgcatgggcagcgcggcggcgtggatgggtagagcaggcagagcgcgcccatttcttggcttgtgctagcagtacggcgtcggcctcctcttcctaagctgctcccgtccggcggctgacgatgctgcggttatggccagtgtttgctttgatttcctggcaaatttttgtgccgtacatcatctttgcaattaaaagttttttggcagttcgaggttccggcccaatagaaagtaaataaagccctggtattggagatggcctgtttggagcccacatggtcatgacggtctagtatgcaaaatcagcaccaacgccgtttgttaaaaaaaaagaaaaaatcggcttctggagaccttgagcatcttcatcagaactattatttttccttcctataattagttataggaggtctgcctaggatataagaaacttttgctccaactgattatcaaagtctcgtcttaagagtattgagtatctacaagagagccgtataattgagtcctaaaatttaaaataggacccaataagttggatggttcaactaaattttatgatccaacaatgagtcatataatcattgatgattgtgttgatcttcgttctatgcatcgtttggttcccatctgatactgcatactgcattttgcagaaagaagtctcccatttat

SEQ ID NO: 14106 - DNA, 932 bp, Zea mays
ttttttttttttttttgcacaaagcaagcagcatgattccatgatgttgttgcgatttctggcgaatacatttacagacaaatcgtgccagtacgtgccacagcgtgcggtcatttctaaatatcaccctcagcaaggaaatgctagacacaacacaagagagttctgcactctacaagcagcgccgccgtagatcttcactggattttctccatcccgtaggtatcttcagctccactggctacatttcttcttctctctgctatcatctcggtgtatgccttagggtaggagtagagaaatatgtaccaccatgcgcatattacaaaagaaaccccagcagtaattacagcagattggataagcacccaactacaggcaaccgcaccagttcccgtaagcaatattgtccaaggctgacaccaggcaggcttggtgtcccagacagagtcgtactcgagggacaggtagttgaggtacccgtccatgtcgtccaccaccccgtcctcatcaaagaacgccgccgcgccgctcttgccactctcccccttgcccccaccgccgccgccacctacccgcgccacgccggcgcgcctctgggtcctgccgcagagctgcagccttgtttgtgcaccggtggcagcacatgatgagaggaaaggggaaggcgcgaaggccgcgggcgcgtccgcgcgggcgccgcatgggcagggcggcggcgtggatgggtagagcaggcagagcgcgcccatttcttggcttgtgctagcagtacggcgtcggcctcctcttcctaagcttctcccgtccggcggctgacgatgctgcggttatggccagtgtttgctttgatttcctggccaattcccggcccgccctccagcttcccaattaaaagaatttggccccggccggcctcgaggtacccaatg

SEQ ID NO: 14107 - DNA, 2540 bp, Zea mays
attgggtccctcgaggccggccggggctttccccgcgcgtccgcgaggggagatatttattttccggtccgttttccccgacagaaaggagtacttccaacaaactgctccgctttcagcacctgcccagcggaggaagagtgcggattgcggcggcgccggcggacgaaacaatggcgtcggcgagggacgagcatcttgatgggattcgcgcgctgatggcggcccactcgccgccgctccacgggctggtcgtcccctccgaggatgcccaccagagcgagtacgtgtcggagcaggataaacggcgggagttcatctccgggttcacagggagcgctggcttggctcttatcaccatgaaagaggcattgttgtggacggatggccgctacttcttgcaggcaacacagcaactgagcgatcgttggaaacttatgcgcatgggagaagatccaccagttgaagcatggattgctgataatctggctgatgaagctgtcattggaatcaatccatggtgcatctctgttgattctgctcaaagatatgagaactcattttcaaagaggcaccagactttgtttcagctttcttctgatttggtggatgaagtatggaaggatcgcccgctagttgaacctaggcctgtaattgtacacccagtagaatttgcagggcgcagtgtaccagaaaagatgaaggagctaagagaaaagcttgtgcatgaaaaagccactgccattataataactgctcttgatgaggttgcttggttgtacaacattcgaggaagtgatgtggattatagcccagtggttcactcttatgctattgtaacattgcacagtgctttcttttatgttgataagagaaaagtaactgtcgaggttcagaagtacatgtctggaaatggtatcgaaataagagagtatgaaactgttcaatcagatgcaagtttgcttgcatctggcaagctacaaagttctgtacatgtggaaaagtatatggatgaggtggagagttcaaaaatttggattgattctggctcatgttgccttgcactctactcaaaattgagtccacatcaagttttgacgcttcaatcaccaattgcccttccaaaggctgttaagaaccccacagaactggatggattgaggaaggcgcatattcgagatggtgccgctgttgtacagtaccttgcttggctggataatcagatgcaggagaactatggagcttctggttatttcagtgagataaaagggtcgcataaaaatgaacatttagcaaccaaacttactgaggtgtctgtgagtgacaaacttgaaggcttccgtgcaacaaaagagaactttaaaggtttgagttttcctacaatttcatctgtgggaccaaatgcagcagttattcactataaacctgaagcaagcacatgttcggaaatggatgctgataaaatatatctttgtgactctggggcacagtacctggatggtacaacagacattacaagaactgtacattttggtaaaccctcagcacatgagaagtcatgctacacagcagttttgaaaggccacattgcactagacattgctgtgtttcctaatgggacgacaggacatgctcttgatattctttcacgagcaccactctggagagagggtcttgactatcggcatggtacaggccatggaattggatcttatttgaatgtccatgaaggtcctcatctaattagcttcagaccttctgctcgaaatgtaccgctgcaagcatcaatgactgtgacagatgagcctggttattatgaagatggggcctttggtataagattggagaatgtacttatttgcaaagacgccaatgctaagtttaattttggagataaaggttatttggcatttgaacatataacatgggctccataccagaccaagctgatagacaccgggcttctgacccctgttgagatcgactgggtgaacacgtaccactcagactgccggaagatcttggagcctcatctgaacgagcaggagaagcaatggctgatgaaagctactgagcccgtagctgcaagaggctgagccttttcgtcaacgttgcatgccaccgagcgccaggctcatcttctgcgtggcatacatataagattggctgcccccgctggttaaataataatagcggcgaaggaacaggatagcttgttctcaacgctgatcttcgccgctaaagtggagtgtttggcaggatgctattttctttcccattagggtacgttcgggttttacggaacggtaggtttttatacggaacggtgggtacaacaattcctagagccggattgtttctctaattatttatataaggtttgatcaattgaaataattttggatccattctcggacaaacgaacaagtcccttaagctgatttgtacagttattctgggaagtcgcttccaactgaatacgctgctaattgtttcgccctaatcggatagccttctttgacgcaaaaaaaaaaaaaaaa

SEQ ID NO: 14108 - DNA, 4229 bp, Zea mays
tagtccttgaccactttttctttaatcatctcacgttctgcattattatattgaaccttggctagggtttttattcacatgttgtgtattctattttatttacttgttttagttatcgtgtagcatatggacagagagtttcttgtgcggatgtcctacatggaaatttacaatgaagatattaatgaccttcttgtgcctgaacatcgaaaattgcagattcatgagagtattgaggtaaacaacccaacttttcatgtgatattgatcactggccatctttaatagtagtcttattgttacatgccggtacttctgattgaagaaagggatctttgttgctggtttaagggaagaaattgttacatgcgcggaacaggtcatggatttcatgtcttttggagaatgtaagccttcttgaatgtctgctggctcagttactctatattttatttttaataaactgctagcacaactgcagcccaccggcatatcggagagacaaacatgaatctttatagcagtcgttctcacactatatttcgcatggtaaggttatattctgtatcatttcccacctgatcacaattctgattattatgctactaaatgtttaggtaatcgagagtagagaaaaaggcgatgacaatgaagttgaagatttttgtgatgctgtacgagtatctgttttggtatgtgcaattctcctctcttaattgctactctctcctgcagataatgatttgtttttttgtaatacatgtagtttatccttgaaattttggttgtccataccattatgaaaatttcagactgagtaacggtatttgtaggtttgtgttgaacaatgctccttagtttccgacaggaagctgttatgcatcctcttccctccctcggtggttgcccttccaccagccgcacgtcggcacctgctgtgggtccgatgtccaccccaaaggttgtgccccctatctgcttgattgctccctccccttgccgggcaccagtctcccatcctcccttgtgtcaccactgacagctataaggcccaacgttggagtgacaactgcccatctctagacgactctttttgaggactctaggccttctctatctcgctccttctgggaggctctgctcaacacggtggcctcagttgaggtcttgaagccccccgttctttgttcagtctggagatctcagccaagtccttgtagtctactccctgggtggtgctatctagggctgctctagcctcgatgttgtgggtggcagctactaacaggcggggcactgatgccgacggttggtgtaaggtggagggacgtaaggtttgccaaggtcaacatcgacaagcgtggccgttgcaccaacagataatcgatgctaacttcttgggcatttgcaacttaattacttcttgggcattgccgttgagcaccgcccccacgacctgttagttcatcagagggtgtacactctggatctccttgagcggtctggcatgatcaattgcaagccttgctccaccttggtggatactcaggccaaggtctcctttgcctttggtgccctgtcagtgatcccactgcgtaccagagcctcactagtgctctatggtacctcaccttcactaggccggatatctcctatgctgttcagtaggtgtgcctacatatgcatgttccacgagaggcgcacctcatcgatgtgaagcgtattttctggtacctctgggacacccttaactacaatcttcttctccgacattccttggcgttagcacaacacttgtcgcctacaccaacattgactggtccggttgcccgaccatgcatcgttctacctttagctacgctgtcttcctaggcggcaacctcgtcttctagtcgtcgaagcagtggtctgtcgtctctcgctcgagtgccgatgccgagtaccttgccatggcaaacggtatggctgagatgtgctggcttcgacagctccttctagagcttcacaaattgtccctagcatatgggtgacaatgagctctaaattttacactataagatttaaggatcggatcggattaggaccgggccctatttctattcatttttgaactaaaatttatttagggccctactattttgtgaagaagcatttggatcgtgatccattagcatccctaccctaacagcatccttgtctactgcgacaacatcaacgcaatttatctctctaccaacctcgtccagctctagcactagcggacaaagcatgtcgagatcgacctctactttgtccgcaaggtgcgaccgcgtcaccatcggtgatgttcgcgtccttcatgttccgatgacttatcagttcgtcgatatcttcaccaagggcctccctacgccagtgttctcggagttttgctctagtctcaacatccgtcgtcgctagagtttcaattgcggggtttattataatgtgttttcctctgttgggcctagcccctgtatgcaacccattaggggtgctactatgtgtatccacttgtactggttaatagattgttctatttttccttcaatattaataatgtacattccagaaccttgttgacttagctggctcagaacgcgctgcaaagactggtgcagagggtgtgagacttaaggagggttctcatattaacaaaagtctcatgactcttggtacggtcataaagaaacttagtgaaggcattgagagtcaagggtaagttattaactttttgactggcaaccctacctgttctgataattttcatcactgctttagtattggatttcattttcaggggacatgtgccataccgtgatagtaaactgacaaggatactgcagcctgctctgggtggaaattctaacacagctatcatctgcaatataacacttgcacaggtattctatatttctttatctgctgtgtttggactattggataatggaagtagaatggtacctcttgtcccatttctttatcatatatttgtaatatgttttgcttatccatgatgcttattgtggaaactaagttgaaaggtgccgcttcttttcttttgttccattttcatgtcaaggtaacagctcaaagtggtattttgaatttctgtctttcgaatcagttgcttcattgcttataaagtcatgtgccatagagaagcaaacaattagttagtcaacaactcaacatgccattgagaaacacaaagagcaaacatatagtcttagaactaacaatttgtgtcttggtaaactatttattttttatattttgtagatccacactgatgagacaaaaagcagtttgcaatttgcgagtagagcattacgtgtaacaaactgtgcatgcgttaatgaggtattaacatgtttctgttgcccactagattattgtttctattcattttgatataattgcataaatccttatacattatatatgtttgcagattttgacagatgctgcattattaaaacgccaaaggaaagaaatagaagagcttcgagcaaaacttagagtaagtattaaaaaatgtttcttaagaaataaatctattatccatacttctttaaaattgaaacttacattcttctgcctttagaaatctgaaagtgatcattgggaggaagaaattctgaatctgcgaaacacactactgcaggtagccttgtcaggcgtttcttatttctgtccagtgatttatggctatgcacatcatgtaatgtgataattattatttttagagtgaattggaaaaggaaagaatctctttagagctggaggaggaaaagaaagctaaagagcagcgtgacagatgcttgattgaacaggcaaagaaaattgaaaatcttagttcactggttttaaattcagacagagatgacaggagtactgcttttagtaaggttagttgtcacaatttatatatgtaatataatatgtaatagtcatgcaaaggcgtatgaactgcgtggttgctcattggttctttcttctagtttttctccataggtactttcttttctgttgataccttgaagtaaaatacgtttagactttgacgtttgaactttacagaaatggcataagatgtgtgcttcttttaaacagagggccaacaatttgtgtacttttttagcctaccaatagcttttctcttcttttttccttgaacagaacaaaagaagggtaacatggttcctgac

SEQ ID NO: 14109 - DNA, 1841 bp, Zea mays
cccacgcgtccgataaatggtacacaaccttggaagtgaaaacattcttctagagtctgttttgcatcgcgtcccgccacgccggccgggttctcccttcttgcaacaaactgctgatcttgttaaggattatttgaaatttatggatgatcatttgaaagaatctgctgatcttacgtgtctcgcatatagacaccgtacttactcaaaggtaattgagtttgttcaatttaaagaccgcttgcatcactccatgcaatatctttctgcaaaatcagattctgttatgctacatctcaagcagaaggcggactctcttgatgaagtggagtctattctagaaagtgttagccatggcacaaagctggttgagctatctaatgaggatagcatggtggacttaaccttcaacgaagatcttgatgcacggccttggtggacgccaacaagcagcgttaattttctttcagaaccatttgatgaaagttcaacacctgcaagctatagggccaaaatgtgcaagcacaaatctaatgagaaggacggttcgaagctgaaagatgtagagagaaaatctcttgttcctcgacttgtttatctttccacacatggttgtgcgtcttttctcagggagagtgaatcaaatggtgcttcctctgatgtaactgcttctggggagatgaaaactttgcttgataaatatgctaggagtattggttactcttttgatgatgctctaagttttgttctgggtatctcacatggcaagaaggctgtcaaggatttggctcctgatatagtcagctggatgaactttgctgtgtttatcaatgcttggaacttgtgttctaatgtgtcagtgatccctggaactgacaaaagcagcccaaactcctggtggatcgtggataacctcgtcaaaacttgcatagatgagcagttggctgataccaatcaaattctgacatctccaggaagcaatattccacttctagcgtggatggtgacagagcccatttcctggcaccttcttgtaatccaatcctgtatgagatctatggctccacaagggaagaagaagaagaaaggcgggccatctgagcgaccaaacacacctcacctgcaggcaattcggagctccgttcagtgcatgactgacactctccagagagtccagaaatgtctgtcagaacagatgaagccagaagagcaagctctagacatgctggtgtcacatttgcaaggaaccggtgccgaaggccctggacagatcgcccgtatcttggacgagagcgcagcagctgccagctccgaaatcggtggccggatcgcccattctctagagccgtggagccgcgccggcgtgatgagaagaatagttggggctgagaatgagacgatagccgagttgatgaagatctgcacctcgaagctcaagctccttgcgtccgcatcagcttccctgtccttggtgttgcactaggctgggaaattttgatcgtgagattttttttatcctcatccccgactgctgtcgtgccttcctcttgcccccttgatgttgtaaaccaaactaatgtgcgctggtgtttgttgtttcgatgcaattttggtttgagtgacatgctagtttccgagctgtttgcatgcctgctgtctgtctttggtcgtggtggaactgttgctagaatccatacgtcgtttgtgatcgtgatggattgatgacctccgtttcttgaactgtatttgtctactggttgagggcacttaagaattttactggattgtatttggtttcatagataaaatgcagtatgtagggaaaacaaatccctgggtat

SEQ ID NO: 14110 - DNA, 8028 bp, Zea mays
  misc_feature (2980)..(2980): n is a, c, g, or t
  misc_feature (3498)..(3498): n is a, c, g, or t
  misc_feature (3732)..(3732): n is a, c, g, or t
gagtattaaacccatatgagacaaggatgagtcgccaccttgctctgccaagatggtaatggaggcgatgaggacgccatgtctcgtcttcgcaccgccacacataggacacttgaggtcatgatccactagtgtagacatccgtcatcgggacttagttctttatgctcacatgcaccaatcaccacgagtgtgcaatgttgacataggtgaacttggaggcggtaagagccaatgtcttccataatgtgccactgccaccacaagccactatgaccctatcttcgtctgagcgttggcccctacacgtcgttgaggggaagatctttgtgcagctcgatggcgagatagagcgcgaccccatagcctctagtaccttgataactaggcaaagaaccacatgtcagacgatcaagacaccttcatcgacaccgatacgatgatccatgacaccatcaaatttagtgatggctcaaaggtcgcactcgaaggatccaggactggtgagcaccgcccactcgcgagggtgtacttcgtcccgaggctaatcaccaacatcatcagcctcagctatctcgacgagggtaattgcgacatccacaccaatcacaactacctttggatttgtgatgacaagaggcacctattcgcctgagtccagcttagcgaaccgtccgtaccggctacatatgaagattgggtgaccgttgcgcttgattgcacacaccaacaatagtgtgtggttgtggcatgaacgttatatctccttctctttgacattgtgtgcaagatcgagcaacgggccatggtgcacgggttgcctcacgtcgagtatgtccactagctatgtgacgattgtatcaccatttgcatcataggagaaacgaaaaaacaaacgggctactagacctagtccatggtgacctttgcaatctcatcatataagcattaattccttatgttggttgatgatcgagacatgtatgtgcgggtggcgttactcgctgccaagagcgacacccactgttatcaaaaagtttgagcaaaggtggaggagaaaggccacaacttacgtgtgtcgtaccgtacccgtacactaacaaaacggtgagcataccactaagtttgatgagtattgtgccgaacacgacgttgagcaacaacacacgatattgcacatgccacaacagaacaatatcgttgaccggtggaactagactgtcatctccatggcatgtagtctgctggagagccagaacatgccaacgatattctagggcgaggcggttgtcgcagtcatcttcttgttgaaccagtcacccattaaacaccattgacaatatggcacctcatgaggcatggcatagtcgtaggccggatgtccagttcctttgcacttttaggtacgtgatgagcgtcaagatgacaaagctgcacataaagaaagctcgatgactgctgcacttgggttgtctttctcggctatgagctaaacaccaagacgtggaacttctatgatcgagtgacaagtcacaccatcatgtctaaagatgtcgtattcgatgaaccgatgtcctagatttagaaggacggggacgttgacctaaaggccaatgcataccttgtcgtggaataccgcttgatgaatcttaacaacggacgcaaccacaccgacaccactacgagctcattagatattgtgatgacgctagcctctacaacaaccttagtgctttcaaaggatgacacaactagtgtcactcatggcaccgaaccaccgaccccgcctcccatggctcctcatgtgtgccagtcattgaattacttacagttacactaattgaagtgcatatttttcacgaataagcatatatttttatcaatgtattatttatttcataaatgatcatgccttcatattttgtaatttctaatatattttctagtacaaactttagtgtgttaatcagaaaaagataaattacaatctatctaaccccaattacgaagaacatggatgtagtatacagcgggcacataattatacacatatatttatataaatatcatatatatatatatacacatataaatatacatacacaaatatgtatatataatacacacatacacatacaggctgattggttaccgtgccccacgcgcgcgggctcgcacggtgcattgaccatgcgcaagcgcgtgttcagttgcctgcgtcttcgtccatagctctgcatgcgcgcgcatgcagtttagccactttttcactgtctggcatgcacgtctggagatgtggagagtggacttccctagaggtctaggcccgctcgagccatgcgcgcgccagccggggaaccaatcggcaatcagccacatatatatccggggtaagcaggtttgcggacacgggtataacattttcatacacgtgagaaaaaacctatcgggttgagaatcaaacccacattcgtatctcgggtacaaactcacaccaaatccgcacctatagagtttttacccgcaacacatgggtaaaatatgctcgttggcatctttaattcacacctagctaatcaataaaacacatatttttgtgttttatattctatgcccaaacataatataaagtgtatgttatataaaaattgaaaacaatgcacgccgctgtatatcgctcataatgtgttgtggaaaagcctgtgggccttcttgccttctatgaagaagggtttactggcccgggtgcagcaagcagaatttagttatggcccatggctcattaaccactgggccaccggccaaccgcccaccagcataccggctccagtgatcgacgccgggtcgccggcgaaggaagaacagtcaggacgaggaaagaaaaaacaacagaaacgaggaagaaaaacggaaaaaatagagcggcggggcgagatctacgacgcggccgcgggaaggagaggactgcctctacgcaatnccgctatcctggcgacatccacgactccgatatccggtaaactggtatcattttttgtttttctcgctcccccctcgtgttgtagtcgagattattccgttcggtcctatctcctgatgtgattcggttccacgattaccatgtctcatcggtacgccgactgcttctgttcagtcgagaattcgcagcttcctttatcctgagaaacctagctcttaattttagcagtgcgggcatggctctagcgttctattttttcttgtatatatcttgtagcaagaaatagataaaaaaacagagtaattagcttctgacgtcatgttaagacacatgctggaagtgtctatccctttgcggattggagtccggagatgctttcatacctttctttcttgatgataagagtaccccacttttttgttacttgtgcagttgtgcttccttagctctaaaaggacctcgtgacttgctcttcagttgtctctctttctcagttctatatgtcatagccagatagncttctaagttctaaacttattttcctgttactttatctatggagtttcattcctagttcattgcacattggttatcgtgacaaatgggggtgtcgctagcaggtctctcttctctggataaccacaccaccaatcatgagggaatcaccttcaacacagggggggccatctacatcttctgcggtgtgtgcactttccaaattttccattttgttatctaatgcactgaatttncataaccttgttcgacttgcatggatttgtatttagtaaagtatatataatagtctttttttctattaccgagtgatgaaccattcagccatgaccctctttgtcaagcatgctctgtcatggagagtagactatgtctactagttgcccttggcaccactgcccttcgaataccaaattttggaagctgagtttcaaaggcgttgttgctatgattcttataatactacacacaacttaatttagttatttctttgattcttgaaacatatgcataattaggtaacaagagcagcataactaaatcgattgattctgtatgtaaacgtacaatataggcaaacttttgtaactctactttagtctctttggttaattatttattttttgactgctgtttgattaatacaggttgatgatagttactcagctgacggtgttgaagattcacaactattcctctccgtgccagctttaaaccaagctgcatcttatcttgcccagacagcttcattcctcactcaatgcctccctgtacctggttttgtgggttagttcttttaattgttttgagaaaataattccctcatgtcaattgtgtaagagatgtcagcccttatgataattccattttaactgccaggtcatgtttgccatcttaatgcaggtctatctgaggagggccaagagttattaacactgccacctgcatcggcttcaggcagactttctgttcagacttcttcagtagagccttccggtaccaattcatcccttggtcagtcagattgtggtggaaacccctctcaagaaaacgctggacagatggtgccttcgcatgtttttcagaatggagcttcactgttccaagggtacaagattgctctgcatctttatgtttttctcctcttattcaaatcctgctagaatttgatgcacagtgtctatcagtgcagcacctgccttagaatttgataaacggtgggtctatctttcccatactaaataggaactgagttaaaactggatgctattttttaatcaaatttggatggtggatggatgtaatcgcgttccataagatgtccctgatatgttgtgcagccttgttgaacgtgctcggaaaacggtccgtggttcagcagatgatattggctggctccagcgagatcaaagcttacctacaactgaggatgggacagccagattcttagagattttggattctgtgaggtcagcagatgtacctaactcgaacttgattctgatgatatccaaacatgcttttaacgatagctttgatatgagctttatctcatatggaccatttcatccctcttcagaaacaatgaaccctagctatctgattcattggtttacttggtggttccaggttagtcagctggttctcctattatgagctgtcagtttccaaccttttatgataacattatatttctggttgtttataggtctgtttagtaaccacggacctctttactttgtcaaaacaaaggcatatttctccaagatgggtctggcttgccatattgccaaaattcatagtgaggtactaccatacactaacctgaacttttgcttcttgtctctttgtcgacaaagcagtgcattaaaaaaaaaccacattgcagtcttcagtgagtaaaaatgcacgagagataaaggaatacatagaagaaatatactggggatcaaggaaacgtgtgctcctccttggtcacagcaagggtggtgttgatgcggctgcagccctctccctctactggccacaactcaaagacaaagtcgcaggtttagcattagcccaaagtccatatggaggaagccccgttgcttcagatatcctgcgagaggggcagcttggtgactatgtcaggctgcgtaagatcatggagatcttggtatccaaggtccttaaggtattttccttgatcattccagcaatccagtcactaaccagcctgcctattgaatgacagtgttgctgactctattaattgccttgtgttcagggtgatctgcaggctctagaagatctgacttatgaaaggcggaaagaattcctgcgacggcacccgctacctcaggatgttcctatcgtttcgttccacacggaggcaagcatcactcccagcgtgctcacagcgctctctcacgttgcacacctggagctcccgattgctggcgatggcaattccactaggatcccagttgtgatgccactttcagccgcgatggcagcatgctcgcagttgctggtggcgaggtatggcgagaagagtgacggtctcgtgacgaggaaagatgctgaggttcctggttcagtggcggtccggccggagcggaagctagaccacgcgtggatggtgtattcgtcgctgaaagaagagtctggggatcaggcggacacgtcgcaggtatgcgaagccctgctgactctacttgtcgaggttgcacagaagaggaggcatgagatggcaatgaaagacgagtgaaagtagcttttggtgttggctggcgatagtgggatgtatcctcctgtaatcgtagactggcctgttgctggctgtacagagttgtgctgctcaaagtgctttgggacctgtttttgtttggttgacagaaacttgtgttgtatagcatgtgaagttcagaggtggatggagaaggttctactgtgttgtgtttggttggatgtacaaaaattgatataaaggggtggccacattttctataatgtttggatgagggtcacacgggatgaggtgaacactggagcaattttttatggcggtgtggtctaaaaaaaccgagtggatggtgccggcctcgcctctctcgtgctctcgaaaactgggatggccgcccccgcctctctcgagtagtgacagctaaccatcatacaaacaaaaactagaatggtttcatccaagtttatcccttctactaaataaaaaaaactggtgactgttagggatgaccttgccatcaaatcaggatgacattgtctcatactattttgacctcaaaccaaacacatcataaattgctcatgatcatcaacaaggtatgtaccttgatagctcatgatcattcaattgcaagcttcaattcaactcatttgcaagccatcaaatatatcatgaattttaatcaaccaccactagactatagcaatagcactttggactccactgattttttgacttgccatcgagatagaattatactaggattcaatacttgacttgacattggattgataatacgaacaccacatgaatcaagcctccaatgttgatggtacctacaatcaattatgggatcccatcaattatccactttttgatggtacccaaaccaagttgggctttcaagtttagagcaacaaacttacacattgtcttagtatggatggctgaatggtttgcaatttcaaccaataatgcatcgttgccatctttctaagcacaatattagtatcatatagaataggcttataattgttacctagggaacatgaatttaccatgtgtcctcttttttgacatatatagtaatacctctttgattgagtttttctttctttctcaaattttgcttcatattgtcttctctcttctcaattgtttgatccttcttaagcttgttggtacacttcgagacaaaagtgatccatatcttcgcatttgtacttgatgtgagctaaatcttattttgattcttgcttatcatctcagaatcttaattatgcatttgatgcatttttcttcctcttcttgttttctttttcgtctccataccaacactattttatggtggatcttgatttgctcttggggcttcttctcttgctcgtcttgaggcttcacttgatacttcaccaatttcttggttggacactttgagttgaggtgactcccaagtttgacatttgaagcacttaacattcttgatcctctcttcttccttcaacttaagaatatcttcattggggcatgcatttgcaagatgatccatctcatggtatcttctctcttctcaattgtttgatccttcttaatcttgttggtaactttgaaaaaagtgtccatatcttcacatttgtacttgatgtgaggcaaatcttacttatttcaattttcgctcatcatcttggtatcttgattatgcatttgatgcattttcctccctcttcttgttttctttttcgtctcatatcaacactattttatgaatgacattgatttgctcttgggggctctcttactcatc

SEQ ID NO: 14111 - DNA, 1877 bp, Zea mays
agcagaatttagttatggcccatggctcattaaccactgggccaccggccaaccgcccaccagcataccggctccagtgatcgacgccgggtcgccggcgaaggaagaacagtcaggacgaggaaagaaaaaacaacagaaacgaggaagaaaaacggaaaaaatagagcggcggggcgagatctacgacgcggccgcgggaaggagaggactgcctctacgcaatcccgctatcctggcgacatccacgactccgatatccggtctctcttctctggataaccacaccaccaatcatgagggaatcaccttcaacacagggggggccatctacatcttctgcggttgatgatagttactcagctgacggtgttgaagattcacaactattcctctccgtgccagctttaaaccaagctgcatcttatcttgcccagacagcttcattcctcactcaatgcctccctgtacctggttttgtgggtctatctgaggagggccaagagttattaacactgccacctgcatcggcttcaggcagactttctgttcagacttcttcagtagagccttccggtaccaattcatcccttggtcagtcagattgtggtggaaacccctctcaagaaaacgctggacagatggtgccttcgcatgtttttcagaatggagcttcactgttccaaggccttgttgaacgtgctcggaaaacggtccgtggttcagcagatgatattggctggctccagcgagatcaaagcttacctacaactgaggatgggacagccagattcttagagattttggattctgtgagaaaaaatgaacacaagctatctgattcattggtttacttgttggttccaggtctgtttagtaaccacggacctctttactttgtcaaaacaaaggcatatttctccaagatgggtctggcttgccatattgccaaaattcatagtgagtcttcagtgagtaaaaatgcacgagagataaaggaatacatagaagaaatatactggggatcaaggaaacgtgtgctcctccttggtcacagcaagggtggtgttgatgcggctgcagccctctccctctactgaccacaactcaaagacaaagtcgcaggtttagcattagcccaaagtccatatggaggaagccccgttgcttcagatatcctgcgagaggggcagcttggtgactatgtcaggctgcgtaagatcatggagatcttggtatccaaggtccttaagggtgatctgcaggctctagaagatctgacttatgaaaggcggaaagaattcctgcgacggcacccgctacctcaggatgttcctatcgtttcgttccacacggaggcaagcatcactcccagcgtgctcacagcgctctctcacgttgcacacctggagctcccgattgctggcgatggcaattccactaggatcccagttgtgatgccactttcagccgcgatggcagcatgctcgcagttgctggtggcgaggtatggcgagaagagtgacggtctcgtgacgaggaaagatgctgaggttcctggttcagtggcggtccggccggagcggaagctagaccacgcgtggatggtgtattcgtcgctgaaagaagagtctggggatcaggcggacacgtcgcaggtatgcgaagccctgctgactctacttgtcgaggttgcacagaagaggaggcatgagatggcaatgaaagacgagtgaaagtagcttttggtgttggctggcgatagtgggatgtatcctcctgtaatcgtagactggcctgttgctggctgtacagagttgtgctgctcaaagtgctttgggacctgtttttgtttggttgacagaaacttgtgttgt

SEQ ID NO: 14112 - DNA, 1670 bp, Zea mays
ccattgggtacctcgaggccggccgggcgacactctgcccagctaagctaagctccctccgtccatcggcatggcgactaccactactaccatcctcctcctcctcctcgtcgcagccacagccgtctcggcggccgacctctccgtgtaccacaacgtgcacccgccgtccccgtccccgctcgagtccatcatcgcgctcgcccgcgccgacgacgcgcggctcctcttcctctcatccaaggcggcctcgtccggcggcgtcacctccgctcccgtcgcctccggccagactccgccctcgtacgtcgtccgcgcggggctcggcaccccggtccagcagctgctcctcgcgctcgacaccagcgccgacgccacctggtcgcactgcgcgccgtgcgacacgtgccccgccggcagccgcttcatcccggccagctcctcctcgtacgcctccctcccgtgcgcctccgactggtgcccgctcttcgagggccagccgtgcccggcgaaccaggacgcctcggcgccgctgccggcgtgcgccttctccaagccgttcgcggacacctcgttccaggcgtcgctgggcagcgacacgctgcgcctgggcaaggacgccatcgccggctacgcgttcgggtgcgtgggcgcggtggccgggccgacgacgaacctgccgaagcaggggctcctcggcctcggccggggccccatgtctctgctgtcccagaccgggagcaggtacaacggcgtcttctcctactgcctgcccagctacaggtcctactacttctccggctccctccggctgggcgccgccgggcagcccaggaacgtccggtacacgccgctgctgaccaacccgcaccgcccgtcgctctactacgtgaacgtgacggggctcagcgtgggtcggacctgggtgaaggtccccgcggggtcgttcgcgttcgacccggccaccggcgccggcacggtgatcgactcgggcacggtgatcacgcggtggacagcgcccgtgtacgcggcgctgcgcgaggagttccggcggcaggtggcggcgccgagcgggtacacgtcgctgggagcgttcgacacgtgcttcaacacggacgaggtggcggcgggcggcgcgccgcccgtgacgctgcacatggacggcggcgtggacctgacgctgccgatggagaacacgctgatccacagcagcgccacgccgctggcgtgcctggccatggccgaggcgccgcagaacgtgaacgccgtcgtgaacgtggtggccaaccttcagcagcagaacgtgcgggtcgtcgtcgacgtcgccggctcgcgcgtcgggttcgcgagggagccctgcaactgagcccctgaatccgtccgtgccctatgcacgggaggaaggaggagacgcgctgcggctgccgcatcggtcggtgtgcagttagttgtcctgttagtctatgctacgttgtctgcactctgcaataacggacgtgacccggggaaaaaaactgtttcgtcacgggtagctagagaatcacgtaaggctcttgttttcgtttgtgtcctataatgtatggctattggcctgtttcgagaggttaaaatttggaggtgctgcatcaaattcataaaaaaaaaaaaaaaaaagcggccaaaaagcggcc

SEQ ID NO: 14113 - DNA, 695 bp, Zea mays
ttcgcgttcgacccggccaccggcgccggcacggtgatcgactcgggcacggtgatcacgcggtggacggcgcccgtgtacgcggcgctgcgcgaggagttccggcggcaggtggcggcgccgagcgggtacacgtcgctgggcgcgttcgacacgtgcttcaacacggacgaggtggcggcgggcggcgcgccgcccgtgacgctgcacatggacggcggcgtggacctgacgctgccgatggagaacacgctgatccacagcagcgccacgccgctggcgtgcctggccatggccgaggcgccgcagaacgtgaacgccgtcgtgaacgtggtggccaaccttcagcagcagaacgtgcgggtcgtcgtcgacgtcgccggctcgcgcgtcgggttcgcgagggagccctgcaactgaacccctgaatccgtccgtgccctatgcacgggaggagcaaggaggagacgcgctgcggctgccgcatcggtcggtgtgcagttagttgtcctgttagtctatgctacgttgtctgcaataacggacgtgacccggggaaaaaaaactgtttcgtcacgggtagctagagaatcacgtaatggctcttgttttcgtttgtgtcctataatgtatggctattggcctgtttcgagaggttaaaatttggaggtgctgcatccaattcgtacgtcgac

SEQ ID NO: 14114 - DNA, 2206 bp, Zea mays
cttggggtcccccgcggtgctcctcacaccggcctcggcgcctcgcaccacaaccacctcctaccccttctcttcttcttctccccccttgcgaatcggagaccaagtgcaattgcccacccaagccccggaaccgggggccaagagcagtacagggggttggtttctgcgacggcgaggacgcgaagcggattcggatcgcgccgccatgccgctcgacgagctcgccgacaaagggccgtcgtcctccgaggaagttcagctcgcgccgtcggattccaagttccggagcctcagtccttcgccgattccgctcccaactcttccgagcatcagatcattggtccactcggtttctgacgagagtgtaaatgtagatgtcgcggcctcacatcaaagtgaaaatggatctatctctactgttagttcactagaatcagagagggcagcatatgaatttcttgctcaaactcctgtcaggtcaactgatgcacatcttgttgagttttcggaggctatgagaactgttgcaaaagccttacgacgagtggctgaagggaaggctgctgctcaagcagaggcagcggagtggaaacgtaagtatgaattagagacagcgcacaagcatcggagtaaaatcaaaggctacagcagttgtatcaataatgacttagacaaactggtcagccaactaaccctggagacacctacatctgatcaattaggatgttgcggaaagcatggtatatgtgcacatgagattctccaggacgaagttcctgggcctatcccaagatctaatcacaaggtggtggggagaaaggcatcatttaaactttcatggggatgtaatggggataaaaatggacaacataagcatgattttgtgtcctttgaaaaaggtgatataacaaccgcagaacgaagcaataagcagatcttactgaaatgggaatcgccaccacaaacagtgcttttcataaccaaaccgaattccaactctgttcgtgttctttgtgctgaaatgatcagatggcttagggagcataaaaatataaacatgctttgttgagccacgtgttagcaaggaacttctaacagaggattcttactacaacttcgtccaaacatgggataatgatgaggagataaagatgctgcgcacaaaggttgatttaattataactcttggtggtgatggaactgttctgtgggctgcatcattgttcaaaggacctgttcctccggttgttgcatttgccctgggatcactgggcttcatgacgcctttcccaagcgagcaataccgtgagttgttggacaatgtgctgaatgggccatttagcatcacgctgagaaaccgcatacagtgtcatgtaatacgtgacgaggcaaaggatgaaatcgtgtctgaggagccattcttagtgttgaacgaagttacaatcgaccgaggaatatcatcctaccttaccaacctggaagtctactgtgacagctcttttgttacttgcgtacaaggggatggactaatcatatcaactacatctggaagtacagcatattcattagcagctggagggtccatggttcatcctcaggtcccagggatccttttcaccccaatctgcccgcactctctgtcattcagacctttgattctgcctgaatacgtgaccctccgcgttcaagtgccgttcaacagcaggggcaatgcctgggcatccttcgacggcaaagaccgacagcagctgtcgcccggtgacgccctgatctgcagcatttctccctggcccgtgcccacagcctgcctggtggactcgacgaccgatttcctccgcagcatccatgagggtctccactggaacttgaggaaatcccagtcatttgacggcccgcgtgattgatgcaacagctgttcagttatatttcagcccggtgccagaattcaagctgggaattctcaacaggaataactgtagctactccagggtgctctcacctttaccgttccatacttgcctatatacaaaggttgcgtgcgttagatgtgaggtatagatagatgtatagaatatggatggatgataacgactggacatgttgaataatacaacgccaacgtatgcacgtaaaaaaaaaagcggcccccgtgagcggccagaaataatccgcgagccatacacgacgagatggcagcttctgc

SEQ ID NO: 14115 - DNA, 2643 bp, Zea mays
cccgcacgcgccgcccgaagccaaccgtcccagtctgggccccaccggcgagagcccgtcggcgtcaatccaggacccgataaatagccgcgccgggcggggagaggtggtgctcctcaccggcctcggcgtcgtcgcctcgcaccgcacccaccggtccgccacccacctattcttcttgtccctctcccccctcgcaaatcggaggccaagtacactgcccacccaaccaagtcaggagcagaacaagtagtacgggctgtgttttctgcgacggcgagccaagagcagaacaagtagtacggggcgtgttctctgcgacagcgagcggaccggatcggcggcgccatgtcgcacgacgagctcgccgacaaggagccgtcgtcctccgaggaatttcagctcgcgccgacggattccaagttccggagcctcagccctgcaccgattccgatcccagcttctccgggcatcagatcattggtcgactcggtctctgatgagacagtaaatgtagatctcatggcctcacatcaaagtgaaaatggatcaatctctacagctagttctaccgttagtttactggaatcagagaaggcagcatatgaatttcttgctcaaactcctgtcagatcaaccgatgcacatcttattgagttttcagaggccttgagaactgtcgcaaaagccttacgacaagtggctgaagggaaggctgctgctcaagcagaggcagcagagtggaaacgtaagtatgaattagagacagcgcagaagcagcaaagtaaaatcagaggctacagcagttgtatcagtaataacttggacaaactggccagccaactaaccctggagacacctgcacctgatcaattaggctgttgtggtaagcatggtatatgtgcacaccaggttctccaggatgaagttcctggacctatcccaagatctaatcacaaggtgggagggagaaaggcaccatttaaactttcatggggatgtaacggggataaaaatggccagcataagcatgattttgtgtccttcgaaaaaggtgatataacaacagcagaacggagcaataagcagatcttactgaaatgggaatcaccaccacaaacgccgcccggcataacctcaccgaattccagctctgtgcgtgttctttgtgctgaaatggtcagatggcttagagagtataaaaatgtaaacatctttgttgatccacgtgttagcaaggaacttctaacagaggattcctactacaacttcgtccaaacgtgggataatgatgatgatataaagatgctgcacacgaaggtcgatctaattgtaactctgggcggtgatggaactgttctgtgggctgcatcattgttcaaaggaccagttcctccagttgtcgcattcgcccttggatcactgggcttcatgacacccttcccgagcgagcactaccgtgagttgttggacaacgtgctgaatgggccatttagcatcacgctgagaaatcgcatacagtgtcatgtaatacgagacgcggcgaaggatgaaatcgtgaccgaggagccgttcttagtgctaaatgaagttacgatcgaccgagggatatcgtcttaccttaccaacctggaagtctactgcgacagctcttttgttacttgtgtgcaaggagacggactgatcatatcaaccacatctggaagtacggcatattccctagcagctggagggtccatggtccatcctcaggtccctgggatccttttcaccccaatctgcccgcattccttgtcgttcagacctttgatcctgcccgagtacgtgactctccgcgtccaggtgccgtacaacagcagggggcacgcctgggcgtccttcgacggcaaggaccggaagcagctgtcacccggtgacgccctgatctgcagcatttctccctggcccgtgcccacagcctgcctagtggattcgaccaccgacttcttccgcagcatccatgagggtctccactggaacttgaggaaatcccagtcgtttgacggcccgcgtgattgattcaacagtttctttaccgttccatacttatatacaaaggttgcgtgcgtttagatgtgaggtagtatagacgtatagttgagaatccaaatatatagccatgaccatgcgtgtgtgtacatgtttctgtgcttcagtgctccccagatctgaatggaataattggcgagccatacacgtatgacgagatggcagcttgcagtcgtgcgatctgggcacttgtgacgattgatggggaggaagcctccatccttttttagctttccatactgatagctgagctgatgaatgttggttgaatggagtcatggagtgggcatgctctgctgttgctcctcctcctgctcctgtgacggccagatgggtgcctgcctaataatgcctgctgcccattttgacctgggggcgagggcgatcggtcacacgttttgaatccgtgatcaggattaacaaaagctgggtagctttcgacgtgattcttgggggctgcttttgcctgaattaaagacccgagtaccgaaaaaaaaacggccggccggggcatgattctctaatcattccctttccacagctgcaggtcgactc

SEQ ID NO: 14116 - DNA, 3348 bp, Zea mays
tgctggaagtgaatgctcagatggtatcaactccatagatgttgagctagaccacagtgacatcgatgactgtgagattgctctacagcactttgtctgtgaaacagcacaacagaggtcagcacatcttgtttcaattgaaggaaaaggacgtgaagaagatgatgcaccagaatcaactgggggtgcaacgatgccatttcatgcagtccccgacttgctaagctggcaagatggagatggtaagcaagtgtgatatggcaacttctgtttgattgggtgaaacatgttttcacagtcttattcgatccgcatcccattatggaggtgacaacagctgtggtgctaaaccttctttccgacttaacgcagtagttagatgctcagaatgggtttcgtcttgcaggccacctgtggagggcgaatctgattatgcggatcttctagagtaccttgacattgaagttgcatcaagctcaaacacagccatacttggtgcaaacaatgcagctgagaaaggtggaaatgttgatctcatgtcatattcaaacgacaaaattcctttaaataacctgattcatcggtctatggagctgccttctgaatttgtcattcgggcattgccgctcatatctagggacctacaccctatcccagaggagagagttgctgagaacttcaacgtgcaagaaaatcatgaagcagcaatttttactgattcagttgttgccttgactgggttgcatgtaattgaggagcactttgatgatggaactgacataactctaagctctgaagttgtttcctcatatcctcgagctaatggtgtcacccaatctccatcaagtgagcatgcagaaatcttgaatccatttgtttttatggctgctgaacataataaggtggatataagcgacatgcatggcgaagcaactgccggatatctacttgattctgatgatgaggctggtaaaatctatcctgagcctatggaaggcagtggaattgatgaaagtttcctgtctgaattggatgtggtgggagactttggagttgaaccgatgagactggaccagcaggtgacagatcaggcttctcatggtgataacactaccgatagtgttactgcagattctgttattagtcctcagacatctgacaatgtctccttgaccatgtcggaagttggtgctgaagaatccagggagcagtctccattggctgatgacctaaatggctccgaatttggctactcgtttggagcatctcatgatgaccctgagcagactgtctacaatcctcggagacggatccttgaagcaagcccctatgaagcaatgataatgaatgtggagatgaaactaccacatggtgagtcagaagtgcctgctgatgatacaccatcaccagcgaccttagcagctggatcaagtgagccagaggccactattaatgagttagcgacaactacagctgatcctgagattactgttctagatgcaaaatctctggaggatattgagactgcctttaggctggttagtgatggtgtggtctctgaggccaccatgggtactgaaactttgcagatctcaggtgctgatgctgcagagcccaaaggggctgctggagagctgcatgtcattgatgcgaaatctgtggacgacatacatgctgctttccagaagcactttgatgctattgtgaatagttccttggaagaaaatgaatacaaggataggcatgtagagatggcagaatccatggagcctgatcaacttactgaagcaatacatgccgtaagtcagcacaacttgggagatgctagggaggctttaccagcggaggagggtacaagcgatatgagtactagcgaagcagagagtcacaacaacattggtgcagcatccgataaggtctccgatagcagtgccaagaatactgcgcaggcagtggtgttggaggtttctagtgaaagagaagaggaaagtgaacagcagtgaagaccagtggattgactgctgaaaggaatcaatagaattccaccatatatgaatttgagacaaaaatgctccctggtttgaagtttgaaggagctatagcaagcattgatggagcgctattgctgagtttcacgggcttgccactgtgcatatacttcacacattcaaaacacaaagttctgaagtagaccttttgtgaatgcgtttgctttttatttttgctattgttttgaggttttggtgggtttgttttagattgatcccccctcgtttggctgtaatttgaagaggtaagttttgcccagacagttcggtgtggctgcagggacatggaacgatctgttctgccatgtgaattgagattttgttgtattgtttgaactttgaactagcgaagctggcaatagaagaacaagataggtgtatttcacctttgaatgtgtcggtgacatttattagtgtccttaccgtgaataaactgtttaatttacagcgatctgcttatttgtcagcacttgtcctgtacctcatgtacggttctggtgccaacacagcttcgcttgctcgtgcggtcgaatgtctccgagttcagatgtcgcccgtccgtcaatttctgaagggtcgtttcgtctccatttctgagagcgctgacgttgttgtttccacgcagagataacctgactgatttcaccccaagaatcaatctgcattacatatgttttcactcttcgctgctgaaggtacatggattctagttatttagccgtttgtaaatatgatatttctctatttttagctggatatgcttagcttcagttatcggtagatggtcccatttggtggcttttgtttccagtgatgcattcagactgtcttgtctatctcgtcacacattattcgccataaagtccacacgttagcattgctttgcttacgcagtggtttcagtgagggcatttgagtgcaaaaaaaaaaaaggatgaaaaatgataggataccgtctgctgcgccgattatttatgattgcttgggcattatctcttgacatatactagtaaactggttttgtctctgggttggcagtttggcattgtggaccagcacgacgagacgtgcgggcgcacgggcacaggcctcgccggccgccgcgagcgtggggcgcattacccgctcgctacgtcgcttgtgtagcagtctgatccttgacccccgtggtccactgtcaggcgcgtcgtgggctgggtagcagctggccagccgccaccaccgcccgaaatgcttgacaacgagtaggatacagcttgtcagcctgcagattggtgtgctaccgtgggcatattcatca

SEQ ID NO: 14117 - DNA, 2761 bp, Zea mays
ctggttttgattctgatcaggctgagagttctcctgatgcttccatgactgacattgctcccgttcttaatgagattgatccacttttgcgtgctgattccaatcgccccgatcctgttcctaatgatgattcagacacagattctcatgtctcagaggatcatcaaattgacgatgatagtaatgatgagggtgatgacattgatgctaaagataatgtggagggggagaaggaaaatgatgggaaggaagctgcatttctttggacagcagatgatgaaaagaatctgatggatcttggatattctgagatagaaaggaaccgcaggttggaaattttgatggctagacgaagatccaggaagaacatggcatttgaaatcgataacaacttgatagatgttcatagttctggctctggtacaagtttagatgatttgtcacgcttccgtgcacaggtacctcctattgcagtgcccaggaggaacccttttgaccttccatatgattctgaagaagcagcaattcctggctcagctccttcaatactgcatgcacgggcgcgcccgtttgaccttccccttgaacagtcaaatgacagtgttgttgtccatgcacatgatattttaaactctggagaacctgcgacttctcgtcgtgacatgatctttagaaggcatgaaagcttcaactttggaaggatggatgtgatccaggagaagcgtttttctagactcaagccatattttgttcctgaaactgtggaatggaatgcaagcaatttccaaagacagttcagtggtaagtctgagtctaagatgagctctgttactgaatctgatattgcttcttcagttgctgatcaggaggatcataaggaccaagatgaaaaggaccttgcagatgttggaagtgaatgctcagatggtatcaactccatagatgttgaactagaccacagtgacatcgatgaccgtgagattgctctacagcaatttgtctttgaaagagcacaagaaagggaagcacatcttgtttcaactaaaggaaaaggacgtgaagaagattatgcaccagaatcagctgggagttcaacgatgccatttcatgcagtccctgacctgcttagctgggaagatggagatggtgacaacagccttggtgctaaaccttctttccaacttaacacagaagttaaatgctcagaatgggtttcttcttccaggccacctgtggagggcgaatctgattctggggatcttccagagtaccttgacactgaagttgcatcaagctcaaacacagccatacttggtgcaaacaatgcagctgagaaaggtggaaatgttgatcgcatgtcatattcaaacgatgaaatgcctttagataacctgattcatcggtctatggagctgccttctgaatttttcactgaaacattgccagtcatatctagggacctacaccctatcccagaggagagagttgttgagaacttcaacgtgcaagaaaatcatgaagcagcaatttttactgattcagttgttgccttgactgggttgcatgtaattgaagagcactttgatgatggaactgacagaactctaagctctgaagttgtttcctcatatcctcgagctaatggtgtcacccaatctccatcaagtgagcatgcagaaatcttgaatccatttgttttgatggctgctgaacataataaggtggatataagcgacatgcatggcgaagcaactgccggatatctacttgattctgatgatgaggctggtaaaatctgtgctgagcctatggaaggcagtggaattgatgaaagtttcctgtctgaattggatgtggtgggagactttggagttgaaccgatgagactggaccagcaggtgacagatcaggcttctcatggtgataaacactaccgatagtgttactgcagattctgttattagtcctcagacatctgacgatgtctccttgatcatgtcgaaagttggtgctgaagaatccagggagcagtctccattggttgatgacctaaatggctccgaattatattaagaagaaaaaaatgtttggaatcataaacacacacaaaaacattcacaccaacaaactcagattacatgcacaccttgactaagtttagaacagtaaaaaaggaactcggactagacctctgatctccatttgatatgctatattggtttaatcacaaatacatgatcttcatatgactcccctaagaatgagcacttacaacttctcgtgatgctataaggacgcacttacagatttttgcgtaaacaacgagcatcctagttgtgttttttaccagcaggcgctgctactcctgtcatacttcaaccatttgtattcacatggtcttaatggtttgatgacagctatcctgttgttttgttcttatctaaaacacagtcacgcttctgtcttgcattgtaatcgtatttttctgacacttgtgaacttggttgctcaggttcatgttgtctctgctaaatatgtagtgaagtgcgataatgatacttttgtgagacttgattcagtagtcattgaaattaagaaggtaccaggtgggagaaaggctttacatggggagtatgaatatacaacacaagccacgacgccatgggaaacaggctgtaacctatgaggtcaagcttatggaatgtttgccatagcagttattacatttacattgcttcaaacaccaccttaacatttctta

SEQ ID NO: 14118 - DNA, 1025 bp, Zea mays
tatgtgagtgtgaaagattaaaaactacagtatggttttatttgaagttttaacacttcatataaattttctgtgatgattcagataacttgcacttcccccattgaaattgagcttgttgccatggcaaattcattatctccaccagtgaaatataattttcacaaaatagagcagttcaaggagaaagcagatactgttgaatatatttttgaaatgcttagcccagcaatgttcttcctacttgagaagggcatcaagttgcttatcgtgacacttggctcaaatggtgtttttgtttgttgcaaagagcacactaacttcatgaaagaccagcacaagtgcaaacagacgcctttctccagacagctacttgaaaaaatggacgggtgttttccatcgaacaatcttgctaatctgtgcagagaaagctcttcaagaacatgtgtttttcatttacctgcaatatcggcctctgtgataagcctcacaggtgctggcgattgtttggttggtggtgtcctttcagctctatgtgcaggcttcgatatcatccagagcgttgcagttggggttgctatagcaaaggcatctgtggaatctgaagccaacatacctgatgacatttctgctgcgagtattgcagatgatgcacaaagtgtattgcattctgctaaggtgctttggtgcaaatgaagaatagaaaaactaccatcccggtgtaaattgaagacagtcaggtgctattgaagctattgaactctgttactgttccaacggcacaagacggataagaatgaaatcgctatatatgatggatttttggttggaagaacagagggatcaccaatcagaattctttctactatagcatatatttttcatgtacattgtgggtgcaagttcgatcaagggagcaaatcctgttgtatttttttagttagtgagattatgtgatgaaaaattggttagcgtcaaatttgcatttgcaaagtgactaatttaatgacataatataatacact

SEQ ID NO: 14119 - DNA, 1088 bp, Zea mays
agcgtcagacattccagtgcgtgcctggcaagtggcaaactcgagctgtctagtcctcggttcgcgaatcttccacagagaggcagacggcaggactcgcttcaagctcctcatctcgcgcaggggggtcgcctgagatcacagagacaatggtgaaggcagttgctgtcctcgccggcactgatgtcaagggcaccatcttcttttcacaggagggggatggtaattcccggcacatgtttttgacttacaatgaggatctctgtggtctaacgagaatatctgcttcatgggtaggtccgaccaccgtgactggaagtatctctggcctcaagccagggctccatgggttccatgtgcacgcgcttggcgacaccaccaacggctgcatgtcgactgggccacacttcaatcctgttggcaaggagcatggcgcaccggaagatgaggaccgccatgccggtgatcttgggaatgtgacagcgggagaagatggtatttttgtctcactgccttgcgtcattgtttggttcatttgaactggagaaatctttataaagttggctgcgaagactagatttattcattttccaatgtacgttgttgcattgaaactgcagcgcaatagctcataatcccactgacaatttacttctttgcttctcaggtgttgttaatgtcaatattactgacagccagatacctcttgctggaccccactcgatcattggccgagctgttgttgtccatgctgatccggatgatcttggcaaaggtggacatgagcttagcaagagcacgggaaatgctggcggacgtgttgcctgtggtatcattgggctccaaggctaaagcagttaacctccgaggcaaacaccatagaaggtcgaagcgagcacctcaggatgttgctgttccatttcccctgtattggcaacacaatttgagtactccaaataagcgcctgatccatgatcagagagcactattcatgccattttgtatatgaacaatgttgcgcacctgcttaagtgtctgttccaacaaatgcttaagaagacaaaaaaaaaaaaaaaaaacccgcggcc

SEQ ID NO: 14120 - DNA, 937 bp, Zea mays
gcacgaggaaaaatactgcatacctcgctcccgggcgggccggcagggagcgtcagacattccagtgcgtgcctggcaagtggcaaactcgagctgtctagtcctcggttcgcgaatcttccacagagaggcagacggcaggactcgcttcaagctcctcatctcgcgcagggggggtcgcctgagatcacagagacaatggtgaaggcagttgctgtcctcgccggcactgatgtcaagggcaccatcttcttttcacaggagggggatggtccgaccaccgtgactggaagtatctctggcctcaagccagggctccatgggttccatgtgcacgcgcttggcgacaccaccaacggctgcatgtcgactgggccacacttcaatcctgttggcaaggagcatggcgcaccggaagatgaggaccgccatgccggtgatcttgggaatgtgacagcgggagaagatggtgttgttaatgtcaatattactgacagccagatacctcttgctggaccccactcgatcattggccgagctgttgttgtccatgctgatccggatgaccttggcaaaggtggacatgagcttagcaagagcaccggaaatgctggcggacgtgttgcctgtggtatcattgggctccaaggctaaagcggttaacctccgaggcaaacaccatagaaggtcgaagcgagcacctcaggatgttgctgttccatttcccctgtattggcaacacaatttgagtactccaaataagcgcctgatccatgatcagagagcactattcatgccattttgtatatgaacaatgttgcgcacctgcttaagtgtctgttccaacaaatgcttaagaagacactactggaggtgtactatcgagtactaccagcagcatctaaacttgaccacaaaaaaaaaaaaacaaagccct

SEQ ID NO: 14121 - DNA, 896 bp, Zea mays
gggacccgacgcggccacgccgggcccccccccgagaggcagacggcaggactcgcttcaagctcctcatctcgcgcagggggggtcgcctgaggtatcggtcaatcagtaatcaccccaaatcctagggttctagtcgcttctcgtcgtttcgttcgtagatcacagagacaatggtgaaggcagttgctgtcctcgccggcactgatgtcaagggcaccatcttcttttcacaggagggggatggtccgaccaccgtgactggaagtatctctggcctcaagccagggctccatgggttccatgtgcacgcgcttggcgacaccaccaacggctgcatgtcgactgggccacacttcaatcctgttggcaaggagcatggcgcaccggaagatgaggaccgccatgccggtgatcttgggaatgtgacagcgggagaagatggtgttgttaatgtcaatattactgacagccagatacctcttgctggaccccactcgatcattggccgagctgttgttgtccatgctgatccggatgaccttggcaaaggtggacatgagcttagcaagagcaccggaaatgctggcggacgtgttgcctgtggtatcattgggctccaaggctaaagcggttaacctccgaggcaaacaccatagaaggtcgaagcgagcacctcaggatgttgctgttccatttcccctgtattggcaacacaatttgagtactccaaataagcgcctgatccatgatcagagagcactattcatgccattttgtatatgaacaatgttgcgcacctgcttaagtgtctgttccaacaaatgcttaagaagacactactggaggtgtactatcgagtactaccgccagcatctgaacctgccaagcggccc

SEQ ID NO: 14122 - DNA, 2785 bp, Zea mays
  misc_feature (862)..(862): n is a, c, g, or t
  misc_feature (2591)..(2591): n is a, c, g, or t
ttcgatgtgatgattgattcatcccatgtttctgttcgtccttttcctcgtattgctactccggattgagccaaaccctaggccgtggggggctgacggagggcgcggcgagcgggggctccactatcgatagcatgcgtggcgggtactctggccgctgtggcttcgctggcggccggcatagcagcagccgcagcaacgatggcaggggataccacgggaacccttgcttgacgatgcaccaaccgtgggcgtccctgctggtgcacggcatcaagcgtgtcgagggccgctcatggccatccccaatcacaggtatcttttttccccacctttaacttggatctgaatgagtaagtaggattttcagttccaattccatctcttccctcccaggccgcctgtggattcacgcagcatccaaggttcctgaccccgacactatcaaagccatggaggatttctacagggagatttatgccgtcgatggcatcactggcatcaagttccctgatcattaccctgtctcacgcctccttggtaagcactcgtatgcctttgtcttctctcccagttactgtatactagtactatataggacacggctgctctgactacttcctccagtcacaaatgtaatccatccggagttgttcttttccaactttggcatagcatcttgagtgaaaagagtgatatgttatgaaagttttttcccagactgaatctgaatttcaatctatataaatttttttgaattttgatttgatgcccaaagttaaattttttaccctggataaatctagatggagttatatgtacgaccagaggaagtgcatgacatttttttgaagttgttggnttgggacatgaaaaattgcgactcatctcctgccattttttttttgcttttatgtgctaataatatatgctctgccacaggctgtgttgaggtggtaggctgcctcaggtctgaagagcttgtttgctgggaacatgtgcctgagtctgtatgttctcttactcgcctatttcccttcctttgctccagtagcattttacctgcaatgcatttcatttagctcatgatgcaacatcctactctcaaatgcaggtcaggcttgaagggctgactgacttttgttggctctgtgaaaatccacaggtcagtttgacatactaccctgttcctcatccctaggctctagctagcacataccataaccgctgccatctttgtttgtccgtgatattccgtacatgaatttatgcagaagttggtggttccattcgagatgcgtggttaccagggtgtctacaatttagaaagaagggtgagttcagtcctggttggaagcagttcgtcccatttccatattttgcttgtactcataactctggaatctgttctgcttgccgaaagaaggatctatgatggggctgtgaggggcctttcacctgttcaaggtccactgcctgtcaagttctctcttccagatcccagagaccccttctccttgaagccaggatctcttacatttgctgcttccaaacccacgctgcaaaaatctgaaagtgttgccgcagcaataaccggggctcgagctgcagccactcaattctcaaagaaggatcgcaaagctgctgctagtagtgaaattggtacagaagagcaatcctggggaagccatggcggtagcagttcagttgattgcaatggtctgtccattgtccatggcagctctgcgcatctacagaaccagaatcagccttcaattttcccgagcactccagcgaattcccaaaatccaaattctgagcctcggagaagccctagactagaatttggagcttccaatagggtgagtattggatttatttttccgtccagtttcaatttttagttacattagagaagtgggtcagtggtggagatgtgacttcgtactagaattcagctggcaggggtgttgcaacgaaatgaatggcaaaccgctagaacaaattaggcaggcatgtttatttgcttatcatggctaacctatttgtttgtgataaaaatctgacactaacactaataggtgactgattattagcttgttgcggtggcccgctgcgagctgaagcagttaagcttgagcaagaaaggaacaggacaagcagttcccagaagctgaccaatgcaagctaacaagtagtaatgcttgtcatagcccatagggcgagagagtgtgtttgtagaaagatgggtgatgtttgcagaattcatggtagcttgtaattaagtatatgctccagtgctggaagtgttgccattgtgtgaattattaatgcttgtcgtcacacgtacgtacgctagcagtgtcatcgctgaggcgggctcttttggcatttggttgtcataggacctacccggctctgacctatatgctcttaggaattttcttaggagtttgtttgtaacgacagaatgggatggaatatgacgattctttaaataaggttgtttgattaagatattggaataagactatcttagtgttgtcttcaattgtttctaaaaattggagcaaggagataggacgccgggnatgtccttgtcctgtctgtccctagttatcctgcaactaaatgcatccatagacaacaaaggaggtctaggttcatgcaccacctgtatttgaggatctcttccgatgaggctgtggctaacaatcgtgtatatggcagcaccacctgtatttgaggatctcttccactgaggctatggctaacaatcgtgtat

SEQ ID NO: 14123 - DNA, 1557 bp, Zea mays
actaatttctttgtgtgccgattcgattcgatgtgatgcattgggtccctccatggccgcggttcgtccttttcctcgtattgctactccggattgagccaaaccctaggccgtggggggctgacggagggcgcggtgagcggggtctccactatcgatagcatgcgtggcgggtactctggccgctgtggcttcgctggcggccggcatagcagcagccgcagcaacgatggcaggggataccacgggaacccttgcttgacgatgcaccaaccgtgggcgtccctgctggtgcacggcatcaagcgtgtcgagggccgctcatggccatccccaatcacaggccgcctgtggattcacgcagcatccaaggttcctgaccccgacactatcaaagccatggaggatttctacagggagatttatgccgtcgatggcatcactggcatcaagttccctgatcattaccctgtctcacgcctccttggctgtgttgaggtggtaggctgcctcaggtctgaagagcttgtttgctgggaacatgtgcctgagtctgtcaggcttgaagggctgactgacttttgttggctctgtgaaaatccacagaagttggtggttccattcgagatgcgtggttaccagggtgtctacaatttagaaagaaggatctatgatggggctgtgaggggccttttacctgttcaaggtccactgcctgtcaagttccctcttccagatcccagagaccccttctccttgaagccaggatctcttacatttgctgcttccaaacccactctgcaaaaatctgaaagtgttgctgcagcaatagccggggctcgagctgcagccactcaattctcaaagaaggatcgcaaagctgctgctagtagtgaaattggtacagaagagcaatcctggggaagccatggcggtagcagttcagttgattgcaatggtctgtcaattgtccatggcagctatgcgcatctacagaaccagaatcggccttcaattttcccgagcactcaagcgaattcccaaaatccaaattctgagcctcggagaagccctagactagaatttggagcttccaataggtggcactgagtgaactgaagcagttaagcttgagcaagaaaggaacaggacaagcagttcccagaagctgaccaatgcaagctaacaagtagtaatgcttgtcatagcccatagggcgagagagtgtgtttgtagaaagatgggtgatgtttgcagaattcatggtagcttgtaattaagtatatgctccagtgctggaagtgttgccattgtgtgaattattaatgcttgtcgtcacacgtacgtacgctagcagtgtcatcgctgaggcgggctcttttggcatttggttgtcataggacctacccggctctgacctatatgctcttaggaattttcttaggagtttgtttgtaacgacagaatgggatggaatatgacgattctttaaataaggttgtttaattaagatattggaataagactatcttaaaaaaaaaaaaaaaaaaaaaaaaa

SEQ ID NO: 14124 - DNA, 3584 bp, Zea mays
tccatatccactctccaactaaaacaaaggaatatggtgaagacttacttccttttgtgctggatgcattgagtgagatagcttttcatccaaagttttcttcatctcgtgttgagaaggagagaagagcaattctttctgagctccagatgatgaacacaatagagtatcgggttgattgccagttgttgcaacatctgcactcagaaaacaaactgagcaacagatttcctattggacttgaagagcaaatacataaatgggatcctgataagatccgcagatttcacgagcgttggtactaccctgcaaatgccactttatatctggtgggggaaattgatgatattcctagagctgtgcgggaaatagaggcggtatttgaacacactctttcagaaaatgaaggaaatcctgtaccgagcgctaatccatttggtgctatggcaagcctttttgcaccaaagctcccaggtggttttacttcaaacctaactggtgaaaaatcacctgccacagataaaataaagcctgcaaaaagggaaagacaagcagttaggccacctgtagagcataagtggtcccttcctggagttgctcaggatgccaaacccccagcaatttttcaacacgagttgattcagagtttctctatcaacatgttctgcaagatacctgttagcaaagttcagagctacaaggacctgcgcagtgtactcatgaaaaggatatttttgtctgccctacattttcgaatcaatacaagatacaagagctcaaaccctccttttacttcagttgagctggaccacagtgactctggaagggaagggtgcacggtcactactctcacagtaaccgctgaaccccaaaattggagaagtgccatcaaagttgctgttcatgaggtgcgaaggctgaaagaatttggtgttacaatgggagaaatgacccgttacatggatgcactgataaaagatagtgagcagctggctatgatgattgacagtgttccctcagttgacaacttggacttcatcatggagagtgatgcacttggccacactgtcatggatcagttgcagggacatgaaagtttgcttgcagttgctgaaactgtcacccttgaagaggtcaacactgttggcgcggaagtattggagttcatttcagattttggaaaactcaatgctccccttcctgctgctattgtggcatgtgtcccccaaaaggtgcatgttgatggcgcaggtgaaactgaattcgagatatatccagaagaaatcactgaggctatcaaggcaggtcttgaggaacctatttacccagagcccgagcttgaggtgccaaaggaattgatcactcaatcaaagctcgatgaactgaaattgcaacacaatccatcatttgttcctttaaccaaagaggagaatgcggtgaaagtgtttgacagtgaaactggtatatcacaacgccgtctttctaacggaatttccatcaactacaagattacacaaaatgaagctagggttggtgtcatgcggctcatagtagggggagggagagcgacagaagattctgaatcaaagggatctgtcattgttggtgttcgttccctgagtgaaggtggctgtgttggtaacttttctagggaacaggttgaacttttctgcgtcaataaccttatcaactgctcactggaatcaaatgaggaattcatatttatggaatttagatttgctttaagagacaatggcatgcgtgctgctttccaactccttcatatggtccttgagcataatgtatggctagaagatgcatttgatagagcaatccagttatatttgtcttactatcgctctatccccaaaagtttggaacgttctacagctcataagcttatgttagccatgctaaaccatgatgaaaggtttgtagagccatcgccacattcactgcagaagttgactcttcagtcagttaaagatgctgtcatgaaccagtttgtgggtagcaacatggaggtcagcattgttggtgatttcactgaagaagaagtagaatcttgtgttcttgattatcttgggactgtgagggcttcaagttctccaaccatagaggagcgtattgagaagatttcctttcgaccatttccatcagatgttcatttccagcaagtatacataaaggacacagatgagagagcctgtgcgtatattgcaggccctgctcctaaccgttgggggttcgctactgaaggaaatgacctatttaatgtcattcagagatctgacgctgatgcagaaatatctgaaccagtaagcttggatctaacagggaagagacacatcaatgttcgcagccaccctcttttctttggcatcactttgagtctgcttgctgaaattatcaattctaggctatttacaacagttcgagattccatgggattaacatatgatgtttcttttgaattgaacctttttgacaaattggatcttggttggtatgtgatcgcagtcacttcaactccaagcaaggtccataaagctgttgatgcctgcaaaggtgttctgagaggattgcatagtagccgaattgtggaaagggagctcgatcgggcaaagaggacactgttgatgaaacatgaagctgagacgaagacaaacgcctactggcttggtttgcttgcccatctacaatcttcatctgtaccaagaaaggatgtatcatgcatcagggaattgacgacattatatgaaagtgccacaattgaggatctgtatcttgcatatgagcatctgaaagttgacgattcttctttgtttgcttgcattggaattgctggcgctgaatctggtgaagatacaaatgatgatgagcttgatgtggatcttcatggcatggctcccatgggaggccggggtctttcaacaatgaccagaccaaccacatgatcaccattgggatggccagcccttccaaggtgacatattaaatgctgtgttactgcatcatggacaagttgtgctgaaacctactcggaattggttgtggatctttatatggattttaaccttgctcctgaagacaggagccacatggccctaggagactattctcgtttcccagcaaaacggtttaaagataattgaaacattggatctgtatctggggagactattgtttgtttcctatgagccacaaccaaaaagcttggccgttgcatttccccccgagaagaagcgttggagttaatgactcgcaaggtcgtggaaaggagataatatttttcgaggtcattatgtagcttggcatgtacaggaaagcaggctgattcttgcatacagcagttgtaactaggtcgttgagggcattgaagataggatgccagtagaatcacatataagttgctggtctgcgaattcggaaataatgatgaaggcgtaggctagtaacattttggtgttattctttttttttttaatcaaaaaattgtagcctttgttaccggtaataaatagatccatagctttgatgttgataaaaaaaaaaaaaaaaactcgagggggggcccggtaccc

SEQ ID NO: 14125 - DNA, 1880 bp, Zea mays
cggacgcgtggataaaccagcaatcgcatattcgcttgcctttcttgccctacgccgccagcttcccccccgagccaccaccctccacttctcaccactgccgtctccttcccaaacccggctgccgtctcctttgattccacggcctgccacgcagcagcagcaaaactcctagtcaacccttcaactcgcctactactcctactagccccttcttttcttcgatctccgcaatctacagctttgcttctcccggctcgagcggctagggtttcgggagtgcgcggtgagacggcatgacaacgcggggagctaagcgcgcggccacctccgaccccgccgcacccgatttaccaagtaagagagtaatggacggaccctcttttgatgttcacagggcggagtcttcccatcagcatgtgatggcaggacccgctagtttagatcctcggcgggcggaggctgctagcaaacatgtgagggcacttaatacccagtttgcaagctgggttcaattgcagctgcaaaatcatccagctgaactttgggaggacggccttaaggattacatatcacatgcttctgaaatcatggaaaaattcaaggatgttgtcaactggctaaggcaaaatcaagcaggttcaatagttgtttcatccccaagctcactgaaggatgataagtccaatctgccagcagcagatgatagcaaactcttagtacagccaagttcagataacaaacagaaggctccaattatggcttctagttcttcatcttttcagaactcaagcttaccgaaccttttttcatcgccttctcagcaaaaaacaccagattacagtggtatgtttgctgacaagaagaacacgtccagtgatagcagtaaaccacctttccagtttggtggaaataatgtcatatttggtggcaagaaggatgcacctggtgacagcagtaaacctttccagtttggtccgaataatggcatatttggtgacaaggatactcccagcgatagcagcaaacctttccattttggtgcaaacaagggcatatttggcgacaagaagacgacaagtgttgcccaaagttttaacccacagagtccacctctgttttcaatgaatcaacaatcagtcctcccaggaaaccaaaatacttctgaagcttcagctgacgcagatgaagatgctgaacctgagaagccaagcagcccttctgtaaagaaggcagaagagaagggggtagttgttgttcatgaaaccaaatgcaaggtgtatgtcaagcatgatgatgccactaagggttggaaagacattggtgttggtcagctctctatcagaagtaaagaaggcacagagaaagcatccaaagaatccactcctaccattgttataagaaacgatgttggtaaaatcctcctgaatgctctgatctacaaggggataaaaatgaaccttcagaagaatacggttgcttcgatatttcatacttcagatgcacaatcaagtgaatcagctggtgacacagttgtagctcgaacatacctgttccgattgaaaaatgtagaggaggctacaaaactatcgacagcaatcaaggagaatgcgccctcagactagttcttacggcatggattatcatctcgaatctctgcttttggcgcgagctgtaagatctgaaggggacaccaccgatggccactgcggcaggctaaaagatgccttgcagagattcttttctttttgttctcctagctgcatcaagatatcttgcttgtaacttgtaaggctgacaggctggttatgtattagtactttcatgtaccatcttttgcattgacaagactcttcagcatgcatacagcccatcatgtc

SEQ ID NO: 14126 - DNA, 1996 bp, Zea mays
gataaaccagcaatcgcatattcgcttgcctttcttgccctacgccgccagcttcccacggagccaccaccctccacttctcaccactgccgtctccttcccaaacccggctgccgtctcctttgattccacggcctgccacgcagcagcagcaaaactcctagtcaaccccgcgacccgccccctgctcatcctagcccaaaactttttttcttcgatctccgcaatctacagctttgcttctcccggctcgagcggctagggtttcgggagtgcgcggtgagacggcatgacaacgcggggagctaagcgcgcggccacctccgaccccgccgcacccgatttaccaagtaagagagtaatggacggaccctcttttgatgttcacagggcggagtcttcccatcagcatgtgatggcaggacccgctagtttagatcctcggcgggcggaggctgctagcaaacatgtgagggcacttaatacccagtttgcaagctgggttcaattgcagctgcaaaatcatccagctgaactttgggaggacggccttaaggattacatatcacatgcttctgaaatcatggaaaaattcaaggatgttgtcaactggctaaggcaaaatcaagcaggttcaatagttgtttcatccccaagctcactgaaggatgataagtccaatctgccagcagcagatgatagcaagctcttagtacagccaagttcagataacaaacagaaggctccaattatggcttctagttcttcatcttttcagaactcaagcttaccgaaccttttttcatcgccttctcagcaaaaaacaccagattacagtggtatgtttgctgacaagaagaacacgtccagtgatagcagtaaaccagctttccagtttggtggaaataatgtcatatttggtggcaagaaggatgcacctgttgacagcagtaaacctttccagtttggtccgaataatggcatatttggtgacaagaaggatactcccagtgacagcagcaaacctttccattttggtgcaaacaagggcatatttggcgacaagaagacgacaagtggtgacagcagtaatccttttcagtttggtgcaaataatggttttccaacatccaatgcaccatctattttttcttcagttgcccaaagttttaacccacagagtccacctctgttttcaatgaatcaacaatcagtcctcccaggaaaccaaaatacttctgaagcttcagctgacgcagatgaagatgctgaacctgagaagccaagcagcccttctgtaaagaaggcagaagagaagggggtagttgttgttcatgaaaccaaatgcaaggtgtatgtcaagcatgatgatgccactaagggttggaaagacattggtgttggtcagctctctatcagaagtaaagaaggcacagagaaagcttccaaagaatccactcctaccattgttataagaaacgatgttggtaaaatcctcctgaatgctctgatctacaaggggataaaaatgaaccttcagaagaatacggttgcttcgatatttcatacttcagatgcacaatcaagtgaatcagctggtgacacagttgtagctcgaacatacctgttccgattgaaaaatgtagaggaggctacaaaactatcgacagcaatcaaggagaatgcgccctcagactagttcttacggcatggattatcatctcgaatctctgcttttggcacgagctgtaagatctgaaggggacaccaccgatggccactgcggcaggctaaaagatgccttgcagagtttctttatttctttttttgttctcctagctgcatcaagatatcttgcttgtaacttgtaaggctgactggctggttatgtattagtactttcatgtaccatcttttgcattgacaagattattgagcatgcttgcagcccaaaaaaaaaaaaaaggcagcaaagcaagtggcaatggttcaagtc

SEQ ID NO: 14127 - DNA, 2113 bp, Zea mays
gcaccagtccgttacccacaactgcccgtattgtttaacactatcccgcacggtgcgagaatatccaaaaatggacgccaccgtcgtcgccatcgccgacgaccttgatgactccgactgccgccgccccctgctcgcccagaacgaagagatccacctctacacagagccccctaaccgtcagcatcctcctctggatgctgcggcgacgcagctcgaggagcagcggaagccggagagagtggcctctctggacgtgttccgcggcttcaccgttgccatgatgatactcgtggacgacgccggcggggcgtggccgggcatcaaccacgcgccgtggttcggggttacggtggcggacttcgtcatgcctgccttcctcttcatcatcggcgtctccgccgcactcgtattcaagaaaatggcaaacaagacagctgcaactaagaaggctgcaattcgggcttcaaaacttttcatattgggtgtgattttgcaagggggatacattcatggacgacacaaattaacttatggtgttgatttggatcatattcgatggctaggtgtgttgcagaggatagctattggatactttgtagcagcaatgtcagagatttggcttgtcaacaataatttggtggattcacctgtaccatttgtgaagaaatacttcatagagtggttcatggccatagctattacagtactttatgttgccttggtatttggcctttatgttgcaaactgggaatttgaaattcaaactagcaattcaaccctttctatcccaagcaattcaattgaaacaaagatgatccaatgtggagtcagaggtagtcttggaccaccttgcaatgcagttggcttggtagatcgagttttgcttggtgaaaatcacctatataagaacccagtctacaaaaggacaaaggaatgcagtattaattctcctgattatggaccacttcctccgaatgcaccagattggtgcctggctccatttgatcctgagggtttattaagtacgctgatggctgtggttacttgttttgttggtttgttctttggacatgttttaattcattgcaagaatcattcacagcgaatgctaatatggctgctagcttctgtggtgctgacaatctctgcgtatttagtgctattattaggcatgccttttagcaagcctttgtatacagtgaactacatgctactcactggaggagtatctgggttcttgttgctgctgttgtactacatagttgatgttattcatattaagaagcccttcgtactattccaatggatgggcatgaacgcacttatagtctatgttctcgctgcttgtgagctattccccacccttattcaagggttttattggcggtcacctgagaacaacctggtggatgttactgaatccctgctccaggccatcttccagtcgaaacgatggggcaccttggtgttcgtcctcctagagatagtcttttggtgcttggccgccggcttcttgcacatgaaaggcgtttacttgaaactgtagaaccaaatcgtggacagttctctgatggaacggaattgacgtcctgcaaacattggtggaaggcccggtatccctgttttttctgtaaatgcaacgcgattctggaaccatgggtgtagcggttgattacaggacgttgtggtcccaaggtcctccaactcatccgcctccatgcacaccaggaaaacatcttgctgaaagtcacaagcgtttcaccacgtgaagacccagtctgatggtctttcagttgtttggtaaaactgtttctgttttcctgcagaaatcatttctagtttctagtgattttggaaaccaggatgtttctgtttatcacttgtaatcttgggtaaatctcaaaaacgtagtgtattttgctaatgattccacgatgaagtgagtgagtggacatgtacacagtagacagtatgaaagtatgtatgaaccgtcgatcaccgtataatccatctactccaactcattgcagtgaaatgctgtgttgtacctccaagttctggcctctcaggcatgtacatatcaatggaaaatgctgtaccgtttaatttc

SEQ ID NO: 14128 - DNA, 897 bp, Zea mays
  misc_feature (888)..(888): n is a, c, g, or t
accgcgtccccagcccaacccagagcattcttggtcccgatttcctcagctcaggtgccgggttccccaggcacaagctacaaaccctaacccatccgggagcaccggaaattttggaggctgaaacggaaaggggagaaggcgatgacgacgagggagccgcgcgaggcgtcccggcgcgatgggcgcgactcgcacgggaggcgcccccactcctcgttcaggtcgcggagggacgatcccagcccaaggagaagagatgacaggaggcgtgaatcggacagggcgcaccacagaagtcgagatggagaatttttggaggtggtggaccatgatcagaagcggaatagagatgctgcgcagagcgctgaccctccgaatgctgagtcgaagtcagcgagtgatatgaagaatggcccctccaccaggcatgagagatcacctaggggaaccaaacgattttctgagtcgagtgaggcatggcggcctcggtctttctttcagcacaatgagcgtggaagtgctgggcaaggtggtcggcattatgaccgccaggctagtgactatggaaggcaaagggagcatctctctgatagagataaacagaagacagagagacacagtttgcagggaaagattgagctggaccagcaaaagaaggatggtgattcaacatggaagcatgatggatttttccagttggaggaagcagcaccccttgccaagaagaggccaccatttcaggagatgaagatacaagaatctgctgacactgtaacagaaccagattctagatcaaggaattatcaggcacggggatatggaaatcatcgacccttcctaaggccaagatgatcgaggctttagaagggggtttcctgacacagnagtgatggc

SEQ ID NO: 14129 - DNA, 1417 bp, Zea mays
accgtcacggtcagccccagcccaacccagagcattcttggtcccgatttcctcaggtgccgggttctccaggcacaagctacaaaccctaacccaaccgggagcaccggaaattttggaggctgaagcggaaaggggagaaggcgatgacgacgagggagccgcgcgaggcgtcccggcgcgatgggcgcgactcgcacgggaggcgcccccactcctcgttcaggtcgcggagggacgatcccagcccaaggagaagagatgacaggaggcgtgaatcggacagggcgcaccacagaagtcgagatggagaatttttggaggtggtggaccatgaccagaagcggaatagagatgctgcgcagagcgctgaccctccgaatgctgagtcgaagtcagcgagtgatctgaagaatggcccctccaccaggcacgagagatcacctaggggaaccaaacgattttctgagtcgagtgaggcatggcggcctcggtctttctttcagtgggacttcttttatgacacattgattcaaatgcccactgtttgtaacaatgttagactacctgtgcttctatgtacagcacaatgagcgtggaagtgctgggcaaggtggtcggcattatgaccgccaggctagtgactatggaaggcaaagggagcatctctctgatagagataaacagaagacagagagacacagtttgcagggaaagattgagctggaccagcaaaagaaggatggtgattcaacatggaagcatgatggatttttccagttggaggaagcagcaccccttgccaagaagaggccaccatttcaggagatgaagatacaagaatctgctgacactgtaacagaaccagattctagatcaaggaattatcaggcacggggatatggaaatcatcgacccttcctaaggccagatgatcgaggctttagaagggggtttcctgaccacaggagtgatggccagaggaatgggcatgatataaggggaagattttctgttaggggaggaatggacagagacaggtttaacaatccatatggtgggagaagcaacgcagagcaggcttctggtgatcaagaagaaaaatggaagcatgacctctatgatcagacaaacaggagcccgcctccaaagactgaggaagagcagattgccaaagttgaagcgctgttggcactgtagctgtcttatttatgtctggagttgttttttgtgatagattatcatgtacttggtttcagatgtgttgaatactgtcttttttattctatatattctgcatatctatgtggaattgtggattaaaccaccttatgaagctattccatttggactgataatattgtactagataatcatgagtttcataatgtagaaccatcaagcgaagtccaggcca

SEQ ID NO: 14130 - DNA, 1646 bp, Zea mays
aactgggtagtaaggacaaatgttggttgtacaatagtgtagattcaacaaatgtttcaaaaacctggtataagatgtaaaacttttaaatgagattcatgacaacgtgaaaattaactaaaataatcaggtttcaatcaactgaaggaaacgtagaacgtgatatataatatactaaggtacaataatatctcgcagttcaaaattttgagtagatagtacaaaattactggactttcaatgcaatagatccgactaagacataaaatagagttaaattcaagcaagaattttccatggctgtccatagaacgaagggtagttatctccctcttaagaaccaatggctatctccctctcaagaaccaatggctagaatccttgtaattttttgtgttgtttctttgctttcctgtttcctaatattgtactatgaacccagggaattttttgtctgttcctaataatagagcaggaaagggaatctctatcctttgtttttctcagctatgtctttttttcttttccaatttttattttggtctgtcattttggatcactgcagagggggtaaaaaacattatttgaaaccatgtggaaatgcttgtgcattgcactgagaaagaatgatgtggcatttttttttcagttttacttagatgctgaaaacctgaaaccttcgagtgattatttgcttcatgttgtagtatggttgttggcctgttgctgcccatgtccattggcgtatcacgtatggctatttgctttgttgaaagcctgaacctaaagccatgtccatgggcgtgtagttattatatatatgaaggttgatcggttcctatagctctggacgatcaggatgtccgattgaccgatcagagcccggttaatcgggctggtcgccgacaaatcgtgattagtcagctgatcgcccctctggcgatcaggagcgatcagccaatctgaaaacattggtttgagcctaggaagctgcaactctataatacaggtctcgagcagcccaaaatgcacagaactgggattcacagtttgaatgaaagtgacagagttcacaacaaagctatatataactagaaaaaccaaagcagcctataatttgggacagggagtggtagtagtaaaaaaactaaaaaaatatatgtagaaggcacatactctctggccatggcaactaagaaaatctcctgcatggtctgctttcaagtgagatagagcagacttgagtgccttcctcgcaaggtatctttcttgttgagatccctgctgttcttgcatagcagtggctagagaaaatcaaggatcgacagaaaatccaccttctacatataaattgaagctttcattggaaaaaaggcctgtgaatgaccaaaagagtatgcagtgcacagtgtggaaactggatatcattcatggtaagtgtgaatagcaatatgccaataccaatacgagcaaatgtcatactatcccactcaagaaaagcatttccttcatcacccagcaaacctccttttaacttgaaaccatagctttgccggtctgtgctcatcaacacatcaaaagaggactgtgatatctgacaaggtacaaaatcttcaaagtatagaacctacaattgtgcaaccaac

SEQ ID NO: 14131 - DNA, 1003 bp, Zea mays
ctaaagacctgtgccatacttgacatttgatgaggcagctgaacttgcctattttgagagcgccgggtcagctacgtaggccccccccgccagctagagaaggcgatgtacctgtgagggttaagaattcttataaccgtcgagcccctggtacccttatcactaaagcaagagatatgagtaagactgttttgactagcattgttttgaaatcaaatattacaatgcttgatatagtcagcacacgcatgcttggccagtacggttttctagctaaggttttttcgatatttgaagacttgggcatctctgttgattgtgtggctaccagtgaagtcagcatatctttgacactggatccatcgaaactatggagttgtgaattggttcagcacaaaaatgaacttgatgatgtcattgaagagcttgagaagatagcagttgttcatctactgcagaacaggtcaataatatctttaattggaaatgtgcagaggtcgtctttgattcttgaaaaggctttcaatgttctacgaagaaacggtgtcaatgtccagatgatatcgcaaggggcgtccaaggtgaacatttccttggtggtccatgacagtgaggcaaaacagtgtgttcaagccctccactccgcgttctttgagaatggtttcttgttggaagctgatgagttggatgttctgcatgatggctttacatcgcattccaatggcacaatccacagccattagccgaggatttgatattcatctgtttggctactgtagtgccacttgtgatcaaatcctgatctttggtcgatatctaatgtttttatgaggctacgaaggattcggctttagagctactacccatcagaagtctaggaatttgttcagagctactacttaggattttgtttagagattaatgatactgtttggttttttgtacaattgattgaaagtatatacttagttatcttggcaaaaaaaaaaaaaaaaaagcggcc

SEQ ID NO: 14132 - DNA, 2239 bp, Zea mays
aggaaccacttcacactactctccgcggctctgccgtccgttctcctctcgccgccgccggccgcgcctccaccctcgcggcactcgcatggcggcgccggctctccgtatcactgcgcggctgggacttgcacttgacggtgccaccgccgcgagacggcgcgaggcctcggcgcctgtggcggtgccggccgcgccgtggctgaagaaggcggcggtccggtgccagcgagccgtcggtgccgctgttgccgagaagaaggatgcgccggtatcggttgcgcaggagagaagcggcgacgggggcgcggcgccggagctcaccgtcgtgatgaagttcggcgggtcgtcagtggcctcggccgagcggatgcgggaggtggcagacctcatcctcagcttccccgaggagcacccggtcgtcgtgctctcagcgatgggaaagaccaccaacaaactcctcatggctggggaaaaggcagtgggctgtggtgcgaccaacgtctcggagcttgatgagctctcctttgtaaaagaattgcatcttgggacgcttgatcagcttgggctagatagatcaattgtttgtggtttgttggatgaacttgaacaacttcttaagggaattgctatgatgaaagagctgactcttaggacacgagattatctagtttcatttggtgaatgcatgtctacaagaatatttgctgcacttttaaacaaaattggagtaaaagctcggcagtatgatgcatttgatcttggctttataactaccgatgatttcacaaatgcggatattctggaagcaacttatcctgctgttgcaaggaggctacatgtggaatggattaatgatcctgctatacctatagtcactggctttcttggcaagggatggagatctggtgcaataactaccttgggcaggggtggtagcgacttgacagctacaaccattggcaaagccttgggattaagagaaattcaggtttggaaagatgttgatggtgttttaacatgtgacccaaatatccatcctaaggcaaaacctgtgccatacttgacatttgatgaggcagctgaacttgcctattttggagcgcaggttttgcatccacaatcaatgcggccagctagagaaggcgatgtacctgtgagggttaagaattcacaataccatggccacagcggttagaaaccagaagctactaaggttggatatgtttttaacatactgagtggatcatgcatcatagtatttcttatattcattgacttagacacttagtgctatccaaactgaagcaactaaagctttccaattacttcatataacaccacgaaaataaatttccagaagtttggcagtacctttaactccccactcttgtgtttcctgtaaacttctttagctatgtcctttgaaacaatatatcctggtccatgcgcccagggaggataactctcctcaggccattcctaactcaagtaaaacagcagttattacacttgatccaccataccaaatgacagaaaccagaactaaattattgaaaataaggcagcaacatatgcttaaaaacaaatgtgctaataagcatagtaacaaccaagcactaattagtgctccaacagtatgcaggtgcttagcagctttgcatgtttcttatacatccatgcaggagcccctaacctcctaatgatgttttttatacaaaacttgagctgcttaagcgagcacttatttaacgtatcaatccatcatttatggaacaaaacacatggcagagcaatggtctagaggaagagccatttcgtgtatacaaatgatattttgcagaatctcttgatataacgtatagcacttgtggtcttaaacttgttctgggtgtcatttaggtccataagtgtatcacatgaggtctaaatcaccctaatcaacatataattacgtatgtggtagtgtcactcttgcctgaagtctgagatatccccgttgtctactacatgctcatggccatcgtcgctatcttgtattgtgcatataaatttaccttgtaccattttgtatgccacatagactaagtttgtgctgattagagtgatttgaactttgagtagcacatttagcaattttagggggccatgtgtgcgttttaagagtttagtacacatagtcacatacggagcaagtttaatgacaattgacgtattttactgaaaaaaaaaaaaaaaa

SEQ ID NO: 14133 - DNA, 1596 bp, Zea mays
attcggctcgagccaaggcgtccgaaatccctgagctcgctgtcatcaaggacctgcatcttaggacggttgatgagctcggtttagataggtcgattgtttcaggtttattggatgaattggagcaacttcttaaaggagttgctatgatgaaagagctgacccttaggacaagagattaccttgtttcctttggtgaatgtatgtcgacaagaatatttgctgcatatttgaacaaacttgggaaaaaagcacgccagtatgatgcatttgatattggctttataaccaccgatgatttcacaaatgcggatattcttgaagccacttaccctgctgttgcgaagaggctacatgaagactggatggatgaccctgctattcctatagtcactggttttcttgggaagggatgtaaatcatgtgctgtcaccactttaggcaggggtggtagtgacttgacagctacaaccattggcaaagccttgggattaagagaaatccaggtttggaaggatgtagatggtgtgttgacatgtgatcctaatatatatgcaaatgctatacccgtgccctacttgacttttgatgaggctgctgagcttgcctactttggtgcacaggttttgcatccccagtcaatgcgaccggctagggatggtgatattccagtgagagtaaagaactcatacaatcgtcatgcacctggtactgtcatcactaaatccagagatatgagcaagagcatattgactagcattgtgttgaaatctaatgttaccatgctggatatagtgagcacaaggatgcttggccaatacgggtttttagcaaaggtattctcaatatttgaagatttgggcatctctgttgactgtgtggctactagtgaagtcagcatctcgttgactctagatccatcaaaactatggagtcgtgaattgatccagcaggaacttgatcatgtcgttgaagagcttaaaaaatttgcagttgttcatctgctgcaacgtagatcgatcatctcactgatagggaatgtacagcgatcgtcattgattcttgaaaaggcattcaacgttctgcgaagaaatggtgttaatgtccagatgatctcacaaggggcgtccaaggtgaacatttccttggtagtcaatgacagtgaggcaaaacagtgcgtacaagccctccattcagcgttctttgagaatggcttcttgtcggaggtagagggagctgacgttccccagaacggagcctctctgaactcaaatggcgctgtctatggaaactagtcgactctgcaactgctttcttcacaatttgtgtaccattggtaggttgaatggtggtgattcatagctatttatttagggcatcagtcatgttggtgcaaattttcttgatgtgttaagagcttactaccagaacagtctgcatggtataccgtgcgattgggtgctaccaagtagtagccattgtcaatgtcttggggatttgccacatgtttaaggcatacccaggcttatatgtatctgagttgtattgtatgtgagaactattaagagaattgcttgcaccctttgggtggtgatt

SEQ ID NO: 14134 - DNA, 1741 bp, Zea mays
tatccactattgctggtccctaaaaaatatttatctatttcttgctctcgccaagcagcacgtaacttaaatcaataatcaaagttacaatgccaaacaactacatccaaattatttaaccaagattatataatctaatatataatctatattatataatgtataagctgaaactaactatatcataaatcatgttatctaagcataaccgatacctcactattacctgtgtctaatctgttgcgattaaaaaacggaatcactatcatcttcaggatcggatcgggacgccgttactccttgactctatcgttctgcctaccccaacaggccaactcaacactcgagtactcgacaccgcccctctgatatggctcaggcacgcgtgcgccttactccggccggccgcacgccggccgccacgttcctctcgggctccaaccccagacccgcccacctcaccttcttcccgaagcttacccctacctccctctccgccgccgcagctgccaatgcgccgccgccccacatcgtcgtcgtgggctccgccaacgccgacatctacgtcgaggtcgaccgtctcccgctcatcggcgagaccgtggcggcccgcgcgggacgcagcctcgcgggcggcaagggcgccaaccaggccgcctgcggtggccgcctcgcgctgggccctacctacctcgtggcgcgcgtgggggatgacgccaacggccgactcctagagggcgccctagccgacgctggtggtgtccgcaccgaccgcgtcgcccgcgcggccgatgcgccatcgggacacgccgtcgtcatgctcatgcccgacgggcagaactccattatcatcgtgggcggggcgaacatggagggctgggcggcggggatcggttcggaggacctggaattgatccgaaaggcaggcgtgctgctgctgcagagggagatacccgattgggtcaacgcgcaggctgcccaggtgctttttacctatcttagattggtttggcacacaaattttctttataataaaaaaggtactgtccgattatttttgatatgatagggtaatgcagcttggagcgccacagtttagggactgttttaaacccctagagctaagttgcattgaaaggataaggggcgatactgtcttgctgattttagttggcccaacccagctaatgaactaattgttagtcgggggtccagctaacaattagctgaagctttagctggactgtttggaacccctacagctaattttagctactagcaattatctgtataggttccaaacaggccattagttatgctgtaactttttaggcagctgtttggtttcttaccataattatggtgtgccacactctcatagccccctgccccacacgtgataggcttactttcatgccaaactttgattttgctggccacacattttgtagcaaccacagtttgccaaaggtcaggcgtggcaaactacagcatcaaccaaagatgagatatatatatttgagaatgaagcagcaatttactgaatgttttcattatttgatgtttcagtattcggttttcgaaatttggggagatatagtggctgtgtcatgtggggtcaccactacactcacaagcgcgacgccaggaacatatccagcatgatgtaggcgtgatctgcactatgtcatcatgcagatcaccatgcagcgggactaggcacgatctggcacaataaacg

SEQ ID NO: 14135 - DNA, 1484 bp, Zea mays
aactcaacactcgagtactcgacacagcccctctgatatggctcaggcacgcgtgcgccttactccggccggccgcacgccggccgccacgttcctctcgggctccaaccccagacccgcccacctcaccttcttcccgaagcttacccctacctccctctccgccgccgcagctgccaatgcgccgccgccccacatcgtcgtcgtgggctccgccaacgccgacatctacgtcgaggtcgaccgtctcccgctcatcggcgagaccgtggcggcccgcgcgggacgcagcctcgcgggcggcaagggcgccaaccaggccgcctgcggtggccgcctcgcgctgggccctacctacctcgtggcgcgcgtgggggatgacgccaacggccgactcctcgagggcgccctagccgacgccggtggtgtccgcaccgaccgcgtcgcccgcgcggccgatgcgccatcgggacacgccgtcgtcatgctcatgcccgacgggcagaactccattatcatcgtgggcggggcgaacatggagggctgggcggcggggatcggttcggaggacctggaattgatccgaaaggcaggcgtgctgctgctgcagagggagatacccgattgggtcaacgcgcaggctgcccaggctgcaaaaagtgcaggagtgcctgttatcatggatgctggtggaatggatactcctttacctcgagaactactcagtctagtggatattttcagtccaaatgaaacagagctagcgcgtctgactgggatgcctactgagacgtttgaacagatcagcatggctgcaggaaaatgccataaaatgggtgtgcaagaagtactagttaaacttggatcacaaggatctgctttgttcgtcgagggagaggagccaatcaggcagccgatagttcccgccacagaagtcattgacaccacgggggctggtgacacattcacctcagcgttcgctgtagccctggtcgaggggaagcctaagagggagtgcatgagatttgctgctgctgccgcctctctgtgtgttcgagtaaagggggctatacccagcatgcctgacagaaaatcggtgatgaagcttctggaatctgtgggagtcgaatagccgcaaaatgtggcgttggtcgtgcgaatttacagagcctcgtttcggcggcgatagagtgagcaccttggtactccttgccttctcattctcttgtctggtctggtgcacatttggaagcatgtagtgcgatggtagtactagtataggaaaacaggaccttgctgcttttaagtccctacttttttttagtgtttcctttcttttgagtaatagcacttactagtttcacgcaattcccatgccctcgacgtcctgaacattgctgttggcggcctacctcgttaaagattggagtagattgagggagattaaatctctttatatttaattttgaaaaaaaaaaaaaaaa

SEQ ID NO: 14136 - DNA, 1829 bp, Zea mays
ttttttttttttttttcggtacaagactcaaaatcgggacttattattatacgcaataatcagtacagggaagtaattaactgttcgacgcagatgtaacttttcaatgacaggcactggaagtatcataacaagaacatggtacagaatcacaactgggatttgtgctatctgcagtagccagtacagaatggtaactgactgtctgacgacagattaaagaactacccagtggatttctgcggcgataacatcttgattctcctgctgatattctgcatcacgtcaacgatcgtgaacttcttctgcaatctaaactggacggccagttgcgtgataagaggcggcccaccgcctagaatggcctggtcgtccattatttttgtgtgaaagtgttggagagcaatcgcgcaaagcgcaagaactgtccggagtgctgatgcttcaacagtgggacctaaaggaacttgcacgtcaagagacatcaatgtattcaggtcatgcttgtgcacagcctctggatcatcggcaagaagcacccttagagcagctaacaggcgtccatcaacaacgtcagggcctcctaagctcacctttaaaacggcaccctctccatgtaggtttagctgtgacaatatatcttgttgccacttggctggcgctgaaaaattgggagaagagactccagctgccatgcttgcagcatcaagaagggctccatcgtaacttagttccacttgatcgtaaggattctgtgttatcacaaatccataatcaagaagaaagaaatcatttgggtagcagccatagttcagtgttattgcttcattttgcttaatcttcttctcagcaagaacctttactgacatgtctaagctgtttacacttctttcctggacaatcctagcatttgggttgaaactatgattgcacatatcaataagaggcaacaacattgggacttcaccatgcaaacggaatgcacgagaagaggcagctgacatagcccatccaagggaagatgaatttacatcttgtccataaaaaggatgatctaccaagggcacagtatgaagcttctgctgtacctctttctcaaactcgaggagaaaacgacatcttttattgacctggtggaggataggggcatactgcaaattttttatgtcttccccaggaaagaagattggaacagtaaatgtctctggcaaattggcaatatatggccaccaaaatgaatcagatttggccctttcttgaagcaacctcaagcccagcttcatagcccatagttcatccgggacttgttgggcgagctgcacaagcacgtcgtccgcggcactggtgggccggcgtagtcgtaatggaagctggctcgggagcgcgatgaggacgtccccaattgggatgtcgccgtaggccgcggcggaagaggctgagatcccgagcccgtgttccggatgattcgctacgcggagggcacggtggacgaatccgccctcgcgctgcacccaccggaccaggtccggcggctgcggcgcgaggcgcgtggcggcggtgaacgcggcagagcaggagaggttgcggctgcggatgctgctggccctacgtgagagtgacgatgagaggagagtgactgtagtagtgaagagggccttccttgcagtcgccggcgtaaaccccgcggcggcggccgccatggggacggacgcgctagctggttggatgcggagagggcaactaggtccgcaccagtatacgataagaccagatgggaccgaaactaaccgcgtttttcgattaggatgttctaggtaatggtctcgtgc

SEQ ID NO: 14137 - DNA, 3771 bp, Zea mays
tgcatgcctgcagatttaaactacacctactcatatacttactagggagctaattctaacaattttgggttcattccaacaatttaaacatatccacaagccccgcaacattgttataagcatgaggattcagttagtgatttcacattttgttcggggactactcctccgaaggtcctcaaaacacttacccagtaacagttttttattttgtttcaaaagcagaactaatgccgaaggtggccttcaatcggagttatcaatatacacattccagaaagaggaagcttcgaacaaataaccttgtgctcatgaacgacgaagcaagaaagtaccatagggcaccttcggagtttagtctacaagtcgaaagagggaaaggacagcttcgcccttggcatgtaaaataggctaaatgtataggcctaaggtcacaattgtaatttcaccaaagttgtaccccacgactataaaatataaatagaggaacaatgctatgtataagggacctttttcgagccttgagcactagatcgctcaaccttcgaagataccttcaggctctagcttgtgtaaagccgaggaacacttgtaatcggaatgaaataaatgcaaatgtatacatctagatgagtgatatattttgctcttcatgatttacacaatgttttcattacctatattgcaatatcttattaccttctccctttaatagtcgtagaagagttagttaaaaggagatgcttctaatttaataacttgtggtggcttattttttatatcttttagagatcaaaaacgagtaaccaacacagttgatggcttccaacaccaaacaagcccataaaaacaattcagggcaaaccctggatgacataatctgatattcaaaattgacactcttatattacaacaacattatcatatactataacagaaaaactgttccctgctccccagtgagaaattcaatcgtgacccagtgtataaattagcatgaaagctcatttcccagtcacttcaaaatcattatagaggctcaaagcattagcaaccactaatcagaaaggacattacccgggacttgttgggcgagctgcacaagcacgtcgtccgcggcactggtgggccggcgtagtcgtaatggaagctggctcgggagcgcgatgaggacgtccccaattgggatgtcgccgtaggccgcggcggaagaggctgagatcccgagcccgtgttccggatgattcgctacgcggagggcacggtggacgaatccgccctcgcgctgcacccaccggaccaggtccggcggctgcggcgcgaggcgcgtggcggcggtgaacgcggcagagcaggagaggttgcggctgcggatgctgctggccctacgtgagagtgacgatgagaggagagtgactgtagtagtgaagagggccttccttgcagtcgccggcgtaaaccccgcggcggcggccgccatggggacggacgcgctagctggttggatgcggagagggcaactaggtccgcaccagtatacgataagaccagatgggaccgaaactaaccgcgtaggagtttcatctatctggcgggtcctactcctatataaaaacgcgcgcgaccccctcccagggccgtcaatcaaattcaaagctgtcgcacccggccggcaatgggtctcgtcgtctccgccaccgcgtcctgcagcgatatcttcttcagccgacgccgctcctcaagtccgcctcccccagccgcggctagcactcccccgcccacgtacacaataccggagccggccctcgtccgcgtgttccgccacttcgacgcggacggcgacggccgcatctcggcggacgagatgcgcgagttgtgcgggtgcacagccgtggaggcagacgagatggtagctgtcgcggaccgcgatggagatgggttcatcagcctcgaggagctcgaggcgctgtttgaggacggcgaccggtcagacacgttgcgcgctgcgttcgccgagtacgacgagaacggcgacggcgtgatcaccgcggaggagctgcgccgcgctctgtggaggctggggatcgtcggggaggagatgacggccgagcggtgcgcagagatgatcgcggtggtggacatagacggcgacggggtggtctgcttcgacgagttcaaggccatgatggacacggcggcggcgtcatgaaccatacgcgcccggcgctctgcaccacacgtgtacgtgtacgtctgatattgttcgtcgacatgataacaccctaattagcagtaaacccattagttttagggtttcacgttctagtctagttcgagattggtttgtgatcggattaaagttttgcgttgtggcgccgtgtgccaattgatttcgatcatttcctttaatttcgcacctgttggatcgttagaaagttgaatggccggccgcgcaggctttcaatttgattccgccgccggcggaagctgctcgctatctggtggaatctgctcgtacgtgtatgctcgttggctcgttgctcgcagtctcgcctcaattattaatttattatcatttgtttctcgttcccaaacacgtcgcctcaagccctcaacattactttatccaaacgttgtcctcgcaccgaggcctcctatcatggacgacaacgaaacaatggatactattttgaaactctgacttgcaattaaaaggcaaatataggagaggcttaaaacgtctcctaccattttgaagttttgtactggagacttagagcatgtttgattttagttactaatttttagttttttctattttagttatttttagtctctaaattgctaaacacatggacatggttataattcatgtgtttagcatttaaatactaactagccaatcacccgtgctttgctacggtattttttataaactggctggagtaaatttatttggtctatgttgtaacttagcaacatatatagcacatggtcatttgtcgccaggcatatggcttagacttgcacgacgacctgggccttcgctaccggtaccgtcatagccttgctcccttttgcagttgttttgcctcccgatgccattttttgagttgaaatagacttggtaaaccacaatggttcactcacaaagccaccatacatttcatctcactcgcaaagccaccatacaatttcatctcattataaagaacaagagcgaggcagcgtgggtagacttcacaagcaaaaaatctagaaacctacactctgtgactatggaaaggaacaactgtacacatgaataacagtgaagaatagcacatgactaaaggaagtggtttatatcacggatgacaccaaggacatatcatcggatccctgccttgctaatggtgtcgttggtgtcagaagtctgtgcttcgcaagtgcatctctgaactgctcattctgcatacaacagtcaccaattgtataagttaaatcaactggtagccattaacaataaatattggaccttatctatgctgaagcactaaggaactgttattgcaatggaagtcagatggcacatcaaagacaagtaccagaccaaggaactgttattgcattcagccgcaagggcctccttgatttctttgcctagtagatctgaaggcgttgcaaaaggcacgtacttgggaccacctactaatgccattttttcatttgcaaataataacaagaccctcaaaacttttcatttcactgaattagttaatataattgctc

SEQ ID NO: 14138 - DNA, 845 bp, Zea mays
ttttttttttttttttgccccagccattacaagttattgacatttctctgcataaccaaacccaatcaaatctggataaaagaatgatttccaacggatccctagcttccaccgtcatatataacaaaaacatgaagattttagtctaagtgtactgcacaaacgcatatcaggaggcagaacaaaaaaaaaacctatcccaacctcaactaacaacttatctaatgccaaccgagccaactgaaacttaacacaacaaaaccaatctacaaggacaaaataattacacagcacaaggagaattgaaaccctataacatctgatggaagaatctagatgtatttgcgtatgcccgtgcagcaacgtaggcctaggccttccagggcttagctcttcaagaattgaaaggcaggaattgcagtaagctcttgtggtggggcaacattctgaaattctttggcatccatagaatctgctatctcctcaagtgatatgggcaagctaatttcatcatccagtagaaaggtgttccccagagtttcatcgcttgattccttggtcatcaatgttcgcatctcctcaaggacctcttctgacacactctctgtgttatatttatcatcccagtactgagtgcatattttgtaaagctgctgcacacttagtactgggcagagatcattgacaatctcatcatatgaaatcctgaactttttgaatatgaccaagaaaccgacagcttgcctgatatgcttgagttcatccaacgcagatcctgcatactctggcttcacttctccacaccacacctctagttgtgccaacccttgtttcacatattctcc

SEQ ID NO: 14139 - DNA, 1863 bp, Zea mays
ttctgggctgctggcccaagcccaagtacacccaaactacacttccacgaaccacgaccaaatgacccgctcggacaaaatgaaactgaagaggcatgctcgtgcccacggcctggagggagaagaccaggaataaaaaagaggcgtggtagtgtacagtgtgagctgacagggacagtgcccaccaatggtccccttctcacggtcacgctagcagcagtagccctcccccatcaccgaggagagagaagcctgtcgccgcgcgaccgccccacatggctaccgcgctcggtggggagcccaaccccaccgccgacgccatggaggtcgaccctccgcgcgcctccgccgacgagaagcatgtcgccactattattgcggggggtagtgatgcagtgacaggccacataatatcgactacgattgggggaaagaatggtgaaccaaagaggaccatcagctatatggctgagcgagttgttggaactggatcgtttggggttgtcttccaggcaaaatgcattgagactggtgaaactgttgcaattaagaaggttctacaggacaaaagatacaagaatagggagttacaaataatgcgatcaattgaccattgcaatgtcatttccctgaagcattgtttcttctctaccacaagtagggatgaacttttccttaacttagtcatggagtttgttccagagtcactttatcgcgttctgaaacactacaaagacatgaagcagaggatgccccttatatatgttaaattgtatatgtaccagatattccggggactagcttatattcatactgtaccaggaatttgtcaccgagatattaagcctcagaatatcttggtggatcctctttcccaccaagtcaaggtttgtgacttcgggagtgctaaaatcttgattaaaggtgaagctaatatatcatatatatgctcacgctattatcgtgctcctgagctcatatttggtgcaactgaatacacaacatctattgatatatggtcagctggatgtgttcttgctgagcttcttcttagtcaaccattatttcctggggaaagtgctgtggaccagctggttgagattatcaaggttttgggcaccccaacacgagaggaaattcgttgtatgaatcccaactatacagaattcaagtttcctcagataaaagcatgtccatggcacaagatcttccacaagagaatgcctccagaagcaatagatcttgtttcccgtcttcttcagtattcgccgaatctgcgatgtagtgcacttgaggcgtgtgctcattcattctttgacgaattacgagaatcacatgcaagactccctaacggacgcccatttcctccactattcaactttaagcaggaactagcaaacgcaccaccggagcttgtcagcaggctattaccagagcatgctcgacggcattcaggattcggttccttatttgggagtggaccgtagcccgtaggaaaatctcgttttaatgttgggctgctgtacgccgtcagagggcaatctgcatatcccaaatctaagttttagaacctgaccatcttgtcgaaaagttaccagccttagaaaaacccgaggtggcctcttgtgtccatgttctgccagtagcggcacataatgctggggggatggttaggtgtaattgttaagcacagagggtaactgactgagctaatgtattttcacgtttcagtctgtatcgaacttgtacctgtgtaccctgtaccaatcgcagctgatgtaatcatgtaaatgcttctaaactacttcaagttatcatgatggccaattcgcaattttacagtgcataaaaaaaaaaaaaaaa

SEQ ID NO: 14140 - DNA, 4021 bp, Zea mays
  misc_feature (1350)..(1350): n is a, c, g, or t
aatgggttcccctattgattggattcctcgtacctgtggcttgcggtattccactattgtctctctcgaaatcggccgtctctctcccgtccggcacttcctccgatcgactagcctgcggcggcgccggcgccggcgaccagcggccatgcgggtggcacccagggtgctcttcctcgtccgcgacgccgcgggctacggcgctgccctcgccgacgcgctccgcccgccgcccgggctaacgagggagtcctcgcccttcgagctcccccttggaaagtacggcctcgacggagagaaggcgtgcgccgagctcctgagcttttccgattccagtggctctccacaggtgaccatttttgttctgccagactataagccacctcttgcagcgtgtgttgtaaatgaggtcttggaactgatttcttctgaagctacctccactgagcgaactctaattgtcccatacatcacaagatcgtcaagctatcatcatggaacggaacatgcaacaaaggcatcgactgtacttcatggtgctgaaataggggcaacaactgactatactcacctgttggttggtgggaccactaaacctcctacatccttgcaaatacgtagtgaaccaatattatgtttgctggaaatggtgcgtgtgttgaaggtgcctacagttcttcttgtcacttctggtggacagcagcaaggcaagagctctacagtttctgatcttgaggtactgcaatgcttaggagagcacttggccaagcacacggctttgcctttgttcgagtctcccaaggaactcttgccatggaaataataattgtctatttctgctttcctttgcttctgtttgctctgcagactttgtggtcctgaaattttatagaattgttctgatcaaatgggaaacatcagcaaaacaataggcgtgctaggtggtggcaatgttaaaatgtgtctctaaaagatctacggtgacagtggataacattgttttctagttttcttctgtaaaaaaaaaagcaacacaccttgcttttcctatggtcttgtctgattcttggtgttttgatctgtctatttagtactgcgatgttaaaagttttgacttctgaatttatcatattctaatatgaagtagtgcatataaccacacataggtagcattaacagcctgctgcctctgatcgtccagttcagttctgaataactgtgaaaaaaggatattataatttatacatgtaaaatgtgaagtttcttgagtcttagctcacccaatttttttttccaattgttaggtactgcaatgcttaggagagcacttggccaagcacacggctttgngaattttccaaaggaactgttctcaagagagggatcgaaaaatcaccgaattgatcaggaaccctggcgcgagctgtatgggtgacggtgccctcatacagtttggtattagcttaattggctatacatgtttgactcggatgaatgatggtgttttatggagctggaatcacgaaggatctggtccgtcgaaaccactatatataatgtggttcctttcgcctgggtaaatcaactcatcagcaagatatcggatgtcttagaacttgtagacgctttgcagttaaacattaaacgaaatacatttacacttctaacctcttggccagtagtattcaagggttaggtttattgcctgactcgctggaatgtttatagccaaagctccaattttgctttcgaaggatatatatacatatattctcaacgttttttcttgtaccgcatcttcctagcgttggcctaaggcccgcaaagtggcctttaggccggttcgtcccaccggtccagttaaaagtgagagcagccccgtccgtaggatgcaaatcaacggccacgattgagtgcccccttgaacaaaacccatagctagcccgacacttcgccagggcccaggggtcagcggataaccgcacgacagaactagcgcgcgaatgggagagagatggccattttccgtcgggatcgcgcgacgcggcgcagttgaccgggacgaggtattcaattattcatcgacgcggcggcgacactaagactgaccgcagcgggcgtctctcttccatccctcctttattactgttcatcttttagggggctacagttctcttattccctccgcaacgccgcgcactgcggcatcctctccgccgtgttccccttctctctcacgccagataaggcggatcactattcaccccccggtcgcttctcgcgaacgcctacgcccacgccctggcgaggaaagttcttggtcgatttcactacgcctcgacgcgtccatcgagcgtgggcgacatggcgtcggatctgccggtacaatgccgattcagatccggtggacctcgacgacgagcaggagcaagtgcacggcgacgaggtcgtgacgaagcaatcccgtgtgcggaggaggacgaagcaccgacaaatacgactccgccgaggctgttcttcgtcgccacatctgtctccctccactccgaccgtcgacggcatcctcagatccggatttcctcccttcgcttctgacacttggaccacagatcttgccttcctcaggtacgaagcacatctcaatccggctcccaggttaatctgtgttcgtttcatttaggaatttgtctgttcttagtttcgtagttcaggcaattcattcggtaaggatcaatttcgaacacttgcaacagcactagtctagatggatctggtttagggtttaggattgtcgaacacattcgtagaacctttagttgctcggacattccttgtatagttgaacaatccatgtaaacttgaaagttcctgtagatcttggtcgacactttggtgttatattagaacttcaagcatctaagattgtctttctcatccttcctatctcactattttaaactctactctctaaacagtacagtatacaatgcaaaactgtccatatgtacgctctgctgaatatggtctaattctgctatgtgtaaatgtgttgtatcattttaggagacatatccaatcttcctctagctagacaacatatacaagtgtagtacatagcattactaaaaattaggtgtgcaaacatgcttcatctatgagcacgtgacatggccataaatactagtacgatcctgatcttccacattattaaaatacttgtaattagtattaaaatatacgatgtgatatgagctgaatggagaccggccctccatattccgagagaacccaaacgtgtctctttttttttctttgtaccggatccaaaaaaggaagagcttcctgtcaggccagctcgcgtgctgattcgctaatcctgattgcagcacctccgagtccgacgtccagtcgaccagtcggcctacatgacgactgcatcggtgcatcccgggctctaaccgctccacacgtgacgacgtgacacgtcggtgggggtctctccgtccgagacgtgctccacaactatatagcagcagcagatgcagccagggctacggtcgcggtcgccagtcggcgtcacaagcaattagacaagggtcgctgccgacgcggggcccttagtcgcacggtcagtcgtcttctactcgtcctcgtctgcgctcccaactgcttcggagaaatggcgtcaggtggagtgaatgcatcctggacccgtggtcccagactcccgtgtggccagggcgactgccgtggacccgtggtggtgttagactgtccgcatttattcccttaattttttttctataccctatttttctgtcacgccttaaagatttcaactcctgctttttcatcttccgcaacggtttactctaagggcgtgtttgtgaccctgtccctggccagcttggccccttcaactggtccaggctgaggctagcctgttccggctactgcaactcactttgtttgtgcacttgtaccatatgagtctggctaagacgagctgggtttgtcgctc

SEQ ID NO: 14141 - DNA, 1137 bp, Zea mays
cctcgaggccggccggcgggattccactttttctctctcgaaatcggccgtctctctcccgtccggcacttcctccgatcgactagcctgcggcggcgccggcgccggcgaccagcggccatgcgggtggcacccagggtgctcttcctcgtccgcgacgccgcgggctacggcgctgccctcgccgacgcgctccgcccgccgcccgggctaactagggagtcctcgcccttcgagctcccccttggaaagtacggcctcgacggagagaaggcgtgcgccgagctcctgagcttttccgattccagtggctctccacaggtgaccatttttgttctgccagactataagccacctcttgcagcgtgtgttgtaaatggggtcttggaactgatttcttctgaagctacctccactgagcgaactctaattgtcccatacatcacaagatcgtcaagctatcatcatggaacggaacatgcaacaaaggcatcgactgtacttcatggtgctgaaataggggcaacaactgactatactcacctgttggttggtgggaccactaaacctcctacatccttgcaaatacgtagtgaaccaatattatgtttgctggaaatggtgcgtgtgttgaaggtgcctacagttcttcttgtcacttctggtggacagcagcaaggcaagagctctacagtttctgatcttgaggtactgcaatgcttaggagagcacttggccaagcacacggctttggaattttccaaaggaactgttctcaagagagggatcgaaaaatcacgaattgatcaggaaccctggcgcgagctgtatgggtgacggtgccctcatacagtttggtattagcttaattggctatacatgtttgactcggatgaatgatggtgttttatggagctggaatcacgaaggatctggtccgtcgaaaccactatatataatgtggttcctttcgcctgggtaaatcaactcatcagcaagatatcggatgtcttagaacttgtagacgctttgcagttaaacattaaacgaaatacatttacacttctaaaaaaaaagaaagtagtattcaagggttaggtttattgcctgactcgctggaaaaaaaaaaaaaaaaaa

SEQ ID NO: 14142 - DNA, 2033 bp, Zea mays
aaaccaaaatcatttcatccccggaaccggacgccgaacggcagtgctgcaaaagtccggacaaagctcgcgccgcccaccgcacccgatccgcctcgcccaggcgtgctgccgtccgctcccttctcccgcgccgtcgcctccgcctacgcccgggccgacccgctggacccagcgtgcgccgctccactcggacgcgccgccgccctctcgggttgaggcggaggtgcttggggacccgcccccatggcgagcgccggcaacagcggcagcggggacgacgatgcaggagggaagctcctggcggatcgctaccagaagggcgaggtcctcggcgagggcacgtatggagtcgtcttcaaggccatcgacaccaagactggaaatacagtcgcggtaaagcgaatccggataggaaaggacaagaaggaaggtgtcaacttcactgcgttgagggaaattaaactacttaaggagctgaaagatcctaatattatagagctgattgattgtttcccttacaaggaaaatttgcaccttgtgtttgagtttatggagaccgatctggaagctctcataaaagataagaacataatactctctccagctgacacaaaatcatatgtccagatgatgttaaaaggtctagcgttctgccataagaaatgggtgctacacagggatatgaaaccaaataatttactcattggtgccgatgggcagctcaagcttgctgacttcggtctggcccgtgtgttcgggagtccaggaaggaacttcactcaccaggtctttgcacgttggtaccgggcaccagaattattatttggctcgaagcagtacggatctggggtggatatttgggccgctggatgtatttttgctgaactgcttactcgcagagcctttctccagggttctagtgacattgatcaacttgggaagattttcgcagcacttgggaccccaaaatcttctcaatggcctgacatggtttatcttcctgattatgttgaataccaatatgttgctgcacctccactacgtacgttgtttccaatggccagcgatgatgctttggatcttctgtcaaaaatgcttacctatgatccaaaagcaagaatcagtgctcagcaggctctagaacacaggtacttttcatcgttacctgcaccaacaagaccatcgcagcttccaaggccacgtcggaaaggagatcaagggaataacaagattcctgatctcaacctgcaggatggccctatggtgctctccccgccaagaaagttacgtagggtgacagcgcatgaagggatggaaggtatgcacaggacagataaagtggacgaacatccttctgggatgaggcacaccgatgacatgcccagtcagagttctagaattccaatgtcagttgatgttggggctgtgtttggcacacgacctgcacctaggccaacattgaacagtgcggacaagtctcgtttaaaacggaaacttgatatggatccagagtttggatacgcggagtagaaggaacacatgtttacatgcaccattcttttcttattggggatgttgatttttaaaataagattctgacacaatcaactgagatgttaccgtcatcgcctcacgaagaggaaaactgaagagagattattctaatttatcccgagtcacatagggtattacagctaaccaattccgtaaggcaggctcttgaaaacagtagactcaatgggatattcatgagtggagagtgttatggggaattggaggatggaaaagcttgctccatgcgtgtttgtacgtgttttgccaagattgtgctgaagcatctgatctatctactgattctctattttccgtactgtcaattcccgttcttgtatggacagagctttgagcatgttttcagtcagacaccttaggcagtgattcttattgtacaacttatatcatctgacatttcttttgagatgattaaacaatgcatggcgaaaaaggggggaaaagtggtcttgatttaa

SEQ ID NO: 14143 - DNA, 2109 bp, Zea mays
  misc_feature (691)..(691): n is a, c, g, or t
atccccggtgcagaacgcccaacggctgtgctgccaaaagtccggaccacagctcgcgccgcccgccgcgccttgcccagacgtgcgctcccttctcccgcgccgtcgccactgccctggccgacccgctgggcccagtgtgcgcagccctcccgggttaaggcggaggtgcttggggacccgctcccatggcgagcgccggcatcagcggcagcggggacgacgatgcaggagggaagctcttggcggatcgctaccagaagggcgaggtcctcggcgagggcacgtacggagtcgtcttcaaggccatcgacaccaagactggaaatacagtcgcggtaaagagaatctgggtagggaaggacaagaaggaaggtgttaacttcaccgcattgagggaaattaaactacttaaggagctgaaaggtcctaatattatagagctgattgattgtttcccttacaaggaaaatttgcaccttgtatttgagtttatggaaactgatctggaagctctcataaaagataagaacataatactgtctccagctgacacaaaatcatatctccagatgctgttaaaaggtctatcgttctgtcataagaaatgggtgatacacagggatatgaagccaaataatttactcattggtgccgatgggcagctcaagcttgctgactttggcctggncccggatggttgggagtccaggaaggaacttcactcaccaggcccttgcacgttggctccgggcacacgtaggtctttgcacgttggtaccgggcaccagaattattatttggttcgaagcactatggatctggggtggatatttgggccgctggatgtatttttgctgaactgcttactcgcagagcctttctccagggttctagcggccgcgtgcgccgtcgcgtgggtttcgctgcacttgggaccccaaaatcttctcaatggcctgacatggtgtatcttcctgattatgttgaataccaatatgttgctgcaccaccgctacgtacattgcttccgatggccagcgatgatgctttggatcttttgtcaagaatgcttacgtatgatccgaaagcaagaatcagtgctcagcaggctctagagcacaggtacttttcatcgttacctgctccaacaagaccatcacagcttctaaggtcacggtggaaagggaaagatcaagggaataacaagatgcccgatctgaacctgcagcatggccctctggtgctctctccgccaagaaagttacgtagggtgatagcgcatgaatggatggaaggtatgcacagagcagataaagtggacgagcatccttctgggatgaggcacaccgatgacatgcccagtcagaagagttctagaattccaatgtcagttgatgttggagctttgtttggcacacgacctgcacctaggccaacattgaacagtgcggacaagtctcgtttaaaacggaaacttgatatggatccagagtttggatttgcggagtaaaagaaactttgttaacgtgcaccattcttttcttactgagatgttggtttcgaaaatattctttgggagatatttccacagttcactcagagaagaggattgcattgaagccacaaaactgcaccgaaggattctgacacgatcaactgggctgttaccgtcatcggctcacgaagaggaaaactaaggagaggtcattctgatttatcctgagtcgcatggggtattatagctaaccgattccgtaaagaaggctcttagaaacagcatgctctatgccatgcgagtggagagtgttatgtggaattgggggcatagaaacgctcgctccagttagaaatgtgtgtttgtgctaaatgtgatctactagtcctccattctccgtggtttcaatttccttcaattcttgtacggacacttagctttgagcattcttcactcagcccctctacgtatagtgatttttattgtaactaagagcagtgattttattgtaactaagggcagtgattttattgtaactaagagcaattgttgtgttctcgaaccaacattcaaaactgaataacacgatatcagcgcaatgtggacgatat

SEQ ID NO: 14144 - DNA, 5392 bp, Zea mays
cggcccgtttgcactcggttcccacaggccttttttccctcgtgatccctgtcactgacccactgatttcaacgtcactcagccactcacctagtggcacctgttcatgtgaaacgaacaagcagacagtgctactaacaagacaaaattggtcgccgccccaggcaaattgacgtgcctgtaattgcagaactcattggacctgcttgccatttgagccgtggcacctgcatgcaggagcactagaagtaacacctcacttttactgccatcgaactgatagcgattgcgagcgtttcgacagttggcctgaaatcgccgatcaatcatgcaattgcaaacgaatggctttccgtcgacagtcaaatcaagccaagccaagcaattcggacgtacataaaggataaagcgttcaattatgaacccactctttacccccattccaccacgaaacttgcttaccgcagcagacaacatcaggtccgcgagtggatcacccaattattaggctatctccaatcgactgtgtgtaaattacattgtttgcagagtgaagtttaaaatagagagtgagataaaaactgctgaagatagtcttaatagatggttgatttgtagggactaatttttagtcactctattttatttcatattagttcctaacttgccaaatatagaaacaaaaatatatttttgtttctgtatttgataatttgtgaccaaaatgaaataaaataaaatgactaaattagccgctaaaaaccaaacacgcctcctccgattcctacgcagcctgcatccgaagctgaagcctgcaataatttcagaagcgcaaacggggcgctttttttttcagttcaccccactgtctctcacagttctcgttctccactttttctgaaaagcttcagtgttctcatccttggcagacacatctttccactgctctgctcattggcgagcacttggcatcagggaagggaacagctgaatgggtcagctctcaatctctcatctccaccaccggttgacgagcaaaccagctgcgttatctgcggcacactaatcatttctcccactaacacacatgcagactagcacaagtgcggctgtgttcaagatagagacaaagtgatgtgtaacgtgacatggacgtgagaaaaggaattacctgagcttttttttaaaataaaataaagtaaaataaaataaaagggagtggtagtggagtgctatatgcatccgatcttttactttatgtatgggataagaatagaaccccaaatttcctagtaagttttttttttctctctctctcctttcctaaggcatggggatccggttccatgttgctcttagaataaacatttgcacatacatacatgaagagtgatgtaggttgttggaactttttttttgagagagacgctgttggaacaaacaatttccagtgcttttggattcctaaaaaaatggccaagagagccgttctaacaggccatagtacgacttcgattttttttatatataaaataacagctcacgatatgcaaatcgaacaggagcaatatgatagtaccgtgacggcagaaacaaaagagggtgtcgtgatgcagacgcacatgtattagtatactaacatcaaccagcaggtgttcttacctgcaaatcatgtagtcaggccggtaaggctccctccaaaacaacagttcgagccggccagtgtagcttatccattgcttccggtaacctcctacctgtaactttcagcttcttcttttttcaattaaatgatggcacgctgtatcaactaggctgtcacgtcgaacaattaggatgtctgaatatttctgacagtgatgaactaatgaaccgagggaaaaaagaagaagataagtttaggaggagaattggaaataggcgccttggaatatttgatatcttgcttcctcgaaatattcctcaggctacttcgcttgccacacattgcatccctctatctatcattgcttgcagaggcgaaaacagtagttgcacggaatctagagctacctccactacacgaacacgagtcacgacacagctcctttctactaacacttaaaaaaaaacctttggtgtaacaggaaaaatcggaagcttatatgtcctgtttgtttcagctttttccagattctagtcatcaaaatctgctgcagattgttaacatataggattttgaatcactttaatcaaaactatccaaaatcaacgtaaacacagatcagtcgagtcgttatgatagtggaaactgtcactttctatactctaaaccttgtagattcttttatgtttctccgtacgtaacagattcttccaacagaaaagctcttccgaaataaaaataaaaccaaacatacctatgttgattgatttgctgtaaattgcaggtggcagcataatcgaagccgagaaatgcaattggcgccatcgcactattactctgcagttcttccagcatgtgcttaatttttctcgaagaaaaacttgaactgtcaccgtcaccaccagtccaccaccaccaccactgaatatttggtagcaaatgcgtcaacgattcagctgaaaatttttagcccttgtatagaaaacccaattttcttttaaaaaaattgtatcgatgtgtgttgggtttagtaccatcagtccatgaggacgtcgtctgccaatcatttttgtcccgcacaattatcatgccttagctgtcctcacaatatccttctttttttagaccggattatactccgtgtgctgtttagtcgttctattttacaaaactgctgattctttttcgcctggaaattcatttgagtgccgcgttccttggactattatttttgcatgtgcctgtgacttcgtgcagatcattgccaggaaaactggatgttaagccgttccggttggtgtgcaagagaaagtacaccgcgtgatcaccaaatggcggtaactctatctatgcgttggttgcctggaataatagtggccagctaatgataatccattccccagtggaatgcagatgtcgattggatgattggccttcggccagccaggaaaaatacactgtgctcgtcatgctactcaaggggacctgaggcgttcggatcagggggcgtgtggtggttctgaagattgaaattaaggagcagtctgcagtcgtgtgatcaagaacgatttgctttttttttttaccatttcaattttcaaggtatctagactaatcttcttgagtcagcataagacgagaataaaatacagtcttaaataaaacctagtcggcagtatgcaggtctgaaactttctcccagagcaatgcgtcattggattgtcgtgcatgtttgtttgactgtttattttgaaatggaaaacaagttcggcctgtttccacataggatgccaaaaagccatgactacggtctacggcagcagtacagaacagggaagaaggcgacgagacccagggcggtcaaaacgccagagatagaagccatcgccgacgtcgaatcccggccggcggtctgtttcctcctcctcctgctgctgctgactgcccgcctcgcgccgcgcatagaatccctcgctctgcctcgccctcggcctcggcatcgccactcgctttcacgctccatcatcaccaatggctcgatgccaaaaccgcaattaaaaatttcggcttgggcgtatcccgcccggcaccgagaggaggaagcctgcccactaccgcgtatctctctcctccctggctctcatccccccaccgagtcgtcgccccctcgctttcaccccacgcggaagcaagaattcgtcgtcaaattcccagcttgcgcgtgtttctgtggatttcttcccgcttccctgctcctgcctcctatgggcctttgatccggggcttcgtggatcttgggaagaggaggtgtggtgggcgcctcggcggcgatctggcggggaggatatggccagcgggaaggagccgatcgaggtcaggtttcgtctcttcgacggcacggatatcgggcctacgaagtacgatccctccaccacggtctcctcgctcaaggagttcatcctcgctcggtggccgcaaggtgaggcactgatgaggcttgttgatttggtagcgtacacgcctgtgccgtcccgatctgctgacaagcgacggacgcttttgtaatttaggtgcaggggtattccccgtgtcacgagtttcttggatcatgtattgctaattgcttcttttgcgctttgtgctcatgtctcacgagtgcgagtctttctcctacctcatgttattttgcttgtggcgaatggctgctcgtggtatccgtgatttgcttttgtcttcgcggcccatggacagttgagtagtgggaaactatgcttcaattttctttttcagcctagtcctagagctggctatgcttattcaattagtattagcttcagcattatgcttctagtggctatgccatattcactgattagggcctgtttggatgcttcaactatccctccttaacatactcactaaaagattctctcctctatatctcattcttatccaacatcttctatatctcatcctccacaaattaaatacacacattaaagacatattttattctagattttttacgtacctatttattatacccttaaatagatagatgagaagagatgagagtctctctatatatagagaggatggaagaggacaccggtgaagcatatagaggaggaaatcttctctaggggacgctctacagactcccgctggagtcagtctaagctagggctagttacttgttgggctaaaaactgtctaactagttaatcaacagctagttggaaatttggctaaaaatttaactcaactattagctctcctgtttggatgcacaagagctaacttttagctagctagtagttagctagcttcgttagtatcctatgattgcatattggttttttagcttaaaagaagtaacctgtaactggctatgccatattctattttctttttggtgtatacagaatcctagaactggctgtgccatattagcagttagtggatactttccgttcttactttatgtggtatggagtcttcaactgtgaatgtcaattgccaatttgtggcagaagagggaaagagcacaactttggaaacagtatatatcacacaccataggtggaactgatggaaacaaaggtcacctcttttgtttgctataaaagaagcaaagtgcacaagaccatattaataactgtggaccttttaagtgattacctactctcttctaatctgtaaagggaggtattattaccctgtggaaaggtttttaccattctttgg

SEQ ID NO: 14145 - DNA, 1545 bp, Zea mays
gaacgatttgctttttttttttaccatttcaattttcaaggtatctagactaatcttcttgagtcagcataagacgagaataaaatacagtcttaaataaaacctagtcggcagtatgcaggtctgaaactttctcccagagcaatgcgtcattggattgtcgtgcatgtttgtttgactgtttattttgaaatggaaaacaagttcggcctgtttccacataggatgccaaaaagccatgactacggtctacggcagcagtacagaacagggaagaaggcgacgagacccagggcggtcaaaacgccagagatagaagccatcgccgacgtcgaatcccggccggcggtctgtttcctcctcctcctgctgctgctgactgcccgcctcgcgccgcgcatagaatccctcgctctgcctcgccctcggcctcggcatcgccactcgctttcacgctccatcatcaccaatggctcgatgccaaaaccgcaattaaaaatttcggcttgggcgtatccgtcaatacaccgagaggaggaagcctgcccactaccgcgtatctctctcctccctggctctcgtcccccccaccgagtcgtcgccccctcgctttcaccccacgcggaagcaagaattcgtcgtcaaattcccagcttgcgcgtgtttctgtggatttcttcccgcttccctgctcctgcctcctatgggcctttgatccggggcttcgtggatcttgggaagaggaggtgcggtgggcgcctcggcggcgatctggcggggaggatatggccagcgggaaggagccgatcgaggtcaggtttcgtctcttcgacggcacggatatcgggcctacgaagtacgatccctccaccacggtctcctcgctcaaggagttcatcctcgctcggtggccgcaagataaggatatagctccaaaaactgttaatgacttgaagcttatcaatggtggaaggatattggagaataaccggacacttgcagagtcccgtgttccagtaggagagatcccaggtggtgtaattacaatgcatgtggtagtgcggcctccacaagctgacaaaaacagtgagaagcagcttgccaattcccccaagcagaacagatgtggatgcaccattctctgataaggcgtctgcttggtgctgtacaatctgtgtgtacacataagattttgtatgtgctttgctgtgttcacacaagcatggattcgttttgatatccaattcttgaagccatacaaattccagaagtaagaacccacggaatacgaagatttctggatcgttttgttctagagtgtaggattggatgcttcctgctgtataaattgtgttgtcaaaactgaaaaaaaaatctctttcttttctgctatattgacttattatcgattctttctagctcggttgcttttgattcgtgtaacagaaatattgtactcatgtatatgtaacttgcaaaaggagtaatgtatggtgttatggtaattggtaaaggggaaaaaaaaaaaaaaaaaaaaaagcgtat

SEQ ID NO: 14146 - DNA, 1061 bp, Zea mays
  misc_feature (2)..(2): n is a, c, g, or t
  misc_feature (4)..(5): n is a, c, g, or t
  misc_feature (9)..(9): n is a, c, g, or t
  misc_feature (11)..(11): n is a, c, g, or t
  misc_feature (16)..(16): n is a, c, g, or t
  misc_feature (23)..(23): n is a, c, g, or t
  misc_feature (27)..(27): n is a, c, g, or t
  misc_feature (29)..(29): n is a, c, g, or t
  misc_feature (31)..(32): n is a, c, g, or t
  misc_feature (40)..(40): n is a, c, g, or t
tncnncctngncctcnccaatcncttncncnntccatcanctccgggccctcgtgcccggcccgcaattgaaaatttgtgcttgggcgtatccgtcaatacacgcaccgagaggaggaagcccactaccccgtctctctctctctctcctccctggctctcgtcttcctctcctcccccaccgagttgccgccccctcgctttcaccccacgcggaagcaagaattcgtcgtcaaattcccaccttgcgcgtgtttctgtggatttccttttttttggccgcttccttgctcctatgggcctttgatccggggcttggatcttgggaaggggaggtgtggtgggccgccgccggcgatctggcggggaggatatggccggcgggaaggagccgatcgaggtcaggttccggctcttcgacggcacggacatcgggcccaccaagtacgatccctccaccacggtctcctcgctcaaggagttcatcctcgctcggtggccgcaagataaggatataactccaaaaactgttaatgacttgaagcttatcaatgctggaaggatattggagaataatcggacacttgcagagtcccgtgttccagtaggagaggtcccaggaggtgtaattacaatgcatgtggtagtgcgacctccacaagctgacaaaaacaagaagcagcttgcgaattccgtcaagcagaacagatgcgggtgcaccattctctgataagacgcctgcttgatgttgtacaatctgtgtagtcttaggattttgtatctgctttgctgtgttcacacaagcgtgaattcattttgatatccagtccttgaagccattcgagtccagaaacatacacactaaaaatccatcgaatatgaaggtttctggatggtagatttggatcgtcttgttccagagttgaggattggatgcttcctgctgtataaatggtgttgtcgaaactagaaaaaaaaactcttttatttctttttcttttctgccatgttgacgttatatatatatcgattctttttagatcagttgctttgtctcgtcta

SEQ ID NO: 14147 - DNA, 5663 bp, Zea mays
  misc_feature (354)..(354): n is a, c, g, or t
  misc_feature (2738)..(2738): n is a, c, g, or t
gccagaacttcttccgtaacatttgaggcggtctgggtctggctccgcacatcagtagccggacgttacggcatagaattggcttcttggtaaggttaaggagacgcctgctgctccgtgctcctgtgccagcagtcctgtgatcaagaacgttttttctttttaccatttcatttccagggtatctagggtaatcttcctgcatccgttcgtatcgtaattcctgattatttatcctttatccttcgtattatacaatccagattaaataaattaaaagacacaccaacaacacatattatattattaggtggataatataatctaaatatctaaattttcataatctataantaggtcaataaatttttatatagtctataagctatattatacttttccgttttttatttgttgtggtttagttcaaaaattactagcaaacgacaaatatttgagaatgcaggtagtagatatgtttgattcgctgtctaacttgctatattttatctaacttttgtgtctaaggttagttcgtaaattcgaacgactaaccttacgcaaagtgtgacatagttagtcacgaaccaaacagaccctggccttagacatagctttaattccacataactacaaatacgagaataaaatagtcttaaaacccactcggcacatccatgtacaaaactttcccccagagcaatccatcagtggattgtggtttgtatttgttgactatttattttgaaatgaaaaacaagctggacctgtaacagtacaaccaaagaagagacaaaggggggagagagagatgttccacaacagcagtacagaacagtgaagaagacgtcgacgagaccaccgagggcagtcaaagtgcccgagatagaagccgccatcgcccgtcgccgacgtcgaaccccggtcggcatagaattccccgctccgcctcggcctcgccaatcgctttcacgctccatcaacaccatggctcgatgccaaaaccacaattaaaaatttgtgcttgggcgtatccgtcaatacacgcaccgagaggaggaagcccactaccccgtctctctctctctctcctccctggctctcgtcttcctctcctcccccaccgagttgccgccccctcgctttcaccccacgcggaagcaagaattcgtcgtcaaattcccaccttgcgcgtgtttctgtggatttccttttttttggccgcttccttgctcctatgggcctttgatccggggcttggatcttgggaaggggaggtgtggtgggccgccgccggcgatctggcggggaggatatggccggcgggaaggagccgatcgaggtcaggttccggctcttcgacggcacggacatcgggcccaccaagtacgatccctccaccacggtctcctcgctcaaggagttcatcctcgctcggtggccgcaaggtgaggcagtgagacttattgatttggtagcgtacacgcctgtgccttcccgatctgctgatacaagcgatggacgcttttgtaatttaggtggaggggtattctcatgtcatgagttttctggatcatgtattgcttcttttttggctttgtgctcatgtttcgctagttttcttgctacccctgctattttgcttgtggcgtatgacttctcgtggcacctttgatttcttgttgttttctggatgcatggtcagttgagtagagggaaactatacttttgttttcttcttcagcaaagtcctagaaccggctatgccttattcaattattagcttcagcattatgctttgagtggctctgccatattcgctaattagcttcggcagtatcctgtgactggctagcttcagaagtatcctgtgattagctagcttcagaagcatcctgtgtttggctagcttcagaagtatcctgtgactggctatgccatatcctctctcttttttggggtatgcagaatcccagtactggttgtgccatattatcagttagttgatactttcggttctttgctttatgtggtgcgaaattctcatctgtgaataccaattgccaattttgtgagcgaagagcttttttggaaacagttcacagattgtaagtggaacggatggaaacagggtctcgcttattttgtttgctgtaaaagaagcaaagtgcacaaggccatattaataactgtagacctttcgagtgattatagcactatgtaaaagaagcaaagtgcacaaggccatattactctcttcaaatctgtaaagggagttttacagcactatggaaagcttttcaatgtccgactgttagataacctgagtttctctgcagaagtgcaacagctcaacttttcaccattgacaaacattctgattaatagtttggcctatcatgtgatttgcacaccttataagatgagggcaaacaattcactctgaatccttagctgtctggtattcaagtgaaaccttggacatttgtgctgtttgtgaattgaaccttgggccttattaaatattagtatatcagagagaaattgtttggatgtcaggtcacttttgagcatgttggtcagcaacagcaagccatagtagacactagtcccatggtacgtgtaagttactgagagaacattgtgtaagcacttgcactaagcagcagaatgatctgtactttttcacttaaacagtcagagatcttttgtaagccagcagaagtcattttagaaanatcttcagaaataattagtgactgttgtacaattgaataattgatgttttggataaagaatactaacgatttagtgagtagaatactctcgttcggtagggaaagactgcccgcacggtattatatattaagaagaagctcaatcgagtcccgaccgagaaaagtcacgaaagatgccctcctgtgcagcatgagtgtctgtcccctataggccagatctttgctcgtgttttgagccttcccagcccatacacgaggatccgcccccataggtcagtccatctcgtgtgcacacaaccagggaaccggcaagtgatcttttttaaccttagtttgaaattcgctcccactgggatttgaacttagtacttaaggaacgctactcagaccacctaaccaactcagctagaggcccttttgctgagtagaatactctgaatgatagtaatgacagttctctgattctcccgctttgtgatggaactttccttggcatgacttcatgaaatacttgcatgaggtgcacccacatgggaaccggactagatcaagtaaaaactgagcctttctggctgaatcaacatgtggaatgtgaaaactatattgatgcttttgcgtgcattcacaacacaaggaacgtgtgtacttgcacatgcctgcttgtgttgatccaaacataagtatgtgaatcgtcacgaacctgacatatttattccttctgttatctatttgaagggtgcctgcatcaattctgctagctttatcagtttctcaatttgcatttcaaaattcaaactgagcattgtgcaatagcatattgtattttctgtctgtgagacccttggttgattgtgctggaaacttactgagttactgtgttgtcatatcatgtcctacacattggaacttttcagtgcaaattctctgtttctcaatccatgcatgttgttcttgttttctgaatggaatttgttattttatttgtgctaacagataaggatataactccaaaaactgttaatgacttgaagcttatcaatgctggaaggatattggagaataatcggacacttgcagagtcccgtgttccagtaggagaggtcccaggaggtgtaattacaatgcatgtggtagtgcgacctccacaagctgacaaaaacagtggtattgccgacaatttcagctctttgatcatagcattttcttggttcccatgacaaataacttgagttctatttccatatatttaattgaagtgtttgtcatgatcaactcttgtgctggaaacatactgctcctattcttgtggtagtgaatgcatctagggatgtatctctgttatccaaatactacaacctgaaagatatttccagttactccatgtgaatttaaactttttagttcaagttatgaactgagttgcttatatatgggagtagttttctcacgtgtacataagtcacaaagttcccggatcgatagggccgaggaatgcggctacctatgagagatttttacattgtgagaacaaaaatgaccccacgtatcttggtcggggatgacgtttcttgatcgagtgtcgctaccacttaacatgtttcttgtgactatgcgtgtacctatcatgtgtgtgtgcgcgcactatctccaccactaatgatgcctagagatccaaactttcgaacacacaaccacaacacaaccttctaataattttcaatacagcaagtcttgaggtgcttaggtatcttaggtgtcttaagatagaacttgtaccaacatgagcattaagggtgtgtttggtttgaggaatgagctggtacattttctcactcctcaattttttatttggtttgtggaatagaatgagttgatccatcaccacaacattctttataagctaataattagtatacatacgaggaataagttgattccaccaaaatttatggaatgaactcatgatgtatcaactcatgaagcataaggtgactccacaaaccaaacacactgtaagttgacgcggtggaatgtttgggtgatatgcggccacaagcatactaagtaatttctttttgttgtttaatatgatcttaactgtgatgctgaaagctattgtgattttcttgacattttgtgaacataccttaacatgttgttcacctataattttccagagaagcagcttgccaattccgtcaagcagaacagatgcgggtgcaccattctctgataagacgcctgcttgatgttgtacaatctgtgtagtcttaggattttgtatctgctttgctgtgttcacacaagcgtgaattcattttgatatccagtccttgaagccattcgagtccagaaacatacacactaaaaatccatcgaatatgaaggtttctggagggtagatttggatcgtcttgttccagagttgaggattggatgcttcctgctgtataaatggtgttgtcgaaactagaaaaaaaaactcttttatttcttttttcttttctgccatgttgacgttatatatatatcgattctttttagatcgaaaaaaaaaaaaaaactaacagaaatattgtactcagatataagttgcaaaaggagtaatgtatggtgttatggtaaaggggaaacaaagaggtgaaaagagcgcatggctagttttacatttgattctttggttaacctgacctgactgtgcatgcagtagctgaaggagcagtgatgtgttttagtagtaggcatacacaatttgctctgattacaattcttacaagtttgtacaaaaaagatccagtaaattatcggaaagcgcctccggtcgatccattcgtcgctcctccatgaccgtcgtcaccaccaccattcctcattttgatttcttcctatgttgtctccttccatctgcaaaagctaattcaggtc

SEQ ID NO: 14148 - DNA, 1803 bp, Zea mays
aacatcaacttggcttcgtccgaaagccgccgcacccgtttcgctagggttattcgcccacccaccgcgtcgccgcagctccatctctcgcagccatcggtgaaggttcctctcctgcccccatcgcgggcgcgcgcatctcgtcttcgcaggtgggctactcgtcgccttctcagtctggcatcatgcgtgatctcagcctctccttggccgagtactctgtctttggctccatactaaccattggagcaatgctaggagctgttgtcagtggtaccgtggcagaccgagttggtcgaagatctgcaatggcgatatcagatcttctctgcattttcggatatctcttgataaccttttcccagaatttctggtggcttgacattggaaggttctcaattggatgtggaattggccttctttcatatgtggttccagtctatatatcagagataacaccaaagaatcttagaggaggtttcgcaactgtaaaccagtttatgatatgttgtggggcatcacttgcttatgttctgggaacttttatctcctggcggactttggcaatcatcggagtggcaccatgtttgctgcaactggttggccttcttgttactcctgagtccccaagatggctggctaggtttggccacccaggtgcatttgaggcagcattgcagaagctaaggggaaagggaactgatatctctgacgaagcaaaaggaatcaaagattttacagaaaagcttcagcaattaccaaagtcgaagatgttggacctttttcagaaggattatatccgtgctgttacagttggagtagggttaatggtccttcaacagtttgggggagtgaatgccatttgcttttatgccagtgaaatatttgtttcagctggtttctcatcaggaaatacaggaatgctggctatggttgctgttcagattccgatgacaggactaggagtacttctgatggacaaagctggacggaggccacttttgatggtatctgcagctggaacatgcctgggttgcctactagttggattgtcattcttagctaaggaacatcactggggaaaggacctgaacttagtgctggctttggcaggcattctgattttcggtggatcattttcactgggtatgggaggaataccctgggttataatgtcagagatctttcccataaacatgaaaggagcagcaggaagccttgtaacactcgtcagctggcttggctcgtggatagtctcgtacgccttcaacttcctcctggtgtggaactcctacggcacattcttcatctttgcaagcatctgtgggctcacagttgtgtttgtggagcagctagtgccagaaaccaaaggaagaaccctagaggagatccaagcctccatgaactcatccttggcgcccccctctgatatatgatttgcctgtctagtttacacaaccaaataactggatgtgatggcagcatgtaaatactattgcgctacagtggttattatttgtacgcatacaagtttgtatatctaggacggcttgaagatatgattctcgcaggaccatccagctttgtataatattgtccgtcataaaaatgatactattgcgtcggtattgggaacctcgtcatcaaatgagatttagggggtgtttggatacttctactaaattttagtcactgccacatcgaatatttggatgctagttagttttcatacactgaagaggtaactataaacagagcaaagtattacacaattttttgagtttaataaagcactctttatcg

SEQ ID NO: 14149 - DNA, 6559 bp, Zea mays
  misc_feature (1633)..(1633): n is a, c, g, or t
aactaaactgaatttaaaaggtaatctatagaacttggatcaagtatacttctagccttcctgcatgtgtgtgtgcttgtttatatatataacagattgagggctaaaacaagtatatcacatgtgagctaatgattcaaccataaaccctatttcaacattatgaacttgcaagatagtaaatggagcacacaagacaccggtttatcccatggttcagctcgccataaaggattgcctaagtacacgttgttgagaaagccacaaaaggcttaggcttgccaccaaggctttccccaacctagttttcaaatcaagagacataaatcttgaagtgagggtgatttcttagttgtgattgatgattacaaacctcttaaggctgtcacacaattttgctagcacaggggcgatgcctagcaggctaggagcaagatccaagagtaataaaccctagaattatcggtcaagtgtgaatcaaatggtctttgaggtgggaaatcaatagatccactctccaatcgaagtttgatgcttttctcaatttttgatggtgggaatcaaagatttgcttgagagggaacaatggaggagagaggactaagcagttttatgttctgcaacaatctaatgcgagaaagaagttctaaccgttgtggtcgaatagatgtatatatatacttagtattcaagcggttatgttatgggtggcactatcgccctagccaaaccaggatagcaaataaaattttggtggttgatttggctcggtatgacgatgtctatcatgaattttgagcatttggtttaaaagttgaccaattgttcttgacccttgatagtacgacttttcataaactcaaaatataaaacataaaagaatttaaactcattgagtcagcaaaaccatattagtgattggtggatcctttgacctatataacatcctcccttttcgattctcttcttgtaatctcgataaatcttgttagttctctaattcggtggtcatcaacaccaaaatcctcattatggcttgattgcgcttacaactggctatgactatgagtacgaaggttgtctttgtttggatcgtgatccttctcttccttttataagacaaactgagagaaggatctattacataagttctaagggttgaggcatagcgagtagggggtggagcctcggcatgtagttccttgtcctccaggattctcgcgcagccgaaggactccatgggtgacactttcttcttccgttagggtactatagcgatgtcaccgttatcctgaagtctgtcgctatgcaccgtcttgtcgcgtggcagtttatgcattgtcctttggcggctcccttgcgacacgacagttgaaccggtgtcaggtgccacgctgacgctgtgattggttacgtctgcattctgacataccaactatcgtgtctttattctgatcgcacggccatgtccaaatctgacttgcacgttctcacgcatgtaatgttcagcgtgatacgatcccatgaatttcggacccgttctcgtcatgtaacttcactaagagcatctcaaagagaggatttaaatcgagtcctatatttaaatataagagttaagatcacaaatagcttncaacaaagtagctattttataaattttcaccaaatcagtataggactcgaaggcagagttgctaaatatattaccccaggcagcggacctattcatctccatccaacggtttttcaggcgtggtctttatattgaagagttcaatagcttcagtttaatcatcattcctcgcaggcgagtatgctgcgtgtgtagattggaagtgatacactctggtgttttggaagtgatatattctggtatgttccttcagatacagaaaggtgacagaaacctgtttttctttttctatttggaaaaaaatactagtgctagctagatgattttttgcatattcaggtaaaatatagttatatcatgtagtatgctgatgtggacacaaactttctgcttctgatttacttgctttggctattctatacctgctttgagcagcaaaaagacgaagatagagatggagcaccggttttatattcaatagatatatatccaaataagctacaaaccatgcaaaaagaggaaaggagagatggagcaccggttttatactaaatacatatgtattcaaatacggtatgaactacaagatgaaggaagagatcggcaagaaacaaacggaagaaaaataccagagaatctcgtgacggcgtcgaactggccgttatgggctcctggcggaacacctgacgaaaagaaaggcagcggacctcccatggcgtgaatctgaaaaaccggcctggaaggttgaaggatacgcgtgacgcggagtgtaaaaatgtgccgccaaatcgcacggagttaactaaccacacgggtttaggagttgccgttggagttgcaaaaaaactgtaggtcccaatcaacttaaatcagttccaattttgttttttagaccccaattataggagtccctcttggagatgctctaatgaagttaaagttgtttcaaaaatattcgatgaaacagttttttagaaaagatagcagatcatttttttcgttcctatgttgggagagaagttaaacaaatttatatatataaaaagaagttttccggctggaagaacagctgctgcgctgcagcttggcaaacggttgttcggctagctgattgctaccagcattaggtgcaggacagctgctgaaacgagcagccggacagcgttgtaagagaatgtctacaagacgtagagtatgggagtttatcctgaattctgtctgggcgagtcatgacctctcagcctattgatagaaatatgcgagccattcaatcggcccactcgagctgttcttggacttgcctcaagctaactagtcaaacactcaaacttagcccagctaacacccaacccggtatgatcccagctgattagcccaaaccgcgcagatcaggcaatagtttatccgagttaacgatgctttaagcttctcagttgacctgcaaaagacaagtcgtgaatcgtgatggtcccttcaggcttcagatttcagctttcacaggtgacagatgtcacatgaatgaacataacaaaggacaacagtaaggacaatggccgacaaggcttcataaactggattgcacatccagcctctgcctgtgcctgtgcaagattgctcgacagtttgtctgcagcttgcagtcacagctgcgggctgcccatgatgttcctgatgcgtcaagggacgagaagctcaggtgacaggtaggcgacgctcggcttgccgccgtccatgtccccagggcccccggcagagacaggccagaacgctgccctcatctctcgcgtctactgcatccatggcggtatccagctcagcgcagggaaatattatttgtttgccaaccaacctctgtttgaatgaatcagcacgcaaagtcaaatacagcgcttcatctggcgcaaagccaacaacaattattggtacaggtacagtgaaaactagccaatcgccggggagacgtaaaaataaacaataatctatacacacttgcaggcagtcgctcgccggccaggaatccacttctaaaacacgtctaacacgcgccggaatcccggtactgatgaaaggcagaacgctgggagggacggtcaggtcagtccagccggagcccggcgaggtcgtcgacgtagctcctggggcgcggcacgggcgcggcggcgacgacgctggaggcgtcggcgagcgccgtggcgtcgtcgtcgtcgtccccgccacggacgccgttgaagaaggggtcctgcaggaggtcggcggccgagggccggttccggggctggccgatgcagcgctcgatgaagccccgcagctcggcgtccttgagccgcttgagcgccgcgggcgggacgccccgggtgacgttgtggaagatctgcacgacgctgccgcactcggcgtagggcacctcccgcgtgaccatctccagcacgcacatgccgtacgagtagatgtccaccgactccgtgtacgtctccgtgtacagctccggcgccatgaactccggcgtgcccaggatggtgtgcgccacgtgcgtcttgtccacgatcgccgccagcccgaggtcgccgatcttgacctggccgttgtcacacggtttagatttggcagcgcgggtcgaacacgcatcgatcgttcgtgtatggatggatggaaagcaacatccaacagacgcggcgttttcaacacaaaaaagagcaggcaggcaagcagcgcgtgcggaatcccgcgcgccgacggctccttgcttgctgctgttatggtagcttagctggattaaacaagaaagcgatcgtatcaatataaccagcgtagcaaaattaaagcgcgcctccccgccagcgtgcatcccttgggaggcttctcctttattccaaaggagcagcccgcacaggaggagcatatctcagactccatccagctcgtgagatctctctgtctcgctggctttacgcgcggagggagagagagagagaggtacagctcgtcacagaaaagaagcgaaaaagggcgacaatagggtcccgccaccaatcccctagtgccctaatgcgcgggtcgttgtattgtacatctccagcaagcagcgccaacgaccagcaccagacacgaacccaattcaaattttatatatatctaatctatcctatttttcgctaataattagaaaaccctaaaattttggccttaccgcgttctgattgaattgaatgaatagaacaggatcggctgggacacgacgaaaatctctagaattgacgaaataaaggatgtatcgagaaagggggcaacaggcgatcgtatgtatgttacctggccgttgttgccattgatgaagacgttgctgcagttgaggtcgcggtggatgatgcaggggtcgtgggtgtggaggtggttgagcccctcgaggatctggcgcgcccacttcttgagcgccttgacgaagacgtggcggtgtcggtggcggtactcgcggaggctcccggaggtgcagacctcggtgatgaagttgaggacgccggcgtcgcggtccagccacaccttgtggaagccgatgatgtggtcgtggctgagcgagcggaggaggcgcacctcggcgtggaggcgctccaccatgccggggtcgcggtcggccagcgaccgcagccggacgcggttccacgccacctcgatcccctcctcctggtcgaacccgcggtacaccttcttgacggacccgagccccagcacgtccgcgtaccgcccgaaccgccccgtcgggtccacctcctcgaacgcctcctcgccgtccacgcggtccaccgccatggcggcggcggatccggttttgcgcgggcacgggatgcggcgcggcgtgccgcggatgcggccgtgcgcgcgcgagttgagggatgggggggcgcacaagaggaggaggggaaggagcggaccgttgcgccggcgcctatttatagcggggagggaggggatagccgtggtccgtggatagggacgaggaggctggttggcgtggagcggcgcggttgggcggccgcgggtgttgttcagttgttgtagaacagagtgcaccaggcggagcctgccgggtgcccgagcccgactgccccagcgagggaggggcatacgagtccgggacgtattctgctgcgtttgtatcggggatttgaccagacttgtttgcgcgctcgcagctgtcccggttcgtttcgttatctcgtctgttttgattgcggctagaccgattggcagtttgtttgtgtttgtcacagccacgcagaatgctactgtgcttatagaagaagaggggtaggtgaggcaggcttacctgattacggttgcgttgcttgggcctcttcaaccaacttttcaaatagctagacgaccgtgagagaagaagcaaaatcaaagggtcatgcaaactcttgtatatctgcttaaggagtaagaaatctttaatctacaatgcaaacagccgatttcacaattagccggtgtataattattttcagttaaactatctatttctacggctaaaagatccaagcgctggacctccagtgacaagtgacaacgccctacaaatgcccctgtgctccacgagtttcgtcaaaagtgtgcagcgcactccccgcctagctgctgttgagagaaggagctggtatgttaagcttggtgtctggcagactgcttatcgaatcggttgatggcctgttagaggtgagaaatgtctgaaatacccttaatatttctgaataggtatacttactaactagagtactacgtatggcttcaaggttgctgatctcttggtcaagctcctcatcttgtggtgttggactagcagtcttccttttctggcttcgatcttctcttaagaggattccatcttggttggtgtctagtggagcaagaaaagcctctggcaccgtg

SEQ ID NO: 14150 - DNA, 1384 bp, Zea mays
gccaaccaacctctgtttgaaagaatcagcacgcaaagtcaaatacagcgcttcatctggcgcaaagccaacaacaattattggtacaggtacagtgaaaactagccaatcgccggggagacgtaaaaataaacaataatctatacacacttgcaggcagtctcgctcgcccggccaggaatccacttctaaaacacgtctaacacgcgccggaatcccggtactgatgagaggcagaacgctgggagggacggtcaggtcagtccagccggagcccggcgaggtcgtcgacgtagctcctggggcgcggcacgggcgcggcggcgacgacgctggaggcgtcggcgagcgccgtggcgtcgtcgtcgtcgtccccgccacggacgccgttgaagaaggggtcctgcaggaggtcggcggccgagggccggttccggggctggccgatgcagcgctcgatgaagccccgcagctcggcgtccttgagccgcttgagcgccgcgggcgggacgccccgggtgacgttgtggaagatctgcacgacgctgccgcactcggcgtagggcacctcccgcgtgaccatctccagcacgcacatgccgtacgagtagatgtccaccgactccgtgtacgtctccgtgtacagctccggcgccatgaactccggcgtgcccaggatggtgtgcgccacgtgcgtcttgtccacgatcgccgccagcccgaggtcgccgatcttgacctggccgttgttgccattgatgaagacgttgctgcagttgaggtcgcggtggatgatgcaggggtcgtgggtgtggaggtggttgagcccctcgaggatctggcgcgcccacttcttgagcgccttgacggagacgtggcggtggcggtggcggtactcgcggaggctcccggaggtgcagacctcggtgatgaagttgaggacgccggcgtcgcggtccagccacaccttgtggaagccgatgatgtggtcgtggctgagcgagcggaggaggcgcacctcggcgtggaggcgctccaccatgccggggtcgcggtcggccagcgaccgcagccggacgcggttccacgccacctcgatcccctcctcctggtcgaacccgcggtacaccttcttgacggacccgagccccagcacgtccgcgtaccgcccgaaccgccccgtcgggtccacctcctcgaacgcctcctcgccgtccacgcggtccaccgccatggcggcggcggatccggttttgcgcgggcacgggatgcggcgcggcgtgccgcggatgcggccgtgcgcgcgcgagttgagggatgggggggcgcacaagaggaggaggggaagttttcgattaggatgttctaggtaatggtctcgtgc

SEQ ID NO: 14151 - DNA, 643 bp, Zea mays
tctttggcgattgaatttcgctagcaactttcacggatgtagcttccatacgaagacatggcacctcttcaggcagcagttgccgttgttcaaagagatgctggcagaaagatcctgctctaagaccaacctttgcagagattatggatacaccaaactctataaaggaggtggttcggagttctgtgcatcacaagaggcatttaggtcgatctcactcttcttcgagtttatgcgcgctgcccaggacaacatcacagcgctgacggagttggacgatgtcatcgggctcgactggatctagatgggatggaccctacttgcgctgaaggagagagagagggcgtacttggcttgcaggggatcgtagtaaggttcatctttttcatgggtcatgttatctgtcatgtcagattacacaacttcagttatttcagtctttgcgagagaagtaccaaaataattttacttcatggctactctcagatgtgttcatgtcgctaccactaatcatataagggtaacaatgtatttgttagcaaacaatttttgagatattaaagtcggtgataatataagtgttgttcgttttaaaaaaaaaaaaaaaaaaagaattcctgcaaggccggggggatccactagt

SEQ ID NO: 14152 - DNA, 1429 bp, Zea mays
gaaaacaattgccaagtgccaaccaagctcggtggctgaatagaaaaattgtgcccggcagcgagccagcgatggccagattcacgctgttttgctccggcatgtcagcatgtgacgaggacgccaccatcctctgcacctcaaaagtgagagcgagagcccccccctcaacatcactgacaccaccaaagcacgggaaagcagaggaagcggagcagagctttgtgggagcgtcaatggcaggaacttgggtgaagatggagcagaagggcgccggtccgggagcacggagctcccacgccatcacgctgctcgggggcacggcctactcgttcggcggcgagctcaccccgcgcgtcccggttgacagcaccatgtacgccttcgacctcaacacccagacgtggtcggcgctggacgcgacgggcgacgtgccgccgccgcgcgtgggcgtgaccatggcggccgcgggcggcacggtgttcacgttcggcgggcgcgacctggagcacaaggagctgaacgagctctacgccttcgacgcggcgacgcgggcgtggacgctgctgtcgtccggcgccgacggcccgccgcaccgcagctaccactccatggcggcggacgcgggcgcggggcgggtgtacgtgttcggcgggtgcggcgacgccggccgcctcaacgacctgtgggcgtacgacgtggcggcggggcaatgggagcagctgccgccgccgggggaggcgtgccagccgcgcggcgggcccgggctggtcgtcgccggcgggaaggtgtgggtggtgtacgggttctcgggcgaggagctggacgacgtgcactgctacgacccggccacccgggagtgggccgcggtccagaccacgggcgacaggcccagcccccggagcgtgttctgcgccgccgggttcgggaggcacgtggtgctgttcggcggcgaggtggaccccagtgacctcggccacctcggcgccggcaagttctcggccgaggcgttcgcgctggacacggagaccggcgcgtggacgcggctggacgacagggcggaggccgagcaccacccggggcctcgcgggtggtgtgcgttcacggcgggggagaaggacggccagcgagggctgctggtgtatggcggcaactcgccgacgaacgaccggctcggcgacatctacttcttcacgcccgttcttgaggccacaagctagcgcgtgtgacgaactggctggcaatgtgtagcagttcaatctgcatgtgcagggcttgtatgttgtgaattgtgatcatcgtcttgtgtcgtagttgagtttcctggtttgtttttcttaacttccgtcgtttttttggatttttatatgctgtgtgatttgagaataatcatggtaaaacttaaatcccagcaaaaaaaaaaaaaaaa

SEQ ID NO: 14153 - DNA, 1564 bp, Zea mays
gacctgttgtcctctcggacgacgacgagttctcgtgctcacgttccggtgttcgccaccggtggccacacacccatgtccgatttccgaaacatcgcggcgccgcaatccaatcaggatgcgatcaccctccacagccatcacgtgttggtcgtggcagaaaggacacaaaaccacggtttcacacggcacgcaccgcgcgaatccgtcgttcccactcgcacccgcgtcatgcgtcgccgcccccgcgcccccgcctatataaaaaatctcgtcccgagtcaattcatcacggggaactcctgcaaaactagacacttttacacagcgtggcagggcagcggcaagcagatcgcgagctcaagacaatggcagcagcggggagcgtccagggccacggcgcgcggttcgcggcggcgtgcggcgtgctcagccggtacgtaaaagcagcagcggtggcgactacgacgacggtggagctgcggccggcgggcacggtaggggtactccctctgatgcctggtgcggacctgtccacgcaagaggagcgcgaggcgggggcggggccggggccgtcgccgtcgccgagcgcgcagctgaccatctcgtacggcgggcgggtggtggtgctggacgacgtcccggcggacaaggccgccgaggtggtccggctcgcggccgcgcaaggcgcaccgcgggcgctgcgagcgccgccgaccaaggcggatgatctgcccatggcgaggaaggtgtcgctgcagcagttcatggagaggcgcaagggccgggtcgccacgcgcggttcgccctaccgccgtccggcgtcgttgccggaccatctcacgctcacgctctgatacagcttgttactactattactagctaggtgtgtgtagctgtagcagcataagaacagacgattgtacatggaaaaaaaagaaaacagaaataactctccgatcgagttcacgcagcaaaattttcaagtcatcaaagaatagtagctagcagtcggtgcaggaagcttcttggtgcggaacactggatgagtacaagtaggccgtcgctttcgcgcacccaccggggcgtgtctcggagccccggcatctgcatacagcgtatcggccggccgcttctggtttaccgttgaaattactttagcgcggcggtcggcggtcgggctggcggacgtcaaatcgatcgtgtgccccgcgggccggcacacgcacatcgctactccctccttccttcggccgcctaacatgcacgtggaggtcttttgcaggtcttcatcttctttataaacaaaaatagggaacgaaaccgtcaaaccggtgaactttctgtgggggtgtggagcccgagttgaactggattttttctagtccctgctacttctggtcggcccgtgcgtacgatcgatttcaaacagctttctcagtcaaaaaaaaggttcattttgtcttaaaatcattgtatttctacgatttcaaattttctttttgcaaagcaaatagccaaataggcaaatagtacgacgagttccaacgcatgtttacgagcg

SEQ ID NO: 14154 - DNA, 4317 bp, Zea mays
  misc_feature (2951)..(2951): n is a, c, g, or t
  misc_feature (3647)..(3647): n is a, c, g, or t
attgtcgtggcctcgtcgtgcagggaaagcttagtccgcaaggggttaggaaagcgtgcgggcaggaccggggggtgggcatggtatcagctcctggatggggcgaaagggtggtttgtgcgtgcgcagagagcgaggcaagggtgggggtgtggagggtaaaattatggtagtgccacagtctacactattaacttaatatatagtagttaaaaagaacaacaaacttgttatcttccaatttacttcctattttttttttcaaatggtgaatgtataagtagttggtgaaaatgttgcttgcttgctattatactttttactagtgttatatgtgtggtcgatggataacttagtgcaaggtcacttgattatacaacttattatttatatttcatttctctactaataatttttataccaaatcatgaactcaacgttcatcacataaattttggaccatgatctaattaatcattacaatacttattgattctgaggagaataaacatattaggagataaaacccacagataacccgtggatacccgctaacccgatgggtacgggtttataatgggtatagatatttttcacgggtatgagtttaggataacaaaacccagtggatttgtaaccgttaccatctctattgctgatgttcaaagtgctgctctatccagctcttgggcggtttctgcagactgcagcagagccgtttttgcttcggtagacaagtggagctacaaccactctagggcatgccaaacgtggacgtggcattaaaaaaagagcaacatgaatggcaaacatctttcttttttttttttctttgatacataataactatagtatagatggatatctcactattctttgttttttttaccttctttacagaatgtccagtttacatagacctggaacacctacaacatacattagcactagcacatctgtacatgacaaccacaaaaacagacagcaacgcccaactattgtactccagctgtccagcatacgctagacatcctagtgcaggcgtgcagcatgtgctgacttgtgacgttgcacagtggcagcataggttacatagcacgcacatgatcatagaatcccaggttcacagttagaatagagagaggtacactattgacagcagctgatctttccttccccgacatcagcattctggtaggttgacacgctgtcctccatttcatgttcgacgtctttctcgatatctttcttcatgaacaggcctccaagctaagtgtctccagtcagtgggctccctaagccctgtgtcaactcaatcccatgaacaaacttccattgttacttttggcacaagttctccaggcccttcagaaagtggctgttgactgttgtcaatatcaacagtcttcttcatcttcttcatcataaataaccataacgtgacatcaagcatatcattttttttcaggcaagaaaatggtgagcagaaagtatcatacacagtgccagttgtgcagcctttctttctttcttgctcgcgcttcatccccatctgttcccctagttttaattgagcagcagcttcagcagcgttcacctgggccggcctcaattcgtgctctctcttaaatttgaaagtgtagacatgtaatgtaatgtcaacattcgaaggtggacagtggacataacccttgccaaaattgttacagagaagagaagtaagtaagtaactagcatagcaacagcgtaaatagttaatagataaacacaggagtgagaaaaaaccagaaatggctctatgcatatatgtgtagcatattccaataaaccccttaacacaaggtgcagctgcttcgctgagtttggagaggcacaaactatatgctttgctatgcggctatgcccgggacttttggggacggaaaacaactagctggagctactgaaggaatagcaaggataaaaacatgctgatctacactcagattcatgtagcagcatagcaagcatccagaccaaatataaggtgagctaatacttctagggatcaggagtcatgttaatcacaatcagcacatcaactatgaacacgctgatctacacccagattcatgtaacgttaacctagctcgagaagcccaattatgcctaacctgttcgctgtggcacatcccaccttatacaaggaccaagctccaattatgcctaactgaatatcgcccaattaattaacaaatcgaatagacgcaaccatactgagggccagcagcagctagaagcaaagcaactagcagcttcgatgccagggtcaatcgactcaacgacagcgcctatggtccagttacgaacaggggcaagaagagaagaaccaacctggtgccagctctgcctcccgtcccagagagcacaggctgccggacgaggcccgcctatcctcatccaccgtgggggtcacgtactcacgagtctccacagatcctacaaaggcgcgaggtaagtcggagatacgcggcgccaacagagccgctgccgtaacagcagcagcatttgctcttcaccggcgagcgagcggcggcggagtagagaagggaaaggggacgacgacgacacggtgcctcccagtcccacctccgggttggactggtcactggacccgatccttcacctaatcaccttcactcgatcagtcgggctcgagcggcttcatttcactgacatgtgggtccctatccgcagctaggattctgggcccctgtggcagccagtggaagagttcctctcacttaacagcatctcttctctctcccacggttgcttccaggtcccaccacgtagggaggggattggagacgccgagctccaccggaggcgaaggcggaggcgcgtggcgcgccctcggactcctcgctggtgagtgagcggtttctgccgccgcttccccctcgtcgtcnttgtccttcccgtatcagtggtggattcgatctggacctcaagcccagatccgggcttacctttcgctcctcggttggtgattcttggttgaccgatggattggtgcacggatttcacttccctagagaaccctggttgtcgagacgctggtatttcgtgtggcgatgtctggccttggtaggaatgtagggctagccccgtttggaagatgctgcgaaatgccgtgcaaaattagggtgcatgtactgcttgaagcattgtgtgcatttattactcggcaatgatatctgcctaattttctgtagctctggttggtttgtggtagttttgtagcattgggagtgttagggcatgtacaatcctgtctcttaagtcgtctcttaaccgttttagggggtaaactgcaaaaaaaatataggagtggactctggcgcattgctggaagagacacctccggctctggttgtacgagttggtggtcgtctctccagatccgatgctcttcctggtcgatggcgcgaaaccgtggtggctaaatcctttcttcctgcttgagtagacaacatcgcctttccctcgcaatgccactgaaaagaggtgctgctggcacccgctgcaccacctctgctgcccatggcgccaccgagtttgccaccggcagccgatccgtcgcgggccaatccgccgcccagttngtcgttgaagctgccacccagttggccgcccaagccaccaccccaaccatcgccctcgttcttagatatgcttcaaaggtaaagtctctgacttgcttcactaatattgtgccatgcagtcctgcgaacacacaagaacacagttatcctctcgaccctttgtgtgtgtgacactccaatttgattttgagatctaatcttttctgccatcaaattgcactgcatgtgagggctagctagtgtctagattaattgattagatttggtgtgtagcatcaatgtatatcatgttcggtgccgctaatgtctagaataattgattagacgtggtgaacataatgcaatgttgtgtaatcttgcacaacatgatagttgaagatgaaaaagaaatagcacgaattcctattgacttgaatgtaaacccgggagcatctattgcgctaccacccgaagtgagcacccaagctaatccatgctttgcagatgtgcttcgaagaaattcagaaattcaagacaactcaaagcatattgagctcaagacagatttagttgaacatatatggcatcgatatggtccaaagtagtatgaatattgtaattttaatttcgtgttacctaaattatatattatttatggaaatattatgagtcaggcacaatacatctttgc

SEQ ID NO: 14155 - DNA, 3040 bp, Zea mays
  misc_feature (2992)..(2992): n is a, c, g, or t
ccacgcgtccgcactgacatgtgggtccctatccgcagctaggattctgggcccctgtggcagccagtggaagagttcctctcacttaacagcatctctctctctcccacggttgcttccaggtcccaccacgtagggaggggattggagacgccgagctccaccggaggcgaaggcggaggcgcgtggcgcgccctcggactcctcgctgtcttgtttttcaggacaaaatggaccttgcacctcagggtttgataacacagcaacaaaaggcaaatgagcgaaggccagttggtagctcacaaatttggacacggtatggtgttctgcttccaagccagcagactcgaaagctaaaagaatggattctgactgatgagcagcaacagcttgttaatgctagtggtcttggacatctggcacttaccactgggtttaccattgaccgttctttgctgacatctttttgtgaaagatggaataatgaaacaaatactgcacatttcatgggatttgagattgcgccttcacttcgtgatgtttcatatattcttggcattccagtgactggtcatgtggtgaccgcagagccaattggtgatgaagctgtgaagcggatgtgcttgcattatttaggagagagccctggaaatggagagcaactgtgtggcttaattaggctgacttggttgtataggaattttcatcaactacctgaacatccaaccatcaataagattgcatatagcacccgagcttaccttctataccttgttggttccaccttgtttcctgacaccatgaggggatttgtatccccaagatatctaccactgttggcagattttgggaagatccgtgagtatgcttggggggctgcagcccttgctcatttgtataggggattgtctgttgcagtaacacctaatgccacaacacagtttctcggcagtgcaactttgctcatggcctggatttatgagtatcttcctattactcaaccacaacagaagaaccagagcacattgctgccccgggcttgccggtggaactttggaggagcaacacgtggacagagaaaaaaagtcatggactggagaaaagtttttgagcaacttcaattttccgaggtcaactggaacccttacaaggacatgaatccagcaattgttccggaatattgcattgcagcagataacatctgctactctcgtacttggctaatcagctttaacataaaggaggcgtatgtgcctgacaggtttgctaggcagttcgggagggaacaaggacgcctccatggtgtgccaatgtggacaagaagaacttggagtaagtggaaagactggaggactgagtatgctcgtgagattgaggagttccatcaattggttggctgccatttcacccctcctgcggaaaccaatatcaactcctttccactacatgagtctagtgctggacagaatgatgcaggatgcagtctgaatatctctcataatttttctgcaatggttgaagatttgaaaaatgatctcccagtaattggtcgatatcttgagggaaacttgcttccttcagatgttgcaagcttcctagagagggtgagcacgatgatcaagagttataccccaccacagggcagccgaaggaaagatcgagtaagtcatggccccgctgacccagtcaggtcaaagaacccaagaaaaaggggaagacattcactctttcaagattcttttcctcatcggtatctaggcaccccggtaaacatagtgtttgatggcaccattcctctactaaatgggggtgaggcattgaaggaacaagtggccatggatccctggcgggtctcccagtcccatttgacgatgaccacatcttcttcatctctagactcaagctcaccagaatcaatgaagcggaggcgggaaggtggggatgaaattccaatcacaagggacactgattgcctccaaagtggaaggctctgtgtgcagctgaaaatgttcaagcacagagatggagtgaatgccgaggcagctaatccgattttccgctgacgaagacaaaacttcgcttggtcttcatattgtacaaagtagcaaagaaacatgacttgtttgctgcactgctgacagttagctggccaccaacaccgctctgcggtattgctgtctgcaatttgcgaggattttcctgtgtttatatcgttgtgaaacagttgcctctgtgaaatagatgccttttcagaagcgatagagttgtaactgtttatgacaattaacatggctattaaaggggcaagtcttttggcacagatagtgggagtggttgttctatcttttaatgataaggcatttcttcacgttttatattcggtagttagatcaatgtaaaatttaagctcttcgttttattattttgtttatatttatacttacacgtgctatcatgtacgctctctactgatcactaaccgtgtgtttggtcgtgtgtttggttgcgcgtagctggatagcctggccgtcgtcatgcgttgacgaggctccgtgtgtttggttgcgcgtaggctaactctctactgaacactaactgtgtgtttggtacattaaccgtgtgtttggttgcacgtagctagatagcctggccgtcagcatgcgttggcgaggctccgtctgcatgcgttggtgaggctcctgcgcatgtttgtttgcctgtatgcaggtggctaggcatgcatatataagtgcagtcacgtcttttcgaggggcttttgccttgcatccgccgatacgcgtaaaaccttcgtatctgcgggagcaggctcacgtgaggccggttgcacacatacaggtattaaaagaaagttgtgtgcaaccaaacatcccccacttgttatttcattaaacaaaaaattaccagttgcaatactttgaagcttggtttataaacgattataacggaagctataatacccctacaactattnttactattatatatatatatatatatatatatatatatatatatatat

SEQ ID NO: 14156 - DNA, 1610 bp, Zea mays
  misc_feature (1607)..(1607): n is a, c, g, or t
gcacgagaccattacctagaacatcctaatcgaaaacaggtcccaccacgtagggaggggattggagacgccgagctccaccggaggcgaaggcggaggcgcgtggcgcgccctcggactcctcgctgtcttgtttttcaggacaaaatggaccttgcacctcagggtttgataacacagcaacaaaaggcaaatgagcgaaggccagttggtagctcacaaatttggacagcctggatttatgagtatcttcctattactcaaccacaacagaagaaccagagcacattgctgccccgggcttgccggtggaactttggaggagcaacacgtggacagagaaaaaaagtcatggactggagaaaagtttttgagcaacttcaattttccgaggtcaactggaacccttacaaggacatgaatccagcaattgttccggaatattgcattgcagcagataacatctgctactctcgtacttggctaatcagctttaacataaaggaggcgtatgtgcctgacaggtttgctaggcagttcgggagggaacaaggacgcctccatggtgtgccaatgtggacaagaagaacttggagtaagtggaaagactggaggactgagtatgctcgtgagattgaggagttccatcaattggttggctgccatttcacccctcctgcggaaaccaatatcaactcctttccactacatgagtctagtgctggacagaatgatgcaggatgcagtctgaatatctctcataatttttctgcaatggttgaagatttgaaaaatgatctcccagtaattggtcgatatcttgagggaaacttgcttccttcagatgttgcaagcttcctagagagggtgagcacgatgatcaagagttataccccaccacagggcagccgaaggaaagatcgagtaagtcatggccccgctgacccagtcaggtcaaagaacccaagaaaaaggggaagacattcactctttcaagattcttttcctcatcggtatctaggcaccccggtaaacatagtgtttgatggcaccattcctctactaaatgggggtgaggcattgaaggaacaagtggccatggatccctggcgggtctcccagtcccatttgacgatgaccacatcttcttcatctctagactcaagctcaccagaatcaatgaagcggaggcgggaaggtggggatgaaattccaatcacaagggacactgattgcctccaaagtggaaggctctgtgtgcagctgaaaatgttcaagcacagagatggagtgaatgccgaggcagctaatccgattttccgctgacgaagacaaaacttcgcttggtcttcatattgtacaaagtagcaaagaaacatgacttgtttgctgcactgctgacagttagctggccaccaacaccgctctgcggtattgctgtctgcaatttgcgaggattttcctgtgtttatatcgttgtgaaacagttgcctctgtgaaatagatgccttttcagaagcgatagagttgtaactgtttatgacaattaacatggctattaaaggggcaagtcttttggcacaaaaaaaaaaaaaaaaaaaaaaaanaaa

SEQ ID NO: 14157 - DNA, 973 bp, Zea mays
attgggtacctcgaggccggccggggaaatatttctagctctagcacttacttttcacgtcatgaatgctcgtcagctcgtgagacgtgacgccgtgtcctgaaaaaaaaaagacccgtcccggcgacccccacacccttcaatccgggaaaaaaagcaacagctcgattgcccgggtcctccaaaaccctcgagatctcggttggtggtgtggtggggtgctcttccctctcgcctccgctccgaagcatcgatccgaactcctcggttactcgcggcagcggcgtgtcgagatgcgccccaacattatcacagaggctgggattccaactaggttgaatcagtggtggagcagcattccgttcgttacttctggtgttatcttgatatgtggagtaatttatctgctctgcttgttgattggctatgattcctatgtggagatatgcttcttgccttctgctgtagcatcacattttcaagtatacaggttctacacatctgttctctttcatggttctttgcttcatgtgctattcaacatgcttgccttggtacccttgggcactgagttggagagaatcatgggatcagtccgtctcttattcttgatgctccttcttgcaacaacaaatgcaattctccatctcacaattgctttcttggtggcttacaatcctctgtatcacgttccaaatcttgtgaatgaatgctccattggcttttctggagttatattctcaatgattgtcattgagacaagtctgagtggtgtgcaatcacgaagtgtcttcggcctcttcaatgttcctgcaaaatggtacgcatggattttgctagtgctatttcagtttctcgcaagcaatgtttcattgctgggacacctttgtgggcatcttgtcaggatttgcatacacttacgggctgttcaactacttgcttcctgggccatcatttattcctaaaatcgaag

SEQ ID NO: 14158 - DNA, 1107 bp, Zea mays
acaagtcacaacgccctagagtagaggctgagctgcatatatcaccgagcaccctctctctctctgttcccctccctcgctcgacatggaggtcgccgccgccacttgtacgctccttgctgccgtcgccctaccagtttcgtcctcagcagcagcagcacgctctgcgacgaaacagagctactcgaggaggaagacgacggccgtgcgagccgtcatggcgaggccgcatcaggtgccgccgcctgccactgccaccgccaccgccaccacgtaccgcgacaactggttcgacaagctggccatcgggtacctgtcccggaaccttcaagaagcttctgggatgaagaacggaaaggacggctacgagggcctgatagaggcggccctggccatctccgcgctgttcagggttgaccagcagtgggacactgtggccagcgctctccaacgggccttccccagctacatcctcaccatgatcaaggtgatgatgccaccctctcgattctcgcgggagtatttcgccgccttcaccacggtgttcttcccttggctcgtcggaccatgtgaggtcagggaatcccaagtggatggaagggaagagaggaacgtggtctacatacccaaatgcagatttctggaaagcaccaactgtgtcggaatgtgcacgaacctctgcaaaatcccatgccagaggttcatccaggattcacttggcacggctgtctacatgtctcccaattttgaggacatgagctgcgagatgatctttggacagcaaccacctgaagatgatccagcactgaagcagccctgcttccggacaaaatgcatcgcaaagcagaatcatcaagtgaattgctctatttgatttgagaggaagtggatatgtaaattactatactactatcagtggaaattcccaaaattacatgctttcatgtttattcccttagtaagcagcatcagtttcatagattctttttacttgaaaacatagcagaaggcaattctagtatacgtcaaattgttaggaaactggttgctgatcaagaggattgaagaggaaacacaagatatgcctttgtaaaaaaaaaaaaaaaa

SEQ ID NO: 14159 - DNA, 7989 bp, Zea mays
  misc_feature (4683)..(4683): n is a, c, g, or t
gagttcggctgccctgccgcaactgctgcaactacaattaatatagacataatattgtataagttgcaaccgcggacggattaaagccgcagctaacaagcatgccacattggagccgaccgctgacgtggatggcactacctggagctattagagatcagcagcgaaaaatccacttcttcaccacagctgtgccgcggacgctctggaacctaccagctgtgtttagtttctgttaaccagaggaacgaagaaaaggaatccatatatatcttatcttcgcagtcttctctgacgcgacaggagatcggatctggtgttgcttgatacaatgatactgcaccgtgcacatttatgaagtcaaaaaatgcttgcttcgtcaaatggaagggcacacgacacattgctaaaataaatagaatagatggatgaatgattctgcacaaggttattaattagcgtgatcccaccaaccagcaataacaataaggccttgttcgtttccgtcggattacacccggaatcttccagctaatcaaagtttatataaattagagaagcaatccggtcaggaatcgttccgacccaccaatccggcagaaacgaacaaggcctaagtcagtactccctcctccgccctattccatctatttgaaaacggtgcgatgaaacccacgtgtggatactccaaggagatgttcgggagagcgcgcctcgcacgtcacgaggcaaaccacgcccccgcgcgcgcgcgcccgatgcgcggcgtcaccccgcgccgtccaggactcactcaccagcctttatttagccataccacacatataggtatgtgttgtacttgaggagtttgggggggagcttctgctctctgtgcacccttattaggctggcgcggacagagtgcattgcctgcacctgcacagagcagaactactggtccagttgcttgcgtgctaatcatcacatcagatcatggaaggcgaacaggtgtacgtggactggagagggaatgcggcggacgagaggaggcacggaggcgtcagggcaacggtcttcctctacggtaagccgatgctgccgttactattgttgtccctattactagtattgttccatgcgttgcgtgcacagtagggggagattgtcttgtctcagtaccaagaaatgttgcacgctggaccatctttctttgttcgtgatttctgttctgccgttttttttttcctgaaatgagagtaagctgttggaggcttggagcctaatagatacggaaaaaaaaggagagagtgggagagagagaaactcataaggggaaagaatcttctatctgggttgaaaacttccgtagtagcgagcgttggattggagctacgaaaacgatctcaactcgatcccatagaaactaaacagacgcagaaagggaatcccatgtctgcaaagcggtaccagtactacaagaattgtacgcaagggagggcttgcgttgcgcttgcgccggcacgaggtatccaacgcgcgcgaaatgaataaactacgtacgatctggccgtcctgtttttatttttattttttaatctctgggtaacctgatctgtgcagagcagcaggctagcaggtgcgaggagcgcgtgataagcgatcaagcacagaagaagaaaaaaaaaaccgttctacccacaattcaaacccccaacctcccaccaaagattctaccctcggttcctaaaaccgtccacgtcccaaaagttccaaattcaaccaaacatattaaaaaactaatatttaattcagtcgtggaatatatgtttacaataaataaataatctaaaggtacaaataagggttttcgtcgtgctactttagaagccgtttatttaatataagatcggatggttaataagctcatctatgattttctagctaggagtaatagatgaaatatatcatttctctaattttaattttttttgggtaaaatagtctcaatgcatttctccagatgttggttggttggacttacatgcaatttctgaaccacacaggcacacaacacaaaatcatttcagccgactctcatctcatgtctgtttgcagttttgttcatgctacgaagctgctctaacagctcaaacttcaccgtggtggcctatttgcacggcacgttgcatctggacattgtgacctcatcaaccgtgataggctacctggttggcaccgtgatgatatctgctgctctcatgaacttcatctctgatgcgtgtatgatcaagcgaaccaccgctatatttgtattcggaccctgcgtgatcctggtagtagtttacttctctcgagctaattccatgttaaagaaaaaaaaaaactaggtttacttccatgctgaagctggatttttttttagataatcactattgttgtttctatcaaatatgttgattattcatgttttttttttattttagaccataccataattataatacaagacagacataacacattagtttattccataaaaaaacgcacaaatagaaagtgctctatagcatttttttcttttgaaattgcaaaaaaccagaagaacaaataatttcaggttataaacaaatcttctgttggacgatgcagggttatatgttgctagcactgcaagcccatttccctgcactccatcctgaaacctgtgccatagacgaagagccaaacaactgtgaggcagctcggggttggaagttgacactgctctgcttgggcctgttcatgtttgctgttggggagggctgcatgcgtgcctgcgtaccacccctcggtggagatcagttcagcgacagtgacccaaagaaaccgcagctcaggagtacgttcttgaccaggcttaagctcgcaaactccctcggagcgatgattggattggccttcttagtgtggattgagaataacttgggctgggacatcggatttatgacgtgtgctcttgctgttcttgtagggctgcttgtggcagccagtggatgtcctttctatcgcatgcagaagcctagtggatgtggaagccctctaactagaacattgcaggtaaaaaagttcatacgtacagtaagcatgtcatacacaatgtacttcgcaattcagtatttttgtgttagttctttttaatgaacatatgcaagaggactgcgtgctaatggcactgaccatacgaaagttcttacggagagttctcaagttctgtcactggtactgctacaggttcttatcacttcgtcaaatcagaactcagctgccaatgtagatgatattgagctacaagacaccaacacacaaggtcatgttttcaaatctgggtaagttccattgttcaggtttccatggaactcatgcttctttaacaaaacaaagaaacagtatttctgtggataataatgaactatttttctagctagacgtagcaataccatgccggttgtgtcaattgttaatctcccctctccaaacaactgttgaacaaggcctggatacatacatacatacacatagatgatggaggtaacaccaacaactggcttttcattttgcagaaccaatcaagctgatgaaaccagggtcctcatccagatgcttccaatcttcatcagctgcttcctcgtctacctgccattcgtgctgctcatgacactaaccatacaggttggccgtgcaatggacagaggtgcaggcgcgatccagataccctccgccgcctctctcatcgcgatcccaacagcgttccacacgctgatgcagccatgctacgacagaatcctgacgccgctgctgagaacagccaccggacaccagcacggggccaccccgctgcagcgcatcggcgcaggatcggcttgcgggatcgcggcagcgtgcgtcgccgcgctagtggaggcaagaaggctgaacgtcgcagagcagcgcgggctaacgacgtcgacaggaaccggtgtgccggcgttgtctgtcttctggcttgtgatccagttcttcctgctgagcgtcatggacacggcatccttcggcgggctggctgagttcatcaggagcgaggcgccttcggcgatgaagtcgatcgcgccagcagtgcagtcctgcgtggctggactggctgcctggtcatgctgcgccttcatccatctcgtgaacaggatgacgaggagtggtggcggtggagacggggggtggctggacggaacggatttcaacagagcacgccttgatcgcttctttctgtcgctgggagccttcgagctgctggcactggtcaattacacgttctgggctaggagatacgccaggaagctgcgacgtgtcagtactgtcgtttgatgagaacgactcaaaaaattaaacacaaccaaacagagcatctcttaaaaaaaatcataaacttagacttaataagttgctaaatatatagcgggaacaaaaacaactatagtctccacaatagttctctagcctccaacggcgtaaaggccaaccaattttgtcggtttttttcttcttcttaaaagctaatgttaaatgtattttaatagattttgacttaaatgtatcggcggaccttgaataatctcgtaaggatttaagggtatatctcgtatatacataaaactttaaaacatatttctgaatctaaacttgttaagnctgcattcgttttcgcctgaccaatcaatcagcctagtttagaatttgatatagcttgctagagctgttcttttgtcttaggccagaaacaaagtcatctgttttaactcctccacctcaatccttagcctagaataaacttaggtgaccaactattcggattaattcctatgctgaaagtaggttgtgttggtttggtttctggcttagcttcaatcctggtctgccgaatagataatccatacgtggtattatctactggacaattctaactgacctagcatgtactactttaacatatggcattattttctcttggaaaatatccttctctctcttgcctacaaaggcaaatagagggttcgccacaaaagccaaagctacttaggccccgtttagttagattgattaatctttatttcatagtttttagtctcgtttagtctttattttgacaaataaaaagactaaagtagagattaatttgctttagtctctagtctcccacatgggtgctaaaaatgactaaataacaatatttactctaattgatcttgtctagaaaactggtgtcatacaaagaaaataagaaaagggatattttgatctttatttgctacacttaatatatttagaatctgtttagtcagtacaactaaataaagtagagactaaaatttagtctgaaatcaaatgggaccttaatcattttctcctagcgcgctctctctctcgtgggcctcacaagtcacaacacgcctttgagcctttcgttacctcctagtccctagatcgaacagcagccacaacacgagctcagacgccaatccctcccgctcctcttccttccctcccagccacagatcacaggcccggagaccaatccaaagagtcgctagcgcgtacatgagcgtccaaaccttaacgtactacacgccaaccaaacgccacccgataataaaaacagagcgccacacgagcgggcgcaacgatgcttcaggttcgcgcgtcctcggccttcctcccctccacctcctccccctccccgccatcctcgtcgcaggcaccggcgccagcgccgttccggctctcggggaagagccagcggcgcggcgggctgatcgcggtgccgcaggcgagccgcgtggctaggcggtccgtgatggcagcggcgggggcagccgcagccgccccggcggcggccaagctcgaggacgccgacgcgctcatcgactctgtggagaccttcatcttcgactgcgacggtcagacaccccgccgccttcggcttcttaggtagtggacgcgtgaatgggtctgctggctgccttaaactcgcgcgtccgcgtgtcgtgtgccgcgcaggtgtgatctggaagggcgacaagctgatcgacggcgtgccggagactctcgacctgctccgatcaaaggtccgtgtccgtcccaaaaccacaacgctttcctcgatcccctctcgttcccactgaagctgcagtgctgctggctggtacgccggccgtttcagggcaagcggctggtgttcgtgaccaacaactccaccaagtcgaggaagcagtacggcaggaagttcgagacgctggggctgagcgtcgacgaggttggccgggttcttaatcggcactcctcgtcatgaacccgcttctgttcgtcggtttcctctgctgctgctgctgcctgctgctgctaaccgatgagaccggccgcgggtcgctgcttgcttgtgcgcaggaagagatcttcgcttcgtctttcgcagccgccgcgtacctgcagtccatcgatttccccaaggacaagaaggtacctctcgccattcgaagtaacgtgcgaaacatgcgcgaagtttaacgtccagaatataggtgtatgtcatcggagaggaagggattctgaaggagctagagttggctggatttcagtacctcggtgggcccgtaagtaacaatgccactgaaatttcacaccccatggatatcagtcagcatttgctaattttgaccgtgcgaagtctctgaagtacggactcacgcagctcagatttcatcgtcgtgctgcagacagacggagacaagaagatagagctcaagcctggtctctacatggagcacgacgaagatgtacgtatgatccttctccacgttctgggggtgggtgtggcatgctgttagaagtagaccaaccaaatggcacgcttttggagggtttgttttacaggtgggagcggtcgtggtgggatttgatcgctacttcaactactacaaagttcagtaagtcttcagagcttcgcattgctgaagcctacatgttcatacttcatacatacagaatcacaccaatatcgttccacaaggcctgtaaacttgccgccgatgcgttttttttaggtacgggacactgtgcatccgtgagaacccagggtgccttttcatcgcaacaaacagggacgccgtcacccatcttactgacgcccaagaatgggcaggtggcggagcaatggtcggtgcacttctcggttcgactaagcaagaaccgctcgtggtcgggaagccatccaccttcatgatggactacctggcaaagaagtaaagaggctcgaacaattctaaagatgtcccgtgtttgagattttcgtcgaaggatgtgtgaatgttttaagtgtaataataaaccatacagcccacggcaagttttccagattcttacatttcttcatgacaggttcggaatcacaacatcccagatatgcatggtgggggaccgattggataccgatatcctgtttggtcagaatggaggctgcaagactctcctcgtcctctcaggttttcattagttcctcagttctaactctgatttctgattgatacaaggcactgctgatttaacatcagcataagtattgagcttggctgtctcttgcaggcgtgacttccctgcagacgcttcagagccccgacaactcgatccagccagatttctacacgaatcagatttcagattttctcaccctcaaagcagcaactgtctgaagagcccgcgttccatttgcacagcatgtcagcatcggcctttttttaacgaataaggaaatacaaaggacggatttgttttttttcactcttgtgtaatcatgggatatctttatgtgcaacatcagccatgcaaatatcataaggatgccaagaattaatctaaattctctagtcaacctttttttttacttcagacaaaatgcatatatatgtcctattgttaacgtaccagcatcaagttaccaaaatg

SEQ ID NO: 14160 - DNA, 2240 bp, Zea mays
gcttctgtccgtcaaagctgattttaggtgccaaacacgtagctatttggtctgattttccggcaagcgcttggcgctgaatctgctgttacacaggctgagaaaagcgaccatcctgccgcgtctggaagaagtcggtcggattctcgatgcttggccaatggccttccgtaccttttgtttctaccatcattacattcgtccattatactataatgatgttattttggagtaaaccacatgtagcgcgtagtgtagggtatttgttgcatgcaccgttattttaggaattacggaataatttagttttttttatggcggttatgaataaataggcaagtaaaaatgttacgtacacgaacggatcacattagcgtgataattgacacataagagtattttggacattttgtaatgggagcttagaatcagcccacgtagaatcaatatttccaaacgcccagattatctacacatcgattctttccagctagattcttataaaactagtcagaaaaaaaagtctaaacatacatgcccatttgtcatggctggccttgttaccggacacggcacctacccactgcgtactacccctcctctaccaccgccgcctacttgccgggaaaccgacccgattccagtggctcggatgtaaattcatccggtcccccggccccggcccgcacccgccgcatccctctatgaaaatctcacccccctggctggccgggggcaatcctcctccttctttcccctcgccgatcccaggtcccaatcttttccttctccgccctcgccgccggccaacatgatgcacatgaccttctactggggcaagtccgccacgatcctattcgacggctggcgcacctccacgtggctcggctaccttctctccctggtggccctgctcctcgccgccgccttttaccagtacctcgaggccttgcgggtccgcgtgaagctcatcgcggaaggatccgccaagccagcctcctccatccctccacccgccagctccgacccgcggacgccgctcctcgcgcccgccttcgccgggcgctggccgccgcgtgtggccgtggccgcgatgttcggggtcaactccggcctcggctacctcctcatgctctccatcatgtcgttcaacggcggcgtgttcatcgccgtcgtcgtgggcctcgcgctcgggtacctcgcgttccgcagcagcgacggcgaggatctcgtcgtcgtcgacaacccctgcgcctgcgcgtaagggtgtcgggctcgccggattgccttgtccccaggtttgccttgcttgttgatgttgtagtataacacaggtatcataataaaaaatcatgtacagatccaattgtgcgtttggaggacttgcagtgttcaggtgtgtttggggtgcattgtagggtaaagaatcagattaatgtatctgagcctctgaggagatggtttaactgtttttgagatcaaatttgacaagctctagaatgaacatatctattttgtttgcgatgttactaatccaagaaacggaaaggccaactgcatggagtatatatatctattcaatttggaagaatatgaagatagctagcttaggctatctcgatcagctctatctcactttcactctataaacagtactacgatgcaaaacaatgttttacgcggtcatatacacaatctattggacagatccttacatatgatcactagaaagggaaggcttgtcctctattgcctgtttatgaattgtaccccgtagctacctgtccctacgcctgtaagcctgtttgtaaagtacagcaaaaggtaatggatggggaaaccattgttatgtttgttgtaaaagcactcctattgtgtgtatatatatgaaaaatttaatcaggtggggactattcgtccccccgtcgactgtaaaaaaacagacttgtttagaattgccagtaaaaatttcaggttatatcatcacattcgttcgttgatgctttgttatctttatgctgagctaataatgtagtctagcctgccaggattgtgaaatgtatgcgttcattgatgcttagcactttagcagtgggcggtcgactattgacaatggcaaagcagcccatttgacaatggcaaagcagcccatttgacaatgacaaagacatgccattgctgccgcatcggcaattcggcatacgacgccctcgtccgtgacttaagaataaattcgaata

SEQ ID NO: 14161 - DNA, 1000 bp, Zea mays
ccggccggggcagtcgcctgtcccgtgtcctccggtcccggacctctgtgccgcactgcccacagcgacagcatcgacatcgccccggtcccgtgtcgcttcgcttcgtagttcgccgccttccccgcgccccagcagcaacggattcccctcccctcgagagatccgacccttggcccggtcgctggggagagcggcatggggctctgggattcgctcctcaactggctgcggagcttgttttttaagcaagaaatggaactctccctggttgggttgcagaatgctgggaagacatcgctggtcaatgctgttgctacaggtggctacagtgaggacatgattccaaccgtaggcttcaatatgcggaaaatcaccaaggggaatgtcacaattaaactttgggatcttggtgggcaacgaagattccgcactatgtgggagcgctactgccgtggagtttctgctattctatatgttgtggacgctgctgaccgagatagcatcccaatagcgaaaagtgaattgcttgatctgctgacaaaacagtctttagctgggattcccttgcttgtccttggcaacaaaattgacaagtcagaagcgctttcgaagcaggcattggttgatcaacttggactggaattgataaaggaccgcgaagtttgttgctacatgatctcctgtaaggattctgtgaacatagacgttgtcatcgactggcttatcaagcactctagaacagcaaagtaggctttatgtgtgtttgtatcacttgatgcatggtaatttgaatttacctttgtgaatcagtactcccagaatcctggtttcttggtccagatgttaaaagcgttcacctcgtaatttatgatccctttggtctcgcagacgaattgtatggtatctagaagaccagaaccttgtatttcctttgcaattcccttgaatcttttattattcttactgtgaaaaaaaaaaaaaaaaaaaaaactcgtgc

SEQ ID NO: 14162 - DNA, 1477 bp, Zea mays
cctcgaggcttgccgggacctctcgtctccctagtcctgttgtgccggacccctgcgccgcacccgcacggcaacagcatcgacctaggcccggtcccgtgtcgcttcgtagttcgtccccttccccgcgcccccagcagcagcggattcccctcgagagatccggcccttggcgcggtcgccggagagagcggcatggggctctgggactcgctcctcaactggctccggagcttgtttttcaagcaagaaatggagctctccctcgttgggttgcagaatgctgggaagacgtcgctggtcaatgctgttgctacaggtggctacagtgaggacatgattccaacggtaggcttcaatatgcggaaagtcaccaagggaaatgtcacgattaagctttgggatcttggtgggcagcggagattccgcactatgtgggagcgctattgccgtggagtttctgctattctgtatgttgtggacgctgctgaccgagatagtgtcccaatcgcgaaaagtgagttgcatgatctgctgacgaaacagtctttggctgggattcccttgcttgtccttggcaacaaaattgacaagtcagaagcgctttcgaagcaggccttggttgatcaacttggactggaattgataaaggaccgggaggtttgttgctacatgatctcgtgtaaggattctgtgaacatagacgtcgtcatcgactggcttatcaagcactctagaacagcgaagtaggctttctgtgtgtttgtatcgcttgatgcacggtgttttatcttttgtgaatctgcgcttcccagaagcctggttccttggtccccatgttaaaagcggccaccttgtaatttatggtttctttggtgtcacagacgaactgcatggtatctagactagaaacatgtattccctttgtaaatcctttgaacctttgattattcttactgtgaatgccgtccagtgtttttattctgcacataacaaaccagacctatgctcatgcggggccttcttcacagagaaaaaagagagaagtccgaatttggtcaagtgtttatattggtagtacttcgatcaaaaagtgtgggtgtttgagactgctttattatattttttacggttctggtctaactttatctctacaactatacgcattttatctaacgtctatccttgagctataaaagcgtaagacaacccctatccaagatatccttaagctttaccaactataacacgagccaacaataccaatgccagtactatactggactagggctctagctcgaaccagtataatctctcatctcagactcctaccttcgagcctagtgctgggaaatatggttcggggcttttcgggccagcacgagcacaacccgaaaataagagcccaaaacacgaaataatatgggacagactagcatggcccgaaagcaggcctgagccgggcctctggcacgcc

SEQ ID NO: 14163 - DNA, 1456 bp, Zea mays
ttgttttttttaaaaaaaactttgactttttgaaaaattaatgagttaataattattttttgtgatttgttttgtcgtagatttgtgtttaacttaaaattttacatttttaaataaatattttgaataagaggagtgattaaagtttttttgataaaaataaacggtgtcatatttatgaacggagatggtatgttttaaaattagttcacatttatttttctgattaatatctaacagtaatgctattttataggagacgggtgaaaaacgccctgaatcctaatccctatctagaggccccacggtttcccgcacaacagagcgcttccaattctttttctgccccccgcgcggccgccccggcccctgccccaattccccaacacagcgcaagggccagacgcccagaaccagacgagcacggacggacctccgcaggccgcatccctccacgtgcacgagttccgaggcgccccttcgatccgcccggcccggccctctccaccgcgcgcgcgcgtccgtcgctagcgtttggccgtctccctcttgagccccgagtacccccacgacgcggcaaggaacctcgccatgagggtccacccggctccgcggaagcgcaccatcgccgtgcagcgctgcgccacggcggcggcggcggcggcggcgggcgcactcggcgggaagaagctgcgccgcctgccgcacatcttcgccaaggtgctggagctccccttcgcggccgacgcggacgtgtccgtcgaggaggacgcggcggcgctgcggttcgtcgccgcggccgtcgacggggtctcccccgatggcgcccgcgcgcacgccgtcgagatccacccgggggtcaccaaggtcgtcgtccggggcctctcccccgccgacggcggcggcggcgtcgacgacgacgatggggccgccgctttcgagctcgaccgctggcgcttccgcctcccgccctgcacgcgccctgccatggccacggccacctactcccagggcgagctcgtcgtcactgtccccaagggcgccggccccgacgacgcggccgctgtcctcggtggcacggagcgcgtcctcgtgcttgtatagtatatctacatgtcccgtccatgactcatctccactgctttgctgattcgcctgtttctattcctactactatactaataccaaatatttatttatatgacgcgcgagatgatgataaacgatgcacttagagtagtagtaataataataatgcctgtggatccgcccttgctgctaattctctgagcgtgtgcacttggtcaggagtttcttccacccagcttcaatacaacacctttggcaagcagttcatctgtttgtgaaccatgcatgtacatcatcacctgccgtgctgaatggatggacatgattgtgttgtgatttggaggtcaatcaaattttgttttttgtt

SEQ ID NO: 14164 - DNA, 1910 bp, Zea mays
gttgatagcttctgtatactagcgagttgccgagttgtccttgctttgctacgattttttatatatcatataaataggtattgagatatttattcaaatataattattgtttatttttaaacactaagatacatgtggttagatggtaactgcgcaggcggggtcgggtgctggacaaatgcaggagttggggcaggtgctggggtccacttggctcacagggcatggcgctgagacgggacatgagaaccagtcgaaacgcgtgggcacatctaaagtgttagcgtggaaggtgagaccgtggtagcaacaggtggtcacgttaaatttttaatagagtggtataaatttacatgcccttttctaaaaaatccactttctccaagtaatagctgcgcaaactacttgaaaagcctgagacgctgacacaatgacccaccaagacgactaacaacgcggacgctcgcctccagaataaaaccgcccccagctaagaaaagtcgcctccaccagaggaggcccggccaatccagaaggtgacgccagcaacgacgcccgcgatgcgccgatgacctgtccggactccggactcggaacccgccttcttcttgccgccaaagaaaggaaggcaaaacggttcttctttcgcgtcggcaacagcgacacccacagccggccagcccaagtctataaatgtacgcgcgtcctcgcggccggcccggatcacccaatgacccaatcaatcgctaacaacccaataaaccgcggacgcagcagaaaagaggtagaggggcggcgaccgatggcgcggcggggcacggaggcgttccctaacctgggcgcgcactgcgacaagccggactgcaaccagctcgacttcctgcccttcgactgcgacggctgcggcaaggtcttctgcgccgcgcaccggacctacggggaccacggctgcgccaaggcggcggaccagggccgcaccgtcgtcgtctgcccggactgcggcgacgccatcgagaggctggttccggggcagggcgagcgggagatcctggaggcgcacgtgcggtcgcggcgctgcgacccgggcaagaagcgcaagccccggtgccccgcgcggcggtgcagggagcagctcaccttctccaacacccaggactgcaagggctgcggccggaaggtgtgcctcaagcacaggttcccggccgaccacgactgcgccgccagcgcaccaggagctgccgcggcggcgaggagggccagcggggagtgcggccgcggcgcgcggaaggaagggagcggcggctgggcgctgccggcgtccatccggagcctcaagatcttctgaggcttgccaatttgccatactgtcacgttgcagccaggtcaccacagcgaaagaaactgttcctcgagatggatgcagcgaacgtatttcatatgttctttggttgatgtataaatgcattttcaggctaagaatctgaaatacagaaactggacattgaaatgttccatcaatactggtttttaaggcagatgtgaagacagacaaatttgcgttcaatatactacgggagttttttttttccaaaaaaaaaaaaaaaatgattgtcctacgttctgttgcgtatgttgttggatatactctgttttacttttttttcagtggtaattcatattgccacactatgggctagtttgagatgcaaaaaacccgaagtgtcttatttaaaattaaataaaaagaaggttttaacctctataatactctccgattttggactccaaaactagtctttaatataatataaaaattctttacccctcccactaacttaaaaatactcttagggtctgtttgatttgtccagagactaaagtttagtctcaccctgtttggttattgtcgg

SEQ ID NO: 14165 - DNA, 4639 bp, Zea mays
  misc_feature (1307)..(1307): n is a, c, g, or t
  misc_feature (1313)..(1313): n is a, c, g, or t
ccgggttaagctggtagctgccggtgatatgtatctgctctcaaggttgcatcaacttatctgggaccacttgctgccaataacgaagctctactgaagcccttgaaggaaacattggtgacactaattcaacccaatgaagatgtagtcatgaatgcattgtcattgccagtacttgccagttctgtccaggttgcaatgagcagaaggcttggtattgaagagcctcagttaatgaagatagtcagaacaacaatccatacacacactgaatggtttaagcttcagatgtgcaaggaccgttttgagcacttattgaagattgattctctaaaagaggttgatccatcattggggagtcaccgtaagtccaaggtccttacagatgaatgtgcaaatggatcatctcaaatgacaacatgttcaagtggcaaggtgccagatgaaggtagtagccctcaagtctcatcagaagttgcctgtgatgaaaatgctatactgaaggttatggaattccttgcgttgccaagggcggacgccatccaactcctcatgcagtacaatggaaatgcagaggcagtcatccaacagatcttccaatagtgtactgtaaataacaaagtattttgcttgctttcaaacgtaattatttgttgatacttttcttgccctgtacagaagattctgttagaactaggagtctgtgtttgatgatccacagtacttctatggacttacacagagtaggaatcggtgggattcagcgcaggctaaactcaacgataaatgcaaagatattgatttatactggttcagaccattgaacagcgtgcgtaatatatattatgtctagttagttgtgttggattgttgagttggcttgcttgggttccttacaagttggattactctgtccctctttatataatccataagagaggtttatgagttaagtttttaacttttaaccggctaatatggaagttacagaaagtcttttttttcttctctagtctgatcaggtcaatagtttttagagcagttttagtgcgtgtttggtatgactctaaagtaaaactcaaagggagctggagctagagcctaccaaacaccataattttagagttataaacttcatggggttttcagagccgtaatataaaattttggagtatctttttgctgttctgaaaactctaaaaagcaacctaatatgaaatttggatttacccacaaaatttacccacaaatgttactggcaatgagaaaataatctaaactctagagcagagccttagagtttggantagaantactccggagggaagcaaagccatactaaatacgcctttagatagtgtttggttcctgattgaattggtttgatgtataatataatgactctaaaaaggaaaaattatgtttaaatactgaaccatttggctctctaaaatcttccggacatagctactagctggtatagagccgctctatatcaacggactccggaatcaaacgctacctagattatttgaaactatatttgttgtgtgcgtatatcttacagattcaaaagttattcggtacctctatttgccctttttcgcaatctcatcaaagtcatgcgccaggttgatgcggcggagttacagtttatttggctagttccgtaaaacaaaggtcgttgattaattcttttttgcaaccctgtactgtacgaaatggacctggctatatatccactattcgcttcgcacattattagccatagccagctcactgtaccactccatttggctttttaagcccaggtggaagtttctgctacgttttgattttcggcccattcatgcatctaggtgcaatggtaaaaagctcgtagctatactgtccaatgagccgtgtccaatcagcacggcgtgagcacaacccaagccggaccaacttagttggaccgaggcatggcatgattatattttggatcgggccgggccgacatgtggacctgagcctgagcctgagcctgagtacaagaacaacactattacacttactcgggtcgtgttgtgtcgtcgggctaagccgtgctaccgtgttgcgctggcctaggctcgcagctgtgtaaccgtctaacacccactagctctgatggatgatgcccataagctcatacttcataacaataacaacaagacatgtcagtctaagttcatacaaccataagttcatacttcgtaaataataacaatagcagcaagaatgcaagacatacatgctgcctacccctgatgcccaaaagttcatactgtaaagcccaaaatgtgtataagaaaaaataaatataaataataaaataaatatatgaagaaataaaaatagtaaattcagacatctcaaatcatacttaagtgtgaaatttgaggactgaatttctaaaatcaagaagtattctagaaaataagtaaaagaaaaattttctattcaattaaataatgatgcatatcattaaatgatgcaccataagcatttattcacatgaatagttaactttgaagtaacctttacttcttgttccacattcaaaatactatttttttctaaagagaaagaaataaggaatataaaactcacataaagtatatatagaatcatactttcaaaattagtacaataattgtgcaacataatctgaggataaattgccaccaattttgaatccaaactggaatttaaatttggatttagaatttaagagagaaatactataaaagacaagataaaatttataaatatataaattcatcccactgatttgtccaaactgaatacttaaaaggattataaattcttctgaggaatttgaattcaaattttggatttgaaaaggaaaaggaaaagaaattacaaagaaaagaaaataaaaagaaaaatgtaaaacctaactgggcccaatctgcttcggccaatctttcctcacgcgcatcgtcagcctcaccccgggctacaaaaccaggcacagccgagtcgtacgccatcccccttcctctattcctccctttttaccgcgaatgacgagagagagacacggtgggaggagaccggagggtacacttgcgccattgtcgtcgaccgcgccgtggccaagctcgccgccgtcaccctgacctctggtaagtgcacgagcctgttctttacatccgtagggtcgtgtgacaccgttagggtggtagttgggtcggcggttggccggtaattgctcatcgggcttcaaccgcgccgtagagtcgccatgggaggtagaccaacgccgtctcggggcgattcaactcgtgtgatggttgtccaggttgggcgtagtcgtagcttcgtctagagtatattagaatggaattcgggggatcattgtgtagaatggggcttcctcggcgaggtcaccaccgccctggggttcgccgatgtgatttggtgggcggcgtcgccaggtcgcgacgcagatagggttaggcagatcgtgtccgtcggttgtgcggtctacggctctgattagaaacgggatataccccttcacgacattaaatcgaggtcgttgatcaccgatctgacgaatagaattggatctaggaatcctcgacgttggatcctgatccctcggttctggttacaccctgagttagccgcggtgaaatctaatcctggtcgcgcgatttgaatccaacggcccagaactcaccataccccttcaactggccagctttataaaatagcccttgtccttttgtcatatcaacccgcagtccactgcggggttgggctgagtctgtgcatcacttatgatttcgcccccacgtttcagtaaattttgtgttcggtccagtgaacagaaaatcaaaagaattcatttagaaaatacatttttatgggggaataattataggaacttaattaattcctagaaaatgcattttaactcctttttagccaattccaattcctataattttgtaatattgttgtttgtcatctagtaccactgttttgacatgaaagtcacattaaaattaatatcctatttaatcttgtaccaaacgcataaaatcttcagaaattcatagctcccccattttaactccgatttgatccattcaagttgcgttagtcttgtacaagtatttactacgcagtaacaacatttattataccatgtctcattcttttctaattagatctttatttaatttatgtgggttagtcttgttaatctacttatcattataatctactagaagatgatctatggtcaattcacaacttagattaaagttgagataattatttatagaataacctctcatatgatttatattaaccaatttatgatatagtttaatattttaatcacataaatcctctataaaatcataactccttaaccatgactccaattttagtggttctcgttcctacgatctcgtagcaacgcgtagatcattattatgcagtatgttcttatgtttggtgtgatgttaattttgtctatactgtgtctgtttgtaattccacgactagcagtgaggtcacgaggatctgaaggatcaccctggtaactgggaatctcagtgcaagcaagttgtgcccttga

SEQ ID NO: 14166 - DNA, 1318 bp, Zea mays
tgcatgcctgcagataaagacgtggaccgttgtttgcattgcaatggccgctgcgagttggaggacggggcaccaactccctcgccgtcccgcgccgtgctccaagcagaaccggaccaccagcaatagcaagccgccggtggtgatcgcgcacgagtgccccagcgcgatgcgtgcccacgtggtggaggtgcccgcggggcgcgacgtgctgtcgtgcgtctcggcgttcgcgcggcgtgggcggcgcggcgcgctggtgctgggcgcggccgggcaagtcacggacgtggtgctccgggagccagcagcgctggtgctccgcggcaccatggagatactgagcctggctggctgcttcttcccgttcccggctccagccacggggacggcggtgttcctggcggggccgcggggcagcgtgctgggcggtggcgtcgcgctgggagggctggtggccgcagggccggtggtagtgatggtggccacgtttgtggcggcggcgctggacaggctgccgttgggcaataagggttgtgacgacgtgcatgccatggacaccaccggggcgtgcggctgggcctgggcggcagtgtgccgaaagcaccagcagcgtggcaaataaggatccattcctgcctgctgctctttactagcatccttacaactctagctagtaatgaacaaactccataaggatctatgctcctgttagttgatgagaaatggaagagggtcggcggcacaacgtgcacagctctctcacattgcatctttcaatacttgtttactcctccaacatgcatgtcatgacatccatccttattctcaagtcttaagatttaactccgcggccgcaaagcaaattaattataagaaaacataacacgtacaacaacaaaaaaaaaggcatgcaagaaatccagccaataaataagagaaaggttcatcgttcgtcaactagctaaatccagccattcaacgacgatgagcacagcgcttgcacgccaacgcccaagaaatccctggtctcctccctccccacggcaacggcggcatccttgaggccggcatggcgcacggccgacagcacgtcgtacggcatgttcccgccggtcgccgtgagctggctcgtcgttagcgtacttgttccagaaccgctgatgagattagtagcgttctgctgggttaatgcgctaaacagcagacctgcaccacagtcggatggctgatgatgaccaccggccgtcgtcgtcataatcacgctgccggacccggacgtgacggcacccatctgcgcggccttctgcaggcatgc

SEQ ID NO: 14167 - DNA, 1468 bp, Zea mays
cattgggtacctcgaggaattcaatttgattgcacaagtacaccttggctacaacccttggccgccgcctcagcctcaacctcaactcatctcgccggtggtcgatctcctccatctgctcgccgcggcgcaacccggagaggagaccgcgctcggtcgagcaccacctggggctagcgtcctcgcgacgagctccggcgcggcgtccgccctctgcagccccggtgtccccgcgaccggcttccgtgcggccggcacacagctccacaggccaacgggacctgattcatggcgaagcaggcgtacgccacgagcagtctcgtggtcgggtacgcgctgtgctccagcttgctggctatcatcaacaagtatgccatcaccaagttcagctaccccggactgctgaccgccctgcagtacctgacctcggtggttggagtgtgggtgctcgggaagctcggcttcctctgccacgacgccttcaacctccagaccgccaagaagtttgcgccggccgcggttgttttctaccttgccatcttcaccaacacccacctcctcaagcatgcaaacgtcgacactttcatcgtgttcagatccctgactcctctcctggtggctatcgccgacaccaccttccggaagcaaccgtgcccttccaagctcacgttcttgtccctcgtgatcattttgggaggcgcggtcggctatgtgatgacagactcggccttcaccctcactgcatactcgtgggcactcgcttacctggtcaccataactactgagatggtgtacatcaagcacatggtgaccaacttggggctcaacacctggggctttgtgctctacaacaatcttctctcgctgctaatggcaccggtgtttgggtttctgacaggggagcacttgtccgtcttcagagcttttgagtcaagggggcagagttggtttgagcttgatgcctttgtggcggttgcgttgtcctgcgtctttggtctgctcatcagcttctttggtttcgctgcaaggaaagcgatctctgccacagcgttcacagtgacaggtgtggtcaacaagttcctcacggttgcgataaatgtgatgatttgggacaagcatgcaagcatgtttggtttggtttgcttgctcttcactctcgctggtggagtgctctatcagcagtcagttacaacaaaaggcaatccttcagcagcagctaagcagggaagaggtagtgatgatgctgttgaggtggatgaggagagccagatgctggtttcatctccaaaggttgtctaaggtgcatgatcaccaaagatccagttctgttcgtttttctggacccatgttttgaagatttgtcagtcatgtaccgaaggaaatccaagaggctgcatttttgttctaggagaggctgcagtaactttacatgatacatgtttggtctataattatttttgttaccgtg

SEQ ID NO: 14168 - DNA, 2661 bp, Zea mays
cgccggtggtcgatctcctccatctgctcgccgcggcgcaacccggagaggagaccgcgctcggtcgagcaccacctagggctagcgtcctcgcgacgagctccggcgccgcgtccgccccctgcagccccggtgtccccgcgaccggctccggcgcgaccggcacacagctccacaggtatgtctccgtccgcacagcgtcacgttcttctctctcctccccccgccaacatctcgtccctctcgctccctcttcgcctgcttgattctgctctagcctcagaccggccctcgctctaaaaatgtcattacgcacccaatccgcttgtagctgtatgctgcaatctactctgtcttcttcttccatcaccaacgactgcgccggccgtcgctgctgtcctacttcgccactcgcttcccttcctgctgtgcaaagccgtgcgcccaaaccttaaacctgaacatactattcgtaatcggatctgaatctaattacaggtgtatatgcatgtattatgatttatgcctactaacttctattgctttgcaaaaaaaaatactgggtgtacatgtgtacactatacatccatgctctttactgagtccgcccctggtctgatcgattcttgcttgacgccgcctggtccatggatgaaccgtgtcacctacaattgattctgggatccggcttctgatttttccgtgtgagttttcaggccaacgggacctgattcatggcgaagcaggcgtacgccacgagcagtctcgtggtcgggtacgcgctgtgctccagcttgctggctatcatcaacaagtatgccatcaccaagttcagctaccccggactgctgaccgccctgcagtacctgacctcggtggttggagtgtgggtgctcgggaagctcggcttcctctgccacgacgccttcaacctccagaccgccaagaagtttgcgccggccgcggttgtcttctaccttgccatcttcaccaacacccacctcctcaagcatgcaaacgtcgacactttcatcgtgttcagatccctgactcctctcctggtggctatcgccgacaccaccttccggaagcaaccgtgcccttccaagctcacgttcttgtccctcgtgatcattttgggaggcgcggtcggctatgtgatgacagactcggccttcaccctcactgcatactcgtgggcactcgcttacctggtcaccataactactgagatggtgtacatcaagcacatggtgaccaacttggggctcaacacctggggctttgtgctctacaacaatcttctctcgctgctaatggcaccggtgtttgggtttctgacaggggagcacttgtccgtcttcagagcttttgagtcaagggggcagagttggtttgagcttgatgcctttgtggcggttgcgttgtcctgcgtctttggtctgctcatcagcttctttggtttcgctgcaaggaaagcgatctctgccacagcgttcacagtgacaggtgtggtcaacaagttcctcacggttgcgataaatgtgatgatttgggacaagcatgcaagcatgtttggtttggtttgcttgctcttcactctcgctggtggagtgctctatcagcagtcagttacaacaaaaggcaatccttcagcagcagctaagcagggaagaggtggtgatgatgctgttgaggtggatgaggagagccagatgctggtttcatctccaaaggttgtctaaggtgcatgatcaccaaagatccagttctgttcgtttttctggacccatgttttgaagatttgtcagtcatgtaccgaaggaaatccaagaggctgcatttttgttctaggagaggctgcagtaactttacatgatacatgtttggtctataattatttttgttaccgtgccttgtttactggtaagctccaaaccccatgcgatgtttaattacttagaacgacaaaccaatgcggtgaccatcttatatggttattggcacctatctggacattgtatacctgatgaggtgactatcagattacatacaccctttctgacattactaaggcccatgttcgtttggtacggattgatgggctggaatcattcctagccgaattgcttctttaatttatataatttttgatcagctggaatgatttcgggtgcaatcccgcacaaacaaacaaggcctaaatgttttagcagtgcattagcttcatggttttggtatgatcagattttcagtggcccatttgctatcagcggggatcaaataaactacgcatttgtttgcggtatgcattaaagattggatatcctcaatataaactgcaccgccttttttaattgatatatgttaaagtgtggatatcttcaggatgcttcgcagtcagcagttaatgaaactgccaagatcggttgcattatggtcatctggtgtactgttctacaaggcaattcgaaaatttgtgttgatgtccttgcaaaaaaagttgtgttggtggtgcataggataatcggattaatgctgttgttgctacagcaactaagctgtctatggtgcttgctgcttggtttgtctatggtgctttggtttctaatttgtcgaattatgttctgttcaactgctctagagattataattatgtag

SEQ ID NO: 14169 - DNA, 3426 bp, Zea mays
ccgatcctcacggtacctcacggggataagcatgccgatgatgcgggcacgccagcctccgatccgtttccaccgccgcgcgcgccgcccggccgctcctctcgttcgtcttgtcctctccgcctgtctcgcgtgtcctcacccttcctccgtcctccgtcgtccccttttctttaatgacaaatcggctgcgagccaagtggggcgtgcactcaaacccctcatccccatgagaccgcacgagttggagcaaggctcagtgcccgcctgcccccgcatgccgtgcgatgccatggaggcgcgcgtccctgggcgtcgtcacgtcctcactccttgtccgtctgcctgtcgccttgtctcgccttgcaggtcgtagacggcagacgaggagcagcagcagcacgaggcggccgggcccgggccacgccatgccggagaaggaggcgcaggccgccgcgttctgcggcgaggcggtgatcgccgagttcgagtccctcacgcgggacgccgccgccgtgcagcgcgacacgctgcgccggatcctggcagacaacgcctgcgccgagtacctccgctgccggggcctcgcgggccgcaccgacgccgccagcttccgcgcctgcgtgccgctcgccacgcacgccgacatcgagccctacattgcgcgtatcgccgacggcgacacgtcccccgtgctcaccgccaagcccatcacctccatctccctcaggtcggtaatactcgactcgactcgctctgtacatgtcggtgagccaccgtgtgtgactgaccgtccgctggccctattattcccgtgtcatgcagctccggcacgacgcaggggaagcgcaagtacctgcccttcaaccaggagctcgtcaagtccacgatgcagatataccggacttcctacgccttcaggaacaggtgagtgagtgcacgcgcgcgcatatgcatgtcacactgtcagatcatctatattctcatcgcctcgcctccacactgcaccgcgcttccctcgcagggcgttccccgtggaggacggcaaggcgctgcagttcatctacggcagccggcagttcaccaccaagggcgggctgacggcgacgacggccaccaccaacgtgtaccgcagcgaggagttcatgcccacgatgcgcgccatccagtcgcaggtgtgcagcccggaggcggtgatcttcggcgccgacttcgcgcagtcgctctactgccacctgctgtgcggcctgctgtacgccgacgaggtgcgcatcgtgtccgccaccttcgcgcacagcatcgtgctggccttccagaccttcgagcgcgtgtgggaggagctgtgcgccgacatccgcgcgggcgcgctgtcgcccgcgcgcgtcgccgcgccggccgtgcgcggggccgtggaggcgctgctggcgggcccggacccggcgcgcgcagacgaggtggcgcgccggtgcgccgggctcagcaactggtacggcgtcatcccggcgctgttccccaacgccaggtacgtgcacggcatcatgacggggaccatggagcactacgtgaagaagctccgccactacgcgggcggcctgcccctcgtcgccgccgagtacggcgcgtccgagggctgggtcggcgccaacgtggagcccgagacgccgccggagtccgccaccttcaccgtgctccccaacatcgcctacttcgagttcatcccgctcaaggcggccaccggccacggcggcggcactgccggcgacacgtgctacgccgaggctgagcccgagcccgtcgggctaaccgaggtcaccgtcggcgagcactacgaggttgtcgtcaccactttcgcaggtaacagtcaaaaattctcaccgatcgatcgtaaaccaccgcggttggtttcaaagaaaccgtagatgcgtccatcggatttaggttcggatggtacgagttgttgttgtcctagaagcctgttactttcatgccagcagccacctaaccgctccctccagatcgagaccaaacttcgccttgtgtccgtggacagtggacgtactagtactactaatcctaaccggtgggcacagtgcggagacggattagctgcccccgacccggtttcgcctcgcgctttcctctttgttgacttgcgccaccgcacctctgacggggaccgccgaaggaggaggaggaggccgggggattgactccggcggcggcggtggcggcggcagcggtccggtcggcggtcgccgttcagcggaaccctttgggctttagcgatcacgtacgtcgctcccggccggtctcgaacaaaagagggggcgggcgcgcacggggggagatctccctttcagagaaagcagatggccaagaaagaaactgcatgtcaggaaggtctgaaaccgacgttagctgttctgttgtgtgcgtgcgtgcgtctggtaggttaggtcgtcgcccaagaacagccaggagatgtatatatttatagacgatcttggggagatctggattcggtaacatagcgtgtgtcggagtcggtaggctatgaaccaaaaaaaccagccacagctagcaagaaacaggatcgcacaaactaatccgaaaagctcttctttaatttaaaggattctgatccagaaagtgttgtctcttttctacgcatttgatcaggtgctttgcaaatcttctacgatatacatggatacatattttttccacctttgcacacccatccatccatccatccatcgtcggctgcagcgttactgtctgtcacagcgtcacaagacagtaacttgttacgcctgaaagtatgcaatgcaatgcacctagttagtagtagtatactcttttttcctggaacctgcaccactgcccactgcctgaatattacacttggctcaatgacaagtgagacgagcgacgatgatgcagctgcacagagacgacttattcagcaagtttatttattagtctgaaagagaattaataatttgataatagtagtagcatcttgtagagtactagtagtagtagcatctacgacattactagctcccagtaaataaggattaggggtgggaacggataattctccgtcgggttttagctctccgtttccgcgaggaagtatcccgacgaacacttgcggagatatttcttctcaatctccgttccatgtggtagtaaatccccgtcggaatctccgtcatcgcttaaattataattaggacgtattttctttgtttattaatgcaaaatattgtcacttatacacattgtcagataaacatatttgtacaaacaagtgatttctttgcaatataattatctagtatctgaaaatattgtcacatatataattaacgggtctcaacgagaattattgggacgatgaatgcttccccattctacgtc

SEQ ID NO: 14170 - DNA, 889 bp, Zea mays
aagtcggcccggcgctcaaacccctcatccccctgagaccgcacgagttggagcaaggctcagtgcccgcctgcccccgcatgccgtgcgatgccatggaggcgcgcgtccctgggcgtcgtcacgtcctcactccttgtccgtctgcctgtcgccttgtctcgccttgcaggtcgtagacggcagacgagcagcagcagcagcacgaggcggccgggcccgggccacgccatgccggagaaggaggcgcaggccgccgcgttctgcggcgaggcggtgatcgccgagttcgagtccctcacgcgggacgccgccgccgtgcagcgcgacacgctgcgccggatcctggcagacaacgcctgcgccgagtacctccgctgccggggcctcgcgggccgcaccgacgccgccagcttccgcgcctgcgtgccgctcgccacgcacgccgacatcgagccctacattgcgcgcatcgccgacggcgacacgtcccccgtgctcaccgccaagcccatcacctccatctccctcagctccggcacgacgcaggggaagcgcaagtacctgcccttcaaccaggagctcgccaagtccacgatgcagatataccggacttcctacgccttcaggaacagggcgttccccgtggaggacggcaaggcgctgcagttcatctacggcagccggcagttcaccaccaagggcgggctgacggcgacgacggccaccaccaacgtgtaccgcagcgaggagttcatgcccacgatgcgcgccatccagtcgcaggtgtgcagcccggaggcgggtgatcttcgcgccgacttcgcgcagtcgctctactgccacctgctgtgcggcctgctgtacgccgacgaggtgcgcatcgtgt

SEQ ID NO: 14171 - DNA, 3693 bp, Zea mays
atttgcccataattagatatgtgtttttgtgggtcgtgcctttgtgggacgtgtttttgtgggcatgtgtcgtgccgggccagccagccaacatgtacatgtatactaggagcacaccgctccctaaacattaaactagtcaaatatatgatttttatatatcatataaatataatttgttttaataaaacacaaaaatacatatactctgttggttaggtgggggtggatgtagaggtaacaaatctcggatatgcatctactaagtgtatcatttgcaggggaagcacacgcacaaggcacaacctaaccaactctcccttccattccatcctctgtgctctccttcggcaccagggggagtggaggggcaacatgatacgacatcgtcttcatgtcatgcgcgcttaatgtttttttgccaaaacaacgtgtagcagctagctaacatgagagagtggcgcgtgctatctactttaggctttagcactcgcatacataatgcattattttgtcacgacatgtcacatccagaccctccataagttttttttttttttttaacaaacgctccaaaggctttaaaaagcgagctcggtgacacactccgatcggaggaatccctgaaagaacgtctcgtgccgtcgccagtgtgccacgagcgggcgcggccaattaaataaaaaaaatccccgcgtacccagccaacgcgacgcgggcagctcgctaaacaccgcaggccaaggcgtgcgcttttgcgctccgagtccgaccaggcaagtgaccaactgactgctcacggagacccgacggccgtcgacggtcgcgagacgccctttccaccgctccaaaatgcaccagagccgactagcgagctaggtagcttccaaatcttcggggcttgcattgcattgtccgcctgcctaagcacgcaacgcaaggaaggtatagtattctctacttcatcttccagtcctcctgctagctagctttgcctacaaagcaacgaaaaagcgagcgggcggcaccacacgtcggtcgagtgcctatcccttgaagcccttcgacaacaccgagaggaacggaacggaacggatcgcccccctttatacaagcacactcgccgcgcaacactcccgaaacgtgcatcgcgactagttagcagttactgccgcggacagagcacggcaggaaggagcgagcattcgtgcgggagagctggtggcacatggaccgccgggactcctccgaggcgccggggccggccgtgaacggcactggcggcgtcggaggcgcgggcgcggcggcgcccggggtcgtcgacgcgaccttcgacaccaacacggtgatcctgctggcggcgctgttcctggcgctgctgctcgccatcgcgctcaactcgctggccaggttcgcgctctggtgcggaggccgggccgcggccgggggcggcgaggtggcggcgtcgccgagcgtcgccgcgtcgtcctgcgcgggcgtccggggcgggatcaagaagcgcgcgctgcggagcatccccgtggaggtttacgtcggcggggatgcgaaagacgacgaggaggagggggccgggagcggggacgtgtgcgccatctgcctcggcgagttcgcggacggcgagaaggtgcgcgtgctgccgcggtgcggccacgcgttccacgtcccgtgcgtcgacgcctggctgctgtcccgcggctcgtgcccgacgtgccgccgccccgtcatggacgccaagcctgccagtgccagtgccacaggcggcaggggagtggcccagcagagcgcccgccgcccggacagcgacaccgtcgccgtggtcattgcgtgagggacgacggaggggagcatgggcgtggccatgggcccatggccatcgcaagcagcagagacctagtggtagttttcgattaggatgttctaggtaatggtctcgtgccgctctgtactgttccggcgtcgctgtggataagttcatgtaaaaaatatctccgtagcctgccctgctctggtagccgcatcgtccgatattatccggcgacggctggcccacttgcactagatgacgctacatgcttggagtgtactgctcgctagtgtagcatcttcttgccgttgccgttgccgtcaaatgtagtgcacgagtagctgcccagttgctctgtcacagttttcagtttcggtggtgccgtgcaacaatttgttacagataagcaaccatgcggccggccggccgttcgttcgtcgtcgccggcgccggcgccggctggtccgcgtttccgctgccgcacgcgtcacacctgcaagcgttacgctggccgtgcgctgatcggcgttcgacatgccgaccaaacaaccaccgagtgccttactctgaatcgaagctgatcgggcgctgctgctgctgcaaccaccgagatcagtccgtggcgccaaacccgatggccatggctagctgcacggtgcgtggtccgtcgtcgtcgcccgatgctcacgccacacgcatgcacagacatacgcgtcatgagcagctggctgatgaaccggcctgaaccgggggcggaaggcactctggcacttgtcttggtctgtctggttttgatgcaccggtatggtatctctacttgtgttgtgtccaatttccctggcacacaaaaggaggatgacaagtgctaagtcattttcgcccctgtccttttctggactcatgcatatctgagatctccattatgcaacttgagtaaaatatatgttctggaaataactggtaacatgtctcatgatttggagctccatcatcgtcggaacgtgactcctctactgacggccaaataaacacgccacgtgttgctgcagaaggttagaaaacggtatcttgaacgaccgatgagttaatcatgcaaattgttgagcacgcattttctaagttgttgtttttcctaggatggatggaagacactgtgcataatttgcacaatagcaataatacaatatagatggaagtttttattaccaagaccagcgggctctttggtctcggacattaccctcagaattaacaagggataagaaattatgtgctcatatacattataattggcatacccattgtgtttttaaaatggtcatagtgtgtggtaaggttgtggccgacagaccgtgcatatagtcgtgcaaaacactgttttacaccatagacaacattatttatagagtaaagtttgaaatgagagctggataaaaaaagcattctcgagatagcctaaggagatcaactaaatgaaatctaaatattactatgagattgttttgttacatgtgaccttgctcctggacttagacggtaagttttttatatcctacaacatatagaaagagtaagagtgaatagttaagactcaggagtgataattaagacttaggaatttatgatggttgtaagagtgcatagttaagaaagagtaagattgtcgatggacgtatgatggttaaagtaagagtgacgctcattcaaaagagtgcatagttaccactcgagaatttatcgttgatgtgttctctttgtcaatcgttagtattgtaatgtatccatgtaacattaccaaaattatctatgtcatgacaataaaaatgtgttaatagacctttgtcagcttggtagcattctattacacc

SEQ ID NO: 14172 - DNA, 5990 bp, Zea mays
  misc_feature (4241)..(4241): n is a, c, g, or t
  misc_feature (4272)..(4272): n is a, c, g, or t
  misc_feature (4314)..(4314): n is a, c, g, or t
tggtggttatccctaagtatggtgctttcggttgccttagtttcttaacttgtggatgacgatggccatggagtagtttgttttaaaatttgaatgatatttgtgttggtgaacttgtggtttgaaaggttatgtgaacttgtggtttgaaaggttatgtgaacttgtagtttgaaatggttatgtgaacttgtggtttgaaattgttatgtgagctgtattggagatgtgagaagtttatgaggtgtgtgattggttatatgcttgtaatgtgaagtttgtaagctgtatatgatgtttttgagctatatttggtgtttgtgagttgtgttggtgatatgtattgtatatgtgttgttgtgtagaaattggatgagaaattgatattaaaaattgatattaaaatggtgctggtttgcagcaggaaaggttaattcccatcagtttgactatagccgacgggagttactggaggtgggcgctgagctagtaattcctgtcgccccttagccaacgggaactatttaattaattctcgtcggccagggtctaagctgacaagagttatgcgaccgacgagaattaattaattcacatgggtcggtggccaagccggcgggaattatctaattaattcccgtcatccaaaatctaagttgaagggagttatatagtcgataggaattaattaattcccatgggccggtggccaagccgatgggaattattggccgacgggaattaactaatccccatcggctacagtaagccgacgggaattaattaattcccatcatcgatcagccgacgaaaattatctaaaccccgtccagggattgccattgaccaagaaccaatgggaattaacccaaaaccgacgggaattagttattcccgtcggtataaggctaattcccgtcggttcttggccgacggaaattacctggattcctgttgtgacacttaagatcatggagcatctagtatcattcttcattcatccatgcatggagaaaatcaaggattagggtttggagaagttttcaagaagcttaagaagggagcttcttcaactcacccgagaattgagatggaggtgaggaccttgatattctattgagttattgcattattgaccttccttctttctattctttgattttccccttccttctcttatttttctctctctagtccatatgtgttcttcactttagagagagggagatggtaagaatgagaaagatgggccagtggttgttgaactagctattgaatggtcacaaatcgtgctgacatgtgggaccaatgagtaggagaataagacaactcacccaaccaattctcttgacttagcgataaagcatatgaccagctaggccaatgggcggtctaggaggacgctgaaaatgggattttggagttgaaggaatgaaattggggttgggtcttcaattccatctacaagatcaatataaaccctttgagagttagaggaatacttcttgggggatactttgttggatcaatggtggatttgactaggattgacttgggttgattaaagaagattagtagagttgataagtgagtctggggtcttttactatagagggtggattcctgacactagtataaagaagctctatagagacggttcataacccatttttactggtatttttcagtatcaccagcgcgagagaccagtggaaatggatcttcccactggcggttctatttgaggcaagtatacctatgtcctaaaccctaaacgtctccaagcgagttgtatggtcctaaactaatttaactttgtgctcattttttggtgtgtaagattttatttttttcttgcaatcgatgacattttgtttaattggtttcttacaattaggtgtgaaacccatcgaaaatggtattacaatataaaacaaaaacaaacacaaaaacaaaacaaaaatgatcgagtcagattttatctttttccatatttatgaaactaacgaatacacaaaaatggttgaaaatagttgtgaaaccagttgcaaattgcaaaacggtactcataatataggagacaaacatgtgagatttgtgctgtctacttacaatgattcgttttgtggttcttttgctgctaattccaatcaaaggaacttggaccctgcattctgcaaacctcggagcgctctgaccatatgtgcttgtcttcatcagaaggacaccacaacgctcagtagtagtccaccccacagtgggctagcatagcagccatgggtaatgggttgtccgatccctatacctgtccgggtgcattcacaaccgcaggtgtggttctggagacgaacaaggacgtggagaccgggccgcaagagcaggagcggcataatggcggcgacgtcgcctccaagggttggaggagaacctggccttatctgatcaaaaggacccaagtcgacacactctacaaaggagaaggagatggtagtctgctgatgcagcattgtaaagtcgacacactctgcaggttaatcctttttggggcagtcaagtgttagtgagtgctctatgtatgttaatcacccctgcagaggctgcatatactgaactactcacaagcttgcacctgtcgagatagttttgtaatcgcctacatcctgttcaaacgtgttcttttttttgttcccgttgtgtaatctaccctaaaagtgcttccttttctcttgaaaaacagctatagttgcctgttgagcagtaaaataaaatacgaagaacacagcaagcctaggtttatgactccgttgtgcaagtttgtgacatttgaataagtcgagcgattaaagtttttttttaaaaaaaattaatggtgttatgtctttacaatatttaagtggaatttctttagaaaaaatacaaaaaataagcgcaaaatctagggtccaaaccctactaaccgtctctctcccaagcttaacttcaaaccacttaaatacatttttgtttgtgtattaaaaaatagataccgttaatattatgaatatagaaatcgtagcaagacatggataaccaaatagtatgtcatatatttgtaattgctacgacgagtctagtaaaaaaatgtataaaactgaaaagaatacactcgtcatcgtgtgacctgctccactgttattcccgttacaccaaagcaatcatggctggtcccgtgcacatccttgttgcaaccgagcggttttgtgtgtgtcgtggcctctcatgggccctccgtgtcgccaaaaaggcaccgcaccgtggtggtccactggtcgcgtcgcgcgccgtcgtcgctgctgcttctggttcgttgcgtcttctcgccggtcgccgtggacggctggcgcagagcgcaaccgattggctggacggtcggcatattttattcgatgcaaacttagcgtgcaggtgcaggtgcaggtgcagcacggcggccggtactactagacaggtagtagcaccccggacccctttcggttgctgctacctttcttggccgtttttatggaccagctgatccagatctttctcttttttgctagtactatattataaagttttttttcttgttttgtttcgggcaatgtatgcatgcaaagatgatttttgctctatatgaatcattgaagtagccacaataattacagagtttgtatctcatataggcccgattctgaattgaagtaaagcaatccacatttgtacacaatgcaaactaattaaacattgggggacggaggcacgctgcacccactataaataaaagccgccgaccaccgccagccagccagccagagcctccactccagcagtcagtcggccggcgatacatatatatactagagtcatggagacgatggcggcgaggtacggcggcggggagatcagggacctgcagagcaagcaggaggcgccgggcgggtgcgggagctacttccagatgccgctgcactacccgaggcacagccgggaggactacgaggccatgcccgagtggcagctcgaccgcctcctctccgagtatggcctgcccgtcgccggcacagtccaccagaagcgcaccttcgccataggcaccttcctctggggcgccggcggcattatccactgagctcaaggtcttgtttactgtgcatgtgcttgacataacgagcttgtatcccaattcccaacagaacacggcaccgtccatgtgctctttctantttctctccgtctctcgctcttgctcgctgncacttctcacctgtgcccgctgtcgccgccatgccccttctncgtgccaccacccgcgcttgccccatgccgccgccaccaccgcacgcctgcgggcgtctgtgttgtttgcgtttgccgccccgcgtacgtctgcggtctgcctcgtctcaagcggcgccccagcgcagtccccgtccgtcttcgccccgattatgtctgactcgtctcttctacgctcctgcttccacacccatcaaaacaaaaaacaaaatgagtataattttatcgtccatccataaaatctaagattaacaagctaagaaatgttgattgttatatacttgatttaataattactgtatatttctattggcaacgactgttatgcaagcggtctttctttacaagcgtgcaaacaaactatctggtttattagatcgagatccaatcgtaggtcacatttaacacttaaactcttccaccaccagcttagtaatctttataaaaaaattcctaacaaaccatggttgtttttatggttggatcataatctaatggaccagatgatttgcttgcacgcttgcaaagaaggaccactagtaatggttattttatagctaattaatttttattattttattcgtaataaccactagtattaaaataaaatacaatattataagactttataaatacggtaaaatattgataggatctcaaaacgtacatgtcacctatttctatcggtatgtcttacatgcatctcatacgtaagatatgttgttttgaaattgtctctttttctgcggtctcaaagcgaccaacaatgtgatatttatgatgagccacgagttcgagtgagatttcaacgtcataatcttgttgttctccattgcactacatttgtgcatgagatagagaacaatgtggccatgctgctgaaatcatgttcgacctccgtatggtcgtaataaattcacgttatgtcggtcgttcttgttctaaggatcaaatataagtgacgatcgttgatggatgtatgatggttgaagttataatagggctttttttgaaaaagtggatggtcaagactcataaacttatcgctcatgcagtgtctttgtcaatcgttgatattgtaaggtatcaatgtagcaagtgtttctattatctatgtcatgaaaagataagactgtcaatggacctttgcagtttggttttgtgacaagttataatatgtgtgtgcactatggcgagtcacaacatcaacatgtaaaagttgaagaacatgatatggcagaccataatagaatggacgagatgcttgatgctttatatggtcggagtttgaactagagtctaaggatcttcctatgctatatgttcaaaagttcttcaaccttatgaaagcttcaaaagaagtactagggatggcaacggggaattccccgtcaggttttagcttcccatctccgtccctgtgacggaataatttcccgtgggaatccccacgaatgcttgttggggacatttcttccccatccccattcctcgcagggacaaatccttgtcgaggattcccgtccccacttaaattataattagaacgtacttcctttgatattaatgcaaaacattgtcacttatacatattgtcagatataaaaaaccattatgtgtacactaaaataaacatatttgtacaatgagtgatctcttgacaaggtaattattta

SEQ ID NO: 14173 - DNA, 3083 bp, Zea mays
  misc_feature (2872)..(2872): n is a, c, g, or t
gcacgagaccattacctagaacatcctaatctaaaagatagagaaatgagcttcgctgttcgagaaaacagcagagcccggccgaattcgttgggcagcctgcggagatgcagtagaggccgccaggcgcagatggaatgagcgaccgggctctgctccgccgctagcctgccgccgcaccgcgccgtcgatcgccgcgccatgaacggtccccgcggctaccccctttctccaccggcaccttacccccgtatggcgtgatccaatgatagcaccaagagcgcaccttcccctctccctgacggcgtcgtcctccccgcacggcggcgcgcgcacccgcaccaagaagaggaagaaaccatgtcccccaacctggacagcgccatcaagagccaggtgccggcgctgctcctgaggcgtctcttcggcgcgtcccggcgggacgaggccaagcagctccagcggaccccggcgccggtggggaggcggcgggtgttcgtgcagacggagaccggctgcgtgctcggcatggacctggaccgcggggacaacgcgcacaccgtcaagcgccggctgcagctcgcgctcaacatgcccaccggcgggacctcgctcaccttcggcgatcgcctcctggagaacgacctctccttcttacgcccggactcgccgctgctgctcacccggaacagcatcaaccggagctgctccaccccgtgcctctgccccgtctccaaggacttcgagcacaaggactgcagcggactggttgagatgctcggctgttccagcagctgtgcccgggtgaagcgcctcgtggacgacgtggtgactgccatcaggagcggcgtggatccggtccccattagcagcggccttggtggctcgtactacttcaggaacgtcttgggcgacagggttgctattgtgaagccgacggacgaggagccctttgcgccaaacaatcccaaggggttcgtcgggagggcgctcggtcagccgggcctcaagagatctgtgcgagtgggagagacggggtttagggaggttgcggcgttcctgttggaccatgacaacttcgccaacgttcctgccacggctctggtgaagataacacactccattttcaacataaactgcccggtaaatggaggaaacctggcaccggctcatgaccagcaacagcaagttaacagcaagattgcttcgttccagcagttcatagcccatgacttcgacgccagcgaccatggcacgtcaagcttccctgtcgctgctgttcataggatcggcatactagatatccggattttcaacactgacaggcacgccggcaatgtgctggtgaggaagcttaacggtggcacaggccgctttggttgccagacagagctgttcccaattgatcatggcatgtgcttgccggagaacttggaggacccttacttcgagtggatccattgggctcaggcttctattccgttctctgaggaagagctcgagtacatcagaaatcttgatccaaggaaagatgtgcagatgctgcgccgggaacttccgatgatacgtgaggcctgcctacatgtactggccctgtgcacaatcttccttaaggaggctgcagctttcggactctgcttggccgagataggcgagatgatgaccagggagttcagagggatggaggaggaaccaagccagctggaggttatgtgtatggaggccaggaagagagtagcagagtgggagcccttctctgccacagctgaacatggagaagataccgatttccagttctcggtggatatgctaggagaatacagtgatgtagtgcgatcaccaaggttcaatggctcaggttccaaggtgtccagtttcagaagccctttgtctaagctcgtcgagagcgtcgacgagggcagtgatggccatgaagatcaaaacgagtctgatcgagtcttgtatgctggatggaatacatccagcgttcctagcaaagctatgggccatagtggcaatgcctcaaaaagtgcaatgaacaggagtgccgatgaacaacttccatcaagtatgtgttttgtcaggctgtcggatatgagtgcagatgagtgggatgtattcctcgaaaaattccaggagctgctgaaagaggcactgcacgagagcgcaagggcagcagcaggtcaaaggatgaagcagcggctgggcacttcatgcaagttttgagcagggcaatagcgcatcagagaagaaaaaaatgcagtgctacttgtactgcttgcttatggagtgagtacaggatgaagatatcatcgtatgcggcaccttcaaccttgtgcaacgatctaggttgcagcagccatgtccagcaggtagataggaccacaagcatatgtagtgacggtgtggagaactgctacgcgtgtttattagctatatgtttacgaaggggaatgcttaataataaatgtttgtcagcctgtgtatattggcttgatgttagatactccagctttagcatgcaatttcttagtcgctgaaaattctttgtagcttgtgatgtgacctgtgagcagtgtaaacattgcacctttgatggaaaaataatgcttacctgttgttgaataaaaaaaaaaaaaacctgtttgcttggtctccaaaactcttccaaggcatacaggttaagtagatcacaggttggaactgttctggagcagttaaaataccagtaacatgagctcatctcgcctccagcgacagcttcacaaatgggaacaaagaaaaaatagctgcaggcctgctttgtcttccaatcagaaaggtaaccctacactgcatagtcagaaaggtgatttcaactacactgtgatgncagttacaagatgtcatcacaagaacaaatagtcattagtcgtgtcatcagtggaaagaagaatcatagagacggtggataactaaacagaacatagagagcatttagccaaggactaattctatcagcgcagattcgcttacaacatcatgcagtttcacaaatttgacagcataggttgttagataatattaagaatgtatctgtaaag

SEQ ID NO: 14174 - DNA, 1765 bp, Zea mays
cttcggtcgatctatatgcagtcatagcaaacttattatggtgataggtatgtgcctgtgcgttgcgacgggattaacaaaaattggtataaatcatacttgtagagtaaaaaattacgcatagcaataaaaatcccatcttagaaatattgatgatatccttgtgtagatcagaatagcatatattacgatggttgaatcattgagcatgtacaataaaaggcactaaatatgggcataaccttaaacaatgagtagctaaatgttgatactaataacaatgactaaaaatgatagccactatcagattaaaaatattacctccgtccatggattaagtgccaaagcattaattctccaaaatgtcctttaacaccgccaatttccgcttgcatgttttgatacattatcatcgaaactaaaatagaaaggctacaatacgatgggatggaacatccatgctgcttgtaatataagataagaaaataatgaaaaaccaccgaaacgcatatcaatcgcctcacaagaacatggaaattgcacaatgcgacttacccatgtagtcaggctcatcattgtgctgttgtacatcatgatcactcatgcagggcaaactgcattcaagattacggttatcattatgttctgtcggtacctcaactttcataaccacaacaatataggaccacttgttttcagttgaaaaccaaatgattttgcacctctgaaagtgcaatgaacataatgataaccagcgttcctagcaaagctatgggccatagtggcaatgcctcaaaaagtgcaatgaacaggagtgccgatgaacaacttccatcaagtatgtgttttgtcaggctgtcggatatgagtgcagatgagtgggatgtattcctcgaaaaattccaggagctgctgaaagaggcactgcacgagagcgcaagggcagcagcaggtcaaaggatgaagcagcggctgggcacttcatgcaagttttgagcagggcaatagcgcatcagagaagaaaaaaatatgcagtgctacttgtactgcttgcttatggagtgagtacatgatgaagatatcatcgtatgcggcaccttcaaccttaccttgtgcaacgatctaggttgcagcagccatgtccagcaggtagataggcccacaagcatatgtagtgacggtgtggagaactgcgacgcgtgtttattagctatatgtttacgaaggggaatgcttaataataaatgtttgtgagcctgtgtatattggcttgatgttagatactccagctttagcatgcaatttcttagtcgctgaaaattctttgtagcttgtgacgtgacctgtgagcagtgtaaacattgcacctttggtggaaaaataatgcttacctgttgttgaatatcttggatctgtgtttgtttgcttggtctccaaatctcttcaaggcatgcaggttaagtagatcacaggttggaactgttctggagcagttaaaataccagtaacatgagttcatctcgcctccagcgacagcttcacaaatgggaacaaagaaaaaatagttgcaagccttctttgtcttccaatcagaaaggtaaccctacattgcatagtcagaaaggtgatttcaactacactgtgatgccagttacaagaacaaaaagtcattagtcgtgtcatcagtggaaaaaagaatcatagagacggtggataactaaacagaacatagagagcatttagccaaggactaattcatcagcgc

SEQ ID NO: 14175 - DNA, 869 bp, Zea mays
aatagggatcttcaggaaacaaatgacgatacaggcatgattttattcaggtcatgactgaaaactaggatcagaaagacaatgtctgaaaaaccaggtgtgttaggattcataagaaaatatatatagagtaatctgacttactacgcctagcaatctgccatctcttcgaacttcaaaagttggaataccccgggccctcctcgttcggtgcagaaaagcaacgaacacctgcgcgcgagaaacccgcccccgtcggccgtcgccgtcgtcggcctcccgccgccgcgggcgatgggttgcttgttacccgatcaggcgttcgtgcggctgcggaaccgcacgtacggcatgtacctctacgcccacgaggacggcgcggccgtcgtcctgaagccgcaccgcgcctgcctgcaaacggtgtggcagttgcaccggatcctgcgcgccgaccgcaacctcaactacatactcttccgcagcgccgcctacggccggtacctcaccctctcgcgcgagacgtcgccgatctaccccggtcatagtcaccaagtgaaccacacgttccagggcgtctacgagaccccgatgcaggacgacgtcctctgggtgattgcctctgcggacaacctccacgccgtcatattccacgccacttaccgtgtcctccgctccagcccctcgaacatgctcctcttcggacacgccttcgtcgtcggcgacatctatcacccggtcaattacggcaccactatacattggacggttgaggaaattcccgtgagaccagaaccaccagtcattcacctcccaactgactgtccatttgtcacttctggatatctggcgcgggggatgatgacatgcgg

SEQ ID NO: 14176 - DNA, 567 bp, Zea mays
agaaagacactagctgaaaacccaggtgtgttagcattcataagaaaatatatatagagtaatctgacttactacgcctagcaatctgccatctcttcgaacttcaaaagttggaataccccgggccctcctcgttcggtgcagaaaagcaacgaacacctgcgcgcgagaaacccgcccccgtcgccgtcgtcggcctccagccgccgcgggcgatgggttgcttgttacccgatcaggcgttcgtgcggctgcggaaccgcacgtacggcatgtacctctacgcccacgaggacggcgcggccgtcgtcctgaagccgcaccgcgcctgcctgcaaacggtgtggcagttgcaccggatcctgcgcgccgaccgcaacctcaactacatcctcttccgcagcgccgcctacggccggtacctcaccctctcgcgcgagacgtcgccgatctaccccggtcatagtcaccaagtgaaccacacgttccagggcgtctacgagaccccgatgcaggacgacgtcctctgggtgattgcctgtgcggaaaactccacgccgtcatatt

SEQ ID NO: 14177 - DNA, 1363 bp, Zea mays
  misc_feature (135)..(135): n is a, c, g, or t
gatcggctcagactgagtgctgaactgctgatcatgacgccgccggacaggctgctgtgcgcacctgggacctggccgctggccacctgccaggctgccggagtgccggtgtcgtgtcaccgtctgccgactgcngagcagccgatgcggctgggtgttagtctacatgccacaacagagaggttattttttttaacaaatctatttttatctttgcaattttaattagtgaatctacaattttatgtcagtcagcaattttatgttttttttttttttttcttttatgtaaatctgaagttcattattaatgtcaatttacttgtacaatacagcgattgaacatgaagaggggtggagatattgcttcactttttcgaaaacacgaagcaaagaagcttgctacctccccggcatatccttcttcaactccggcagtaaatcaaggacaacctagtaatgaacaagaggaaggagtgatcgaagaaaatcagaatcatatgccttcttcaccaccaccagcagcatcacaatcatcagcaccgccggtttatgatatcaatcgtcttccacatgatccaggtgaaagacaacccatatcaagttatcatgttaatgatcatggcaattcgaagagcatatgttctgaaaggtcctttgcaaccatatggacatgaatttccaaaaagaaaaaattggagatagagaccacaactttaattttgtgtggttccatatttttccttgggttgaatatagtatcaagaatgatacagtattttgttttgtgtgctatttattcaaaaataagaaaagtaagggcaagggcacaaatgcatttactgtgggtggatggagaaattggaatataggaagcaaatcacttttgaaacatgcgggttctatggcacacaagacagctcaagagaaatacattggctatatgaatcctattgcatcaattgataaccaaattgagaagtggagtgatgaggacattcatttgtataagataagacttacttattcaattagatgtttgaaatatcttttgcatcaagggttggcattccatggacatgatgaaagcaaagagtctagcaacatgggcaatttcattgagcttttgaaatttcttgctactaacagtgaagaggtgaacaaggttgtgttgaacaatgctctaggtaactgcactttaactagcccaatgattcaagcacagattattcattgttgtgccatggaaactagaaaaaaaataattgaagaacttggtgaagagccctttgctactttagcagatgagtctagtgatgtatcacataaagaacaactagctctttgcttgcggtatgttgat

SEQ ID NO: 14178 - DNA, 4118 bp, Zea mays
gaggcctgcccttttttatagatcgctctttcaccttagtgaggtgatactacctaaaatcgttgcgctgtgttactgtgtatgctttcatgtcatgttggaccaaggtattttttcacggcccatctaagataatggtccgtttgttagacaatatgtggggagaaaacagcgtcgccgcgtggcacacgacgcacaaaaatagagattaaaatacatactttcgatatattgagaagtgatatatatatataaaggttgtcctaataagacgctgagatatatgaacatagaatgaaatgagctatcaatcgatctcaaaataaatttctacgtcgggcacataataatgtaaagtagtgtcacgtagaaaaaaaaacagacgaaaagaatacgatatcccaaatcgtgaggccaacaatgaagggcagtataacgacataagaaaactccaaattcgtccgctgcacgtcagatctgggggagtaatgtaaaccacaggtttctggtggagctagagctagccaggtgtagaggaagatatcgtagaataggataccgtaacctagtccccggcccgggttcggacgtggtcttgttgactgaaattaaaacgataatcttctgagtttgatttgtatcatatgcatgcatgatcagacaaacagtcgtcctccatcctccaatcactcagctcggcttcaaagtgtagtttagtacgtggcgctagctgtggacatgttctgatcacgtaagcttagccttgtcgtttgcacctcctaccagcctaacgacaaagggtttctaattgtaatctgtactatggcaatgaagcctaaccaagctactagtttatctcacgaactcaagccaatgcaaccaatggcgtacgcgcaggtggatctatatccgaacttattagtcgagctagctagaacaattttattaatcgctagttcccactgcacgcgtagtaatattgaactatagacctgcatgcccacgtatttgtaggctagctgatgctctgcactgataagctaagcaagctagctagtagtaagatggtcagcgacgacgtctcgatcgaatgcagccgaacaaatgttcggtattcctcgtctcggttcgtctttaataatcataccacactggatccatcaccagacatatatggtaacacaccgtggccacttcggatccactgctgactgcccagagagctctggataatcgcatgcatgcatgcgcttcatcatatatagccgcggcgcttatccagattactaagcaacgtgctgctatgctaaatttcagatcaatctactacaaacatatacttaacacatttgcaataaaatttggccgaccagccccggtcaaggagggcgtacgcgtacgtccccttctcgcggtacggttccagctaaattctacccgcccaaagcttggtctgccgccgcgtgtccacccagccctgtcccgcccaattaatttgttagcaatttctactacggcgcgacgaccctagcagcaatctgccgggcataatgaatagtttgcgtccaagtcgagccggtaacgcgtccacgtttctgtgcgtaatcgcgtgcattaattatcttccgagataaacatataaactgcaaaccgaagcaaacaaaaataaataaaagcccttcgttcacgtaatccaccacatttagcacgcaagaaacgttttggcatggcaggcaattggctcagctctaacggatttttagtctggtttcggtggatcgaactgtttagaactgatatgctcgcgtcgtccacagggatcgaaatatctatctatataatccttttgatgtctcgtcgtttttaagctgcactgttgctcgtggcctaccgagattacaccgcccgccccgggctgctttgccgttatgagcgagccgagcttcaccggcatcccatgtcgtcaccgtgcccctcgcgcgttttttgggggggcaacatgccttgtttgttcgcttgcccctgtatatatacagacctccccaccacctcccctaccactaccagcctcaaattaagcagccaacaagacctgtctatagctgcctcgctagccaagcctgactgctacctagcaacgaccagctgggactgggagggggagtccatcgagctcgccccaggctgacgatccgctcgatctcggggacccaagagtttcgatagacgacgcatggcgaaggtccaccccaacgtgctgctgtcgtcgtcgtcgccggctgagggagccgccgcagcggcggcgggcggcgagggcgaggagacgtcgctgacggtgtggcgcaagtcgctgctgttcaactgccgggggtacacggtgttcgacgccaggggcgacctggcgtaccgcgccgacagctacgacgccgaggccgaggtcgtgctcatggaccccgccggccgcccggccttcaccgtgcgccgcaggcgcctcagcctgtccggcgagcagtggctcatctacgcgggcgaggagacgcggcggcccgcgtacgccgtcaagcgcggcggcggcggcgggaagtcggtggcgcgcgtcacgccgtgcgccgccgtgcccgccgcagctggggccgccgcgttgcccgcgtacgaggtggaggggtcctacgcgcgccgccgctgcgtggtgtacgacgcccaccagcgccgcgccgtcgcggaggtgcagcccaaggaggcggtcggctcggacgtgttccgcctcgtggtgcagccgggggtcgacgtgtcgctcgccatggccgtggtcgtggcgctcgaccagctgtttgggaggccgtcgctcctcaggagctggtcctcgccatagattcatgttttctttcttgtgttcaaattcagtctagataggtttttttgcccctggacttggggttgtgaattatcactggagatgctgatgactcgatctgcctgggcatcgtttgttggcatgaaagcaattcctgttcttgcgtgcttactcccaaaataccctgctcccaattgagtttttttttttaaaaaaagaaattatgaattccctctcgattctcttcgtttggcacaagagggacagagttgtaaatacctcgaggaacgttatgtactactgtccgatttctgaaggcgaaattttgtcctttatgtacttgttttagcacaccttgtttgatccctgcgtcttgatccactcgagtgctatttttgggcacgtcaggttgtcgaagccaaaagcaacactgacacagcttcctgcgtcggcttctactctggtagtaaacatcaaacatggacatgtcgaatttcacgcttggagcaacgattttggtcgcttttgcatgcgggttgcccagataggacaatcgagtcgtttctcgcccgggaccctgccactgccatcctcctgctactagagagtagagacaggcaggctggtgcctcgctgctttccagatataccaggtggtcattcagtccagctccatgatagagccgagcgccgaaagatacacaggtacgcatcctgtagctgatcgtcggcgttttgtgtttacatgtagtttgtgcgatgaatcttctcacgattcttgcattgcatgcatatagcagtgtccacggcgcaggttagcttgagtaagggaagtgttcgttcaacagatttacagactaattatgaagaagttaccgtgtacccgtatcaaatcgacgaattaattagatctaaatgacacatgttacaccataagaatttgacaagctgagataggcccatcagtgcacgctacgccggtctcgatagccgatgcaataatatgcaacacacagtgacacagtgcttgtttgtgtgtataaaacacattacacatgcaacgcacggttgtgtaaaaaggcttcagaaatctcgtgagcacacaacaaagcacgaggacgaggccaggtgtcgcctacacatttcagaacccagcaacactaggcccaacaaactattctttccaaggtaagcccaagtaatcatatgtgctagcaggccaggccgaagccgaaagcccaaaagctgagagacctgtggagta

SEQ ID NO: 14179 - DNA, 995 bp, Zea mays
actatgcatgtattgaacattattccaattatctaagaactcccgtttccctgcctatcttcttcttccccaagctacactctctctcccttccctctggtagctaacactttgtctaggacccataccaagaccggctacatatacacgatacagctcgagccagagtcgttgaggccggtgacgacgagagcatggaggtccaggtccagcagagaggatcccctgcccccgcggcagagctggaggtctccctccgcgagttcaccatgtcggacgcggaggcgttcatgtcgtgggcgtccgaccctcgcgtggtccgcttccagcgccgcgacgcctacgagcatgtggaccaggcccgccgctacatcgccgaccacatcctgccgcacccgtggtaccgcgccatctgcgtcggcgcgggcgcgcccctccctgtggtgggttccatctccgtgaagcccgggcccaccgaggacgggcggccgttcagggcgttcgtgggataccgcctggcgcgcgcgcactgggggcggggcatcgcgacacgcgcggtgcgagcggcggccgcggccgtgttcgcggcgtggccctggctgctgcggctggaggccgtggcggacgtggacaacccggcgtcgcagcgcgtactggagaaggccgggttcgccagggagggcgtgctgcggaagtacgtcctgctcaagggccagccccagggacatggtcatgttcagcatcgtcgtcgagacggagcaggacaaaccggatgggccatagatcgccgcgatgctatgggctcctggcctttcgctgctgcgcatacggcatacgtcacgtatgtagtgtaacgttctaggcagccatgtatcatgtactgtatgtatgatgatagtataccaccgtgtgtatgtgataatctgaaaggaaataggaaaatgaataatcgtaccaaaaaaaaaaaaaaaaaatgcgagcggccccaacacaat

SEQ ID NO: 14180 - DNA, 852 bp, Zea mays
gccaccctctatgtctctacctctatatataatgcttcaacggctccgtcccgtcccaagtcctatcaacagcgtgctcgagattacagagatgccaactggtaggctgagcggcaacatcacccaggactgggagccggtggttctgcgccgtacgaagccgaaggcggccgacctcaagtcgtcgaaggcggtgaaccaggcgctgcgatcgggcgcggccgtggagacggtgcgcaagtcagcagcgggcatgaacaagcactccgctgcggtggcgcccgcgcgtaagctggacgagacgacggagcccgctgcggtggagcgggtggctgtggaggtgcgcgcggccattcagaaggcgcgcgtggccaagggatggagccaggcggagctggcgaagcacatcaacgagcgcgcgcaggtggtgcaggagtacgagagcagcaaggcggcgccggcccaggccgtgcttgccaagatggagcgcgctctcgaggtcaagctccgcgggaagggcgtcggcgcgccactggcggccggcgggaagtgatctgatattctgatgtgatggacttgtgcagattgcaacgttgatagcttaacctcttttttgaatcggctggttcggatgggcagtttgtgtttgtaggatcgtaattgggggaatactatatgatgtgaaggacttgttgcgatgtttgatgttgcggatgttgagcattatttgtagcactgtatgcatgcgtatagtccgtctataagcgtggaaagtctgtcgtaggattagatcaggtggttcaaagtttttctctgtgcgtgtttatccctcttaaattgcacgagttgctg

SEQ ID NO: 14181 - DNA, 829 bp, Zea mays
gccaccctctatgtctctacctctatatataatgcttcaacggctccgtcccgtcccaagtcctatcaacagcgtgctcgagattacagagatgccaactggtaggctgagcggcaacatcaccccaggactgggagccggtggttctgcgccgtacgaagccgaaggcgggccgacctcaagtcgtcgaaggcggtgaaccaggcgctgcgatcgggcgcggccgtggagacggtgcgcaagtcagcagcgggcatgaacaagcactccgctgcggtggcgcccgcgcgtaagctggacgagacgacggagcccgctgcggtggagcgggtggctgtggaggtgcgcgcggccattcagaaggcgcgcgtggccaagggatggagccaggcggagctggcgaagcgcatcaacgagcgcgcgcaggtggtgcaggagtacgagagcggcaaggcggcgccggcccaggccgtgcttgccaagatggagcgcgctctcgaggtcaagctccgcgggaagggcgtcggcgcgccactggcggccgtcgggaagtgatctgatgtgatggacttgtgcagattgcaacgttgatagcttaacctctttttttgaatcggctggttcggatgtgcagtttgtgtttgtaggatcgtaattgggggaatattatatgatgtgaaggacttgtttcgtagtttgataattaaatggttgcgggtgttggcactgcgtatagtttggttatatacgtggaaaggtgtgatatgattagattagaccttcaaattttatggtggactggaataacgactgaactggtttcgctctc

SEQ ID NO: 14182 - DNA, 684 bp, Zea mays
ccaagtcctatcaacagcgtgctcgagattataagcgcaaggaaatacaaggaaataagagtacagagatgccaactggtaggctgagcggcaacatcacccaggactgggagccggtggttctgcgccgtacgaagccgaaggcggccgacctcaagtcgtcgaaggcggtgaaccaggcgctgcggtcgggcgcggccgtggagacggtgcgcaagtcagcggcgggcatgaacaagcactccacgacggtggcgcccgcgcgtaagctggacgagacgacggagcccgctgcggtggagcgggtggctgtggaggtgcgcgcggccattcagaaggcgcgcgtggccaagggatggagccaggcggagctggcgaagcgcatcaacgagcgcgcgcaggtggtgcaggagtacgagagcggcaaagcagcaccggcccaggccgtgcttgccaagatggagcgcgctctcgaggtcaagctccgcgggaagggcgtcggcgcgccactggcggccgtcgggaagtgatctgatgtgatggacttgtgcagattgcaacgttgatagcttaacctctttttttgaatcggctggttcggatgtgcagtttgtgtttgtaggatcgtaattgggggaatgttatatgatgtgaaggacttgttgcgtaaaaaaaaaaaaaaaa

SEQ ID NO: 14183 - DNA, 1813 bp, Zea mays
agaactactggagttgctcttacttagcccgaccctaaattttaaactatgtggtatctttgttaggtccaaatccagctcgtatatttgaccctataaaatcaaaatattataatcacataaagtttatagcttattaataaagatattaaataatactatcatcatttgatcatataaactccaaatatcacaacaatataaagtaggtagcttattaaattaaataacttggcttcattgagcattgccgacccaagctcggtccatctgtgcggaccagggggccgacaagccaaatttttaggctcggccagaccgtcttcaaatcatgctaggccggtctatattattttgtaccggatcgtgttttgagtcctgtgcgtttttggaccgtgcttgagttggtctaaaaaaacctgacccatatcccagcactactggacaggagactaggaaggataagggaggttttccttgctggaaatcagaacaatcatcgttcgtatgttcttgactgtccgatcgtatctgtatggccaagacgagtaaagctgatactgtccgactggcagtgagctatacttggcagtgagcagggtggcctcccattgcattcccctccccctcctgttgtcccgtacgatggcacgctcggtagccgttgcaacgattggggatcgtctaatatagccgttgtcctgcagcgccttccctccccggccaccgcctcgcccaacggctctattccgtgctccacgctccacggtgaccgttgtgagtttaaagcattcctctcacttctcatcgccgggatccagatcgttcttcctcttgcccgccgattcgttccaccaccgcgaaagccacacagagagcaggagagacaatccagagagatcggcgccatgaacgacctcatgactaagtccttcatgagctacgtcgacctgaagaaggcggcgatgaaggacctggaggcggggggcgacgggatcgagctcccggagtcgggcgccggcggcgtcacggacgagcgcctgcgcggattcttccaggaggccgaggcggtgaaggcggagatggcggccatccgcgacgcgctcgaccgcctgcacgccgccaacgaggagggcaagtcgctgcaccaggtcgacgccctccgcgcgcaccgcggccgcgtgaacgccgacatcgtcgccgtgctccgccgcgcccgcgacatccgcgccaggctcgagtccctggaccgcgccaacgccgcgcagcggaggctctccgcggggtgccgcgagggcacgccgctggaccgcacgcgcaccgccgtcacctcggggctccggaagaagctcaaggacctcatgctcgacttccaggcgctgcggcagcggatgatgtccgagtacaaggacaccgtgcagcggcgctactacacgctcaccggggaggtccccgaggaggaggtgatcgagcgcatcatctccgacgggcgcggcgaggagctcctgggagcagccgtcgcggagcacggcaagggcgccgtgctcgccgcggtgcacgagatccaggaccgccacgacgcggcgcgcgaggtggagcgcagcctcctggagctccaccaggtgttcctcgacatggccgtcatggtggagatgcagggggagaagctcgacgacatcgagagccacgtcgccagcgcctcccactacgtgcagggcggcaacaaggagcttggcaggccaaggagtaccagcggagcagccgcaagtgcctctgcatcggcatcatcatactgctcctactcgtactgctc

SEQ ID NO: 14184 - DNA, 7661 bp, Zea mays
  misc_feature (1773)..(1773): n is a, c, g, or t
tctcgtcgccaactcggtccatgaaaggaaagacgagccgccttgccgcattcacgcacaggctgccgccggccgctacgacgacgtacggaatgagtagtgtgcggtgcggcgggcctccatccatctcataataggtcgacaagatcattgctcgcacgcaacttggtgtacgtcccgtcgtccttattagcatccatggccatgcatgcatcgccggccgggccgcccagtgcgttccacaccaaccactgacgtgacgtggcccagtagcctcgatacttaaccgcagtcagtataactatatataagtaagcatgcatgcatgaataatgcaagtctttatttcatatgcatggcgaactacgtggacggagcagccagagtatcatatcagccatgcatgcatgcatggggcatcattgttttaacccaccatcagccagaacagaaacacatgactaatgtccaaagtggttagggtatggattcagtccaccactccacctacagccaggtagcctgctgtaggtacggtcgtacggacgaacaataaaattaactaaacaatgcttaccaagttaccagcgatttctctatgagctccagggtacagaggcgcgcggcgtacagcgtccaggttgtctggtttacgttgcacgcgtgatggggtacaggcgacggctccgcctcaatgattccctcccttttgtcccagaatcattcctgcatgcaaaagggcagctagctagctagcttattggtgatgaacaaaaggccccggcgtcgtcggttcgcttcaagatcctctactatctaatggcttcttgctgcctgcccccgattttgcttcagagtccacggtcccagctagccgcaggactgtgtatatatactgctaattctattttatgtaaccttagtcttctgtgcgctgtcatgtaaacacgtactacgacatattgtgcaaatgttgaatggatcctgggctcatggcattggtttaatagtagtaaaattgggcggcgaatacccttggctcgggcactgacatgtcagtgcgtgtgtggcccgtatgggagaagtagcacatgccatgtagcaggacggaccacggacggtatactgtagcctcagtaccggattctattgcagcagtccgaaccagacagagcagagagaacgacgacggtatacagtatgcagtatacgtactacaataatcaatgcacctgcatcttccgttcagacagtcgaccagttgggggtgggcgagaccgtatttttgcctgtgatagattcatagacatagtagaagaggaacggacttaccggctcaggctccgttggtttcacgcgcgggtttcccgcccgtttgacgcgctccgtgtcccatgcgtaacagtcctggctcggctcggctcggcgatgataggcgcgcccaacgcagacgcagcgagacatatcttggcctgccggcgcaaacgcaacccgggagcgcggagccaatgccgccatgccggcagtccgcaacgtcccgcgtccaaagccagtcgtccaaacccgcgctacgggcgtgagaatgcgtgatgcagcagtacagtatttgtttccacagcacacggcaattgattaattaactaaaactcataatcgcgccactttcgggtcacagggacgcgggccccgtcgtcccccatccgtttcctcctccgcctcgcctcctctctacccagccccagcctctcccggtctcccctcctctcctctccnctcctctcctcctcttcctctgcttctctccccgatctctatttcccatttccgggcggctcccgttctccacctcaattattgcccacccatccccgctccctcctctcctctcctcccgtcccacccatctcctcgcaccagcgccgggggaatggcggccgcgctgtggacgctgctggtggcggtggccctgtcggcggcgctggcctcgaaccgccccgtggcggcggcggcgacggcggcggcggaggcggcgaacgaggtgctccgcgcgcaccagctgccggggggcctgctgccggcggggatcacggcgttccggcacgacgccgccacgggggcgttcgaggcccggctggacgcgccctgcacggcgcgcttcgaggtcggcctccgctacaacgccaccgtctccggggtcatcagccccggccagatcgccgacatctccggcgtcgccgcgcaggacctcttcatgtggttccccgtccacgacatcaaggtcgacatcccctcctccggcgtcatctacttcaacgtcggcgtcgtcaagaagcacctcccgctcgccgtcttcgacgcgccgccggcctgcacgcccgacccgctcctgcaggtaataaacccatctctcgaccctcggtcttttttttttttttgatagaatcgttggcgctgtttgcgagtcctgagtttcttctccggcgcccgcagcggctggaggacgtgggcgagggcggattggccgtggtgggcgccgcggcgtcccggcgatgatgggtggaggagaacggaggagggttcgacggcgccggcgagccaggatcacgagcgcagttttgagaggagaacgggcgatcgccggccttcttcgatgcacatagatagcgtgggcatttccatctgttttcttttttctgcttcctactagtggctacactagtaaccaacctcgtctatcattgttcgtttcgtcaagctgttgtcatttcctgctgtcttccgttcatgtccgtgttctgttcggccggaatccgccggcagcacgcgtgtccccctcgcgttgcgtcgtgcggcgtagcggcggcgaggacgaccgccggcgattttttttttggcgcgcggtaatggatgcgggctgcgcgctactcgcgtcgtgacgaaacgaatctggctggaaactggaatgcaaatccaatcacgcttcttccttccccctgcccaaatgcatgcaaatccattggcctgcgattcagtgcacactctcttgcatcgccagcgtcgttgtctcgctgatgcctgcctgcatccgtctccgccgccgtaggagcgaggcctgtgacgcggtctccgtccgttccatcgtggcatggcatcatcccgtccccttcgcgggccggagagagagagagagagagagtgaggtgttgtctgagaaaaagaccatgattcgacatggcagatgctgactagtcccctcgtctctctctgggtatcaccattcaccagtcactaccctacctccctacagcgaatagcaataccgggtctgggtggatggtcacactgtccatgtctgcagtgcagacagacagaggatgcctcctctctatcctaccggctgcagtctcgccaactaattcctcggtgcagcttagctaaccaacccctcgaatctttaatcattactagtatttttttctctatcgaatccaacaacgaaacgaagcgatatagttttactggtagtcgaaagaagtagatctggacatctggtgagctagcgtgtgcatgattgggtggcactgggggttcaggtacgcatgtgacgagtccggggcaataattctcggtcacaagcggacaggatgatgcgcatggagacccaaaatcccctgttcgactaacccgacagctcaggaatatctggatcgcaggagatgccatgccagtgccacacatcgcttgctcccggccggggtggttttggtactagttgcactgatgactggttcgtcgcggtctaaacttgacccggttgcccccctccttttttttcttgctataattaactgttaaagctcgtgtgagttgtgaccactgctccaggaaaggatagccgctgagatgctgacacgcgggtccagctgagaggtgggggtacgtcctacgtgtcagtgctggagtggggagtgacgggcaacagcgacgtgaccggacgcgacgcgattagcgggcgcatcgcatgtgcgagggaggaacgatgacggtaaggagacaagacaagcgtatcaactgcagcttcctgcagcctgccggggtgggttgctgcagtaggtgccgctgctggccaatgccaacgagccatttgcccggttggccgtggtcacctggcgtggctcttccggcctgtggattatgtgggcggaaccgcggaaggatagggatggagcctggaggaggggagagacgcgtccggtgacgtcccctgtccaccgttttgagtaggagcgctgtcaacgtggcgaggattcaaggaggacagacagtccagggcaggttgatcacaatatcaactgtttgttttaggtaggagccctgacaacttgacatccgacaccgtgacattgaggtgtgctccggaggcttctctcggatagttttattttggaacttgattgctggtcgaggtgaaatatatatactccatgtcctgattgccgtgctacccagaggccacactgcctgaaaagaaaagaaaaaaaagaaagatgtaaaagaaaataaaagcaaaggaaaaattaaaaccaaatttgggctgaattcactgatggcccgaaactgtaccgtagaccccaacccacacatcgcaagagaggcccagcccagaagttttcaaaactccgacgtataaaaaagaccccagacccacagtcccctcctctctctttccccccgtgtcagtgtgtcacgcttcgaccacgcggcggcgccatggcggcccagcccatccgcaagccgcacttcgaccgcatcgtccgcgcgctcgcctccgaccacccgccaccgccccgcgccgagctgcacgcgtttctcgtccgctcgcacgccgcggccaccgcgcccgccctcgtccgctcgctcctcaacggcgccatcagccgcctctccaagcggcgcccgcgcgccgcgctcgccttgctcctcatcatgccgcgcctgcccgtgcgccccgaccacttcacgctccccttcgcgctcaacgccgccgcgtcgctccgcctcctcccgctcggcgcctccctgcacgccgtcgcgctccgcctcgcgctcctcccgctccgcctccccgtcgccaacgcgctcgtcgacctgtacgccaagtgcgaggagttccccgccgcgcacgccgcgctggcggacatccccgcccccgacgcggtctccttcaactccctcctctgcgcgcacgcccgcaacgcctccgtgcgtcccgccgagtccctcttcgctgccatgcccaccaggacccaggtctcctggaacgccatggtggtcctctacgtcagcgctggtgacctcgcggccgcttgccgtgtgtttgacgaaatgccgacgagggacacggcctcgtcgatggtgctcattgtcgggtattgtaagtgcgggctggtgcagaatgcgcgtgagctgtttgacaaaatgcctacaaaggatctcgtggcccggacggccatgattaatggttatgcacagactgggcggccaaaggtggcactcgctttatttagggatctggaggctgctgggattgagcctgatggagccacaatggttggggttatctctgcaggtccacagataggcagcacggagttggctgggtgggttggagcttacgtcgacaggaagaagatcgaaaggaatgagaaggttcttacagcactagtagatatgcacgcaaagtgtggcaacattgagcaggcactgagtgctttcagggagatcccacgacctgatgcctatccatacacagcactgattagcggcctggcaacacatggacacgaaaatctggcactttcagtgttcgaaaggatgcgggctgaagacatcaagcctcaccctatcactttcgttggtgtgcttacagcatgcagccacgcagggaatgttgaaaagggactggagtattgggaggcaatggtgcaggattatggtattgagcgccatgcggaccactatgcctgtgtcattgacatgctcgggcgtgcagggaggattgaggaggctttcgagatggttcaaacgatgccgatggggccacatccgggggctcttggtgcactcctgagtgcctgcaagacatatgataacgttgagattgcagaagttgtcgcaaacaagctatttgagttggaaccttggaacactgggaactatatactcttgtcaaacatatatgctgggaaagaactctgggaggaggcagaaagggtcagatcactgatgagaacaaaactgccatttaaaagtcctggatccacttggtttgaggatcgacagagagagcatgctaagatgtctatcatggactgaggatgagcagaaacaccactttctggagatgatggaagctaggaaggctgaaaacatagctatttgacagtcagcaaagcagaggagcttcgtatcagtttgccactaagatcctatgtataggcactggtcaaggtgatttcctatagtaagtgtacaatgtctcccaatgaacctaggtaggttgcaataaagttcttacatatagaataggtgttatagcaagagattcaaatatatgattccctgaacatttagtaataggaattgctatgaagtagtaaaggattatttagaacaatcactccatatgaattagtgtacattggtcttgatttactgataaagtatgagcatattcacattcactgcatgaaatggttatttacaactagaatagctctattctgcatgctgagtatccacttgtatagaagggagttcctcattcataaatagcatactaatttgtgcacatttttttttcaggtcatttctcatcctagcctcactctctcgatggcacgagctctaattcatcgatcttgggaccagtgacctccttgacatcattcaatcctcaatgatcttgaatgttggcacaacctttatacccagtttctttactgaaagctgcaagtagcatgcgcgggagcttttcagcatgtcatattccacggggcagagagtcgtgaatacacaagaaacagggaaatattcccaactgagggcttgattagagggggatttaagagattgaattcttttctatttgattttgaatagcaagagatttaatccgctccaatctccttcaatctactcctaatcgaacaaggattaagggcttgttcgctttcctctcaatccatgtgaattggttggaattgagtgggtttaaatttcaaacaagtcaaaatcttttggacttgttcgttttgtacttaaaccatgtggatcttttggacttgttcgttttgtacttaaaccatgtggattgaggggtattggggtgtattaaggccttgttcggttatttccaatacatatggattggatgagattgaaaaaaattgagaagaagtttgacttgtttaggattcaaactcatctaatctcactcaatccacatggattgagagctaaccgatcaaggcgtaaggtaaattttgactagttgtggatttatttcctctcaatccacatggatttggaaaaaaatgaacatcataatatttttcaatcctatccaattgacttgggacagaaataaccgaactagagtc

SEQ ID NO: 14185 - DNA, 941 bp, Zea mays
  misc_feature (877)..(881): n is a, c, g, or t
  misc_feature (883)..(886): n is a, c, g, or t
  misc_feature (888)..(892): n is a, c, g, or t
  misc_feature (894)..(894): n is a, c, g, or t
  misc_feature (897)..(897): n is a, c, g, or t
acgatctctatttcccatttccgggcggctcccgttctccacctcaattattgcccacccatccccgctccctcctctcctctcctcccgtcccacccatctcctcgcaccagcgccgggggaatggcggccgcgctgtggacgctggtggtggcggtggccctgtcggcggcgctggcctcgaaccgccccgtggcggcggcggcgacggcggcggcggaggcggcgaacgaggtgctccgcgcgcaccagctgccggggggcctgctgccggcggggatcacggcgttccggcacgacgccgccacgggagcgttcgaggcccggctggacgcgccctgcacggcgcgcttcgaggtcggcctccgctacaacgccaccgtctccggggtcatcagccccggccagatcgccgacatctccggcgtcgccgcgcaggacctcttcatgtggttccccgtccacgacatcaaggtcgacatcccctcctccggcgtcatctacttcaacgtcggcgtcgtcaagaagcacctcccgctcgccgtcttcgacgcgccgccggcttgcacgcccgacccgctcctgcagcggctggaggacgtgggcgagggcggattggccgtggtgggcgccgcggcgtcccggcgatgatgggtggaggagacggaggagggttcgacggcgccggcgagccaggatcacgagcgcagttttgagaggagaacgggcgatcgccggccttcttcgatgcacatagatagcgtgggcatttccatctgttttctttttctgcttcctactagtggctacactagtaaccaacctcgtctatcattgttcgtttcgtcaagctgttgtcattacatgctgtcttccnnnnnannnnannnnnanaanaaaaaaaaaaataaaaaccgaaaaaaaaaaaaaaaaaagcggcc

SEQ ID NO: 14186 - DNA, 1387 bp, Zea mays
actcgaccgcaagcgtgtgtacgcacggaccgcccgcccacgcacgggcatggcagcctccgcctccccctcatcctccacaaaccctaggtagcacgggagtccctcgccgccggatccccgagaccctgcaagccgcgccgattctgtgctgtgtgctccacggctagatttctgggtgtgaaagagcgcgtttttttaacagttcttagctagggagattttgggaagggagagtgctggaataatggagccgaggatcgggaacaagttccggcttgggcgcaagatcgggagcggctctttcggggagatctacctcggcaccaatatccagacgaacgaggaggttgcgattaagctggaaaatgtgaagacaaagcatcctcagttgctctacgaatcaaagatttataggattctgcaaggaggaactggaataccgaatgtcagatggtttggtgtagaaggagactacaatgtcttggttatggatttacttggaccaagccttgaggatctatttaatttctgcagcaggaaattatctctgaagaccgtgcttatgctcgcagatcagatgataaatcgagtagaatttgttcattccaagtcttttctgcatcgagatattaagccagataatttcctcatgggtctcggcagacgagctaatcaggtctacgttattgactttggccttgctaaaaaatacagggatacctcaacgcatcagcacatcccatacaggcatagaaaagaataatctaatcattcctgagttgtatatgctttgtgttcattcctgtagtaagcatgtttagtgttctaattagctcaagttacttcccatttttctcttgtaccttttctagggccaagctggaaattctaagcatgtctaactttttgttagcacaagttctatctggctactactataatataatgcttaggctggtgccagtgcgggcggcagcgcgggcgagaagaggccgctgccgcccgcgcgcgggcgataggcgggcgagaggccagcgccgggcgatggcgctggcgcccggcgagagcgggcgatatcgcctcgctctcgcccgcgctggagcgcccgcccgggcgagaggcgggcgagagggaggcgaggcactggcggggcgagagcgcggggcgagagcgcgggcgagagcgacgtggcgcgatctgattggtccacgtgtcgcgatctgattggtccacgtgtgctagccgttgcaactagccgtttttgaccgtttggagtccgattagagttatgtaattttattttaattatcatgtcattttattttaattattatgtactttgtaatttttaattcaataaaaaatattatgttgtgtgttttct

SEQ ID NO: 14187 - DNA, 2838 bp, Zea mays
  misc_feature (525)..(525): n is a, c, g, or t
  misc_feature (541)..(541): n is a, c, g, or t
cccccgctttccgtgcgcatggccgccgcgcgggcgcaaccaccaccgccgtggccggatgtctagaaagcccctcctccccacctgcgggtcctccacccctcccccgctcttcctcctccgccgcctcctccctcgccgccgcgcgacctcctctcccccgccgccctccacccggcggaggaccgccgccatgccaccccgcgccggcgactccgccgcggcggcggctgcggcggcatccttccgtctcgggatggtgcgggtggtctctttccttgtaggcgggctcaacctcgcggtgctgctgcttggactctacctcatcgacgccgtgctcccgtcggggtgcggcgggggggctcgctttcgcctcggcgcccgctctgtccggggtccgcgtgctctccatgatcggcgctgcgcgcgcgcagcacgccacggcggacgccatagctaagcgccacctccacgagagcgacgcatctgtcgcagctgatgccgtagctcgccacgagattaggngtgaggtacaaacgcntggttgtggtggaccagatttggtatggcagttggtgcattgcagttggttgcagcaatttatctcatgtttgtcattgtaagagatctctcaaatgaaagaagatccacttcctgcttctttgggaagtgttcgaccatggaatccgagaagctttgtgctgcctaggacgtgcaaaatatctaactgtattggaagaagatgaggtttattctgttgcaagactccttggtgatttggttgcatatcgtgcttctgggacaggacatttggagctcttagcagggcttgctctattgcagaagcacgggaatttatctgaattgcagactgaccttgtggaggcatcccatgagcttatgcaagaagctgctttcctccatccatttgcggaagcatgttatacgggaccacttcttgattttggacgaaatcctatcctgtttccctgtgcatgggtttatagacaaggtgtgttaactccatgggcacgcagaagacgccctgcacttgatggtgataattggtggcgaggccatgctgcagctttccttagatttgttaatataccacctaaagcacttctgaaaggacgtgtttgccagagcaagcgtgaagctgcttattttgttgtggttctccatgacaaaagaactgttgtcattggggttcgtggaacagagacaccagaggatctcataactgatggattatgcagagaatgtgcttttactatggaagatttggatggactagtaaatgaacaattacctgcaactacaagagagagagttatttcaacatttccccactatcgtcccggtggcatcctagcgtccggccagggagcttttcatgcaactaatggagaaaacacatcttctggaagacttggattcctttccacactgctgggggagggcagtgagtgtcatggatataaagttcgtcttgttgggcattctttaggaggcgctgttgctacagtcctaggaatgatgctatatggcaaatacccaagcgtgcatgtatatgcatatggaccacttccttgtgtggactttgtaatagcggaagcatgttcgcattttgtcacaaccattatttgcaatgatgaattttcctctcgcctttcaatcaattcgattcttaggctacgatctgctgcaataagtgctctttcagataactctccagctgatacagcaatgatacaaaagctcgctcgaagaattttgcatgtgaacaggtatcatgataatggtcctgacgatggcataatccagggctatgctgatcatacaagaacagcagatacaacagtaccgaatgaaagacaaatttctcatcagattccattatgcaatactgaactagacctccacaatacgcaaaatggcttttttaggtataatgggtccagtgcatcaatagatgagcatctgagctatgaaggcataagcagtggccatgatatgcaaataattccacttgatggggctgattctggttttgaagggcaccagacatcttacagagaaataccagtggagcctcctgagatgtttcttgcaggcttaattgttcacatagtgcggcaaagaagaagtctctttcctctttggaaatgctggagcatccaggaaactgaaccaccatacaaagctgttttagcgaaaagggagaacttcagggatatagtggttactccttacatgtttacagatcacttaccatggaggtgccactttgctatgcagaagattgttgaagctcaaaccctatgagacgtgcgcattccgatccacccgtacaacaacatttggtctgaccaggacaaaactgctgcccatgtacagaattgcgtgaaggacagaaaattatgatgatcacatttagcagcatggtctattgcaggctggaccgctggaggtatatttcagtccttcaggcagccagaatatgtccgtgacagacccaaaatcgtgacgagcttattgacagtcagaggccaccgagacatgatcactggttactgtacaccaacagtatctaatcagtctactcaccctggcaacctgcgcgtcaattaattaattcatcgatgtttttttctcgattgttctcttcaattaattaaattcatcgattgaatcattgttgtgcagctgcgtcgattccccattatttttttgttggtgcctagttatggtgtacataattcagcacagcaggattagccatagactgactggctggcaatggcaagtgacggtcaagatgtgattgtattgctt

SEQ ID NO: 14188 - DNA, 1522 bp, Zea mays
cccggctcggctcggctcggcacaggatccggccggccttttcactcaactcgcttcagcagctcagcctccaaccaaccgagagaagccagagaaaaggttactccacagaaagcaaaaccctagcccactccggcgcgccaccggccgatggtttcgatgagcaccacgccgaagccgcttgactccgccgtcgtcagcgcagccgttgacggcggggatgagggtggtggtggaggcggtggcgggaagaagcaggcgcacggggcggtgatggcgccgccaccgatggtggtcccggccgcggcgcccgcggccgaggaggaggttcggaaggtcaggaagccgtacaccatcaccaagtcgcgggagagctggacggagccggagcacgacaagttcctcgaggccctgcagctttttgatcgtgattggaagaaaattgaagcatatgttggctcaaagactgttatacagataaggagccatgcacagaagtacttcctgaaggttcagaagaatggtacgggcgagcatctgcccccacccaggccaaaacgaaaggcagctcatccatatccacagaaggcatctaaaaatgctcctgcagtttctcaagctattttatcacaagaacaacctacccagagggagcaaggttctgtcatgcctatggatactgctactgtgagaaacacaaatgcgaatgtggcggtgccttcctgggacaatactcttgctcaacctttcagcgctggtcatgttcaaggtgcagctgcaacaaataactgttcaagtagcatggagagtccatctggtacttggccaacttctgaagcagtcgagcaagaaaatatggttccaccactccgtgccatgccagattttgcccaagtatacaacttcctgggaagcatatttgatccggatacaagtgggcatttgcagaggttaaaagcgatggatccagttgatattgaaacggcactactacttatgaggaatctttccatgaaccttaggagtcccgactttgagcaacatcggaggttgctatcatcatatagctatggtggcgcggaccatgtcaaatctgaagccatggaaaatcttggatctcctcagagtggccatcttccatccctggtaacaagcgaatgagagcacacttccaatttgcggtcggagctttggttgtttacacgggacattcctgtgcgctcccagcaatggagttgtggagacggctggtctgtttatgaatgctagagacgtatcgtggcagtaacatctgtatagcttccaataaatggtctgaccctaggcaagttttgctttttcgcgtacgtgtagatagccagttttgtgtgctcatgcaattttttcctgggtggggcctagatcgtatgtttttttatatacacactattggacgcgtgatgtaaatatgtgcaatctttgtaatgcttgaggtactataattatataatggatatgttatgatcgaaaaaaaaaaaaaaaa

SEQ ID NO: 14189 - DNA, 1717 bp, Zea mays
aaagcatccccctggcagcgtctggacgggcgcttctgtctgcacgcgagcgagcgaagcgccccgaaacatccacatcggacatcgcgcacgcaacgcaaccgcagcgtcccatttcccctctccctccctggtcctcctcaggtcagctcagcgcctcagccttcaaccaaccaaccaaccaacccaactcgagccctcgacgagcacccgagagacacgagagtgaaggaaagaggaaaaagaagaagactacagccaaaaccctatctcactccggcgcgccaccggccgatggtttcgatgaacaccacgccgaatccgcttgactccgccgccggcagcgccgccgtcgccggcggaagcgtggacgagggaggaggaggaggcggcaggaagaagcggatgcgcggggcggtagcggcggcgatggtgccgccgccgatggcggtcccgctgccggccgcggcgcccgcggcgggggaggaggttcggaaggtcaggaagccgtacaccatcaccaaatcccgggagagctggacggagccggagcacgataagttcctcgaggccctgcagctttttgatcgtgattggaagaagattgaagcatatgtcggctcgaagactgttatacagataaggagccatgcacagaagtacttcttgaaggttcagaagaatggcacaggcgagcatctgcccccacccaggccaaaacggaaggcagctcatccatatccccagaaatcatctaaaaatgtttctcaaactattttattacaagaacaacctactcagcgggagcaaggttctgtcatgcctatggatactgctactgtgataaacacaaatgcgaatgtggcagtggcagtggcagtgccttcctgggacaatactcttgctcaatctctcagtgctggtcttgttccaggtgcaacaaataactgttcaagtagcatagagagtccatctggtacttggccaacttctgaagcagttgagcaagaaattgtggttccatcactccatgctatgccagattttgcccgagtatacagcttcctaggaagcatatttgatcctgatacaagtgggcatttgcagaggttaaaagtgatggatccaattgatattcaaacggtactactacttatgagaaatctttccacgaaccttaggagtcctgactttgagcaacatctatggtggtggggaccatgttaaacctgaaggcatggaaaatcatggatctcctcagagtggccatcttccattcctggtaacaagtgaatgagagcacactggcaatttgtggtcgaagctttggttgtttccacgagacacattcttgtgtgttctcagcaatcgagttgtggacggctggtctggcaatttatgaatgccatgtctgccaatctgtatagcttccaataatggtctgaccctagactagttttgttttccacgttcatgtagatagctagttttgtgtgctcatgcaattttttactgggtggagcctagatcgatatgtttttgttgtatcacttgtgcacgcgtgtatgtaagtatgtggaaccttgtaatgcttgaggtacttgagagtcttcggttaagacaaagcatatatgcgcaataatcaggagatcaccatcgtcgactatataatgagaagtttttttagttgtggacctacctaacaaaaaaaaaaaaa

SEQ ID NO: 14190 - DNA, 5622 bp, Zea mays
  misc_feature (1622)..(1622): n is a, c, g, or t
  misc_feature (1781)..(1781): n is a, c, g, or t
tcatctcatgtgtacactgccggaagggaagcggtaaacttaagcaagtatatacacatgtcggacctataacaccctatttgatcagctcttacaacggtcaactacacctgacgcaccctatttgatccgaggaatccttctcaagctccgcgatcagctgctcaatgtttcttctgtatataggcatgtaatggtcattgatcatcattttcgaaagcctcagcttgccgtacagagatcttggcgtcaagaagatccctaggctgctttgtgcctccccatccgtaacatcatcctcaggctcctctccacgatctgcttcttccctgctggagaataatatgtgcatgatttttccaggagggtagaacctatgcacttcctttgtctcgctgagcacatcttcagccacgccacccacctcctcagcaattgtactttcagccctcgcttccgctatgtcatcttcttctccctccctcttccggtacaactcactttcaagttgctgccacagctccacatcagtcatcctgtcctcatccccatggtgatcgacgatgtcatcatcgctatctcccttgtcatctaccaagtcaacaccatcgaccgccacagaaacagaactctgaaccacttctgatacagcttctgatgtaactgtctctgtggtttctgcagtggtttcagtcaacaatgaagtggattcagatccaccgcctgtagatgttattatttcctctgatgtgacagcggctcgagatatattgtttcgccgtcttggcccaatacaagtccatggggacagttgcagtgctggtcttgtccatgctgcctgtgctacactgcgagctctcctcattacaacctggccataagaatattatcactggaagccatggacaatgcagcaagtgtttaaaactcaaagacatctaagcttcctgaagatggtgtaacaaatgaagctttgaaggtaacctgcgtcccagtagatacaggtcttaagatggcgccagcaccagctactcttgctttagcatttgccatagatggaagccgggatcccaaggctgacgcagaacgataaaaagtgcttaggattctggtttgttcaatttggtggcggagatcatttagccaagctgacgctgtaacctgttacgaagggatattgtcatcatctcatgttcttacaaaagaagtacagtcaatgcgtgtgcactaacaaatttctaaaaaacacactttataatatgggattaacaaagtcaggaatatcagtaagaaacctctgaacgaagatcatctactgacgcagcagaaaatgttggaaccagatcagctccattgatgactgtagcgataaaatgcactcctgactctgccagtttccatgtcatacatgcagctgcagaacagaacattttctaagaaaaatatatactccttaatatttctacatagttaaatggaatttaagcttatcaaagattctagtatgatagaaacattgaacttaggttgcgaaacttataacagttccaatcataatatcagctaaggacttaactactgtgtactaacatttggattttatgaatagaattccagaaccnatcacaaagttcacaagcagtctggactatctactataccaacctgcccctgtgagtataaaaacataagacaagcaagtatatatatggtaatgaaaagagagagaaaatgtcatgtacacatcgttttcatggtttgattgagaaattaaggttctnaaagagaaaaaaagcatagcatagaaacctggagcaaatgccagacaagtagtagaggcaaactccttctgttccctcagaacgtatgtcaacagagcagctgtaccacctcccagtgaatgtccaacaacctaaatagatttgccaattgccatgaacacccatcaattgcaacactttgaaagaaacatgtaaacatagttatgatgcatcataagtcataaaaaggttatgttgtagcaatgctcatactctagcatcaaagacaaagaaaatggctatgaaataactcaaacctttattttgaagtctgggtacatctgcaatgcttgtgccagacaaggccctgagagctttgcaatccacctagcagcggcaaccatcccaaaatgagcatatcctagtactaagtcgctaacaccaccttcctgtacaatggtatggtgaaatggaaccacagcaccagtggcagctgttaatgtatctctgatgctatgagttcccctaattaatagaagtatagactttttgtctctatcaagcaaaatggtgaaagctggcttcaaaatctgcaagtaaaccacagaaattctgggatcaatgccaagtagacattgttcttatgcttagctattggaatacaaaatcagcaaaagaatggccataagaaaacaatagaagttttcactcactcctgctttaggttcttgcataagaacatcctccgtagtgtagccagtcgcctccaaaaacaacgggaatggctttttggagaaatgccagcaaagtgtcagcaaattgagaagatactttaaatcagcaattacttcagctcctttgagctccacactatcatttccagcgtatatgcttgctacagataagtttccctgtaacacatttcagaagcagagctatcagaaaccttgtaggagtactggcaatcacagtgcaatctgcatttttggttcatcaaatacaggattaatcatttgtttacgatagacagctctgccctggcccctggttatgtatttttacagaggaaggctttaaaggatgacatgagcacggtatgagcgaaatgtgaaggaccaaactatatccactgcctagcttaaatgtacagcactccacattggctttcaacctccaagaatcagaactagttcaaacgggacaagattaccaacaaagtgtgagccaccaacctgtctcttgaggaggaaactgatcccgaaggcaaggtcgccgatcggccacttcccaagggtctctgaatacgtgaaccgcagcgtctctgacagcgtcgagatagtctcaagccaggtggcaggggcgcggacgtccctccgcgatacacggctcctgctgggagaaccctgtgcggccctgggtgtcacatccctgctatcgctgcactccccttccttattcagcctctctgtctgcaggcggcggttcagtgtgtagtaaagcagtgccgcggcccccgcggcggttgccattgtcgctgtcgccatattgtcggggagtagtctgcaggggcttcgtcggcggccttgagccccggatggcctgtgggtcgcagcctcctgtgcagttgtaacccaaggttatcaatggcgcagtcagccagtcagataacgttacttagcagcccccgaggcttccactggtgatgcgatcttgatcctttggggcagggcagtatgaagtcaaacctgataccacagacagataaaccgagtttttttattccaagaaggccatcgattgggcgggcactggtcaccgatagctcaccctccccctctcctttttttggcagtggtatgaacagttggaccatccaaccacatcccatcaaacactactagtacactagatagagtaattcacacaaacaactaacaggttgaagaagtccaacgcaacaagtgaactaagaagaaatcgtccgacgcggaaaaaggaagtacggagaaagaaaacaagaaaatcatccaggtagagatattcgattggagacgttacctcgatggctcaacaattgcgcgcggcagcggtcgatctgattggcctgggaggtcgaaacccgctagggttttgggaaagggaggggggagcgggagacgagtccgggtgagcctacctatcggtgcggaatgcgcgggaggtggggagtgagagagaaatagggagacgagagaggaggcaggatatggtgccttaattctcgccgaatctcgcggggcagtggcggcggatggggaggggaagaagggcttccgtccgaccggacgaggcgcgtttcctttttgccctttccgggaagaagcggttgcgcttgggggctttccggacagagccggttgccgatggggtccgcctctggagccgcggtgggtgtgctgctgtgctttgcgggtgcggcaggacaaagcagctagagcccagagacaacacgagccgcgtgcccgcgttgcaggttgcttcgaggccaaggccaggcccacgggcgttccaggggaggtgtccactgtccatagtccatagaagcgggcgcggtcagtttggaccaactgggtcttcgtatgtcagacgtgcatataatatttcctatgttctaagctttagcttttctacctgcatataatgtttcatggctttcaaaaatctcaagaaagtacgtctatatttctatcttatccatactatctctgtaataatatttcctatgttctaagctttagcttttctacctgcattggccttgtcgtgcactcagatatacacaatgttagcatagtaaaattaatatattttaaaaataaaaaatattataatttaaaacgatagagctgtcaactccgccagagaggagttatccttgatgttgttaaaatgctctccaagatctcgataacgagatatcatgcctatagtacactcggatgagagtcgaattggcactcctaaggccctttgactaggagaccaaactgcaaaccagtcattcgaagctctacaaggattctctaatgttccctaagacacctctggagcaaaagagctcagtatggcctgtctctggcgccacgtgtcccccaaaccaagatgacacataacactagactaatacgataaagctctcgcctattgtatttattgtgatggatggcattgtggtcaaaagaaggcatgatgtagtcatgtttgagaccataagtgtactcacagatactttgttatgtgtgcaggtgcaacatctattgtagccatgtatgggactgcatatatacccttgaacactgtgtgggtgtgtgggtgcatcaaccgccatggccacacgcctaaggctgcaagcataaccgtaaacattgtaaagtacgtgcagctacatgtactgtcaactacgttgtactcaatgacttggattctcgtactaggcactatgacataatgtgatcaccattacagcgtgactgaaacatgcatcacgtgcatgtcaacaactctgacaagacaagaacaatcaagtctgcatggtgaagcatgtcatcatgcatgaatataactctcctctgtcttgagctataaaaggaaaaggagagaaaaataaacaggatctctcatggaactttggtgtctctctgaccttttcggggatcttttagaagactttacaactttgaccttttaggacttttggactttcaacctctccatgggactagacctactagggattagtctttggcttttaagggatggactttgagcacctaggcttctcaccttatccggcttcagcacctaggcttctcacctagactac

SEQ ID NO: 14191 - DNA, 1869 bp, Zea mays
attagcccattcagagaacaaatattagtggtatcaaagattagtttagagctaattgagagcacaaagattagtggtatcaaagattagtgggccaataaaggcccgcaaacacgtgcaagaccaattcattcaacaacctcaagaatcatctatcatgaagcgtttggcccaatacaagtccatgaggacagttgcagtgctggtcttgtccatgctgcctgtgctacactgcgagctctcctcattacaacttggccataagaacattatcactgcgtcccagtagatacatgtcttaagatggcgccagcaccagctactcttgctttagcatttgccatagatggaagccgggatcccaaggctgatgcagaatgataaaaagtgcttaggattctggtttgttcaatttggtggtggagatcatttagccaagccgacgctgtaacctctgaacgaagatcatctactgacgcagcagaaaatgttggaaccagatcagctccgttgatgactgtagtgataaaatgcactcctgactctgccagtttccatgtcatacatgcagctggagcaaatgccagacaagtagtagaggcaaactccttatgttccctcagaacgtatgtcaacagagcagctgtaccacctcccagtgaatgtccaacaacctttattttgaagtctgggtacacctgccatgcttgtgccagacaaggccctgagagctttgcaatccacctagcagcggcaaccatcccaaaatgagcatatcctagtactaagtcgctaacatcaccttcctgtacaatggtatggtgaaatggaaccccagcaccagtggcagctgttaatgtatctctgatgctatgagttcccctaattaatagaagtatagactttttgtctctatcaagcaaaatggtgaaagctggcttcaaaattcctgctttaggttcttgcataagaacatcctccgtagtgtagccagtcgcctccaaaaacaacgggaatggctttttggagaaatgccagcaaagtgtcagcaaattgagaagatactttaaatcagcaattacttcagctcctttgagctccacactatcattcccagcgtatatgcttgctacagataagtttccctgtctcttgaggaggaaactgatcccgaaggcaaggtcgccgatcggccacttcccaagggtctctgaatacgtgaaccgcagcgtctctgacaccgtcgagatagtctcaagccaggtggcaggggcgcggacgtcccgcacgcgtgggcggacgcgtgggggagaaccctgtgcggccctgggtgtcacatccctgctatcgctgcactccccttccttattcagcctctctgtctgcaggcggcggtccagcgtgtagtaaagcagtgccgcggcccccgcggcggttgccattgtcgctgtcgccatatcgtcggggagtaggctgcaggggcttcgtcagctgcaatgagcccccgatggcctgtgggtcgcagcctcctgtgcagttgtaacccaaggttatcaatggcgcagtcagccagtcagataacgttacttagcagcccccgaggcttccactggtgatgcgatcttgatcctttggggcagggcagtatgaagtcaaacctcgatggctcaacaattgcgcgcggcagcggtcgatctgattggcctgggaggtcgaaacccgctagggttttgggaaagggaggggggagcgggagacgagtccgggtgagcctacctatcggtccggaatgcgcgggaggtggggagtgagagagaaatagggagacgagagaggaggcaggatatggtgccttaacccacgcgaccg

SEQ ID NO: 14192 - DNA, 2610 bp, Zea mays
tagcttctctgccgagtgcctgcacgagaccattgcctggcatcgacaccttgaagcgtgctagggtttcccccgtcttatcgcttcctcgttcccgcagccgccgcccaaaccctagcaaacccgtcctccgccatggccgacgaccactactcgtccaagcggaagtacgacgacccctcgccgccgccgcggcgcacggggttctcttctggcccgccgcctgcctcgccgcccgctggcggcgccccgtcgtacaacagcgttgcgccgccccccgatgagatccagctcgcgaagcagcgtgcgcaggagatcgcggcgcggatctttaacgccgcagaggccaagcgccctcgcgtcgacaacggcgacgatgacgtcggcggcttcggtggaggaagttccctgggtggcagcggtggtggtggtggtggccgcatcgggggcgcaggacttggcttctcgtcctctgccggtggtgggcatggggcttctatcccaccgttatcttctcagagcagtgcaccacagtactcatatggtggacatcagggtacaagcaaaaagattgaaattccaaatggaagggttggtgttattattggaaaagctggggaaactattaggtatatccaacttcaatcaggagcaaagattcaagttacgagagaccatgaagctgaacctggtgcactgacaaggcaagttgagctttctggcaatcctgagcagataagcaaagctgaacagttgatcaaagaagttatagcagaggctgatgctgggtcatccggtgctgtatctggtggccggaaatacaatgcaccacagccaggcgctgagacattccagatgaaaattgctaataataaggtgggattgattattgggaagggtggtgagaccataaagtctatgcaggccaaatctggagcccgcattcaggttattcctttgcatctgcctgctggtgatacttcaactgaaagaactgtgcatattgatggcactcaagaacaaattgaacatgcaaagcagctggtggctgaggttaccagtgagaatcgtgccaggaatccaatgtctggtggctattctcagcagggctatcaccctcctcgtcctcagtcaaactggggcccgccttctgcgccaccccagcagtctggttatggttatatgcagcctggggcttatcctggggcaccgccacagtatggtgcacctcagcaaccttatggtagctatcccccaacatctggtggctatcagactgggtgggatcagtctcaaaaccagcaatctcatacaactccccctggtactgggtatgattattatagccagcagcagcaacctcaacaacaacaatctgcccctgggactgctgcttctactgatgccactagctacaattatggccagccttcaacatatgcttcacaaggatatgattctacctatactcagcatagtggtgggcagcaagcatatggacatgatggctactctggttaccagacccaaggccagcagcagggctactctcagcagactggttatgaccagcagggatatggtgcatctgcttatggatcagctgcgaactcgacccaggatgggtccagctatggtggtcctggtggggccacccaggcatctccggggcagcaaacttcaaccccagctgctggaagccaccctggctatgccagtcaaccgcctactagtgctgcagcaagctatccagttcaaggttcagctccatctggatatggtgctccaccaccccagcctggctatggcacccaacctccacagcaaggtggatatggtccgggcgcttatgggcagccttctccacacggcgagaaacctcctgcatcttcaccttatggacaagctccgcctcctggatctgctcagggtgttatgtgcagtatggttacagccaacctgcatacggtgcaccaccagcttaccctggtgcacccactgcaagccacccgggctatggccaacagcagtcttatggcgatgcttatggtagtggaagctatgggcagcctacagcctacactactgaagcagcagctcctgctgcatcccaggatcactctgccgcacctgccgcggcccctggaacaacagctgcgccagctcctgacaacaatgggggtgccaaaacttctgcggaaacttgatcttcaacagctaattgggaacaaactttttacaagcctctgttgtgtcgtttcctccactgttgcttaatattacacatctagtttaggctccacatctacaggttatatctttctgcctgttgttttgaccccatgaatcgctctttccgtgctgttgattagtactttgttgtttttttattgctggttagatgtttggactggtgatatatgtgtttgtgcggttactcttgttggactctaatgggtacctaccggcttggtctggacatatactgtcctatatttgtttttagcctccttttacattggttattatgtgtgctgtacaactgtcggacgtttccataagctggtgatagttatggatgaaaatttggttccccccccccaaaaaaaa

SEQ ID NO: 14193 - DNA, 2439 bp, Zea mays
  misc_feature (193)..(193): n is a, c, g, or t
gccggccgggtcggggcgcgcaggagatcgcggcgcggatctttaaccccgcggtgccctcgcggcctcgccgcgtcaacggcgacgatgacagcggcggcttcggtgtaggcctgggcagcactggtggcggtggccgcatcggcggcggaggactcggcttctcgtcctctgccggtggtgggcacggggncttctatcccacaattatcttctcagagcagcgcacctcagtactcctcttatggtggatatcagggtacaagcaaaaagattgaaattccaaatggaagggttggtgttatcattggaaaagccggggaaactattaggtatatccaacttcaatcaggagcaaagattcaagtcacaagagaccatgaagctgaacctggtgcactgacaaggcaagttgagctttctggcaaacctgagcagataagcaaagctgaacagttgatcaaagaagttctggcagaggccgatgctgggtcatccggtgctggatctggtggccggaaatacaatgcaacacagccaggtgctgagacgttccagatgaaaattgctaataacaaggtgggactgattattgggaagggtggggagactataaagtccatgcaggccaattctggagctcgtattcaggttattcctttgcatctgcctgctggtgatacttcaactgaaagaactgtgcatattgatggtacccaagaacaaattgaagctgcaaagcaactgatcagtgaggttaccagtgagaatcgtgctaggaatccaatgtctggtggctattctcagcagggatatcgccctcctcgtcctcagtcaaactggggcccgccttctgtgccaccccagcagcctggctatggttatatgcagcctggggcttatcctggggcaccgccacagtatggtgcacctcagcaaccttatggtagctaccccccaacatctggtggctatcagactggatgggatcagtctcaaaaccagcaatctcatacaactccccctggtactgggtatgattattatagtcagcagcagcaacctcagcaacaatctgcccctgggacagctgcttctactgatgccactagctacaattatggtcagccttcgacgtatgcttcacagggatatgattctacctacactcagcagagtggtgggcagcaagcatatggacatgatggctacactggttaccagacccaagggcagcagcagggctactctcagcagactggttatgatcagcagggttatggcacatctgcttatggatcagctgcaaactcgacccaggatgggtccaactatggtggtcctggaggggccagtcaggcatctccagggcagcaaacatcaaacccagctgctggaagccaacctggctataccagccaaccgcccactagtgctgcagcaacttacccacctcaaggttcagctccatctggatatggcgctccaccatcccagtctggctatggcacccaaccaccacagcaaggcggatatggtcagggcgcttatgggcagccttctccacagggccagaaacctcctccattgtcaccttatggacaggctctgcctcctggttctgctcaggctggttacgggcagtatggttacagccaacctgcttacggtgcaccaccagcttaccctggtgcacccattgcaagccaccagggctatggccagcagcagtcttatggcgatgcttatggtagtgcaagctatgggcagcctccagcctactctactgaagcaacacctcctgctgcatcccaggatcactctgctgcccctgctgcggcccttggaacaacagcttcgacagctcctgaaaacagtgggggcgcccaaacatccgctgaaacttgagcttcagcagctaattgggaacaaacattttccaagaccctgccgtgtggtttcctccgcgctgttgcttaatataattacgcatctaatttagggtctacaacttcaagttatttatttttctgcctgttgtttttgacaccatgacttgctgtttccttgctatattgagtagtactttgcagttattttattgctggcgtatatgtctggactagtgatatatgtgtttgtgtggttacccttgttggaccgtaatgggtaccttccggcttggtctggacagataaatgcccatctatatgtattctgagccctgttatgattgctctaccgtcggaggtttctatgcccccttcagctggtgatgatggttatgtatgaattttggtttcaatatttcgtaagacttatgtatcggtccataaaaggtttaagcagcatgaaagtctgcctttttgtttttgctgctggtaccaaaaaaaaaaaaaaaaaaaaaaaaaaaaagtactctgcgttgttaccactgct

SEQ ID NO: 14194 - DNA, 914 bp, Zea mays
cctcgaggccggccgggaattgtatattgcctcgcggccggccgggaccttgtctacaagggttttccgctgtcttatcccttcgtccacgctccctgcagccgccgcccaaaccctagcaacccgtcctccgccatggccgacgaccactactcctctaagaggaagtacgacgacccctcgccgccgccgcggcgcacggggttctcttcgggcccgccgcctgcctcgccgctcgcgggcggcgccccgtcgtacaacagcgtgccaccgccccccgatgagatccagctcgcgaagcagcgcgcgcaggagatcgcggcgcggatctttaacgccgcagaggccaagcgtcctcgcgtcgacaacggcgacgatgacagcggcggcttcggtgtaggcctgggcagcactggtggcggtggccgcatcggcggcggaggactcggcttctcgtcctctgccggtggtgggcacggggcttctatcccacaattatcttctcagagcagcgcacctcagtactcctcttatggtggatatcagggtacaagcaaaaagattgaaattccaaatggaagggttggtgttatcattggaaaagccggggaaactattaggtatatccaacttcaatcaggagcaaagattcaagtcacaagagaccatgaagctgaacctggtgcactgacaaggcaagttgagctttctggcaaacctgagcagataagcaaagctgaacagttgatcaaagaagttctggcagaggccgatgctgggtcatccggtgctggaactggtggccggaaatacaatgcaacacagccaggtgctgagacgttccagatgaaaattgctaataacaaggtgggactgattattgggaaagggtgggggagactataaagtcatgc

SEQ ID NO: 14195 - DNA, 4084 bp, Zea mays
gtctcttgctcccaggccgatgctgggtcatccggtgctggatctggtggccggaaatacaatgcaacacagccaggtgctgagacgttccagatgaaaattgctaataacaaggtatgcaccttgttctatttggacaagggtttgccttaccatacgaaactacactttatcatgctaccacaagtatttggcatgtgtatgggtgcctgtttgtcaattttatatcaatcaacagactgttgtgtgatttccttacccatgttgtttttttcctctacttctgatttttgtctatttctttttaggtgggactgattattgggaagggtggggagactataaagtccatgcaggccaattctggagctcgtattcaggtttgctatcttgttatatagcttcctgttttaccttagctgcaatcagaagtaaggttacactaagttcacttgtggctgtttgtctgcttgtttttgctttgccttgtaaatatcacttctaaatgattgatattttgtcatcctggagtttatcattcatattttgctgtaaacactccatttggtccaaacaacactccatttggtccaagctgttcatttattctcaaatcattttggtctacttattttgctattgacccacgttccttcggcacgcggctcctctcgtgctcgtgtgcaggttattcctttgcactctgcctgctggtgatacttcaactgaaagaactgtgcatattgatggtacccaagaacaaattgaagctgcaaagcaactgatcagtgaggttaccagtgaggtccgccttctttctcgttgtgtatattcctgatctgtaattgctttgccgttttgcgctttatctatcttaggtaggttgcttctggttcattctgtttattgtctcattttatgattttccccgattctttttgaaaattttgtttcttctgcttattgctgccctacattgattacactgcgtcttcgctaatcaatgtctgaaacatattgttcgtgggtacatcctcagcatgcaaggggattgttatatgtgttcttccctgtttatgaacataacttattaatggttttgggcaaggttcacaactggagtatataataaagcgaagaaacatatttgtaaactaacttgttatttatcaattagccactgctaggctcgttaaatggttttgtacagaaactgcatctaaagttttgacaagtattgatttgaaattcatatgatcgtttacatcatatggaatatggatgatactattttgggaaaaaaccagagagtccttgttccacttgttctattcagtggttattgtttttttgtttttccacatagagccaattagtgtcattagcttgccaggaggactgcaaactatcctggagagcaggtgtgttactgtttaatatcaatgccctactggatataactctgtattttcacttataacatgttttatggattatgtgagctgacgtgctttatctggcatctgtatcatttcaaatttttcatctgatcctcctgtttctctggagcacaatggatacatatacattgctttctcatggcttgtgggtccctcgggccggcccgtctcaggcccaggtccccaggtgtttcggttgtttatggtggtcatgcattccaatttaggtccttctgttctagttgcacatatttagttctgatgtttatgatcactacagaggcaagtttttccttttaattcactattcccacctatacaacttggtggttgattaagagttgtattctcatgtacatagtctctgattcatgatacttattttatagttgggcccaaaaattaaggatctatattctctaaagtgtgcatagaccagtcaagaagccagttaatagtgcaactaaagaagggttgtactggggaaaataggtaaaaaggctaaaatttgggatccaaatacagtctgtgtcatgcataaattttatttggaatattcctgtatcatatatgttgaactctttcgcagcagaaggattccgaaaaccttgcatgaagctattttatgtgatatttgtgtctattatatgtaccttgtggctttgcaggttgctgcccaatcttttttttgtgcttatatagtatcatttgaatgctgtctttgatgcttcattttatttttttttcaacttcagtaaagtagcatatctgatcatcatatatcctgtcatttagcaatgaatagaatcttttagatagtagtggaagcacctttgtattatcatatataactttggacatctattgaaactctattccatggtattgctattcaacatatatatgtatatattcgtctagctgtccaatcttcattagccccatagttttgcgcgtgggcaacggtagatgggcatcgctagcttgacgatcttgatcggtgagttgctccttccatttttcttggtggttatggaatttatctgcaatatgtcttgtgcttttgtatgtctgctatttgtgctgctatttttttttctattatgtgcactatgtctctttgtcatatacatatacagatgtgcaaactatatttttgcagaatcgtgctaggaatccaatgtctggtggctattctcagcagggatatcgccctcctcgtccccagtcaaactggggcccgccttctgtgccaccccagcagcctggctatggttatatgcagcctggggcttatcctggggcaccgccacagtatggtgcacctcagcaaccttatggtagctaccccccaacatctggtggctatcagactggatgggatcagtctcaaaaccagcaatctcatacaactccccctggtactgggtatgattattatagtcagcagcagcaacctcagcaacaatctgcccctgggacagctgcttctactgatgccactagctacaattatggtcagccttcgacgtatgcttcacagggatatgattctacctacactcagcagagtggtgggcagcaagcatatggacatgatggctacactggttaccagacccaagggcagcagcagggctactctcagcagactggttatgatcagcagggttatggcacatctgcttatggatcagctgcaaactcgacccaggatgggtccaactatggtggtcctggaggggccagtcaggcatctccagggcagcaaacatcaaacccagctgctggaagccaacctggctataccagccaaccgcccactagtgctgcagcaacttacccacctcaaggttcagctccatctggatatggcgctccaccatcccagtctggctatggcacccaaccaccacagcaaggcggatatggtcagggcgcttatgggcagccttctccacagggccagaaacctcctccattgtcaccttatggacaggctctgcctcctggttctgctcaggctggttacgggcagtatggttacagccaacctgcttacggtgcaccaccagcttaccctggtgcacccattgcaagccaccagggctatggccagcagcagtcttatggcgatgcttatggtagtgcaagctatgggcagcctccagcctactctactgaagcaacacctcctgctgcatcccaggatcactctgctgcccctgctgcggcccttggaacaacagcttcgacagctcctgaaaacagtgggggcgcccaaacatccgctgaaacttgagcttcagcagctaattgggaacaaacattttccaagaccctgccgtgtggtttcctccgcgctgttgcttaatataattacgcatctaatttagggtctacaactacaagttatttttttttctgcctgttgtttttgacaccatgacttgctgtttccttgctatattgagtagtaccttgcagttattttattgctggcatatatgtctggactagtgatatatgtgtttgtgtggttacccttgttggaccgtaatgggtcccgtccggcttggtgcccacctatatgtacccagaaaaaaaaaaaaaaaaaagcggcc

SEQ ID NO: 14196 - DNA, 3078 bp, Zea mays
  misc_feature (1237)..(1237): n is a, c, g, or t
caattagccactgctaggctcgttaaatggttttgtacagaaactgcatctaaagttttgacaagtattgatttgaaattcatatgatcgtttacatcatatggaatatggatgatactattttgggaaaaaaccagagagtccttgttccacttgttctattcagtggttattgtttatttgtttttccacatagagccaattagtgtcattagcttgccaggaggactgcaaactatcctggagagcaggtgtgttactgtttaatatcaatgccctactggatataactctgtattttcacttataacatgttttatggattatgtgagctgacgtgctttatctggcatctgtatcatttcaaatttttcatctgatcctcctgtttctctggagcacaatggatacatatacattgctttctcatggcttgtttgtgagaaagaaatgctctaaacagacccaggtccccaggtgtttcggttgtttatggtggtcatgcattccaatttaggtccttctgttctagttgcacatatttagttctgatgtttatgatcactacagaggcaagtttttccttttaattcactattcccacctatacaacttggtggttgattaagagttgtattctcatgtacatagtctctgattcatgatacttattttatagttgggcccaaaaattaaggatctatattctctaaagtgtgcatagaccagacaagaagccagttaatagtgcaactaaagaagggttgtactggggaaagtaggtaaaaaggctaaaatttgggatccaaatacagtctgtgtcatgcataaattttatttggaatattcctgtatcatatatgttgaactctttcgcagcagaaggattccgaaaaccttgcatgaagctattttatgtgatatttgtgtctattatatgtaccttgtggctttgcaggttgctgtccaatcttttttgtgtgcttatatagtatcatttgaatgctgtctttgatgcttcattttatttaatttttttcaacttcagtaaagtagcatatctgatcattatatatcctgtcatttagcaatgaatagaatcttttagatagtagtggaagcacctttgtattatcatatatatctttggacatctattgaaactctattccatggtattgctattcaacatatatatatgtatatattcgtctagctgtccaatcttcattagccncatagttttgcgcgtgggcaacggtagatgggcatcactagcttgacgatcttgatcggtgagttgctccttccatttttcttggtggttatggaatttatctgcaatatgtcttgtgcttttgtatgtctgctatttgtgctgctattttttttctattatgtgcactatgtctctttgtcatatacatatacagatgtgcaaactatatttttgcagaatcgtgctaggaatccaatgtctggtggctattctcagcagggatatcgccctcctcgtcctcagtcaaactggggcccgccttctgtgccaccccagcagcctggctatggttatatgcagcctggggcttatcctggggcaccgccacagtatggtgcacctcagcaaccttatggtagctaccccccaacatctggtggttatcagactggatgggatcagtctcaaaaccagcaatctcatacaactccccctggtactgggtatgattattatagtcagcagcagcaacctcagcaacaatctgcccctgggacagctgcttctactgatgccactagctacaattatggtcagccttcgacgtatgcttcacagggatatgattctacctacactcagcagagtggtgggcagcaagcatatggacatgatggctacactggttaccagacccaagggcagcagcagggctactctcagcagactggttatgatcagcagggttatggcacatctgcttatggatcagctgcaagctcgacccaggatgggtccaactatggtggtcctggaggggccagtcaggcatctccagggcagcaaacatcaaacccagctgctggaagccaacctggctataccagccaaccgcccactagtgctgcagcaacttacccacctcaaggttcagctccatctggatatggcgctccaccatcccagtctggctatggcacccaaccaccacagcaagccggatatggtcagggcgcttatgggcagccttctccacagggccagaaacctcctgcattgtcaccttatggacaggctccgcctcctggttctgctcaggctggttacgggcagtatggttacagccaacctgcttacggtgcaccaccagcttaccctggtgcacccattgcaagccaccagggctatggccagcagcagtcttatggccagcagcagtcttatggcgatgcttatggtagtgcaagctatgggcagcctccagcctactctactgaagcaacacctcctgctgcatcccaggatcactctgctgcccctgctgcggcccttggaacaacagcttcgacagctcctgaaaacagtgggggcgcccaaacatccgctgaaacttgagcttcagcagctaattgggaacaaacattttccaagaccctgccgtgtggtttcctccgcgctgttgcttaatataattacgcatctaatttagggtctacaactacaagttatttttttttctgcctgttgtttttgacaccatgacttgctgtttccttgctatattgagtagtaccttgcagttattttattgctggcatatatgtctggactagtgatatatgtgtttgtgtggttacccttgttggaccgtaatggtctggacagataaatgcccatctatatgtattctgagccctgttatgtttgctctaccgtcggaggtttctatgcccacttcagctggtgatggttatgtatgaaatttggtttcaatattgcgtaagacttatgtatcggaccataaaaagtttaagcagcatgaaagtctgcctttttgttttaaaaaaaaaaaaaaaaaa

SEQ ID NO: 14197 - DNA, 3696 bp, Zea mays
aagtttgcatgtggtgtttgtcctgcttgtttattctttgcctagtaaatttaaatgccacatccaagtaattgatattttgtcatccttgagtttgtcgttcatattttgccttgaccactccatttggtctaagctgttcatttatactcaaatcgttttggtctactttttttttctgttgatccatgtttgcatgttattcttgtccttacaaattcttgtgcaggttattcctttgcatctgcctgctggtgatacttcaactgaaagaactgtgcatattgatggcactcaagaacaaattgaacatgcaaagcagctggtggctgaggttaccagtgaggtctgctttctttctcttgttgtgtctgatatctgtgattgctttgctctcttgtgctttaacctgtcatttaggttgcttctggttcgttctgtttattatattgttttatgattttcccctgttctttttgaaaatcttgtttcttttgcttctttgccgccgtacattgattatactgctgtgctaaccaatggctgaaacatattgttcgtgggtacagccacaacatgcaaggagattgttatacgacttattccctttttctgaacatagcttattaatagttttgggcaaggttttcatgacttaagtattatataataaagcgaagagttgtatttgtaaactaacttgttctttatcaattagccactaccgtaggcctgttaaatggtattccatagaatctgcagctaaagttttgacaagtcttgatttgaaattcatatgattgttcacgtcatatggaatatggatgatactcttgggcaaagaccaatgagtccttgttgctcagtggttattgtttattcatttctccacaaagagccaattagtgtcaatagcttgccaggaggactgcaaactatcctggagagcaggtttgttactgtttaatgtcaatgtcctactggatagaacaatgtgttttcacttatagcatggtttatggattattgagctgacatgctgtttctggcctctatcatttcaaaattttcatctacttctcctgttcctctggagcacaagggatacatatacattgctttattcgtgtcttgtttgcgagggagaaatgctctaaacagccccaagtcaccaggtgtttggttgtttatggtggtcatgcacaccaatttagtatttagatccttttgttctagttgattgtagatatgatgtttgtgatcattacggaggcaaggttttcctttttgtccactattgccacctatacaacttggtggtggattatgagttgtatcctcatttactattgcctctgattcactatacttgttttagagttgatcccaagaattaaggatttatattctctaaactgtgcatagatcataaaagaagccagtaaatagtgcaactaaagaagggttgtactggaaaaaataggtaaacgaggctaaaatttgggatccaaatacagtccatcttgtacataacttttatttggaatttggaatattcctgaatatcatatatgccaaactgttttgcaaccgaaggattcagaaaaccctgcatgaagctattttattatgtgttatctgtctctattatatgtgcctggtggatctgcaggttgctgtccaatgttgtttttgtgcttaaatagtatcatttgaatgttgtctttgatgcttcattctgtttaatatttttcaacctcagtaaagtaacctagctgatttttatatatcctgtcatttagcaatgaattgaatattttagatggtagtgaaagcacctttctatatcacatacatctctagacatctattggaactctattccacggcattgctattcaacatatgtatatgtatatgttcgtctagtccaatcttcattagccccatagttttgcacatgggcaacgctagatgggcatcactagcctgacgatttgatcggtgagttgctccctccatttttcttgttggttattgaatttatctacaatatgtcttctgcttttgtatgtctgctatctgcactgctatttttttcttctattctgttctccatgcccctttcatgtatacatatacacatgtgcaaactatattttgcagaatcgtgccaggaatccaatgtctggtggctattctcagcagggctatcaccctcctcgtcctcagtcaaactggggcccgccttctgcgccaccccagcagtctggttatggttatatgcagcctggggcttatcctggggcaccgccacagtatggtgcacctcagcaaccttatggtagctatcccccaacatctggtggctatcagactgggtgggatcagtctcaaaaccagcaatctcatacaactccccctggtactgggtatgattattatagccagcagcagcaacctcaacaacaacaatctgcccctgggactgctgcttctactgatgccactagctacaattatggccagccttcaacatatgcttcacaaggatatgattctacctatactcagcatagtggtgggcagcaagcatatggacatgatggctactctggttaccagacccaaggccagcagcagggctactctcagcagactggttatgaccagcagggatatggtgcatctgcttatggatcagctgcgaactcgacccaggatgggtccagctatggtggtcctggtggggccacccaggcatctccggggcagcaaacttcaaccccagctgctggaagccaccctggctatgccagtcaaccgcctactagtgctgcagcaagctatccagttcaaggttcagctccatctggatatggtgctccaccaccccagcctggctatggcacccaacctccacagcaaggtggatatggtccgggcgcttatgggcagccttctccacagggcgagaaacctcctgcatcttcaccttatggacaagctccgcctcctggatctgctcagggtggttatgtgcagtatggttacagccaacctgcatacggtgcaccaccagcttaccctggtgcacccactgcaagccacccgggctatggccaacagcagtcttatggcgatgcttatggtagtggaagctatgggcagcctacagcctacactactgaagcagcaactcctgctgcatcccaggatcactctgccgcacctgccgcggcccctggaacaacagctgcgccagctcctgacaacaatgggggtgccaaaacttctgcggaaacttgatcttcaacagctaattgggaacaaactttttacaagcctctgttgtgtcgtttcctccactgttgcttaatattacgcatctagtttaggctccacatctacaggttatatctttctgcctgttgttttgaccccatgaatcgctctttccgtgctgttgattagtactttgttgtttttttattgctggttagatgtttggactggtgatatatgtgcttgtgcggttacgcttgttggactctaatgggtacctaccggcttggtctggacatatactgtcctatatttgtttttagcctccttttacattggttattatgtgtgctgtacaactgtcggacgtttccatgagctggtgatggttatggatgaaaatttggtttc

SEQ ID NO: 14198 - DNA, 1324 bp, Zea mays
agtccagttcaaccggtttcactttatatttcccccctccgttgtaataattctgcactattttcagacatgcaaactcagaaacagatagcaagctaaccatcaccgctcacgattttgctattttctcaccggctaccatcgctaccacttttccagggaaaatgcagccagccaatcccctccttttcctcacattcaaataaataatcgttaaataaacagaattaaaacaaatcgattgttaattgaccacgtctccttctatttaccccggaccctaaccaaactctaacctccatttcttcccttcgccatgacgccgccgccgccgcctccgtgcctcgcctgcctcctcaccctcctcctcctcgccgccgcggcggcgccaccggccggcgccatctgcgtcccgcgcaatcccggtggccacagcaagccaggagcgccggccaagcccgcgccaccgaaactgaagcccctcacgcccgcggcgccggcgccgccgaagccgacgccgatggccccgggcgccgacatcgtgcggagcctgtgcctgaagaccgactaccccgacctgtgcatgtcggccatcgcgaagcagccgcagccgcagctgccggtcgggaagcggctggacggtgccggcgtgctgcggctggccatgggcgccgtgcgcaccaaggccgccgaggccaaggccgcggcgggcgcgctcgccaacgacccccggacgcagccgctggcgcgcggcccgctgcacgactgcgtcgagtcgttcgacgacatcgcctacagcctcgaccaggccgccaagtccctcgccgccggcgaccgcgacaccaccggcaccatgctcgacaccgtgcgcaccgacgtggacacctgcgaccagggcttcgaggagcgcgaggagctcacgccggtcatggccaagcacgacgccgagctcgccaagctctccagcaactgcctcgccatcgccaccgccgccggcttgcgctagatcgcctgtgcatgtgctagctcctaggcaacaacaacaataatatatataccgccaccttataattaactctccacgcatcagagaagcttcacacatgcaccaaacttgtgcatccatggatatccaagaagaagatgtagttagtgcaagcgttccggttatttcgttttccttttactcctcttcattccttctaccttcaccaagaactgattgttgactgaccgcacctacaagagtttatggggcggccatttaaatccgataattataatcctaaacttgaccaaaaaaaaaaaaaaaaaatttgcggcc

SEQ ID NO: 14199 - DNA, 2478 bp, Zea mays
  misc_feature (51)..(51): n is a, c, g, or t
  misc_feature (117)..(117): n is a, c, g, or t
caaagttgtatatatagtcaaagaataaaagcttacaaatgatggacttcncataagtagagccagagaataatccatatttaagtggcgtcaccagtctagtgactgtttttcccntcattaattctggtgatggagatgcttgagagctcgtgtcaaacaaggctagcatttagtattgtcatgacgtatgttttacttcgaaaatgataggtggacggatcattggaagccaaaaacaagcaaacaaaaataaaaaagaaaattaaagaaaccgggatgctgtcgtgatgatgtgatggatggccatggggatgggatgcagtgcacagcacagcaggagagaagtgtcgacaccctgggcttgcaggagcaggaacgaacggaaagaccggcagcgcctcggggtgcgtgcccactgcctcggcgatgagcacaccatgtcctcatccgggtccaccccctccccggacccggatcgccatcgatcagtcactcggctcctgctctgcatcacaacaacgccatctgatctgctcaacaaacagattgcaaaacaaaacaaaaaaacaggaaaattattctgaacttaaagcagctgcgaataatgcatggcaactatatatacatcttttcatatttttgctaaggttgtaaagattttacaggcacttaattggcgcaacactgtatattttcatcttgtattgcatgtggacgatggatagccagcggccagttacgtacagtgtagcatcacatggcgatgagcacatcagcatgttgcaaatccgtgtcggcgaccttgttcgtttgtgccggattgtgggtcagaacgattcctaaccgaattgtttctttaatttatataaactttgattagctggaacgattccgggtgcaatccgatagaaacgaactaggcctaattgagaatgcctcacactttaacctaatcccggccggcgcccctataaatatacagtatacgtgcacacgcacactaactctacgatcaatgcaagctttaaaacagcaccacatatattttaaaattaaaacagcaccatatagatcttaaaataaatcatcacgggaaaaaagtacgagtttcttcaattaatcacagctggtcccaatttaaaatgcatttatttcattccatctcaaaacaagctagctagctagctaaccatcgagctagatgacgacataaaatgcaacgggatggatgcgtgcctggatcttacagggtactgctactggtatcgtgatttcatgtaccatatatacctcggtaagtttaaaaattactgcagtaatacgcaccacatatattttaattacaagcatagttcgtacacgtgcgttcggctcgtgagcaacaagctagctacactaggccgaattaaaaacaagagccacctgctgtctgctgcccgctgcgctgagcgtgagagctagctactaccttattacctctctccgcagctgtaggcggcggcggcggcggccatggacttcgtgctccaggtcctgctgcgggtggtgatgagaagaagcatccgcaggctgcaagaggtcgttgacatcgccgtggacatcggcacggctgtcttcgtggccgtgcgggtctccggcctcgtcttccgccgccggctgcccacgccgactacgacatcgtcgtcgtcgacgacgtactactactccccggggacgtcctcctcgatcggcatgcatgtccaggaggattaattattgacaggcactagatgagctagctagctagctagggccagaagatgtatacttctcgcgggggcatgtaagtactaaggtcatatatctgtgcgttcttttttgtggaatcaaactaatttcgctagctaccctaatatatatgttgtgctactgctctacctatatacatgtgtaatttgaggaattgaggccgcaaatcaaaacaaaaacttttgagccaaaaaaaaaaaaaaaaaagcggccaacagtgattaattcagaaattaagaaacagccttgacatgaccatgtagcttatttgcaaataataaaaagcagaaaatttgatagaatgactgactagcggttgttgtagatgccatctatgtgtggtgatcttgttgatgcggctgggttcacataggtgatgcaggtttaatttgaagatcctgatcagttttgaagatcttaatcattactaggaccctatcattcatatatagttcgctggaatgcctcgttgttcaggatcagtttaaaggctctcctacaacacatgtctatttttgagtttcagagggcttgtttgaaaacccaattttgttccgatggattttcattttctaaaggtaaattagtctaattttccttcaaaaatagaaatcccttaaaaaatagagctcataaactagctctaaatgggaaaagtagcagaaagccgtaaataaacatatatac

SEQ ID NO: 14200 - DNA, 746 bp, Zea mays
ttctccgaaaaaaaaaaaaaaaaaaaaaaaaaattaaaaaaaaaaaaaaactgtgcggccctcgagccggccccgctatggcaaattaaaaacaagccacctgctgtctgctgcccgctgcgctgagcgtgagagctagctactaccttattacctctctccggtctccgcagctgtaggcggcggcggccatggacttcgtgctccaggtcctgctgcgagtggtgatgagaagaagcatccgcaggctgcaagaggtcgttgacatcgccgtggacatcggcacggctgtcttcgtggccgtgcgggtctccggcctcgtcttccgccgccggctgcccacgccgactacgacatcgtcgtcgtcgacgacgtactactactccccggggacgtcctcctcgatcggcatgcatgtccaggaggattaattattggcaggcactagatgagctagctagctagctagggccagaagatgtatacttctcgcgggggggcatgtaagtaccaaggtcatatatctgtgcgttcttttttgtggaatcaaactaatttcgctagctaccctatatatatgtgttgtgctattgctctagctatatctatacatgtgtaatttgaggaattgaggccgcaaatcaaaacaaaaacttttgagccgacccaagttgcagttgagcggccaacagtgattaattcagaaattaagaaacagccttgacatgaccatgtagcttatttgc

SEQ ID NO: 14201 - DNA, 822 bp, Zea mays
cccacgcggcaggcaccagctcaccagctagctagctagcacctagcagtcgtacacacgggctagcagtcgatcacaaaccaatcgcggagaggcaatcacgtacgtatacgcacgggcacgtagctagttagcagtcgtagtcgtagcgtgacgatgagggttctctctgttgcggtcgctctggtcgtggtggtggccgcggcctgcctcgccgcgccgcggggcgcggacggcgcgggcgagtgcggggcgacgccgccggacacggtggcgctgaggctggcgccgtgcgcgtcggcggcggaggaccccggctccgcgccgtccggctcctgctgcagcgcggtgcacgccatcgggaagcagagccccaggtgcctctgcgccgtcatgctgtccaacaccgccaggagcgccgggatcaaggccgaggtcgccatcaccatccccaaacgctgcaacctcgccgaccgccccgttggctacaagtgcggagattacaccctgccatgagcggcggtgagttctccaggtcggatttgctgcatggcatgcccgagtatcaccaaagcgcgagctcttgtgtcgagcgagtccgtgtctgtcgtcagtcagtctctatgtgttgcccatagtaaacaaagacatgcgagtaccagacatgtgcaactctagtagcatggtgcgtgtatcactaggtacgcgtactcgtatcgttgtgttcagttctgggtctatagagatgtagccctgcattgtcgaaataaatactgtgtccactcgttcgtgaaatgaaaaaaaaaggcttgatggtcgact

SEQ ID NO: 14202 - DNA, 2309 bp, Zea mays
  misc_feature (2014)..(2014): n is a, c, g, or t
ggcacgatttgtctcgggataaaagtgcaatggttcaccaacttgtacaatcctatctataggatgccatgccaaccagatgtgctagcggcgagctcctaaaatcagatgagaatagtatggaagggagctattcccgttttgtgatctggagtgtatacaagacgacgccataagcatgcattatttgtgtacatactagcttgtcttttttatcaagattgttgtgtattacatctgcacactctattcgccctgcccttgcattgcactgccactaccgcacttcaagcacactagcacaggcagagagaggcagggtaaacaactgccctgctattttttttttccttcgctagaatgaggacagccgccgcacttcgagaggcaacataaaaaaagtgactgacgtccactgaaactaacggccgcgcacgccgatcgggttgcgccggccgatgtctccggcgccaccacgggcatgccatggcgttcagccgttcacaccctgttcctttgggcccaaagctacctcaccacatcgaccaccgggcggggaaggctacccctacccaccagcgcgcaccgagccggctgagacgtgtggcggagcttgcgcgacgccactggcggaggcgccctcgcgctgccacgcgcccacgccgcgtgacggtgcgcggctagtgctcgccgcaccggtcgtcccgggccatcacgaggtcgccgcacctacacgctcgacgacactatataagaagcggcctgcctccctcgagccggccgggaccgatcacaaaaccaatcgcggagattcaatcacgtacgtatacacacggccacacgggcacgtagctagctagcagtcgtagcgtgacgatgagggttctctctgttgcggtcgctctggtcgtggtggtggccgcggcctgcctcgccgcgccgcggggcgcggacggcgcgggcgagtgcggtgcgacgccgccggacacggtggcgctgaggctggcgccgtgcgcgtcggcggcggaggaccccggctccgcgccgtccggctcctgctgcagcgcggtgcacgccatcgggaagcagagccccaggtgcctctgcgccgtcatgctgtccaacaccgccaggagcgccgggatcaaggccgaggtcgccatcaccatccccaaacgctgcaacctcgccgaccgccccgttggctacaagtgcggagattacactctgccatgagcggcggtgaggtctccaggccggatttgctgcatgggcatccccgagtatctccgcacttcttgcttggagtgcatgcagcactacccactgaatgcatgcgtctctgtctacgattcttcttttatttctagtgcggagattacaccctgccatgagcggcggtgagttctccaggccggatttgctgcatggcatgcccgagtatcaccgaagcgcgagcgcctcttgtgtcgagcgagtccgtgtctgtcagtcagtctctatgtgttgcccataataaacaaagacatgcgagtaccagacatgtgcaactctagtagtatggtgcgtgttatcactaggcacgcgtactcgtatagttgtgttcagttctgggtctatagagatatgtagccctgcattatcgaaataaatactgtgtccactcgttcgtgaaatgaaaaaaaaggcttgatgctcgactaaaaaaaaaaaaaaaaagccaaaacataaagatttatatcctagatgataaaaaaataagaacatgtaatataccgtccttgcggtacaaaaaatcaaggcacctacgacgtactgtctctggttttgagcacagttacgttgttttgaagcgacgcggcctcattgagagactttcttctgacaacttaaaagttcaacaacagatttgaacaaaaataacttcatagaaaaaggagcagcagttgagagatggaacctttcttgccatactcacaagcacgagaagagttgtatggcctctgtttcctanctagtgcctgaaagattgtacatagacgctttcgattcaagccgcatcttattttattggatagaacagttattcgatctatccaataagcacagatcatatcaaatagcgcatccttcatttcatatgtagcgttatttcgtaccgatctatgccggatactaaaaatactagtagagtgctcgtgcgttgctacggttcgtgtctcttcaaatacgttattgttgaaacatttttaagctattacattttttctataacattaagagtgggaaaaacttaacatactttcgca

SEQ ID NO: 14203 - DNA, 911 bp, Zea mays
  misc_feature (9)..(9): n is a, c, g, or t
  misc_feature (15)..(15): n is a, c, g, or t
gggtacccntcgggnccggccgagagaccatgccggttgctttgtaaagtttgtatcacgtcgtccgtgatacaatgcggtcctccgtctacaagcgtgctgatcctgtctccctcgaggccggccgggaccgatcacaaaaccaatcgcggagattcaatcacgtacgtatacacacggccacacgggcacgtagctagctagcagtcgtagcgtgacgatgagggttctctctgttgcggtcgctctggtcgtggtggtggccgcggcctgcctcgccgcgccgcggggcgcggacggcgcgggcgagtgcggtgcgacgccgccggacacggtggcgctgaggctggcgccgtgcgcgtcggcggcggaggaccccggctccgcgccgtccggctcctgctgcagcgcggtgcacgccatcgggaagcagagccccaggtgcctctgcgccgtcatgctgtccaacaccgccaggagcgccgggatcaaggccgaggtcgccatcaccatccccaaacgctgcaacctcgccgaccgccccgttggctacaagtgcggagattacactctgccatgagcggcggtgaggtctccaggccggatttgctgcatggcatgcccgagtatcaccgaagcgcgagctcttgtgtcgagcgagtccgtgtctgtcagtcagtctctatgtgttgcccataataaacaaagacatgcgagtaccagacatgtgcaactctagtagcatggtgcgtgtatcactaggtacgcgtactcgtatagttgtgttcagttcagggtctatagagatgtagccctgcattgtcgaaataaatactgtgtccactcgttcgtgaaatgaaaaaaaaaacttgatgctcgactaaccaaaaaaaaaaaaaaaaaagagacct

SEQ ID NO: 14204 - DNA, 797 bp, Zea mays
cggaaccgatcacaaaaccaatcgcggagaggcaatcaccacgtacgtatacactgcacacgggcacgtagctagctagcagtcgtagagtgacgatgaggggtctctctgttgcggtcgctctggtcgtggtggtggccgcggcctgcctcgccgcgccgcgggtcgcggacggcgcgggcgagtgcggggcgacgccgccggacacggtggcgctgaggctggcgccgtgcgcgtcggcggcggaggaccccggctccgcgccgtccggctcctgctgcagcgcggtgcacgccatcgggaagcagagccccaggtgcctctgcgctgtcatgctgtccaacaccgccaggagcgccgggatcaaggccgaggtcgccatcaccatccccaaacgctgcaacctcgccgaccgccccgttggctacaagtgcggagattacaccctgccatgagcggcggtgagttctccaggccggatttgctgcatggcatgcccgagtatcaccgaagcgcgagcgcctcttgtgtcgagcgagtccgtgtctgtcagtcagtctctatgtgttgcccataataaacaaagacatgcgagtaccagacatgtgcaactctagtagtatggtgcgtgttatcactaggcacgcgtactcgtatagttgtgttcagttctgggtctatagagatatgtagccctgcattatcgaaataaatactgtgtccactcgttcgtgaaatgaaaaaaaaggcttgatgctcggctaaaaaaaattaaaaaatataaaaaaatttataaa

SEQ ID NO: 14205 - DNA, 2146 bp, Zea mays
tttagtctatgtttatacttatatttgacattcaaacatttgatatgatacatatcccttaatcgatccatgcgtgctaagtaataagtcgaccttcctttgtttaagggttgtttggtttgaaggggttaaaatacatcggatatttgactattagttagagtgagagtgtttgaatgcactggatctaactaatagtttaactattagctatttttagcaatataactaataattagctagataagtccactaaaaatattttagctaactaactattagctatattgcatttaaatatttgtatagtctaattacaaaactaattataagtaatagtcatcgaaacattcaatataatataatatagactaaactttaacgtgtataaccaaacacccctaattgcagccgcaattattgaaatgaaaccgtaggatactggaacgttctggacaggattgacactcgtactcccaggtcccagccccaattattgaaaccacgctttcgtgatatcatgatcatcgaaggcgcctgtcaattttgtgcagcaggaagactgttccgcagaacacgtggagcctcgtgagtgacccaagcaagccagcaagcgattcaacacttcacgctcatcttcagtacgatcctcaaaccacaatcgatgcaaccctaaaattttaagcaaattattcgcctcgtctcctcgcaagcctctcatctgctcgccgtttccctctcttctttgcgacggcgaaaatggtggagaacggcgtcgagcagcccctgttacagggcggcggccctcctaataacgccgggcacgcaaagccgcctccgggagctaggccgccaaggaggttccgacgctgcaggacggcgccttccaccgacgcggcgcaagaatctcccccgcggagccagcaggacccgagcctgcagcgcggcaccacccagctggcgccgcccaaggagcttctgcggggcgcgcggccgagcttcaggctcgtcggcgtcctcctgctggcgtacctcctggccgggaccgtagcgttctacctcgccatggaccacatgtccggcgaccgcaccgggagccgcgtggtggacgcgctctacttctccgtggtcaccatgacgaccgtcgggtacggcgacctcgtcccgtccagcgacgccgccaagctgctcgcctgcgccttcgccttcgccggcgtggccctcgtcggcaccttcctcagcaaggccgccgactacctcgtcgagaagcaggaggcgctgctcttccgcgcgctccacgcccgcaaccgcaaggcgctgcgcgtcgtggaggcaaacagggtccgctacaagctgtacaccgctgcggcgctcctggccgcggcgctcgcctccggcacagcgttcatggtcgaggtggaagggatgcgccccgtggacgccttctactgcgtgtgcgccacggtgaccacgctcgggtacggcgaccagagcttctcgtccgtggccgggcgcgcgttcgcggcggcctggatcaccgcgagcacggtcgtggtggcgctcttcttcctgtacgctgcggagctgggcgcggagcggcgccagcgggcgctggcgcggtgggtgctcaggcgccgaaccacctgcacggacctcgaggcggcggacatggacggcgaccaccgggtcggtgccgcggactttgtgctgtacaagctcaaggagctggggaagattagccaggaagagatcgcggagttcttggaggagttcgacgagctcgacgccgacaactccggcaccctctctccgcacgacctcatcgtggcacagcccggttagcgcggcaatcactggcagccagcaaggcagtaggcaggtggagtgagccagcgtgcagcgtctagactattcctgaccagcgtgccaaagacgtacagtatagagttgtgttggtaactttggagctgggagcctgggagtgggacacgctgaaagctgcctgtactgccaattctgtagcccagtattgttttcaatattctttaggcgttgttcggttactgttagaaatataggaattttccatattattttaattccataaattaatattacaataaggacatataaaatataattaatc

SEQ ID NO: 14206 - DNA, 1848 bp, Zea mays
ttgggtacctcgaggccggcccattgggtacctcgaggccggcactcatctccagtctccctctccactctgcggcccggtcgatccccattccgatccatcgcacgggcagcgcccagtccggttcactcatggagtctctagtggctgcgctccccgcgggcggcgctgcggcggcggcggccttcggtgggctggtggccgctgccgcgctcgccggaaaggtcggccttgtcgggtccaagaaacacctcaacgcgcccccagctgtctctggtttacccctgattgggaatcttcatcagttgaaagagaagaaacctcaccagacctttacaaagtgggcagaaatttatgggccaatttacactataaggaccggttcttctactgtagttgtgctcaattcagcccaagtagccaaggaggcaatgattgcaaaattctcatcaatatctactcgaaagctatcgaaggcattgtcagcgctcacccgtgacaaaactatggttgctacaagtgactatggtgacttccacaaaatgattaagcgttatatcatgacattcatgttgggtacttctggccagaaacaatttagggacacaagaaacatgatggttgacaacatgttgaacactttccatacattgttgatggatgatccaaattctcctctgaacttccgggaagttttcaagaatgaattatttcgcttatccctggttcaggctttaggcgaggatgtgagttcaatctatgtggaagagtatggaaaggttatatcaaaggaggaaatctacaaggccactgtggttgacatgatgatgtgtgcaattgaggtcgactggagggatttcttcccgtacctcagctggattccaaataggaccttcgaaacaagagtactgactaccgaagcgaggagaactaccgtgatgcaagccttgatcaagcagcaaaaggaaagaattgcacgtggggagactaggatatcctacctggacttcctgctggcagagaatacactgactgatgaacaattactaatgctggtgtgggaagcagtcatagaagctgctgatactactttggtcacgaccgagtgggctatgtatgagattgcgaagcacccagaaaaacaggaatacctttatcaagaaatccaaaaagtctgcggcaataagacagttaccgaggatcacctgccagagttaccgtacttgaacgcggtgttccatgagaccatgaggcggcattctccagttccattagtgcctccaagattggtccatgagaataccaacttggctggctatgaggttccagccggcacagagataatcatcaatctgtacgggtgcaacatgaacaaaaacgactgggccgagcctgaggaatggaagccagagaggtttctggacgggaggtttgaagcagtggatatgcacaagaccatggcctttggcgcaggaaggagggcctgtgctggcagcatgcaggcgatgaacatctcgtgcaccgccatcggcaggtttgtgcaagagtttgcctggaggctcgaggaaggcgacgaggacaaggttgacaccatccagcttacaaccaacaggctttacccactgcatgtgtacctcgcacctagaggaaggaaatgagcctctactgtaaacgggtttcactgtactaatttaaaaaaataatttgctgttgcctgtgtatgacttttggatgatctctatgctgtgaagttgttggtctgaaattgggttaacaatacgaagtgcatatcatacaggacatgaacaccaaaaaaaaaaaaaaaaaaaaaactcgagagggggccgg

SEQ ID NO: 14207 - DNA, 1276 bp, Zea mays
tgcgcaagggctgcggcgacgcctgcaccatccgcccctgcctgcagtggatcgaggcccccgaggcgcaggccaacgccaccgtcttcctcgcaaagttctacggccgggcgggcctgctcaacctgctcgccgccgcgcccgacgacggcgtccgccccgcggtcttccgctccctgctctacgaggcgtgcggccgcatcgtcaacccggtctacggctccgtcggcctgctctggtcgcgccagtggcacaggtgcgccgacgccgtcgaggccgtgctcaggggggaccccgtcgtgcaggtcgacgccgggtccgacgccgccgctgccccgccgctgctcgccggcgccaggccgccgccgccggccgccttcgacatccgccacgtccccagggatcccgacgccaccgccgccgacctcctccgcgccggccgcaagaggttcaagcgcgcgggttcgtcttccaacgcctccaaggcgaagcccctgcccctcgagctcgagggcaaggccggcaacaacgaacgcgcgtcgcccagccctcccccgacgcaacaacgagaggcggaggagctgcagccggtgccgatggtcgtcgagccagaacacggcgaggagtccgccggcagccacgaccaccacctgcagctgcaggggtggtcggaggaggacaccgacgtggaggcggcctcacacgtgagccaagccgaggctgagccgccagccagcagccagagccaggtgctggtagcggatcaggaggaagaggaggttgggctcgagctcacgcttgggttcgagcctgtcgtcaggcagcagccgaggtcgtcgcgctgcgacaagagcggcttgagcgcggcatcgagcctcatcggcctgcggctgcagctgccggccgcctaagcacaggcacagctcgcacctaaacgaatagagcagttttgcgaccctgcgcctgcggtgtttgcttaaaaataagcttttggacccccgggtgccaggagacacacagtagccaacttcaaattttctaggttttgtttatctttttcaatttttcttcttgtctttaactgtaaaagttgatggactgcacaattactcaggtagagggggtttggttccccgatcaaagagggcgtttggttaaacggtttagttcttatatcgaatgtttaaatgccagttataagtattatatgtagtatatttaaaaattaattatataaatgaagactaaacattagtagataaaaaaaaaaaaaaaa

SEQ ID NO: 14208 - DNA, 3581 bp, Zea mays
gaattccggcgtgggcgctgggctagtgctcccgcagcgagcgatctgagagaacggtagagttccggccgggcgcgcgggagaggaggagggtcgggcggggaggatccgatggccgggaacgagtggatcaatgggtacctggaggcgatcctcgacagccacacctcgtcgcggggtgccggcggcggcggcggcgggggggaccccaggtcgccgacgaaggcggcgagcccccgcggcgcgcacatgaacttcaacccctcgcactacttcgtcgaggaggtggtcaagggcgtcgacgagagcgacctccaccggacgtggatcaaggtcgtcgccacccgcaacgcccgcgagcgcagcaccaggctcgagaacatgtgctggcggatctggcacctcgcgcgcaagaagaagcagctggagctggagggcatccagagaatctcggcaagaaggaaggaacaggagcaggtgcgtcgtgaggcgacggaggacctggccgaggatctgtcagaaggcgagaagggagacaccatcggcgagcttgcgccggttgagacgaccaagaagaagttccagaggaacttctctgaccttaccgtctggtctgacgacaataaggagaagaagctttacattgtgctcatcagcgtgcatggtcttgttcgtggagaaaacatggaactaggtcgtgattctgatacaggtggccaggtgaaatatgtggtcgaacttgcaagagcgatgtcaatgatgcctggagtgtacagggtggacctcttcactcgtcaagtgtcatctcctgacgtggactggagctacggtgagccaaccgagatgttatgcgccggttccaatgatggagaggggatgggtgagagtggcggagcctacattgtgcgcataccgtgtgggccgcgggataaatacctcaagaaggaagcgttgtggccttacctccaagagtttgtcgatggagcccttgcgcatatcctgaacatgtccaaggctctgggagagcaggttggaaatgggaggccagtactgccttacgtgatacatgggcactatgccgatgctggagatgttgctgctctcctttctggtgcgctgaatgtgccaatggtgctcactggccactcacttgggaggaacaagctggaacaactgctgaagcaagggcgcatgtccaaggaggagatcgattcgacatacaagatcatgaggcgtatcgagggtgaggagctggccctggatgcgtcagagcttgtaatcacgagcacaaggcaggagattgatgagcagtggggattgtacgatggatttgatgtcaagcttgagaaagtgctgagggcacgggcgaggcgcggggttagctgccatggtcgttacatgcctaggatggtggtgattcctccgggaatggatttcagcaatgttgtagttcatgaagacattgatggggatggtgacgtcaaagatgatatcgttggtttggagggtgcctcacccaagtcaatgcccccaatttgggccgaagtgatgcggttcctgaccaaccctcacaagccgatgatcctggcgttatcaagaccagacccgaagaagaacatcactaccctcgtcaaagcgtttggagagtgtcgtccactcagggaacttgcaaaccttactctgatcatgggtaacagagatgacatcgacgacatgtctgctggcaatgccagtgtcctcaccacagttctgaagctgattgacaagtatgatctgtacggaagcgtggcgttccctaagcatcacaatcaggctgacgtcccggagatctatcgcctcgcggccaaaatgaagggcgtcttcatcaaccctgctctcgttgagccgtttggtctcaccctgatcgaggctgcggcacacggactcccgatagtcgctaccaagaatggtggtccggtcgacattacaaatgcattaaacaacggactgctcgttgacccacacgaccagaacgccatcgctgatgcactgctgaagcttgtggcagacaagaacctgtggcaggaatgccggagaaacgggctgcgcaacatccacctctactcatggccggagcactgccgcacttacctcaccagggtggccgggtgccggttaaggaacccgaggtggctgaaggacacaccagcagatgccggagccgatgaggaggagttcctggaggattccatggacgctcaggacctgtcactccgtctgtccatcgacggtgagaagagctcgctgaacactaacgatccactgtggttcgacccccaggatcaagtgcagaagatcatgaacaacatcaagcagtcgtcagcgcttcctccgtccatgtcctcagtcgcagccgagggcacaggcagcaccatgaacaaatacccactcctgcgccggcgccggcgcttgttcgtcatagctgtggactgctaccaggacgatggccgtgctagcaagaagatgctgcaggtgatccaggaagttttcagagcagtccgatcggactcccagatgttcaagatctcagggttcacgctgtcgactgccatgccgttgtccgagacactccagcttctgcagctcggcaagatcccagcgaccgacttcgacgccctcatctgtggcagcggcagcgaggtgtactatcctggcacggcgaactgcatggacgctgaaggaaagctgcgcccagatcaggactatctgatgcacatcagccaccgctggtcccatgacggcgcgaggcagaccatagcgaagctcatgggcgctcaggacggttcaggcgacgctgtcgagcaggacgtggcgtccagtaatgcacactgtgtcgcgttcctcatcaaagacccccaaaaggtgaaaacggtcgatgagatgagggagcggctgaggatgcgtggtctccgctgccacatcatgtactgcaggaactcgacaaggcttcaggttgtccctctgctagcatcaaggtcacaggcactcaggtatctttccgtgcgctggggcgtatctgtggggaacatgtatctgatcaccggggaacatggcgacaccgatctagaggagatgctatccgggctacacaagaccgtgatcgtccgtggcgtcaccgagaagggttcggaagcactggtgaggagcccaggaagctacaagagggacgatgtcgtcccgtctgagacccccttggctgcgtacacgactggtgagctgaaggccgacgagatcatgcgggctctgaagcaagtctccaagacttccagcggcatgtgaatttgatgcttcttttacattttgtccttttcttcactgctatataaaataagttgtgaacagtaccgcgggtgtgtatatatatattgcagtgacaaataaaacaggacactgctaactatactggtgaatatacgactgtcaagattgtatgctaagtactccatttctcaatgtatcaatgtatatagaagttaacgtgcatgaggagataatgatgactcagaagttactaacgattaattcagttttagttccggtcc

SEQ ID NO: 14209 - DNA, 798 bp, Zea mays
cgggaaaaaaaaaaaaaaaaaaaaaaaaaaaaaaaaaaaaaaaaaaaaaaaaaaaggctgcgacaacgtagcatacactagtgcttttgctagctacttgtgcgagaagagagagcgcacggcgatagatatggcgcatagcaagcgcgaaatcaagcccgggagggcgcataccaaggtggccggcgacgacgagatgctgcggaccgggttcttcgacggcacgccgctggagggcggcaagatcgccgactcccagcccgtcgacctcttcgccgctgcccgccgcgtcgccgacgccccgtactcatcgcagcaggaaggaccacacgaggaggggaccaacaagaacgccgtcatcgcggagtcggagcccgtcgacctgcccgcgagcgcgcggggcgtggcggaggtgaaccgtgctgggccggaggagcagacaggccgcggtcggcagggcatggccgagcccaccgccggtggacgtcgcttgggattaggtcgcccggccccggcttaacgatccagatcaagcagtactcgactaccgccactacactacctgctctgctcgtgtcttgtttccagttttctttctctgtaagcggtgtagggtttgccaaacttttatgtacgaattatgaatatcaataaagtcgatctgctgctgcgtttcttggcaccaacaaaaaaaaaaaaaaaacgtttttttttttttttaaaaaaaaaaaaaaaaaaaaaaaaaaaaaaaaaaaaaaaaaaaaaaaaaaaaaaaaaaaaggggcgggccggttttaa

SEQ ID NO: 14210 - DNA, 931 bp, Zea mays
  misc_feature (614)..(614): n is a, c, g, or t
aattttgccatcgcgtacgcacgcgcgccggattaaaaccccacggtcaccaccgcagctagcgaccgaccaagaaccagcatgaagccactggtggcgcgcctgctcctctgctactccctgctctggctggcgcccgcggcagccccgctacgcctgcagcacgatcatgtccggggccacggccacggccacggccacgcccacccgcctccgtacgcgcgtaacgcgacggcgtacggcgtctcggcggcgctgtgcccgggctgcggcgcgtgggcggacgcgctggagttcctctactaccacaacctggtgcggctggcgtcgctggagccgccgctggcgtggtccccgcgcctggcgtcgtacgcgggctggtgggcggcgcagcgccgcggggactgcgcgctgcgccactccttccccgacggccagttcgcgctcggggagaacgtcttctggggcgggcccggcggcgcgtggcggccccgggacgccgtcgcggactgggccgccgagggcgccgactactcgtacgccgacaacgcgtgcgcgccaggccgggagtgcgcgcactacacccagatcgtgtggcgacgcaccaccgccgntcggctgcgcccgggtggcgtgcgacggcggcggggtgttcatcacctgcaactactacccgcccggcaacgtcgtcggcgagaggccgtactaactagctagcttagcagctcagtaccctcggcctcggggatttattacgtgacgtggcgaacggcctcgtgtagccgtgtcgtgtgtaaataatattcagcggtcgttccggtgaacatgatggtaattcactcgaggttttccctgttggcttccgtaaatcgtgtttggtttgaccagaggcctcagagccacgatcccaataaaatgtggttttaccctt

SEQ ID NO: 14211 - DNA, 622 bp, Zea mays
  misc_feature (348)..(348): n is a, c, g, or t
ccctcgaggcctgccgggaccggaccgaccaagaaccagcatgaagccactggtggcgcgcctgctcctctgctactccctgctctggctggcgcccgcggcagccccgctacgcctgcagcacgatcatgtccggggccacggccacggccatgcccacccgcctccgtacgcgcgtaacgcacggcgtacggcgtctcggcggcgctgtgcccgggctgcggcgcgtgggcggacgcgctcgagttcctctactaccacaacctggtgcggctggcgtcgctggagccgccgctggcgtgggtccccgcgcctggcgtcgtacgcggcctggtggggccgcgcaancgccgcggggactggggcgcttgcccactccctcccccgacgggcagttcggcgctcgggggaaaccgtctttctggggcgggccccgggcgggcgcggtggcggcccccgggacccccttcccggacttggccccgccgaaggccccctactactcctaagcccaaaaaagggggggcgccaagggccggaaggtgccccactaaaacccaaaatggtggtggcgcacacccccccgcccgtcggtttgctccccgggtggcctgggaaaaag

SEQ ID NO: 14212 - DNA, 698 bp, Zea mays
tcccacgcgtccgattggaagatgggcatgatagcgcactgcaaccttgttcaatgagtgaaagagatagtgccatgggtcttgctagcctgggagcggatactcaatcatgtgttgatgtccattctgacaattggacatctgtcagcattagtggccgtgatgaagttttaactgctgccaaaattgcatctaggaaaaggagcaatcctggagacagaatagaagatttagatgcttcacttgtgggaagcccaaaccaagatgagtgcagcggagggagatgttcagttcgaccgagattgatactagagatttcctcagattctgattagcacacatttgtgttggctgatgcctgcatgacttggagaaaaggaagggggtggatgtgatgctgtctaacgcggtcagcgaactggcaagcagctagaggcctctcctctatcctgtaattggagatcccatctctgttaggtggtagaacgtgacaccaggagcaacatatagagtggcataatagagctgaaccatatatacatgcagtgtaggcaattttgtaccatatatgtcatgaaccgaggtggcagttagttgatgtaaatatgctccctctctgtttttctatattattggctgaaaggagaggggaggatgcatgctcagtccggcctggttatttatcatttatttatgat

SEQ ID NO: 14213 - DNA, 2598 bp, Zea mays
gtggcatctaccagatggtactctctctctgtccacagatacagcagccaaacctggaatgtgcattgtaaagcacgaggtcaaagaagagccattgtctgaagaggtgggatgtcatcttaagttgggacttaggaaaaaaagcaatggccagtgggaaattagcaagagagtggatgctgatctggtgccgtcttctggtaacgaccatgaccattcaggacacgatgaaaacaaaaactgcatcactcactcaagcaatattgatgatacaaacattgcagatgaaggttataatttagagccagcaacaaatggttatcccatgacccatgtccatgatcttgactcttcatccgcagacgaaaatggtcctccagcatcgacagggcaggatatagtagttttgagtgactcggatgatgatgctatcatggtgttgtctcccggtgctgtgaactgtggctcgatgcataacactggaaatctgtttccacccaacacacctgaaaatttaggagtgtgtagtggagaaactggtggatgccccaaggagacatcattccttgcattaaaagaagattttggtgatccggggttgtcattttgggaaagtcatggtagtccccgagatgcttctacttcccagatccccgatgccagtacaaaggcagtagataatccaggtgaagtggacaaccaccctgccaatgatcaatctaagcaagggcaagtttctggggctgattttggagtagcagcaaatcccacgcgtcccattggaagatgggcatgatagcgcactgcaaccttgttcaatgagtgaaagagatagtgccatgggtcttgctagcctgggagcggatactcaatcatgtgttgatgtccattctgacaattggacatctgtcagcattagtggccgtgatgaagttttaactgctgccaaaattgcatctaggaaaaggagcaatcctggagacagaatagaagatttagagcctcccctggtatggaagaagtcttcactcctttttgttgtgtgatttttttttgttattatctgttcattacaatgtttttttttcttgcgcttagatgattttgaatctgcgcccattgttcctacagtttcatcaccatcactttgccactgcacaaacgtatcagaatctttggcaggcttgtgacactttgagtcgctaatttatctggttaccatgccgctgcttttgtccctaaaaaagatgaacatttgattcccttgtgtgcagcttcacttgtgggaagcccaaaccaagatgagtgcagcggagggagatgttcagttcgaccgagattgatactagagatttcctcagattctgattagcacacatttgtgttggctgatgcctgcatgacttggagaaaaggaaggggggtggatgtgatgctgtctaacgcggtcagcgaactggcaagcagctagaggcctctcctctatcctgtaattggagatcccatctctgttaggtggtagaatgtgacaccaggagcaacatatagagtggcataatagagctgaaccatatatacatgcagtgtaggcaattttgtaccatatatgtcatgaaccgaggtggcagttagttgatgtaaatatgctccctctctgtttttctatattattggctgaaaggagaggggaggatgcatgcttagtccggcctggttatttatcatttatttatgatatataatgaaaacggagtaccaggtaggtcgcagcggtagagaggtgcaaatctaatctaatcttgtgtcagacagggtcttcaaatcatatctttacttatgtttaagatttttattaatttaggggtgtttgaaattggttttgctccaaaactccgggtaaaggagctatgttccaaaatctagattgctttctcgtatcactgtccagtgatagtggtggttaaatgctttcaaacttcatatctaggttatttaaaaaaattaaagcaacaaaaagagtactttaaaaatttagagttttactctagagtcataccaaatacccacttaacttctaatttagtcgcataaatcagctaatctaacgctctaatctaatgcatttagtggatgtgtgcgtcttaggctggacattgacggtaccagtcgccgtgttagagtctaggttagtaacgatcagattcgctagatactgatcgcgtgcttttgatgtggagtttggctagtgtcattttaaaaattgacggtacttttgatgtgcgtgcccatatgctaattaagggcttgttcggttattttcaatccatatggattggagaggattgatactgatcaggagatattttaacttactatggattaaaaccccctcgatctccctcaatccatatgaattgaggtagaatcgaacaagctctaaggttataccaatccataaggggattagaggagatttaatccccttctagtcatttttgattaggagggggattgaatcccctctaatctctttctcgattggtataaccgcactaagagcttgttcggttattttcaatccatatggattgaagggga

SEQ ID NO: 14214 - DNA, 1237 bp, Zea mays
gatgcagaacctattgatgatattgaaatggaacaggaagatttatctgaggtaccaagtgccatggaggaggtgaatgttgatgcagtagtagaggagttcgatgatgagatggccgaggaagtgtctggtggtagtagtggagaagagacggcagccttcattcagaattcagatattccttctcaatccactcccgagcctgaacaggcaaagggcattgacgaggtatccttgcagcaagatgttcagactgaggattctgaggatcatgctgatggcaaggaggatcagccagcgcagcatggtcaaaagttgggatcagatatgtggtcaagttacttggacaaagtatcggatcctgctgccattggtgctgctcttgctgccattattgttgcagctgttgtggcattcctttacatgaggcagaagcaaactcgtgttgcctccaatgaaccagctgagcaggtggagcaagttgagcaggttgaacgggttgagcaggttgaacaagttgatcaggttgaaactctttctgactcaggaagtagccaggggcatgttgttgccaagggttcactgtttcacagtcctggcgtagaagcctctggcccctcacagtatagcagcagcttgtcatctgggcttggcaggaggaggaataccaagggtgaaggccttgagccagtagtgtcgaggagagactcgacagctcaatccacatcatcttatggtagtttcaccacataccagaagatccctgccaagaaaggaaacaaggaggacgaagcgatgaccccagtccggcgctccagcaggctgaggaatgtgaaaactcctgaatcttaagattggcgcaagctggcatctgaactgccttttagattattagataattgctattgccactttgtttgctgcttagtgaagcatcatgtgtctaggcaatcaacaggtttgcatgatgtgataaacagctctctgctgtttttacttcaaaagatgattaggacttgtgtgttcagtataactgcttaagatttaattgatgttgacttgctcgttgtactgttctctgtttgagatgaatcctctgttttagatgaaatctctggattgcattgcgcccaagattttttcctaggaaggtattacactaaagtcacctgggtgtggagtactgttacgaagtccagtgcggcagccggcagaaccttgtgattatctctatact

SEQ ID NO: 14215 - DNA, 3726 bp, Zea mays
gtggcactgtggcagcgccgcaacggtcgactgcttgagcgtctgcgcctggcccacctggcagctgggcatctaacgggcgagtgagagcacagagcagaagcggcgcgcgtccatggacacaaatccccaacggtcacaaggacggacggatagacacacacacaacagtataaagagccagctagcccggccgcgccgggaaacagatccgccatacgcccatcccatcccctctcctcactcagctctcctcgcccaaaatctccgccgtctgcagttccggttgcgagtccacacagctcatcacgcttccttcacaaatcgaacgcagccgccagccggatgtcgattgcggcggtcagatcctcgtccccgggcccgtcgccgaggccgtgctgcggcctcaggaggagcgctgattccagccccttcaggcccgccgtgtccccactcggtaaggcgtcttccttccgttgccgcggctcgtggcttatttcctctttatcgccggattacttccctacttagacgcgatctgccgatttctctcgtatcccataaagctccgtgtctcgatctcttattcttacttttggatttggacgtccgtttttcaagaaatcttggtctgccgattccttacatattttttcggcgattcacttcgcagattcgccgcagaggagctcctccgtctgcaagaacagcggccgcgcctcgccgcggacctggggcgcggagaaggagaacgacccgcgcgacgcggcgccggccgcgagcgcgaggacgcacaaggtgcgctccagcggcggcggcggcggcggcgccaaaagcttcatggcgcccactatctcggcctcctccaaggccgtcgcgccggctttcacgccaagaaagaaggtattcggcgagcgcaacaacgatgccgtcccttcgtcgccagtggaccttgcgcacagcagtaagcccagggctgcgcatccgctgctgccagaagagggctctgggcgtgccgaggcgtctgcggctctcactggacggcgcctctgcccttccttccgcggctgggcctgtcgtttcgcgcggcgccccgtcgttcggaggtgacgaggccgccgtgatggttgagaatcccgccgtctccgagagccaccacgacgtggctttggcggacgcggaggtcgtggcagccccgtacgatcccaagacgaactacctctccccgaggcctcggtacctccgctaccagcccaaccgccgcctcgagatttaccgtcatggcggcgggagcgtgcgggggctcgaggacatgttcgcttcccagagcagcagcgaggaggtcgacactgcgaccaccacggaggaggaagtatccggagaagggcagccagatgactcctcggaggaggagacctcggctatggcccctccaccggaggccagagctcagtctactgctccggccctggatcgcctcctgctgccgcagcccgcgctggattcgccactagctcgggtcctgacaccggagccgaaggagtctccgcgagctggtggcgtcttgatacctgagcgggaacgtgcagtgagccccgcgcgagctcgtcccaagaagaagaggtcaccagtgaggttcctgcttgcccctcttgctctggttctgttgatggctgcagcgtttgtctgtgttccaccgccgccgggttatccggtcatgctgaacacctccatgtcaaaggtgtcagtcttactttcagttcaagaattgcatcctgtggagttggctgctaggctgaagcaatggtctagcagttcgttggacttcgtcacgtcctactgggaggctattgcatcttaccaagaacgacctgtccttggtccgcacttggctgccaatgttactgctgctgctgcagaagtagatgcagattacgctgttggtttctactacagtgctgctcagacaagcccaacaagtttggagttggggactcatgatgttgtttcagaaaatgatactgagatgattgctgggcctgatgtggaggatccggtaacctgtgatgaccctgatgcagaacctattgatgatattgaaatggaacaggaagatttatctgaggtaccaagtgccatggaggaggtgaatgttgatgcagtagtagaggagttcgatgatgagatggccgaggaagtgtctggtggtagtagtggagaagagacggcagccttcattcagaattcagatattccttctcaatccactcccgagcctgaacaggcaaagggcattgacgaggtatccttgcagcaagatgttcagactgaggattctgaggatcatgctgatggcaaggaggatcagccagcgcagcatggtcaaaagttgggatcagatatgtggtcaagttacttggacaaagtatcggatcctgctgccattggtgctgctcttgctgccattattgttgcagctgttgtggcattcctttacatgaggcagaagcaaactcgtgttgcctccaatgaaccagctgagcaggtggagcaagttgagcaggttgaacgggttgagcaggttgaacaagttgatcaggttgaaactctttctgactcaggaagtagccaggggcatgttgttgccaagggttcactgtttcacagtcctggcgtagaagcctctggcccctcacagtatagcagcagcttgtcatctgggcttggcaggaggaggaataccaagggtgaaggccttgagccagtagtgtcgaggagagactcgacagctcaatccacatcatcttatggtagtttcaccacataccagaagatccctgccaagaaagtaagctgcaattggtctttacatttagttttgttccttttgctaaatgtatggcccttgtgttagcttgcactgaccttgttctcacaacacagggaaacaaggaggacgaagcgatgaccccagtccggcgctccagcaggctgaggaatgtgaaaactcctgaatcttaagattggcgcaagctggcatctgaactgccttttagattattagataattgctattgccactttgtttgctgcttagtgaagcatcatgtgtctaggcaatcaacaggtttgcgtgatgtttgataaacagctctctgctgtttttacttcaaaagatgattaggacttgtgtgttcagtataactgcttaagatttaattgatgttgacttgctcgttgtactgctctctgtttgagatgaatcctctgttttagatgaattctctggattgcatttctccaaagattttttttctaggaaggtattacactaaagtcacccgggtgtgttacgaagtccagtgcggcagccggcagaaccttgtgattatctctatactaaataaaacaccagttccacggttcctaccattgtcggtgccatggtttccatcatcgttgtgcttcaccacatttaaatgataaagaaagtaaaattatgtacaaataaggatttaaacaatggttgttggctccaaaccacattcacaacaaattagccaacggtacaatcatacataaaagaaaaccgtagcttgctagtatgtctaatatatatgctccggtggccgtcggaatattatccccccgtgcttcttccgtgttaaataaccttgtcttcttccctgttaaatagcaacgacaatgcaggtgcttcttccattg

SEQ ID NO: 14216 - DNA, 849 bp, Zea mays
gggtaccccggggcccgcggggcgccgccacgcgaatccgcatctccagactccaaccagcgctcgtccctccccgttctttcctcctcccttcagccatcgcagtcgcagcgcaggttcttggctggttgctggtgtcgacagcaaagtccgcaactccaatcctgcctgcgctcctcccgtcctcactcagcacccgcgcacgccgcctgcctgtcgattgagatctctttcacgcccctttctgccatcgcacaactgagccgcagctagtaacatccattttgctggtcaataagtcgtgggaggaagaagatggattatttgaaggtgcaggtggtagagtcatcatttgtagtgccgagcgagccgacgccaacgaaggcgctctggctctcttgcttggacatggttcagtccaacaaagcccacaccccaacgatccacttgtacagctccaacgatgctgcggcggctgattttttcgacctgggcagactcaagaaggctacggccaaagccttggtggccttctaccccctcgccggacgcctcgtcgacagcgacgatggtaggaaggagatcagctgcaacggcgaaggtgcactctttgttgtcgctcgcgcggatggtgatctcactatcgatgaagtcaagaaattcaagccatcaccagagttgaggaggctgtttattccactcatcgagccatcgtccatcataatggccatacaggtgactttcttgaagtgtggaggtgtggtgttaggaacagctatccaccacgccgccacagacgtttcaagcgcgttccacttttttcagacatggtcggcgttctgcaagcat

SEQ ID NO: 14217 - DNA, 1921 bp, Zea mays
cattgggtacctcgaggccggccggcgataaaattgcaacgatgcggcctcgagccgccgcctccacgcgaatccgcatctcccactccaaccagcgctcctccctccccgttctttcctcctcccttcagccatcgcagtcgcagcgcaggttcttggctggttgctggtgtcgacagcgaagtccgcaactccaatcctgcctgcgctcctcccgtcctccgtcctcactcagcacccgcgcacgccgcctgcctgtcgattgagatctctttcacgcccctttctgccatcgcacaactgagccgcagctagtaacatccattttgctggtcaataagtcgtgggaggaagaagatggattatttgaaggtgcaggtggtagagtcatcatttgtagtgccgagcgagccgacgccaacgaaggcgctctggctctcttgcttggacatggttcagtccaacaaagcccacaccccaacgatccacttgtacagctccaacgatgctgcggcggctgattttttcgacctgggcagactcaagaaggctacggccaaagccttggtggccttctaccccctcgccggccgcctcgtcgacagcgacgatggtaggaaggagatcagctgcaacggcgaaggtgcactctttgttgtcgctcgcgcggatggtgatctcactatcgatgaagtcaagaaattcaagccatcaccagagttgaggaggctgtttattccactcatcgagccatcgtccatcataatggccatacaggtgactttcttgaagtgtggaggtgtggtgttaggaacagctatccaccacgccgccacagacgtttcaagcgcgttccacttttttcagacatggtcggcgttctgcaagcatggtgacagtgctgccgtggagctcccgtgccacgaccgcaccctactccgcgcacggtccccgcccacagtccaccccgacgcgctctccacattgcagcctcggctcgtcctcactgaacccgaggggcctcttgccatcgaaatcttcaccatttccagggatcatgtcgcctccctgaagcagctctgcggtggcacgagcaccttttgcgccgtcagcgctctcatctggcagtgcgcgtgcgttgcacgacggatcccaccggactctcaggtgcgcgtgatgttcccggccgacgtccgccgccggatgaggccgcccctcccgacccactacttcggcaacgcagtgatcaggctatacgccgctggcccggcaggggacattggcacggcggcgttggcatccgtcgctgcccgcatcaagggcgccgtcgagcggatggatgacgagctggtgcggtccgcgattgactactacgagatggccgagacgaacaagagacggactgggacaggcatcttaccacggacggacctgaatattaccagctggttgggtaggccacagcacgacgcagattttggctggggaaagccgcaatccatgtcgcgggcggagtctgtccgcggcggctctatgcacttgatgaacgacgacggtggtaccggcgacgtccgcgtgctcgtgtgcttggaggctgaaaatataaaggagctaggacggctgctttatgcaaagctctagcaagctgctagtgctatgctctaaaaataataatattaataataaggtttgttactatgcttaaggggaaccatactttttccctcgcgatttattattattatggcagtttcaataatgaaaaccatttgtaattcctgtgacaattaatttatgcgtccacgctagaaataaaaacttgtttgtaataaaaaaaaaaaatttttttatggcagtttcaataatgaaatccgtatgtaaaaaaaaaaaaaaaaaaaaaaaactcgagactagctcgtgc

SEQ ID NO: 14218 - DNA, 3351 bp, Zea mays
agagagagaaaggggagggaggggcagataaagaacactgcaccatttgtgtgctcacttgctttcaaacgtgcacctcccctcttcttcctcctcccctcatctccttccaacaagcgccataaccacagcttccctctcctcctctctcttgttgcacgaatatgacgccataaccacagcttccccgtgaacgacaaggagaagcagagagtgctacataggtacatgtagggtactataggataagaactatacagctaggaggtagcggagggaggagcacgccgccagcagtagggatgtacaagaaccagctccaagaactggcgcagaggagctgcttcagcctgccgtcgtacgtgtgcacgcgcgagggccctgaccacgcgccacgcttccgggcggccgtcaccttcaacggcgagaccttcgagggccccagcggctgcaccacgctccgccaggccgagcacgccgctgccgaagtcgccctcgcccgcctctccctccgcggcccgtccactaccctcgccgcccgggtcctcgatgagacgggggtgtacaagaacctgctgcaggagacggcccaccgggcggggctgaagctgccggcgtacaccacggtgcgatcgggcccgggccactcgccggtgttctcctccaccgtcgagctcgccggcttgagcttcgcgggcgaccccgccaggaccaagaagcaggcggagaagaacgccgccatggccgcctggtcctcgctcaaacagagtacgtcatcggcccaatcccgaaaacacaaaccttgcgcatatctttacgcgtcacggggcatcattaatggcccccgccatggtctttgcagtgccggaggctcgcaaggagcccggcgccggcgacgagcaggagcacgtggctgtcgccagagcgctcgcggcgctgaagccgcgagacggcggcgacggaaaggcggcgccgcctctgcaggcgcgcagcagcaacggctcttcttcctccgctcttccgaacccgtcgctgtacagacaccaatggcggcctcggaccagtacccctgcccaagcccaacccctgccgccgaggacgggggccctgccattgggacctcgagccggcccaggatcctgcccccactgcatctgctacaacggccggcgtgcggctccagggacgccgcggcggcagagctggtgcggatgctggagcgcgccatggtgcgcgaccgggaggcaacgccgccttcgccgtgctactacgcggcgcctgccgcctcggcgtaccgccacggcagcgcgccgaggaccttcgccgcgggcgggttccacgccccggctgtgagcgtgcggtcggtgatcccggtgtgcgccgccccgccgccgcagaccccggtcaaggaggaaaggaatggcccggcgacaccctcaggcgcatgcaagagggcgtgagcgacgtggtcagcttgtgaagcgcagcaagagaagaagaaagaaagagcctggctctgttgttgcaggggagttttggatcacaactttctctgtagtctgtacagaagttgtgtacgaggtcaactactacgcatctccctcgctctctgtgtgtgtttgaccaggatctagatggtgagatcttcgtcagaaaggcagccatggccatgatgaggctgtgaagggttttaggtggacgatgaacatatatgaatatatagttgtactgttctagggcttcagtagaagccatgctaccgtgttaacaagcgcatcgtatcatcccttcggctcggcaatctgcctgcctgcacacagatcttgaactctttcttggcttgtacaaaaaaaaaagaacacctcatatacataaataaatctttcctgaacctcgtgttcttctctgccagctgattaggaagtcgatacattttttttcacggtataaaaaatggcaggctaaacctgtcaaatactgtagtgccagccgtatgccttgcaacttcactacggagtgaatgagtcagccgtatccgtatgcatcatcctcaagaaagaaaaaaaaacccgagtcggatggtacacgagggggaatcattcaatgatcgaaaatggtacacttctcagatccagagtttatggtgatctcgactgccgaacaaacggcacatgcatacgtctacgtcatgtggtttagcgtccagagcgaagaggcctaattaatcccaaggcctatcttccttcaacttgtcatccctgattgcaattgcattggtttcctgccggctgccgccgagggatcgtctcttgttcctcgcagtcgcagcgctacacaggagcggggagcaagtatatgtatggcggaatgatgagacaacagacagacgcgaggaggaagaagaagaaaagctcgtagtagaggcggattgtggtcaccaccgtccagtagctctccatctcgagacattaatgggcgtagcgcaggcatttattgcctcatcagagagccgggggaggagaggagagagggaagtgggagatggcaggcaggcacacgctttaatggcggggcagtggccatttactcggcactgtctttcccgcaatcaatgctgccatcggcgtatgtactgctagtgctagtagtagtccacccacagagaaacccgcaagcgagcaacacacacacaccacaaagctatggcccatgggccatgggccatgggcgagccaacatgaccacccccaccccacatttgaactccttctcaaacaatcaatagtagcaagctaaattagattacagcagcaaatagcgcattacaaaatggggtcaattttatcttttatcactcaattaagagcaaggacggaactagaaaaaaatcattcacttattcagtaattccactaaagttttagttattagtttctattatagtttcagtcattttgttatcgttacagtttcaatcatttcattactgttttatgcatttactcatttagtcattctattaaagtttcactcattctgttaccgttacagtttcagtcttctgatctgagcgtgaggggcacgtgggggtcggacatgccttccacctcctactgcttgcacgagcacggacccacaaaagaggatttgaaattctatttcattggttgcaaatttactagtgccgacgtcatcaattcctaatgttgttcgtctgctaaaagattcatgtggagaaccagaacaggacaacaccataagatcttcgcccttgaaatctatcccatgtaagagatagattgaagaccatgtaagagatagattgaagacagaagatccttacaaatttag

SEQ ID NO: 14219 - DNA, 2163 bp, Zea mays
caactctagcattgcactcatttttggtcttttaatcgtgagttgatctaggaaaaattgatggggttttaaaattgcaagggcttatatgtcgcgaaggtgggatgatcacgagttgattgaagcaaaattaagggggttttcaaaagtttacgtccgtggaaccgtcgaaccatgaaaacagatttatctaaaatttaagtttaccgatttctaaatgtaatttgtagtgccgaccaaacaaccagcaacgacgaaacacccactctaacatgcatgatgcttttactcctgtatggaatcgttttgggagttctcctcttatattcatcgcaaggccaaaatcatgcaggttgatggggacggaccgcccgcgggtaaaaagtcaaacctcctccttaatagaagaaataattcatacatattacatacgacaagcgcgaggagacaaggtaagcatttgggtcctccactccgtctccgagatgggtatcgctctcctcgcgctgctgctggtgctgccggcgagccatgcgtgggtgtgcccgccgtgcgggtcgacggccgtgccgtacccgctcagcacaggcgacggctgcggcgacccggcgtacaaggtccggtgcgccgccgccaccaactcgtcgacgtcgtcgccgacgctcatgttcgatgcgctgaacggcacgtcgtaccggatcacgtccatctcggccgcgacgcagcggctggtggtcgcgccggcgccgttggtggcgcagggcagcaggtgcgtgtcggaggggcgcggcggcggggtgcagctgaacgcgtcgctgccgttcaacgtgagctcgtccaacaccatcatgctgctcaactgcaccagcgcgctgctgctgtcgccgctcaactgctcctccaactcgctctgccacgtctacgccaacgccacggggtccacggcggcggcttgcgcgccgctgccgctctgctgcaccttcgtggcgggggggctcgtccacgtcctacagcatccgggtgtccccgcagttctgcagcgcgtaccgcagcttcgtggggctcgacccggcggcgcagccgccggccacgtggggccgccgcctcgggctggagctgcagtgggccacgcccagggagccgctctgccgcacgcaggccgactgcgaggacggcgccaacgccacctgcgccgacgacccgctcacgcccgcggcccgccgctgcttctgcgtgcccgggctctcgtggagccccctcgccggcgcgtgccagctgagtacgtaatttctttccgctgcatctgcacgccgttgaatcgaagactcgaggacgaggatggacaggtcctgaattaaatggaactcctgtactacttgttcggtttggtgcagatccctctgattgccagatcgctgggggctgcggaggatccaaccatgcgcctctcattgcaggtaaccgcttgcttccgtgttcttgtcgttcagagtgttcgacaaatctcaaaacctaaaaaaaaaagaaaatatttagttactgcttgacacaaatgattagatgccacataaaaatgtttctaaattgctagatagtttgattgaatatatatacaaattttagatgacataccctaccggaaaattctagatcagtgcttgcttcgtcttttttttattgccatctactgtcacgggtaaccgtataatacatacctcatattaaccgctaaaactttgacaacaattttcctcggcgtagtacaaatccctcatatgacgcgttgggtaaagaggaggtagtggtttggtcgactcaagcaacccttttgacccttctagtccagtcgacagtaggtacgctgcattcaaccctttacccttttgataagccacaatggtatggtcaactttggggggctcatggcatggaccatagtcatagagggataagctttgaccactccatgaatgtgtgttgcaaagactggcggctggcagcagacaagacaactatcagcccatgaggtccagatcaacggctcactctacgttatgtttttataaagatctgagaacgttttgttccggcatatattagtataagggcccgtttgtttaccttgattttgaggaattgaaaactaattaatgaagtagtcta

SEQ ID NO: 14220 - DNA, 5068 bp, Zea mays
  misc_feature (26)..(26): n is a, c, g, or t
  misc_feature (1346)..(1346): n is a, c, g, or t
atatgacgcaaacgggtgaatactgngtgaatgttccagacaagcatgtgccaactgcctcacaataattcagtaccaatcagaagaagaaaccgaccggccatgcagagtgcaaaatcgagcagatgaatgctttgcagtactagtcccgcggagcaggtataatgggattcgtcatcagggaggcactaatctcttcttgataaaaaaaaggcttaatcggctgcatctgtgattgttttaaggcgccctatttcttcagtctgaatgctcgaatggataataagtctgccgctggctatctaccgtctacctgtgtttagaaatcagaaccgaagtaccaccaacaccaataatgactgagagacagagtcagagagtgaaagatgtggagctctcggcttctggccctaaatccaaaccttgtgatttcttagtatcatataagctagatcatcaccggctatattaaaaggaaatgcagtgttgtgttttatccatacggaccacgcatccaagattccagtcaacgcgcagttgtcagcccatgggattcgaagttcctaacgataggcagacgtgtccaatgtcaacggtattggtaatacaacggcgtatagacatgacatgcttgcagggatgtactccatgtaccgagtagaaacacacatactcagactgacaggcccttaaaacagagaccctgttaattaatgaaaccagggtcagagaccccagcagcaaaaacagctcttcggaacaacaaggagcatctccacacagcaaaaacagcaaatgaccgaggatgcgaagtgggatttggctcccgcagatgcgacaggtgggcacagtttttgctgcttctgaacgcgccgaatagtctactgatctccagcaggccgtttagcggcgtcagcgggtgataaacaagtcggccgcggacggaccttaatcgctcgggtgggcgatcgtgatggcgatcctgactgcgtccgcgggagttgctctaacttgtactacgggagtaagtggcaacgttttacacttttcctattgctcttgtcaacagacaacacagctttgttcttgtccttctatataaaaaaaacctataatttatttaatatgatttattatgccaacatttttttctcgtcatagtgtataaaggctgtaaacttttctttttctgatttcctaccaataattgctaacagatttggatcgcaagatgaaggtctgctggctgttaactagccatcctgaaatatagcagatctacagacactactgaggtgtttggttcgatgaatcactctattcaaaataaagtgatgcatcatgantccattcctcaaatttggtgggataactccattccacgtattattactaaacaactaactatgatgaattagtactaaacaactaactatgataaataagttgctgatggattaattcactctatttcacaaaccaaacaaaaaagtgagaagtaataagacgatggactacctcattcctcaaaccaaacaccccatacatctccatctcatctcaccccgtccctgtgtcgtctagccatgcggctctctctctcgagtcttgtctgactgactctgatgttgttgtccagtcatacgatcatcgatacatgtcgtgaatcgaaaggaaactatagaaaaaagttttcagcctatagagattttttttgcacgattcgggactaccggggcccttttccctgtctctctctcgctattatctgagcttgcaggttccgtttctcagcacaataatattcggggttttttttcacacagaagtcctcttccatgacgtcgcctgtttgaatcttccccgttgacatcgctctacaatgatttcaaattattggtgcacatattagtactcggcagtctagcacagcggtaaaatggttcagcaagcggtatgtcatatagatactatagtattgacttcaatccatatgtgttgagctggattgaactgtattgaacttaatctacttgcgttaaggtgaattagagtgtaaattagtttaagttatactccaatccagctaaataaatgtggattgatgtcaatactaaagtaaccaaacaagggttttaggccttttgcatctggactaaaaaaatctttgttattacccctgcacactgaaacacgcacagtgaggcacagcgggtccagctggatctccagattccgcagcggccctgggatcctggccaccgtgggtgggcagattcacaaaagcaaaattagaagccgatccgttgtttgttttgccgaatcaaaactgcaatttgctcggcacatccagcgcccgcccgcccaaccacccacctcctataaatccgatcgacgccgcccccgggcggtgtcccgtcctcgcatcccacgccacaccctcccaatcccctccccctcgcgtatccacacctttcacacgcgacgccggagagacagagcgcgcgcgcgcgcccgaaagatgtcgacgtgcgcggcggacctggcgccgctgctgggcccggcggcggcgaacgccacggactacctgtgcgggcagttcgcggacacggcctccgcggtggacgccacgtacctgctcttctcggcctacctcgtgttcgccatgcagctcggcttcgccatgctgtgcgccggctccgtccgcgccaagaacaccatgaacatcatgctcaccaacgtgctcgacgccgccgcgggggcgctcttctactacctcttcggcttcgccttcgccttcggcacgccctccaacggcttcatcggcaagcagttcttcgggctcaagcacctgcccaggaccggcttcgactacgacttcttcctctaccagtgggccttcgccatcgccgccgcgggcatcacgtcgggctccatcgccgagcggacccagttcgtcgcctacctcatctactccgcgttcctgacggggttcgtctaccccgtggtgtcgcactggttctggtccgccgacggctgggccggcgccagccgcacgtccggcccgctgctcttcgggtccggcgtcatcgacttcgccggctccggcgtcgtccacatggtcggcggcatcgcggggctgtggggcgcgctcatcgagggcccccgcatcgggcgcttcgaccacgccggccgctccgtggcgctcaagggccacagcgcgtcgctcgtggtgctcggcaccttcctgctgtggttcggctggtacgggttcaaccccgggtccttcaccaccatcctcaagtcgtacggccccgccgggaccgtccacgggcagtggtcggccgtgggccgcaccgccgtcaccaccaccctcgccggcagcgtcgccgcgctcaccacgctgttcgggaagcggctccagacgggccactggaacgtggtggacgtctgcaacggcctcctcggcgggttcgcggccatcacggccgggtgcagcgtggtggagccgtgggcggccgtcatctgcgggttcgtgtccgcgtgggtgctcatcggcgccaacgccctcgcggcgcgcttcaggttcgacgacccgctggaggcggcgcagctgcacggcgggtgtggcgcctggggcgtcctcttcacggggctcttcgcgaggcgaaagtacgtggaggagatctacggcgccgggaggccctacgggctgttcatgggcggcggcgggaagctcctcgccgcgcagatcatccagatcctggtgatcgccgggtgggtgagctgcaccatgggcccgctcttctacgcgctcaagaagctgggcctgctgcgcatctcggccgacgacgagatgtccggcatggacctgacccggcacggcggcttcgcctacgtctaccacgacgaggaccctggcgacaaggccggggttggtgggttcatgctcaagtccgcgcagaaccgtgtcgagccggcggcggcggtggcggcggcgaccagcagccaggtgtaaaaaaaaaatcaggagcaaattgaaaccgagctgaagttacgtgcttgcctttttcagtatgttgtcgcgtatcacgtttgaggtggatcgtatctgccggtcagtacgcagtgtttgggcaaatacttggctacttgggagtcgcaagaaattgtgtaaattatatagaggaggatggcgacgaagcacgcatgtgttacgtagttggggtttgtgtgcacatggtggtgggcaggggctaggagagggtttatctttaggttattttcgtagtggaatgaatcttatgatcggatatccatcgtcggaaggtgtggcgggctgctggtcaagataggtggcttctatgactatgagggttgaaacaacaagtggacgattctgtcctgtggtcactgctcatcatccaatctagcggctttgacggtcgtgcctttttagtatcaataatattattccaagtttaaaataaaaaaaaaaaagcggcctgcggccttgttcctgcctgtaagctgctaaacccagtagtttgaaagttgaatgttgttactccttaagctttctataaaaggtgggtttcctcttgtcaagaaaaattgcatatacaatgcggttctcagacacggatgtaacggtgtgactgatgctctagcccctcctaccgctctcaagtccatgaaaattcactaaaatctcttttaaaattttaagtgtacatggtataatcttattatatattttatagtttttatcgtttatttagagttcgatttttattataatactactttagctttctggtttttttctagatccgtccctaacggttctatatatagatgatcataaaataatttattttgtagactctttaagctatgataattactctactagtttgcgagagtacaataactcattcattttattctaagtaatttaccataatatcatgataaacattaatatgatttatagtagcatatgtaccatggacatatatttttatttaattgtaatttggtatagatattgtcataaattaaggtg

SEQ ID NO: 14221 - DNA, 2620 bp, Zea mays
tgtactagtgtgatactatcaggccgcatgcagattcctttcgattgtttatagggtttttttttttataaagactgctggttttcaagccttgaatcttgtagctaggtagccagaccggtcccggccgggtcgaggaagacgcaaaactcagcaagcacagttgtgctagcctgctaggcacggtgtgtagcaagagacagaaacgagcgtataaccatggcgattaactgatagctgtggaattttgagcacatagtcctccaaacatttgcatttgtattgtactattgtttatgtagcgaagtttaaaatgcagtttggtaggcctaacccgcatgcgagggcaccgcacagtgaggctgaggaacggaaccactccagctaagattccgcaccgcagcaaccctgggatcctgctgtcagcgcgggccgcgggaggggagattcactggcagcggggccccacaccccttcccaggcttcccatctcagaaaacagaagccgatctgttttgttctgccgaatcaaaactgcgatatgatcgtcatctcttcgacagcacccgcccaaccatctcctataaatccgatcgccgccactggccgttcgtcccccatccacccatatcccacgccacaccctcacaaccccctcacgccgccatacctttccaacgctacgccggccggagggacagagagccagccaagggaagatggcgacgtgcgcgacggacctggcgccgctgctgggcccggcggcggcgaacgccacaggctacctctgcagccagttcgcggacacggcctccgcggtggacgccacgtacctgctcttctcggcctacctcgtcttcgccatgcagctgggcttcgccatgctgtgcgccggctccgtccgcgccaagaacaccatgaacatcatgctgaccaacgtgctggacgccgccgccggggcgctcttctactacctcttcggcttcgccttcgccttcggcacgccgtccaacggcttcatcggcaggcacttcttcgggctccagcgcctgcccaggaccggcttcgactacgacttcttcctctaccagtgggccttcgccatcgccggccgccggcatcacgtcgggctccatcgccgagaggacccagttcgtcgcctacctcatctactccgcgttcctgacggggttcgtgtaccccgtggcgtcccactggttctggtccgccgacgggtgggccgccgccggccgcacgtccggcccgctgctcttcgggtccggcgccatcgacttcgccggctccggcgtggtccacatggtcggcggcatcgcggggttctggggcgcgctcgtcgagggcccccgtatcgggcgcttcgaccacgccggccgctccgtagcgctcaggggccacagcgcgtcgctcgtggtgctcggcaccttcctgctgtggttcggctggtacgggttcaaccccgggtcgttcaccaccatcctcaagtcgtacggccccgccgggaccgtccacgggcagtggtcggccgtgggccgcaccgccgtcaccaccaccctcgccggcagcgtcgccgcgctgaccacgctattcgggaagcggctccaggcggggcactggaacgtggtggacgtctgcaacgggctcctcggcgggttcgcggccatcacggccgggtgcagcgtggtggagccgtgggcggccgtcgtgtgcgggttcgtgtccgcgtgggtgctcatcggcgccaacgccctcgccgcgcgcctcaggttcgacgacccgctggaggcggcgcagctgcacggcgggtgcggcgcgtggggcgtcctcttcacggggctcttcgcgaggcaagagtacgtggaggagatctacggcgccgggaggccctacgggctgttgatgggcggcggcgggaagctcctggccgcgcagatcgtccagatcgtggtgatcgccgggtgggtgagctgcaccatgggcccgctcttctacgcgctcaagaggctggatctgctgcgcatctcggcggacgacgagatgtccggcatggacctgacgcggcacggtgggttcgcttacgaggaccctggcgacaatgcaggggttggtgagttcacgctcaagtcggcgcagaaccgtgtcgagccgccggccgagcagcaaccgggtgtaaaattcaggaacgaatttaaaaaccgagatgaagttacgtgcttgccttttttctcagtgtgatatcgcgtaccatatttgatctcgatcgtatctgccgccactgtttgggcaatacttcgccactttggagtcgcaatcgcaagagtttgtgtaaactatagaagagcgtggcgacgaagcacgaacgtatgtgtgtgtgttttggttggggtttttgtgttacatgcgtgtgttttaaggtgcgtttggttgaatggataaagagggacgaaactaggcagccacaatttcagttatgtttggatgagggtaaagcaggggcaagttgaaccctagaccatttttcagtggtggcgccgtccccaaaaaacgagcggatgaagtcgcccccgcccctgtcgcggtgctgaaaaaatcgtgttgcctc

SEQ ID NO: 14222 - DNA, 2088 bp, Zea mays
ggagcagagggttcaagggaggggacaggtcgagcagctcacctttctctgctcgagaacgagaggagctcccgtcttttgcttgctgtgccgggcgctgctgaaggttcagctcagtccgatggcgttgagcggcagagctctgctcttgttcaagctgctgctgctgctgctggcgtgcctgctcttcctcttggagctgtcccgaggcaaggaagaagcattcagcctgaggaacctcccgcccttccacaaggccagcagctaccccgcggggtgcccgacgacgtacgactacatcatcgtcggcggcggcaccgcggggtgcccgctggcggcgacgctgtcgcacaggtacagggtgctgctgctggagcgcggaggctccccgtacggcgaccgcaacgtctcctacatgcagaacttccacatcgggctcatgaacatggcgccggactcgccgtcgcaggccttcatctccaccgacggcgtcatcaatgcccgggcgagggtgttgggcggtgggacctgcatcaatgccggcttctacagccgggccagcccaagctttatccaggaggccggctgggatgaagacctggtgaacaaatcatacccttgggtagaggacaagattgtccagtggcctaagatcgcgccttggcaggcggcgctacgggatgggctgctacaagcaggtgtagcccccttcaatgggtacacctacgatcatgtctctggaacaaaggtgggtggcaccatctttgacgagactgggtaccgccacacagctgccgacttactatcagctggagatgctagcaacctgaaggtgctgctccacgctagtgtgcacaagatagtgtttggctcgcgacaaggacgactgaaggcaagagccatcggagtcgaattcactgatgaggatgggagacaccaccaggcattcttgaacagcaacagagacagtgaagtaattgtatctgctggtgcgattggcaccccccagctgctgctgctcagtgggatcgggcccaagaacgacctcaagaatcataacattccggtggttctccataacagatatgtgggtaaagggatggctgacaaccccatgaactccatattcataccaacaagaagccctcctcggcagtctctcattgaaactgttggaataactgaagaaggcgtgttcattgaggccagcagcgggtttggtcagtcgtcggagagtgtccactgccaccatggaatcatgtctgctgagattggacagctgtctaccattcctccgaagcaaagaaccctggaagcagcccagaaatacgcccataacaaacttaatctgcccaaagaggtattccacggcggttttatacttgaaaagattgatggtccgatgtccacaggccatctggtcctcacagacactgatgtccggaacaatccagcagttaccttcaactacttcagtcatccacaggatctcaatcgctgtatctatggtatcaagaccattgaaaggatactcaagacaaaccgtttctctgaactctctgctgatggtgctgggttatcgatggaaagggtgctcaatatgagtgtgcaggctaatgtgaacctgataccgaagcatacaaatgacacagaatccctggagcagttttgcaaggacactgtgatcaccatctggcattatcatggtgggtgccatgtagggaaggtggttgaccagcattaccgggtgcttggagtttcaggtctccgggtggttgacggctcaatattttctaaatcgccagggaccaaccctcaagctacagttatgatgatgggcagatatatgggagtgaagatcctaagggaaaggctgggacgagcagctggagtgtagtcgattcctggacattagctttttattatgtgtggcctaggaaagaaattactaattttttgtgggatccagaatgaatcgctgaagaaaaacaagccatgtgtttcatctgtacccagtaatcatttgtctaatatgatatcgcagactaaatggttgactgacggccgagaagtttaaaaaaaaaaaaa

SEQ ID NO: 14223 - DNA, 1441 bp, Zea mays
  misc_feature (45)..(45): n is a, c, g, or t
  misc_feature (83)..(83): n is a, c, g, or t
  misc_feature (87)..(87): n is a, c, g, or t
  misc_feature (89)..(89): n is a, c, g, or t
  misc_feature (97)..(97): n is a, c, g, or t
  misc_feature (124)..(124): n is a, c, g, or t
  misc_feature (141)..(141): n is a, c, g, or t
  misc_feature (159)..(159): n is a, c, g, or t
  misc_feature (173)..(173): n is a, c, g, or t
  misc_feature (175)..(175): n is a, c, g, or t
  misc_feature (188)..(188): n is a, c, g, or t
  misc_feature (237)..(237): n is a, c, g, or t
  misc_feature (243)..(243): n is a, c, g, or t
  misc_feature (283)..(283): n is a, c, g, or t
accccgcgcttttttaccttgctagggacgccggcgctttcggcnagcttggacactgagcaaacggcttcggcccccgcttncttntnccacggcnggcgccaggttcaccgttggcgtcccngcgaacccccgaacggnccgcgtcgggcgttttantacgaaccgtcctngnacgttttacgccnacggtacaaagtaccgagcgaggttgacgctggcgtccgaggctgcccnacggtntacccagggccacggcgacgtcggacgtctggtcgcccgntgctggccggccccgccgtccccttcgcgcccttccgccccggcgcgctcgccaaggacctcgccgcggggtacctcgtcctgcagctcaggatcgacgggagggtccgctggaaggtcggcagctgggtgtcgggccactaccacatgttcgtcacctgcccggcttacttcatcagctccggcgccggctccggctaccgcggcgctgtcggcgcgcacgggctcaggttccagaccaccacgtactgccgcgtcgaggtctagactctagcgagcgagaggtcgatcaccgccgagaccgcccgacctccacgtgctctgctcctgccgcgccgccgaggtaggccacaccttgtcatgtcgcatactgcaaagcggaaacaaatgaagtgatacagaggttggaaaaaaagaaaaagaacaagtgtgaggtgatttagtgagggttaagcagtgtatcggtgtgattacatatatgttttttgttttgtgtcgcgatctttgttcagttcagcgttcagttgttcataatataaattctaaaaagttcattcagttcaggaatgagacaaaaaaaaaacccgcggcctttcttgtgccgctgccgcattctgcttttagttaggctgttgggattagtgtagctcacggtaccggggattagagagcttttaggtaggtaggtaggtaggttgcaaatcacatggtactacatgagttgttgttgttcagctccaacggaggttttggaactaggttggtacggtgcctgccaacctgcaccggaactccggcgaccgtccctgtcgtccgcggccggtcaggggctgccgagggcggcggcggcaaagtacggtttatttgagacctgggatcccggggtagggtagggcaggcagctcattggtccctctccttagcttagcttggagatcccaagaaacttctcaaaagcaagcgtaatccaaaaagattgtgtcttcttctttctcctccatgtgtgaccatgtggagaacaccctgcacattggaattggtagtgtgtatcttccggcagtagcagtcttaagtggatgtattatcacttcattaattagtaatgcaggtagaaatctgttctagctactctgcaggtaaactatagaggatccggggt

SEQ ID NO: 14224 - DNA, 8400 bp, Zea mays
  misc_feature (1456)..(1456): n is a, c, g, or t
  misc_feature (4238)..(4238): n is a, c, g, or t
gtggcgtgcaaaatacgtagcctttgcttgttttctatttgtctttgttcatgtgcaccacttcatttgaaagtagataggaaatactaacatggtattttcattggcggtggcatgttggagtcaaatgtcaatgaggcagtgtcaatgtgtcattatggtgctagaaacagagaaaatgtattaaagaggccaacagatgtttgactaagcctgggttcactagtttcctatgttaagcaatagaaaacctggcaaacttgcaagtagttctattaaacagttcttttagagtttggtttcataaatccatttcccatggaatgcagagtcaaattaaagcaaaataatgcacaatgccatgttaacgacatgttgatgtcaggtgcctagccgtgattaggcatttggcagcttggtccttagcgcctaggaaagatattttaacgacacagttaatttgaactaatataggtggtgcttgattcacttttgtaccaactttgtttgccactccatagtatgtctttttcttatttataaagtgtgccactacccatcaaaattgtgtttgttggctaatggaggttttggttacatcacctcagtttgggtttcaaggagctagcggttggcttccatttcatgtccttgtttgttcaagctatttgttcaattggttatgagggcagatctagtgctagaggctcccacatgaagacccgtaacctagtgattcattgagacagctctcaccactgcaccgggcctgcccttcatgaaatgttttcttttgtgaatcaatgttggtgtcaagtgtcttatgcgtataatactgtgaatagagaaaaatatagtaacgaacccaacagatgcttgactgacctggcttcactattcccttatattaggcgttctaacttccaacctattaatacctggcaaacctttgaattggaaagtgttttagattgtattatttttcttttttcaccttttagaatatggcatgtatggtgagcacaaaagatcattgcagcaccaaggatgggattgggtcatggttctgtattctttcatgttgtggttggccttatcacttatcagatttgtttatatggcatggaatgatctaaaaagcatcaagtgctactttggtgacagagttgatcagctaggatgatggctcctattgccaacacaggcaatttttgtagtaattcatgtgaaatggtaatatactggctgaatcacttagccattagttttgtttgcctacactttattagaatccacttcgtgtctaaaaagttcctagtgagaaatttaggccagatgaatatatggtatagttggtaaggagagacttaagttattgtctatatctatagtttgggtttcagatccttgctccattacaatggatgtgtactttgatttggtgtttcccatttanaattaactgtacctgtaaacttgatgagaagtgtgatttgttgacaaattatttttcgatggattgtaggatgtagggatgatgattttttataagaaaattgtttcatgttgaaaatccatcacttagtgttattcttcaccaacttatgcttagaatgcctcattagttacaaactatttttaaatgcatcaaatgagtcttaagggatgtggcctcagttcaagcactgtttatagacacctccttgatcattggccggaaaacaggagggaaccagttctttgaatcagttgaacaacacaattagggcatggttttgtatgctactgcttacagatgaatgcattaagtgcctgcgtaaattctgaaatgcaaccttgtgttatgttgatgctagaatttgggaagaaaaacatcatagttgactgaatttgtacatctgacataatatagtggtataaagaggcaatgaacagttttttttttctctctcgaacacacagtagaaatgtgcattattatattaagaagaaaaaatagtacatggtccaaaatagaccaaattacatcaggcaccaccttgtggtggccaaaaatgaaaatacaagaaggaatccatcaagacatagaaacctacatgcccatggttaatcccactggccaaatatccttaagcccagcagcccctgccaagcaccagattctggcctccttgatgccctgaatgactttagatacacttggggggcgccccatcaaagacacaggcatttcgatgtttcctttttttctcggagaactgtgcatcataagaaagtgccaccagcgagttaaagccttttttcttttccttacaaactctggcttttgctgttccaccaatcttggaatacttcatcatcaatcctcggagtgagatgttggaggtcaaccagcctaaggatggaaaaccacacttgtcaggcaacaacacaagccaccaggaaatgctgaccatgaatcggaactttgatagttcatttcttcattcttcacaaataaagtggagacattgttatttctgctcgctaaatattcaatccaataattctaaagctcacatgtaaatgttccgggggaagcgttttcctgcacacaatgatggcctctaagaggccatgttgggttgttgggtggtgcatcactgcatatggacaatatttcatgtttgatttttagctgttagttttgtggagtctttgcatatatctgcataatcagtgcacatgtttgtatttatgcatctcattggaaacagatggaagtacttgatcccatggctgaacttactttctttgttacatgtgtttattgccttggggaatgccttgaataattccttaggtgctataaaggaaccatatatatacatttcttctgttcccattttctagccttttctgtttgatcttgctactctgtttttttttctttcctgttgtggtagttatggacttgaggcatggatacacatgtctggttactagatgggttaaaaattagctatgtttggctaacaactaccagaagacttttctaaaacagttagtccacctattagttctcatatttagatgccctagagctaatttgggctaatttttagctagctagtaattagcccctgtatccaaacggcacttacactaggtgcctgtactttctttgttgtgcataggctagtactaaatcacgtttcaccaatgttgcatacatggttgtagtttatgtcagctgaattactattgtagctagtcttcacaatatagtctatgctggcacaacaggtccgaattttagttgacattttttattttgaggacacggtcacacggataccctaggttacacaagatagattcttggaccttgtttttctgaggatacctgaacctagctaatcgtttgtttgtatcaggagttaaggatcatcataacaggtttgctgactactctggatgctgatcggggggtacaagaagctaactggcacaatgggggtgcgtttatctgcatttgatttgatgagcaatactcaagctgggtaaccatgcttttatctggctgtaataggagtagcgagtgagagaagtctggaatgatccatatgcttggtgggtaatgagtggtctgtgtagcttcaacagaaatgtttgtgaaagttacggtaagaattactgtgcacgcgcgcgtggtggttagctggtttatctgggcgtgtgctatggagcctctcatgagtcatgaaacgaatcggtgtacattgaactagcgcttggaatgaagccctgccattcttggagatggatggctggatcctgtaaccgtcctgtccacttagggcttgtactgttgcacatggatcgaagggtactgagggggattaaaactcgttttagcctactggatgtatgtgtgcatagcacatatatcaactaaaaaaaactcctctatgtggtggggagagagagagagtatgattatgtctaataaaaaagatcaaaataatttggtcacttcatagattgtatcgtgggctgtggcaggaaatccggttgatgtatgggttgggttgatggaagcacgaagaagcaccggtgggtgtagtttcacttttttcacttatttattgttggctgtgtcctatatacagtatctcgtaggtgggtgcgtttggttgcctgcatatggtttggccaggctcatgagatgtagctttcttctgtttggttgtctgatnagtctcttcagcctggggttgtctgatcagtctcttcagcctggctcgtgggatgcgaagattcctcttgagcctagctcttgagatacgtaggaattggctgtttctccagagccaggctctgccggtgtaaccattagtctttcctaatgatagattaacgtataattagtgtctattaaataaatttaatttatttaaaagtggattaaggctttgtataatatattatagactattgcaacatcatcacatgaaaatataataaaactttatagcttttaagctcatgcataaagtatttattcaagcaaccaaacatcatctcgcatgggtcaggctaagctcatacaagcaaccaaacgtagagatattacatgctctcaaccaggttaagagtcaggttctttagatactagccaggcccacctatccagacaaccaaacatgccagtagtgcatgtgttaaaccagggctgcgtgatcattgtgtgtggattgattggaagctggtgggactgggctgttcgttactatatattcggtttggcagatccgttcacgcaagcatgtctctccgtgtgcctgcaaaacgatgggcctgcgcatgtcgtctgcaccggcagatgtttcgatgtggagagagagagagtgagagagagagctgtgctgcacgcctgcactgcactgcactgcagccaaagttcattcgttgttgctgatgctgccgcgcgcgggcgtccgatcctttcctccctctcgtctctatgtctgagcgagtgctgctggatagaggaggataggggagatgcggccgaggtttggtgaccaaacgcgtccatataaggctgcctggtatggtaggtggtgggtcaattgtgaagaggactcatcaaagcagtacagggggagccggggagggatggaagtctattggaacccgcctgcttagtttttagagatggcctcctgtttggaaggttcctgcgtgtcgcatcgtgaaggagtcgtgttcgtctgatggtaccttacccttattgggctttggcccgttaatttagacggccatgcccatgtgccagaaaaagttagcaaagacgacctagaacgagtgtggggggaggcgggaaaaaagggaggcgagcagatggccgccgaatcggattctgcccggagaaagttttttgttcgggagacgaaagcgcgcggatgcggcaggagaaatgtcatgcgtggctggactatggatgcctcggcctccctccctgtatcagcagcacgacacgaggactgtttgaactgttgcacatgtaatatctatagtaatacaaaaataagacaagtcagtatggattaaatacaaaccaacaaaaatagtaacgacgaccgccggcgatgaggattgaggaagaggaagccacgcccgcccgttgtgttgttgtcagcgctcggcactcggagacggtgcctgccgtgacgtgtcgtgtcacgctcaccaacgcacccgtgccgataccagaccagaccagaccagacccgccccgccccgccgtgttcaatgcatccacgctatgccatgtggggagtaacaaaaacaaaaaaatatgtttctttcaccctatgggtcacactcacacccgtgtttcgtgtgcccatccatccatccatgtttcggagctgtgctaacgcgcccataaatttgatcattttttattagttcgtgagacccgttttcaatcccgtgccaaattccgctgcggtcagttatgttctaaaactctttaatagagcagttccgctctagactttagattctattctcgtaacaagtgtcgaatatatacattcaaactcaaactttatgtttatgttgtcttttttaaggattccggagctgtaaaatagatactctaaaaaaatgtatattctacctctcaaagctctatagagtttacaactattcagttaagatgtttggctggatctgatcaagttctctttggagttttgatccggagtcatagcaaacatccacctttaatggcatgtttggcagtgtgcataaaaacggaatcagcaaaattccttttgtaaagtatttttttattttctattctcaatgtatcttgatgctaaccctatcaaccaaacatcatctttttttttctcacttaaacgatctcatgcaaccaatcaaatgtactgaattatataaaaaaaaaccccattcccaaacgacactacacagctcagctcagcccagcctccctttcccttgaagcctctccaccaacccaaagtcacagagacagagaggaccaaggcaggcagccgtcagcgagccagctagccagccatgggcaaggactgcggcaaccacggggacgatgacttccggcagtcatgccggcgcctgctggccatcctgctgaccatggcgctgctggtgggcgtcgtggcgctgatcgtgtacctggtgctccgccccacgcacccgcgcttctacctgcaggacgcggcgctgcggcagctggacctgagcaacggctcggccccgctgctgtccacggcggcgcaggtcaccgtggcgtcccgcaaccccaacggccgcgtcggcgtctactacgaccgcctcgacgtctacgccacgtacaagtaccagcaggtgacgctggcgtccaggctgcccgcggtgtaccagggccacggcgacgtcgacgtctggtcgcccgtgctggccggccccgccgtccccttcgcgcccttcctcgccgacgcgctcgccaaggacctcgccgcggggtacctcgtcctgcagctcaggatcgacgggagggtccgctggaaggtcggcagctgggtgtcgggccactaccacatgttcgtcacctgcccggcttacttcatcagctccggcgccggctccggctaccgcggcgctgtcggcgcgcacgggctcaggttccagaccaccacgtactgccgcgtcgaggtctagactctagcgagcgagaggtcgatcaccgagaccgcccgacctccacgtgctctgctccggccgcgccgccgaggtaggccacaccttgtcatgtcgcatactgcaaagcggaaacaaatgaagtgatacagaggttggaaaaaaagaaaaagaacaagtgtgaggtgatttagtgagggttaaccagtgtatcgttgtgattacatatatgttttttgttttgttttgtgtcgcgatctttgttcaattcagcgttcagttgttcataatataaattctaaaaagttcattcagttcaggtgaaaaaaaaaaaaaagaagccttgtgccgccgccccattctgcttttagttaggctgttgggattagtgtagctcacggtaccggggattagagagcttttaggtaggtaggtaggtaggttgcaaatcacatggtactacatgagttgttgttgttcagctccaacggaggttttggaactaggttggtacggtgcctgccaacctgcaccggaactccggcgaccgtccctgtcgtccgcggccggtcaggggctgccgagggcggcggcggcaaagtacggtttatttgagacctgggatcccggggtagggtagggcaggcagctcattggtccctctccttagcttagcttggagatcccaagaaacttctcaaaagcaagcgtaatccaaaaagattgtgtcttcttctttctcctccatgtgtgaccatgtggagaacaccctgcacattggaattggtagtgtgtatcttccggcagtagcagtcttaagtggatgtattatcacttcattaattagtaatgcaggtagaaatctgttctagctactctgcagtgaacttaactgggtgcagagtgttggtgctccgtgaatttttcggaacactagtacgtttcactgatataaccgtgcgctagctagcgatgccgatgctgacatttttttcgcgatagcagctagcaacagcatgtggtccagatattccactaaaacgataggcatcatccatccatcagccgtattatatttttctttacccgagagagagaaaaagcagaggaggctggcatcagcatcagcatcagtggaccaccgacgctgtggtctcggaaagttacgtgtcaggttgccggagc

SEQ ID NO: 14225 - DNA, 1980 bp, Zea mays
ctcaacttaaacgatctcatgcaaccaatcaaatgtactgaattatatgtacacaaccagactagatcatgtggacaaccaatcaaaccccaaatatcttgttaaaactgaaactctcccgcctacgattagacactcgtaaattgaagatgaaaaaaaaaacggtcctccatctatcaatgatgatatctaggctatccagacataaatcccggcaaagagaaaagctgctcgacatggacctctctctccgttcggcctccatgatttcaacatgatcatagacaaggagtgaccaatccctaaacccaaattaatataaaggacaccccggccccggccggcccggcactacacagctcagcccagcctccctttcccttgaagcctctccaccaacccagagtcagagagagaggaccaaggcacaaggcaggcagccgtcagcgagccaggcagccagccatgggcaaggactgcggcaaccacggggacgatgacttccggcagtcatgccggcgcctgctggccatcctgctgaccatggcgctgctggtgggcgtcgtggcgctgatcgtgtacctggtgctccgccccacgcacccgcgcttctacctgcaggacgcggcgctgcggcagctggacctgagcaacggctcggccccgctgctgtccacggcggcgcaggtcaccgtggcgtcccgcaaccccaacggccgcgtcggcgtctactacgaccgcctcgacgtctacgccacgtacaagtaccagcaggtgacgctggcgtccaggctgcccacggtgtaccagggccacggcgacgtcgacgtctggtcgcccgtgctggccggccccgccgtccccttcgcgcccttcctcgccgacgcgctcgccaaggacctcgccgcggggtacctcgtcctgcagctcaggatcgacgggagggtccgctggaaggtcggcagctgggtgtcgggccactaccacatgttcgtcacctgcccggcttacttcatcagctccggcgccggctccggctaccgcggcgctgtcggcgcacacgggctcaggttccagaccaccacgtactgccgcgtcgaggtctagactctagcgagcgagaggtcgatcaccgccgagaccgcccgacctccacgtgctctgctccagccgcgccgccgaggtaggccacaccttgtcatgtcgcatactgcaaagcggaaacaaatgaagtgatacagaggttggaaaaaaagaaaaagaacaagtgtgaggtgatttagtgagggttaaccagtgtatcggtgtgattacatatatgttttttgttttgttttgtgtcgcgatctttgttcagttcagcgttcagttgttcataatataaattctaaaaagttcattcagttcaggtgagacgcctccggccttcttgagccgctgccgcattctgcttttagttaggctgttgggattagtgtagctcacggtacgtaccggccgtcgtctgcgggggattagatagcttttaggtaggtaggtaggttgcaaatcacatggtactacatgagttgttgttgttcagctccaacggaggttttggaactaggttggtacggtgcctgccaaccaccggaactccggcgaccgtccctgtcgtccggccggccaggggctggcgaggacggcggcggcggcggcaaagtacggtttatttgagacgtgggatcccggggtagggtagggcaggcagctcattggtccctctccttagcttagcttggagatcccaagaaacttctcaaaagcaagcgtaatccaaaaagactgtgtcttcttctttctcctccatgtgtgaccatgtggagaacaccctgcacattggaattggtagtgtgcatcgtccggcagtagcagtcttaagtggatgtattatcacttcattaattagtaatgcaggtagaaatctgttctatgcagtct

SEQ ID NO: 14226 - DNA, 3678 bp, Zea mays
  misc_feature (2082)..(2082): n is a, c, g, or t
gcgctctctctcaccttcatccgtcttctctctcctcccgcctgccttttaagcgacgcgcccacctcccaccgtaccctctctgatcgaccacccttcccccggctctccctcctccgcgccgcgcccgttgatggccggcgggaagaggacgacggcgcgccaccaacacaaccacccaccgccgccgccgcctaaccctagccctaaccgtggccgcggggtcgccgacccgccgccggcctcggacgactcgccgtcgtcgaagcgcatgctggccttccacttcctccgcgcgctggcacggatccacagcaccacgccggcgccgcgccgcccgcgcaccatccgccgcgcggcctactcgtccatggcgcgcgccgccagcccgcgccgggcctggacgcaggcgctgctgctccgccgggcgcgctcgcgcggggtggccgtcggcggctcgtccaggcgcgcggtcctgctgcggaggcgcgtctccgcctcggcgcctccaccgatgctccgcgccagcgccggggcgacgtcggcggcggcgccgccggtccagggcccgcctccgaggcaggccggggagccggccagggccgacgcgctccggcggatcgtccccggcggcgccggcatggagtactgcagcctactcgacgagaccgccgactacgtgctgcacctccgcgcgcaggtgcagctcatgcagagcctcgtcgacctcttctctccgcccaacccaaccagtaattaatcaataccgcatggtcaattgattcttccctcttgcaccgccgtcgccgcggtttgtgtctaaatcatcatcgcatatctcttgttcatgccacacatgcatgagatggatgcatgattaagataggagattattgttgaggagagagatcgattattattattgctgctagtgcatatgtttagtgggtgtataggttgggaacacacattcatggaggatggaaccacacaccgatcaattggagggagaaagagattgttcgggtaattaattgtaatatatatagagagagacaattgagccacatacatatataagctattagtgcagtgcttgctgttgggtacggcaccagatgattgggtatgcgtatatatgccagtgaaaaattgtggagccatgtgtcatgtatcttttgtacctaactacgtagtaggtaggtatatagctgtgttacacacttttttttgcctgtcaatcttccttttctatgcatgtagtacgtaggtctacctatctgaatggggaacaagtaattactgatcatatatatggcatgacatgaacctttaccatgagtggttgcatgaataatgcctgacgcatgaataagctattaacatgctattatcttttttcttctagatcgagttaggtatactagttgttattcttgttttttctggaatgaggtataggtgcgcgcggctacctgcccacgtgtatgcatgtatctctctctctccctctactctgtacggtgggagagctgacaaccatagggcataggtacatgcatgaagctctagctagttgttatttgccttgtgtaattggagtgctaggatggtggtgttgtgttcaattggtttgtctaatgcagttaccatcttttgattaaataaaggacctcccttttgcccccctccgccctccctggaatttttttttgcctcatctcacattcagtcagctagttaggccaactaattatccccagttcctttttaggtgccaccgtctctaaagactattctgtgtacttgtacctaattttcttctctttggttctttgtcatgtgttattattcttggttgttgttgtctttggcacatgcttttgttgctttctttgtgaggtaagaatcccaaaggcttaatactggcttcttctgtttgttccaactgaccaaagagaagtgatttgtgcaaattgtgtgcccctgggtaagctaagcagcatattcgtgcaaatcttatactatcatcagactacacatgcatatatagttcagacattgcactcatcataaacattncttacagataagagtatccttttcatttgttttattttctctttggacataaggtaagggcacgtgcataacacattacatttaattaggtgattaatatagctgtccaattcgaacacctaaatcagtactaatgacactaaattctggtactcgattgaatctatatatagctagctaagctaaccaacctttgcaattagctagccaattctatcggcccacaagatttagctagctgtaccaataattttctagatagctatacatccatcttccattgattaacataaatatacataacactatatgttgcccactatatagaataatggtggcaggtgaatattgggtaccaattccttaatttggaggcttctataccaatgcaacaaaaatgtatactcatttgatctggtctctgctttgttttcttgtgtgtttatactttatacacgagttaattattagtattattaagtttttatttgttgcactgcatatagtgggccagtatacaaatctaacacaacatccaactatcagcgcattttagcatgctgtgaattatatgaagtctccattatgcatgccaaagtttaatcagtttatataagcacattgtatttttattagcttttattagtgaaacaataacaccgcactcaagcaagaacagaatatttatgcactgagtgaaatacatagacgctggtgtagacatcacacatggttattaagtaataacacaacattcaactttggagtgaccagcttgagaagatcaaattttatcaatcgctctagaaggatgaaactgacttgtttgcattgaatgtgaatgtcatgtatagacactacagctgtcttttttcatgttacagaactgaaaagagagtcatgaaaagataacttatgcctacacaacgcacgaagaacgtaagaattagcgcaaaaatgcctccttcagcccatctcaattgtggtaaaagtttgaggccttgtttgagtactaaactaatttacacttcaatccatctcaacacatgtggattggtgaatataagtgtcatgtggggccgcacctacacgcgggcccgcgacgccaggagggctgaggctagggcgtttaaggaaggcgccagcagcagcactaccaaggaaggtccatccaaggaaagtggcgagattagtggccaaattgataggccttaattagaggggagttggtttccaaataagtcatttcctaaattagggtttccaaataagtcatttcctaaattagaagttacctagttggtcgggccagtggcctatttatatggaaccaatgaggcagtgaaaggaataagaaatacatcagctttacctcccatctccctacactctctctaaagcctacggctgaggattacctccccggagaagacggacagcgggtacgagttacgtagccgcggtccagctgctcgaggggttaacgcccttgacaacctggtatcacgatcccggcgatcctcttcccagtccaccactacgccagccgcagcaccaacatcaccgacgtcctctgtggcgtcttgcgtccagccc

SEQ ID NO: 14227 - DNA, 737 bp, Zea mays
ggaaacctcgtctgcctgccaccaacccagttcctcgcctcgtgaaaccaaagcgccgaccgaccgatcgcgcacgcacctgacgaaccaaccaacttggggaccaaccgatggctatggcgacggcgaagctgagctccccggcgaccagcttgctggctggcggccgcgcgcgccggtccgcgcccgcgcgccgcgcgacggtgatccgcgccgcggcaggctcctactccgacgagctcgtctccaccgcgaaatctgttgcttcccctggacgtggtattctggcaattgatgagtcaaatgcaacatgcggaaagaggctatcgtcaattggtttggacaacacagaacctaaccgccaggcttacaggcagcttttgctgacaactgctggccttggtgaatacatttctggtgctattctctttgaggagactctttatcaatcaactacagatggcaggaagtttgttgactgcttgaaggatcagaatatcatgcccggcatcaaggttgacaagggcttagttccattgcctggatccaacaatgaatcatggtgccaaggtcttgatggtttggcttcaaggtgtgctgagtactataagcagggggcgccgacagcaacgtggaggactgttgttagcatcccttgtggtccatctgcattagctgtgaaggaagcagcatggggacttgctcgatatgctgctattgctcaggataatggctta

SEQ ID NO: 14228 - DNA, 1578 bp, Zea mays
acctcgtctgccaccaacccacctcctagttcctgtttcaggacgcttattattctccgccgttggcgtcgtgaagcccgaagacaccgatctcacggacaaacttacaacatatggctatggcgacggcgaagctgaactccccggctaccagcttgctcgctggcggccgcacgcgccgatctgcgcccgcccgctgcacgacggtgatccgcgccgccgcaggctcctactcggacgagctcatctccaccgcgaaatctgttgcttcccctgggcgtggtattctggcaattgatgagtcaaatgcaacatgtggaaagaggttatcatctattggtttggacaacacagaagtgaaccgccaggcttacaggcagcttttgctgacaactgctggtcttggtgaatatatttctggcgctattcttttcgaggagaccctttatcaatcaactacagacggcaagaagtttgttgactgcttgaaggatcagaatatcatgcctggcatcaaggttgacaagggtttggttccattgcctggatccaacaatgaatcatggtgccaaggtcttgatggtttggcttcaaggtgtgctgagtactataagcagggggcgcgcttcgcaaagtggaggactgttgttagcatcccttgtggtccatctgcattagcagtcaaggaagcagcatggggacttgctcgatatgctgctattgctcaggataatggtttagtgccaattgtggagccagagattcttcttgatggagaccatgggatcgagggagctcttgaggtggcagagaaagtgtggtctgaggtgtttttctacttagccgagaacaatgttctgtttgagggtatcctgctgaagcctagcatggtcacccctggagctgagcacaaggagaaggcttctccagaagccattgcaaagtacacgctaacaatgctcagaaggagagtacctcccgctgttcctggaatcatgttcctttctggtggacagtccgaggtggaggcaactctgaacctgaatgcaatgaaccagtctctgaacccatggcatgtgtcgttctcctatgcccgggctctgcagaactcggtgctgaagacatggcaagggcgccctgagaacgtggaggcagcgcagaaggccctgctggtgcgcgcaaaggccaactcgctggcccagctcggtcgctacactggtgagggcgagagcgatgatgccaagaaaggcatgttccagaagggctacacctactaatgtgccagcgagatgtttccatgacataataataattgtagcgttttggtgttattattattattattttggtacgctctggtgaataataaccaaattgttggtgccaacgacatctagcagcaaattggtctttagaactcatgtagaaccttgagaacgaacatgtaatctggtgaattctattcctatatttgaggcgatggatgctaagttgccatatgcgacaagcacaacaggtgatttatgttcttttataaaaaacgctcaaaaaaaaaaaaaaaaaaaagcggacgcgtgg

SEQ ID NO: 14229 - DNA, 1348 bp, Zea mays
  misc_feature (1283)..(1283): n is a, c, g, or t
  misc_feature (1285)..(1286): n is a, c, g, or t
acttcctctcctcgtgaaacaaagcgccgaccgatcgcacacacctggccgaaccaaccaaccgttgtcaaacctatggctatggcgacggcgaagctgagctccccggcgaccagcttgctggctggcggccgcgcgcgccgcgcgacggtgatccgcgccgcggcaggctcctactccgacgagctcgtctccaccgcgaaatcggttgcttcccctggacgtggtattctggcaattgatgagtcaaatgcaacatgtggaaagaggctatcgtcaattggtttggacaacacagaacctaaccgccaggcttacaggcagcttttgctgacaactgctggtcttggtgaatacatttctggtgctattctttttgaggagactctttatcaatcaactacagatggcaggaagtttgttgactgcttgaaggatcagaatatcatgcctggtatcaaggttgacaagggcttaattccgctcccgggttccaacaatgaatcgtggtgccaaggtcttgatggtttggcttcaaggtgtgctgagtactataagcagggggcccgcttcgcaaagtggaggactgttgttagcatcccttgtggtccatctgcattagcagtgaaggaagcagcatggggacttgctcgatatgctgctattgctcaggataatggcttagtgccaattgtggagccagagatccttcttgatggagaccatgggatcgaaagaactcttgaggtggcagagaaagtgtggtctgaggtgttcttctacttggcccagaacaatgttctgtttgagggtatcctgctgaagcccagcatggtcactcctggagccgaccacaaggagaaggcttctccagaagccatcgcaaagtacacgctaacaatgctcaggaggagagtgcctcccgctgttcctggaatcatgttcctttctggtgggcagtccgaggtggaggcgactctgaacctgaatgcgatgaaccagtctccgaacccatggcacgtatcattctcctacgcccgggctctgcagaactcggtgctgaagacatggcaagggcgccccgagaacgttgaggcggcgcagaaggccctgctggtgcgcgcaaaggccaactcgctggcacagctaggtcgctacactggtgagggtgagagcgacgaggcgaagaaaggcatgttccagaagggctacacctactaacgtgccagcgagaatatttccatgacgttatacttattgttttggtgtttacattatacttnanncttatcgttttggtgtcaaaaaaaaaaaaaaaaaaaaaaactcgagggggggcccggtaccc

SEQ ID NO: 14230 - DNA, 557 bp, Zea mays
ggccgggccggggttgccggccggcccgggcgggctcttgggccatcctctactcgagcgggccgcttctcccatccagccgcgcacggcgtcgccggaaccggagaaaggaggggagggagcgcgagatggacaaagccaataagctcagcaccggagcgggggagaaggcgaccaagagcaggagccacgggtccacggcgctgttcgtcgcggtggactacgcgttcctgctcgtcttcgccggcttcctcgcctacctcgtcgggtcgcggatcctcccctccgccgccggctccgcctagaccggccggcgttcgtggatctctcttctttcttgcacgttttcttttttgagccgatggctgcctgcgggagcaccgggatcttgccgggcggttctcgtctcggtctcgatctcgatctgatgccgctcccgctatgtaatctggcgacaatttgacgagaagagaactagcggtgtgtttcttggcaactcgcctggtaatgtgacgcatctttccttaaaaaaaaaaaaaaaaaaggcccctagggac

SEQ ID NO: 14231 - DNA, 3111 bp, Zea mays
gggctgaatgtatttttggctaaatggttttggttgaaaaaaatacttatatataaaaggatttttgggttgcgccccgggccacggcccaggtggcccgaggcccaaatctgcccctgctcgtatattggtatgcatttatgttgttcttctggacaaaatcgataaaaaataaggctgtgaaatggtaggggcatttggtcctttttcttgtgaggtgaggaatagaagaatgaaaatatagatggagtgttgttttctgaattcgtttaatgaaactagtgttgttttttgaattgcttgaaaacgaatactatttcctaaacactgtcttaaactagcgttgttttgcgaattcctccaaccagactacccacaagcacacctgtagagtcgcaaaaaaatgtgtatctcacttctccattaccgaaccctttaaattttataaaaaactactgatatttatagtgtataataagaatataaaatatatttatataaatatataaaattatccttgttttaatttattttatatatttttagtcaaactaaaaaatattttgctcctcaaaaaataagatgtacatttattttgaatcaaatggttcatttgagatcgatccactccaactttttccaactctattccaaacttgtccaactactccaagaaaaaggtggagctaagtgtcagcttcatatttcggttgacctccttgataatacttgatagtcatctagagggagtgaataggcgacaacctgaaaaattaacacttatacaaaatatggatcccaaacaagttgtggaacaagagatacaataatcagagttagcggagatagtctttttgtacttgttgcttgttgctcgaatgtgtgcggaattaacttgagagcaaaataagtgtcaaatcaaagcaaagcacttagagatgaagtaattaaggaatagttatctcgcgtctgttgctcttgttgatattcaaatgacttaaagagcaatataagtgataaagagtgaaagaaccaagcaatagataacgtagaggaaagagagagaaaaccaaatcgcgagtgaaagtaaagaacataggaaaacatgggtgaaatgtttaccgaggttcggttctaaagaacatacgtccccgttgagatgtcccaaagcatagtctctctcaagtaatagaccgataaaccttacgtatgaccatagtgcatataaataatatatgttctaatacaaagttctagaggcagtttaagtttgtttaacaacacaatatatgaccatacatatgttattgttgcaccattttttccgttacaacgcacgatcatttatctagtagtttgtttatgatagtcaactcacaccagtttcaatcaaacgactttcaccttttttttcagacagcagacttttattttgagctaaaccaaacacacccattggcaggcgctgtttatttttgttacgcccggcttttttggtggtcgcgccgggcggccggcagatctcttgggtcatcctctacgcgagcgggccgcttctcccatccagccgcgcacggcgtcgccggaaccggagaagggagggaggaagggagcgcgagatggacaaggccaataagctcagcgccggagcgggggagaaggcgaccaagagcaggagccacgggtccacggcgctgttcgtcgcggtggactacgcgttcctgctcgccttcgccggcttcctcgcctacctcgtcgggtcgcggatcctcccctccgccgccggctccgcctagaccggcccgcgttcgtggatctctcttctttcttccacgttttttttggagccgatggctgcgggagcaccgggatcttgccgggtggttctcgtctcggaatcgatctcgatctgatgccgctcccgcgatgtaatctggcgacaatttgacgagaagagaactagcggtgtgtttcttggcaactcgcctggtaatgtgacgcatctttccttattctgttgctactagtactatccctgctcgtgtcgtgtgtgctgagagtctgagattgcttgggactttgaatgcggcgtttatgccgcgatctgtgatgtctgcttgctactgacgccaatttaaagtaaacccatcagcttgcttcctatcagaaccgcgacgcgttcgaccgcgctgatcactgggatgttgtccatcaagcgtctctggatgctcatcctcatggtcgtcgccgagctcggacacgacccacacgctccccgcagcttcagcctcaccacgttaccgccgtcgatctcgcgcaaggcgacgtcgcctccgtctgctatcaggtacgggcgcgcacctcgtccagcaccgactccacgtttccggtagtcaatggcagctggaccaccgtgttcaggccggcgtagaacaggcgagggttcagttgagctcataaaaagggcaactactgaatccttgagatcgttcagaattcagatgtacttgctctctaccagattccgcgcagcgaaacagttcgcaagctagatgcaacggcgcgcgagctaatcgttttaggagcagtgcgaaaccatgcagtttttccggctgaatcagctaagaattcctcgtcagaacatcacaggagcagtgcgaaacctctgcaagaaagctttgcgactggcaattgcagccggcgatgagggggatacctcaccatgcggacgccggccaatggacgtggcggtggcggcggccaatctcggagcaggactcccacgcgaccacagcgcgacacgcagctccacgccggaacatcacacccaattagcacacccaatctcggagcaggtctcttgtttgatggatgaatgaagtatgaactgaatatgatcacctttctaattatattaccatattaagaatggtatctttaattccaaaatgaaattacaacattcaaaataaaataaaatcaacactattttagtatttgagaaatccataagcacaacgaaagattggggcagctatttctcacctgctggtgtcggtagaggatatggaggtggtactggtggatggtggtaggggctggatcacggct

SEQ ID NO: 14232 - DNA, 2627 bp, Zea mays
  misc_feature (1727)..(1727): n is a, c, g, or t
ttttagtttagacactttttttttatttcctactacttttcatgtctattcagatttttgttctaaaaaaatacaaaagcacaagtggtacgagcatacagatattgaaatgcaaaattgcttaataatgttgggaaaaaacatataagtaaagttactgtataaactggacgttttatcttatgtcaaaagacatggtgccacactgcacatgaaactgtccttttatgaaaacctggtttgctcatacgtagtttcaaaaataaaaaaggggccacgcctggtgggataaaactgttccttttaaaaaccttgtttgtacgtggtgattggacgcagttaaaaaaaacaaaaaacacgcctggtgggactcgaacccacaatcgtctgattagaagtcagacgccttatccattaggccacaggcgcacgagaccattacctagaacatcctaatcaaaaaacaaatgagagataagcatatcagatctcttcgatcatcctgcagatctctattcgaccgcggcgaaccagtgaaccgccacttcgcccatccaggctccagccccgcaccgcgcgagtgcacaacgtcgccggaaccggagaaagtgagggggagctggagatggacaaggacaataggctccgcgcccgagcgggggagaaggcgtccaagagcaggagccacgggtccacggcgctgttcgtcgcggtagactacgccttcctgctcgccttcgccggcttcctcgcctacctcgtcgggtcgcggatcctcccctccgccgtcagcttcgtctagaccggcccgcgttcgtggatctctctcttttttccttccacttttttttgttgttgttgtttgcttggagccaatggtggcgagagaaccgagatcttgccggccgggtggttctcgtttcgatctgattgccgctcatgcgatgtaatccgaccgcattttgacgagaagagaactagcggtgcttcttggcagttcgcttggtaatgagacaaatctttgcctgttcagttgctagtgctgtccctgctcgtgtgttgagattgattgggacttgatctagcgttgcttgtgtgttgagattggttgggacttgatcgagcgttcgtgtcgtgatcgcggccgcctccttgctactgacgccagctgaaagtaaatctatcagctagatggatctcatgcttcattttcgatatgtgattctgtgattcaacaccttcttctccttctagcccgccactattaaactaaaaattggattgaaaacatgcactgagattttatcttcgccaatacataataaaacagccatggagttctgttcaacactggtttagtttcgactttgcacggtcttctcctcactcttctccattactcttgctcccaaacaagcactactgtctaacggcaacgatcggatagcacatctacattgtatacttgaatggtcctgttggagctaacatacagatgtccacaaaattatgacagttgtgttcatcctcttttgtgaacttggcattatctattggagagtgttgtagattcttttgttagctggtattatgccaggcgctagatttagtttgttaagaggtgctaagagttaggcaataattaagaaggtttatcctcttgggaggattatcctatccactataaaaatctgtaatgtggttaggctcctgagctataaaagtgnccttaaattgtattagggaaagcatcaaagaagttgtatctgtgggtgcggctgcttgatcactctggcgagcttcccgccatctggtgatctaagtctccaaccgccacacagcatgtcctactccttgcgttcttccactcaatccaccttgatagcccacccttcgccttgatagcccacccatcgtggtgcacttctccccgtcctgcacatcgcagtagggttcaccatagagagctgaggagtcgggcctaccagatcatcctcaaatttgtacgtcggcaggcttagctggttttcaagcaacatctcgaatattactctggtatctccaatcgcatcgagtacttctatttctaacagggaattagagtagtaactgttagcatagacatggtgaatttgcatccaaccccacgaatagttgtgatagctccaagtggtgatagccttaaccatgggttggtatttgtagtaccttagtcagaacttcctagcccccttctcatccctatctatggctagtgttctgatgtctccaagtgagtaacttgaagtaacatgatccttgattcattatattgccccagaaaccttaggaaattcctctctacccataaaaacatttcatctcttatccttggataaacatggccttcatttatagtataacttatgttccttatggtgattgaaacattaaggactagtttaggaaccccattttttttaaagagatttccatttttcaagggaaattatttcgttttcccttgggaaaatagaaatcccttgaaaaaatgaagctgcaagggtacgtgtgtgcttgtggatttatctatttgtattaacaaaatattagtaatcacctactccctggccccacgcatcaaaggc

SEQ ID NO: 14233 - DNA, 759 bp, Zea mays
atttttgttcggacgcgtgggatttggtggtgcaccggcgcggccggcagagctcttgggtcatcctctacgcgagcgggccgcttctcccatccagccgcgcgcggcgtcgccggaaccggagaagggaggggaaggagcgcgagatggacaaggccaataagctcagcaccggagcgggggagaaggcgaccaagagcaggagccacgggtccacggcgctgttcgtcgcggtggactacgcgttcctgctcgtcttcgccggcttcctcgcctacctcgtcgggtcgcggatcctcccctccgccgccggctccgcctagaccggcccgcgttcgtggatctctcttctttcttccacgtttttttggagtcgatggctgcgggagcaccgggatcttgccgggtggttctcgtctcgatctgatgccgctcccgcgatgtaatctggcgacaatttgacgagaagagaagtagcggcgtgtttcttggcaactcgcctggtaatgtgacgcatctttccttattctgttgctattgctactagtactatccctgctcgtgtcgtgtgtgctgagagtctgagattgcttgggactttgaatgcggcgtttatgacgcgatctgtgatgtctgcttgctactgacgccagcttaaagtaaacccatcagctttatctccaaaaaaaaaaaaaaaaaaggcccctaggcctctccttccgtttctcgggatcgtcgacacctccatcggcctccgat

SEQ ID NO: 14234 - DNA, 1197 bp, Zea mays
catgacatgtcatctcctgtatcccccatatacttttatgggccaccaccaccagaggctcttaggggactggctattgctcctcctatggttggtccacctgcttatccttacttccaagcgcagcctgagccacagcctgagcctcagcctcagcctgatgctgagcctgacgtagaagaggaacgtgtcaagctgctcaagcagatagagttctacttcagcaaggagaacctgtgctcatatgtttacttgaggcagcagatggatgatcagggctgggttgatatatctcttatagctggcttcaaaaaggtccaagggctaaagaaggacctgcaatatataaaagagacggtgcagtcctcatctattctggaaatgaaggataacaagatcaggaagcatgatgactgggtgaaatgggtgatccctcgtgagagcaatcctgatgtcccgtcaagctcagcatctgtaccaaggcctgatgtcaataatctgacggcacatattggaggcatggatctgcaggattccgctagctctgctggcgctgtggagccgaagcataatgatgtggtccagaacggatcgccttctggtaatgaagaggctgcagtagctgaggacagctctgatcagcagtagttacaacaagacagtggtttggattcacaccatgactgcaggggttttgtcggtgcgcgaatgacagggcacaagtggtaacttttttttggcaacttttggaggggaggcgagaggcgtattagactgacaagcgaacgtgtttactggcgttcaggtaagattttgctttaccttgttatattcaggggtagcgatgaagatttggggcagttggtggaatggagatgaagcagaatagtgggaaaacgaaggtggtgatatctggaggcgcctaggaccgaggacaaagattatgtgtgataagttagtagcccccctggtggggttgcgtttgcacacgggcgcttggatgctaccatgctgttgttacgatgaactagttggttttcgtctgcgttaggatgggggatgttgtaggacctccgattttttttatggaggagctgaacttggagagcctttttttttggacttgttgttttgtggcatgatggtgttaaattgaagtaagaagatgctcattctgctgtaaaaaaaaaaaaaaaa

SEQ ID NO: 14235 - DNA, 737 bp, Zea mays
caataatctgacggcacatcttggaggcatggatctgcaggattctgctagctctgctggcgctgtggagccgaagcataatgatgtggtccagaacggatcgccttctggtaatgaagaggctgcagtagctgaggacagctctgatcagcagtagttacaacaaggcagtggtttggattcacaccatgactgcaggggttttgtcggtgcgcgaatgacagggcacaagtggtaacttttttttggcaacttttggaggggaggcgagaggcgtattagactgacaagcgaacgtgtttactggcgttcaggtaagattttggtttaccttgttatattcaggggtagcgatgaagatttggggcagttggtggaatggagatgaagcagaatagtgggaaaacgaaggtggtgatatctggaggcgcctaggaccgaggacaaagattatgtgtgataagttagtagcccccctgtggttgtttactggggggggttgcgtttgcacacgggcgcttggatgctatcatgctgttgttacgatgaactagttggttttcgtctgcgttaggatgggggatgttgtaggacctccgattttttttatggaggagctgaacttggagagccagggagttttttttttttttggacttgttgttttgtggcatgatggtgttaaattgaagtaagaagatgctcattctgctgtaaaaaaaaaaaaaaaaaaaaaa

SEQ ID NO: 14236 - DNA, 1400 bp, Zea mays
cctcgaggccggccgggagacttgatcgccatcagtgtctactcttctaatgtttgaacgcagagcatcttccgcgaaccagtaaaaaaatgtggtttcatctcaattgtggacgagtttacatgcaacatttcgattcacataaagtctagcgtaccaggacgtcttgaatttcttccaaaatattccaaaatgggctatcagcatccgaaggcacgatgaatttgggagctggaactacagttcgtcaccctgttcattcattcagaaaagtgcggtggtttctcgtgaacgagcaacccagaaaaagtacacctgtcgcgtaagcgtcctcaggcagcagctccccggtcgcggtctctgtctctctgaagggaaagctctgtttccccttcccggtgccggagtcggggaaggtcaccgcgggcgcgagccgatggacagcaacaacctcctggcggcgtggccggtcctggggccgggcgtcgccggcgccgtattcggcgcaggctggtggttttgggtcgacgccgtcgtctgcagcgccgccgccgtgccattcctccactacctcccagggttcttcgcctcgttcgccgcgctcatgttcaactgcgtcaaccgggaggacatcggcgatggctactactcaccgtacgacgactccgagtggagggtgaagctctggctttttatttcgtacgtggtgtcgtttgtttcgctggccggggcagtgggtttcttggttcaagatgcgcttacggatacggggccatctgcgtggactggcagtgctggcatcctgcagtgcgtgtttgtgttagtgagtgggctgatctactggacgtgccactctgaagattgacttaagaagtataggtatatatggccaaggaggaggaggatggagactgcttttctcagaagcgattgcttttccgtagtacgtttctggaggcacctttggaccgtgctttccgaaacgggtggaataaagagccattttctagttgtttcaagagagatgtagataagctgtactactattttacacgtgtttatagtcgtgtatcatgttgcttaaaactactttgtgaggtgttgttttggagcaagaaacttataggggtgctaagtactcgctctgtttctttttagctgtcgccggatagttcaattttgcactatacagcgacaactaaaatgaaatgaatggagtagtcaggaaacatcgttacatttttccctgttggcgaatttctcgtgcaaggtttgacaactctagtctgctcctgtacctcccgaggaagtttggtgttgccaacattttgtagacgcctagtcatgttgtgtctggttggttggaggcctgccaggcaacaacacatcttggcccaatc

SEQ ID NO: 14237 - DNA, 4144 bp, Zea mays
ttgtagatgctcttagtatgccctatgggactgggagagcacatgttctgttcctaaccttgggaccttggcaacgccttacatacagttatgacctcagctcaacagctctgaagctagcttacgtagccatgataggttcagtagagcaacacaactaccggtccttgcgaagaacgactggtctccaaccaagcaaaccttcgatgggcgtcgtcgcgtcgaagctgtggcatgccaggacaggactgcagggaggaagcgacacgacgcaatgagagatccgtgtcggatcctgccccgcaccgaaagccccgacggcgtcggccggcctagcagccattcatcatgatccctacgcgcgcacctgcgcatcctgaaacgaaacatgcgccgaaccggacggggcgacagggagggaagacgccgaggacacggctcgcgcggggacgcgacgggtctcctgcgccgcgccccacacccacctcggccccaccggcggcggcacaggctccggtggaacaccgaactgcaggtgcggccgggtgtgtctcatgtttgggcgcgtgggagcaggcgagcagcccccggcaactgcaatggcaggtcgtcgaaacgaaaccccggctccacccaccaccgcgtccaccggcaggcacggccgatacgcgcgtgggcgcagtccgcgcggccgcggcgcagggcgcaaatggtaacaaagatagcaggccaccagcgttgggactccaacccaccgatcccaaagcccacgcccacgcccacgcacgccttgtcgcagccaaagccacaaccaaacgtccaaacgtggccggccgttgcgaccaggcgaggcctggaccagagcggtgaaattagttgtcgtatcaagaactgacacaagcagatcattgcttttcctggcgtgcttccaaaggagattttttttccaggcactgactccgaagctcccgcacggatcagatcatcattagtcccaggtgacagtacgagattaggaggagacagggcggccacagcagagcctattaataatttaagactacgaatgaaattaataaagagtagacagcaggagaagaaagtgacagatatgccacccgtgacacggccgcgtcagaggaggcaaggagggttaacatgggaacgagggggttgtacttgcagaagtagtagtagtacgtagctagtgaacggctgacggttacctagagctaattaactgttacatgaacctaagagtgattaaaaggagccgattaggcgcgcgaggcaagacgcaagagtgggaaagtgccttcggtcgtcggctgggctgctagacgctgatgggagacggggaaggggaggagacagcggcgcgtggcggggagtcgtcggtgtcgtcatcgtcgtcgtcgtctccgtcgccggtgatgccgacgccggttccggtgccggtggcggtgccggcgccagcggcggggctgaggccgatgcccgcggctgcggccgcggcgacggagttggaggcgagctggttcttgtggttgtgcatccacaccttgagcacctgccgcttgacgccgatctcgtcgcagaagcggtcgagggcgccgtcgtcgttgcgctggatgcgccagccctgcttctccgcgaactcgcgcatccgctccttctgctccggggtgaacttggtccggaaccgcttgcgcccgaagctgccgctgccgctgcccgcgccgctgccgggcgcgaggccgacgccgaagtcgtccaggcgcggcggcgtctcggagccggcgcgcgcggcgagccacgggggcgcggcggcggcattgggcacggcgtggtacggcagcgcgaggtgcggcggcggcgctggcaccggcaccggcaccgacgggaggaagccctgcagcgcggcctggtggtggtgatggtggtggaagtgctgctgcggcggcgcgggcagcgcgggcggcggcggcgggcggaagaagacgggcggcgcgcacgggctcgccgccgccagcgcgcggcggtggaagctgcggtggcacccgcacgccgcgcacttgagcgtgtccggcgaggacgccatgtactcgccgcagccgtcgaacgcctgcccgcccatggccgccgcgtggttgcgcatgcactccttgtacttgccgcccgcggcgtcgccgccgccgccgccgccggccccatcgtagggcaccaggctcaggtgatccatcatgtcctgcgtcgtctcccgacccaaccaagtggtccggtggtggggctggtcccttccctcacgcccgacgtgcggggtggagcctgtgtctgtgtgtttgtcttcctcccctgcctgcgcctcctccacctggctatcactcgcagtcggcagtccgcaggcaggagggcggcagggggatggattttatccgcgcggggctcggtcgctgtctcagccagccccccgcgtgcccggcacgagcacagcgattaaccttaacacacaaagccccctatcaaacgccctgctaggatgattaataagcggcggtgcggcgccacgtggcgtgcggcagcccctgagtccccggccctgcgctcgcccacgtgaggccggggcagccggacagggaggtcggttcggggtcttccgactccgggacacgggacgaaagccaagggggggacggacgtgtcgaccggccactgggtggcgcggtaacagtaacggccgtgccgggtttccccgcgggggccgggcccgccacgttgggtgcggcggcggtggtgcctctgcggcggcgtcagacgcgtaggcttgcccggacggacggagggggggcggtgaggtatgggcgaacagccaggcgtccgtccatagccgtggcttggcttggcgtggctcgtcttgtccccaggatcctctgcgccgtgcgtggcgtgggggcggaccgtgcttcgtgcacggacggacggcgacggactcgtgatcactgacccgctcagctgccctgcaattacgcgcggcagttggatctctgacgaaacttacgcttgcctcccacacccacacgggccacgggcatgcgccgtgaagaggcaggcttatcttatctcttgtctccgctaagcggcagggccgatgaataaattgcagtctccgttgattcattcatggtgatcacacgacgcttacacctgcattgatcgcctggcttactcccaccgacgtcaagcacgcgtgcacagtgagaaggccgctggggcgcagcgcagtaaaggctagcgagaggggatcggatatgccttgcgtccgtgacagctgagagatctctccgtcgccgggcccactgcccccggctctacagggtactactactgctcctgctcggggcacgctctcctcctgccgtcctgcgtatgcacgcatgcatgtatgatttctcgtcgccttcagttttgtgcttgcgcgtgctcgctgcgtcagtcaggtaggtcgcgtccatttgagtggagtcggcaagcagccaggcaggcaggtggtgagcaaagcaaacgcgatgctctattatctcgcacggatatttgccgttcacgggcgatgattgatgacatgatccccgaactgaacccctggctggctacgggagagagagagatgggcagagtggtggacggtggtggtgggcgtgggggaacacgccacgccagcgggggccgggcaatcaatggctcgccccccatgcgtcgtcctattcctacctcctctcccgctcacacggacacggagggaggcgtaggtcgatcggccgcataatgacacgctgctccactgcttgcctagagatagcatcgctacagtgctgagcttgcatggttgggaggacacaattcagcttgaggctggccgcactgggctactggcctactgcaaacgctactcgacgcagcaatagagttcaacacaagcgcagcggcggactcgattcatacgctatctactgtgcacggcagcagaaacgctagcaatagcgtcggacgcagcagaaacgctatccactgtagcgtacgagtggaggtggaggccagagagtgggtggtggggcccatggtgggtatttttgatatatattgataa

SEQ ID NO: 14238 - DNA, 2973 bp, Zea mays
  misc_feature (17)..(17): n is a, c, g, or t
aattgaaatatttaganagtatgtgcaccaccttgttttctaaattctactttcttagcacagcgttgcatttttccacagtaaactacattcctgtgtaatatgattttatcttatagatactcatgttctggatgtgccacttcagtgcttgagagcctttttcacttgctaattggtcctggcatggcatgttcgggcacgtcaacgtatctcacggcaagagaaaaataggttgaatcttctgaaaattggtgatcaagtagcatatatgaagatggttgaggagagcaagaacgaacgtctgaaaatgctccttgacaaaacaaatgagcttcttgaaggaattggaaaagctgtgcagcgacaaaaagatgctgagcatgttagtcagcatgaagggagtgaagtgccaaaagggtcagagtctgaggattgctctcaaatctcaggcgtcaagagtgaatcacctggggaatctccttcagatgacgatgcagactttgctggctctgcagatgaaagtaaattcaatgcaggtcgtagacttgattttactgtccattccattgaagaaaaggtgactgaacaaccatcagctctcgaaggtggggaattgaggccatatcaactggagggtctccaatggatgctttctttgtttaacaccaatttgaatggcattctggctgatgaaatgggtctgggtgaaacaattcagaccatagctttgatagcttatctgttggaaaataaggaggttgcaggaccacacttaataattgctccaaaagcagtattaccaaattggtctaacgaattcaaaacctgggctcccagtattgggacaattctgtatgatggtcgtccagaagagaggaagcttttaagggaaaagaattttgatggattgcaatttaatgttttgctcacgcattatgacttgatactgaaagataagaagttcctaaagaaagttcactggcattatttgattgttgatgaaggacatcgtctgaaaaatcatgaatgtgctcttgctcgcacactagtttcaggatatcagatccgccgcagactacttttaactggcactccaatccaaaatagcctacaagaactgtggtctttgcttaactttattctgcccaatatttttaattcatctcagaattttgaggaatggtttaatgcaccatttgcatgtgatgttagtcttaatgatgaggaacagctattaatcatacatcgtctgcatcaagttttgcgtccatttttgctgaggaggaaaaaagatgaagtggaaaaatatctccctgtcaaaacacaagtaattctcaagtgtgatatgtctgcttggcaaaaagcatactatgaacaagtcacaagcagggaaaaggttgcactaggatttgggctcagatcaaaggctctgcagaatctgtcaatgcaacttaggaaatgttgcaaccacccctatctatttgtagagcactacaacatgtaccagcgggaggaaattgttagagcatcagggaagtttgaattgcttgatcgtctacttccaaaactgcagagagctggtcacagggttctgcttttctctcagatgacgaaactgcttgatgttttagaaatatatttgcaaatgtacaatttcaagtacatgaggcttgatggatccacgaagactgaagaacgagggaggttactggcagattttaataagaaggattcggaatatttcatgtttctcctcagcacacgtgctggaggacttgggttgaacttgcagacggcggacactgtcattatatttgatagtgactggaaccctcaaatggaccaacaagctgaagaccgtgcccatcgtatagggcagaagaatgaagtgcgtgtgtttgttcttgttagtgtcggctccattgaagaagagatcctggaccgtgcaaaacaaaagatgggtatcgatgcaaaagttatccaggctgggttgtttaacacaacttccacagcacaggacagacgagcattgctgcaggagatccttaggagggggacaagctcgctgggaacagatatccccagtgagcgcgagataaatcgtttggctgcacgaactgatgaagaattctggttgtttgagaagatggatgaagaaaggaggcttagagaaaactacaaatctagacttatggatgggaatgaggttccagattgggtattcgccaacaatgatttacccaagagaaccgtggcagatgagttccagaatataatggtcggtgcgaagcgacgtagaaaggaggttgtctattcagactctttcggtgatcagtggatgaaatccgatgagggatttgaagacattccaaaggcgactcagaggtcgaagaagactgcttactcatctgacatccaagttgagtttagtgaaaggaggaaaagacctaggtctgtagaaaacagcgcagacggtgtgagcaacccgacgtggacgcctgacaaaggaagggctggagtttcatcatacagcaaggacgagactgaagatgatggcgaagacgaagtcattactagcggcttacaaaagggaaacagtttcacatggaataccctaggaagaagaaggtcaagccacttcagttcgtcatcggactcgagagggcgcccaacattctaatggcaacatacatgaatgttatggcctcgacctgttggttgatggaatacccttgtagagcagggctgcgactatgactgagtaccttcaagcttatgaactttattaggattactagtatactgtatggacttgttggcatgaatttgtaactcctttaaatattaattgtttaaacaactggtggtgtttgctatcataccgcgccgacatgtttttatttttttgctaatcaaagtttttgtggccaggttttattggtgtcggggcccatagcaaatgcttttgat

SEQ ID NO: 14239 - DNA, 1439 bp, Zea mays
cttcaatccctctttatccaaacaacaaacaaggcctaaagagtcggacttgccacgcggtcggtcgcggcttcctgggctagcaggcttcttctagatacgtgggctgcgcaactccctcaggcccaagcttaagcatagctacgctgcgcgccgcggccccgcccggcttgcctctccaaacctccgcatcctggaacccgccccgccacgccaccgccatctccccgcgccgccggcctaaaacctagccaagccatctcccccgcccgaaccttccaacgccggccgcttcctatctcaaccactcgccgctccgtctggtcttccttcacgccgattacgtggcgcacctactcgtgctcctcacctacgtctccagcgcttctgctctccgccgccacttccgtcgctcggtcaccgttgactgctgctacggctagctgggtgttaactgaatcgtaggaatttaggaaatatagttggcacagcccgccacggcatggaggtcgacggcgaggcacaacatttccgcctcttctccaagagggccaagcccaagctcaagcccgaggtccagccccagccggagccggaacccccaagccgtgaccccgccgcccccgaagcctacctcgaccctgctcccacaatcgtgaccgagaccggccaggccgacgacgcggcggacgctgccggcacggcgccggcgaccttcgcggaccttggcctatcgcagtggctggtggatgcgtgcgaagccctgggcatgcggcgccccacggcggtgcagcgccggtgcattccgcgcgcgctcgcgggggcggacgtgctcgggatcgccgagacggggagcggcaagacggccgcgttcgcgctgcccatcctgcaccgcctcggggaggccccctatggcgtggccgcgctcgcgctcgccccacgcgcgagctcgcggcgcagctcgccgagcagttccgcgcgctcggggcgccgctcggcctcaggtgcctcgcggccatcggaggattcgactcgctcgcgcaggccaaagggctctcgcgccgcccccacgtcgtcgtcgccaccccaggacgcattgcgacgctcgtcaaaaacgatcctgacctcgccaaagtattctcccgcacaaaggtaggcatgcggtttccttttagcatcaacacatacattattgttgctgtggatgcctttatcacttcccttctctttgctcaaaatgtatgttgatgactgtcgtgtttttctctccattgataagggcatattactattgtaatctatgttatactccatacggaacatacacttctttattcacttatattccttgtgaattttggaagtagaaaatgtagttgacatgttctattgaaatgtaatggtcagttggtcacagacctttgtctgcctgtatagaa

SEQ ID NO: 14240 - DNA, 5967 bp, Zea mays
  misc_feature (4513)..(4513): n is a, c, g, or t
  misc_feature (4847)..(4847): n is a, c, g, or t
  misc_feature (5186)..(5186): n is a, c, g, or t
ctgcagatctcgcagccaaggcaggcgccacatatcagtgactaagtttagaaagatctggagaacagagccacaaaacaagtaatgcggactctgagagtcatcacagagaaggcaagcatcaaccagcaagctgttaaggattatgagaatctttttcagcatcctttaactcaaagtcatgttgaagcgttagcggctctctttggatgggagactccggggaatctcttcccgtagtgtgtttttctttctgggttgtaatttataattgttgtaatggatcctagcaaaattatatgttggaatgtgagaggtttaaattcagctgatcgtcaaaattcagtccggaatctagttctgtcctctaaagctgatgtggtctgtctccaggaaactaaaatgactgtcatttctacaagaaccattcttgcagccttgggttcggatttctgccagttctcctttctaccatcttgtggtgctagtggtggtgtgctggttgcttggaagcgacatctgggagtgactgggttgtctaggattgacagatacagcatttcaatccaattctgcaatgcgcataatcgctgctggtggttaacttgtgtttatggtcctcaaagtaacagtgataagatgttgtttcttcaagaactgagagacgtcagggctgcttgcactggaccctggttgattgctggtgacttcaatctcatctacagggcttcagataaaaataattcaaatattaacagagctatgatggggagatttagaaagttggttgaggacttgagtctcaatgaggttccactatttgggcgtaaatacacgtggtcaaatcagcaagacagtcctgttcttgttaagcttgacagggtcctctgttcagtggagtgggaagacatatttccaaatgtccttcttcaaagtgctgcctctgaaggctccgaccattgccccctgctgcttggcattagagataataagatgggtaaaagacgtttctgttttgaagctttttggtccaaattggaaggattccaggatgtcatccaggaggtttgggattctgtggcagctgtaaactgccctttcatgactctgaatttgaaactaaaagccacagctaggaagctgcaatcttggagtgggaagcatgtgggacatgtgaggactcagttggctttggcaaaggaaattctgcatagactagaaatagcgcaggactgcagatctttgtccttggctgaaatctggttaagtaatttgctgaaaaagcattccctgtttttatcttcacttcaacggaccattgctagatcgagatcgaggatctcttggcttaaagagggggatgctaataccaaactctttcatatgcactctcgacatcgaaaaaggaggaattttgttgcacagctggtgaatggagaccagattctcactagtcatgatgataaagcagttttggtggacaatttctacgccagactaattggtgaatgtggggatagggagcagactattaatctggaggcgttgcacatgccaactttcaatcttgcacacctcgatgagcctgttacagagcttgaactttggaatacaactaagagtttacctaatgacaaggccccaggtgaccaggtcccgatggtttcactgggcgcttctataaatcctgttggaacattatcaagatggatcttatggctgtagttgctgcggtttggaacaggaagtttgacaatttttgcttgctgaactcggccttcattactttaatcccaaagcatgatggggctgtgcatgtcaaagactttaggccaatcagtttggtgcatagtgctgcaaagttgatcacaaaattattggccaatcggttaagtcaaaagctgaatgatatggtgtctccaatccagagtgccttcattaagggacgtttcattcaggataattttatgttggtccaacaaacggctagacttttccatcaacagaaaaggccacgtcttctcctcaagcttgatattactaaagcttttgattcggtttcttggcctttcctcatcgaagttatgaagtatcttggctttggacaaatttggagggacatcatttgtgggcttctttcctcctctagcactcaggtgcttttgaatggcagtccaggaggacatattgaatatagaagagggctccgacaaggggatcctctctcccccatgctctttattctagttatggatgttcttggtctactgttttctaaagctgaacacgctggtctgctcttggatctttcccccagaagacctctgcatcgggtttctatgtatgcagatgatgtggcactcttcttacacccttcggcagcggatattgctataactctagatattttacatctatttggggaagcttcaggtctccgcaacaacgaacaaaagtctaatgtttatcccattcagtgtgggggtgtggagttggaaatggttcaggatcttctcccttgtggcatctcgacctttccgtgtaaatacctggggctgcctctgtccctgaaaaatctcaccaaggatcaggtgcagcctattgtggatagaattgctgatcagctgccaggctggaaagcagatttgatgacaagagcaggccgtaaagtgcaagttcagcatgtgcttaccggaatgcttatttatcttgctatggcagtaaatattccctcttgggctattaaggccattgataaaattagaagaagtttcctttggagagggcgcaaggaggccagaggtggtcactgcctggtggcctggggcagagtctgtagacccctacagctgggcggtcttggcatttctagtcttaaagaacttatctgggccctgcgcatgagatggctttggctccaaaagactgagcctaaccgaccttggtgcagccttcctatccaggttccggataaagcaagggctttcttctcgatggtgttgacttcaaaggttggtaatggggctaatactttgttctggactgataaatggattcatgggcagaaaattgcagatttggttcctagattatttgatatcattccgaaaaaaatcactaacagaaggacggttcaggaagcattgacagatagaagatggattgctgatatcacaggatcactctcggtgggagtattattggattatcttcatctttggaatttaatttcagattttgagctgctgccagatatagaagataaacatacttttagtattgctgcaaatgggacttattctgctaaggctgcatatgatgggttgttcatcggggctgtgcatttcggtcactatgaaagagtttggaaaacttgggccccctctaaatgccacttcttcctctggttatcggtgctaaataaatgctggacagcagataggttggcaaagagaggacttgatcatccggagaagtgtccgctttgtgaccaagagtctgaatctttggatcatattttggtttcttgtgtttttgcgagagaattctggttccggctgaaggttgatgtgcattttcagactacaaaatctggctcctacacctagtacggtgtcttttacgggttggtgggagatgatagacaatggctccggagatatgattatgaagggtgtcaactcccttattgccttgggagcctggattatttggaatcatcggaatcgaattgtctttgatggaatctcccctagtgtttctgcagctcttcgtcaggcaagggaggaacaacagttgtgggaaatggcaggagctaagggtctctcctttcttgccgcaaccatcaggggcacctagctgcctggtttatcgctgatgggctggttttgtttttcaggatctgtttgctcttgtttttgtttttttctcttcttttttctttggttttttatcccctccggggaggtcttttgtactttggtctattttggaccctcttttccttctacttaatataatgatgcgcagttctcctgcgctttcgagaaaaaaaaagagtttctcccttgcattaggattcgctaatcaaggttgaactgtaaccgcaaagcactcctctataagtttaggtgtagcaaatatatcacattttttttgttacacttgaattttcaatttgcttaaataaacaaagcaaagccaccagtattacaattgtgacactcctaagctttatgctataaaagtgaggcaacaaaaattcactaacgaatcataatgtagactagtcaaatgccagattccacaataccacaaccatccaagacatgagcacaagcaagaggcacaaacacatcggaatttcggatatagttcgttcatcatgttcatatagacgacatggcgatcccgcagaactggatccaactccgactcgccgagcaaaaccctagggaggctgggggttttggggaatggttgatctgatggttgatagtggggagccttcccntcactaatattggttggttagtgggctattggcctattaatgggtcactttgcaggcccgactggcgactggtggcctggaaacatcgggccgggctttcatagatgaaaatggccgggctcgacatttagtcagccaatgtcgcgtactgaaaaagaaaagatccatcttcctgataaattgcaatgtgatgggcgatgatatggtttactgagaaagaaaaagaaaagatcactcgtacgagcacatcaacaatgtcgctatcattcgttgaacactttgcttagatgttaggtatgctttcccgcatatccttctcgcctctgctacgccntgcgctaatgttgatagaagagctatggggcaagtacttccacggcgagtcatcgttaccatgatgcatgtataaatggtcaatctaaagttgttaccaaaactaaagggcatgtttatatatgagcctttttctatgtatgttactctccgttccaaaatatagtcctttggagtcctcttttttttcggtccacaaatgggtgagaatgaatttagacatatatacaaactacattcataggttaattaatgaatgcatgtttagtataaaatgaattatattttggggatgaagggagtattagactatttttagtggaaattttattttagtttnattttcattaaatatatcgccatataagcaaggatggtgacatgacaagaatttaataagagaaatagtgagagtttaacgagaggtgagagagtttcatctagatgaaacttagcatacatgatttcgtagataaatgatgatgtgtcattctcgaaaacagtgcaatgaaaaataaccttatgacatgtacagccctgatgagcccctcgatggttttccacgtacaagtaatagctaaatacaacattatactattctgatccttagatcataaatatagtaaaagacaatatgtatagagaaagacgaccctctagaaaccccgtaggaccccatatataatgagcacggttatacatgcccttatggaagtttataattgctcacaagttattactaaaaaaagttgagtggtcaccatcggtgttgagtagtccaaattttttgtttctatcaatgccacttttcatcagatttggctctaacagtgttaaattacggtgataaatatttaaaatagcctcaggtctaaatgatcttaaataaaaaaaaactcaataatagaaacttattgatctctttattaaaaatatatatttatttaacttcattaaaaagttttttcagttaagaccattaaaagctaaaaattaacatgtttataactaatttggaggcaatggaggccaaacatatggagaaaaaatctctcacgaagaactaaatgtcttacttaaatggcaccctataaaaataacacgatgcaaagaggatttga

SEQ ID NO: 14241 - DNA, 2992 bp, Zea mays
attaatcttctgaaaactggtgatcaagaagcatatatgaggatggttgaagagagcaagaatgaacgcttgaaaatgctccttgataaaacaaatgagcttcttgaaggaattggaaaagctgtacagcgacaaaaagatgctgaacatgttagtaagccagaaggagggagtgaagtgccaaaagggtcagaatctgaggattgttctcaaatttcgggcatcaagagtgaatcagctgaggagtctacttcagatgacgatggagacctccctggccctgcagatgaaagtaaattcaatgcaggacgtagacttgatgttactgttcattctattgaagaaaaggtaacagaacaaccatctgctctcgaaggtggtgaattgagaccatatcagctagaaggtctccaatggatgctttctctatttaacaacaatttgaatggcattctggctgatgaaatgggtttggggaagacaattcaaaccatagctttgatcgcttatctgttggaaaagaaggaggttgcaggaccacacttaataattgctccaaaagcagtattaccaaattggtctaatgaattcaaaacttgggctcccagcattgggacaattctttatgatggccgtccagaggaaaggaggctgttaagggataagaattttgacggagagcaatttaatgttttgctcacacattatgacctgatactgaaagataagaagttcctaaagaaggttcactggcattatttgattgttgatgaaggacatcgtctgaaaaatcatgaatgcgctcttgctcgaacactagtttctggatacatgatccgccggagactacttttaacaggcactcctatccaaaacagcctgcaagagctctggtctttgcttaacttcatcctgcccaatatttttaattcatcccagaattttgaggaatggtttaatgcaccatttgcatgtgatgtcagtcttaatgatgaggaacaactactaatcatacatcgtttgcatcaagttttgcgtccatttttgctgaggaggaagaaagatgaagtagagaaatatctccctgtgaaaacacaagtaattctcaagtgtgacatgtctgcttggcaaaaagcgtactacgaacaagtcacaagcagggaaaaggttgcgctaggatatgggatcagaaagaaggctctgcaaaatctgtcaatgcaacttaggaagtgttgcaatcatccctacctattcgtagagcattataacatgtaccagcgggaggaaatagttagagcatccggaaagtttgaattgcttgatcgtctacttccgaaattgcagagagctggtcacagggttttacttttctctcagatgacaaaattgcttgacattttagaagtatatttgcagatgtacaatttcaagtacatgaggcttgatggatccacaaagactgaagaacgtgggaggttactggcagattttaataagaagaattcagaatatttcatgtttctcctcagcacacgagccgggggtcttggattgaacttgcagactgcagacaccgtcattatctttgatagtgactggaaccctcagatggaccaacaagctgaggaccgtgcccatcgtatagggcaaaagaacgaagtacgtgtgtttgttcttgttagcgttggttcaattgaagaagagatattggatcgtgcgaaacagaagatgggtattgatgcaaaagtaatccaggctgggttgtttaacacgacctccacagcacaggacaggcgagcattgctgcaggagatactcaggagaggaacaagctcactgggaacggatatccccagtgaacgtgagataaaccgcttggctgctcgaaacgatgaagaattccggttgtttgagaagatggatgaagaaaggaggctaagggagaactacaaatctagacttatggatggaaatgaggtcccaaattgggtgtttgccaatgataatgaaaccttacgcaagaaaaccgtggcagatgaattccggaatataattgttggttcaaagagacgtagaaaggaggttgtctattcggactcttttggtgatcagtggatgaaatccgacgagggatttgaagagattgcaaagatgactccaagggtgaagcgaactgcttattcgcctgacattcaagttgagtacaatgaaaggaggaaaaggcccaagtctgtggaaaacagcgcagatggcgcaagcaacccaacacggacacccgacaaaggaagggctggagtttcatcatacagcaaggatgagaccgaagatgatggtgaagacgaagtcatcaccagtggcttacagaagggtaacagtttcacatggaagacccttggaagaaaaaggtcaagccacttaagttcgtcgtcggactcaaaagggcgaccaccattctaatgtcagttgccttgatgcttttgctcgatgaagcccttctaataatggagtacccctggaggctagcagcgctaccatttcgaaagtaccttgaacctataaacttcaggatggaggctgtagctagcaggactaccattttgaaagtacattgaagctataaacttcagaattagtaatttactctggacttgttgccatgaattcgtaactcaaacgaacttaaattgcgttacagttcaagcctattttgggggtaaaagttattggtaaatagctggtgatggcttgccctgaatttgggctgtcttgtctgcacattccgttgagcagtcttcggctaatgcctgtccagattttactggtttatatggcaagcaaaactgtactaggtgctatttgatgtgcttccaccgaggcaagtcctcaaacaagtgtcatcttttattgtgtatagctagtagagttggctctgtggaaaaaaaaaaaaaaaaaaaaaaaaaaaaaaaaaaaaaaaaaaaaaaaaaaaaaaaaa

SEQ ID NO: 14242 - DNA, 6405 bp, Zea mays
  misc_feature (1338)..(1338): n is a, c, g, or t
atagaaatggcctaatgtcacattcttttttcacatacactcatctaaactatgaggattcaccatatgtataaggggcatgttttttggatcactgtggcactagctaagatcatgtgtttgattgatggtccatctcaccgttgttggtggcgacatagtcttgatggtcatctaaagtcttcttttttgggggcttagtatgcaaggactcgagctcagatactttcgactgttttgtccatgagagcgtgccatactcttccctctatcgccacgtcatgccacatcacttatggatcgtactatcaactcagttatcgaccatcatcaactcttatatatcgcaatgcttcagtgcacaacttctaccgataacctaaagaggtagattgtatgccctcaggggttttccaaagatgcatgttatgttgttgttgatcagatcatcatctttcaaggcgcttctgtccagggcattttcgacctacccgttgttaaaaccgtttgattgtcttttagtgccatacacttatataaaccataaagattcaccatatgtataggggtcgtgcttttttttggatctctatggcaccagcaggagcggatctagacaaaacaaccattggtatcatctccattaaattataaaatcatcaactcatttgagtgctaacaaacatacattctaatggagattactaaaattcatcggtgtcagaggacaccaaaaaagggcctagatccgcccctgggcaccagctaagactatgtgtttgcctgatggtccagctcactgttgttggtgacgacatagtcttgatgaccatataaagtcttcttttggggaggactcgtgctcaaatagccctgactggtttgttcctaagggcgtgccatactattccctgtgtgactcgagcacatctatcgccatatcgtgccacatcacttatgaaccgtactataaactctgttatcgatcatcaactcttatctatcgcaatgctacaatgcacaacttctaccgataacctaaagtcacctcgataacctaaagccacctcagcaccatatttgtttttatgttatatacttttattcgacatagaacacatatttttattaaaattaaaatacatatggttacataattaaacaaatgaaattatataatttataaaataatatttaaagattacatgaaaaatatacaattcataaataaagttacataacttgaacataaaaattaaaaaaacatatttaataaataaaaatctaatttagactttagataatcaataaataactagctaatatggtatatatatngaccaatcgaaatgcatcatattattactgaggtcgaatgataccgtctaattctgctcgatatcggtgaaacgtatattgatatcgatccgtcgggatcgacttccgaagccagatcaaatacacacgttgcctggagattctgcatacgcgcctaaaatctcaactgctatataaacaccgtcatcagattaaaactgaccaccaggcctggtacccgcactccccggctcgttggtcgttgccctgccccggctttctcggtgtccgcctgccgctcttggccgccgccgccgccgccgcggacgacggcgagtgggccgagacttgcccccccgcgccgcccggtgagttgctaactcttcctcccgtctcgtctctctctctgcctcggctcttctcctctgcctctgcctgtctctggtgaataattcgtaaagatagagatgccgcagacgattggagagtttctctttctcctcgtgatttctcggctgtcggcctgtcgccagtcgctagctaatgcgcccgcctgtctggctgcatcgacggcatcttctttcacctcggggaggtttctgtccgtcctttggtgacaagggaattggacggtattaatggagaggaaagagatttttctcacccatgaatgctttcaagtttcaattctctggttaccaaatcagcctaaagtccaatgtgaagatctgctcatctaatagattagtttatttaagaccagtgtgtagagtttatctgataaacgttttgtggcgtggaacacgacgcacgacggccgtccgcgcttattcttgttctggcagagagaaagcggtggccgcgtcgtatctgattcgttcgtccttctctgcgctccgtccagctcggtggctggtagcaagcagcactgagttgagtagcgactagtgaggggtggcttgtacgtctgaaacttcctactaatttccagcccaatacgcatcgcaatcgcatgtggggatgcgccgagttcacctctccttttctttcttttttttccctgaccgcaatagcacaagtgcctttcgaacaaaattgacccggttaaattgtgcagacgcatgatttattagatagaaaaatcagcaaaaagccaaaaacctatcacgatagtaagataacaaaccctaggctacctatttacaccgacagaacccaccacacgtcatagttgccgagcttaccacaagcagcagtaagcagctctgacttcccactatgagcatcccatcagccaagtacttaacacacttgacggactcaaccgcacatcagcatgacagcattgccgagcttaccacaagtaaagcgagcagctccgacttcctacggtgaaccttccaaaaggtgaacttggtgtgtcatcgttgtcgagctttgccgcatccaaaacaaagcagctccgacttcaccactacagatcacccccctagaagagccagagagatgcaccacaagcaagcaacaaacccgaaagaggccggcctcgtcgaaaacccaaaggtttgtagacaagcaaacagcgtcgcacacgcaggcagaaggacattcaagcagtgcagagtttatatgtgacaccttcagccggaagggaacaacgttgtcacctacctaggaacactatgcgtagttccctttagagttagagggaccccacactccacaggaaagaggggaggcgccttgatgacgcttccaaggaagaggacggcacccaattgtcgccgtcgtcagggttttcatccgccgcaacgcccaagccacctcacacctgtacaaagaggctgcaccaccaattgtctgctggtccagcaaaaaaaacatcgtatactttagtggggtcagggatatcaggttcgattttatttttcttttccctccatcgggacgtcgtaaaattagggtactttacttctgtaatctgcatctttagccaaccatctgtatgcaatcatggtactagatatccgttagctgtcaggcagaagaatcttcaaattttattgtttacttctttccattcccggtgtctaaatcgaaataacacgtccgaatctttttatttataggcacaccgcaggtgaagccatgagcatggaggtagcaggtgcagaggcacctgtcaaggtatcttcgcttttgttcatctgttctgcaaattcagacacagatccaagtagcgctgtgtattagctgcagattgatttgtactgatgaggttgcttctgaaaagattggtttgtactgatgaggttgcttctgaaatctgacaggggaaattccttggtatacttgtctgctggcttttgggaaatggaagccttttcgcgtggaacagtattctaaccattgaagattactactcccatctcttcccggtacttgctttcagaactcagttgatgattgattggaatgagttcagtttcagtgtagcagggtagcagcacagttgaaaaacatggagggggtggcatccttgatttatctttgttcgtcaaataaactgaatggaacctgtgtttgcttctatgcagatattcagttacatttggtatcacaatgtctcactagtcaacgatatgttaaccgcatttctactgatatggtttctcacattgttctcattccagactatttttcaatggttactgagaagatattcgttccagtatttgttgtatttatacattcagatttgtaacaaatatgttattgttgcaggattatcatccaacaagagtactcacactagtttaccagccttttgcctttggaataaccctcatcatgacatattatgaagcaaagatgaacacaagattgagaaatcttgcaggattttcccttttcttcctcgggtcttttgcattgataattgtgagtacattgcccttgcaaacattaaagaaaaaaaggagagagtgcagattagtatgccggcatatgagctcatgcatcacattgttgttctagctggatgttgcaactaaaggacatggtgggcttggtgttttcgttggtgtatgcataattagcgccatatttgggacagctgatgctaattgtcaaggcgcactggttggcgacctttctttaatgtgcccagagttcattcaggtaacatctcacgttgtctcttctcaatcatttctgccgctgttttggtatttcattcagagttttcatgacatgtattgtgctttgagttttcagtccttcatggcgggactagctgcatcaggggtcctaacatcagctttgagattagttaccaaggcagcttttgagagctcaaaagatggtcttcgcattggagctagtaagtcagaattttgtgaaccatttgcggatttagtaaagttattcattctttggtattaagaaaacatatcttgacacttccaaaataaaagcacatgattctgaagcaaatatgggaattgaacgagatggccaaaagcatgaggttatactatatgtgattatgttctgtgatcattttaggtatttatttgcttgagaacatatttgctatagatttatgtatttgcgtctgttttggccaaggcattatacttccatttgctggattgttaagatgggaattaatccactgatctcatcaacagtattgttcataactctcttccatttgttgtgtcgttgggtcctgttacaatcatgtctacaaattcaagtattcaacagaagaccatgatatttatctgccaaataacccgtctttcattacttggtgcagtactgttcttttcaatcacatgcctgttcgagctggtgtgcctcctgctatacacattcgtcttcggcaaactacccatcgtgaagtactaccgtgcaaaggcagccgctgaaggcagcaagactgttgccagcgacctcgccgctgcagggatcatctctgaacaacagggacaggtatgcgttcccctatgatagatatcaaacaattaattgtgcgtttccttgcaacttcaccattcgagatccgaatgctgatgatgcacagcgggtgactcgtgcagatggaggaggatccagagaaatacaagcgtctgaccactaaagagctgctgatgcagaacatcgactacgcgctcgatatctacctgatatacgtcctgacgctgtcgatcttcccaggatttttgtctgaagacactggagcacacagcctgggaacatggtgaagtttcttgcttctatgcactccgcaaatcacttgcatcattcagacatgacatccaacctgttgatgttcttttcgtgaaccactagaaatgcttgctagtatttattcctggcaaatcgtctatgtgtttcaggtacgcgcttgtgctgatcgcgatgtacaacgtgtgggacctgatcgggaggtacgtgccgctgatcccgtgcttgaaactgacctcccggaagggcacgctggcggctgtcttggcgcggttcctgttcatcccggccttctacttcacggccaaatacggcgaccaggggtacatgatcttcctaacctccttcctggggctcaccaacgggtacctcaccgtgtgtgtgctcatggaggcgcccaaggggtacaagggccccgagcagaacgctctgggcaacgtgctcgtcgtctgcctcctcggcggcctcttctccggcgtcgtgctcgactggctctggctcattggcaagggctggtgagtacggtcttctgcgcgtgggtctttgagggggatcgattagattttagatctctgtttcgacctcttgtttttgcttaaaaaaacagaaaacttctgtctttaggtagctagtcagagaacacggatactgtaatctgtctaagtttgaaattttctttcgggtgcaatcactcccttttgtttccgacttttggatgttgtatagtattttggaatgaaatattattgaggtgtgagcttgagcacctgggtgtattttcttacaatataatttagctcttgcaaaaataattacctaaatcaaacttgctta

SEQ ID NO: 14243 - DNA, 1702 bp, Zea mays
atcagattaaaactgaccgccaggcctggtacccgcactccccggctcgctggtcgttgccctgccccggctttctcggcgtccgcctgccgctcttggccgccgccgccgcggacgacggcgagtgggccgaaacttgcccccccgcgccgcccgacacaccgcaggtgaacagatatagttgccatgagcatggaggtagcgggtgcagaggcacctgtcaaggggaaattccttggtatacttgtctgctggcttttgggaaatggaagccttttcgcgtggaacagtattctcaccattgaagattactactcccatctcttcccggattatcatccaacaagagtactcacactagtttaccagccttttgcctttggaataaccctcatcatgacatattatgaagcaaagatgaacacaagattgagaaatcttgcaggattttcccttttcttcctcggttcttttgcattgataattctggatgttgcaactaaaggacatggtgggcttggtgttttcattggtgtatgcataattagcgccatatttgggacagctgatgctaattgtcaaggcgcactggttggcgacctttctttaatgtgcccagagttcattcagtccttcatggcgggactagctgcatcaggggtcctaacatcagctttgagattagttaccaaggcagcttttgagagctcaaaagatggtcttcgcattggagctatactgttcttttcaatcacatgcctgttcgagctggtgtgcctcctgctatacacattcgtcttcggcaaactacccatcgtgaagtactaccgtgcaaaggcagccgctgaaggcagcaagactgttgccagcgacctcgccgctgcagggatcatctctgaacaacagggacagatggaggaggatccagagaaatacaagcgtctgaccactaaagagctgctgatgcagaacatcgactacgcgctcgatatctacctgatatacgtcctgacgctgtcgatcttcccaggatttttgtctgaagacactggagcacacagcctgggaacatggtacgcgcttgtgctgatcgcgatgtacaacgtgtgggacctgatcgggaggtacgtgccgcttatcccgtgcttgaaactgacctcccggaagggcacgctggcggctgtcttggcgcggttcctgttcatcccggccttctacttcacggccaaatacggcgaccaggggtacatgatcttcctaccctccttcctggggctcaccaacgggtacctcaccgtgtgtgtgctaatggaggcgcccaaggggtacaagggccccgagcagaacgctctgggcaacgtgctcgtcgtctgcctcctcggcggcctcttctccggcgtcgtgctcgactggctctggctcattggcaagggctggtgagtacggtcttctgcgcgtgggtctttgagggggatcgattagattttagatctctgtttcgacctcttgtttttgcttaaaaaaacagaaaacttctgtctttaggtagctagtcagagaacacggatactgtaatctgtctaagtttgaaattttctttcgggtgcaatcactcccttttgtttccgacttttggatgttgtatagtattttggaatgaaatattattgaggtgtgagcttgagcaaaaaaaaaaaaaaaa

SEQ ID NO: 14244 - DNA, 910 bp, Zea mays
agacggcagcgcacacattcacttggccttggcttttgcctttgtgctgtgacttgcaaggaacgtcggcgagagggccgggcaggcaggcaggcgcacatcacagactcctcctcgcccaccggccggccggcgctcccgatggcgtccaggtgcttcttccccagggacgctgccgccgccgaccacccgcagtccaaggcggcggcggcccaggccctcgagcggctgcaccacggcgggcgcctcctgtccagggaggacgtcgggggcgcggtgcgcgtcaagatcgtcgtcagcaagcgcgagctcaagcagatggtcgcggcgctcggcgacggcggtctggtggccgcggccagcagcgagcgccaccggcagcgcgcggcggcagcggcagggccgggcgccgagcagaggctgcagtcgctgcggcggcgcagcgtgcggcgggcggccgaggctgccgcgcggcggatgcaggcgggcggggagtgggagcccggcctgcagagcatccccgaggaggtttgctgatgactaccgctctctaccactaccagaccagtagatgatgatggcgtggcgtccttctctttcatggctagtagtagtagtagcagtaatctcttgactaattgtggcttgggtacgttttgatccatcacttgcctcgctgctgctaaaagcgcgctaggagatgtatggtgttgtacagcgctgttctcgttctgctctgggctatccttatcatcggcccagtacggctgcttcttgatgtagtttctgcgtacgttttgccctgtgagttttctctttattttggtgtggaccaagagaggatcggaggaaattgagagatgtgttttggaccttggatcacaatgcggttgctgctggtgattgattc

SEQ ID NO: 14245 - DNA, 1621 bp, Zea mays
gagcctggagcgtggtctttctcagccgggttctcgaggcaccgaacgccaacaacgaaaaactccgcagcagtccacccagtccaccagacatccgacagggaattgggaggggttgataggactcatccgcctaattcttgtagtggaattcaaccaattgattgctatttgggacagcggatttgtgatcctgttaccacagtcttcttgcgggccagaaacgcgaatcacgatggttccaggaatcgccaccaagacggcggcgcgaccggtggcctgggcacctcagcctcggaacatgttcgtgttcggcgcaggtttcgtcggccgctacgtctcggagcgcctcctcgcgcagggctggcaggtctccgggacgtgcaccactgtcaccacgaagagggagctagagatgctgggcatgaatgcttccgttttcgatggcacagaggacagcctggaaaatattcacagtttacgacaagcaactcacttgctcatctccatcccacccatccctggagttggtgatcctctacttattaatttagatgaagatctgaggagaatactcggccatggtaatcttgaatggctatgctacctttcgtcaacaagtgtgtatggtgattgtggtggtgtattggttgatgaggagtaagggactcgttggttcttttctcgtccatgaagtacattttaatagaaagctaaatacactgctgtgtatgcagccatacagtaaacccaaagagcgagtctgccaaattaagatataacgcagaaaaaggatggctgaatcttattgatgatccaaaactgtcagcttttgtattccgtttaggtggaatatatgggcctggaagaagtgctttggacaccttagcgaagagcaaatctttgtcacggaaacagaagttgcgagaatctaagcaatatactgcacgaatccacgtggctgacatctaccaggctgtcttggctagtatgagcatcagatgtgcaaggaaaatatttaatgtggtggatgacgaccctgccccaagagctgaagtttttgcgtttgctacgagtttgatacagaggagatatcctgatatgataactgaaaccattgatgccaagcctgcaggcttagattatcaagagatgatcgtacctgcagagaaacgggtttctaatgctcggatgaagcaggaacttggtgttaatctgcttcatccaacttatagatctggtctgcagagtatccttgatgcttggcaaattcagcctccacttcccaatacaagtcaatgatgatttagttttgaaaggcatataggtgtatgtacatgtatttgtgcttgatttggttcttgtataaaaaagaacggagtgaataataatttagtgacgttgtagccttttttggcggagttggtctggtgctcgtgttatttttagcattgtttacgaattatatagtacaatctagtcgccatggatctgactagacgattaatcgtgatgagattgattagtggagcctatttggttctagattttcatatgttgtccgacatatttcaagacatatacgtattatatagtagtatggaaataaatgaacggtgac

SEQ ID NO: 14246 - DNA, 1738 bp, Zea mays
ctgttaccacagtcttcttgcgggccagaaacgcgaatcacgatggttccaggaatcgccaccaagacggcggcgcgaccggtggcctgggcacctcagcctcggaacatgttcgtgttcggcgcaggtttcgtcggccgctacgtctcggagcgcctcctcgcgcagggctggcaggtctccgggacgtgcaccactgtcaccacgaagagggagctagagatgctgggcatgaatgcttccgttttcgatggcacagaggacagcctggaaaatattcacagtttacgacaagcaactcacttgctcatctccatcccacccatccctggagttggtgatcctctacttattaatttagatgaagatctgaggagaatactcggccatggtaatcttgaatggctatgctacctttcgtcaacaagtgtgtatggtgattgtggtggtgtattggttgatgaggatcatacagtaaacccaaagagcgagtctgccaaattaagatataacgcagaaaaaggatggctgaatcttattgatgatccaaaactgtcagcttttgtattccgtttaggtggaatatatgggcctggaagaagtgctttggacaccttagcgaagagcaaatctttgtcacggaaacagaagttgcgagaatctaagcaatatactgcacgaatccacgtggctgacatctaccaggctgtcttggctagcatgagcatcagatgtgcaaggaaaatatttaatgtggtggatgacgaccctgccccaagagctgaagtttttgcgtttgctacgagtttgatacagaggagatatcctgatatgataactgaaaccattgatgccaagcctgcaggcttagattatcaagagatgatcgtacctgcagagaaacgggtttctaatgctcggatgaagcaggaacttggtgttaatctgcttcatccaacttatagatctggtctgcagagtatccttgatgcttggcaaattcagcctccacttcccaatacaagtcaatgatgatttagttttgaaaggcatataggtgtatgtaagtgtatttgtgcttgatttggttcagatatactacctccgttctaatatttgtataaaaaagaacggagcgaataataatttagtgacgttgtagcctttttggctgagttggactggtgctcgtgttatttttagcattgtttacgaatcatatagtacaatctagtcgccatggatctgactagacgattaatcgtgatgagattgattagtggagcctatttggaatcatatagttgaccgacatatttcaagacatatacgtattatatagtagtaatagatatttatgttagtatacacaataaataagtttgcttgtgagaattgatttctgtattgtctgttagagtggatgtattaatcagtttaacttaaaagcttaatgtgatgggagaacgtaatacatattatatagtagtaatatatagttatgttagtatacacaataaataagttcgcttgtgagaattgatttatgtactgtctgtttaatcagttgaacttaaaagcttaatgtgatgggagaacgtaatagctagagagaaagatgtaaacgggaaaataaatgagcggtgacacaaataaagtttttagtggtattcaaacttaagatctctagctttaatatcatgttataatgaacgtactgaccagatcaacctaaaaa

SEQ ID NO: 14247 - DNA, 711 bp, Zea mays
  misc_feature (693)..(693): n is a, c, g, or t
cggacggtgggcaaaaagaggcatctgatcttgttaaagtttgcacctctgttttggagtttgaagcatccagagatggactttacttcgttcctgaggataacgcttccgaacaatcttcggacaaaggcagggcctggcatcaaactttcttgaatctcctggcacgtctagatgcggcatttcattcttttacatgtgcagaacaagaatggaaacttggccagctcagtctggaagctgctggaaaaggcctgttttcagctaataaccaggtttcagtagtctctgtgaaagcaaactctgctttagttaatctccaggatgttcttggtgccatgtatggtcatgcttgtgaagcaagtgcattgctatctggattcaaacatgtatcacaagactgcactgctttgacttcctgaatgtggttcgttgcctcgaggaggttttagctatagcagatgggttgcatgatgtatacacttctggggaaggaagctgctgcctgctcacagttcccttatgaccaatctttccaaggcaaataacaattttgtttccacttgagggcttgtctaatgtgcttgatgtaactgttatgtctgaagcgatttcaaacgaaagagagaagaacaatgctagtatgcctcttattcatggaaaggcattataccaatcttataatattaaagntagggaagcttgcaaaac

SEQ ID NO: 14248 - DNA, 1636 bp, Zea mays
cctcgaggccggccggggattctccacacgtgctacacgacgcagaattgcagccgaatccatcggagcccagcacggccgcaccccggccagcggccaccgcatcgcctcgtatgctccgcgcttgcacacgcgtcggcggcgcgggcgcgggcggctgcggccgacgagaacgcctcatggcctccctcatccccttcctccctccctcaccttactccactcacctcccgcgccagccccagccccagccccagccgccgacagccgctacccaggtcgccgcagcggcgcgcccatcccggttccgcctcctgttcgcgcgcgccgcggcgcagcggcagcgcgactccgagccggcgccggcggccgaggagaggcggtcgctggccgtcagacgggggagctgttcctggggctggcggcgctgctgctgcgcgggaccggggccgagcgtagcggtggggccgcggtggaggaggtggaggcgagggacggggtggtgtgggagcagcgcccccaggacgtggacgcggagcggcggcgacgggagctcactagcccaggtttcagcttctccgccgcggggctgctcttcccctaccacctcggcgccgcgcagtgcctcatggaccgcggatacatcaccgagacaactccgttagctggctcatcagctggtgccataatctgtgcagtgatcgcatctgggaacacaatgcaagatgctctgcaggtgaccaaagttctagctgacaactgccgaagtaaaggcacggcgtttcgccttggggctgtactcaaggatgtccttgttgagtttctcccagatgatcttcacattagatgcaatggaagaattcgtgttgctattactcagctatcctggaggcctaggggcttgctggtggaccaatttgactccaaagaagatgtcattaatgcagtaatcacatcctcctttattcctggatacttagcacccaggccagctaccttcttccgtaataggctctgcattgatgggggccttacattgtttatgccgcccacttctgctgcagaaacagtccgaatatgtgcttttccagccagccgtttgggattgcaagatattgggatcagtcccgattgcaatccagagaacagggctagcccaagacagctgtttaactgggctctggaacctgctgctgatgaaactctagacaaattatacgagcttgggtacctggacgcagctgtatgggctgagcagaattatgctgagcttatcgccaagaatgatcaatcccttgtcgctgattgaattgagttcagtttgcccagaagtaattttggtatccaaagctgagttcatgagaatccatgcctgtaatatattgtaaagatagcaccgtcattgtcgaaggtggcattgttctgcattggatttgggtgtttatgccagcattttcgtagctgtgacaatagtgtagaacaggttgctagcatggccataaaaactgatcagcataatcaaatgtatagattatagatgatgaggtttgacctgagcctaaaacagggggataatggtcctatttgtttcagttttttttttaaaaaaaaaaaaaaaaaaaaaaaaaaaaaaaaa

SEQ ID NO: 14249 - DNA, 2368 bp, Zea mays
  misc_feature (1121)..(1121): n is a, c, g, or t
ctaagggggcctcgcttcctcccaccactgcaacgactctctatagcctctttcctcgtgggctgcctcagcgcaccttatgggctgcctcagcgcaccttactggcttaccctccactcttatcctccagggccccgtcgcctcgtcctcctgccccttctggccctcctaccagctatggtgggggcaactgactattctattatcctccagtagaactggccagaatggattttacaaacctcacttatatgtgtgcccaactgaccatgaaaggggtatggtcacaaagctgtagtttttcgagtgtgatccaaaatagtgttggttggtgaaatgggctcaaaaggttatagatttacgactattggctcaacattgttaggtttgtgaaattttgttcgactgtgcaatgcaggttttgggttctgctggcgttataggaaatcctatgggttttgctaggaatgttgggtttggtttaaaggacttcatatctgcttcaagaaaagggaaattgcaggtttgtaaatgtgaagtcttagctggaatgaccactctttaaccttctagtttgaactcaagatctatggcttactctttttacagagcccagttgaactattaaacggtatagcacaaggttcaaagactcttattggaagtacggtttatgcagtcagcagtgccacttctcacttcagtaaaactgcttataaggtatttatgctgatgaccagcttgattattgaacagtatgttccctgagatcactgctaaggagaaattccactattcagggccttgttgcctttacatatgatgagcaagctgcttcgaagatggaagaacgggaaagacagctaggtttgcatggggaaggagtactgaatggttttctagaggtaaaagtcatatctattgattgtgcattgccatatgatttcaacaattttatagcatatgcctatttacactttaaaactaaataatatatgagctcagccttgggacaaacatgtggggattttttttttcatttatcacgataaatcttgctgggcatttatctaagcatgctgacatgctgtatgttctgcgctgtaatgattctctccanggtctgactgggctccttcaatcaccgattaggggagctgagaaacatggtcttcccggggtcatctgaggtacaaccattctattaagcatttatattcaatttgttcccatttgaccaacagcacgtctgttcctacaggtttagcaatgggaacagctgggcttgtggcacggcctatggctagcattcttgaagccacaggcagaactgcccagagcattagaaaccgaagcaaccctcacgaatccaactacttgcgagtacgtttccccaggcctgttgcccgagatcgccctttgtttccctactcctgggaagaagccatcggtgaatcgttgcttgcccaagctgacagtggcagactaaaggaggagacatttgtcatgtgcaagacactcaagggggctgggaagttccttgtgctaactgagaagctgcttctgctagtctcaagcccatacttggtggatctaggatcgcctcggttcatcggtgttcctcctgacccgcagtggtcgatcgacacggagatgcacctcaagagcgttgttcatctggacaggtctcaggaggtagtgaacattgttgggagcaacggacagacctcacctagggacaaaagaggtggcacgagaaacagggtcatgagctcggccttcgtccccctgtttcacctcagcatagagctgccaaatgaggaggatgcagaagggacggtgcaggtcctacaggcactcatcgagaagggcaaggcacggaggtgggacaagaacatcctacaccggagcaacatcagttgaggttttcacaacagtagtagaggttggtgttttgattgaagtggaagataaactaaattccaccccgtgactcaggtggattaaatatacaaacaaggcctcaaggcagagcagtcaccagcatacataagcttagtgtgaataagaaaacaaagtgttccataggtggtcaccgttggacacgtgcttcggttttgttttaagcttagtgtgaataagaaaacaaagtgttccataggtgatcaccgttggacacgtgcttcggtttttttttttttttttttgcggtctaggtgtagcttctagaagttttgtcgacggctcttgtaaatgaagtgtgagagggcttatgttatgtgtagcaacaccactgttttatgccacggctatgtttacactcgtcgccgggcccgggccatggatatttctgatttcaccataatg

SEQ ID NO: 14250 - DNA, 1424 bp, Zea mays
accaatacagcactggaccactatatatccccccgccccgcgctggggccggtccccagctagcgagcgccgccggtgccagtgcaacagaacacgcaccacacgggcgcagactgcagagacaacagatcgatcgtccaatggcgatcggcgggtcggaggccggcgggggaggcgcggggagcatgaggagcgtgctggtgacgggcggcgcggggttcatcggcacgcacacggtgctgcgcctgctggagcagggctacatcgtcaccgtcgtcgacaacttccacaactccgtccccgaggcgctcgaccgcgtccgcctcatcgccggccccgcgctctccacccgcctcgacttcatccgcggggacctgaggaacaccgatgacttggagaaggtgttcgctgccaggaggtacgacgccgtcatccacttcgctgggctgaaggccgtgggggagagcgtcgcgcacccggagatgtactacgagaacaacctcatcggcaccatcaacctctacaagagcatgaaggagcacggctgcaagaagctggttttctcgtcatccgccaccgtgtacggctggccggaggtgatcccatgcgtcgaggactccaagctgcaggccgccaacccatacggcaggaccaagcttatccttgaggatatggcgcgtgactaccaccgcgcggacacggagtggagcatcgtcctgctgcgctacttcaaccccatcggtgcgcacagctccggcgagatcggagaggaccccaaggggataccgaacaacctgctgccctacatccagcaggtcgccgtcggcaggctccccgagctcaacgtctacggccacgattaccccacccgggacggcaccgcgatcagggactacatacacgtcgtcgacctcgccgatgggcacatcgcagcgctcaagaagctcttcgactctcctgatataggttgtgtggcctacaatctgggtacagggcgcggcacatccgttctggagatggtggcggcgttcaagaaggcctccggcaaggagattcccaccaagttgtgccccaggagaccgggtgacgcgacggaggtttacgcgtccactgagaaggctgaaagagagcttgcatggagggcccaatatggaatcgaggagatgtgcagggaccaatggaactgggccaagaagaacccgtatggctactgcggcggtgcaaaaaaatagcgtaggttcgtcgcaatgaagaattgtcgatagtagttctcttctctacactaatcaatggaacatgtaataaacacggaccacctaatctctactagtttctatggtttccactaccaaaaaaaaaaaaaaaaaaaaaaaaaaaaaaaaaaaaaaaaaaaaaaaaaaaaaaaaaaaaaaaaaaaaaaaaaa

SEQ ID NO: 14251 - DNA, 1044 bp, Zea mays
atcatattcacctagaacaaactgtcatcagcatataatctttgcgcaccgccactccggccgggatgcatttgcactgcatcgtatatatccaacaaaacggcagctagagatgatggcatcctccctcctctttgttgtcgtcctcctcgcagcgctgtcatcgccgccgccgtcagccgtcctggcggcggacgacgacggcaccacgcacctgcacttcttcatgcacgacgtggtgaccgggagcaacccgacggcggtgcaggtgatcaagggcgcggggtcgtcggtcgtcccggggctggcgttcggcgacaccacggtgatcgacgacgcgctgacggagacgtcgtcgcccacgtccgccgccgtgggccgcgctcagggcttctacatgatgtcgtcgcagtcgggcatcgtgctcatggtgtgcgccaacctgctgctcaccgcgggggaccacaacggcagcacgctcgcggtggtgggccgggacgacgtcgcggcggacgtgcgggagctctccgtcgtcggcggcacgggccggttcaggatggccaccggctacgtgctgtggaagacgtccagcatgaacgggcctgacgctaccgtcgagctcgacgtgcacgtgaggacggccacaaccgccgccacgggtagcggcaccactggtgccttctcgggcgccgctgccaagcgggtcggagcagggtgggtcattgcgtgcgccgtcgccgtcgttggggcggtggttggatccggcgtctggtggtgatcggctggcgtgcagtgcagtggtgcacacagtttggtgacatgtccatgactccatgtacttgcattgcttctgctagtggtcattctgaatcatcatggtggatgtagtgttggtttacttttcgcttgtttttcagttggatattatttgacctttttctgtcatgtcgagattctgggtcgaactttttcccttttgaaatgtaagtttttgttaaactaaatatgagtacatcaaattgataattaaaaaaaaaaaaaaaa

SEQ ID NO: 14252 - DNA, 3547 bp, Zea mays
caccaccgcatcgtcgccggcggccaccgggggcgatgcgtcgggggcagccaaaggaggcgcggtggcgcgccgtgccgccagttcacccaggcgctccagagcctctggaggcacagtcccccgatccctcctcctgcgcctcccgctgccggcgctgccaccagcggcgaggccgaaccctcgcggcagccgccggtactcgagaacgctgccttcgaggagtactataaggttcagcaaattgtccgcgaggaggagtgggatgccttcatgagtgttctacggaaaccattaccagcgacttttagaatcaatgcctgttgccagttttataaagatatctgttcaaagttagaaaatgaatttaggcgatctttggagagtgagtcttgcatggcacctgaatttctcccggaaggaattgaggaaaaatcaggcactcgaaagttttcatgagtttctgaagcatgagagtgaggttggtaacataactagacaagaggctgttagcatggttccaccactgtttctgaatgtacaacctgatcaccatattcttgatatgtgtgctgctccaggctctaaaacttttcagttacttgagatgattcaccaatcaaaagaactaggtctacttccaggagcattggtacgtttctccctaagttgcatctggcactaaaactattgctcgtgtaactcttgatgatttttggagtcatgttagttgttagtattcaattttgttacatgtagctagtagaactagtcgttttataatttccaaagacttatgagaaattaatactttagttatattgatatggcctaggaccaacttggcccagtaaacggctcagtctggcctgtaggccgtggcgccggcatggtaaggactaaggaggacctagagcctaggtggctaggaggtctatctcctgtagtcctgtactacccctgtccctaagtcagtccctatatatagaggccccatgtacccttgcaacttaaggagaagtagatcaaagggacaaagggttagcccatcttttcttcccctgacttgggcgttgtcctactggtcactcttcctgtcctctcatttctccccaaatccccctccctaatctggggcaatctaagtactaacatatatattctcccttgttcttgtgagactggttaggtgatagccaacgatctcaatatgcgaagatgtgacctccttatccataatacaaagagaatgtgcaccgccaacctaatagtaacaaaccatggagcagaaaacttcccctattgttctcttgcaaaggattgttcaggttcatataaagatccctgcaaactacaaaagctagaattcgaccgcatactttgtgatgttccgtgtagtggtgatgggactattcgcaagggtcatgacatgtggagaaagtggtaataacaggatctttgttttgtctgctgttttatgcttccctgtatgtatcctcaggtcgcaatctgttattgttgttcaggaactcaggcatgggtaaccaacttcatcttctgcaagtaaatattgcaatgcgtggtattgcgttacttaaagtgggtggaaggatggtctattcgacttgttcattgaatcctgttgaaaatgaagctgtcatagctgaggtgctgactgcttcctactggctcggtcccatccgatgcgatgccataagaggggttcctggtgaccaaaaacgtgtgcgaggacaccactcagaatgaatgtgctcccctaatctaccaatcgagagggcatggcagtcaggtgaagaccgatgcacatggcactccactgcacatccctgccccactcatccgcccaattcggctcgagctgagctccttcgaagaagtggaaactctgttgaactccttgatgtttctagcgagctacctgaattggttcggcgtcctgggcttagcacttggaaggtacaagatcgagaatcttggtttcagagtcacgatgaagttccacacaataggaagaatgtagtacttccaagcatgtttcctgcaagtaatagaaccgaggaaagccataccgtgtgtggtgatgttgaagtgaacataaataatatgaacaacttctcaagaaatatcaacattgaagaaacaagcaaacttaatcaagatatggatggagtttctgttagtcccactaaaattttggaatgcacttctaacattgtgagttcaaagtttccactgcatcggtgcatgaggattgttcctcatgaccagaacagcggggcatttttcatcgctgttcttcacaaattatcgcccttgaatggcagtcagataaaggatacttaaattcagcacacacttgggacagacaggactattcagttccagaaagagcccaagccagaaacacgaccctatgaaactactttgacacgccgtcagcacaatgtttctgaagttgatgatactgaagtgcttggtaggggacagaaattaggcacagacagccaaccctcgcggccgaagaactcaagcgaggtcgaaatagttagcattctagcagagtcaggagatagaatggagttgcaaaagcaaagcaggtgggaaggggttgatcctgtcttagttttgaacgatgaagcggtgataaagagtatacaatccttctttggcatcaaggaatcattcccactcgaaggtcatctggtgactagaagtcctgataatgcaaggagaatatattacgtatcaaaatcagttaaagagattttggacccgaattccgttgctgtcgggcagctgaagatagcttcacttggtgttaaaatgtttgaaaggcatagatcaaaggatccctgtccatgtgcatataggttgtcttatgatggattatcgctggtgcttccatccatcagcgagaggatactatatgcatccgcacttgagttccaccgcctcgtacagtaccgaagcataagctttgctcattttaccgacaccagattcggggagcaagctgcgtccttgacgcccggttgctgtgttgtagtgttactcgaagggaataggcgtgtagattccatttgtaaggatccctccacaattgccgttgtttgctggagagggaaggggaccattaacgttatggtttctccctcggataggaaggatctccttgaaaggatggcgtatcgatttggatgatggatgccctaacgacgactatggagcttgccttggcatcttgacaaggacctacctacctatttggttggctgctaattaaaacttggtataccacattaattaattctaggcacatgtgtttggtttcacattataaagtgggatttgtcgaactttgttacgaatagcaggttcttagtaatttacacgtcggttggttgggcctggacgaaggaaggatttgtacagatcagatgagagagttttgagtttgcaactatgaactatgtactatgtactatccctttcgaccgagagatgaaaagctaaacataactaagct

SEQ ID NO: 14253 - DNA, 1019 bp, Zea mays
attgggtacctcgaggccggccgggtatttttagtgagcggagtggtacctcgggcaccccggagcttggccgctcccttttaccactccttgtctcactctccgccacaacgtcagccgccccgcgccgagcagacctcctccactagccgccgggccgcacaccaaacgctcctgggaatgccgacgccgacgatggtcaggccttttccgctcttcttcttcatcgtcgtcgtcttgctggtccggtcgccggcgggtgcggcggccgacggcggcgggaacgcgacgacggattcctgcccgctagatctgggctacgtgcggacattcccatgggaccctttgccgtgcgcgggaggcgcgcccaacgtgacagcctgctgccagacgctgctctccctgttcggcatcggcctcgccgagcgcctccgcggcacgggccacttccgcctcccgtccgcggcggcctctacggcctgcatcgagagcttcacggacctcatctccgccgcgccggcgagcctctcgggttcctccttggtggcggaatgcttcccggacccgagccagttcgccatcacctcgtcctactgcgccggcgtctccaccgctacgggagttcgtggccgccgtcgggaacgactccgcccaggccctcaactcctcctgcggccccgacctcgcctcgccggcgacctgcgcgctctgttacagcgccggcgtcgccgccaccgcgcatctcaccagcgccgcggccaacgatagcaagtcgggctcctgcttctacctcactgtcctgtacgccgctggcatctccaactccgccggcccccccctacccacccaccgccgcctgcgctcttggacttggcctcttgtcccctgcccccacgccgtcgaagtccagccacgccgccgtctacgccgccaccatcccaatcgcactcgtgctgctcgcatcgctcttcggcttctttctttggaggaagcgaacgcgtgcccattgcaggaagaag

SEQ ID NO: 14254 - DNA, 6881 bp, Zea mays
  misc_feature (2)..(2): n is a, c, g, or t
  misc_feature (4)..(5): n is a, c, g, or t
tntnnttttttttttttttttttttttttttttttttttttttttttttttttttttttaactcctactacaagcaatatagtgccgctagcataagctaacaagactgtagtagtgacatttcgttcaaaccagtataatccttgtgtcctacttgcacaccatctcggccttaaaacgtgtagcacaagtttactagtcagacactcactcgaaacatcgacaattgttggttcacttgatcatcaactaagataatcttggtcagagaagcatcatgccttggagtggactaatctaacttcgttcaattttgacttcgcttctcggcgaagtatatcttgtggcttcgcttgatcaccgacaaagaggaagatttgacttcaatctctgctttgagtcttcgtgttcaggtgaagtaaccattcgccttcgccatattatttgtttcttttttgagcgaagatactcctgaaaatgtatatcaagtaaagagtagataattgttcttcaactccccggggactgtgtttatccaaagtcagagccccaacaggtaccatatacaatttaaactaaatcagaatctctgaaccttctaacgtagaattaccattctcaggaaacaatctttttttatgaaaagggaaagatcagctgacagcacagggcacatgaatattgggttgtgaactcaaggaactcaaactggattggatcaaactcttgcaacttctgctgtggttgaagcctgacagattacaccatgacccaagacttggaacgttgaatcaactgcagatgattctctgggtaaacctcgttgagcacttgagctctcaaactggagattgaaaactctgcacgaacagaagcccttggctctagagctattttgcagtctcacaaagcttaacagagtgccacgaggatgctggtggcaagggagcgaacctcgcctaccatcaccatagcagtgtgccagcaatacaagagcaatgcttttatacatgggcagttccactcaagtctaaacaaaaattaagctggtgttcagtaggatcctctgctacgctcatatggtcgagaagcttccccaacatctcatatatcttgtctgcctcgcaatgagagatgtcatcagcaacgaatacatgctttgcactccgcacctcaatccaactgtaagcctgatccttcttaaggcccttctccttcatgagccccctgactcgacgtgcatcatcccactgtcctgcagctgcatagatgtttgacatcatgacataccgaccactgttcccaggctctaacctgaagagaaactctgccacttcttctgcaagctcgatatttccatgaaggcgacatgcacctaggagagctccccaggatccagctgtaccaggaccaatcctggatggcaaatctttgatgaactcagtcgcttcttccagctggtgattccgaccaagagcatcaatgaaggcagcatagtgttcagcccttggttcaacaccatggtcctccattgattcaagaacgagtcgtcccggacgcacggcaccagaatggctgcaggccgtgaggacagcgaggaaagtgacatgagttggacgaactccagctaccagcatctcctcaaaaatagcaagtgactgctttccgaggccattatgtgagaaccccgtgaccattgagttccaagagataaagtccctctcaggcatccagtcaaatactgccatcgcagccatcatgtctccacacttagagtacatgtcaacgagtgcattgtggatgaaaatgttgaaagggacagagccaatgttccggcgtaagatgaagcagtgcaattccttcccacgtgtgacaagtccaagtttggcacatgcacccaaagctgacaccaagacaaaaggcgttggtgatactcccttggccagcatctgttcgaaaagctcaagagcggtgtcctcctctccattctgctcatgcccagatatcagcgctgtccatgcaatcctatccttatctggcatcatatcgaacacctgcactgcctcatggagcttcttcacttggcagtacccagaaatcatcgacgtccaagtgacattgtctcggatgctgacctgatcgaacaaatgcctcgcatcttccaccctccgagccttgctgtaggcgttcgacatggcattggccatgatgacggtgaactccatccctgataccactaccgcaccgtgcatttcccgcagcggcctcgcagctccgattcccgcacatgcagtcgccacgctgaccaccgtgaaccgatccatggctaaccctggccccaagaacctgtccctggccagccgggcaacgacgcggagcgcctccacctgccggccgtggtgcgcaagggacgacatgagggtgttgtaggagacgaggttgcgtgagtcggccggcattgtgtcgaacaggcggaaggcgtcggggagggtgtccggcctgcgcaagagcgcagcgagaagcgtgttgtaggagtgcgcgttcttgtgtggaaggtcgtagaaggccttgacggcagcggccggcgacgggagcgaggagtagagcgcgacgagacgatttgataggagcgtatggctggtgagcgccgtcttgacgaggtgcgcgtgcaccgcgcggccgagatggagcacgtcccccattgagatggcccgttccaggagaggaatcaactccgggatggcgagggcgcttccgccgccggcggttggaggaggtgctgggaggcatggcggcgggtggacagcgagcggcgggagaaggcggcgcatgcgttcccgactcgacggcagcatatgcgctcacagacgctgaagctatttactgggccgtgtatgatagcgggcctttgggccaatcaagcgggccaagtgggtatgtgaaggcgaacaagctcagcagcgttcgagttgttgcgaattgcaattgcagaacggaattccattccagaaccagccctcgctcgcccccgccgccgcgctgccgcggccatatacggcgaaagccctattcgtgcccgcggccgtggatagataggtcagtgacgattgagaaacccgtagtcggagcagaggaggggtagaggatggtgttcggtcaggtggtgatcggcccgccgggctccggcaagaccacctactgcaacggcatgtcgcagttcctctccctcctcggcaggtaagtacgccgtttagttcctcaccgttgctttggctgcccctcaagctgctctagttaagtcgaacacgcttgaccttgatttgacccgctgcgtgatgccgtgattcgattagtagttgcttcggttgcccctcacaagctgatctaggactctaggtaagtggaatacgcttgaccttgacttgacccgctgcgtgattcgattagggtaagtggaataccttcctctgctaaggttgatcgagaatgttagctgataccatattgcttgtagcagaagttgtgccgagagtttaaacttcacccttggctttgttttggttggactaaagctgaagttgataatttgctcacacggatggcttctttatgtgttttccttgtggcaggaaagttgcggttgtcaatttggaccctgcaaatgacgcattgccgtatccttgactctttgagcaccacattttttcctctgtactcactctctccctatcaaaaaaaaaaacgtactctctccttgatgttctcttgtcacaattgaactttttccttgattgtaataaatagatatgagtgtgccataaacatcgaggacctcataaaactcagtgatgtcatgtctgagcattcgcttggccctaatggaggttgctcctggtcctccattgatattcagtaacctacttgcttttgttctaataatatgactttctttctctgtggtgttaaaacctgtgtcagggcttgtgtattgcatggattacttggagaagaatattgattggcttgaagaaaaactgaagccttttattgaaggtgagtaacgattacctctctgaagtatgcacatatctgcagtggcaatatctgtaacaatggtcatatcccaaaagggcagagcatctgatgggaaaattataaattgctaataaatgacagacccagtgttgtggctcccgtatgagtggggtctagggaaggaataactgaggcaagctttacccctgcagttttgcagagacgctaagtcaatcccgagacctttggctcagttggaaggcttctcactgctgtgctaggcctgtccttcaaattgctaatatcgataaatttgttattttacacaggtctttctatgtgcttggacagaaccaattatatactagtagactaatcatccaactggaattagaattagctttttataaaccctattctgttatcctgaggattgcacctcagtttgtttaaaagtatttctgctgtttcttgtgctatttcatagtgttcaaagttatagactcgtagtaggcaagcactggacattgtaaacagtcatactgctcaaattgtacttctttcacccgttattattgacagccaaacttaacatttctgcagatcactatctgttatttgattttcctggtcaagtggaattgttcttccttcactcaaatgccagaagtgttattaataaactcatcaaaaagatggacttgagggtagagtgtgctctttgtcctatttatatcattctaatgctaatgaactagattgttcaatgttttttcctgtattctacagcttactgctgttcaccttattgatgcccatttatgctgtgatcctggaaagtatgtcagtgctttgcttctttcactatcaacgatgctacacttggaattgccacatatcaatgtcttgtcaaagattgacctcattgagaactatggaaatttaggtatttggaaccttcaatcttcctgtcatttgagcatttattgttcatggaattggatgttcacaccatattctattgatcaatactcctatgtatttactgtagtatctattcatcttcttgattggcagcattcaaccttgacttctacactgatgtccaagatctttcttatttgcaatatcatcttgagcaggatccccgctcagccaagtacaggtgaatttctgaacacaatcgttacagcaacagctaggagtatgtgtactttgctcaaaatttgaacttgatgaatttacatgaattgttaatatgtttccaattcacttgaccaaatactgaaccaaacgcagacatgcagtgcccactttctagtttcttgctcccttgtgagttcaggtttatctgcaacgtacctagataaaaatcttgcatacttgcagtaaccctgttccacaggagatttactgagtttaatttgaggaaaggcggaaatctagaactgggtgaggatatgtgagcaaatgtggaaatctaggttgctagtggataattcttcactcattgcagtgatgtatgtcaatgtagttggtcatatgctaagatttctattatccgctttcaatgtgaaacctttatagtgccccatttataaccttttttagtgaacctgctaacaggaaactgactaaggagctctgtgatgtgattgatgattttggtttagtcaatttttcaactttggacatccaggtctgtatttgaaagactattaaaatctaatttctcattgtcttagttcttacaagcttttgtggcctctaggacaaggaaagtgttggcaatcttgtgaagctgattgacaagagcaacggatatatattttcttctattgacagtagtgctgttgagttcagcaaaattgcagcggcgcctcttgattgggactactgcagatatcctatacttgttctttaataatttttgcgaacaagtcttttgccgcctgtaatttttatgttgtcttcaatgtcccagatgcacactatcaaaccacttgcattctcaggtataatatactgacaatatggagtaagcattagactttctttgcagatgatgcatctgcatgccattaaattctgcagcaagcatgtggtgaatagatcgcaagccaaaccacgcgaaattgcagccaagtatgttgttttatcaccagcttactattgctaagtcgagttgtgaaatctggagtaatatttctctgttacgtatgtggtatgccttagaatatatgctgttgcaccaatatcttgcaaattgtctttctttccttgacgtgtggatacaacagcggaagtgcaggagaagtacatgaaagatgatgagtttgcgcaactgacaagcaggatgcaatgaggctggcggtgccgtcccgcacccccactttggtagcactacgggtgaaccacgacagtgtggcacgttgaacttcggttgccagaacgatgtgaaacctgtctaaattcatgtagctcagttgtaggtgtttactgaagctgattgctgtagttgcctgatcttctgggagtaccctttgggcagtaaaaaaatgcacttgtcaccggtgaccaaccggtcatgtcctgttttgtttgttcgcttcaacctaactgttcgactgcttgtttgaactgctgcagctataatctttagagccaaaacattgtagtgtttggactactgcagttgtaatctttagaagcggtagaaaccggtatgaattaaagccaaacgaataggcttagccttttaggggaacttcctctataaaaaatataaaaatataaatctttgttcttagaagtcaaagaaacttatagaaaaatataaatatttt

SEQ ID NO: 14255 - DNA, 1493 bp, Zea mays
gcgaattgcaattgcagaacggaattccattccagaaccatcccgagaccattacctagaacatcctaatcgaaaaatatacggcgaaagccctattcgtgcccgcggccgtggatagataggtcagtgacgattgagaaacccgtagtcggagcagaggaggggtagaggatggtgttcggtcaggtggtgatcggcccgccgggctccggcaagaccacctactgcaacggcatgtcgcagttcctctccctcctcggcaggaaagttgcggttgtcaatttggaccctgcaaatgacgcattgccatatgagtgtgccataaacatcgaggacctcataaaactcagtgatgtcatgtctgagcattcgcttggccctaatggagggcttgtgtattgcatggattacttggagaagaatattgattggcttgaagaaaaactgaagccttttattgaagatcactatctgttatttgattttcctggtcaagtggaattgttcttccttcactcaaatgcaagaagtgttattaataaactcatcaaaaagatggacttgaggcttactgctgttcaccttattgatgcccatttatgctgtgatcctggaaagtatgtcagtgctttgcttctttcactatcaacgatgctacacttggaattgccacatatcaatgtcttgtcaaagattgacctcattgagaactatggaaatttagcattcaaccttgacttctacactgatgtccaagatctttcttatttgcaatatcatcttgagcaggatccccgctcagccaagtacaggaaactgactaaggagctctgtgatgtgattgatgattttggtttagtcaatttttcaactttggacatccaggacaaggaaagtgttggcaatcttgtgaagctgattgacaagagcaacggatatatattttcttctattgacagtagtgctgttgagttcagcaaaattgcagcggcgcctcttgattgggactactacagaacagcggaagtgcaggagaagtacatgaaagatgatgagttcgcgcaactgacaagcaggatgcaatgaggctggcggtgccgtcccgcacccccactttggtagcacaacgggtgaacggtgaaccacgacagtgtggcacgtcgaacttcggttgccagaacgatgtgaaacctgtctaaattcatgtagctcagttgtaggtgtttactgaagctaattgctatagttgcctgatcttctgggagtaccctttgggcagtaaaaaaatgcacttgtcacctgtgaccaaccggtcaggtcctgttttgtttgttcgcttcaacttcgaactgcatcagctacaatctttagagacaaaatattgtagtgtttggactactgcagttgtaatctttaaagacaacattgtagaagcagtagaaatcagtatggattaaagccaaacgaataagcttacaaaaaaaaaaaaaaaa

SEQ ID NO: 14256 - DNA, 1482 bp, Zea mays
cctccggcccgggagttgttgcgaattgcaattgcagaacggaattccattccagaaccatccttcgctcgcccccgccgccgcgctgccgcggccatatacggcgaaagccctattcgtgcccgcggccgtggatagataggtcagtgacgattgagaaacccgtagtcggagcagaggaggggtagaggatggtgttcggtcaggtggtgatcggcccgccgggctccggcaagaccacctactgcaacggcatgtcgcagttcctctccctcctcggcaggaaagttgcggttgtcaatttggaccctgcaaatgacgcattgccatatgagtgtgccataaacatcgaggacctcataaaactcagtgatgtcatgtctgagcattcgcttggccctaatggagggcttgtgtattgcatggattacttggagaagaatattgattggcttgaagaaaaactgaagccttttattgaagatcactatctgttatttgattttcctggtcaagtggaattgttcttccttcactcaaatgccagaagtgttattaataaactcatcaaaaagatggacttgaggcttactgctgttcaccttattgatgcccatttatgctgtgatcctggaaagtatgtcagtgctttgcttctttcactatcaacgatgctacacttggaattgccacatatcaatgtcttgtcaaagattgacctcattgagaactatggaaatttagcattcaaccttgacttctacactgatgtccaagatctttcttatttgcaatatcatcttgagcaggatccccgctcagccaagtacaggaaactgactaaggagctctgtgatgtgattgatgattttggtttagtcaatttttcaactttggacatccaggacaaggaaagtgttggcaatcttgtgaagctgattgacaagagcaacggatatatattttcttctattgacagtagtgctgttgagttcagcaaaattgcagcggcgcctcttgattgggactactacagaacagcggaagtgcaggagaagtacatgaaagatgatgagtttgcgcaactgacaagcaggatgcaatgaggctggcggtgccgtcccgcacccccactttggtagcactacgggtgaaccacgacagtgtggcacgttgaacttcggttgccagaacgatgtgaaacctgtctaaattcatgtagctcagttgtaggtgtttactgaagctgattgctgtagttgcctgatcttctgggagtaccctttgggcagtaaaaaaatgcacttgtcaccggtgaccaaccggtcatgtcctgttttgtttgttcgcttcaacctaactgttcgactgcttgtttgaactgctgcagctataatctttagagacaaaacattgtagtgtttggactactgcagctgtaatctttaaagataaaaaaaaaaaaaaaaaaaaaaaaaaggg

SEQ ID NO: 14257 - DNA, 961 bp, Zea mays
cctacctgtccgggtgggtttttttcagaatgtccttttttactccgcacctgagcggcgttgccgcgctcctcatgagcctgctcccggactggtcgtcggcggcgatcaagactgcgatgatgacgacctccgacgcgggggacctgcactgggctttgtcattaaggactagcagttccgggacgccaccttctacgccctgggcgcgggctacgtgaacccggcgctcgcattcgacccgggcctggtctacgacctccgcgccgacgactacatcccctacctctgcgggctggggctgggcgacgacggcgtcacggagatcgcccaccgccccgtcgcctgcggcggcctcagggccgtcaccgaagccgagctgaactacccgtccctcgtcgtcaacctgctggcccagcccatcgcggtgaaccgcacggtgaccaacgtggggaaggcgagctccgtgtacaccgcggtggtggacatgcccaaggacgtgtcggtgaccgtgcagccgccgatgctccggttcacggcgctggacgagaagcagagcttcacggtgacggtgcggtgggccggccagcccaacgtcgccggcgccgagggcaacctcaagtgggtctccgacgattacatcgtgaggagccccctcgtgattccagccaagggagagtagcgcggagcagcggcggcctggcggcaacgcactttgtgctgctcggggttcaagaaggctaattttgcgaccatggtacagagtatgtctgtatagcgtctctaggctacggcacttgcacaccgcatgtttgtataggctacgaaactatggagtatgaactggagttcttctggctcgacgtgtgccatctatctcattctcagctgcgattttgttctgtaaaaaaaaaaaaaaaaaaaaaaaaaaaaaaaagtcctctgcgttgttaccactgct

SEQ ID NO: 14258 - DNA, 943 bp, Zea mays
  misc_feature (925)..(925): n is a, c, g, or t
  misc_feature (930)..(930): n is a, c, g, or t
tcagcgtccccggcccccccgcccgcgagcaacccaacccacatccaccggaagatgagagctccagctccagctgctcctattcccgcgctgctctcccgctgctcctcgcctccctcctcggccccgcgccgcctcctctcctcctcccgcacgccagccgcctgctgcccgcctccggcagtcgtccgctctgtctccgtcgatttgctggcggtcgccggggagccggctgtcgcaggcgccccctccgcaacgccgtgccgtcgcctcatcctcctccgtcacggggacagcgccaccgggggccgcttcaccagagatcatgacagacctctaagcaaggctgggagagctgacgcaatcagcgtctctaataaactccaacagatgggatgggtacccgagcttattctctgcagtgatgcaatgcgcacaaaggagactcttaagattctgcaagagcatgtccatggattgtctgaagcagtagtgcactttatcccaagtttctactcaattgcggcaatggatggccaaactgcagagcatttgcaaaaggcgatttgtgaatattcgagtgatgagatcttaactgtgatgtgcatgggtcataataaaggatgggaagaagccgcctctatgttttctggcgattcagttttgcttgagacatgtaacgctgcgttgctagaagctgcaggcaaatcatgggttgaggccttttttgtggctggtctgggaggatggaagctccatggaattgtaaagccatgaattattgtaactaaaagctagatgtaattttttagctgttttttaattattattattaacctttgtgtagtggtttttacatgccactgaagctttcggtctgaaggtatcaacatggttagatagatgagatgagttgattctattnttccncggtccatgagtt

SEQ ID NO: 14259 - DNA, 832 bp, Zea mays
cattgggtacctcgaggccggccgggctgatcgtccttatgcagtattgggggccattggttctgtcctctcaggatttattggcccaacttttgccatcgtcccgcgcgtccggctcgacgtgttctactacagggaccccaatgagatggagaagaaaaccaagctatatgtgttcatctatattggcacaggcatatacgccgtcgttgcttatcttgtgcagcattacttcttcagcatcatgggagagaatcttacaaccagggtcaggcggatgatgttgtctgcaatacttaggaatgaagttggttggtttgacgaagaagaaaacaattcaagtctcgtggctgcgcatctagctgttgatgcagctgatgtgaagtcggccatagctgagagaatatcggtcatcctgcagaacatgacttccctcatgacttctttcgtcgttggatttatcattgaatggagagtggcaatacttattctggccactttccctctgcttgtgcttgccaactttgctcagcaactttcaatgaagggcttcgctggtgacactgcaaaggcacatgccaagagcagtatggttgctggtgaaggggtgagcaatatccgcaccgtggcggccttcaacgctcaaagcaagatcttgtcactcttcagccatgaactgcgtgtcccagagcagcaaatcctccgccgcagccagacatcaggtcttctgtttggcctgtcacagctctgcttatactcctcggaagcgctcattctctggtatggttctcatcttgtgcggtcacatgggtccaccttctccaagtcatca

SEQ ID NO: 14260 - DNA, 1469 bp, Zea mays
gcacgaggaggcaaacacaatatatggagctattcgaggactggagacattcgcccgccgtgctgttttccactatgacaccaaaaatgttgcagtgcgcaatgccccatggcatatccaagatgagccccgctttgcttttcgtgggctgctcctagacacctcaaggcattatcttccagttgatgttattaagcaagtgatcgactctatgtcatttgctaagctgaacgttcttcattggcatatcatcgatgagcaatcctttccattggaggtgccaacatatccaaacctttggaaaggttcatactccaaatgggagcgctacaccgtggaagatgcacatgatattgtcaactacgctaagaaaagaggtatcaatgtgatggcagaaattgacgtgcctggtcatgcagaatcatggggaaatggatacccaaagctctggccttctcccatttgtacagagccattagatgtctctagtgatttcacatttgaagtaatttttggaattttgtctgatatgaggaaaatctttccattcgggctgtttcacttgggtggtgatgaagtatacacagggtgctggaacacaacgcctcacgtgcggcagtggatggacgagcgcaaaatgaccacgaaggacgcttacaaatacttcgttctgaaggcccaggagctggcgatcaagctgaactggactcccgtgaactgggaagaaaccttcaactcgttcgaagaaaacctcaatccactgacggttgtgcacaactggctggggcccggagtctgcccaaaggttgtggccaagggtttcagatgcataatgagcaaccaaggcgtctggtacctggaccacctcgacgtcccctgggaggacgtctacagcggcgagccgctcgccgggatcagcgacagagagcagcagaagctggtgctcggcggggaggtctgcatgtggggcgagacggccgacacgtccgacgtcctgcagacaatctggccccgagccgccgcagcggcagagcgtctgtggagccagctggaggccatatccgcccaggacgtcgagacgaccgtgctgtcacggctacaccgcttcaggtgcctgctgaaccaccgtggggtcgccgcggctcctgtcacgaactactacgctcggaggccgccggtcggcccgggttcgtgcttcgttcagtaagcaagcagccaagcaggaaggtaacctacccacgaccacgaggtgctctgccttcgtatacaagtatacatctgccgttactttgaggctttgagcagaggacttggtgctgccctatctgtgtgtaatccacggaaacaatctgtataataatctgtctccgttttcgatttcccaaagtcgaaataaaaccgcaccgttcaaaccaaaaaaaaaaaaaaggcccctaaaaaaaaaaaactcgagagaaggccgcggtacc

SEQ ID NO: 14261 - DNA, 900 bp, Zea mays
aattcggcacgtgcggcccgccggcacattaaaattcttcccaaccttcccaaaatgccccccaaccgccccgcttacctgctctccgccctcctcctcgccgccgccgccgccgcggccgtcgccgcgcgtcgccacgcgtcgccggccgcgaacgctaccttcgccggagagcccgtctacctctggccgctgcccaagagcgtctcgtccgggtcccggacgctgacggtggacccggacctcgcgctcgacccgcagggccccggcggccgctccccggccgtggccgaggcgttccagcggtaccggggcctcgtgttcgcgccgtgggcgcacgccgcgcgcgcgggccgcgcgcggtacgacgtcaccaggctcaccgtcgtcgttgcctccgccaacgacacgctggcgctgggggtggacgagagctacgccatctacgtggcggcggccgggggcgtcgattccatcgtcggaggagcaatcattgaggcaaacacaatatatggagctattcgaggactggagacattcagtcaactttgtgttttcaactatgacaccaaaaatgttgaagtgcacaatgctccatggcatatccaagatgagccccgctttgcttttcgtgggctgctcctagacacctcaaggcattatcttccagttgatgttattaagcaagtgatcgactctatgtcatttgctaagttgaacgttcttcattggcatatcatcgatgagcaatcctttccattggaggtgccaacatatccaaacctttggaaaggttcatactccaaatgggagcgctacaccgtggaagatgcacatgatattgtcaactacgctaagaaaagaggtatccatttccccatgattctgccgacagcaacg

SEQ ID NO: 14262 - DNA, 4098 bp, Zea mays
  misc_feature (3495)..(3495): n is a, c, g, or t
ggaaagaagagaaaaaaagaagggagggtaaattagcatagcatgcttacatatatcactgcattctctaattccatgcttaccagtactatacttttcacaggtatcaatgtgatggcagaaattgacgtgcctggtcatgcagaatcatggtaagtttgcctgtagcttttcacatgatgttcatagagacagacagacagtaacttctcccttcgttccagcgtagatttttgccagttgctttgttaagtgcaacttagttatctcctgcacaattagagaaattagtggtttttatttcatggcgtcacttagtgttacaacttacaagtattgattgatcgagcagttagtcattcctgggcaggggcagagcttcattgaggccaacatggcccgtggccacccctggcccagtaaagcttctatataattagagcccactctgcaatgttttgtagacttttgctctttgctacaacctaattagttttattggcccttgctagaatttggcccatgctccgtgactgcacctgagtacagcatatgtccaacggtacctatatcaagaaatcgtcataattcccttatttgattttcatctgccgatttacatttcaaattaaattaatgcatacctgtccacatatttctaactaggttatctgattaggcatccaaacgcttacagtggttatgttatgccccttgtctccattatttgctcttgaaaatttattcgcaaatttactttttgcaggggaaatggatacccaaagctctggccttctcccattgtacagagccattagatgtctctagtgatttcacatttgaagtaatttttggaattttgtctggttagttcctttcacacttcttagttcttagtctgcttaagtcatatgaggacttgaatactaatcggacaaatactcatccacttcatataattttgacatcacatgttgctttttttaagaaagtgaaaaggaatacattgatattttgcaacgtggcatgtggaatgtgtgtgcccctatacaggttcatttcatcgagcatatgaatttcttttccaaactgtccatagtactttatctagaaatggtgttccacaaatcattacgaatatgaactggccaactcaatattgggttgtgttttgctgaaacattatattccacaaccaattaaattgacttaaataactaaccggtcgttacatcagagcactaccatttcagaaattggtgtcctgccttccgtagaacctagcgggaaagtacacattcttgtttcttagaactggactgaactcttggattgctttagaatcatgtacaagcaaccataaatgtgcactaaatattatccagtgacagttggaccctcctcctgtagtataaaactcgtgcaccaatattggtaatgatccataataatttctctgctggcttttgtatataccaatttgtactgcattataacaaattgattcatcattatgggcctttttatcttctcagatatgaggaaaatctttccattcgggctgtttcacttgggtggtgatgaagtatacacaggttagacgatttctgtttcacttgggtgatgatgctatacaaatacttcagtgtccaagcgcctttttgtttcccatgaagtttttcccagctcactctaaatatccatgacagggtgctggaacacaacgcctcacgtgcggcagtggtacggaatcttatccagcaactagtttcaatccacaatttatttgatatctgccgctggatgttccatttgactcagactcagttgtttaacttaacaccccccaatcccaatcacaatcccaggatggacgagcgcaaaatgaccacgaaggacgcttacaaatacttcgttctgaaggcccaggagctggcgatcaagctgaactggactcccgtgaactggtccgttcctggcatccttgttctttcgttcactctacaagttacaactcactctggagttacaagggagctctaaccttgactctgcgccccgcctgcagggaagaaaccttcaactcgttcgaagaaaacctcaatccactgacggttgtgcacaactggtaaaccgcgaaaatcagcctgttcctctcattcctcggcaaccgtgaatcttccatttgtcgatgcatggtactgaaaagacagtctgacctgtgaaacgcaccgccaggctggggcccggagtctgcccaaaggttgtggccaagggtttcagatgcataatgagcaaccaaggcgtctggtacctggaccacctcgacgtcccctgggaggacgtctacagcggcgagccgctcgccgggatcagcgacagagagcagcagaagctggtgctcggcggggaggtctgcatgtggggcgagacggccgacacgtccgacgtcctgcagacaatctggccccgagccgccgcagcggcaggtacgactacgagccaccacactctcccgcaaccgagttccctttccacaaggactcaccctcaccctgtcgccgccgccgccgccgggtggttgctgcactgcagagcgtctgtggagccagctggaggccatatccgcccaggacgtcgagacgaccgtgctgtcacggctacaccgcttcaggtgcctgctgaaccaccgtggggtcgccgcggctcctgtcacgaactactacgctcggaggccgccggtcggcccgggttcgtgcttcgttcagtaaagcaagcagccaagcaggaaggtaccctcctacccacgccacgaggtgctctgccttcgtgtaccatatctgtgtgtaatccacggaaacaatctgtataataatctgtctccgttttcgatttcccaaagtcgaaataaaaccgcaccgttcaaacctccttcgagctcgggcagtactgcatttgttttctggcggcggggtgcgtcgctgtcggggaccggacgccatcttttcctcagtttggccttgacctgaaacccgctggtccaagctgcgcattaatggcgcgtgtaatttgcgaccacctgttgtgcttgggtggtttggagtgacgacaatgggtttggcaccttgttctatacttccaatatagagagagaggtcactgtccttcccatgccaccttcttcaaaaaaaatgtatgtctttggccttttgctctatctatttatgtctactgcccctatttcttaactattgggagcctaaaatcgagataaaattgaaagggctaaattttagcccctttaacctgactggattttaggctctcaaactagctacgagtgcaggtgaggtgaagcatggaacggattcttaatatcccctttattacgctaggcgacaaggccatcagcgcaagtctacactacactacaacatgatggccgttcactatacaaaaagattaggcaacgagtacccaacagcatgcccacangagcaaacaaaattgtctcgcacctaatattcccatgacatgtttttttaaataaaaaaacagaatccccttttgtgtagtaggagctcagatcacgtggcatcactctttttttcctctctaggggtcaaattctgtcttcgttttccaaaagcgactacactcttgctctacgaatatgagatgacatcataacacaccaatcaatcctagccagctatgaagcgaactctatgtctatggcgacgttagaagtagggccagacgaaatgtctgtggctcgttggctcgctcgtttcgtggtcagctcgggtcgactcgtttgaatttttttatgagctgaactaacatcctagcttgttcattaacgggtcagttcgatttgttaacgatccagttcgcgagcaaaacgagctatcacattttaacgaaacaaaactatatgcacatcatttacgtaacaattgatcaacattgtcggtaccctgaaacaggggtaccccttactacagtgtgaagacacggtgcccacgcagctatctctagtcgcgtggtgaacaacacccaaccccaccacgtggacggctccggggtcgccaagtg

SEQ ID NO: 14263 - DNA, 2136 bp, Zea mays
caatttacagatgtagccccatcacatgccagtggtggagggtcgaattgatgaatctgttaacttgtataaacttagttaaaaataagttaagtatataagtaaaaaaaagtttattgtagagtaaaattgttaatctgaatgtttatgccactttgatttgattttaagcgtaggggaatcttctgattttgcggggagtaaaccactaaaggttcattgtttgatttttcattatatgtggcacagaaatatcttccctttgataaaacaactaagggagttctatttttttgacatcagataaaaatactttttcacctttcctgtttgtgttacatcctatgtttatcagaccatgctgttctagttactaacttactattgctaatcattttttttctcctagctgaatgcattatcgtcaccatccatttgaataataggatactgatgcagggctcaaaagttatggctaacctgctttccttttgttttgggtgaccgaaacaaagtttggtgaacacttcacatgccatgtgactcagattagtgtcatagcattctttggcagcactagaactctagaagcacctttaaccttttttttaagaaaaacttgtctagttgtgttttcggtggctacagccagacagtttggcaaattgcccccattgcggtggtggtgccgtggtgggctgttaaaaaaaaggacatttaaaaactcttttagggctagcgtggcaactccattttctattgagaaatgaactaattttccttgtgaaaatggaaattatcttcggtaagccatgggattgagttggattcttagagaggattttagtttccaaactagccctcaatcctatggattctaggagaggattcgagtttccaaactagctctggtaatccaagggatctagtcagattttcggagaggatttgggtttcgaaactagccctcaatcccatggattctgggagatgattggagttaaaaatctagctcttacatgatttattacctgcatttgttctttacatgctacagtctagagtatatggtttttgtagggcatggtccagagtagttgctggaggtgtttcccatgcacgttccatgttcaattatacacaatcctatcttgcacaatccattcccacatcagcatgggcattccgcattatttccttgcgcaaactgcattctctatcgcagacagtgaagcaagagaagtttcttatttcgagaatatcataatatctgcatttagcatgagcataacattagcaatcgctctttcttttcgatggatctcctatggaaaaagaagagcagccaagtaaaccgtgggaatgtttttttgttgttgtcttgtgttcgatggcaacacccaggtcgtgaaggcaatcgagaacgcgatccccgtgcggcacgccgccgccgccgccgccgcggagatcgaccccgcgagggaggaggagctgagggccatggaggcggagaaggcggagatcgaccgcgcggcggcggcgcgggtgcggcgggagctgtggtgcgggctgacgtacctggtgatccagacggccgggttcatgcggctcaccttctgggagctgtcgtgggacgtgatggagcccatctgcttctacgtcacgtccatgtacttcatggccggctacgccttcttcctccgcaccaagaaggagccgtcgttcgaaggcttcttcgagagccggttcgcggccaagcagaagcgcgtgatgcgcgcccggggcttcgacctccgcaggtacgaggagctccggagagcctgcggcgtggcggcggcgccgccgctccaggcccggaccccctgcgcgagcgcgggcgcggcgcgggagagcggccattgccactcctactgccattgccattgatcttggcctcgctcggttcattcctttctttttttttctttgttgttcatgcccatttggtggggatgatgattcgtgtatccatctgatgcgcgcgcggatgcaaaaaaaaaaaagcatactgaattgaggtttaaacttggaaccagggcttaagccatgtccaactgttcgtccaaatggtgcgtgcatctgctacaaacaaaaacc

SEQ ID NO: 14264 - DNA, 2284 bp, Zea mays
gctgaggattccaagcagcagcacacaaaagcaccatctttttggaggcttgcagagcttagttttgcggaatatttttatgctctgttaggaagtgctggggctgcttgtttcggttcatttaatcctcttcttgcttatacaatatctcttatagtagtggcctactacaaaataggggtccgtgatgtacatgccgaagtgaataagtactgctcattcattgttggcatgggtataattactgtactagccaacttcttgcagcacttctactttggtataatgggagagaaaatgaccgagcgtgtcagaaggatgatgttttctgcaattctgcgcaatgaagttggttggtttgacgacgaagaaaatagcgcagacatattatcaatgagacttgcaaatgatgcaacatttgtccgcgctgctttcagtaacagactttctatattcattcaggatacatcggccattcttgttgcacttcttcttggtatgttactacaatggcgtgttgctcttgttgcattggcaacgttacccatccttatcatttctgcggttgcacagaaaatgtggctttctggcttttccagaggaattcaggagatgcacaggaaggcttctttggttcttgaagacgctgtgaggaatatctatactgtggtggctttttgtgctggtaacaagataatggaactttatagattgcagcttggcaatattctcaagaaaagctttatacatgggatgggcattggttttgcctttggcttctctcagttccttcttttcgcatgcaatgcacttctgttgtggtatacagccgctgctgtgaaggacggacatctcagtctcgtaacagctgtcaaggagtacattgtcttctcttttgcgactttcgcactggtggaaccatttggccttgccccttatatactgaaacgccggaaatccctgacctcagtatttgaaattattgatcgtgtacccaagattgatccagatgatgccagcggcctgaaaccacctaacgtgtatgggagcattgaattcaggagtgttgaattttgctaccctacacgccctgagatgatggttctgagtaattttagcctcagagtgagtggaggacagactgttgctgtagtaggtgtatcaggatccgggaagagcacaataatttctttgatcgagaggttctacgatccaactgctgggcaagttttgttggatgggcgtgatttgaagttgttcaacttgagatggctgcggagccacatggggttggttcctcaggatcctgttatattttcaacaaccataagagagaacataatatatgcaaggcacaatgcaactgaatctgagatgaaggaagctgccaggatcgcgaatgcccatcacttcatcagtagtctgcctcatggttatgatacacatgtgggaatgcgcggggtggatttgactcccgggcagaagcagcgcattgccattgctcgtgtggtgttgaagaatgcgcccattttgctgcttgatgaggccagctccgctatcgaatctgagtcgagtagggtggtccaggaagcccttgacacattgatcatgggaaacaaaacaacgattctgatcgcacacagggcagcgatgatgaagcatgtggatagcatcgttgtgctaaatggtggtaggatcgtcgagcagggaagtcatgattcgctggtgcagttgaatggtttgtatgtgaagctgatgcagcctcattttagcaaagggtttcgccagcgtagactaatatagcggctctggttgtagatggtgtacattagcccgcccgtggagctaagctaatcagctctgcttcactgaccagatgccctgtggccattcctttttttttctttcctttttggtaatcgctaattcttttttcagtgtgtgtttggtgatcacgaggctgggaagggtgttaccctgttcggtgtagtttttgttagcttattttttcttttgtggtagcctttagaatttggtcttgctgatgctgggtttgggtgtagtttggaactggaattgtaattgtaatcagagcagtggtgggaggaggaagcgcgcactattgtttcgccagtaactgtctagtctaagcaagcatgatgatgctaggagatggttttgtggtagtcagcatcattgtaacctcttgtgattgttatttgcagaaaattaaactacattttcagtcatgtgtaccttttctttttgttgattgctgtgtaac

SEQ ID NO: 14265 - DNA, 1077 bp, Zea mays
ctcgtgccgaatcccaaccacctaccatgggcctggcctggcccatttctatgagaagagaggaggagaactgaagggatcaaagggaaaggaaacctagacaagcgaggcggcggccccgcgttctccgtctccgtctccgtccgcccggcgtaaagaaaagcctccctcaccacagccgccacgccatggccgaggagaccgacaccaggcctgcctccgcgagctcccgaggccgccccgcgcccgaggacgacgacagggaggagggcgagatcaccgacatcgcctgcgctccttccccgcccgccacgcacccgctcgagcactcctggaccttctggttcgacaacccgcagagcaagtccaagcaggccgcctgggggagctccatccgcccaatacacaccttctccaccgtcgaggaattctgggggctttacaataacattaatcaccctagcaaattgatcgtgggagctgatttccattgcttcaagaacaagatcgagccaaaatgggaagaccctatttgtgcgaatggtggtaaatggaccatcagctgtggaagaggaaaatctgatacgttttggctgcacactctgctggctatgattggtgaacaattcgactatggtgatgaaatttgtggcgcagttgtcagtgtgcgtgggaagcaggaaagaattgctatttggacaaaaaatgctgccaatgaagctgctcaggttagcatcgggaagcagtggaaggaacttctggactacaaggactccattggattcattgttcatgacgatgcaaagaagatggacaaaggcctgaagaaccgttacacggtttgatcctgatgctggaatcccagagagttgtagcagtagctggcccaaatgcatgctgggtggttttatctattgctgatgagttgtttaagcaagatccattcctgtattgtactccataagccacttgggtgttgctttgtattgttcactactgtgttttttctatgtgtgggaccgcatctacagtactagttgcttgtcgttgttccgttgttcaaaaactcgagactag

SEQ ID NO: 14266 - DNA, 663 bp, Zea mays
ccccttacaataatatccatcaccctagcaagttgattggcggagctgacttccattgcttcaagaacaagattgagccaaaatgggaagaccctatttgtgctaatggcggtaaatggaccatcagctgtggaagaggaaaatctgacacgctgtggctgcacaccctgttggctatgatcggcgaacaattcgactatggtgatgaaatttgtggagcagtcgtcagcgtgcgtagcaagcaggaaagaatagctatctggacaaaaaatgctgctaatgaagctgctcagataagcatcgggaagcagtggaaggaatttctggattacaaggactccattggattcattgttcatgacgatgcaaagaagatggacaagggactgaagaaccgttacacggtttgatcccaaagagtagtagcatgtagggtggttctatccgattccgtagcaccttgcagagtgtgttgaaggttctctatttgctgaggagttgcttaagcataatctaacatgatgtcgaatgtattcctgtatgttccataggtcagtcacctaggtgttgtttttgtctcagctctgtgtgctatatatatatatatatatatatatatattggattatatatgttcctggttttctatttatatatatatat

SEQ ID NO: 14267 - DNA, 948 bp, Zea mays
  misc_feature (808)..(808): n is a, c, g, or t
tttttttttttttttttgattaatggaaccatgtttagcttccggtaccggcccctcccccgctcgacccccagccgtccgaaaggaagaaaaaaaagaaaaaccagacagcgagccccaagccccaaacggccaaacctccttggacacgactcgccgcacccatccccatccgccgccgctgccatggccgacgagattgacacgaggccggcctccgcgggctcccgcggccgtcctgcgcacgctaccgaggacgacgacagagaggagggcgagatcgccgccgacgccccctcgcccgccctccccgccgcgcacccgctcgagcactcgtggaccttctggttcgacaacccgcacggcaaaaacaagatggccgcctgggggagctccatccgacccattcacaccttttccaccgtagaagacttctggggcctctacaataatatccatcaccctagcaagttgatcggcggagctgacttccattgcttcaagaacaagattgagccaaaatgggaagaccctatttgtgctgatggcggtaaatggaccatcagctgtggaagaggaaaatctgacacgctttggctgcacaccctgttggctatgatcggcgaacaattcgactatggtgatgaaatttgtggagcagtggtcagcgtgcgtagcaagcaggaaagaatagctatctggacaaaaaatgctgctaatgaagctgctcagataagcatcgggaagcagtggaaggaatttctggattacaaggactccattggattcattgttcatgacgatgcanagaagatggacaagggactgaagaaccgttacacggtttgatcccagagagagtagccaatgtaggggtggttctttccgattctgtacaccttgcaaaaagggggttgaaggttctctattttgctgaggagttgctta

SEQ ID NO: 14268 - DNA, 1013 bp, Zea mays
aaaaatagaaagaaaaaggaaaaaaagaaaaaccagacagccgccctaacggccaaacctccttggacacgactcgccgcacccatcccaatccgccgccgctgccatggccgacgagattgacacgaggccggctcccgcgggctcccgcggccgtcctgcgcacgctaccgaggacgacgacagggaggagggcgagatcgccaccgacgccccctcgcccgccctccccgccgcgcacccgctcgagcactcgtggaccttctggttcgacaacccgcacggcaagaacaagatggccgcctgggggagctccatacgacccatccacaccttctccaccgtagaggacttctggggcctctacaataatatccatcaccctagcaagttgatcggcggagctgacttccattgcttcaagaacaagattgagccaaaatgggaagatcctatttgtgctaatggcggtaaatggaccatcagctgtggaagaggaaaatctgacacgctttggctgcacaccctgttggctatgatcggcgaacaattcgactatggtgatgaaatttgtggagcagtggtcagcgtgcgtagcaagcaggaaagaatagctatctggacaaaaaatgctgctaatgaagctgctcagataagcatcgggaagcagtggaaggaatttctggattacaaggactccattggattcattgttcatgacgatgcaaagaagatggacaagggactgaagaaccgttacacggtttgatcccagagagtagtagcatgtagggtggttctttccgattctgtagcaccttgcagagtgtgttgaaggttctctatttgctgaggagttgcttaagcataatctaacatgatgtcgaatgtattcctgtatgttccataggtcagtcacctaggtgttgtttttgtctcagctttgtgtatttggagccctggtttctaataactaaataactagataaggcatgtcaaaaaaaaaaaaaaaa

SEQ ID NO: 14269 - DNA, 8662 bp, Zea mays
ccttgagaaattaggaaattggggaggctccagtggacgatcggaggcaagagctggtgctttggatgcgcaataacctagcagagctcaatagggcaacaattcatagactccatcggcggtgacgtccaatttgaaaaaaatgtgctagcggccggagagagggactaagtctctacgacgttctaccgtggcattcaccggacctaggcggatggctatcacgggttaacctccacggtgcaaagtgacgtggtaaactacctaaggcgtggcgcaaccagggaaaatggcgacagcctcggcgatgactgtgcggccacgttgccgggcaagtgggcacggcgacagggcaaaacagtgcccgaagttcatctcctttgcgatatttctcactctgtgtagttatctgcactccaccgggcacgaatcgcagcgccagtgaggatcacggcgcggagtcatcgacggagagatacagcaaacctgcaatctttttcagtgtactgtaccatcagaactccattcagagtgcttgacagagcatgtttgagagcgatttactccaaaaattgttcagcacctggtcaatcttggtataacaaagttgttcactaatgttagagcttcaattttgccacagtgaccctgaccttatctccattgaatcaaccatgaactgctcccaaagttaaccaaatgtcactgaacttaggttttcagagttaaggctgtctgacaggccaatttcaaatctctttttctcccattttcatgtagtactagggcttactcacttaatcaaatttgtaccctttacatagctctacaagtttgatgtattgatctagggcaaaatatttatgaattcagagataccaagctccaaagtttaccccattcaactgaaattcagacttaaccatatagtgttcatgggtactttttgcgaataagtccaaacttcatcactccacttgaaaattcttcaatgtgaaagttacttggtttgtgatgttttatcactttgctatttgcacttcggtccaaaagtgcgtagaatttacatttacccccctagggttccaattagggtttcttttagggttttgaggactttagggtttttgtgcaactaaagcacatcaaatgtgataccttgtgaacatttctcatagcttatgagattcttactcattttggtttcactttaatccataggccctatttacatggttaagtacgctaccttagcattaagtataccttaagtcaagtcatcacaacttattttgaaatttaacctagtgaatgcattctaagtgtaacaaacaacatgacatgtcaatacacatgatgttatgctcaagtttcagtgccagtagcaccagaggtgttacacaaagtggccatgtgacttgcatagttaccgatgcctaggtgcccatagtcatcaacgctctctctcaagcccgaaggcacgaaaagaaaaggcacctggagtacaaactacggggtcaatgagattagcttacttgtactcagttatttttgtactatgaattacactaaacgaggtaggagctatgactacaagatatggattctaacagaggagacagacagaacaaacttgattagcatccatcaccctgaggctatgttcggttaccgggggtccaatccccaagatgattaaatccacccggggaatgagttgatccctgggctctcactcaatccctgttggggatccgttccacgccttttcactcgtgggacaaatcccaggacggggtgagagatttcgccgagaacaggtcgggacaggacccctgcgtgggtgaaacgaacgcgattttcaccatgggccgggattgagtccgcgtcggggtgatccacgggggttggggcttgatcccggccaatcccggcccaaccgaacatagcctgagtgcgcagcgccactaattatgcttcgctggaccactgaacagtaggccgacactgttgacgctgactaactactcgtggcacccttttcacacgtataacagccgcgcacgcactcgcgcaccagccgtcactcccgcggacttcacgcccgccgcttcccggtcctctactctactcctgatttcagcttctcggcggctcacctcacttcctcgcatcacagcacagccgaggaagcctccaagaaaaagaaagagagaaaatgtctggccccgccacctgctgccacccctttcacctgctgctcgtcctgctcctcttcctcctcgccggcgagggccgctcccagcccgccgccgccgccagtaccagcgaccgcgacacgctgctcgccgtcaaaaaggactggggcagccccccgcagctcaagacctgggaccccgccgctcccaaccactgcaattggactggcgtcacgtgcgccactggcggcggcggggtcgtaagcgggcttaccttgtccagcatgaaactcaccggctccgtccctgcatcggtgtgcgcgctcaagagtctcacccacctcgacctctcctacgacaacctcaccggcgacttccccggcgccgcgctgtacgcctgcgcggggctcactttcctggacctctccaacaaccagttctcggggcccctcccgctcgacatcgaccgcctctcgccggcgatggagcacctcaacctctccaccaacagcttcgccggagaggtgccgcccgcggtgggagggttcccggcgctcaggtccctgctgctcgacaccaacagcttcacgggcgcgtaccctgcggccgagataagcaagctcaccggtctccagatgctcacgctggccgacaacgagttcgcgccggcgccggtgcccactgagttctccaagctgaccaacctgacatatctctggatgggtggcatgaacctcaccggagagatcccagaggccttctctagcctcaaagagcttactctatttagcatggcttccaaccaactcaccggatccatcccggcatgggtatggcagcatcagaagctccagtacatctacctgttcgacaatgccctctctggcgagctcacgcgcagcgtgacggcgttgaacttgctccagatcgatttgtcaacgaatcagctcaccggagatatacctgaagatttcggcaatctcaagaacctcacaatactgtttctgtacaacaaccagctcagcggcaccatcccggcaagcatcgggctgctaccacagctcaaggatatccgcttgttccaaaaccagctgtccggagagctcccgccggagctgggcaagcactcgccgttgggcaacctcgaggtgtccatcaacaacctctccggcccgctgcgagagtcgctctgcgccaacgggaagctcttcgacatcgtcgccttcaacaacagcttctcaggcgagctccccgcggaactcggggactgcatcactataaacaacctgatgctccacaacaacaacttctcaggcgacttcccggagaagatatggtcgttcccgaatctgaccttggtgatggtccagaacaacagtttcaccggcaccctgccggcccagatatcccccaaaatggcacggattgagataggcaacaacaggttctccggctccttcccggcctctgcaccagcgctcaaggtgctccatgcggagaacaaccggctgggcggcgagttgccgcctgacatgagcaagctcgccaaccttactgatttgtcagtgcccggcaaccagatctctggctccatcccaacatcgatcaagctgctgcagaaactgaattcactcgacatgagaggcaaccggctgtccagcgccatacctcctgggagcatcgggcttctcccagcactgacgatgcttgacctgtccgacaatgagatcaccggcagcatcccgtcagacgtaagcaacgtgttcaacttgcttaacttgtcatcaaaccagctcaccggcgaggtgccggcgcagctgcagagtgcagcctacgaccagagcttcctcggcaaccggctctgcgccagggcggactcaggcacgaacctcccaacgtgtccagccggatgccgggggtgccacgacgagctttccaagggcctgatcatcctcttcgcgatgctcgctgccatcgtcctcgtcggctgcatcggcattgcctggctgctgttccggcgccggaaggagagccaggaggtgacggactggaagatgacggcgttcacgcagctcaacttctccgaatcggacgtgctcagcaacatccgcgaggagaacgtgatcggcagcggcgggtccggaaaggtgtaccggatccatctcggcaacggtaatgccagccacagcgaggagcgcggcatcggcggcgacggcaggatggtcgccgtcaagaggatatggaactcaaggaaggtcgacgagaagctggacaaggagttcgaatcggaggtgaaggtgctgggcaacatcaggcacaacaacatcgtgaagctgctctgctgcatctcgagtcaggaagccaagttgctggtgtacgagtacatggagaacggcagcctggaccggtggctgcaccaccgagaccgggagggcgcgcccgcgccgctggactggccgaccaggctcgccatcgccgtcgacgcggccaaggggctcagctacatgcaccacgactgcgctcccccgatcgtgcaccgcgacgtcaagtccagcaacatcctgctggacccggacttccaggccaagatcgccgactttgggctcgcccggattctcgtcaagtccggcgagccccagtcagtgtcagccatcggcgggacattcgggtacatggctccaggttagaaagaaactcaggaccgcaattgccagtcattttaattcaatccgtgagaatttgcagccgattgatctgtggcaacgaactctgcagaatatgggtacaggccgaaggtaagcgagaaggtggacgtctacagcttcggcgtcgtcctgctagaacttacaaccggcaaggtcgcaaacgacagcggcgcggacctgtgcctggcagaatgggcatggcggcggtaccaaagaggcccgctactcgacgacgtcgtcgacgaagccatccgggagccggcctacatgcaagatatcctgtgggtgttcaccctcggcgtgatctgcacgggggagaacccgctgacgcggccgtcgatgaaagaggtcctgcaccagctcatcaggtgcgaacagatcgccgctgaggcagaggcgtgccaggcgagctaccagggcggcggaggcggcggcacgccgcttcctcgagtcgaggaagaaaggcagccggcgacggagcatgtctgactccggacggtggaacgacgacgacgaggaggacagcggcaacttcgttgtgcacgtggtgtagtcggttcggacagtatacagctactggcctcctgctgcaagctcatccatggaggaatttcgtagaggcgccggaggccggcatgagcgcaagaacaaacaaccaagtgtagtatatagatgagtgaacgaagaggtgctgtgatttagctacaaaaccagaagccaatctccaatcacacaagaaggaggttcttggaggtgttggatcgcgatcgcacttagcaagtgtcaatactgcgtgtaataacaagtgccagttttgggcacttttgggtttcagaaaactgaagaccacaaaatctcagggaatgccaatgggtcatgagtgggtcgcgtatctgcaattgtctgtacttcgtactgcaggctgaaagaatgtgtcagggcttactccagcaggtcgcgcaaagcgtcccggacgcgcaattttcgtggtcggacgcgggcgccaaaatgaggaggccccgcagtacgaagcgtattcttctgtaatctctcttttcctcctgcattcattccttgcaacggccacggcctctcccctcgccgcgagagcgcccaacctggcgtctcctccgccgccgccggtttccctggagcaggtgaatggggacgggaagcgactgccggcggtgggcgaaggatcctgtcccaggccgaagtccactcgtcgtcgccgcaagaggcgccgcaccacttcgtcggagagcgacatatattcgattgcaacaccgaaggctgcaaggtttcttccaaatccgaactcgtgctcctagatctgtgtatctcccatgttttcccactaaagccccgtttggttaagggtaactaaagtttagtgactaaattttagtcacttttaatccctaaagaaataaacatggtgactaaaatgaggtgactaaattttttttctttgaaactaaattagtatttttatcttatttgtcctctcaactttcttcttatagcaaacatctattaattaatataggtaaaacagtcattattcacagcaaataatgctctttagttcggtttagtcactggaaccaaacagggtactttaccaactaagctaaagtaaataataaataatattaagagctggtattcaaaacctagatctaaaacttaaaactaaaagttggaacaataattaaaaaaagactttcaatctttttattctcttcattattatataattaaaactctcttttaaaaatatttaaattaaagtaatccttcatgaagtttacactttactttctcctaaagtaaataatttattttgaatatacctttaaactagccacgcatttaaaatatgtccttgagatgaattatgtgtgtgttgcatttgcctaaataaatgaataaataatatatgcatcatgctggagttgagtttgcatttatttggtatttagaacttgaattcagatttgaatttggaagtggagaattgaagaagaaaacaacaaacctatttgctcgaccaattgggcccgggtgcgggcgtgcggctcgtcaccactgcaccggtgcgagttaaaatcacccacacaagccattcgatttgcgctggcaggtgggacccacaactcagcgtcccacctctcccgtacacacagatgactgccagctcacgcccatgcggcgttccctacccacgcacacgggagaagatgctatcacccatggccgcaggacccacccgacagggacacccacacacacttgatcaccgactagtggggcctagttgtcagcaccgcctcctagctcaaagccggtcggactctgatccgggaaatcggtgaacgaactcaccgtatcagtcggggattcctgggatttgttatcgatcatattttaacggcccaccccaagagtataaatgtagttgcgaatacgatagattgatcaaacgccgagggcctcgccaccattaccaagcatgcggagagagagagagccgcagcggggcaaaccccgaaacatcgacgctggtgcctcgggtgccggccctggtgcctcaccggacaaaacggatgattgcgctcgggaatcaccctctttcgatgccgatcgagccaccacacctgggacccgtccctcaccgactcccaatcttggaggattggtcggggctcttcgtcaaagcacgctggtgcgagacggcacctcgtcaggcataattgatggaaagaggaaagggaattcttcgtcagaaccggacatcgcaatggagccaccacgcgccatcgccagagcattgccactacctggtagcggcaagtctggcatacccgagttcgctagctagtcatctatgtttagcacgtttctctgggtgcatcaggtcttactgtcttagtgggagggattcgctagggcgccagcgagccaccgccattctcgcgtgcgccaccttgcctggatgccgtgcgcggagccgggcggcgggaatgtgaatgccagccgttgatcgagtggtgaacggttgggattacactgagggacactttgccatttttgatacgaggcgttgatctgtaatcgtgcgggaaagaatatatcggttcgtaataaatccgaaccccagatttcggatcatgtggcttcaagcttgtaccagttcgggaaggggttggatctaatccacaccgtgggtctgagatcctacagttcagatgtgagcgtacacctttagtggaggcaaaattgtttaagagtcctcagagtattgggaaataaacccatagcccaggttagtttagaaaacgtttaattcaagtccataaattttcagaatgacccctatattttgcaaaaccttatcccgccgtctagggaccttgtttttacacccaggctagagatggcaacggataaatatcaatcgggtattactatcacatacccatacccacgacaaaaaaataacctcgttaggtcacccatattcactggtgggtatggatttacccacatacccatacccatgtgggtatggtcacccgccaatgacccatacccacaaagattagacatatatgatatatcatatgcaataagcatcattcaacaaatatagtgaactataaaaaatactagctactaaacatcaaatttaaataaagcatgtgccataattaagcttcacaccatttgatttctaaaattatatatagacacacg

SEQ ID NO: 14270 - DNA, 2562 bp, Zea mays
gatcgatttgtcaacgaatcagctcaccggagatatacctgaagatttcggcaatctcaagaacctcacaatactgtttctgtacaacaaccagctcagcggcaccatcccggcaagcatcgggctgttaccacagctcaaggatatccgcttgttccaaaaccagctgtccggagagctcccgccggagctgggcaagcactcgccgttgggcaacctcgaggtgtccatcaacaacctctccggcccgctgcgagagtcgctctgcgccaacgggaagctcttcgacatcgtcgccttcaacaacagcttctcaggcgagctccccgcggaactcggggactgcatcactataaacaacctgatgctacacaacaacaacttctcaggcgacttcccggagaagatatggtcgttcccgaatctgaccttggtgatggtccagaacaacagtttcaccggcaccctgccggcccagatatcctccaaaatggcacggattgagataggcaacaacaggttctccggctccttcccggcctctgcaccagcgctcaaggtgctccatgcggagaacaaccggctgggcggcgagttgccgcctgacatgagcaagctcgccaaccttactgatttgtcagtgcccggcaaccagatctctggctccatcccaacatcgatcaagctgctgcagaaactgaattcactcgacatgagaggcaaccggctgtccagcgccatacctcctgggagcatcgggcttctcccagcactgacgatgcttgacctgtccgacaatgagatcaccggcagcatcccgtcagacgtaagcaacgtgttcaacttgcttaacttgtcatcaaaccagctcaccggcgaggtgccggcgcagctgcagagtgcagcctacgaccagagcttcctcggcaaccggctctgcgccagggcggactcaggcacgaacctcccaacgtgtccagccggatgccgggggtgccacgacgagctttccaagggcctgatcatcctcttcgcgatgctcgctgccattgtcctcgtcggctgcatcggcattgcctggctgctgttccggcgccggaaggagagccaggaggtgacggactggaagatgacggcgttcacgcagctcaacttctccgaatcggacgtgctcagcaacatccgcgaggagaacgtgatcggcagcggcgggtccggaaaggtgtaccggatccatctcggcaacggtaatgccagccacagcgaggagcgcggcatcggcggcgacggcaggatggtcgccgtcaagaggatatggaactcaaggaaggtcgacgagaagctggacaaggagttcgaatcggaggtgaaggtgctgggcaacatcaggcacaacaacatcgtgaagctgctctgctgcatctcgagccaggaagccaagttgctggtgtacgagtacatggagaacggcagcctggaccggtggctgcaccaccgagaccgggagggcgcgcccgcgccgctggactggccgaccaggctcgccatcgccgtcgacgcggccaaggggctcagctacatgcaccacgactgcgctcccccgatcgtgcaccgcgacgtcaagtccagcaacatcctgctggacccggacttccaggccaagatcgccgactttgggctcgcccggattctcgtcaagtcaggcgagccccagtcagtgtcagccatcggcgggacattcgggtacatggctccagaatatgggtacaggccgaaggtaagcgagaaggtggacgtctacagcttcggcgtcgtcctgctagaacttacaaccggcaaggtcgcgaacgacagcggcgcggacctgtgcctggcagaatgggcatggcggcggtaccagagaggcccgctactcgacgacgtcgtcgacgaagccatccgggagccggcttacatgcaagatatcctgtcggtgttcaccctcggcgtgatctgcacgggggagaacccgctgacgcggccgtcgatgaaagaggtcctgcaccagctcatcaggtgcgaacagatcgccgctgaggcagaggcgtgccaggcgagctaccagggcggcggaggcggcggcacgccgctcctcgagtcgaggaagaaaggcagccggcgacagagcatgtctgactccggacggtggaacgacgacgacgaggaggacagcggcaacttcgttgtgcacgtggtgtagtcggttcggacagtatacagctactggcctcctgctgcaagctcatccatggaggaatttcgtagaggcgccggaggccggcctctgcggagcaggcgcctgaagatggccgatccggcatgagcgcaagaacaaacaaccaagtgtagtatatagatgaatgaccgaagaggtaaggctgtggaatttagctacaaaaccacaagccaatctccaatcactcaagaaggaggttctggagatgttggatcgcgatcgcacttagcaagtgtcaatactgcgtgtaataacaagtgccagttctgggcacttttgggtttcag

SEQ ID NO: 14271 - DNA, 1652 bp, Zea mays
agagcattagaaggtaaaacacggcggagacgaccggccgccgcgtgcgtccaccgcttcgagaaattaattaatcaccttctagcgtagcattagcatcagcgcgcatatatatgttttggttttgcaacttttgtgtggcagataacgtagagaagacggcggaggcggcgatcgaggtgatcgactcggtggcggaggcgaccgagaaggtcgccgacgaggttgcgcaagcgttccccggcagtgaaactctcaagcaggcagcctccaagattaagacgatcgcggatgagatcgaggaagatgccgacaaagctgaggccctgattgagaaggttgacgagataaagaaagaggtggattcaatcgtcgatcctatactcgacaaggtcgccaaagacaagtcctagagaaagagcccaactggaggagacaaataaaacatccagtaaattagtttaagaagcattagttgagcagtaaccggaagacactacgtacgggggcaacatgacacgtcgggtgtcatcacctatttctctcatcgattcattgctttcagtttcagtcacgtgtttgttcagttttagtgacttcctccctacgaaattctatgagagaacaaatttccttggatgttttattgtcaagtgcttgtgcagttgtgcttgtacatacagtcgctgacatcttaacaagaaccacggtagggcaaatttgctcgatcgccacttacgaacttcgccgcaagtcgcctacggggtagccaaaaatgctactggacatcggtaggaatgcaaattgctggaattgtagttttttaaaaaagaaactttataattttgactaatatttgaaatatgaacgaacctcacatcaataaaaaaacgaattaccactatacatattcaccagagatcacaggtagaattgaatattataaaaaaatgtgaaattttgaccgaaatattgaaccctggttgcaactagtgtgaattctgttccttgttctttttaacgtttttttagtttcagttctctcttttaaaaaaatatatatttatgcacttaggcatcttaatttgcttttgacctaaagagttaatattgtgacctaaggctatccgcactcatactaccctatttctctactctaaaagaaatattctactctatccaacaatactctgcagtcatgtttactctaaatatctaccctataccaactaccatatttattattattatttttaactgctacccctatctctctttcctccctccaatccacgcatgtacacgcaagatagagttgatctccgtactgcactacatctggggtgagagaacgtgaactctaccgtagggtgcgatttgaagtccttcactgcagctgttcagtcactctatacgtactctatacctttagagtaggcatttgaagtcgttcactgcggacagcctaaggcgtcacaataatacatctgacatcttggtaccgtagatcaatgacgttgaggttaaagacccgcatcgacgtggctaactggctacttgtggtattgatgtggctagaggctcagactatctgcaacggttacccctaaaattttccccctatatcacttttttgcgtcacatcatcaaca

SEQ ID NO: 14272 - DNA, 1127 bp, Zea mays
ccatgcttggtcttcggtctccgggtttaattttttcggctccggccggggcccgtcgcctctctctatatcatctccttgctgtgtatcatcactagttactccctccttttatatactgctagctggttccgagtgattacccacagcaacagaagcagttctccaggcaatagactagctagatgcgcatcaccaaagagtagctttcgtctagaacgaagaaacaccccccactacatggccgcgctcagttcttgtgttgcttctggaggcctggcacttcaggccacccttgtggtttctcctcctcgccgccgcgggactccagtcgtcatctccgtatcatctcatggtcgccgcccaagtcttatcggctccaccatgaatccttcaggcatggctccgatcaaaagaactacacgaattcgtgcggttcatccatgccctgcaaattcgttaggaggaagcctcaccatcatcccaatacctgacctgctttcatcatggctctggatgttcggagcggccatagctgcagcagtgcctctttacagaaggttcagagcattagaagataacgtagagaagacggcggaggcggcgatcgaggtgatcgactcggtggcggaggcgaccgagaaggtcgccgacgaggttgcgcaagcgttccccggcagtgaaactctcaagcaggcagcctccaagattaagacgatcgcggatgagatcgaggaagatgccgacaaagctgaggccctgattgagaaggttgacgagataaagaaagaggtggattcaatcgtcgatcctatactcgacaaggtcgccaaagacaagtcctagagaaagagcccaactggaggagacaaataaaacatccagtaaattagtttaagaagcattagttgagcagtaaccggaagacactacgtacgggggcaacatgacacgtcgggtgtcatcacctatttctctcatcgattcattgctttcagtttcagtcacgtgtttgttcagttttagtgacttcctccctacgaacttctatgagagaacaaatttccttggatgttttattgacaagtgcttgtgcaaaaaaaaaaaaaaaaaaaaaaaaaaaaaaa

SEQ ID NO: 14273 - DNA, 3640 bp, Zea mays
  misc_feature (1387)..(1387): n is a, c, g, or t
tctgctcgccgcacagaacctcctcgtcgtcagacgttagattccacatcagaaaggccgaatcccgccggccgccgctgcctcgccgaccgttctggctccagttgctctacctcttcgccagggatggtggacagcgacagtccctggcccggcacgcgttgcatcaaggccgactgcacctgtcaagcaaaggtgagtgctttctgtttaatttcttgtatggtgcctggtgcgtgcgtgctcgagacggtctcggttactgccggagctgtgtgtgcgagtgtggtgccatggcatgtaacgaacgcagtcgtgcccacagcctgttcgtggaaacgtcctcaagcagaagcagtcctagggatgaacggttaacgtgttcgacgttgacatgcacgtacgtattgctggatgctctgtggcgctattgctggagaggcaggaggagagcggcgcctgtattttcagctctcgtcaccccactctggaaacaaacaagaatttgcaccaaccgagcacatacgctggttgtggttgaattcttcaatttgttatttgtcttaaattaacacggtgtcgtttcacccaattcattattgagactgggacatctcaccttcttcttttgtctttttagttgacctgactcttctaactcatcgcccatccctttctggctttttcgaattcttgtcgctaaggataatatatgtcggctttggggccctcgtgcccggccgggtccacgtcccgctcgagccaaaatcaaagaaggtcactgcagacctgaagcctagcaactaagttgtgcctaaaaggtctcttcagccaaaaccccgcaagctcagttttccattgagaagatgcctggagattgcagggtggacagctgttgatgaggttccgaggaggactatatggcatactgaagatccaatcagtaaagaaacatatatttttatccttcagcctttgaaacaagaacagagaggttttctcgcaaagaagcgcttcaggagcccaaaagtctgcacatcatatttttctgcctcttctaacttctaagtgggacttctgaaggctggaccgctgaacgcatgaccagtacaaaacggcatagcttctttttctttattcttctctttcagaggctttggtgagagttatcaacatctcttctgtatcagatgttatcaagatttctattgtcggaatttttactactggcataacatggatctgccagaaaatgagctacaaagatacataaaggacaatggcaaaccaatgtggacagcacataacaatcacaacataaggtatttcaaagaagaagatataagaataatcactaacaactataacactttccttgggaaagggngcatttggagaagtttataaaggggttcttgatgataacagtttagttgctgtaaagaagtacatccataatgtaaaggaggactttgccaaagaagtgattgtccattgccaaatcaatcaccggaatgtagttagactcattggttattgtataggtgaaaatgcactaatgatggtgactgaatatatctctagaggaaacctcagtgatattcttcactccagtgaaatttctatatctttggaaacacgattgagtattgctatagggtgtgcagaagcattaagctatatgcattcgcaaatgtatgggaaagtcatccatggagacattaagcctgccaacatacttctcgatgacaacctcactgcaaaaatatcagactttgggatatcaaagttactttcaacggataataccttatacaccacacatgtactggggagcatagggtatatggatcctttgtttgcacggagcggacgcctcacctcaaagagtgatgtttatagttttggagttgttctcttggaactgattacaagaagaaaggctgtcgatggtggttaaattagccttactgaaaacttcactcaagctctagcgaaacggaataagatacgggaattttatgatgtaaaagttgcagatgagaacagtttgaggattcttgatggaattgggaaactagcagcaaaatgtttagcaatggaaatagagaaacgtccagaaatgaaagatgttgcagaacagcttcggatgtttagaaaaactcaatatcagtcacaagaaaaaatatttttctttggctgggtacggagaagcaaacagccaccccaaaatatggtccagattcacaaaaatcgtggaaatcaagttcttaaagcggaggtacaaacacaggaagtcagtaaagtagataaagatgttcataatgtcacagtagtgagagataggagttcaaaactttacagctttggttcatcgcaggggatagaattagaaaagctgttggaagcatctgccgaggttcttgggaaaggcaagtatggaacaacatacaagactacactgcatgatggttccacgttaattataaagagactgaagactctagacgtgccagaggcagtgttcaagaaacgaatagtagcaataggaacaattgagcatgagcttgtagtcccactacgtcagtactactacagcaaggatgagaagctactggtgtatgattattttcccaatggtagcctagcttccaatcttcatggaaaagatgtgaagccagtaggctgggagactcggtctgccattgcactctctgtagctcgtgctgttgccttcatccactcaaccaatgctgcagcttcccatggcaacatcagctcctccaacgttcttctcaccagtaactacgagggacttgtctcagaacacggcctcaaaactcttgtcagtatcccaacgttacttgctgacaacaacattgcacaaaaggatgatgtgtacagttttggcgtcatactgcttgagatgctcacaagcaagtcaccaatcgtcacagacgagccagatttggtcgattgggttttatcaataccccatgagcactgggcaacacaagcattcgataagaagctccttacaaacaaaactgtggtagaggagctggttcagtttctcaaacttgcaattcattgctgtgacaagaaccccacaatgagaccagcaatggcagaagttgttcaacggattgaggggatacgacgtttctacagctgggaataggcaccttatgtggaacagcagtgcaggttgagaggaacaaactttgagccaaggaacacgaggatacaaattttactgtgagcatacactactgttacaagcatttcttgttgtctgaaaaagacactcacgttccatcacttggttgtttgcgataccgtttccgtttgaaatatagagctctttttcaccaacattttgttctagtacacatgacacatattgtatattgagggtgctattttgttgcaattatgtcagggacgtgacaaaccgacttagttctatggaagcgggaagatgtgattcatttgtaatccatttgtgtgtttgggccctatgatggtcgtattagtagtgggccgtattggcctagtgttgtaatacaaatactggacaagtagtgaagaaagacagaaaaatagaatatcgaaaattccccataaaaaaaaaaaaaaa

SEQ ID NO: 14274 - DNA, 1358 bp, Zea mays
acaccaggcccccgccacgtttttcccccctgaaaaaagggggccgtggggccccccccccatttaagggggggttgccccccccctttgccccccccggggtttccctttataatttccggtcctttatttttggggaaatttgagcgggtaaaccatttccccccggaacaagtttggccctgtttcccccactctggaattaaccctccctaaagggaccaaaagtggagcttccccccgggggcggccgtttcagaactaggggttccccgggctgccggaattcggccggagagagagagctcactagtcccccccccccattcccagtcatctccactctccagcagtcctcacgttccttctctctctcccccccgctttaggtttgcctgtgttgggtagagtcgtatagcgaggagaagaggcttggtgccaagaaactggcatttcgatttggggagtggctaaattcgtcgctgtggaatcatggttctggagtcgtacacaaatctgctagatatgtgttgtgaagatgtgtttgacttccaacaacctttaagatctcttcgtcatgtggtgaactctcctggcatcatatctgaccctgattgggaaagtagtaatgatggcaactcagttggttctatgcctttttgttttaagagaaagattattgttgcaaatttccttcctgtgatctgtgcaaaaaatgaagctaccggagaatggtcctttgccatgggtgataatcaactgcttgttcaactcaaagatggttttccaattgataatgaagttatttatgtgggtagtttgaatgttcaagttgatcctattgagcaagatcgagtttctcagaagcacttcaaggaacacagatgcgtacctacctttctcccagctgaactccagcatcaattctatcacatattctgcaaacagcacttatggccacttttccattatatgctttttgtttgtcatgacaaagatgagctctttgaccgttcactttttcaagcctacgtgcgggccaacaaaatttttgctggcaaaattgtggaggcagtcaattcggatgatgattgtgtgtgggttcatgattatcacctcatgcttatcccaacccttttaagaaagaaactgcaccggatcaaagttggtttcttcctccacagcccatttccctcgtctgagatctataggacactgccagtgcgggatgaaattctaaaatcacttcttaatgctgacctcattggctttcaaacttttgactatgcccgccacttcctttcatgttgcagcaggcttttaggccttaattatgagtccaaacgtggccacatagg

SEQ ID NO: 14275 - DNA, 798 bp, Zea mays
  misc_feature (700)..(700): n is a, c, g, or t
acgactatactccgtatttccgttgatcacttctcccattcccagtcatctccactctccagcagtcctcacgttccctctctctctctctctttctctctctcccgctttaggtttgcctgtgttgggtagagtcgtatagcgtggagaagaggcttggtgccaagaaactggcatttcgatttggggagtggctaaattcgtcgctgtggaatcatggttctgaagtcgcacacaaatctgctagatatgtgttgtgaagatgtgtttgacttccaacaacctttaagatctcctcgtcatgtggtgaactctcctggcatcatatctgaccctgattgggaaagtagtaatgatggcaactcagttggttctatgcctttttgttttaagagaaagattattgttgcaaatttccttcctgtgatctgtgcaaaaaatgaagctaccggagaatggtcctttgccatggatgataatcaactgcttgttcaactcaaagatggttttccaattggtaatgaagttatttatgtgggtagtttgaatgttcaagttgatcctattgagcaagatcgagtttctcagaagctcttcaaggaacacagatgcgtacctacctttctcccagctgaactccagcatcaattctatcacatattctgcaaacagcacttatggccacttttccatgatatgncttcctgtttggcatgacaaagatgagctctttgaccgttccctttttcaagcctacgtgcgggccaacaaaatttttgctgacaaaattgtggagca

SEQ ID NO: 14276 - DNA, 2418 bp, Zea mays
  misc_feature (2379)..(2380): n is a, c, g, or t
  misc_feature (2385)..(2386): n is a, c, g, or t
tttcgcttttctactcgacccataatactgatagagtcagattaaatcatcttatcgatgtatcctttgaatttgttaattattatcatggcagtgttcgagattgcctgtgctgtgaacacttgaatgtagctaacattagttttgtccttgagtgtatcttggcaagcatttttattttttcagatgtttttaaaatattaaaatgatgtattttttgttgtaatgatggtccatcgattgagtgacaatatttatatgtttaagaaaaagaaagtgaaagagcctctagctaagttggttaggtggtctgagtagcactccctaggtcctgactttgaatcctagtgggagcgaagtttaggcagaggttaaaaaaaaggttactcgatggttcccctggttgtgtgcacacgagatggactggcctatggagggaggatcctcgtgtaggggctgggagggctcaaagcacgattgtacgagtaaagatctggtctataggggcggtctttcccctatcggtcgagttgttttattagagtttgtgcccatgtaatgcacacacatatatctgtaggtgatatttttctattcccatgggccgaattttttttgtttatgtgtaagtaatattttattggttgtaaaggtctaactattagtatttttggtgtctctttgcaggaatcatggttctgaagtcgcacacaaatctgctagatatgtgttgtgaagatgtgtttgacttccaacaacctttaagatctcctcgtcatgtggtgaactctcctggcatcatatctgaccctgattgggaaagtagtaatgatggcaactcagttggttctatgcctttttgttttaagagaaagattattgttgcaaatttccttcctgtgatctgtgcaaaaaatgaagctaccggagaatggtcctttgccatggatgataatcaactgcttgttcaactcaaagatggttttccaattggtaatgaagttatttatgtgggtagtttgaatgttcaagttgatcctattgagcaagatcgagtttctcagaagctcttcaaggaacacagatgcgtacctacctttctcccagctgaactccagcatcaattctatcacatattctgcaaacagcacttatggccacttttccattatatgcttcctgtttgtcatgacaaagatgagctctttgaccgttccctttttcaagcctacgtgcgggccaacaaaatttttgctgacaaaattgtggaggcagtcaattcggatgatgattgtgtgtgggttcatgattatcacctcatgcttatcccaacccttttaagaaagaaactgcaccggatcaaagttggtttcttcctccacagcccatttccctcgtctgagatctataggacactgccagtgcgggatgaaattctaaaatcacttcttaatgctgacctcattggctttcaaacttttgactatgcccgccacttcctttcatgttgcagcaggcttttaggccttaattatgagtccaaacgtggccacataggtatagagtacttcggccgaacagtgagcctcaagattcttgctgcaggtgtacatgttggccggcttgaggctacattgaagttgcctgctacaattaaaaaggttcaagaaattgagagtagatatagtggcaagttggtaatattaggtgtagatgacatggacatctttaaaggtatcagtctaaaactgcttggcttggagcttcttctggaaagaacacctaagcttcgaggcaaggttgtccttgtacagattgttaatcctgcaagaagcatcggaaaagacattgaggaagcgaaatatgaagctgaatctgtagctcaaaggataaatgataaatatggttctgctaattacaagcctgttgtcctcattgactactcaatacctttctatgaaaagatcgcattttatgctgcatctgactgctgtattgtaaatgctgtgagggatggcatgaatttgataccgtatgagtacaccgtatgcaggcagggaaatgaggagcttgataagctcagaggtcttaataagagctcatctcacacaagcacacttattgtgtctgaatttgtgggttgctctccatcacttagtggagcattcagggtaaatccttggagtatggaagatgtggctgatgcattatacagtgtaacagacctgacacgatatgagaaagaatctgcgccatgaaaagcactatcgctatgtcaggtctcatggatgttgcttactgggcacgcagctttgaccaggatctggataaggcatgcatagaggcatacagccaaagatgttggacaactgggttggnntaaanntttaaagttatggcccttcccctgggttaaaa

SEQ ID NO: 14277 - DNA, 2383 bp, Zea mays
ccccgaagtgggggcagatcccactagctgtcggaggaaacctagcggaattaggggccaaacccacccgtacgaaataatcagcgctccaagccatgaaaatcacgggttcgattgtttgctctagaaagatctctagagaatgggcaattaggggtccctccatctccatcgcatcggaagacatgggaagagcaagcgcatattgagcgggtactacatgatcatttcctatttaggaagcttactgactcacaatgtcatgttctacttgattgtatgcaacgagttgaggtgaaacctagggatatagtagtacaacagggcggtgaaggtgactgcttctatgtagttggtagtggtgagtatgaagttctggctattcaggaagaaaatggaaaggaaataaccaaggttctgcatcggtatacagctgacaagttatcttcttttggggagctagcactaatgcacaataagccgcttcaggcttcagttcgtgctgtgaccagtggaacattatgggctctaaagagggaggacttccggggtattttgatgtcagaattttcaaacataccatcattgaagttgctccgatctgtacaactgtttacaagatttacagtgcttcaactaagtcaacttgccgagtcacttgttgaagtatcttttgcagatgggcaaataatagtagataagaatgataaattctcttctctgtatatcattcaaagaggtcgtgtgagacttatattggctactgatcaaatgacttcagatacttgggatctcattagtgctgaaacaaagcaggcacaaagtagtcgggaaaatggtaattatgtgcttgatatagatgagggagggcacttcggagagtggtctctcattggtgagactattgctttcactgctattgctgttggtgatgttacttgttctactatcacaaaggagaaatttgactcaattgttgggccttttcctaaactttcgcaagctgattccaagattaaagaatctctggtaactctggagaatgttgcagatggtgatttcccttttaggagggtgaagctctcagatttggtacggggaatggaaaatgtgcatatatgctgctgattgcagtgagattggtcttgtccaagtcaggggctatgacaagatgagaactttaaaaaggttttacatcaagagagtacaagatctccataaggaagtacaagtatttgaggaaaaggaccttatgaaaagcttgagcaaatcaacttgcgtgccagaagttctgtctacttgtgctgatcagtcataccttggaatattactgaattgttgcctttgttgctcactggcttcaatacttcatacaccactaaatgagacatctgcaagattctttgcagcctcagttgttgttgctctagaagaacttcatcagaagtccattatctatagaggtgtttcggcagacattcttatgctcgacagatcaggacatctgcagctggtggattttaggtttgcaaagaagttggaaggtcaaaggacatacacaatatgtgggatcgctgactctctggcaccagagattgttcttggtaggggtcatggatttcctgctgactggtgggcacttggagttttgatctatttcatgcttcagtcagacatgccattcgggtcctggagggagagcgagctggaacctattacaaaaattgccaaaggccaccttgttatgccagtgtctttcagtgcagaagttgttgaccttataaccaagctactcgtggtcgacgaaaacgcgcgccttggaaccagtggtgctgaagctgtgaagaaacacccctggtttgatggcactgattgggagcgaatagcatctgggacttgtgcagcacctgaagaaatcactgagcgcatcaactactgtatagaaactcttaatgaggacttgtccgcatctccttccgtgccgattgaagacccagatgatctcactgctccagagtggatccaggattggtgatctcaatagttgcatgactgtccaatgatgaattgttctagttgaggaaaacgtctctagtttttcaccgagcattctcatatcaaatggaagaaggtatacataagagttgatcgaactgacaagttgtacataccaaagattattccttctgtgatcatagatcagaatttgagatgccaagcaacagagactttggtctatgtttgctgcatagttcctggtaagaaggatctggatagtttgttggtgatccatgtacatgaactttggatcttctgtaattatatatccaatttgtgcactccaaaaaaaaaaaaaaaaaaaaaaaaaaaactcgaaggaggg

SEQ ID NO: 14278 - DNA, 3989 bp, Zea mays
  misc_feature (1561)..(1561): n is a, c, g, or t
  misc_feature (2404)..(2404): n is a, c, g, or t
  misc_feature (2416)..(2416): n is a, c, g, or t
  misc_feature (3441)..(3441): n is a, c, g, or t
tcaacagggaattaacagagctgagagcctgtgctctggtgaccaatcctgggttgtgcgtctcttgtcgaccaccaaagcccgctatctggaggcagcggcgtttgacgacctctgcctaaggcacgacgaggtcaaggtctagtgtcacaagccagaagtcttcctattctgcttcatgctcacaccagaaatggcgagaatgcattcaagaaggattttatccagtagtggggcatcgaggttcacctccagccacgtgtggcgcaatctcactaatgcgcttgcgtcaaagctgcattatcacgtccatcaatctgtcttgatcaggtgccggtgcatgtctggtacggaacctcgcggaacgcatcatcggcagcgcgtgctcaatgcagtgcattgacaccaacttgctgcaccttgacgacccgcgtggcatgctctgtgggctcggactttggacgccatccgaatcgccaagatcatgtgggtaacggtcgccagccacaacatggatggattgtcatctcctgtgtacattatcgacatcctcaaggagaccagcatttttggactgtaaagcatcatcaggtcgatgcggtacaggcagttgtaccttgtgagcggagctggaggaacatcgtctcgccatgatgaaatgcaacggtgacatgtgcttacaggcagagaacagtggcggacaaagctgctatgctaacacttaaaaaatagtggtgtaataaaaaaacagggattatcaagactcgatccttgactaccaagttcaagatataacacttaaaccactatactaactactcttatgtaatcttacggtgtgccgtggcccatatggaccacccgctgggtctgcccctggcagagaatcgtggtgcccattgatcattacataaagaacaattaccaatacatccttaataataataatttttttataaatagtcttcttcagttaaatggtaaaaaaaaactaaagtgcctaaaggtaccaatagcactttcccaaccattgtaaaagagctcttgttttaattttgtttcctgttttaaccatggaccagacaagatgagaactttaaaaaggttttacatcaagagagtacaagatctccataaggaagtacaagtatttgaggaaaaggaccttatgaaaagcttgagcaaatcaacttgcgtgccagaagttctgtctacttgtgctgatcagtcataccttggaatattactgaattgttgcctttgttgctcactggcttcaatacttcatacaccactaaatgagacatctgcaagattctttgcagcctcagttgttgttgctctagaagaacttcatcaggtgataactgttttgcttttctttattgagtaattggcacatgaaatgttatatgttcagattcttttgtttagttaaaccacatgtgttacagatgtttcccttgacatgcatgttgatatgtatttatgcattttcagaagtccattatctatagaggtgtttcggcagacattcttatgctcgacagatcaggacatntgcagctggtggattttaggtttgcaaagaagttggaaggtcaaaggacatacacaatatgtgggatcgctgactctctggcaccagagattgttcttggtaggggtcatggatttcctgctgactggtaagtggttattgacccctttcgtttatatgcattccatatcactggatcaactatgtgtcttgagttcttatcaaagacaaagttgtggttaccgattatctttctaatgtgtccctaagaattttaaagcagtgtgcagtatttcctatcagtttcgtatgcgaacaatgaaaatgccatttttccttgtgacctctgtatatggaacaatactgtctatgcactgcatagcatttttacagatgcgcaaacattgaaatgctgtttacagacattgccatttccaaatctacctgacattctcagaacagactgaaacatgcaaactgcagtagaaaccttcttcccaacaaaaataaatggaggtatccaccccaaaagaaaaaaaaataacgtaacctgagctgacagagtgacagtacaatatctttttcggacatggaagacttgattggaaattatgacaggtccctttgattttgtatgatcaggtgggcacttggagttttgatctatttcatgcttcagtcagacatgccattcgggtcctggagggagagcgagctggaacctattacaaaaattgccaaaggccaccttgttatgccagtgtctttcagtgcagaagttgttgaccttatttccttggtttttttcccatgcgaaaatagtagttcacctattcatttaatttcagcttattcgaacttcanaaagcagctttngttattttcatttataactatgttaacagctactcgtggtcgacgaaaacgcgcgccttggaaccagtggtgctgaagctgtgaagaaacacccctggtttgatggcactgattgggagcgaatagcatctgggacttgtgcagcacctgaagaaatcactgagcgcatcaactactgtatagaaactcttaatgaggacttatccgcatctccttccgtgccgattgaagacccagatgatctcactgctccagagtggatccaggattggtgatctcaatagttgcatgactgtccaatgatgaattgttctagttgaggaaaacgtctctagtttttcaccgagcattctcatatcaaatggaagaaggtatacataagagttgatcgaactgacaagttgtacataccaaagattattccttctgtgatcatagatcagaatttgagatgccaagcaacagagactttggtctatgtttgctgcatagttcctggtaagaaggatctggatagtttgttggtgatccatgtaattatatatccaatttgtgcactcccttgctgtttcggaaatggatactggtcgggaggaaggtcaataattatcgttgtgaatacggacatttctttcatctgccactgtcaatcgatttgtacaagatcaagttttccaaatataattatgaaggttaccaaaacaagagcttgttatctcatatacacggtgcaaataacctgcgacgcgacatttggcatctggacactacacctacctaaaacaaaacttgatgcataatttaaataaaatacgtaaaatacaaaaaaatacataactcataaaaaagactacataaattatgtaaagcaaatagaatgcgacaataaaaaaaattacatagttcataaaagactactcatcgtactcaactttttcatcaatgtcttggtcttctatttttagttgtttggcgaattttttaatggccaacatgtaaatcctttcatgtcttcattcatgtgnttggtgcttgttaacggttgttatttcacgagttcgatcatcaactatctttgctactaattgactaactttgctactaattgagttccacaaggtgtttagagtattttgatgcatgttataaaaacaagcaaaatgagtgcaaattgctaagctttggagtaaacatggtgaagttatggaagatccatggtcagacagctgcccgcccacttggttaagccaaacacactccccctcagtcatgcatgtttgtcatgatgcatctcatgcaacttaaggtgtagtcacatggatgatacgtcaaaaatccaaaagaccgccacgtcatcaatccaacacttagattggtgaagtcagcaatccaaggtaccttgatctaatggttaaatagaaaacaaaactttcatccaatggttgatgaagaaatgcagaaataattatcaaaccgacctcaagaaagcatgtggagcgttggatgaaggatggagggagaggaggggccggtcagcctagtgacttagccgcccaactaagtaatgaccaca

SEQ ID NO: 14279 - DNA, 2909 bp, Zea mays
  misc_feature (967)..(967): n is a, c, g, or t
tgacatgaacaatgattcgacgatccgcaaagagcagatgcagataaatctacaaatggagggtggacgaacgcacatatgacagaggaggacaccagcgcggttgaggtgattggcgcgacttggacaccagcgccggcaaggggaccctagccaccgacgcggcggggtgccaggagcgctcctgcaccacgactgcacagatctgagaagggagtactacgactggcttcattcgcgaatcgagtcgtcgtcctggtcgaggcgttcccaggaagtcagcggcgagatccgccatgagcatgtgcaccttggtgcggctcaggttcgttgtgcccactggccccaactcctgcaacgtgtacccagcgtagctccacgacaccaccttgaagatcctgctgctagtagtggtagcgacggtggtgctagcggtggcagtggtttgggcagaggatttctagagctgcttaaggcgacgaggtaaggaagcagcgagggacgcgggcagggcgagcactcggtgggatctaatttgcagggaggatccgaggggagggggatcggtggagtgagcgggggaacagtggtttgtgcgtgcgcggagggggccgagcgagggcgatggcggcatagacgtcccgcagcagacacaagcatggcggtctagagcctcggtgggggagatggggcgggagggcacgccctagcttgtccccgaccacatcctggcatgggttgcagatccaccgcgtgccgacgtttgagagggagataggactccacaacggcacggtgatggcgatggtgtttaagaaggagaagggagatatgactcctgcccgcgatagggggcggcagcagtggatccgcggggtagggggtgcgtgattaggggaaggggaagacggatcggtgggacgggaggaaggcagaaccatgcaccgtggatgcctacactctattnttaagaagtagtagagattttgatttgtgatttatatattgtagttttgtttattttggtatgtcaattatgataatttgtacacttagctacatatttttaattatattttaaatttagttaattttaaaattatttaatttcttaggtataaaatgtatcgttctaggaccgacggagtagtcggtaaaaacaagagtcgagaaagactgagatgggagtgaacaagaggaatttgatatttcgccactttactttagcatccatttacattgtgttactgacaccacagtcatgacatagtaaaaatttgccaccacttctaaggttatgtttggggcagttctaactccagtaaatttggtggagttggtgaaacagattattaggtgctccagaaaataatgaaactggagctctaagcttttagaagacatttagacaagtcattttatttgttatttaaattaaaaatatttttaaaattaattaaattaatattataaactatctggaggcattcaaacaccacccttagtgctcgttcgctttgagctgattggacagttcgtagctgtattccaggcggaatgaacgagtctggtttggaatccggttccacctgctagaactattcgttttgatattggccgaaaagaaaaccgcttgaattcgagctaaccctttaatctttggcctggaacaaactcagacaatccacctttcggattgattcccagccaagaaacagactagtgaccatgattaagtggctggattggttactgatccggttttgattcacatctgccgaacgaggccttaaggttttatttgggtactttattattgatcaaaattcatatgtattatcgtgttgaggtggattaaagtataaattagtttaaattacatcctatctaagtcaacatatgtggactggggtcaatagtacccaaactcgtgacaagcagttaatttttcgagtgaacaaagagacgggggcacagtagtagaccgcggaatccgatctaaccctaaacccgaatcccaaacggaggagggcactcggcgaggcaggtggcgattctgcgattctcctgtcaccttccgtcgtctccatccccttccatttccggcgagggtcaaagcaggcctcttgctcttgggggtggtttgagagagggagagaacatggccgcggcggcggtgttggtggtgctcacggtgtcagcgctggcgggggcagcggccggcggtgatatcgtccaccacgatgacgaggcacccaagatccctggatgctccaacgattttatcctggtaaaagtgcaaagctgggtcaatggcaaagagggtggcgagtttgttggcgtcggtgctcggtttggtccaaaaatcgtctccaaggagaagcacgcaaaccgaactaaactcacgctggcagaccctatggactgctgctctcctccgaaacataaggttcctggagatgttcttttagttcaaaggggaaagtgcaaattcacaaagaaagcaaagtttgctgaagctgctggtgcttctgctatagtaatcataaaccatgtccacgaattgtacaagatggtctgcgaaaagaatgaaaccgaccttgacataaatatacctgcagttctcctaccaaaagatgcaggttctgctttacatacacttcttacaaatggtaacacagtttctgtgcagctttactctccagatcgacctgtagttgacactgcagaggtgtttctatggcttatggctgttggcacagtacttggtgcttcctactggtcagcatggagtgctagagaagcagttattgaacaagagaagctcctcaaggatggccatgaagaccctactgattgttgaggccagaggttctagtggcatggtagatatcaatgtggcatcagcg

SEQ ID NO: 14280 - DNA, 2879 bp, Zea mays
tgcagttggaataggataaataagagacataaaaagagagaaaacaaaagaactaaatggagatgcggggtatcgatccccgtacctctcgcatgctaagcgagcgttctaccatctgaactacatccccgtttgtttgattgggggattgtacaacttaatatagtcacagtgttttaggaaatgcaaccagacatcattttttttatgcgcgcgaggaaggcattacctataactaaattgacgcctttgggcacccgatgcactaggtaaccatagcggtatatacctctgcaaaaatgctgacaacatgaggctgtgcaagatagtttaaagtcctaaactaagaaatgcaagtttttattgaacttctcccaactgcaaattttccaagctgaaaacagaaacatagaggtgaagagctttagatattgtttagttcagaagctgtaacgtaaatgacaactataataattcacactcgagtgccttctgggcagcttgcaagacgctttctttagcatcagtatactccaactgaattgtcctaattttgccgcagtagaaaagataccagcagcacttgcctacaccaacatccacattccacacgaaatcaaatagaaattttcatgtactggaaacataattttaaattcctgtacattttcacataacttgaactgagtataagaagttcagaacctgaccaactctttctgatattgaccaagtcctgtaaattttcacataacttaaagtaacactttaacaattgaaaagcagagtataagaagttcaggttcaaaacctgaccaactcatcacgatgcaaagttttcattcaacgaaatgctatgacagatctgtcaagcataaaattcattagagtaaaaaacaacgaactagctaggaagcagtcatgaaaaggggtatgaatgtcaagctaaccagcaaatttcagttgacttcatggatatatgattaattggagtcagcttagaagccaacatcaacaaagttcagaaaacccaagatacacttcatcatgctccatgtcttatgactctagcagacaagcttgattgaaatttgaaatattggagatattattcctaaatttggacaacaaagctaaatagggctataatagtgtgccatcttcaaagatttacaataaacaaatggaaaaactgtccgaacaagaaaactatatggaaaaatacattgaattggaattcattcaaatccgtgttttcccaattgaattcagttcacatacatggattcatgacaataagcggccatatagcgtggcacacaacttttctagtcaaatcaccacaaacactacgccgccaagtcgtattttaaatacccgcctcatctgattcagacccgccaaagttcttaagcactggcggccactgcagcatctcacacgggtatacatcacccaatggccgcgactcatcactgttgcgccacagcctcagcagtctcctcgtcctagggtcgagcatcacaacccaatctgccatgacaaagaacagcgtgcatgtaccctcacagaacgctgcgaagctcacaagtttgaagccacggagctggtccgacatcttcgccgagagcttcatgtgggcgagatcacccataaacgccgggtgcatcagcgtgcgcaggtccacgggttgctgctccacccacttcccaggtgcttggagaacccaggtggcgagagtaagctgctccctgatcacgaagaaacaaagccggccgtccggtgtcctgccaatccagtggttaccagcgtagaggagcgttctggcatcaggaaggggcaccgccgacagagtcatctggaccgcgtcgacaaccatgatgtacttctcttcgctctgcagcttgtacatgacatctccgacgacgactgatgggccttgacgagggaccagattccgatgaaccggcccagtggcagactcccaagcggaagatatcgaaaagtagacgagaacactgaagtgtttcgggtcgttgccgaagaggacaaccaccacgcggaatgcatcgccttcccccgggacgagcacgctacacgccaccatgtgctccgctatgcacagaggcggcacccgaacgtacgccttctccagcgggctgcagacgaggagcctgagttcgcgagggtagccagggccgagttcccgcaagagtagtcggccgttgcgggagtcgacgaggaccgcgccgcacgcgggcggcaccgggaggaaactgatgtcaagggagaggcccgcggtgcgcacgaacgggggcagcggcgatggaccgtagttgcggaagaaaccgaaatggctaggcggcctgggaagacatgccgctccagcgccggagatgacgcggcgccagcggcggcacaccgcggcgcagcggatgacgtcgcgcgggggcggcagccgcttgaagacctccaggagcatatcgtcggagagcgatgccaccgccgcgactttgccatctcccgtcgtcaggcgcgcgcgctcaaaccgcgcggagtcgaaaccgcacgatgtagacagggagcggttggggccgccgtagggggacgctgaggggcgcgtgcacttgcggccctcgcggtcagaacagtgcggcggcgaccgggaacgcttgcggccgacgtcgggggaggacggcgaggggcgtgggcgcgtgcggctcccggagtcgaaacagtgtgtcggcgaccgggagcgcttgcggcggacgatgcaggaggacaccatggcgagatgcggtggcgcgacggggtagcagaaaatcgaatcaggattcaggcgcaatgccaaggcgcggcggggtagtagaacaatcagg

SEQ ID NO: 14281 - DNA, 3604 bp, Zea mays
gaggaatgttggagaaaatttgtattgctttttccaaaaactagatttaggagagacttctggagaactcttggagatgctcttacatgtagaagaggcaaccattgcatagaaaaccagactttggtggctacctccataaatcataatagtcattctaaggtaataactgcaccatgtatttgttttttaacaacaacaacaacaataataataaagtacatataaaaatcatgtggaatcgatgctattgattcactaacatatttctatgaggtgtgcgcagtgtgtgtgaagctgtgaacggaaacctgagccggcaccacgcatgtacacggccggcagtgtgatatgatgtactgcgcccttttcgtacatgacctcgcggagcgcatgcaccgacgacgccgcggtgttgcttcctgctgcgcctgccggccggccccagctagttagttcccacctcgcccggggcccgcctacccactcgctcgccgccgcctcgcgtttccccaatccccacacggtccggcggacgaacacggagccgtcggccgcctccctgaaagcacagccctactcccatcacggtcgcacggggtgcgtccaccgcgcgggatgacatgagatgagacgacgacgcggtggcacccgcgactggcgtcggcgacacggtccctcgccactcgtccaggccccgggggcgacctggccctcattcgtcgtccagccagccagcccccggcctaccaggcagcagtggattgtcgttgaagcggtcgccgcggctcctctccttccctctttcctcctccgccctccgcctataagtatttgccgagcacgcgggccatgacctcaccctttactactcccgccccactcttcctttttttttttcttttccgcgcggggatttgagttggaggaggcaggcagctgccccgggggcggggacgacgcgcagcgcaggagcaacgcccgagggaaagcagcgtacccatccattctccggatgtcccatggcaattccggacgccggagcggttcgccgcgtcagatgcccgaggtgccactgcgtcctcgaggagcccggcgccccagtgtaccagtgcggtggatgcggcgctagccttcgaggtaacctctcgtcggtcccactccgatttcatttggatggttgctctgctctgctcgtctcgccagaggttttttctttccttttggtttggtttctccgtatctgacggattctcccgtacgtgctcagcaaagaaccgcaccggcaccagcgcaggagacaccgacctgcctccgcctcctcagagcagccacctggacgccagcgacgtcgcgaccaccagcaggtccaggtccagcaccccgactcctcccgatgtcgggagcagtagcaggtccggcaccccgacccctccgcatggcgggagcactcctaacgccaccgcgactggccatgccgagtccgccgaccccgtgccgccgaggaatcgtgtttctgaccaagtggcgttggtcgagaagagggggcgcgaacagacttcggccgctcaggaggtccatgacggcagcgcaacaagaaatgccggtggaaacagagacgccacttctgaatcgctggatgattcagagaagaggacgaaacgccagatcgaatcgaccgatgctgcgagaaagaggcacccgggggtacctgcagcgcagccgcagtaccaccagcaccaggacggtcatcagcaacttgcgccgaaaccatcagctgctcaacctgcacggggacaagaagaagaagaagatgcaggggaaaaggcgccgagcccatctcgtcgcgctgagctccaagaacaacatctggggcccctgcggaagaagattctcaagacggtggatgagctcaaaggcgacctctcccaacttttcagcaagtcccctgagctcaacgcgccacgcgcgcgcccacctcgtcttcccaagcaagaaggctacgtgtcccgcgcggcggcggcggcggcctcggtcctccctgccagagcgcgtcacgccgccgctgctaccgacggttaccgtggcagcgcagctcgtgcgccgctgaagccccgtcaagccgctgctcctcctccgcgtggcttgccgtcccggcgctaccgccagtgcagagcgcacccgggctcccatgacgtggagcccaggtcgtgccgccacgggcacggctgctgccgccaccacggcaagccggagtgcagcagctgccgagggtactgctgcaggcccagagcgcagccgccggccgccaaggaccccaagcggcgcttggcgccccggaaccactgccggccggtgctcaagggcgcgccgttcatcgtctgctccagctgcttcaagctggtgcaggtgcccgccgacttcgccgtctcgtccaggacggtgcgcaagctccggtgcggctcctgctccaccgtcctctcctactcctacagggacccggccaggaagaaggcctaccaggactccgtcgaccggtgcagcacagtcggctccgagctgcacggcggcaaaggcgacgaagggccggacccgttcgcgccgttcatcgacggcttcgggctcagcagctactcgacggaggacgagcagcggctgcccgtctcgaggaacacgtcgttcgacaccctcgacgggaccaaaggcgtgggacgcctgcaccggctgatggggtacgggtcggctagcgagctgctgcgccactcccctgacctgtacgagagcttcagcgagcggacgacgcctgacgtgagacagcacgacaggaaagggaaagccgtttgcatcgacgatgacgacgacaactacgacgtcgatgactctgacgaggaagagtacattggcgcgctgaagcgatcagcggcgaaagggtccggctggtcgctcccatggatgcccggcaaggggactccagcaacgggaggcattaggatcaggtaaataccaggaaaggattgtgtatattgcaggaataggttcaggtttggaattcgaatgggaattcctatcgttgtagttttctattcattttcagtgcggtattggatttataggctgtttgtttgccatttttttcgagcgcgaaaatgctgtaaaatgaaatgtaattattcagcattggcagtctcattatggctttgtttgggaacaagaaaattgatggtgcctgatgaagaaacggaagtgtataacaaagaaatatcgcagtatcttttttgaaagatattgttgcggtatgttgaaacacaagaactacaaacatgaatttgtttgcatgaggtgcaagcggagagcacttccattaatttccttccattaataaatcaatgcttgtaattctattaaacctttttttttgtgtttgatcaaatttatagagaaaaaaacatattgtacagatatatttcatggtgtagcttattataccatttttttgttataaaactttgcgctctgttccatacattcggttaaacataaaacaaaactttgacttaaagtcaactctagaaattattaattaggtagagggagttctttctag

SEQ ID NO: 14282 - DNA, 4495 bp, Zea mays
  misc_feature (555)..(555): n is a, c, g, or t
ctcggaacggaagttcaaacattcgatgagacaggggctaaattttagcggggtgtaacccagcaccccctcaatcgctgtaggccacgcttggctttgccccaggagctgcctttctgtacgtgagctcgcggagcgcatgcacgtgcgatcgattttaaaaagacctttccagctaccgcgcccacctcgcgccgggaaaaaaaaccccgctggagcctggcctcgcgtttccctttccccacccgggccgcgtggccgcggccgaacacggagccgtcaagagggaagcagccgcgtcaagagggaagccgtcgcggtcggccccggagaaaacggccgcgtgccacgccagccagtccaccgggtcactaccacacgctcggcttggggggtggtccaaacaccacgctggcagaagagaagcgacacggttccgatcctacgtgatgagacgacgacgcggttgcagtggcagtcacccgcgccgcgcgcggctggcgtcggcgacacggtctctcgcccgccgccagtcgccaagtccctcacctcacntcacctcacctcacccacgccagggccccagcccgcaccctccccgcaggcagagacagtggacgtctccaccagaccactcgttgtcgttgaagcggtcgctccgcacccgccgcgcccccgccctccccggctccggctccccctttctccgccaccgccaaccgcgtataaatatctgccgagaacgcgccatggcctcaccctccgctccgccgcccctcttcattttctattgctcccccggtgccggccccggtctccacccacgtatccgcggaggcggaggagctgccgctcagcgaactcgacgcgcccatcccgtctcccccctggcgattcattcggccgcccaaacccacagggagtcggagccggaggagggaggcgttctggagtccgtccaaggagcagttggcgacgacggaaggcgcagcacacgagcaacgtacgagggaaaggggaaacaaagaggtgagtgtgagtcctccgcccccggcctgctgtgctcctgttcccattcttggaattgcttttctctctttgctctgcttgtttcttggtactgctcctacgctacttcggattatagatagatgacagaattccttgaaagatattgttatcacttgagaccaaaatgctccagcccattagtattattatagcatccatatagaaatggactcccgactgatgtttgaagtgtcccagattaaacctctttttttttgtcgatcgcaaggtaatccctagagaacccttggaacaagcaaatgtgtttgccaaacagtccaatctatcaagaggaacattggtaggcacgcacaattatagatttggagtagttatctctcaagccacacgagtctgcaactgtatttgttaaaaattttatgggactgctgacaagtcttgagttttgacaagattaagattggaacattggacttctgttttactgttaccctcattcttttcttttggttggcagcaaatgagcgttttgatgcatttattttttaccgaaaaagaacagttcaaacgtagcggggtcgcttttaccattctttctgtgtcaccaataccattcgccacctcgtcagactttgcctgctaggcatataagcacagaatttgtctgctagcgatgcccgtttatttatctcttcaattacaaggcgccagaatagacagatgaactcatgaacagaatgctgatggtgtttccctgttgcttgcttttgacgccacacgcagccttctccgatcgtcgccagctagctacccacctgtcctccggatgtcctggagttctgcatgcccatggaaaattcagttcgccgcgtgagatgcccgaggtgccacagcgttctcgaggagcccagcgcgccggtgtaccagtgcggcggatgcggcactagccttcgaggtaacctcatgtccaactccgatttctggagctcgcgtttggatgcttgctctgctctcataggttttggtttcgtttggttcctgacgtgtgctcgatcgtgcagcaaagaaccgtaccggcaccggcaccggcagcacgggagacgcggccggggcgtcgccggcgcggagctggctgcctcctcagagcaggcacctggacgccagcgacgtcgcgagcaccagcaggtccagcaccccgacccctcctcgtgtcgccagcaccagcaggtccggcaccccgacccctcccgccggcggctccccctggcaccgagacaccgacgcgacaggcacccggcatggttccggtgatctcgctctcgtgtcggccgggacgcgtgggtccggtgacgtcgcgagcaccagcagtactcctgttgccaccgcgagaagcaggcgccgccaaggcaccgacgcgacgagccgtggctccggcgacgtcgccagcaccagcagtactcctgacaccaccgcgagaagcaggcgccaagacaccgacgcgacgacccgtggctccggcgacgttgccagcaccagcagcacacctgacgccagtgccgacacgacgagacggggcgagtccggtggtcccgtgccggcgaggaatcgtgtccctgagcaagcggcagcggcactgatcgagaaaagagggcgcgaacagagcgcggccggtcaggaagtccgtgacgactctgaaggccgcggaacacgagatgccagtggtgcggagtccggcgtcggtggtgtcggattctccggaggaaacagatatgccactcctgaattgcaggatgacacggagaaggggatgaaacgccagaacgaatcggccgatgctgcgagaaaggaacgtcgtggtgaagctgcagagcagccgcgttacgaccatgaccgacgccaagaacttgcaccgaaatcatcggctcaacccgcggctgctcagcttgcacgcgaagatgaagctgctactgccggagaaaaggcgccgagcccttctcgccacgaggttcaagaggaacatctgcggcccctgcggaagaagattctgaagacggtggatgagctgaaaggcgatctctctgaacttttcagcaagtcccccgagctcaacgcgccacgcgcgcgtcctcctcgtcttcccaggcaagaaggctacgtgtcccacgcggtggcggggccggcctcgggcctccctgccagtgctcgccacgtcacttcttctgccgaaggtcaccgtggcagcgtagctcgtgcggcgaagccccgtccagccgcggctcctccccgtggcttgccgtcccggcgctaccgccagtgcagagcgcacccgtgctgccatgacgtggatccgaggccgtgccatcacgggcacggctgctgcggccaccacggcaaaccggagtgcagcagctgccgaggatactgctgcaggcccagagcgctggagccgtccgcgccgcggaagcccacggcagccaaggagcccaagcggcggctgccgccccgcaaccactgccggccagtactgaagggcgcacctttcatcgtctgctccagctgcttcaagctggtgcaggtgcccgccgacttcgccgtctcgaccaagacagtgcgcaagatgcggtgcggctcctgctccaccatcctctcctactcctacagggacccggccaggaagaaagcctaccaggactcggtcaatcggtgcagcacagacggctccgagctgcacggcggcacaggcgaccaacggtcggacccgttcgcgccgttcatcgatggcttcggcctcagcagctactcgacggaggacgagcggcggctgcccgtctcgaggaacacgtcgttcgacaccctcgacgggacgaaaggcgtgggacggctgcaccggctgatggggtacgggtcagctagcgagctgctgcggcactcccctgacctgtacgagagcttcagtgagcgaacgacgcctgacgtgagacagcacgacacgaaagggaaaggcgtttgcatcgacgatgacgactacgactacgacttggatgacactgacgatgaagacattggtgcgctgaagagatcagcgaggaaagggtccggctggacgctcccatggattcccggcaagcggcaaggggactcgggagccatcaggatcaagtaaatagcaggaaaggcctgtgtatattgcaggaataggttcgggttttggaattcgaattggaatttatttcatagttttgctattccttttaggcgcactattggatttataggctgtttgtttgccattttttgaagcgtgaaaaatgctgttcaatgaaatgtaaatatcctgcgatgagtctcagaaagaataacattatggactttttaaggaacaagaaaaatcgaggtgcctagtgaagaaacagacgtttctaatgcaatattgcaaagtcttttttcgaagataacattgcag

SEQ ID NO: 14283 - DNA, 3995 bp, Zea mays
atgtctcctactccccaggccaaaaaatcacctcccgcgcctccgcgatccttctcgaagactcgaaccgcctggaatcagaatcgccgttgtcgggaatcgctccgatgcccgcggcgatcgggaggcggccgcccgaacgccgggtctagacctcgcgtgcgatggcgaggtcgaggcctagggtttggctcgtggcgggctgcgccgccgtcctcctgtgggcctccgtcgcgcagctcgtcgccgtcggccgctttctcctccttttcggcctcgcgggcgacgccgatccctcgccgccaccttccgcgcttccgcccccgagaatatacacgagcaatggttatctgaagatatcttgtaatgggggtctgaatcagatgcgctcagagatttgtgacatggtggcagttgctcgtcttctaaatctcactatggttgtccccgaacttgacaagagatcattctgggctgatcaaagtaattttggagatatatttgacgtgaggcatttcatcaactctttgagagatgaggtgcacatcattgaacagtttccagagaagcttggtccaagagattcaaacattattgtacttgaaatgccacctgtgagctggtcagatgaaaaatattacttgcatcagatcctaccgctgttcaacaaatacagcatcatccattttaacaaaacagatgctcgcatagccaataatggtatcagtacagagcttcaattgcttagatgccgtgttaattttcatgcactgaaattcacacctcaaattgagggattagggaataaactggtacataaactgcgagccaagggatcatttgtagccttgcatttacgctatgagatggatatgctggcgttttctggttgcaaccatggcctttcacctgaagaagcccaggagctcaaaaaaatgaggtctggcagcgtctgcttcaagcatcttatctggtccaggtcgttcagaattgatcacagaccccataatcctctctaaaagatatgcttatccatggtggagagataaagaaattgattctcaagccaagaggtcgcaaggactatgcccacttactcctgaggaggcatcacttgttttgaaagctctaggatttcaaaaggatgctcttatgtacatcgcagctggtgaaacttatgggggagataggagactagaaccactacggtctgcttttccaaaccttgtacgaaaggagatgctgctagactctgaagttctgcatcaattccaaaatcactcttcccagatggctgcacttgacttcattgtatccacagctagcgatgttttcattcccactttcgatggtaacatggcaaagcttgttgaaggtcaccgaaggttcctgggttttcggagaagtgtggtgctagaccgccggaaattagttgaacttctagatctgtacaccaacaagacaatctcttgggacaattttgcatcttctgttcgggaagctcataaggaccgtgtagctcaaccatcctgcaggcgaaaacttgaaaacagaccaaaagaagaggattacttctatgctaacccccatgaatgcctagccaattcaaccttgtgcagctaaactgagtttctggtttctgtaaggtgaccagatgtgagcgtgaaatcattaccaggcaggaattggcacacggttgttttgatgtcgtgttgtcgagggaccgaagccagatttacacagcccatcacgatcttttgacttcgcattccttattatcctgttgtataggtcagtttttagcttctgtattgattcgttcgctttccaacatgccaaaaggggcctgtttggagcatgtaaattttggtttgttgtctaccatttttcttcatcggtgtctaactcgtgctgctaggccgaagggttagctgtttcatcttttggttttgtttctctaattttacaaattcttagtggaattatcaccttttttaaactgtgctgtttcaatacaggagtgctgaacctgtctctcatttgtctctcttttcttttttggaaaatgttgtccagtttgcttggtgcatcagccttctcgatgaatgctttactgtgtaaacccttccgtgagatcatctacaggagttcctaaaagaatctaaaaaaacaattagaaaatcaagagtttttaagtggctaaaaaaggtatgagcatatacccacttttcaggctgcaagtccaccaattcggcctcatctgcgacaacctcgacgcagtcaacaagttcgagcccaattacaggcttatcagaaggtacactactattgctcctaccctttttttccaccctttggccaacaacggaatgttatgtcttcaatgtttaatccatactacccaagtctttgtaattgacaaactaaacagtgcactaattgagtagactacgatacaagagtaaccacatgcttctattcaacctgtcttcaattacatttgatgttagttactaaagaccaagtagactgagtcttttagattgcacattttttaactttcatggaaacgtttttaggaaaacaaattaggtgtgattctttttaaaattctataacatcaaataaaaaggaaaatagattgtaaataaatgctatagtcaagaactgaacgtgtctaataggttgatttcagtgtttcaagctttatcttatgtttattgattatatgagaccttgcaattggaatattcctgcagattggtatattatatgctcgagtggtgaaaacaaataataccatgaatcccgatgtctcatgcagattggtatattaatgcatgctttaaagaataggaatatataagagataagacttcttcggtttccactactatcatcacctgacatttaatcagaaggcgtagacaatttctaacttattcatgtacatatttactgttctgtaacaattactgtccataaggtatacttactacatcgataagctttgttgcaggtaattcccattcattgttcttattgattaacatgctgacacttaagttaatgtgttcagtgttacgaggaacatactccaatagaaatcttcaagtttgaaacagagatttactacaatttgtttaacctgaagatctaacaactctatcaaaacctttgtttcttacatgcctacctgctttacattgtagcctccccatccatccacccacccaccaagagtgaaaaaaattcaaattccatcatttttatcaaaaatgttatatttttagtgcttcctttgttaagcacctgaagtgacatctttatttcttccaaaaaattgttgtgttatactcgcaggcccctgttcctctatccatttttcaacacacttcatttcccagttatacaaaaaaatctttcaatgcattttttggtgaacacgaacatatttacagaaatttgttttaatgagtgttgtcttatgttattccatgtggcatgctatattgtaaatatcaagtaattgtgtgcttcttctatatgaatatgcgcatcaattcttgcaatagttaaatctatatgtacatttttacatatctatatatgcattcatctgccaaacgttatgtgtaaagctattttacaatttattaaccacaattcataccacatgcaagacattttttccaatcactatatgctcatgtattcttctgaaatattgatgtggtatgcaaataatgaaaattcagatcaacataaatatgtttagtagtgtgtgcttactgttatgttactttctatttaaaaagtatattaaaggtctatatgatattgatcatagatgtcaattgtttgtaagaagctacataacccaaatatgtattgatcatggccaaatcgcgcatattgtttagttctaccaaaatgaagatattgtacacctcttacagatcttaagaaacagtcctagtagttatcctctagtt

SEQ ID NO: 14284 - DNA, 2692 bp, Zea mays
ctccctggaagtcaaaccaaagggaccctaagtgtctatagacctggatgtggtgagtggtgattccgtgattggcattgtcactcgggctcttctttgttctcgtcgtcgtcgtcaccatagagcgcgtctgcaagcgctcccaccccaaaaccccgcggacgcaccgacgcgcgagccataatgcgccgccaaagcctcgccaccgtactgctgctcctggtggccgccgcggccctggccgcccccgccgctgggcactctgagtcctcctgccccttctacgaccacggcggccacggcgaaccgcacgaacgccacggccatggccacagctgcggcggcggcgcggaccatgagcaccaccaccaccatcaccacggccatggacacggcgagatccagcggctgctcccggaggagatggcggaggaggcggatctcgagctcgagtccttcggttacgaagaccatgaccacggccaccaccaccaccaccaccaccaccatcaccacagccacggcgacatggagacatcgcccatgggttagacatttttttgttccgatcctgctcgtttttgcgcttgaggcgcgatttcatccgaggcgattgaatgatttggggatttgatcgagcaggcgtgtggctgagcgcgatggggtgctcgctgctggtcagtatggcgtcccttgtctgcctcgtcctcttgccggtcatcttctgtgagtgcccccgcttggcccgttgcaatctggggattatttgcttgcccttctgcgcaggtcctgattgtctggttgcttgcatgcctgcagttaaggggaaaccgtctaaggccatagtggattcgcttgcagtgtttggggtaagtggggattgtgcagctctttgaaggatcttgctaaatcgagctagcaaatggatatttgtctacaatctactcaactttgtgtgttttccttagcaaatcctgagagctacctagccaagtacattacatttctcctgtcagtctagcgaacgcaacttgaaattcatgtaccctatgataatcttctgcaattacaagctattaaaaagtaatatctgcattcagtgaaagtcacagagatgaattatctggtatcctgtgaattttgtttcatccaggggcaattgaccctgcatatgaaatgttgcctctaaaattttgtccatgatggatgttgtaaatagcatagaaaactcaggttgtatcgaaattcattctgatgtgtttctactcattcagcagagaataaatcaaccaaacagtgcgacaaaagtagacaaatggaatcatgtcatctgtttgaaacacatacttgattacataaaactgtattgtaacggatctgtgatggttgcactttctcatatacaaagtgacattcctttctcctacaaaagataagtagaaatgcaaatggttaaacatgtttttaacatatttttcctgatgagttctgtatgtatctagctgaatatgcgacgcagtcaaaagaaacctacattttttaaacatctgtagaagtttatattcagaagagtcaaccatgagacgacacctcataattttgagattatttagcttatttatgacattgtcttgcaccgatattttctgcatgaggtattgaggttctatagtattgatctatttgactaattctactacgttcagaatcaatgatgttacagcttatgtgctttccttctttggttccaaactttcaatgtaatctgcaggcaggagctatgcttggagattcatttcttcatcagctgccacatgcttttggtatatcctttgatacatgctatggtcttattttggttcttgtttttgtttgtgcttggttcatgtatatctgctggcttatgttttactagttactgttttgtctcgcccatcatctacatcatcctgggctataaactgtttctatatctcctttagttgtaccttggttctcaaggacagtttagtggccctggcaccatatttgcactgccattggacataggaggggacatgggtggattttgcaaaggtcccagaaaagtttaaactcaggaatgttgttgttcactccaatgtaacttgtgaccctaaatcaatcttcttgtaattttaaaaaggagcgtagctccatgcatgttttgcctactgcacattgctttgttaaaagcagtaaacctctgaactgtctgacccaattggatcaaactgttctatttcctaccatctcttgcatgttcttttctgctgtgctatgagttattacaaactgaagtgttgaacctccaaagcataatagcatgttgcttgtgctagcgtcatattgatgtaatattgcatcccttttggttctgacgttcactttgtacacgctgtagatccagttcttttacttcattcgctgtaggagcactctctcacttgcattatttttcaattgctgctcaggtggagggcattctcactcgcatgatcatgagggtcatgatcatgctcatgctcatgagcatgcacatgcacactcactgcaagatctatctgtgggtttgtctgtactatgtgagtatatcctacacatttatgtccaatagtgttcttatatgatcttttttgctatatagagacacttttttgattcagttgctgca

SEQ ID NO: 14285 - DNA, 2125 bp, Zea mays
ccggggattggcattgtcactcgtgcgctccttggggcccgccggcgtggtcaccatagagcgcgtctgcaagcgctcccaccccaaaaccccgcggacgcaccgacgcgcgagccataatgcgccgccaaagcctcgccaccgtactgctgctcctggtggccgccgcggccctggccgcccccgccgctgggcactttgagtcctcctgccccttctacgaccacggcggccacggcgaaccacacgaacgccacgaccatggccacagctgcggcggcggcgcggaccatgagcaccaccatcaccatcaccacggccatggacacggcgagatccagcggctgctcccggaggagatggcggaggaggcggatctcgagctcgagtccttcggttacgaagaccatgaccacggccaccaccaccaccaccaccatcaccacagccacggcgacatggagacatcgcccatgggcgtgtggctgagcgcgatggggtgctcgctgctggtcagtatggcgtcccttgtctgcctcgtcctcttgccggtcatcttctttaaggggaaaccgtctaaggccatagtggattcgcttgcagtgtttggggcaggagctatgcttggagattcatttcttcatcagctgccacatgcttttggtggagggcattctcactcgcatgatcatgagggtcatgatcatgctcatgctcatgagcatgcacatgcacactcactgcaagatctatctgtgggtttgtctgtactatttggcattgtactgttttttattgtcgagaagattgtgaggtatgttgaagacaattctcaaaatggggctcatagcatgggtcatgggcaccatcatcataatcataaacggcacgattctagcgataaagccaaattgaattaccaaaagagtgatactgatggtaaagacattgatcatgctgaagaggaaccttcggttaatgataccactggaaaaataagtgatggccatgaatcagaagctactatacgcaagaggagctcatccaaagccactgatggagaagccaccaattctggaagggatcctgcccctgaaaaagcaccatcaatttcaaactctaacttagtgtttggctacctcaaccttttctcagatggtgttcataacttcactgatgggatggctctcgggagtgcctttctgctgcatggttctgttggtggctggtctaggactttatttctgcttgcacatgaacttccccaagaggtaggagattttggtatccttgtgcggtcaggcttcacggtatctaaggccctattcttcaatttcctctctgcgttggttgctcttgctggaacagcactagcattgtctttgggtaaagatccgggacattcctccctgattgagggtttcaccgccggtggtttcatttacattgctgtcgcgggagtcctaccacagatgaacgaccagaaaacaaccatcaagagctcagtagctcagctgatctccctggcaatggggatgctggtcgctctaggcatttctctggtagaataatctgaatccccatttcaccacttgcagctttaggtccaaccgagttaccccaagtcgatataatgctctagcagctccagactagaagcagggttttctgatcctctcgatatatagtaccaaaaagttttttttttttgaaattttggcatctggttatagattgcctcgcatcggtgttatttgaaggcaacccgtcgcactaactgaatactgtacaactttatggccggctggctgatgtcggctcatgacaggatcaacagcatatagtggaaaacaaaaaaccaaacaaaggtggggcccttttggcggctacacccgcttgtcctggccccgtgcacggtgcaccggtgggtatgcatgccaccaccacgtcggtcaagatctgcccgtgcttcggcctggaactctggctttgccggactccggacgttcatagctgacgagcagtgcgtgtaattaatcgagcttgttctcgcgtaagttgttacttgatttggacgaccaaatctagccagcctactaaggtgtttgcatgcaatagatatatt

SEQ ID NO: 14286 - DNA, 2408 bp, Zea mays
taccccaatgaaagatctgtccagttttcacgatacgtttggttcttttagtgcaaaaagaacagataaaattggtgattattctggttagtttctgcttctactggtaactgatcatatgttctgcacaagtgctagaattttgatttacacacgtgactttatcttctacttttctaggttcatcgaagtggggaaagaaacctgttagtctagatgacgaccgcaggagtacatatgatcagcactattcacgtaatagctctctgtttgctgccctggatgatgagaggaaactactggtgccagtaagcatactccgatcagatacagtttgtggtcaagagctacagatttcaatttttggctgacttgtaaaacctaccaacttaactatagttgatcattgcaaccaccgtcgtatttcaatctatccttgctggaacttgctgtgctaatatttcttgttctttttttgacgagaggaaacttctggtgccagtaggggttcagcagccacatgcatatgctaggagcttggcacgatttgcatcaaaattgggcccagttggctgggatgtggcagcaaatcgtatcagaagggcactcccccctgggacaagtttcggcccaggatgggttgtagatggtgaaccacctcaaaactctcagtgggctcctgcagcatcgactaatccctcctctgagcccactgctccacccaatatgccatccaagaatgatgtactcgatcacaagtctggaccgtcttctaatggggatgttactgctgaggagcatttaattagaactcaaacagtggcttctacatcagcaagctttgataagagctctgacatttccagtaaagtaaccaagcttcagaacggagttaccgagtcatgtggtggtacggacaatacgggatcatcagcgcctccaatgcagcaacacagccacaatcgagaaatccactctaacatcaatggctttgctgctatgtcgaacgccatgagtcagtacgcggggcaagggttatttggatcaggcattcatatgacacacgcccaagtgcttgggatgttttctggcatgaatggcaaagtcaatggctatatccataggcacccagtaactgctgatagtcttaaaacagcaggacagaacggagatgttggaaaggccactgtgaaccccgtgcaaagcgcaggccaggatccaaagaccgcgaccgaaaatagctctgctcacccaggcttgaattccagagcccagtcatcaggttcctcgcctaggggaaagctggcaaatccgaagcaccctgatctggctttgcagctatgagcgcggtagtaggcattgacatagtttggtttagtactgtggtctgcgacagaggcatgagctcctcgacactgctcctccgggcctaattctcaagcttccggcactctgatagacatttgtagcttgccaagccgttgaagaggtaacagatggttggattgttgtcagagaataataacgcaaagcagcggttgcaggaggcggcggcggaacaccatgtaggccccccattttaatcatttgacccccagtgagtttgttgtaaaagggtagggtagcttctgtacaggttctaatcttattggagatgacagtgtttcggatgaggcggccgcctgttgtccaatttgtaacatttataggaggaagtatacaggcgaaaaaggcagtgaataattgtgccttttgaaatgttcgaacggccgattggcggcatgttgctgttgttttgatttcttgtgccttttgggctcactctgtccactggatacgttggatgctggtgattggcatatatatgtaggtcatgctcttgagccttctactcgctgtgattcttcttcgcctcggaaattagtcaccagcaagggcgcccatatgggtgtacactgatttactgatttacattatagatgtactgtttatagagtgaagtttaaaataaagaataagacactgatttactgatttacattatagatgtactgtttatagagtggagtttaaaataaagaatgagatagagagtgtgatagcctttatgctggtttgcgcgcttatccgcttgcatcccaatcgaagcatgagacagatacctatttatcttctcacagtctactccagatccgatcaagttcgctctttgttttttttttcaacttcaaccccatcaattaagctccgtcattgtcacaattaaagcccttggcaaacgaaacgttctaagcatgtgtaatggtctgtttggtagagttttatttgattctgtatttaacctgattctatgagagaggtgattccgtaggtgaaagtgggttctcttggattctttagcatagacc

SEQ ID NO: 14287 - DNA, 908 bp, Zea mays
  misc_feature (800)..(800): n is a, c, g, or t
  misc_feature (808)..(808): n is a, c, g, or t
accgggctcaaatgccgccatatcggggccaggccaccgagggcggaagctgtccagatcgcgtgattccgcatcccgttcgcgagcgcgacacacgctgacagctcacggctgaccttcccgacgcggcctccagctccatcttgattcttgaggcgaagccccggtgcgtaagagtctgccatggccagcgagaataaggtctttgggttcgaggaagtcgccaagcacaacgtcaccaaggactgctggatcatcatcgccggcaaggtgtatgacgtcactccgtttatggatgagcatcctggtggagacgaggttttgctagctgtaactgggaaagatgctacagctgatttcgaagatattggccacagtgattccgcaagggacatgatggagaagtaccacatcgggcagatagatgcttcaacaatcccagcaaagcgtgctcatgtgcagccccagcaagcacccagccatgcagacaaggataatgacctccccatcaagatcctacagttccttgtgcccattatgatcctgggccttgcatttggtatacggcagtacaccaaatcagagtagtaactattcttagaggcttgcctttggagcctgtcttatggtaatggttcgaataaaaacagttcaataattgcgcattgtatttgtcaggtcgatgttgtctcattagtcacatgctactctgtattatggacatccatgttgaaatgtgcgcttttcccccatgaaataaaaaaaaaaaaaccccgtttgaacaaaaggcggtgtcattntttttggncaacatacatccatggtaagggtgtattttgacaaaaaaaaatggacacaatttattttttctctatataacgaaacaaacctggatgatcattatattc

SEQ ID NO: 14288 - DNA, 845 bp, Zea mays
  misc_feature (799)..(802): n is a, c, g, or t
aaatgacgccatgccggcgccaccgagggcgaaagctgtccagatcgtgtgattttgcatcccatccgcgagcgcgacacgcgctgacctactcgacggcctccacctccgtcttgaggcgaagcgtagtgcgaaggaccaactctttcgaagggaaattatatctcaggtgcttaggagtctgccatggccagcgagaataaggtatttaggttcgaggaagtcgccaagcacaacgtcaccaaggactgctggatcatcatcgccggcaaggtgtatgatgtcactccttttatggatgagcatcctggtggagatgaggttttgctagctgtaactgggaaagatgctacagctgattttgaagatattggccacagtgattccgcaagggacatgatggagaagtaccacatcgggcagatagatgcttcaacaatcccagcaaagcgaacttatgtgcacccccagcaagcgcccagccactcagacaagaataatgatctcctcatcaagatcctgcagttccttgtgcccattatgatcctgggccttgcatttggtatacgtcagtacaccaaatcagagtagtactgttcttgaagacttgcctttggagtctgttttatggtaatggtttggatgagaacagttcagtaattgcttagtgtatttgtcaggtggatgttatctcattggtcatatactatgtattatggacatccatgtgttgccgaaatgtgctcttttccccatgaaccgaggcatacaaaatgaattctgactaatcaaaaaacannnnaaaaaaaaaaaaaaaaaaaaaaaaaaaaaaaaagggcggccgc

SEQ ID NO: 14289 - DNA, 522 bp, Zea mays
  misc_feature (7)..(8): n is a, c, g, or t
gcggaanntgtccagatcgcgtgattccgcatcccgttcgcgagcgcgacacacgctgacagctcacggctgaccttcccgagtcccgacggcctccagctccatcttgattcttgaggcgacgccggtgcgtaagagtctgccatggccagcgagaataaggtctttgggttcgaggaagtcgccaagcacaacgtcaccaaggactgctggatcatcatcgccggcaaggtgtatgacgtcactccgtttatggatgagcatcctggtggagacgaggttttgctagctgtaactgggaaagatgctacagctgatttcgaagatattggccacagtgattccgcaaggacatgatggagaagtaccacatcgggcagatagatgcttcaacaatcccagcaaagcgtgctcatgtgcagccccagcaagcacccagccatgcagacaaggataatgacctccccatcaagatcctacagttccttgtgcccattatgatcctgggccttgcatttggta

SEQ ID NO: 14290 - DNA, 1871 bp, Zea mays
  misc_feature (1841)..(1842): n is a, c, g, or t
acatgcatagtaaagttagcaatgtcgatggattacttggctgctgctgtacccgtgaccttggctctgggagtgggatctatcttgttggtcttacgatggacgtactgccgccgccgaacaagcgccgaagaagtgagactgccgccggggtcaaggggcctcctgttcctgggggagacgctccactacctggcagcgtcctccaccccgggggtattgccaccattcttccagcgacggttggagaggtatggccccatcttccggacgaacctggtcggggaggacctcgtcgtgtcgctggacgcggagctgaacgcgcacgtgctgaagcaggaggagcgcggcttccagatctggtacccgccctccttcatgcgcgtcttcggcgccgacaacatcaccgccaagctcggcgtgctccaccactacatgaggaccctcgtgctccgcctcttcggccaccagaccgtccgctccgtgctgctgcacgacgtgcagcggagcgcgcgcgacgagctgcgctcatggctcggccgcccggacgtcgaggtcaggacggccacctccaggatgatatttggcgtcactgccaagaagctgatcagccatgacgacgcagcatctggagaaacgttgtggagatgcttccacgactggacttcggggctgctctcgtttccggtttccattcccggcacaaccttctacagatgcatgcagggacgtaagaaggttatgacgatgctgaaacagcagctcgtcgagcgtcgacggaacgcagcggagcgcgagacagaggattttcttcgatctcgtgatcgatgaactgaacaagccagaccctatgatggacgagagcaccgcgttggacttgctgttcaccatgttgtttgcgagccatgagacgacgtccatggtattaaccgtcatactcaagtatctgacggacaaccccaaagctttgcaagagctgacagaggagcacgaaagaatcctggaaagtagggccaatccaggctctgacctcacgtgggaggagtacaagtctatgaaattcacatctcatgttgtacatgagtcgctaaggctcgcaaacatcgcactggccatgttcaggaaagcaaatcaggatgtgcacataaatgggtacacaattccaaaaggatcaaagatcatgatgtgtccactagcatcgcacttgaatacggaggtctacgaggacccctcagtgttcaatccatggagatggaaggatattcctgaaccagtaggcacttctaaggacttcatggccttcgggggtggtttgcgcctatgtgctggtgccgacttttccaagatgcagatggctatgttcctccattacttggtcacaaattacaggtggaaacccgtcggcggtgggacaatgctattctatccaggactgcaatttccagaaggcttccacatccagcttcttccaaaaatcccaaacgtggttccataaaccctatgaagaaatatgaatacaaataatttaagcaaatattctaaatgtaccatggggaattgaagttcgataacgatatggtacgggctaatttggtgatccacttgttaccaaatcaaccctaatggtagcaggtcggattgtcagaacaaataatagtttcaccaaacagaaggggagtatgtatgtgtgtaacattttatagttataaataatagtagagtaaattctgctcgttgtgtaacaactatgcaggtgagtaaaaattggttcagcatattgtatacattatgcccagttcaatgaaaaaaaaactttgttgtttggtgcgtaaaaaaaaaannaaaaaaaaacaacaaaaaaaaaaaaaaaa

SEQ ID NO: 14291 - DNA, 3748 bp, Zea mays
ctaagtcataatgagtgacaagcaccaaaattattctaaaggagtcttttattgaaatatgcaagaaggtctcattatgagtgattccttctatctaagtgaatcctatagctacaaaccttgctttaaatctttcacgtcccctttagagacacctttcatcatgtagatccatttgcatcctaatattttggctcctttaagaatttcaattaagtcctaaatctggttgatactcattgacttcatttcatcctctatggccttgagccacttgggtgagttaggacttctcacggcttcctcaaaagaggtataatcaccctttgtgtatatatatcctcactcatataaatcacatcttcacttttacaaacctcataatcaccaagaataactgattttatatttctacgaccttctaagaatttgttgaacatgtttagtgctttctatatgaggttgttatggctgaccggctcctcatctacaagggcagtgatctggggcgccaggactggagactcagggacactaacgtctatatatgaaagagcaacaatacatgtcgtagtaatgagtgttgtgagtatgataggtataaagaagaatggataaactatcattggagttgggggtgccaacccatttctcgtcaacgccaatcttttggggtaccatgctcagtctatcttgttttcacaaacttagtatgtgcgtaaggataatagaaatgacaccccttcattttttgggacaactaatgaaacgagaacttattgtcttagagtgtaactttttttgatatttaggttaaatatcttaactttcgctggacagacccacacatgcaaatgttttagtgagggctttctcctagtccataactcatatgctattttaggctccaacttgtgatcttcatcaaattaagtcgcatcttgtttgttcttgctcttgttctcaatttcacttatacagattagccttcgtggcgaggtaagccgagctgtagcggttgataaccagaggacgcgtggttttacgattgcgttctgatgtcgattagaagtcgggccgtgtgtgtttcgtgctgtcaaattgacttatccaccaccaacttagaatttcaaaaagagtctaaaattgtttccttttttactgaaatatctgtcatcgtttacattttctgctccacccaaaaaatgcgaggaaatgtaaaaagaatgagagccagtaaacacggggttacgttttccgctttttcgttttcattatccctactgattgggatatggagtatcatatatggggtcatcgtaagttgtaatttcttttacgggaaaagggtaactgtcaatgtaaaagaaaaagaaaagaaaagaaaagtgcgacggcatgtatacgcttcatcgaaaattccccccccctgccatctcttgctcgacgatgcttacatcaattggagcggccggagtactattcatcagcaagaagacaagcaatagttctgggcagggcacgcaaaaggcgacgcccatgcatgctcccataagcgcaccagcattgcctggtggtacggggagtagttcggagcagttgggtgctgtgctgcgttggaatggttggccttggtcttggtttccactccgtcctatatgatccccacgcctccggtggtgtgccactctaaccaccgcacctagctcgggcatccatccactctcgtccccgtcccgtacttacctgactgagctcacacacacacgtacgatgccgaagccgtggaggccggtgctggcgtcggccaccaagtgctgcgcggcggaggacgcggcggtggcgcccgacggcctggcgcggtgccggccgcagcagtcggagctgtcgcggcggctggcgtccttcaggcgcctctcgtcgctggccaacagcccggtgtccgccaccgccaccacggtggcggacaaggacggcggtagcgtgaagcaggccgcctgcggggagatggcgggcccgctgcagctgcactcgttcggcctgggcgagctccgcggcgtcacgcacgacttctccagcaacttcctgctcggggagggcggcttcggcgccgtgtacaagggcttcgtggacgccggcatgcgcccgggcctcgacgcccagcccgtcgccgtgaagcagctcaacgccgcggggttccagggccaccgggagtggctcgccgaggtcatcttattgggccagttccgccacccgcacctggtcaggctgctgggctactgctgcgaggacgaggagcgcctgctcgtctacgagttcatgccgcgcggcagcctcgagaaccacctcttcaggagcagtaggtgtcctagctagctcttgctcttgctcttggggagcaaggggagtacgtatgtatcacagcaagtaaccgatcgactgcttgctcctcacacctcgatggatcgttcgtgcgggcctgcagggatctcgacgacgacgctgccgtggggcacccggctgaaggtggccatcggcgccgccaaggggctggctttcctccacgccgccaacacgcccgtcatctaccgggacttcaaggcctccaacatcttgctcgactcggtgggttgattcattgatcgggtgcacctgcgctctgactgaatgactgaaaaatccattccacttccaccatttatgcatggcaaattggcaatggcatcatatctccccgctgcaggacttcactgcgaagctgtcggacttcgggctggccaagatgggccccgagggcgaggacacgcacgtgacgacgcgcgtgatgggcacccacgggtacgcggcgccggagtacgtgcagacgggccacctgaacgtgaagagcgacgtgtacagcttcggcgtggtgctgctggagctcctgacggggcggcgcgccatggagcacgtccgggcccgcagcgcgcacgcggagcagcaggtgaagctggtggactggacccggccctacctcagcggcggcagccgcaggctgcgctgcatcgtggaccagaggctggcgggccactactccgtcaagggcgcgcgcgccgtggcgcagctggcggtgcagtgcacggcgcagcagccgcgggacaggccgcgcatggcggccgtcgtcgaagcgctcgagaagctgcaggggctcaaggacatggccgtcgccgtcggcctctggcccgccgccgccgccaccgcgactggcgccggccaccggagcgccaaggtcgttcgcgccgaggtcaagggcgccggcgcagcgtcgcggcggaggagcgcgtcgtccaagctggcttgaatcgttgatcgatcgtcgaacagggctggacgtacggccggagccgtgtatcggggggtttgtttgtatataatgtgccgcgagcttggcgtctgtgtatgcagtctagtacgtagtagcttaggcgcgccgagattggtgaggcagagatcatgcattgcctccaattcatcacgcatggttttgcgaaacgaagatacatacaacttttttccccttcttgttcacatccgcggcctccgtatttctcatgtgtgtacaatacagacagatagtgcgggctgggcatggagtgttggcacctttttgaaccaaacactaatgattcctagatcgtccttgtaatgagtttggaccttgagatgatccctaggtttcgcccacggagggccaaaaccttgggagcga

SEQ ID NO: 14292 - DNA, 1460 bp, Zea mays
ttttttcttactggcatctagcttcactttgttattggcttctgttgcagccatcattatggtacaggccttctgttgaagcagtgtctagtgattctgtaatggcagcaccaggaaaattatccttggataaggcaggtggagttttttcattaactcttagtgttaaccatgttgattcacatgcaccaaatggtgtgtctgaacaatccacagttcttagcaccaaaggatgtgaaacccttgcagcggatatggtgcccaatggtcaagattgtccggcaccaagtggtgtgccagaaacatctagttctgctgttgccatgcgtggggcttctacaagtgtggaacccaagcgcagagatcctcctgtacagattgtgccacctggaagctctgcaaccccatgtgccaaaaatcaagattcttttgtaggaagagtgacacctatagctcgtgatgggcttttgaggacaatttgtggaagctcttcatctcctggcggttatgcttctctagcgcaagctaatacctcccaaaccaatggagtttctgccccaggtgtcactcctaggggctatgaatctgctgtaccaagcttgtcacttggaaattccgaaagtacaggcgtgaaacaagtaaattctgcaccaagaatgacacctgaaggccagaagttcctttcgctgggtattgcgccacgaagcccagcactgcgtgatttagtaaaatgccaggccagttcgacactcgttgccatgcctccagcgggcctgggaaaatcacggtccatgaagatcgagggccatgattctctggcaccgagtgtgaaggagccaaaaggcaatggtggtctagcaccaagtaaaacgccaaagctgcatgaacctgtgatagctgatatgagcatcaagagctgtgattctctagcactgggtatcgcaccaaatggccatacccatgatggtccagcatcaggaagtggggaggccaagaaagagcaggcagcactagtaactggctcgcagagtaaatcatctgtaccaagtcttgacgctagcagccatgttaccggggcagcgagcgcccttgtcgcactatcaactctgcgggagaagggcgggcgttagaggagcagcagcagcagcagtgtagttcccgttggatcagatcctttttctctactgtacatgtttctatgtacaggaatcatccccgtcgactctgatccccagtgcgtacggttgctgttggtggccagtcccctatatgttgcttggcagcaaatgttttggttaataattagtttttataaaaggaatattcacccttgttatgttctctacatgtaaattatctgaggtatacttgcattattatgagtgctataatcttttcttttactacatgctctaaactgtatcgtgtattcaataataaaatgttaatttactccctcc

SEQ ID NO: 14293 - DNA, 839 bp, Zea mays
atagacactggatgtctggatggcatagcgctaaatttgagaccggcaaaatagcaatttttccccctgtgagcccgcgacgcagcgcgaggtgcggccccgtcccctcgccaccggaggagcaggacgacgaggtggcgccggcgcgaggtagtcgcgcgcctggaagagcggcggcatcagagtcgcaggcggaggcgaggaagtgaggggagagccctatagccaccgccgcggggcgtcctgctcgctgcacgcactcccaccattttgtcccaactcgaagctcagactcgtgctgtcgtgcacttcccctcccctagcatcccaagctcctcactgagaaaacaggagatgggaagagacggggaacagactaggcgccggagccgcaagagatcccgcgacgcctccccctcctcgtcggattccgattccttcgactccccatcctctccgagcagtagccctgagcgacggagccgcagcagtaagcggaatagatcatcctcatcgcaccgccacagccgcaagaaaagcgaccggtcgcggagatcccgcgacgaggaccgccggcggcggagaagacgggcccaggagagaaagcggcacggtggggatggtggcaggtcctccgactcccaatcgtcggaggaggatagggcggacgaggcgcgggagatcgtccgagatatcctcatcgaattgccggccatagccgaagagcttcgccagcttctccaaattatagacagtggtgaaagcattgatatttctggaatttctgacaaactattggtgaagcgcttgaagaaacttttccgatctctgagactgaa

SEQ ID NO: 14294 - DNA, 649 bp, Zea mays
aaaatagcaatttttccccctgggagcccgagacgcagcgcgaggtgcggccccgtcccctcgccaccggaggagcaggacgacgaggtggcgtcggcgcgaggtagtcgcgcgcctggaagagcggcggcatcggagtcgcaggcggaggcgaggaagtgaggggagagccctatagccaccgccgcggggcgtcgtgctcgctgcacgcactcccaccattttgtcccaactcgaagctcagactcgtgctgtcgtgctgtgcacgacccctcccctagcatcccaagctcctaactgagaaaacaggagatgggaagagacggggaacagactaggcgccggagccgcaagagatcccgcgacgcctccccctcctcgtcggattccgattccttcgactccccatcctctccgagcagtagccctgagcgacggagccgcagcagtaagcggaatagatcatcctcatcgcaccgccacagccgcaagaaaagcgaccgggtcgcggagatcccgcgacgaggaccgccggcggcggagaagacggggccaggagagaaagcggcccggtggggatgttggcaggtcctccgactcccaatcgtcggaggaggatagggcggaggaggcgcgggagatcgtccga

SEQ ID NO: 14295 - DNA, 1756 bp, Zea mays
caaagtttgtcatactctctctttgctttcaggtgtatcactcgcaggtgatgatgaacttttagcaggtccaaaagagtcacagagacctacgagagatgaatggatgaccacattgccacctgagagaaaagtaaatgatagaaatatttacttgtgtaattgttttatctacaacccaccaaagtatgcttactttattgtgatatcttacatgtatgtaatttttttttacttgtcacaggcaggagtgccaatgcattcaactacatcatttagtatgaatggtaaagaaggacgtggagacacaagtgtctggactgatacccctcttgatagagcacaaaaagcacaacaaaggtatgcttactgaaaacaagggatttttatcgaactacgcaggcgtgtcatttcaccaatagagaaaaagagtacaataacaaggagaaaacagccctatccaaaacatgcgccacacaaacccggttctctgcaaaccatgtgctactgtactgactaaagaacatgaccaaggggatcagactgccaatcagaaaaaggcaccaagagctgcatagcctgcattcatcagcgaccttgcgcagaagactttgaatattagcggaagctccctcaaacacacaagcactcctaaatttccgtacttcccaggccaccaaaataataaaacatgtgcgcatattactgacatttccatttgtactacgtgttgtccccattgcatctttaaacaacaccaaatgtacatgtgctaatggattacgctctcttgcagctatctagaagcctacccacgcgtccgggcaattgcagaaggcgacgacgtgaagagcaagaacccggatgcttcaatcgtagataaatacaacacctccaaacgatcagtgtcccttgtgcagaagcaccgagagagtaaaaaggagaaaaagaagcaaaagcagcaggagaaagaggaatgggagggaagccacccatggaagccatgggaccgggagaaggatctgtctgctgggcgccagaatgtggccttagacgcagagaacatgtcgcaaggattatcttcccgtttcgcatctggtgctgttcagcggaacttcctgtgagctgtgtggaaagatactcctggagcttggtctaatcgatgattaatgtccagttattacatcctggtcggcagatggcaaagataatgctgacatataaaaacgagttatgttaccaaggaccatcgtcctgtaatatcgatcgtgcttgttgtgcttattttctcagtgtattatcgggtgagctaaaatggtgccatagtttgttcgtacgatacaattactttttttttcaacatgtattaggattgtaatttctttttactgatgctaaaatgtctagctcatggggttgggttaccatcggcgtttttgttttttgttgttcccgtgcgatcagatcctttttctctactgtacatgtttctatgtacaggaatcatccccgtcgactctgatccccagtgcgtacggttgctgttggtggccagtcccctatatgttgcttggcagcaaatgttttggttaataattagtttttataaaaggaatattcacccttgttatgttctctacatgtaaattatctgaggtatacttgcattattatgagtgctataatcttttcttttactacatgctctaaaccgtatcgtgtatcaataataaaatgttaatttactgctagtggg

SEQ ID NO: 14296 - DNA, 2212 bp, Zea mays
  misc_feature (2170)..(2170): n is a, c, g, or t
atagacactggatgtctggatggcatagcgctaaatttgagaccggcaaaatagcaatttttccccctgtgagcccgcgacgcagcgcgaggtgcggccccgtcccctcgccaccggaggagcaggacgacgaggtggcgccggcgcgaggtagtcgcgcgcctggaagagcggcggcatcagtagtcgcaggcggaggcgaggaagtgaggggagagccctatagccaccgccgcggggcgtcctgctcgctgcacgcactcccaccattgtgtcccaactcgaagctcagactcgcgctgtcgtgcacttcccctcccctagcatcccaagctcctaactgagaaaccaggccggccggggagacggggatgggactaggcgccggagccgcaagagatcccgcgacgcctccccctcctcgtcggattccgattccttcgactccccatcctctccgagcagtagccctgagcgacggagccgcagcagtaagcggaatagatcatcctcatcgcaccgccacagccgcaagaaaagcgaccggtcgcggagatcccgcgacgaggaccgccggcggcggagaagacggggccaggagagaaagcggcacggtggggatggtggcaggtcctccgactcccaatcgtcggaggaggatagggcggaggaggcgcgggagatcgtccgagatatcctcatcgaattgccggccatagccgaagagcttcgccagcttctccaaattatagacagtggtgaaagcattgatatttctggaatttctgacaaactattggtgaagcgcttgaagaaacttttccgatctctgagattgaaagaaagtgcaagtggggcttacttgctgccttcaaaaaatggtcctacgcttgatattgttggatcattactattagcaagttccaaacttgcagacaacaaaagtggaaagccagtgtcaccaaatagagaagcactacaacaggctaactttgatgtgcaaaataaagataaagattatattgtttccgaagagccaaaaattgttgatgtggaagaggaacctcctaaaagaaggataattggtcctgcaatgccatctcgtgaattactggctgcagcagctgaaatgacagaggctcttaggtgccgggatgctgaactggaagccaatgatgatttgctcataggccctccaccgcctgccgtagttgctgaagctgcatctgcaaatgaagctgagcgatttgaagaggttactagaatattggtggctgacacaaattcaccttatgaggttctgggggtaaattggaagatgtcaactgataacatgaagaaaaggtattggaagttgtctcttttagtgcacccggacaaatgtccacatccttccgcacaagaggcgttcgtgaaattaaataatgccttcaaagacttacaagaccctgataagagaggtgcaatagacgagaagataaaaaagaaagaggagatggaacaatttgaggttgagcttaaagcaatgcgtgaggctgcggaatggagacgaatacaaggtgtatcactcgcaggtgatgatgaacttttagcaggtccaaaagagtcacagagacctacgagagatgaatggatgaccacattgccacctgagagaaaagcaggagtgccaatgcattcaactacatcatttagtatgaatggtaaagaaggacgtggagacacaagtgtctggactgatacccctcttgatagagcacaaaaagcacaacaaagctatctagaagcctacaataagacaaaggcaattgcagaaggcgacgacgtgaagagcaagaacccggatgcttcaatcgtagataaatacaacacctccaaacgatcagtgtcccttgtgcagaagcaccgagagagcaaaaaggagaaaaagaagcaaaagcagcccgaagaaagaggaatgggagggaagaccaccctttggaagccctgggaccgggagaaggatctgtctgctgggcgccagaatgtggccttagacgcagagaacatgtcgcaaggattatcttcccgtttcgcatctggtgctgttcagcggaacttcctgtgagctgtgtggaaagatactcctggagcttggtctaatcgatgattaatgtccagttattacatnctggtcggcagatggcaaagataatgctgacatataaaaacg

SEQ ID NO: 14297 - DNA, 3022 bp, Zea mays
tccgtcttcattttccgttttaccccaaaatacacccccacacacaccaaagtaaatatggattttccacctctcgtttttactgattgggatatatgggtcaaatggaagcaaatggaagcagtcaatcaatataaaatatggtgcggtctatagatgtacagaaagtccgaagcacgttttttggcccggtataagcccggtccggcccacttttatacaggcctgggctggcccggcacgaataaacgggccaggtccggacaggaaactaagtccggcgggctcgccggcacggcccgtttacttttaagctcgtcaatcccttttttgcactaaaccgtgcttactggcgcacttagcccgtttttcaggctacgtttttctgtgcttatcagaccgagctcgcgggtttagatagtccggcctggttttctaaccgtgtctggtgaaccgggtctaaaatgggctaggcttcactggacccgggcctggccgggcggcccgtttgaccatctccagtgctgtctgtaggcgcttcatcgatcgaaaatatcctccggttttaatgactgcataattccttgtctctagctcgacgatgcttacatcagaatggaggtggagtggccggggacggggagtgccagccaaggcgaggcccgtgctagctgccatgacatgagcgcacacagcacaattgtcttgcctgaaacgatacggggagtggttcggagcagttgggtgtgctggtgtgtgttggaacggttgtccctccggcctgggggggtcctcttgcttgctgctatatgatccccacgcctcccgcgccaccggaaccaccgcatccactctcgtcccgtcccgtatctacctacctgctctctcgtcttctgctcacacgctgacgcgcacgctccgagtccgagctaagctagctagctagctacttccggcgcggcacagccacagctgtttaggtagtagctagacgtacgtacgtacgcacaccacgatgacgaaggcgtggaggccgatgctggcgtcggccaccaagtgctgcgcggcggaggacgcggcggtggcccccgacggcctggcgcggtgccggccgcagcagtcggagctctcgcggcggctggcgtccttcaggcgcctgtcgtcgctggccaacagcccggcgtcggcggcgggcacggacaaggacggcggcagcgtcaagcaggccggggagatggcgggcccgctgcagctgcactccttcggcctaggcgagctccgcggcgtcacgcacgacttcgccagcagcttcctgctcggggagggcggcttcggcgccgtgtacaagggcttcgtggacgccggcatgcgcccgggcctcgccgcccagcccgtcgccgtcaagcagctcaacgccgcgggcttccagggccaccgggagtggctcgccgaggtcatcttcctgggccagttccgccactcgcacctcgtccgcctgctggggtactgctgcgaggacgaggagcgcctgctcgtctacgagttcatgccgcgcgggagcctcgagaaccacctcttcaggagtaggtatccctggccaacgcctcgctctccaatccatcgaggagccttgctcaccagctgtgtgcatgcagggatctcggcgacgctaccgtggggcacccggctcaaggtggccatcggcgccgccaagggtctggccttcctccacgccgccagcacgcccgtcatctacagggacttcaaggcctccaacatcctgctcgactcggtgggttataattgggtgcacctgctctgttgtgctgggggccgggcctgctgtcctgtcgagcccctgaacctagctaccatgactcactctctcatgtcatctcccaggacttcaccgccaagctgtcggacttcgggctggccaagatggggcccgagggcgaggacacgcacgtgacgacgcgcgtgatgggcacccacggctacgcggcgccggagtacgtgcagacgggccacctgaacgtgaagagcgacgtgtacagcttcggcgtcgtgctcctggagctcctcacggggcggcgcgccatggagcacgtccgcgggcgcagcgcacacgccgaccagcagctgaagctcgtggactggacccgcccctacctcagcggcggcagccgccgcctgcgctgcatcatggaccagaggctggcgggccactactccgtcaagggcgcgcgcgccgtggcgcagctggccgtgcagtgcaccgcgcagcagccgcgggacaggccgcgcatggtggctgtcgtcgacgcgctcgacaagctgcaggggctcaaggacatggccgtcaccgtcggcctctggcccgccaccgcgcccgtcgccgggcggaacgccatctccgccaagatccgcgcggaggtcaagggcgccgccggcgcagggtcgcgccggaggagcgcgtcctccaagctgccttagtaatcttgacggctggaccacctgcgtgccacgtcgtacatgtctcctagctagctcgtgtgtaccccgggtgtaggaatcgtcttgtgtgttttgtgccacgtcgtcggtgtgtgtatatagtacatactactgtaccgtctagtttaggcgcgttgagattggtgaggcagagagatgttcctccatgcactcactagtacgtacgatccatacctattgctcctggattcatgagatcgttaatagaggtgatgtaaaactttgcaaagtacacatgaatttgaattttgatgatcggttgacgaagcctctttcacacccaaataatgagaaacacactagtgcaattggcattagatacccgcatgattgggttcaatgtaagtgaaggacaattgtgcacatcttttatgtttatgagtggtatataaagtgttattcaatctcttaaattatcattattacaccgtttagccttaatgggagagacaatgagatatcagtcgtgctgaggtcttggtgt

SEQ ID NO: 14298 - DNA, 708 bp, Zea mays
  misc_feature (572)..(572): n is a, c, g, or t
  misc_feature (599)..(599): n is a, c, g, or t
  misc_feature (658)..(658): n is a, c, g, or t
  misc_feature (671)..(671): n is a, c, g, or t
  misc_feature (702)..(703): n is a, c, g, or t
aaccacgacatcttggacagcacagcgcagcgcagcgcagcgagctcgatcaccacaccaaccagactcagatcatccagaactcagagcttctacttctagaacagaacatcaagatcagtcctcccctgcatcctccaccggcctcacctagatgagcacctcgtacaccgaggcgcagttcggctccttgttagacctgcccgccggagacgacctcacgtcctggttcacacacctgtgcggcgaggagcaggcggcggcgctgccggcgttccaggcgccggtggcgatggcggaccccaggaagaggagcgccgagtaccagctcctggaaggggaggcgtccggtgtcaagaggcagcgctccccgaccagcagctccagggagaacagcgccggcagcaatgacggcgactacgagcacacgtccgcagccgcagccgcagccgctcccggcggcgggggcaggaggcagcggcggcggccgccgcctctgggtcaggagcgcgaccacgagtggtgggaccggatgagcagccccgcgtgccccgaggacgaggtccgccgcngcttcggcatgtcccgggccaccctcnagccgtgtgcaaggacctgggcgcccccgtcgccaaggaagacacatggtggcgcgcgncatcccccgtcgncagggggtggccgtctgcatctggcgcctcnncacca

SEQ ID NO: 14299 - DNA, 1858 bp, Zea mays
  misc_feature (444)..(444): n is a, c, g, or t
gcatgcctgcagcttgttattgatgttgtccgtggatttcttctgcacaaacacaaccaccacaccaacaacgcagtgttagagcctagaaccgaagcccagatacgtggcccagcgcaatgcagcagaatctcattttccgtgagaaaaaaaggagacagatagacgaaagtgtgggaaaacgtaaactccacagggagagagcgtggagttaggggtcgttaccgtcttctttgtggccaccatggtcgcgccccttggagtgatagcggcgaagcctgctagggtttttcgcggaggcggcggcggcggcggcccgggagtgactgcgtggtggaagggaagggcggggtagggaaccccgacgacgaccacgtgtaggggtagttggccaaggaggtgacgcccgagctggtgaccccgctgcgcgacatggacgacgcntgcgtcgcgtcctcctccccgtcggcgagcggcgcgggccacatgaacaccggcttggacatgggcacggggagcggcggcacggactgtgtctgcagtcccagtgccgaccactccaaaatgcccaggaactaattataaataatcatgagctatggcaataagaggctcacatatagactgttaagacgaacacaaagctttgccattgtaagctgagtaatttcgctagctttcctctcatcaactgttctaacttcttggacctctttttttacaaaagccttgattccaagctcctttttatatcgagtaagaacaggaataggcggagctaaatcttctttatcaactgcaaacagaaaaaaagccattgtcacttgatagctagacaaattaagatactgttaaatagaaaagaagttagcaaaatgagacagatatttctctattcttatactgaaaagtaggtgcctatacttgtacagtatacattatcgagcaggcatccacaagaaaatatctgccttagatatcaagaagctttaaagaaaagaacatgatcatgcaaacctaggggtgcagtaaccagctgtgtataaacttggaatgccttgtcaagaccacggcatagactatttaattctccatctcgcataggaaccttaaatgcaaaaaattgatctgcagaattaactatgaagtgtgtgagtgtgacctatggaaccgagtactatcttctctacatttattcttctagttcttcttcttcatgagagttaaacattgatttctttccttctttctttaggctgagagaacaaagcaggatgatgcactttccgacctgtgtagcacattgggacaactcaaggaaatggcagtggatatgggcacagaaattgacaggtaatagtaatactgccaccagtgacttctctatagataccacagggcaccattatgagcaaattggcgcagaaaactctccctgtgctatctactgtttatacagtttgatggaggtattttatctcgtttgcaggcaaaacaaagctctggttcctttaagcgacgacgtcgatgaactgaatttcagactgaaaggtgcgaatcagcgcggacgccggttgctgggcaagtgatatggaacctgaattcgggcagtttggagaccgtcgcctcgactgcaggattttaagaaccttgttgtttacatgttttagagcaaactagaaacataggcgctgccgcgcccttcagggtgaatcagcccgtgttctttggagtgaatcaggccacacttgttgtattagtgagagaatgatgatctattttgtgtcattatggatttcatagattattttccctgaactgcatttgtttcaataacataggagggaacctttctttg

SEQ ID NO: 14300 - DNA, 1180 bp, Zea mays
  misc_feature (1163)..(1163): n is a, c, g, or t
tgggaccccgtgcccccgcgcgtcccacgagcgcagccttcaagtgaacacgcccgcgtccgtcttcgtcggacccttctccggcgacgagcaccccccacgccagttgcagatatctggtcatcagtacagaacttgaagtgtagattgtgatgtcggtgccgatgtataacaaacagaactcattgggcaccccccctccccacaagacaaaccccttttctgattctgaagggccatcaagggcacagtctgtcccagtacgacgcaccaatcaatctgtgcaagagttggaagattatgctataaccaaagcaagagaaaccacacacaaagtaaatgattgtgtcagggctgctgaagccatcagggaagatgctacacaaaccatgctaactttacaccgtcaaggtgagcagatcatgcggtctcatcaagtagcagctgacattgagcaggaccttacagtgagtgagaagcttctgggaagtctgggtgggctattttccaagtcatggagaccaaagagaaatcatcagataaaaggaccagtctcaggaaataactattctgcgacaacagctaacgacacggaacagagggggaagctaggaattgccccagcacgtcaagaatatcccagtcatgtacaaaccacacctgtatctgcaatggaaaaagttcaggctgagagaacaaagcaggatgatgcactttccgacctatgtagcacattgggacaactcaaggaaatggcagtggatatgggcacagaaattgacaggcaaaacaaagctctggttcctttaagcgacgacatcgatgaactgaatttcagactgaaaggtgcgaatcagcgcggacgccggttgctgggcaagtgatatggaaccagaattcgggcagtttggagaccgtcgcctcgactgcaggattttaagaaccttgttgtttacatgttttagagcaaactagaaacataggcgctgccgcgcccttcagggtgaatcagcccgtgttctttggagtgaatcaggccacacatgttgtattagccagagaatgatgatctattttgtgtcattatggatttcatagattattttccccggactgcatttgtttcaataacataggagggaactttccttgaaaaaaataanttagaaaattttttttt

SEQ ID NO: 14301 - DNA, 832 bp, Zea mays
gcacgagaccattacctagaacatcctaatcgaaaagagagagaagagtaaggagcgtgcgctgcatcgtggggggcggaggggagggggagcggccgcgggagccgctgcagacagccacgggccacggcaagcgggttgcggtgcggacagtctcacctcgcttatacaatccagtcgaccgttttctcagtctttactctttagcctagcatgagagcagccttcaagtgaacacgcccgcgtccgtcttcgtcggacccttctccggcgacgagcaccccccacgccagttgcagatatctggtcatcagtacagaacttgaagtgtagattgtgatgtcggtgccgatgtataacaaacagaactcattgggcaccccccctccccacaagtcaaaccccttttctgattctgaagggccatcaagggcacagtctgtcccagtacgacgcaccaatcaatctgtgcaagagttggaagattatgctataaccaaagcaagagaaaccacacacaaagtaaatgattgtgtcagggctgctgaagccatcagggaagatgctacacaaaccatgctaactttacaccgtcaaggtgagcagatcatgcggtctcatcaagtagcagctgacattgagcaggaccttacagtgagtgagaagcttctgggaagtctgggtgggctattttccaagtcatggagaccaaagagaaatcatcagataaaaggaccagtctcaggaaataactattctgcagcagtatggcttgaatccttatgaagtttgatatttgaacttaaaaaaaaaaacaaaaaaaaaaaaaaaa

SEQ ID NO: 14302 - DNA, 1041 bp, Zea mays
ccggggttcgcgttatgaaaaacaggcatcccagagatggtctcaatctgtactcagatgcttcagttgattatactgatgtgattttaggtaccacagtgaaggttgaaacaatagaaggactcaaggatcttcacattcctcctggcacccagcctggagagaacttaaaattttctcaactgggagttcccgacattaagaagcctaatgtcagaggagatcactacttcatgataaaggtgaaaatcccgaagagtatcagtggccaagaacgtttgctagttgaagagcttgccgcactaaagaaagctcagaatatctcagttccagaacctacaaaaatagaaaattttcgggagagaaaccatcatccatctccacgcggacgatcattctggggacgtgtctggaatttgttcagggatgataaaggtgataaaagatttgcttcaatcagtgtgcaacctattatcccaggatggaattcttgccgaggaactgatacggctgtccccttgctattaaaaggattcctcatgaccgcaatattcttatttgtaatcagaagtaaactcaggtacactgggaagcgcattgaccgtccaactcaagctgaaatacctgttgagccagagtgaatttctgtcgtcttcatttctgaacgtttgcgacatcacagttttgatgatgatcataaatacgtaactttgccgcgcaaagcttcgtcctgggaaaagaatccggctttgcttgcagtgtatggtatccagacgcagcagtacaggttaacagaatatgggttgcttctcattagtcatttcttgattcattattccaatatgtagaagacacctgcagcaattccgagttttgacgaaagccacatgaaagacatgaagaaacatggccgtaggctaatgtacactgtatgtatcttgtctgcacaaagttttgtaaccatcccggcttgatatcgtttaacgattttgttgcaacataattcataagcactgaatttatgcttaggatgctttcttc

SEQ ID NO: 14303 - DNA, 632 bp, Zea mays
aattggagtgtttacgccgagacttgaaaacggcatcagtagcaaacggaggcgaccacgagcgacggggccagccgcggtccccaacgtcagaggatctcgttccagctgcggcagggcggccaacaccggcacctcatgggcgccgacgacgaagccgccgccgccatggaggcgcaagagagggaggcggagatcgagaaggccatgcgcgcccgcgtcgcagacttcaagaagcaggccgagtcgcttctcgtggtcacgtttggtctgccgttgcttgctgcggagaaacgtgcactgcgggagggttttgggctagtggggcggtctcgggggtagggtttctacttctgctgtcctggtaggagatgaaggcgagcggcgatgatgaatcctgaatcatggtcttcagaacgggtggtgcacgtctcagttgcagttggcagctcctacggttttagaggttaggaggaaatggaaattcgggatatcaactgtcaatgctagaggcaactgtatctgtaagaaacacttaaacggtggagatctcttcttattgtttcatgctctgatggcagccagatggcaggtctgttttctgtggtgcgaaaccaaaaaaaaaaaaaaaa

SEQ ID NO: 14304 - DNA, 2024 bp, Zea mays
aaattggagtgtttacgccgagacttgaaaacggcatcagtagcaaacggaggcgaccacgagcgacggggccagccgcggtccccaacgtcagaggatctcgttccagctgcggcagggcggccaacaccggcacctcatgggcgccgacgacgaagccgccgccgccatggaggcgcaagagagggaggcggagatcgagaaggccatgcgcgcccgcgtcgcagacttcaagaagcaggccgactccttgactcttgaaggcgttaggagagcactggaaaaggacctggatttgaagatatattcacttgatgcacataaaaagtttataaagcaatgtgtagacaaagtttttgctgaatctgctgatgaaaatgcaaatgatgatgcattagaggattctgatgctaaagatgatcatttatcaaaagaagggacagatgttgctaaaccaatgcctgtttcaaataaaatgtcctccaatgctgatgtcgtaacatccagcaagacaggaaaggatcctgaagaagaaaagaatcaaacttccagcagtgatattagtgaagacatgataaaagaagccattgaaaaaagggcatcttattttagaaagaactctgatactcttactttacaaggagttcggcgtactttggaagaagatctcaagcttcagaagaaagctttagatgcctataagaattttattactacaggattagacaagattttgcaagaacctgcaaatgggacaaagaaaaaaagtaaaaagggatcttccaaggatactgacaaaacaagtaaaggctctaaaagagtccgtgaagaatcagatagctctgaattaaatgatagaaagagtgatatggataatagcgacgtggattcaaggccaagaaagaaaagggcagaaaaggctaaagtcaccaaaaaacagaaaatagttacaaatgagaggaaactgtcaactccaaaggctaaaaaggttgcaaaacaagatttgggtagcggtactgaagaacagggtggcaattcagcagaagaggataattctcattcatccgctgaggaagataacaagagaaaacggcaacagactccagcttatgggaaacaagcagagcatctgaaatcgataatcaagtcttgtggaatgactattccacctactgtgtatcggagagtcaagcaagctgctgagaacaagcgtgaggcctgtttgataaaggagttacaggatatacttgaaaaggaaggattgtcaaaaaatccttctgaaaaagaaattaaagcagtgaagaagagaaaagaaagagcaaaggaacttgagggcatagacatgagtaatattattactagttcgcgtcggagaagtacatcaagtttcatacccctgccaccaccgccgcaaatagaagtggatagtgatgatgatgaagacgatgacgatgatgcagaaggcaatgatgcagaaggcgatgatgatgatgcagaaggcgatgatgaagacgatgcagaaggcgatgatgatgatgcggaaggcgatgatgcagaagacgatgatgaagttgatgaggagaatgtcaaaggtcgagatgaaggtgataatgatactgccgaagctgccaacggttctgctgatgatgctgaaaaggagaacaattgattccggccccagaataggttcagcttcatgttggcttcggcaagttggcctcgttcgtggatgtctggatgtagccagttgctcaggagttctcttctgacgtttatttatgtgtgcgtgatgggaacatttgttggcttcagctttgggtgaaacatgaggaacatattgtccttgtagtgatgtgcaatgtcacattcgtcctcttagcatcttgttcgcgattgtgtagattacaacaacagtcgcaaaacatataagttagcagtaatcaagtactgattggtttattagtttctgatatagtataaacctcgtaggtgaaagattggaattactatgcgcttcatgcttt

SEQ ID NO: 14305 - DNA, 1700 bp, Zea mays
  misc_feature (479)..(479): n is a, c, g, or t
  misc_feature (509)..(509): n is a, c, g, or t
cgaagactcgccagatttctgtggcgtgtgtcgggagatgtggtcacctatacgaggggcgatagggggacctgctacggctagggcttcggtccctacggcccctccggccgcggtaccgctcgggtgatggcgaccgccgacgccggcgcggcggagacagcgaccgcgacaggtcgcgttgcatcgtgcgcgacgcgatctagagcctcagcggagccggatctggacgaaaccagacgatcggagccttcggagaggggcggagtctggcttgctggctggaaagcgggaggacgcaggccaggtcaggtagagtcgcccgccgccgcacgcgggggccgatgaggtgggggatgctcgcagcccgcggaatctatctgtgggaagttgtaattaacctccaaggctacgcccaggtatacaaggtgggcgctggggagaagcaaaagcaatcgggccaccaatcccacagcgtnatatgaccgcccggtccagctcagcccagncccatgtgagtcgtccgacccggatgagtccagatccagacccaacgtgaccgcgagtccctcaagatcacacagtaccggcaggcggcagcaattggagtgtttacgccgagacttgaaaacggcatcagtagcaaacggaggcgaccacgagcgacggggccagccgcggtccccaacgtcagaggatctcgttccagctgcggcagggcggccaacaccggcacctcatgggcgccgacgacgaagccgccgccgccatggaggcgcaagagagggaggcggagatcgagaaggccatgcgcgcccgcgtcgcagacttcaagaagcaggccgagtgagcacactctctccccttcctccaacttccgaggctggcgtgaccgccctgcccctcgtctatggtttgcacgctctaatgttcaggtctatggcgtatggaattgggtcgcttctcgtggtcacgtttggtctgccgttgcttgctgcggagaaacgtgcactgcgggagggttttgggctagtggggcggtctcgggggtagggtttctacttctgctgtcctggtaggagatgaaggcgagcggcgatgatgaatcctgaatcatggtcttcagaacgggtggtgcacgtctcagttgcagttggcagctcctacggttttagaggttaggaggaaatggaaattcgggatatcaactgtcaatgctagaggcaactgtatctgtaagaaacacttaaacggtggagatctcttcttattgtttcatgctctgatggcagccagatggcaggtctgttttctgtggtgcgaaaccattttcagtttttgttgttattctttcaattcattgtctcctgtattttgtcttttcagggggtttaacttgtttactgccccttataagttgtgcttatgtataaggccttgcctgttataattccagatatgccgtgcttgagaacttatcctgtttcccagtagaacgtgagtttagaatttccccctttatcttcaattcatgttgttggtttccaccattttatacccaagttctgcatctgtgttttagttcacaggagccaattatttcactgtatacgcgttgatcattttttcataaaaatgctagtctacacggtcaactaaacaaaagctcatctcaacctgcatacaaccaaacaacgacg

SEQ ID NO: 14306 - DNA, 663 bp, Zea mays
ttttttttttttttttcttttttttttttttttttttttttttttttttaaataaatagtaactacttattaactaataactatagtaaataataaatgaccacattaatcgaaattacgaaaacaatatatacctaagaataatgcagacattcagactgcgcctctctgctctcctcctatccatagccgcacctctgattgtctgtatataaatagacaagctcccgagccgccgatttacgcatcggcccggcatgacgcggcgtattcagagggagaagatgagagcaacgtgggttttgccgagcctcctcctcttcctcgccttctcttcttccttttgcaaagcctcagcctccgcctccacaaagcaagacaaggtcggccatcttcactcggtgcacaccgtccctgtcaatttcctccagatttctcgctcgatgattatgctggcaaagccggccggactccagtagtgtgccgtctggctgagcgcagcaagcggagaagagagaataaaggttttgttgccattgtaaacaggtctacatagtgtacctgggcgagcacgggcgtcgctgctgtacagctacaagcacaccctcaacggcttcgcggccatcctctcccaggaagaggccacgaaactgtcaggtacat

SEQ ID NO: 14307 - DNA, 1120 bp, Zea mays
gaaagagggatagagaagagatacacgcagaccagtagcaagccaagcagcgcccacgcccccacgagggccacgaccaccaccacccccgccgccgccgcggcaaactgctactgcccaaccgcgggatggaggtggacgccactgccttctgcccgccgccccagcccgcgcctgccgcctccccggcttcaaagccgcctgcgccggtgctgggcgccggtggagcggtcgcgccggtggcagggcacggccgcggcggagggaggcagtaccgcggcgtccggatgcgcaagtggggcaagtgggtggcggagatccgcgagtcgaacaagcggtcgcggatctggctcgggtcctactccaccgccgtcgccgccgcgtgcgcctacgacacggcagtcttctgcctccgcggccgctccgcgcggctcaacttccccgaccagctcgacggcgcggcggtggccgacaaccccgaggggcacaaggacggcgcggggctcacagccgccgccatccgcaagaaggcggccgaggtcgtcgcccgcgtcgacgcgctccactgcggcggcggcggcggcggcggcggcacctctccgcagccgctgtcgttccatcgccgccgccccaagaaccccgacctcaaccgggagccaaccccggaaacctcagacgacgagtaaagcgcgctgattagggtagctagctagctaggcaggcaggcaggcagcagtagcaagtaaagcaagcaaccaggtggcggcggcgggccaccaaacggatgagcgtgggcgggtgcagcgcaaggtgttcggtggaatgcggatgggctcggaggtgtccaataatggagccgcgacgtcgacgtcagggccggaagccgtagtaaagtggaatagcgcgcgagctgtgccgtttgtttgcccggaggcgacggctctagcagtaagcaggagacagacgggtgcgtccgtgcctcagtcagtgtgtgtgcttgctaagcaacacggctatgttcatctcctcttctcacataaagacgtgtgcaaagaaaaaaagatactgtactacccggcaaaaaaaaaaaaaaaaagcttattgaatcttttccttgttt

SEQ ID NO: 14308 - DNA, 7031 bp, Zea mays
ggttctttgccgagtgctttttttcgaacactcggcaaagactttgccgagtgtcaaaaagaactcggcaaataaaaacactcggcaaactaagaatcgaaaaaattaaaaagaacatcaaaacattttttaaattctaggaacaaaactctccaaccctaccctattaccttacccgttgccctatcatttttcactattattttgaatcaaacttatatgttttgtaaatggtgagattcgaactcgcaacctctctctcgcgcataccctcctataccactacactactacaccaattatgtttatattacgtttccattccccatgtactataacaaatcgagagtaatttgattatttaaggcactaaatgagttcatttgaaaatgtgaccaactataaagttgcataactttttgagatctaaaagttttattttaatagtttctacatccgagaccgtttataaaatttgaattttaaatttaaaaacttcacacgaaattttcaatgataagatgatttcaaatcaaaaaattgtcaactacaaagtttcattacatttcaagacctacaacttttattttggtggtttttccatccgagacagtttgaaaaattcaaatttcaaaattcaaacatagttttgcataacaagatgatttcaaactaaaacattgtcaactacaaagtttcataactcttcaatacctacaactttcatgttggtggtttttcctttcgaagtcgttttcaaaattcaaattttaaatttttaaaattcagacgtagttttcgttgacaatatgacttcaaataaaaaagttgtcaactataaacttctataacttctcaagatctacaaagtttattttggttgtttggtcatttgtttatctcacatgatggttctaacaatatgcacaaattctatacgtctctctcgtagtttcataaactacgagagagatataggttttatgaacaaatttatttttattttgtcatatgaagaaatgttcaatatataaattgtacatcatgatgagttatacaaatttgtagttgaaaactttttcatttgaattaatttactactttaaaatgtgatttttaaattgtctttgcctagtgttggagaaaaaacactcggcaaagagctctttgccgagtgttgtatttgtgacactcggcaaagagccctttgccgagtgtcaaaaaaagacactcggcaaagaaactctttgccgagtgtcaaaaataaaacactcggcaaagagcttcttcgccgagtgttttcttttaccgagggttttttgcgtggcactcggcaaagagctctttgccgagtgcccgaaataaaacattcggcaaagaatatggcactcggcaaagagccaaattccggtagtgtagattaaaagaatccaagtgtttttttaggattaactgtaaacatgacactcaacttttacaaaattggacggctatagttcattttgatgctatggaatggtatgaaaatgaactagttttcaatttttcaaattaatttgagtcgcatgttttcaactgactttttttattagagtccatgtgcatgccaaccagagctagccttttcggcccttaatttattaagataacagacccatgcatcgagaaaaatcatagcagatacaagtgttttttttcttgcaggttaattaacgagttatattaattgaagcaaaagtagcatacaacaaaaggcaaaagtaaaattgtgcaaatggggacgactaccagggccatgcatctccagcaggccgacgggtgcgtaaacggccatgcaaagtaatgtttcgtgctgcagattttattgtttacataatagagtttaaattagggactgagacagtgagtggtataggaactcagcagctagagatattctagtcctccgacactgtacgtgtatgcatcatcttgatttagacggcctcccaaggacactgttgttcctttttcttgtcctgtggaagtacgtagtggagcgacagtagcaatgagaatacagtggactagctagcttgtccggcttcaaggttgacaaaaggtcgttttctcgtgatcaatacatgctttatagtatatatatacgtacatacatacaatacagtatctccgatccctctagacgttagcttcatgctactcattagggcgtatatattaccctcttcgcaaagatgaggtgcatgggccacaagaatttggcaacggatcgatcatgtgcaaaccagctggcacttgaggtgaaagtagtcatgattttttttcttcttcttcaaaataaccctctcccaccatatgctagctgtcaaaataaccctcccacctctcctgatatatagtgatatatattattaaatatccccctctcctacctcccaactacgaacacgcgttggtttgcatgcatggttttcatcaagtgattggtttgcatttgatatgttgtcccccaaggatatttagaagaaaacgaaaacaaattaaatctgttgatatgtgcattggtgcaagccccttccgtacatgcatgatgacgatcgagttaggcggccctcgctagattttgtggaccactttgaccctcgctctcactctcagctggccagccaacagcaaaatttgacctgcagcacagcttctgtttcacgagcaatgcactgcaatgcaagcaagagatgtagctagctggtgctgcatgctagctaggcgctatatacctcgactctcccctgccctccactccatgcatctcgatcttccgccacgtacgtctttcagaatcctgctgcgcgctagctagctgtgcacagcaaagaaggaatcagacctaataataagaacagaaatcaaattattgggccaataatgcatatgctatcgatccatgcacgcacagctcatcatatcaagcctgtctcctcgatctgtggttgcttagctagctgcaagggattttcactgcgcgacgatgatgggccgatgacgaaagtgtagtgtagctgagctgagctgaggtacactagctagacgtactacgcgtacgtcccaccgtactagctctagctagctaacagccatgcattatatggacggacgcgtgacggtcattattagaggtagctagcacgtattagcactagctatagctagtgtggggatatatatatatatatgatggaagaaacggaagcagcagcaaattaaagctatatatatattaggcagctatgcatgaatggagatggtcccaaatgtacgtatatactcgtatattgttagctccgtcctctacgtacagatagataagcgttgttgttgtgtatatagataggtatcgtcctatacaaagacagagagagagagcagacgcagcggcatggcatggcatggcatgtgcccgcgccgctcgctcgaataaataaaggggaaaaaacctaattaagccgcgccatcatctcaactaataacctactagctactaccactactaataataataatatacatagccgtcgtgcgtcgccgtgtacatgtaggaaaaggatgccggccggctaataggcttgcttgcattgcattggctggtggatcttgggcagtgcgcgcgcgcggctgcactactgccacttgcatggcctagtacccagtgctctctagtgcttgccgatgggaggcagcaggcagcccggccagttgcaaacagacagacccacctttcgttattactaacagcgagaacgcaaaaggattacacaggggcagccaatcaggtacaattaaggggctggcaagtggatgttgtgctgtgcctgaataacggctctgcggtggagagcctgtccatggtgaagagccaatagaaaatcttcacttcattagggaccttaagcatccatacaaatgccccatcctccacatgcatgttgcagcgagctagcagcaagatagcctcccgagaagaggatggtggatgcatgcagtgagccagtctgctgcactgcatgcttctctctggcctctggcctgctgggacagacagacagactacctctgccgccgccgtatctgcctctgcccttgtgatccaccttcttctcaactcctccgatgacaccagagttttcccttgtctgaaacgacatgaattccgacttgtttgctgctgaaacattcattttaacagcctgtaattaaaatgaatggatggacgcgtccttcgttctgtggttcggtgtcagtagtagctagtagtatttttaatggtcacttttgcgctttccttttcttttaatgaaaacattcattttttttgtcgttgataggaaacatataaatagccttattcggttgcgtctggatagaagaaaaattgagagggattaaatatccttttatccaattttgactagggagagagatttaatccccttcgattcagacgttgccaaacaaaccctagagatgtgaaataataaggcttgtttagcttagcaaatctcttaacatgtggctagttaatttgtcggacatatgtgtgcatctttccctacctgcccaatgtcaagcttagcaagtctctagatccgaaatttttactcaccgtcactggccgtcgtggttagctagctatctcacggggggaaaatttttttctttagcaacgtggttacacacgctgacacgcatggcgaaagcagaagggacaaacatagaaaccgatagcaagcagatagcttcagagatcactactgttggaaatatgaagagggggaggaaaagacaacacctttcccaccgactggccggtgggccggccgggctgcgattcacattcacatcttgacttgtgtggctccgcgaaagaggagtacttactttttcttttttgatttgatttgatttgatttgaacataacgtgagcctgaattcctgatgctgcgagagatgcatgtgatgatgaggtttgaatgaaatacgtacgccagcacagcctcgctccttccttcaattccgtggttacgcgtttagccaaagacacgaccaaaaagaaacaacaggacatggctgtctctctttctttttccttttttcaagagaggcccgaaggaagagagaagacctttattacctgtatttatgatgagatgcagcagtactatatatgatgtgtgtcggagtgtcaaattactactactttctgctggtgactgatgggaatttggaattagaagggggtcacgtgatggcctcccgctttaatttcactattgttgttgttgttacaacattttatttgggattctatatacatgtttcattccagatgaaaaagaccagcagctgcatttatttatttatttattactcgccgcctgctgcagatctcatctcaatgccatttttttgtggacaaactagcaaactatttattattgttgttgttattaaagttattattattattatatcctgcccggcccatctggctttgttggtgtctcttttgcagaaaatccggcgtctctgttacctttgagcccaaagcccagcccgtctcgttcctcggtccgagcagcctctttattgttttttttttcggacaaccggcgcgcatgatgagccaatcgattagattcctcggacggacgcacatgtctagcactcggctatttcattttcaaccaaatatttatttggaaggtgtttataaggctgtctctgacggcttattcgttatctctcgtaccgtcttctatttcaaactcaattctataaacaatacaatctatattataaaacagtgttttgaaatgaccattaaaagcgatagctgacggtgaacatactaaggtagtggcttggttaatctatacttctatagatatgtaaatatgttggggttcggtccggcggtgaaagtcgtcggcgcagcgcaaataaaaacaccatcttggtggggtcggagttgagtgttcatcagaccgacataattaagcgtctggtgtttaattattaaaaaaaagaaggaatcagcacgatgatggttccgcaatcagttcccatgattaagagtggcagcgttctgcgtagcacatgacattaaagcgcacggcgccgaaaagacactgtttgtctcttttgctttgggtgtccgccgctgcctcgcccttctcctttttgctaaccgcatgcatctctctctctttctctgtctcttttagtctttttggaggaggaacaaagaaccagtggggtttcgaaaggaggagtaggccgacaagtagcatcgcatcacgttctcctaatgaatgactagcatgagtcaaaaacaccatcctttttttaaaaaaatactattattatgagtaaatctgggcagagctcgacgttcaggttcaaatgaaaacaagtaacacgtatacttctacttctttttttttgataatttacgctcctacttgaacttgaatcaatgcatacaccacaaggggcagtgaaaaggagaaggtccttctgaaagagagaagaggtcaagaggatggattgtaaaaagaaaaaggaaaaggagagaaaaaaaaaaaggaaccggtggtatgtagtatgtattagggctctaggcacatttggcatccaatcccaaaataaaagccccagcctccaggacacgccaacgacaaccgttgggccgacgttccgtaacaggccacgatgggccggacgatactttgcccatgagaaatccactcgttcgtgggccgtgtccgtcttgtgaggatagacgatgcaccttcttctttatctcggaaggtactcatgagggagacgcgtcgtcaagcaattaagttattagagcagcttcctaaaaaatgactcatcaaaatcagttttaaggagatatctaaaaaattagtaggggtagattttaatcctttctccaacagatcacttaaagcgaacgattgtttctagg

SEQ ID NO: 14309 - DNA, 5490 bp, Zea mays
cggttttgttgtatctttccccctacgaccccaccaaagtcccggctccggagccacgctgtggcagcctggcaggatcgtcggattgcccagaaacggaacaagcaaccaaacggaaagcgattccttgcttgctcctccgttgctcccgttaccgtccgtccgtcctcactcctcactcagccctgcagcaaaagcaacccgtggtggtggtggcgtggtgctctctcagccatcgttcactgcaccaatggcagcccaacccactgacagctccgcacacagctttaccgaccctacgtgccattgactaggctcatcgaactagaggtccgctagcgtgctagcagccgggatggcagcgcaggcagcctgacacctgtgaggccgtccgccacagtccacagagcaaaagcggctacaaagatccacagcgcactccccccaggcccgccctggactacacagcagaagcatcggcggcgagcgtatacgtatacaccaccaccagtacagcatccattccaactaccttccccatccctacccatcatcaccctcaccagtcaccactcgccaccctcgcccgcccccatggtctcgctcgctggctcccagatcccctcgccttcgccggggcagagcccctgcgcggccgcgcgcccgcagcgccgccagggacactccatgcgcaccatccgctccgctctgctgcagccggactcctccccggggtccccgtccccgcgcgatggcggcgccgacgcgggcgactcggacattgagaacctcaccgactccgtcatcgacttccacctccgcgagctcgccgccaccgcggggcccgcgcacccggcggccgtcgccaagtcctcttccgccatcaacgccgccgccacggagctgctcgacctgtcgcgggacttctccgactactccagcttcaactccgacatctccggcgagctcgagcgcctcgctgccgcggcgggggcggcgcccagatccgacgcgccggacgcggccgccgtggatctgaacgacctcgagtccatggatctgtcggcggacgcggcgccgctggagcgcgtggagccgttcgtgctggcgtgcgtgcgggcgctggggcccgacgccgggccggacgcgcggcgcgcggccgcggccaggatacgcctgctggcgaagcaccgctccgacatccgcgagctgatcggcgtgtcgggcgccatcccggcgctcgtgccgctgctgcggagcaccgaccccgtggcgcaggagagcgcggtcaccgcgctgctcaacctctcgctcgaggagcggaaccggtccgccatcacggccgccggcgccatcaagccgctcgtctacgcgctgcgcaccggcacggcgccggccaagcagaacgccgcgtgcgcgctgctcagcctctcgggcatcgaggagaaccgcgccaccatcggcgcctgcggcgccatcgcgccgctcgtcgcgctgctctccgcgggctccacgcgcggcaagaaggacgcgctcaccacgctctaccgcctctgctccgcgcgcaggaacaaggagcgcgccgtcagcgccggcgccgtcgtgccgctcgtgcacctcatcggcgagcgcggcagcgggacgtgcgagaaggccatggtggttctggggagcctcgcgggcatcgccgagggccgtgaagccgtggtggaggctggcgggatccccgccctggttgaggccatcgaggacggccctgccaaggagaaggagttcgccgtggtggcgctgctgcagatgtgctccgattccccgcataaccgtgcgcttcttgtacgcgagggcgccatcccaccgcttgtcgcgctatcgcagtctggctctgcccgtgccaagcacaaggtacgcagcacaaaccccgcctttctcttcgtcaaatttcggtgctactaggtgttcacgtctagctatattcttctattggctaatcgggcatgagttgccttgctaaatttcgttcgttcgagtgatatggcgattgttgattggtagattaatgttgaagtcgtttcgagcgtttactgatacgactgaagtcacctcgccagtcagttaagaactgattgtcctaaacaggatgcagagtttgagtttgattgaagtctgattgacaccaagtaccctgaaaacgaaaagtacacttaacctagacgaagggaagcgctcgctgtacatgtactcgtggtttaggtagattttctacctgttcctaacaaatgctcggtgttatccacgtttgttaaaaggccttcgtgctaggtggtagcatgcatatcaggtcaggtgttgacctcaagattccattcagattgtggagatacgcgctccttcgtttttttacattgtcaagtactcaagtacagttgaggatctgtttaaaaaaaaatcttccaaggactatacaggaggatatgtttgatgtcttctgctatgcaagtcaacactgcagtgcttttgctacttgctttggtccttggagggacaacgcaccatgttaaattaagaaaactcctagtttctttaaagagagaagatgaatattacttggaaacagtctggcttacaggttacaacgcatgtggtaatcagttttagtgaatctgaaattctagaagttgtggagtctgagtttttgtcgcataatttgcaggctgagactttgcttggctacctgcgggagcagcgacaaggggttgcctgcagagctggagcagtggcagctactaccctcgcgtccgaaaaaggcaagagctatggtcgaaatctgctccatttattctctgtgagaggtgttgagagcagatcagcgacgccaggggggcgcatctgtaaataacagctggctctggttggtttggctatgtgtctatgtgaatacacatgtggtttgcgagtgaggatgcttggttggttactaacgtaacgtcagttaagagtcttaagagggaggagggttcaggggtcccaggttatgctattagaagatttgggtggtaatgaacatcatgctggtttgtagctgtgtccagggtgctagggtatgcttgctttgtcttttcaggttatccggaatgttggatcgccaaccatgtgatttttttttttttttttgcttgaggttccgagtccaaattcgtctgttcctttttatctactcaggcctggcacatggtttgcgaacatttcgtgattcttatttttgttatcagcgctgtcatggatgatggggctggtgtttcctccccgtgcctttaatacgaactctagtgtacgtatactatcaaaaagatggagctagcacttgtaaacacacgtcaaggttacatagactgagatttgacgggatatgagtatgcatgccgccgatggaagttcctgatatcagccaaccatttggcttggctttggctagctgtcacgaacagcgactccttttaatggctgctctagatccatctcatccatcttgtcagctcttatcgctatcagaaacggagcacaataacccaaaatgcgcaagccctcgcgcaaaatctcaaagactgccctggatcttccgctggttataaatataattgccatctcggtgagacaagatcggcgccacacgcccccgttgcgctgcacaggctgcatataaagcccaggtcgtcgctgtcctggctagctggccgagacaggcgccactggccccgtgtcccggtgcactgttcctgcttggcagatgggatttgattggcggctgtttaggagagaaaatttcgctccgtcatcatcttgttcgtagcagcagctagcatcagaagatggcctgtctgacggagcaggataaggaattaattcgggactgagaccagtcggacgcgatggctgctcctgtttgttgttcggttccgattcctggtgcgtggctcatgcctgcatgccagggatgtatgcgacggtgacggtgacgacgacgttgatttgatcgggctgatcgaacccggactggaacggtgagatggacgataggtgaaccgataggccaggcgccaaactttgccgctgattcagtgaacagctcgcagcaactgggtttgcagtacgaaatgtgccaactgggttgcagatagagaaaccagagggcgtgaagaagctccgtcagaatcaagcagccatttcaaagctctgtgtatctgaagtgctaacagcttgcaacagccagacagtcttcagatagtcagccattcgtgcaagaataataataaaaaaaaaagcgagaggcttcagcgacctccgtggctccgtctgaacgctaaaaccgctgcaaagcgtaccgcgtcggtgtccgtcgtcgtatcaggcggtcagcctatagaaaaagctcaaagaaaacgtcgccaggtttccgagttggcgacctactatgataaacaagtagctgacgctgtcgtctggcaggcaacctgcaacactgttcgcttcatgatgatcttgatctgtctgtaagacgaatcatgaacggcgtgtcaaaagtcggaggtgtgcatgcagaagggaagggccgcgttattgtctatataataatgacttaagctctaaagtgtctatttttatatgcaacattcaatcttctatatatgcgcactttttaaacctgtaaaagaaggagctaaaaaacaaaactatcctgatctgaaaggaacggctctagaaatcttggcgccgtggaccgatcgaccaccagggagacagactgggacgttccgtccgtccgatgtcttttctgcggttccgcagagagggtaggaggagccgagagcggagccccggctgcatggtccccggtgacgaggtgttggcgcccccgtaacggcacggccatgtgcgccgggcgcgaggacaggtgcggggccgtgcggtgtagtgtactaccatcctgcacacaggcactgttgttagcgccgtcggcacttgattcttcccccactaccgtcaaacgctcaatcacgacggctggagcggacggtcggctcggcacccctgttgtgcttgtgcatggatcaagcatcgtacggccgtactgcattacagatacacagccgtttcctcgtgtcctgcaacaggatgagagctagctgtgccacatctgacttcaccccgagcgatcgagatactacctgccatgcctgcctgccaagccagatcgatcgcagtcaaatttgctgtagcggaacagcggcaagcagtgcccgccgtctcaactctgaagagaagcgtaatggcgatatagctcacgtgaaagctacgtgaactccttactcttcgtcccttgattattgttatctcagcacaaaactttgctgaggggggccatggaagaactcgtccgagtgcaggccggccggatttcgtacttgggtgatcgttattagacattattagtgg

SEQ ID NO: 14310 - DNA, 2142 bp, Zea mays
caaaacaccttttgtgattttttggtgctctctcagccatcgttcactgcgcctgtggcagcccaacccactgacagttccgcacacagctttaccgaccccacgtgtcatcggataggctcatagaactagaggtccgctagcgtgctagcagccgggatggcagcgcaggcagcctgacacctgtgaggccgtccgccacagtccacagagcaaaagcggctacaaagatccacagcgcactcccccgcggcccgccctggactacacagcagaagcatcggcggcgagcgtatacgtaatatacaccaccagtacagcatccattccaactaccttccccatccctacccatcatcaccctcaccagtcaccactcgccaccctcgcccgcccccatggtctcgctcgctggctcccagatcccctcgccttcgccggggcagagcccattgcgcggccgcgcgcccgcagcgccgccagggacactccatgcgcaccatccgctccgctctgctgcagccggactcctccccggggtccccgtccccgcgcgatggcggcgccgacgcgggcgactcggacattgagaacctcaccgactccgtcatcgacttccacctccgcgagctcgccgccaccgcggggcccgcgcacccggcggccgtcgccaagtcctcttccgccatcaacgccgccgccacggagctgctcgacctgtcgcgggacttctccgactactccagcttcaactccgacatctccggcgagctcgagcgcctcgctgccgcggcgggggcggcgcccagatccgacgcgccggacgcggccgccgtggatctgaacgacctcgagtccatggatctgtcggcggacgcggcgccgctggagcgcgtggagccgttcgtgctggcgtgcgtgcgggcgctggggcccgacgccgggccggacgcgcggcgcgcggccgcggccaggatacgcctgctggcgaagcaccgctccgacatccgcgagctgatcggcgtgtcgggcgccatcccggcgctcgtgccgctgctgcggagcaccgaccccgtggcgcaggagagcgcggtcaccgcgctgctcaacctctcgctcgaggagcggaaccggtccgccatcacggccgccggcgccatcaagccgctcgtctacgcgctgcgcaccggcacggcgccggccaagcagaacgccgcgtgcgcgctgctcagcctctcgggcatcgaggagaaccgcgccaccatcggcgcctgcggcgccatcgcgccgctcgtcgcgctgctctccgcgggctccacgcgcggcaagaaggacgcgctcaccacgctctaccgcctctgctccgcgcgcaggaacaaggagcgcgccgtcagcgccggcgccatcgtgccgctcgtgcacctcatcggcgagcgcggcagcgggacgtgcgagaaggccatggtggttctggggagcctcgcgggcatcgccgagggccgtgaagccgtggtggaggctggcgggatccccgccctggttgaggccatcgaggacggccctgccaaggagaaggagttcgccgtggtggcgctgctgcagatgtgctccgattccccgcataaccgtgcgcttcttgtacgcgagggcgccatcccaccgcttgtcgcgctatcgcagtctggctctgcccgtgccaagcacaaggctgagactttgcttggctacctgcgggagcagcgacaaggggttgcctgcagagctggagcagtggcagctactagcttggctaggtaaaaaggcaagagctatggtcgaaatctgctccatttattctctgtgagaggtgttgagagcagatcagcgacgccaggggggcgcatctgtaaataacagctggctctggttggtttggctatgtgtctatgtgaatacacatgtggtttgcaaaaaaaaaaaaaaaaatggttactaacgtaacgtcagttaagagtcttaagagggaggagggttcaggggtcccaggttatgctattagaagatttgggtggtaatgaagatgatgctggtttgtagctgtgtacagggtgctagggtatgcttgctttgtcttttcaggttatccggaatgttggatcgcct

SEQ ID NO: 14311 - DNA, 1184 bp, Zea mays
  misc_feature (914)..(914): n is a, c, g, or t
  misc_feature (932)..(932): n is a, c, g, or t
  misc_feature (946)..(946): n is a, c, g, or t
  misc_feature (978)..(978): n is a, c, g, or t
  misc_feature (996)..(996): n is a, c, g, or t
  misc_feature (1021)..(1021): n is a, c, g, or t
  misc_feature (1042)..(1042): n is a, c, g, or t
  misc_feature (1048)..(1048): n is a, c, g, or t
  misc_feature (1057)..(1057): n is a, c, g, or t
  misc_feature (1059)..(1059): n is a, c, g, or t
  misc_feature (1072)..(1072): n is a, c, g, or t
  misc_feature (1076)..(1076): n is a, c, g, or t
  misc_feature (1082)..(1082): n is a, c, g, or t
  misc_feature (1091)..(1091): n is a, c, g, or t
  misc_feature (1103)..(1103): n is a, c, g, or t
  misc_feature (1108)..(1108): n is a, c, g, or t
  misc_feature (1114)..(1114): n is a, c, g, or t
  misc_feature (1121)..(1121): n is a, c, g, or t
  misc_feature (1123)..(1123): n is a, c, g, or t
  misc_feature (1146)..(1146): n is a, c, g, or t
  misc_feature (1165)..(1165): n is a, c, g, or t
actggtttgcatccccatatacccaaccaggaccaggccggcggggactctcctcctcgcctccgcctccgacatcgagcactcctcttcaatggcgacggcccccgcacccctctcgctctccgcctccaccctgcccgcccggctccgtgccggagtggtaccggcgggcacacggtggaggcagccgcggcgcgggcggatggtggtgcgcgccaagatccgggagatcttcatgccggcgctgagctccaccatgacggagggaaagatcgtatcctggtccgcgggcgagggagaccgcgtctccaagggcgatgctgttgtggtcgtcgagtctgacaaggccgacatggacgtcgagaccttccacgacggcatcgtggcggtggtcctcgtccaggctggcgagtcagcgccggtgggcgcccccattgcgctgctcgcggagtcggaggaggaggttcccctcgcgctcgccaaggctcaggagctctccaacgggcagccgcagcaggcgcctcctgctccgacggaggatgccgcagcggcgccgccccctcttccggctgcgacgactgctccagcgccggtggccgcggggacgaagggcattaccagcccgcacgctaagaagctggctaagcagcacagggtggaccttgccaagattactggcaccgggccgtacggtcgaattacgccggcagatattgaggcggctgccggaatcaagccgaagtcagagcccactcctgctgctgctgctgcgccaccacctgtggccgcgccttcagttggtgctgtgcctcaggcagcagtgctgccgccggttcctggcgcgactgttgttccattcactaccatgcaggctgcagtgagcaagaacatggtggagagcctggcagttccancattccgcgttgggtacnccattgtaaccganaagctcgatgagctgtacgaaaaggttaagcnaaagggagttacaattanagttctgttggcgaaggctgcagcnatggctcttgcacagcacccngttgtnaatagtacntncagggatggaaanagcntcacanacaacagtnataacaacattncagtngctgtngcaattnangggggcttattacaccttttctnaggatgcagaaagctgganattatttctctcgcaaaat

SEQ ID NO: 14312 - DNA, 884 bp, Zea mays
ccggccgcaatcctcgctgctttccaccaccctataccaaaccagccaaagccctcctctcctccccgcctccgcctccgacctcgaacattcttctccaatggcgacggcccccgcatccctctcgctctccgcctctaccctgcccacccggctccgtgccgcagcggtgctggcgggcatgcgctggaggcagccgcagcgcgggcggatggtggtgcgcgccaagatccgggagatcttcatgccggcgctgagctccaccatgacggagggcaagatcgtctcctggtccgctggagagggtgatcgcgtctccaagggtgacgccgtcgtggtcgtcgagtctgacaaggccgacatggacgttgagaccttccacgacggcatcgtggcggcggtcctcgtccaggctggcgagtcggcgccggtgggcgcgcccatcgcgctgctcgcggagtcagaggaggaggtgccgctcgctctcgccaaggctcaggagctctccaacgggcagccgcagcaggcgcctcctgctccgacggaggatgccgcagcgacgccgccccctcctcctgctccggccactgctcccacgccggtggccgtgggtacgaagggcattgccagcccgcacgctaagaagctggctaagcagcacagggtggaccttgccaaggtgactggcaccgggccgtatggtcgaattacgtcggcagatgtcgaggcggctgccggaatccagccgaagtcaaagcccgctgctgctgctgctgcgccaccacctgtggctgcaccttcagtgggtgcggtgcctcaatcggcagctctaccaccggttcctggcgcgactgttgttccatcccctaccatgcaggctgcag

SEQ ID NO: 14313 - DNA, 1392 bp, Zea mays
  misc_feature (1353)..(1357): n is a, c, g, or t
  misc_feature (1359)..(1359): n is a, c, g, or t
  misc_feature (1361)..(1361): n is a, c, g, or t
  misc_feature (1363)..(1364): n is a, c, g, or t
  misc_feature (1367)..(1367): n is a, c, g, or t
  misc_feature (1369)..(1369): n is a, c, g, or t
accatggctcctgcgtggaaaacctgtctgctactacacaaacgacaattgaatggatgtgttcattttgttcacttttacagagtgaggaccaattgaagaaccaactatctgtaaagatgtctaaaggaaactgccctgcacttgccgccccgcgcccgctcatctcttctgcaaagggtttatacactgggattgaggaaattaatttgctaaaagaaattgttgataaggctcgtaacttgaatgcctacttgatgcaaattctggatgattcagactgttatcatggagaagatcttactgtcatattcaaatctcttttagttgctctcaaggcgacatcagcttctggcttgtatgatgacaatgtcagttgcagaattgagtctgttttgagcagatatttgtggaagaaacaaatacataaactattgtatggtggtaaaaagtcatcgattcaagaagtactgtgccttgatgaagagggttcacatttagagatatgtgatcaagatttcttcaagttggagattagtaaaataaaggaaaccagcctgcagtggctggctaaagcagaggaggttgcatgtgattctggtgagcttgcactggatcttgtgtatggacttatagctgaaggggaaaatctctctgtagactttgagaaggaactaaagttactgagggatcgcagtgtcctctactgcatctgctgtaagcccgacgataacagggccatgattgcatgcgaccagtgtgatgagtggtaccattttgattgcatcaacctgcttggaccccctccagaaagcttcttctgccctgcttgccatccaaacaatggtgaagaatctgtatcacttgcacgctcagaggatgatgaggatagatcaagcactggagccggagctcacacgccgccggacagagtggtggagcgagacttaataaagcttcttagctgccatagcggtagctcatggagcgagagcagaagggctcctcatcgaacagctagaaggcgtagtagtttcgtcggattgttatgatgtgcaggaaccttcttagcaccgtgaattgattctttttagttaggttagaagcaggaacgatccatcatctgctgttgtaatttgtagctgttgacaggaggtagatgtagcaaggcagagctgtaagaacccattattattgatcttgtagcagtctgaggttttggaaattgtatcatatactaccgccgttcttgaatatttgtcgcctattgtttcaaaaaacgacaaataaaaaaattaaaaaagaatggagagtatttttatgctgctgctatgcacggctcataaaaaaaannnnnancnannagnanaataaatttttttaacatcatat

SEQ ID NO: 14314 - DNA, 1070 bp, Zea mays
cattgggtacctcgaggccggccgggccccctctgcctcttgctctctctcgcctctggttggcagagctctcttgaagcctcgagactcgtctcgccgctgctccctcagctctgccgctgcgtgcctgcgttagctgttgcattgcagcactgcgagccttgagctgctagctcgcccttcaccacagtccccagacatggagttcgaagaccgctgccacaaggtccaggagcccaagttcgactgcctgctcttcggtaagccgctgctctgcttcctgcgaaaatgtcgccgcccgttgctgtcatatttttgttccgtcctgctgtttcctcctccctctgctctgcctcctcacggaatgcaagggttttctgatcggttctcgcctacagacctcgacgacaccctgtatccgctgagcgccgggcgcgcaggccatgtcaagaagattgaagattacatggttgagaagctgggtattgacgagaccaagatcgagaacctgggcaatctgctgtacaagaactacggcaccacgatggctggactcagggccatcggctacagcttcgattacgatgagtaccacgccttcgtccatggaaggctgccgtacgacaacatcaagcctgaccccattctcaagcacattctcaagaacctgcgcatccgcaaactcatattcaccaacggtgacatggtccacgccgtgagagccctcaagaggctgggcctggaggactgcttcgaggggatcatctgcttcgagaccctgaacccgccctgcccgccgcagggagaccaggagcccgagatcttcgacatcgccggccacttcgcccgctccggcaccgccgacgagctgcccaagacccccgtcctgtgcaagcctaacgtggacgccatggaggaggcgctcaggatcgccaacgtcaacccgcacaaggcgatcttcttcgacgacagcgtacgcaacatccaggccgggaagcagattggcctccacacggtgctggtgggcaaatcgcagcgggtgaaaggcgcggaccacgcgctggagacat

SEQ ID NO: 14315 - DNA, 1347 bp, Zea mays
cattgggtacctcgcgcccggccgggccccctccgccttctgctctctctcgcctctggtgcgcagagctatagctctcttgaagcctcgagactcgtctcgccgctgctctgctccccagctctgccgctgcgtgcctgcgtcagctgtcgcattgcagccagcgagccttgagctgctagctctctcttccccacagttcccaggcatggagttcgaggatcgctgccacaaggtccaggagcccaagttcgactgcctgctcttcgacctcgacgacaccctgtacccgctgagctccgggatcgcggaccatgtcaagaagaacattgaagattacatggtcgagaagctgggtattgacgagagcaagatcgagaacctgggaaatctgctgtacaagaactacggcaccacgatggctggcctcagggcgatcggctacagcttcgattacgatgagtaccacgccttcgtccacggaaggctgccgtacgacaacatcaagcccgaccctgttctcaagcacattctcaagaacctgcccatccgcaaactcatattcaccaacggcgacaaggtccacgccgtgagagccctggagaggctgggcctggaggactgcttcgaggggatcatctgcttcgagaccctgaacccgccgtgcccgcctcagggagaccgggaggccgagatcttcgacatcgccggccacttcgcccgctccggcgccgccgccgagctgcccaagacccccgtcctgtgcaagcccaacgtcgacgccatgggggaggcgctcaggatcgccaacgtcaacccgcacaaggcgattttcttcgacgacagcgtacgcaacatccaggccgggaagcagatcggccttcacacagtgctggtgggcaagtcgcagcgggtgaaaggcgcggaccacgcgctggagagcatccacaacgtcagggaggcgctgccggggctgtgggaggaggccgagaaggcggaggacgtgctctacgccgagcgcgtcgccatggagacctcggtcaccgcgtaaacccctctctcgaatcctccggtgcaccgtcagcccaaccttctcgacatccaggaccgggacgatcgcataccactctctccccgagccagggctggtggtctcacgctggaactgaatccagccatggccgggccgagaatttccgacagcaagaaggggtgcagcatgtaaaggggggagcagatgatatcatgtttgggatgctcccagatatgtatagttatgtatcagccagttgtttgtaaattaccaataaatattagaagtaataagaaaaaatggagtttacttgt

SEQ ID NO: 14316 - DNA, 968 bp, Zea mays
  misc_feature (873)..(873): n is a, c, g, or t
cccacgcgtccgcccacgcgtccgcccacgcgcccttcaccacagtccccagacatggagttcgaagaccgctgccacaaggtccaggagcccaagttcgactgcctgctcttcgacctcgacgacaccctgtatccgctgagcgccgggatcgcaggccatgtcaagaagaacattgaagattacatggttgagaagctgggtattgacgagaccaagatcgagaacctgggcaatctgctgtacaagaactacggcaccacgatggctggactcagggccatcggctacagcttcgattacgatgagtaccacgccttcgtccatggaaggttgccgtacgacaacatcaagcctgaccccattctcaagcacattctcaagaacctgcgcatccacaacatcagggaagcgctgccggagctgtgggaggaggccgagaaggcggaggacgtgctctaccccgaacgcgttgcgatggagacctcggtcaccgcgtaaaacccctgaatgcctccggtgcaccgtcagccgaactttctcgacatctccaggaccgcatcaacgatcacatgtcactcgctccccgagccagggccggtgatgatctcgcgctggaactgaatccaccagcaatggccgggccgaggatcgatttccgacagcaggaagggtgcagcatgtaaagggggaacagatgagatcatgtttgggttggtcccccgttgtatatgtagttatgtatcagccagtcctttgtttgtaaattaccagtatttagaagtaataagaaaatgggggtttacgtgtacgtttcctgtgctctgtcatctgaagcaataaaactggttagcaagaccgggagagcgcccnaaaaaaaaaaaaaaaaaaaaaaaaaaaaaagggcgaccgctgtccagctctacaggcttacgtacgcgtgcactgcgtgcatcatagcgtcgagc

SEQ ID NO: 14317 - DNA, 5722 bp, Zea mays
  misc_feature (4725)..(4725): n is a, c, g, or t
  misc_feature (5506)..(5506): n is a, c, g, or t
  misc_feature (5515)..(5515): n is a, c, g, or t
tatgtatggagtatcatttgagtatgtactatcgggttgtcatcaactatctaggtccatgtctttgtacaaggtacatgagtgctactaaggttgactccagcggatcccgagcgcgaacgcgaaaagcaccaggccacaaagacgagcgcgtcgcagaaacagacgcgagttccagccgctcgcgtaaagaggggaagaagagagagggaacactagtttgagggagagagggaggggatgcctcttttacgcaactgcatctggtatctcctggatgacgctacaatgacgctcgctgtgaaaacaatgcatccgcgacacgtttttgcgtcctgctggactcagcctaaaatagaccaatttagagtatctgtagctatcactgtggcattctctaccaacattggaataggcgtgactagcaatgtgggaggctgacacatgaggagtacctactctcacaaggcaactcaaaaggggagtctcttagtgggtactatcctttagattttgttttgtttattgcaaacatatcgggtttgtatgatatggtacacgatgctcatgatgggttagttatttttgttggttttaattagacttgatccaaccttaatcatataaattttaatgtctataataaaattagtgtaataaataataatcgtgtatattaaattgatagtgaattgacttagatgcagatgtagatgtagattatttttaatattagatgtatatatatgaatttttagaaaataatcacatcaattttgaaacaggcggagagagagtgggagagaaaagaaagaacattttaaactattagttataggtctagatctagatagagataggcaacacacatcatgcatgttgttccattgtgttatcttttcttagttcgcactctgcacacatcttcattagtttattcatctttttgcatattttttcatcctttctcccctcatatccatggcagacaaggacccaataatgtcacctttccatgagtttacctctacactcttctcctctcataagtctgagcgaatctgatgaccatgagccctcctctaagaataagtttagtagatacaacaacctcgaaccaggttagttggtaacattttgtagtatcagaattgggggttttgtgttctctaaaagagattttgttgagaccgacgaagtttgaggtgacgataaaggtgggggacgtcactctgagttatgggagagagaccgatggtagacggttgaaaggtgggcggtattttagcacccaagtcatgtcgaaaacaaacacttattttagagttgaagaagattattgagattagagatggctgtggtcatgagcatcaacgaagacggtgtttcaccaccagggatggcgagtggtggacgactggaaaaaagattgtgcgccccctaccagtcatgctaataacatgaccgagcgtgtgttaaccgtgtccatatgaatatgaagtactagtaatatataatatgcaagccataataattttgtgcctactccagctatcaaaattcctgttatgtcctcccgtggcaacacgctccgtcccaaaactttccagaaacattgagggggcagttcgggaagaagtgggggaaaatcactgccccccatcgttttgttagggccaatcatggggcgacagctgggtggcactgctccggaggctattaacaactggggttaagcgagttaacaagcgcacgccattggactggtcagctgctaaccgcggctgctaattccgaccggggagccagccagccacggctcgctcggctatataaaccaacacgcccccgcctcctctcctccccctccgcctcctgctctctctcgcctctggttggcagagctctcttgaagcctcgagactcgtctcgccgctgctccctcagctctgccgctgcgtgcctccgttagctgttgcattgcagcgcagccccgcgagccttgagctgctaggtatgctcgcgttcttggccgctggaaatgtgggtcagttcagagctctgatgaactctgcgccgaggatgggaaaaaggacgggattgcttattagatttgaaaatcgaaatagtgatttagtttttcagggttctagaaagaatgataaaattttgagggggcgtaaataatgacatgaccgaatcggaatttggcttggaattaattatcgggagaagtgttcggactgcctgctaatctcgattcctctctgcagctcgcccttcaccacagtcctcagacatggagttcgaagaccgctgccacaaggtccaggagcccaagttcgactgcctgctcttcggtaagccgctgctctgcttcctgcgaaaatgtcgcggcccgttgctgtcatatttttgttccgtcctgctgtttcctcctccctctgctctgcctcctcaccgaatgcaagggtttttctgatcggttctcgcctacagacctcgacgacaccctgtatccgctgagcgccgggatcgcaggccatgtcaagaagaacattgaaggtgaggttcctgttctcctgctgttactgcctgcttcttctttttttactgtctaaaagttcagtgagctgagtgcctgcaactcttcgcttttgccaccattcatttcagattacatggttgagaagctgggtattgacgagaccaagatcgagaacctgggcaatctgctgtacaagaactacggcaccacgatggctggactcagggtacgtgtattgcagcttccctgttgctttgagttgtttgctttttctattagtgaatcagtgagctaaaaaggccctacctttttttccccattcctttggatttcccaggccatcggctacagcttcgattacgatgagtaccacgccttcgtccatggaaggctgccgtacgacaacatcaagcctgaccccattctcaagcacattctcaagaacctgcgcatccgcaaactcgtaagcgtcgtcctcaggcgacacaaatttctcctccttcgggcaagagtcgagttgctgaaacgtacgtacctgttccagatattcaccaacggtgacatggtccacgccgtgagagccctcaagaggctgggcctggaggactgcttcgaggggatcatctgcttcgagaccctgaacccgccctgcccgccgcagggagaccaggagcccgagatcttcgacatcgccggccacttcgcccgctccggcaccgccgacgagctgcccaagacccccgtcctgtgcaagcccaacgtggacgccatggaggaggcgctcaggatcgccaacgtcaacccgcacaaggcggtgagtttccgagctctggcacccaacacaatttccattcctgttcctgacgtcgcatccacaccttgaagaaacattttttattattttttattctgcttgaccatctccctgacgaaagctttacctgattgatctcctgcagatcttcttcgacgacagcgtacgcaacatccaggccgggaagcagattggcctccacacggtgctggtgggcaaatcgcagcgggtgaaaggcgcggaccacgcgctggagagcatccacaacatcagggaagcgctgccggagctgtgggaggaggccgagaaggcggaggacgtgctctaccccgaacgcgttgcgatggagacctcggtcaccgcgtaaaacccctgaatgcctccggtgcaccgtcagccgaactttctcgacatctccaggaccgcatcaacgatcacatgtcactcgctccccgagccagggccggtgatgatctcgcgctggaactgaatccaccagcaatggccgggccgaggatcgatttccgacagcaggaagggtgcagcatgtaaagggggaacagatgagatcatgtttgggttggtcccccgttgtatatgtagttatgtatcagccagtcctttgtttgtaaattaccagtatttagaagtaataagaaaatgggggtttacgtgtacgtttcctgtgctctgtcatctgaagcaataaaactggttagcaagaccggaagagcgacatatttgtttctctgctgaatggctgacagccagatttctcttccatctccccgattccatgagacgtcaagctcctttcctttggcagctgttgagcacttgagaacgtcccgttacaaacactagtacgtttgctagtcgtacaaataagggagaaacattctgatgcgaactagtacctgaatttgtcattaaaacgtgggtcaaactgcaacacaccaacctgaacttgtcattaaagtgtgtggccaactagattagtaaaaagcaaaaggtacatccagacacaatagagggcaagaaaaagaaacacatctcccaaacaattaaaaaaaaccaggtaaataagtcaattacacatcaacaccactcccttatctggtgtatgatttgaagaattaatccattctagataagctggtgcattcatttcacaattttgtggaataaactttttttgaaacgacacgcacaaggtagcgcgtgttatattgatagagaagaaaaatacaagactatgatcatgggagatcataggcaagaaaagaaaaaacaaactcatccagttggatcggaacatcaacacgggttaccgctcaactatactcactaacgagttggattnggacatcaacacggcccagcactactcacaacgaccatagagtagacatagcacaaccgcagcttccacccacaaccgcacgcttgcgatcattgaaacctctgaagtgatccagcgccgatagaggagaagaggggcagacaccaccacaccgagaaggccatcgactcgcaggacccattgccgcagtgatgttgcaccaaagccgaccacccgacggaatgaaaacaccaagtctgaacaacataacatgcaggggcctcgccacatccgccgttggacgcctctctctctcgtgcgcgggaacctccaaacccgctacacagctccccactccggacttgtttcaggaaatgtcgttaaggtagcaagaagaggtgccccaccctctaggaatcttatcaggcctccgaaaccaccaccgtggtttgaaatcatctcattgctttccctcgcacatgaagtcgtcgccaacgagctagaagaacgaagatgtcgcaagcgtcgtcttccaatattgtaccgcaccggatgggttcagccacgttggacaacccgttgcgatccgttgcaggccaagtcatcattagttggcattgtcgttgccgcaagcgtcgtccttcaacgatgtctcgcaccgcactggcgattgccgagaaacaccaggcgccacggcacgctgcgagcagcctaacaacaaccgagtgaagacccccgaccactaacaagagagcagacgtccttgcgtgaggtagacaacccccttatcgcatgctctacnactgattcntcaccaccggtcgaagcaaccacaaacagcaggccgaccatgccatcgattgaacggtgtctctagagacgatgcctcctaggaggccatgacgcccacaggcgtcgtagtcgcccgtctaggagctggaccgggttttcacccagagacctcgtgcagcagggttgcaactccaaaatgacgccctcaacagggagagcgccgccc

SEQ ID NO: 14318 - DNA, 1510 bp, Zea mays
  misc_feature (1459)..(1459): n is a, c, g, or t
actcctatggtgccattgggtacctcgaggccggccgggcccccctccgcctcttgctctctctcgcctctggttggcagagctctcttgaagcctcgagactcgtctcgccgctgctccctcagctctgccgctgcgtgcctgcgttagctgttgcattgcagcgcagccccgcgagccttgagctgctagctcgcccttcaccacagtccccagacatggagttcgaagaccgctgccacaaggtccaggagcccaagttcgactgcctgctcttcgacctcgacgacaccctgtatccgctgagcgccgggatcgcaggccatgtcaagaagaacattgaagattacatggttgagaagctgggtattgacgagaccaagatcgagaacctgggcaatctgctgtacaagaactacggcaccacgatggctggactcagggccatcggctacagcttcgattacgatgagtaccacgccttcgtccatggaaggctgccgtacgacaacatcaagcctgaccccattctcaagcacattctcaagaacctgcgcatccgcaaactcatattcaccaacggtgacatggtccacgccgtgagagccctcaagaggctgggcctggaggactgcttcgaggggatcatctgcttcgagaccctgaacccgccctgcccgccgcagggagaccaggagcccgagatcttcgacatcgccggccacttcgcccgctccggcaccgccgacgagctgcccaagacccccgtcctgtgcaagcctaacgtggacgccatggaggaggcgctcaggatcgccaacgtcaacccgcacaaggcgatcttcttcgacgacagcgtacgcaacatccaggccgggaagcagattggcctccacacggtgctggtgggcaaatcgcagcgggtgaaaggcgcggaccacgcgctggagagcatccacaacatcagggaagcgctgccggagctgtgggaggaggccgagaaggcggaggacgtgctctaccccgaacgcgttgcgatggagacctcggtcaccgcgtaaaacccctgaatgcctccggtgcaccgtcagccgaactttctcgacatctccaggaccgcatcaacgatcacatgtcactcgctccccgagccagggccggtgatgatctcgcgctggaactgaatccaccagcaatggccgggccgaggatcgatttccgacagcaggaggggtgcagcatgtaaagggggaacagatgagatcatgtttgggttggtcccccgttgtatatgtagttatgtatcagccagtcctttgtttgtaaattaccagtatttagaagtaataagaaaatgggggtttacgtgtaaaaaaaaaaaaaaaaaacagcagaccccaaccaataaaaactggggtagcaagaccgggaagagcgaccttatttgttttctcaaaanaaaaaaaaaaaaaacctcggagggggggcccccgacccaattcccccttag

SEQ ID NO: 14319 - DNA, 1439 bp, Zea mays
ctcgaggccggcccgggagaccgcgaggtccccctccgccttctgctctctctcgcctctggtgcgcagagctagctctcttgaagcctcgagactcgtctcgccgctgctctgctctgctccccagctctgccgctgcgtgcctgcgtcagttgttgcattgcagccagcgagccttgagctgctagctctctcttcaccacagttcacaggcatggagttcgaggatcgctgccacaaggtccaggagcccaagttcgactgcctgctcttcgacctcgacgacaccctgtatccgctgagctccgggatcgcgggccatgtcaagaagaacattgaagattacatggtcgagaagctgggtattgacgagagcaagatcgagaacctgggaaatctgctgtacaagaactacggcaccacgatggctggcctcagggcgatcggctacagcttcgattacgatgagtaccacgccttcgtccatggaaggctgccgtacgacaacatcaagcccgaccctgttctcaagcacattctcaagaacctgcccatccgcaaactcatattcaccaacggcgacaaggtccacgccgtgagagccctggagaggctgggcctggaggactgcttcgaggggatcatctgcttcgagaccctgaacccgccgtgcccgcctcagggagaccgggaggccgagatcttcgacatcgccggccacttcgcccgctccggcgccgccgccgagctgcccaagacccccgtcctgtgcaagcccaacgtcgacgccatggaggaggcgctcaggatcgccaacgtcaacccgcacaaggcgattttcttcgacgacagcgtacgcaacatccaggccgggaagcagatcggccttcacacagtgctggtgggcaagtcgcagcgggtgaaaggcgcggaccacgcgctggagagcatccacaacgtcagggaggcgctgccggggctgtgggaggaggccgagaaggcggaggacgtgctctacgccgagcgcgtcgccatggagacctcggtcaccgcgtaaacccctctctcgaatcctccggtgcaccgtcagcccaaccttctcgacatccaggaccgggacgatcgcataccactctctccccgagccagggctggtggtctcacgctggaactgaatccagccatggccgggccgagaatttccgacagcaagaaggggtgcagcatgtaaaggggggagcagatgatatcatgtttgggatgctcccagatatgtatagttatgtatcagccagttgtttgtaaattaccaataaatattagaagtaataagaaaaaatggagtttacttgtacgtttcttgtgctctgtcatctgaagtaataaaagcggttagcaagaatggaagagcaacaaaaaaaaaaaaaaaaaaaaaaaaa

SEQ ID NO: 14320 - DNA, 1458 bp, Zea mays
ccggccggcgccggcttgtgtattaaatcgccccctccgcctcgctgctctctctcgcctctggttggcagagctctcttgaagcctcgagactcgtctcgccgctgctccctcagctctgccgctgcgtgcctccgttagctgttgcattgcagcgcagccccgcgagccttgagctgctagctcgcccttcaccacagtccccagacatggagttcgaagaccgctgccacaaggtccaggagcccaagttcgactgcctgctcttcgacctcgacgacaccctgtatccgctgagcgccgggatcgcaggccatgtcaagaagaacattgaagattacatggttgagaagctgggtattgacgagaccaagatcgagaacctgggcaatctgctgtacaagaactacggcaccacgatggctggactcagggccatcggctacagcttcgattacgatgagtaccacgccttcgtccatggaaggctgccgtacgacaacatcaagcctgaccccattctcaagcacattctcaagaacctgcgcatccgcaaactcatattcaccaacggtgacatggtccacgccgtgagagccctcaagaggctgggcctggaggactgcttcgaggggatcatctgcttcgagaccctgaacccgccctgcccgccgcagggagaccaggagcccgagatcttcgacatcgccggccacttcgcccgctccggcaccgccgacgagctgcccaagacccccgtcctgtgcaagcctaacgtggacgccatggaggaggcgctcaggatcgccaacgtcaacccgcacaaggcgatcttcttcgacgacagcgtacgcaacatccaggccgggaagcagattggcctccacacggtgctggtgggcaaatcgcagcgggtgaaaggcgcggaccacgcgctggagagcatccacaacatcagggaagcgctgccggagctgtgggaggaggccgagaaggcggaggacgtgctctaccccgaacgcgttgcgatggagacctcggtcaccgcgtaaaacccctgaatgcctccggtgcaccgtcagccgaactttctcgacatctccaggaccgcatcaacgatcacatgtcactcgctccccgagccagggccggtgatgatctcgcgctggaactgaatccaccagcaatggccgggccgaggatcgatttccgacagcaggaagggtgcagcatgtaaagggggaacagatgagatcatgtttgggttggtcccccgttgtatatgtagttatgtatcagccagtcctttgtttgtaaattaccagtatttagaagtaataagaaaatgggggtttacgtgtacgtttcctgtgctctgtcatctgaagcaataaaactggttagcaagaccggaagagcgaaaaaaaagaccccaaaagccgccaaaaaaaagcggcc

SEQ ID NO: 14321 - DNA, 4171 bp, Zea mays
  misc_feature (915)..(915): n is a, c, g, or t
  misc_feature (1169)..(1169): n is a, c, g, or t
gtcctcatcgtcgcactgctgcgtgcggataaccaaggaagaaagctgaatgatgcaaggaggagctaacgatgatcttgtggcgtgggaggatgagaatcgcagcaggtgaatgcgcgatgcatcatcacctccactggaatccgctagattccacagctcgagaagactcatcgtcgtatagctggcgtggtacgtaagagtagtctctccaaggattattcatcagcagcagttggtcgcacacatatgcctgcctgcagatacgtagtacagaattctccaagaagaagaagaagatacgcagcacagcaggtttttgtcctggcagtgtgtgtgtgtggaaatagaacagaatactagtaggagcggacaggtacaccatatcttgcattggatccttcagtacgtatttgtggatctggggaatacgaggtgcagcatcgaggcacaggaatggcatttggttcgttctggatgcttcattctgccgcctgaacccagatacttgggatagaagggcacaccacatgcatgcaacacaggctaggccgaaaggggcgcaaatgctgtttgggggccacatgcaccacacatcgacaagaatactagtagtgttgtcgttgctctttccgtgtcacgcagcaatgcctgctgacgtcaacctttttacttatttcgtttgtttattatggtcctgctgtagctttttttttaaaaaaaaattacacgacgcttacaacgcagtatgctcaaccacactgtgaagtgtgaacctattaagtacgtgcaaactctgtcactgtaaatgccttcgaagtttaaaacattaaattttcgagataaaattgatgaagtcgccataaacgtctcgttatcaacgaaaacatcatacaccactgaatacatagaacngttaaattctaaaatgtttgctttttttaaaagaaagttcaaccgagagagctgaggcgtcctccctcctgcaacgggctggcaaacggtgaacgagaaggcatccagccagatctttgggccggcgttaaattcgatccatctcggggggatcatatcgacatacacgccagccacgtagtactccaccatcaccatcgtcaccttttttttcttctaaacccagcttcactatgcgccaacagactttagcncaacaatggcgaacggcctagatctactttctcgcgaacaaatctctctgtactgcttcccgcaatcccgcccacggcccactccatcaaaaaaaaaatctcttcacaaaaatcaaaaagtccctacaattaatttagaatgttattaaccaaaaatcatgctacaacaattccttaaacgaggttctcatatgtagcaacttcctaaactatcaatttatccactagacctagggagttgttttgtcgtcccaatagcctatttcataagtcaataataacaccataaaatcacttatctaccaccgagttcacactcatgtacaaaatgatacacttcgaacaatttgagctgtgaaaggaagatttcatcattctcatttgataagtctgaagatgacaccatccgctggacatgcctttagctaaaaaggcatcatattacaatgtgaccgtggctcccgtgtgtgcgatgagagatgatacatatttttagctctcctcggacgaggcacacaaaaatgcatcacgtgtatgtatctcctattaaaagtttttttttgggctgctgctacagcgacacgcatgagacaaacaattatgtgtctccctttacatgttctgttgggatgggataggtctataaggctatcgctggcacacaaagccgacacgaacccatccaaattccaaagtgccacacgcaccaatactcttgtcctatcctgccgatcatgacgtgcgcacgtccgaattccatccgttgaagaaaaaaaatcgtccaaactacaactgtttcgaaaaatgtttagcaactatcatttcctacctcttattccatatcttattttaaacttcattatacaaataataccatctacaatgtaagttttccaagatcatatatacggtccgttagacacaagaccttactagtaaaaatagagtgataaaggagtacaagcagggcggacctacattgagccaagcgggagcacagactctactcaattttttgattttagtagacattttatcttttttactgtatctactaggatcaattagatagtaaatatctatttactcagattttagtctggtttcgcccctgattacaagacgtgcatcggatagtcaattctgacgtccccgtgttgtcactgttcacacggtacatttcatagggaaagagcaggcaaagatcgaacagccgttgctggtgagctgggaaggcgcagttgttcaacagaatccttttcctcgagcagtatcggtggcctgctctaaggcttcagtcgtcgacgtcgatccaaggtgaaaataggtatgtacagtagtagatcgagagggacggatgtatatagttgtcggccgtgacacaggcgggcccgggccacaaaaaaaaaatatctcacaagaacattgctaccaccaagtgtcaggacccatggttctcgctcctgcgctcctcgtcgtggcggcgctcctggcccagccgctcgggagccgttccggcgacgacgccggggccgcgaacctgcacccggtcgtgctcgtgccgggctacggctccaaccagctggaggcgatgctgacggcggcgtacgagcccccggcgcctgcctgtgccggctccgcggaccagggttggttccctctctggccaaaccacacggcgatgcgcgacgctagccaggtcccctgcttcgccgaccagatgagcctcgtctacgacgccggcgccgacgactaccgcaacgccgacggcggcgctacccggaccccgttcttcggctcggcgcgcgccctcatcgggtaagccgagccctacgttcttccagctaccgcacacctgtctcgcatcactttctgtcgtcctatacaccgttacgttttcagttcacaggcagcgtgctggtcccacctgacgggtgcgtgggacagacaggactgacacatatgcgtatccctctgccaggtgggacaggctggtgcagcagctggaaggcatgggctaccgcgacggcgagaccctccacgccgcgccgtacgacttccgctacgccgtggcgcctcccggccacccgtccgcggtgggggaccgctacttccccgcccgcccgccccgcatccaggagagccgcctcatccatggccgcccggccatcgtggtcgcgcacagcttcggctgcgcgctcacctaccagctcctcctgtcccgcccgctcccctggcgccgccgctacgtgaagcacgtcgtcctcctgggccccgcgctcggcgggttcgcgcatgggatgcgcctcctcagcgccggcatggactacggcctcccgaacgtcccgcggccggcgatgctccggatggcgcggacccagcagagcgccctgtggcgcctgcccacgccgctcgtcttcggggaccggccgctggcggtgaccagcgccgcggcctactcggcgcgcaacgtgtcggcgttcctcgaggccatcggtttccaggaaggcgtgcggccgtacctgacgcgggtgctgccgatgtgggaggcgctgccgccgccgatggtgccggtcaccagcgtcgtcgggttcggcgtcagcacgcccgagacgtacgtgttcggggccgacgggctcgagggggaggccgaggtgctgtacggcgacggcgacggggagatcaacatggtgagcctggcggctgtcgagagatggtcggaggtggaaggccaggtcttgaaggtcgttaggctgcgcggcgtccatcacgacggtttcttcagcatcgatttcgcgttgaatagcacacttgctgagatatcggaggcaggagaaagcgtcattgaacagatcggcattgtatcgtgtcagcagaaacgcagtgattactgagaatttgatggacgggtcctaaaacgtgtcctgcctcacgattgactgattgagaataaaaatggtaggtgatgctgaaaaaaaaaaaaagcaaaaaaaaaaaaaaaa

SEQ ID NO: 14322 - DNA, 1992 bp, Zea mays
ttattttaaacttcaatatataaataatattatctaccgtgtatatgtttttaaggtgatatatacgatccactagatacaagaccttactagtatcaatagagtgacaaaggagtacaagcagggacggacctacattgagccaagcgggggtacagatcccacttttttttttgttttaatagacatttatcttattttctgtatctgctaaggccagttagttagtaaatctctatttagtctctcacttagattttagtctggttccgcgtcctgattacaagacgtgcatcgtatagtccattctgacgtcccccgtattgtcaccgttcacacggtacatttcatagggaaagagcaggcaaagatcgaacagccgttgctggtgagctgggagcctgggaaggcgcagttgaacaacagaatcctttcctggagcagtatcggtggcctgctcaattgtaaggcttcagtcgtcgacgtcgatccaacgtgaaaataggtatgtacagtagtagatcgagagggacggatgtatatagttgtcggccgtggcacaggccgcccgcgtaaaaaaaaaaaaaatatctcacaagaacattgctaccaccaagtgtcaggacccatggttctcgctcctgcgctcctcgtcgtggcggcgctcctggcccagccgctcgggagccgttccggcgacgacgccggggccgcgaacctgcacccggtcgtgctcttgccgggctacggttccaaccagctggaggcgatgctgacggcggcgtacgagcccccggcgcctgcctgtgccggctccgcggaccagggttggttccctctctggccaaaccacacggcgatgcgcgacgctagccaggtcccctgcttcgccgaccagatgagcctcgtctacgacgccggcgccgacgactaccgcaacgccgacggcgtcgctacccggaccccgttcttcggctcggcgcgcgccctcatcgggtgggacaggctggtgcagcagctggaaggcatgggctaccgcgacggcgagaccctccacgcggcgccgtacgacttccgctacgccgtggcgcctcccggccacccgtccgcggtgggggaccgctacttccgcgacctcgggcgcctcatccaggcgagccgcctcaaccatggccgcccggccatcgtggtcgcgcacagcttcggctgcgcgctcacctaccagctcctcctgtcccgcccgctcccctggcgccgccgctacgtgaagcacgtcgtcctcctgggccccgcgctcggcgggttcgcgcaggggatgcgcctcctcagcgccggcatggactacggcctcccgaacgtcccgcggccggcgatgctccggatggcgcggacccagcagagcgccctgtggcgcctgcccacgccgctcgtcttcggggaccggccgctggcggtgaccagcgccgcggcctactcggcgcgcaacgtgtcggcgttcctcgaggccatcggtttccaggaaggcgtgcggccgtacctgacgcgggtgctgccgatgtgggaggcgctgcccgccgccgatggtgccggtcaccagcgtcgtcgggttcggcgtcagcacgcccgagacgtacgtgttcggggccgacgggctcgagggggaggccgaggtgctgtacggcgacggcgacggggagatcaacatggtgagcctggcggctgtcgagagatggtcggaggtggaaggccaggtcttgaaggtcgttaggctgcgcggcgtccatcacgacggtttcttcagcatcgatttcgcgttgaatagcacacttgctgagatatcggaggcaggagaaagcgtcattgaacagatcggcattgtatcgtgtcagcagaaacgcagtgattactgagaatttgatggacgggtcctaaaacgtgtcctgcctcacgattgactgattgagaataaaaatggtaggtgatgctggtgct

SEQ ID NO: 14323 - DNA, 3031 bp, Zea mays
  misc_feature (661)..(661): n is a, c, g, or t
  misc_feature (792)..(792): n is a, c, g, or t
  misc_feature (1880)..(1880): n is a, c, g, or t
ccggacagtccgccggctcatttctggttcgaacactaacatatgttttacagccggtttcatggttagccgtcaaaaatatttcttgccatcaaaaatttatgaatttactatagtgagtgtttggatatcattctcatttttcctttatttcattctcatttttctatgaagatcccaacgggtctaagggagtaaattgttcggtgcccgttatagtcgagcactgaaaatgagaagtgctacaagtggaggttgatgcgctctagcgttctcggtgtttgacacttatatgcatgcgatcttctccaggctcccatggccatccctaaaacacgccatgctcgtcgaatggcccctccctctccgttcgcgtggcttcgtgcacaactcatccatgccacaattctatctatgccaagagcaggcaagggcattcctcacccacgggccacggccgcggccgaattgaattaatggcgtgacgcggagtcgcgaaaaccagacttattacgtgacgacgaccaacgatgcagctcgatagacttatgggcgcctccgtggtcctcgccgtcgttgtttccctcagccgccgtcctccctattgctcgcgctgagatcaagacgacgcctgttgtctccgactcgcgctccgtcatcnctgttcgaggagttcggcttcaggcgcggcggccacgccagtatctcagccaccggcatctcgtggagggtccccgaggggtctcagctgcaagccgtggacacgacgctcatgggtttcttcctcatctnccaactcccttttctaacgagatcaacaaatgagtccgactacgccgaggccaccggcggcgccttctgcccgctcacaagcaagtacgtgcagcggctcttcctgttcaaggaggtggcgcccgacggcacgggcaggggctctctgaccatcgactccgacgaccagtacacggtgctgttcagcagctgccaagagggcgtggaggtcaccatggacgtgcgcaccgagatgtacaacctgcggcgctccggcaccagggagtacctccccgtcggcctgctaccgctgccgtggatcttcgcggccgcggccgcggtgcacttcgcgttcctgggcacgtgggtggtcgtctgcgtcaaacaccgcaggacggcggagcgcatccacgccgtgatgggcgcgctgctgctgttcaaggcgctcaagctcgcgtgcgccgccgaggaccagtggttcgtggagcgcacgggcacgccgcatgggtgggacgtcgccttctacgtgttcggcttcttcaagggcatcctgctcttcaccgtcatcgtgctcatcggcaccggctggtccttcttgaaaccttacctccaggtgcatgcacgcgtcgtctgagatcctgcggttgatccgtgccgtgtgatgcctgcaacgaccaacgatagatcgtgcgtgcgtgcgtgcaggagcgcgagaagaacgtgctgatgatcgtcatacccctgcaagtgatcgagaacatcgcgtccgcggtgataggggagacggggccggcggggagggactggctggcgtggaaccagatattcctcctggtggacgtcatctgctgttgcgcggtgttcttccccatcatatggtccatccgcaacctgcgggaggcgtccaagactgacggcaaggcagcgcggaacctccagaagctcacgctcttcaagcagttctacctggtggtggtgtgctacctctacttcacgcggatcgccgcgtcggccgtcgccgccgtgctcagctacaagtaccagtgggccgtcaatgtctccatcgagatgaccagccttgcgttctatgtgttcgtgttctataactntccagcccgtggagaagaacccttacctgtacgtgggtgacgatgaggaggaagccgcgggtgggcagcttgagatggagagcacatttgagatctgacgagacattttctttagattatatgagatctgatgagacatgcatgcatgtaatacgttatggatgtcttattatctctcccagttttgtatatatagttatacagtgctacaaacaacctgatatggctttcatgttttcccagtagcctaaattgtcctaatgtattcagtcatatataagattagttaattacttaggaatgagtaagttctctggtgcctggtataattttcaggatatctgtttattccagttatgcctgtttatatatagatgatccaaacttcatatatactacttctgtccgaaaatatgtctacaattattattagagtaaaaaatatatatccaaagaatactatttagattacagtttttatcgtaaaacttatcctagaaactaaacagtaaatcttaattttctgcacattattacctaaactttatgaccataaatttaaacagaaccttaataatatgctagctagttcaccgctaattcgatatcatacaacgtactagtttgagccaatttttaagtccaacgcatcaggatagcaaccgccttacaaaaagtatcataagatacataaagaatcgtggataatatagcttagttgattgagttttttggggtcgaaaatatccactcgatttaagtcttcaacttcttcatatgaaaatatggatcaacaagaaaaccccaggcacgggaaaggggaatacatatccccaatcgtttgaaaagcctgtagcttggcgattctagtttggctcgaggttaccggccttgtttggctcgtggtgcatatcgggcgcttattaccttcctacagggaaccagataaccagattacatggtgtccatcaccggcgtcgacggactgagccaggaggcgatgacgagcggcggcatgccgacggcaacgctgtcgccggtgttcaacctcacggtcctcgcctgattcatcgtcctcgcctgattaatcgcttcgttcgacgcactcgtcctacgctttcccattggcctcgcccacaccctacccagcg

SEQ ID NO: 14324 - DNA, 1992 bp, Zea mays
ctcgaggccggccggaaacgtggggacgatggagacaaagaaacgcaagcctgtggtctactaaagacgggggcatcgccatcgcgggcaaacggaggccacaggattagcagccagtattagcagcttctccgtgctgctgcgtctcctcctcatcgtcctctccagtgtccagctcggccatggcgttcaccgtctccttctcccccgccaacgttcagatgctccaggctaggagtggccacggccacgccacctttggaagctgttccgccgtgccaagagccgggccaaggctgcgctccacggccgtccgggtcagcagcgagcaggaggcggcggcggccgtcagggcgccgtccgggaggaccatcgaggagtgcgaggccgacgccgtcgctgggaagttccctgctcccccgccgctggttaggccgaaggcccctgaaggaacgccggagatcaggccccttgacatggcaaagcgcccccgtcgcaaccgcaaatcacctgctcttagggctgcattccaggagacgagcatctcgcctgctaactttgtgcttccattgtttatccatgaaggagaagaagatgctcctatcggagctatgccagggtgctataggcttgggtggaggcacgggctgcttgacgaggtttacaaggcccgcgatgttggtgttaatagttttgttctctttcctaaagttcccgatgcattgaagtctccaacaggagatgaagcgtacaacgataatggtctggttccacgtacaatccgcttgctcaaggacaagttccctgatattgttatctacacagacgtcgcgttagacccttattcatctgatggtcatgatggtattgtgagggaagatggtgtaattatgaatgatgaaacagtttatcagttgtgcaaacaggctgtttcacaggctcgtgccggtgctgatgttgtcagccctagtgacatgatggatggccggattggagcacttcgctctgctctggacgccgagggcttccatgatgtctccattatgtcctacaccgcaaagtatgccagttcattttatggccctttccgagaagctttagattcaaatccaagatttggagataagaagacgtaccagatgaacccagctaactacagagaagccctcatagaaaccgcagcggacgaggcagaaggagccgacattctgctagtgaaaccgggattgccgtacttggacattatccgactgcttcgggatcattcagccctaccgattgctgcttaccaggtctcgggcgagtactcgatgatcaaagccggcggggccctgggcatggtggacgagcagaaggtgatgatggagtcgctcatgtgcctgcggcgagccggcgccgacgtcatcctgacctacttcgcccgtcacgccgccgcggtgctgtgcggcatggggcccaagtaggaggcgaggcccgcccgccattcctgccctgcactgtcattgtggagttgagcgatgagttggcttatcgtatgttttgggggcctggcactggcagaggattgtccgaggccttggatctcttccaataatctgcgccgggagataataagttttggagttctcgcatttcccggtactaatcttctgcgtgttgctagtactgaaaaaggtttggattttgaagcgattttagacagctggattagtacctcaacgaacgaaggatttcaggggaagcgtgcgtatcattcttgaaggcgtcgcactcccacctcccactcccacgtgatttcacggtggaccctggaacaacctcgattggacagtacactactagctgctcgtggtcatggctcaggactatctatccatctatgcaaatgaactaggtcaaggtacaaaattaattatgcttaattaaaagcctgcgacgagataaatttattaagcttaattaatctataactagtaaatggactaattaggg

SEQ ID NO: 14325 - DNA, 2463 bp, Zea mays
atctaaattcgtgtattgttgtccgttgaagtgccctaacttgtggcaagagaaatgcagctgatgtatgcagactctccagttgacattgagttcttacatgaagcttttctgtttgattttctgcttgtttctgaaaataccttgtgctttgccctcttctgaacacgcttacaagtgtttgcagacagtgcatttcaaaaacccgggttttttttaaatctgtatgtttgaaagcacttgatgtgtccattttagatccaacggtaaacaagtgacacttcgaaatcgtacctggacggctcgtcccccgtttccgagttccaagtagaggacgtagaggtggtaatgaattaagatccaaatgtttcttaataaaatgatagtgccttaaataaattgtagttaaaaaataaataaaaataagacttgattttaattagatccttaaattttattgtaaaatttagatcatattgttacccatattccaactgtcacactgccactgcagggccaccacaccgcgcccgcggctagactccaagaaggaaatctccagcgtccagctccagcccatagtgaatctcccggagtcgcccaaacaacagcgacaaccatggccgccgccgcctgctattcgccagcgcgcatcatcatctcctgctcagctaccaccacctcctcaccgtcgtcagcgcgcacgctgcgcgtcgccgtagtggggggtggccccgcgggcgcgtcggctgccgaggcgctggcctcggcgggggcccggacgttcctcctcgagcgcagccccgcgggcgccaagccctgcggcggcgccatcccactctgtatgctggacgagttcgccatcccgcgggacctcgttgaccgccgcgtcacccggatgcgcgtgctctccccctccaacctcgccgccgacttctcccgcgcgctgccccccggggcgcacatccccatgctccgccgcgaggtgctcgattccttcctccgccgccgcgccgttgaggccggggccgagctcgtcccgggcctcgtcacctcgctctcgctccccgcggggcccgccgacccctacctcgtccactacatctcgtcctccccggagggcgtgggagcgggacggagcgtgctggaggtggacgccatcgtcggcgcggacggcgccaacagccgcgtggcgcgcgaggtcggggccggggactacacgacggccatcgcgttccaggagcgcatctgcctccccgacgccggcatggcgtactacgacgaccttgccgagatgtacgtgggcggggacgtgtccccggacttctacggctgggtgttccccaagtgcgaccacgtggccgtcgggaccggcaccgtcgccgccaagccggagatcaagcgcctccagtccggcatccgggcgcgcgcgggccccaagatcgccggcggccgcgtagtcaaggtggaggcccacccgatcccagagcacccgcgcccgcgccgcgtcgtggggcgcgtggccctagtcggcgacgcggcggggtacgtcacgcggtgctccggcgagggcatctacttcgcggcaaagtcggggcggctgtgcgggcaggccatggcggaggagtgggtgcgcacgggctccgtgacggaggccgggctgaggcgcggctacctgcggcgttgggacgacgagttcctgctcatgttccggttcctggacctgctgcagcgcgtgttctacggcgggaatgccggccgcgaggcgctggtggagatgtgctccgacgactacgtgcagcggcggacgttcgaaagctacctgtacaagcggatggtgcctggcgagccgtggggcgacctccggctgctgtggcggacggtggccagcatggtgcgctgcggcgtcatcggcagggaggtggagcgcctgcgacggctggagctgcaaggctagataggagctttgctgaataataataatgcaagatgtgcccgattgacgttgtcatcgttgtctgaatgcattttatacccttcctttgtaaaaaaaaaaaaaaaataaaactttgccatgaataagctgtggttaggaaccggatacatatcgaactatacccacaatgcgaatgtcaagtgataaccttatcgtacagcacaattgcgatgcattaaaatgaactgaattgctcagtaaacgatctaccagcgctaatggccaattacagtgtcttaacatcggaacatgtattgagagtaatcacgcaacataagtacaaaacaaaaccagctctctgaaaagcctaccaaagaaatacaacacttaaacattccaatgaaacaacaatcatcaaaatgaccatggctccgtttctgcggaaaatgcctcaccatgtgctccgtgaaaccgcagaaatatccaatcaggcctgtgttcattggtatgtcagtgtgccgcatgag

SEQ ID NO: 14326 - DNA, 1820 bp, Zea mays
gcgagtgctgcaaacacaggcacaccgctgcgttccgctacccccggccgggaccgccagacgcaacgcaaccaatccccctctctgtcctctccgtcctgaactcgcgcctcgcttcgtctctcccattcccacccgctgaagcttcaaggaacttctctaagaccgagctaacgagctcaccggcgggcaggatgctggcggcgtccaccaaggtcggctctaggctggcctctccacacgcctccttgtccgccggtgctgcggcggcggctctggcgagctcccccgtgctgggctctgggatgctcccaggcgccgggttcggcgagacggggagtcaccacgcggcagacgcgccgccgccgctgccttgcagttcctcgggcgattcaagggaatattatcagtggaagagactggtgaatcaaaggcagtcaacgctagatggaggcaaagtgcctgctgcattgggccaccatgtttttggtgcgggctgttcctcacggaaccaacatatctacagatatttttcatattcttctcatcaagggagtatatggggcaggagcaaggttctacatgacctgccagggtatgtaaaaattgtggaagtagggccacgagatggtctacagaatgagaaggacatcgtgccaacacctgtaaaggttgagcttatacgaagattggccacatccggattacctgttgtggaggcaacgagttttgtatctccaaaatgggtacctcagttagctgatgcgaaggatgttatggaagcagttcggactatggggggtgtacgttttcctgtattgactccaaaccttaagggatttgaggcagctattgcagcaggggcaaaagaaatcgcaatatttgcatcagcttctgaaggattttccaagtcaaacataaactgcaccattaaagagagcattgcccgttataatgacgttgctcttgctgcgaaagagaaagaaattcctgtccgagggtacgtttcttgtgtggttggatgcccagtagatggaccagtgccaccttcaaacgtagcttatgtagcgaaagaactttatgacatgggctgctatgaggtttcacttggtgataccattggagtcggtactccaggcaccgtggttccgatgcttgaggcagctatctccgtcgttcccgtggagaagctcgctgtccacttccacgacacctacggccagtccctctcgaacattctcatctctcttcagatgggagtaagcgtggtggactcctccgtcgccggcctcggtggctgcccgtacgcgaagggtgcgtcggggaatgtggcgacggaggacgtagtgtacatgctcaacgggctgggcgtcaagacgggcgtcgacctgggcaaggtgatggccgccggcgagttcatctgcaggcacctgggacgccagtctgggtccaaggcagcgaccgctctgagcaaagttaccgcgaacgcctccaaactctgacaatttaccatgatcccctactgcagataattgcagtaaaattagcgcatggtaataaatagactgaggctattcaaataaatacggcctcggagctagtagtgagtagatttttatttatgtccatctagctagcaaaataagcgcgacactgccaacactgccggtctagcaagcaaaatgagcaaatatgtgaccacctctacgggaaagattcccccaacactctcagcaaacggaagtggtgcatcagttcgttccagcttccagtcatcacatgttcactcagcaaacagaaatggagcatcagttcgttcc

SEQ ID NO: 14327 - DNA, 1808 bp, Zea mays
  misc_feature (16)..(16): n is a, c, g, or t
acatcctaatcgaaancaaaaaaacccagacgcaacgcaacgcaacgcaacccacccccctctggccctctctgtcctctccatcttgaactcgcgcggtcgcgcctcgcttcgtctctcccattcccacccgctgaagcttcaaggagcttctcgtctgagcccgagctaacgagctcaccggcgggcaggatgctggcggcgtccaccaaggtcggctctaggctggcctctccgcacgcctccttgtccgccggtgctgcggcggcggcgctggcgagctcccccgtgctgggctctgggatgctcccaggcgccgggttcggcgagacggggaatcaccacgcggcggacgcaccgccgccgctgccttgcagctcctcgggcgattcaagggaatattatcagtggaagagactggtgaatcaaaggcagtcaacgctacatgtaggcgaagtgcctgctgcattgggccaccatgtttttggtgcgggctgttcctcacggaaacaacatatctacagatatttttcatcttcttctcatcaagggagtatatgggccaggagcaagattctacatgacctgccagggtatgtaaaaattgtggaagtagggccacgagatggtctacagaatgagaaggacatcgtgccaacacctgtaaaggttgagcttatacgaagattggccacatccggattacctgttgtggaggcaacgagttttgtatctccaaaatgggtacctcagttagctgatgcgaaggatgttatggaagcagttcggactattgggggtgtacgttttcctgtattgactccaaaccttaagggatttgaggcagctattgcagctggggcaaaagaaatcgcaatatttgcatcagcttctgaaggattttccaagtcaaacataaactgcaccattaaagagagcattgcccgttataatgatgttgctcttgctgcaaaagagaaagaaattcctgtccgagggtatgtttcttgtgtggttggatgcccagtagatggaccagtgccaccttcaaacgtagcttatgtagcgaaagaactttatgacatgggctgctatgaggtttcacttggtgataccattggagtcggtactccaggtaccgtggttccgatgcttgaggcagctatctccgtcgttcccgtggagaagctcgctgtccacttccacgacacctatggccagtccctctcgaacattctcatctctcttcagatgggagtaagcgtggtggactcctccgtcgccggcctcggtggctgcccgtacgcgaagggtgcgtcggggaatgtggcgacggaggatgtggtgtacatgctcaacgggctgggcgtcaagacgggcgtcgacctgggcaaggtgatggccgccggcgagttcatctgcaggcacctgggacggcagtctgggtccaaggcagcgaccgctctgagcaaagttaccgcgaacgcctccaaactctgacaatttaccatgatcacctactgcagataattgcagtaaaattagcgcatggtaataaatagactgaggctattcaaataaatacggcctcggagctagtagtgagtagatttttatttatgtccatctagctagcaagataagcgcgacactgccaacactgccggtctagcaagcaaaatgagcaaatatgtgactcgtgtagagagacagagagaatacaaatgaagtatactcccccaacactctcagcaaacggaagtggtgcatcagttcgttacaaaaaaaaaaaaaaaaaacggcacgag

SEQ ID NO: 14328 - DNA, 4702 bp, Zea mays
  misc_feature (1884)..(1884): n is a, c, g, or t
cggacgcgtgggcggacgcgtgggctgacgcgtgggcgagtgctgcaaacacaggcacacagctgctatgggatgtcgccggccggaaaaaacccagacgcaacgcaacgcaacccacccccctctctgtcctctccgtcctgaactcgcgcctcgcttcgtctctcccattcccacccgctgaagcttcaaggagcttctcgtctgagcccgagctaacgagctcaccggcgggcaggatgctggcggcgtccaccaaggtcggctctaggctggcctctccgcacgcctccttgtccgccggtgctgcggcggcggcgctggctagctcccccgtgctgggctctgggatgctcccaggcgccgggttcggcgagacggggagtcaccacgcggcggacgcgccgccaccgctgccttgcagttcctcgggcgattcaagggaatattatcagtggaagagactggtgaatcaaaggcagtcaatgctagatggaggcaaagtgcctgctgcattgggccaccatgtttttggtgcgggctgttcctcacggaaccaacatatctacagatatttttcatcttctcatcaagggagcaaggttctacatgacctgccaggatatgtaaaaattgtggaagtagggccacgagatggtctacagaatgagaaggacatcgtgccaacacctgtaaaggttgagcttatacgaagattggccacatccggattacctgttgtggaggcaacgagttttgtatctccaaaatgggtacctcaggtatagtgctttgatgcgaaggtctctggagaacattcagattagacacctgttttatctgcacctattgtacacattgattttctcaggaccctgatttacaacttgggtttttcttcaatatgtaattgaattttcatggagcaggcaggactgaggctgtttatatatctttttagatatatttgtcgctagttatgttgtgtagcattccagagttgtgaaacaaataatcctcctgtttatcataaagatgattctcttgtgcctatatgtcagaaatgtcgtacctgttccaaagtattaaagttttttcccctcataaactaaattggtatagttttttttttcctttttagtaaaaatttagaaaatggtgagaccattgacatcagaaaaggcatttggattgggttctgatttgtttactttgcctaaatgagcgtgagcataattctactctttcattggagtgtcaccagagatttcatggagtgaatataacatcatggaaatttgtcagctacacaaaacccctttccagtgtcatcagaagattgctgcaatatggtggttactctgtgtggaccctcggcaggaatatgcctctctctaaaggctctgaatggaatttattgtgtcaggtcgtgccaatagaatcagttagtaccttggatcctatagaaccttggtatctttgtttttaccttcacagctaatattcctctagtatcatagctgttgggacggagtacatctgttttcagaagtgaacatatacatagcttctccagtttaattgatcctggcaagcctggtgcagtggtgagagctgtctcaccgagtcaccaggtcgtgggtttgaagcaacctctctgcatttgtgaggggaagactctcggtttatccatccctagaccctaatcatgttcaggcagggtaatatcagaactaaggacgacagtgatctcttgattatactcctatgattcatgcattgttcttttcatatttacaggcattgatgttttcttcttaagttcttatgtttcactaaaattacctttctttttcttgcctgccatgtaatgaccagttaatntcaataatactatttttttattattgtagttagctgatgcgaaggatgttatggaagcagttcggactatggggggtgtacgttttcctgtattgactccaaaccttaaggtgaagtatgttcattcaattggcctgtattactatttttatggtattattgtatactgtatgtttgcctcatcagtaccttgttatttgtgcgcaccactcatcagggatttgaggcagctattgcagcaggggcaaaagaaatcgcaatatttgcatcagcttctgaaggattttccaagtcaaacataaactgcaccattaaagagagcattgcccgttataatgacgttgctcttgctgcgaaagagaaagaaattcctgtccgagggtgagctcttctacttttgcaatatcaagtttagttttccacactttcaaaatatctggttgtgtttgtataaagtaactaacacagtagccagtctagcacacatctattatttgcttgctgcaaatacagtccactagattttgtagacaaatgttaaacaacaacccatgggccaaaccaatagtaaacactagcatgaatcatgaatataacttgccttagaagaggcacattaacacctttaatcctgctagtttgagcaattcatgattttaatcttcactcccatttgtcaactcttcaccctgcacctagtttcaataatgtgtatgtttctgaccatgttactttcccacttactctgctagtctcttggccagtcttgtgtgtgtgcgcgcgtgtgcgtgtgcgcgtgcgcgtgtgttaatgtgatgatgagagaattctgatgagtgcatggattttttatataaaaaataattactggtatagtaccacatgttttgatgtttgcacttacgtcactgaaatactttgggtttgctagatatgtgctgaagttgaataatgttgttctgtggcaaaaatgtaggtacgtttcttgtgtggttggacgcccgcccgcgcgtccggtgccaccttcaaacgtagcttatgtagcgaaagaactttatgacatgggctgctatgaggtttcacttggtgataccattggagtcggtactccaggtgatattacatgcctatttttgtttcttcagaaaaatattcatattcgcttcttctgagctaatttgttcctgcttgctgttagaccttgatttgcttacataacgcctgtctttctagaactagagctaggctttggagatgctgatcagtttggcgctgatcgatttcattagatcctcgaacaaatagcaaaggccgccccttacataatttcaaaaaatggatccgattttaagaccacacatcacatgggatttaaaaacaatgagggtaaagcatcaagcgtgcgtcaaccacaatcttctttttatgccataccaaagttccgtcattttccttgatttctatttcccagctgcacatgctatctgcagccttgtggtcctgtgaagattctgaacagtttcagcttttctcatgtatgcaggcaccgtggttccgatgcttgaggcagctatctccgtcgttcccgtggagaagctcgctgtccacttccacgacacctacggccagtccctctcgaacattctcatctctcttcaggtaacaaaccgagaataccatttacacagtcgaaagtgaaaagtgatcaaaccggtgtcctcttgtcaaccagatgggagtaagcgtggtggactcctccgtcgccggcctcggtggctgcccgtacgcgaagggtgcgtcggggaatgtggcgacggaggacgtagtgtacatgctcaacgggctgggcgtcaagacgggcgtcgacctgggcaaggtgatggccgccggcgagttcatctgcaggcacctgggacgccagtctgggtccaaggcagcgaccgctctgagcaaagttaccgcgaacgcctccaaactctgacaatttaccatgatcccctactgcagataattgcagtaaaattagcgcatggtaataaatagactgaggctattcaaataaatacggcctcggagctagtagtgagtagatttttatttatgtccatctagctagcaaaataagcgcgacactgccaacactgccggtctagcaagcaaaatgagcaaatatgtgaccacctctacgggaaagattcccccaacactctcagcaaacggaagtggtgcatcagttcgttccagcttccagtcatcacatgttcactcagcaaacagaaatggagcatcagttcgttccagcttccagtcattacatgtttacaacatccagatctcacctacgctatggacacaatgggaaatgtctagtgctgtaatgcattccacgaaagttgatgggttagctatgatctcaaacttacagcagattcaaagcatttttgggagggctcccaaactggccctggctctgctttctctaggtgcaaaaaaaaaacagcttcaacatagagcatttaggagctggaaccactttttttttataagctagagtaaaaaaaaagctcctagcggctcctccctccactccctgtcctgcccagcgctcgtcgcctggcctctgtcgcgttgcatttggtgtagccggcctatgcccgacgttgccacccagcgccagcctctgccaccctgcaccccataaagccaggctttaataacatcatatttcataatgatttcgtcatcaacttttataatgtatcatgaccatgaattatttacgttttatttatatgtacgtgcatgagatgttggtgca

SEQ ID NO: 14329 - DNA, 1663 bp, Zea mays
gaccgggacgcgacgtgaggcgaagtcaaatccggaaaagaaaagtaatggcagcgaaggagggaggcagtggggaaggtgggtgggaagaggctgcccaaagctaccccagccgcgtctccccaccaccgccaccagcccttcttctacccccaaccctcccccaacaccacaccagcgcagcgccctctcctacccgactcccagctagcccctcacgcgctcgtcggcgccctgtcgagtcgagcccgcatctcgcccgatcgagagcgagcgcatccgcgcgccggggagagctttgctttcggtggtctgtaacgactcaacgacgacggcaggcggtagataaaggcgcgcgatgtgcgacgcggcgccgaggtacaggggcgtgcggaagcggccgtggggccggttcgcggcggagatccgggacccggcgaagcgcgcgcgcgtctggctcggcaccttcgactcggccgaggccgcggcgcgcgcctacgacgtggccgcgcgggccctgcgcggcccgctcgccaggaccaacttccccgcgctcgccaccacctcccgccgccccgcgcccacgtgcagctccggctccaccgtcgagtcctccagcgggccccgcgccggggaccccagggccagggcggcgcatcgcggccgtgctgctgcgaagccgcggcggcccccacggcaggcgccgccgccgcccaccgacgccgactgccacagcgactgcgcgtcgtcggcctccgtcgtggacgacggcgacgacgcgtccacggtccggtcgcgcgcgcgcccgtcgctcgatctcaacctcccggcgccgctcgacttggacggtggccacgacctcgggttctgcacggacctgcggctctgtctctgagcgatcggaatcggatccacggacgaggcggattctgctttgacttgtcgtgaacttgtagcagtagtgccatgtactacgcgatacgaatggcaatagaattggatgatggttccttttctttaacgctctccggattcattcagaggtcagtcatctcgtcgagagtttcagcctttttttctcatgtctggatctgatttgtatcttgctgtcattctgtatgtactttgtacaccagaaaacatctaaaagagagatgttggcgaactaacacaaaaaaaaaacgcaatcccgagttttttttttttttttgcttgttatattgcctctgcgtcgaggtagacgcgatatggttcatcggttcatgcttgcccgtttgtgtacgagaccaaagatgcaatgcatcaacagcgtacggcgtaccactctggttttatttttctaaataagttttaacgacaaaatctgggccggaatgcattgtaaaaacaggacaagtcaggcatgacaccaactgttccatacatgctccaccatagttcaggccatgattttatgattttggtacatgggcgtatatggtttggatttcaaaatcgacggcagtttttctctttgaaaaaacatatgctttccggtcctatcctaaaatgagtatcactattctattcacactggttatatttctaaatctaactatatttatagccaatattaacaaaatatatgtagatagaatttattgtaaacattaatttaattata

SEQ ID NO: 14330 - DNA, 919 bp, Zea mays
gacgtagagatcgacgctaacatatagctcaagtttacagtacaatgatgataacatggggtcttttttcgacgctgttacttgtcttctccctcgactcactgcgctgcagctaatatcttttcactgcttatctggcaccatctacagttctacacgtagtagcgcggggactccgttccggccaaaaaaaatcctaaggaaacgcggccgaggacgagagtgggccagcggggtcgaggaggtaaagaaaactaatggcagcgaaggagggaggcagtggggaaggtgggaagcggctgcccaaagccacctccaccaccaggccttcttctacccccatcccaacgcccaggccacaccagcgctgcgagctctctcctcgtagtcgtagcggagtcccagcccctcacgccctcccgatcgcgctcgtcggcgccctgtcgactcgagcccgcttctgggccgatcgacagcgagagcgagcgcagcggcgcgccgaggagagctctttcggtgctgtataacgacgacgacagcaggcggcagataacacataaaggcgcgcgatgtgcgacgcggcggccgtggcggctccgcggtacaggggcgtgcggaagcggccgtggggccggttcgcggcggagatccgggacccggcgaagcgcgcgcgcgtctggctcggcaccttcgactccgccgaggccgcggcgcgcgcctacgacgtggccgcgcgggccctgcgcggcccgctcgccaggaccaacttccccgcgctcacctcccgccctcctgccaacctgcccgcgcccacgcccacgtgcagctcaagctccaccgtcgagtcctccagcgggccccgcgccggggtgcccagggcgggcaggcgcgctgctgggaagccgcgtgccccgcggca

SEQ ID NO: 14331 - DNA, 701 bp, Zea mays
ccaccaccagcccttcttctacccccaaccctcccccaacaccacaccagcgccccgccccccccccgcccctacccgactcccagctagcccctcacgcgctcatcggcgccctgtcgagtcgagcccgcatctcggccgatcgagagcgagcgcagccgcgcgccggtgagagctttgcttgctttcggtgttctgtaacgacttaacgaacgacggcaggcggtagataaaggcgcgcgatgtgcgacgcggcgccgaggtacaggggcgtgcggaagcggccgtggggccggttcgcggcggagatccgggacccggcgaagcgcgcgcgcgtctggctcggcaccttcgactccgccgaggccgcggcgcgcgcctacgacgtggccgcgcgggccctgcgcggcccgctcgccaggaccaacttccccgcgctcgccaccacctcccgccgccccgcgcccacgtgcagctccggctccaccgtcgagtcctccagcgggccccgcgccggggaccccagggcggcggcgcatcgcggccgtgctgctgcgaagccgcggcggcccccacggcaggcgccgccgccgtccaccgacgccgactgccacagcgactgcgcgtcgtcggcctccgtcgtggacgacggcgacgacgcgtccacgttccggtcgcgcgcgtgcccgcgctcgatatca

SEQ ID NO: 14332 - DNA, 2994 bp, Zea mays
cctcgagccggcgggatctcgatgctccaaacaccatcaaattaatcgcgctccttctcccaccagctctccccctttttttcctgcccacatacaaatgcttgggcattagcgatcctcctcctcgttctccttccccttctccctcctctgggtctgggtgcgccctcccctgctccacttctccggcgctgacatgacgtccacggcgtactcgcggtcgtccaagctgccgggcggcgagcggcggctgcccccgcgcctcatgcgggggttcgcgtccaagatcgagcccaagaagctgggcgtcggcctcatcgccggctgctgcctcgcgctcctcacctacgtctccctcgccaagctcttcgcaatctactcccctgtcttcgctagctcggccaacacgtccgcgctgatgcagcagaacgcgccgccgacctcgtccaaaccgtccgtgccggagacggagaccatcccgccgcaggagacgctaggcggcggcggcgacagcgcggatcccgtcgatctgcgtgagggcgcgacgggctccgaggagcccggcttgccggaagctgccctcacgaggaaggacatggcggcgggctccgacgagcccggcttgcccaccaggaaggacgacggcgaggatgcggcggccgagcccaccaccaagccatctgaggatggcaagggcaatggcagtggtggcgggcaaggagtaggcaagatgatttgcgacgagaacggcgtggacgaggggttcccgtacgcccggccgaccgtgtgcgagctgtccggcgacgtccgcgtgagcccgaagcagaggacggtgtacctggtgaacccgtcgggcggcggcgggttcgacgagcgcggcgagaagcgggtccggccgtacgcccgcaaggacgactttcttctccccggcgtgacggaggtgacggtgaagtcggtgccttcggccgcggtggcgcccaagtgcacgaggcagcacaccgcgccggcggtggtgttctccgtggccgggtacacggacaacttcttccacgacatggcggacgcgctgatcccgctgttcctgacgacggcgcacctggacggcgacgtgcagctgctggtgaccaactacaagccgtggtgggtgcagaagtacacgccggtgctgcggaagctgtcccggcacgacgtgatgagcttcgacgccgcggacgaggacgacgccgtgcactgcttccccgctggcgcgttcctggggctgtaccgcgaccgggacctgatcctgtcgccgcacccgacccggaacccgcgcaacctgacgatggtggacttcgcgcggttcctgcgcggcgcgctggcgctgccgcgcgaccggcccgcggccctcggggagcagcccggggcgcggccccggatgctgatcgtctcgcgcgccggcacccggcggctgctgaacctggacgaggtggcggcggcggcggacgagctggggttcaacgtgacggcggcggaggccggcgcggacgtgccggcgttcgcggcgcaggtgaacgcggccgacgtgctggtgggcgtgcacggcgccgggctgacgaaccaggtgttcctgccgacggaggccgtggtggtgcagatcgtgccgtggggcaagatggactggatggccaccaacttctacgcgcggccggcggcggggctggggctccgctacctggagtactacgtcggggcggaggagacgagcctcaaggacaagtacccgcgggagcacgtggtgttcagcgaccccatggcgctccacaagcaggggtggcaggcgctcgcccagaccgtcatgaagcaggacgtcaccgtcaacctcactatgttccggcccgtgctgctgcaggcgctcgacaagctgcagcagtgagggaccgtgattcctgctactgttcgtcttcctcgaattcgccattgccgaccggccatcccgagactgtggaggctagctagctgctgctgctcctgccaagtacagtactatcgctagaaaaaaagaaaaatgagagatagagagggaatgaaggaggcttcaaatttgcaatcgagttggtttgtattttttttggtttcaaccgtagcagtgcagcagaaacaccagcttggatagtgcgttttacatacactacagtctacacgcgaacaagaatcatgttcattcttttccttgacgagttgactccacctggcaatggcattcttcttctactgatgaacacatcactaatgtattttggggattgagctgttcggagcatgtgctacagctgtgcattattccatctacctttctgtgtggcctgtgctgtgcatgattccatctgcatcccagactcaggctagctccagcaagacaccctaaagggttctgtaccctaaatatagaggatcaaatggtcctctatgctctccagcagcgttctctaaacggtcctctaaatttagaggacgctgctggattctctatctatagagtttctctaaacggtcctctatccatttaaatactttaaataaccggtttagcaaaactaaaatatgtacaatacatttgagagtatgacaaatacgtatgtataaaaaacaaaaataaaaaatgtttctaatatagatatttgagtatagaggacgtgatttagaggacgttgttggagaggaatgagatatagaggctggaatcttttagaggaaactgtaaagtacggatatagaggatgaatatagaggacgttgctggagacagcctcagactgcttgctttgtgccttcccgccgttgactccgaagtccaacgcctgcattttctttttcactttgcacgaagctatgctgagcatgacacagaagtacagaacagaagctacatcgtcatcgtcatccccaagcaccacaaagaaaggggaatacgttgttgttctttcattctaggtacatgcaatgcaaccgctgcag

SEQ ID NO: 14333 - DNA, 3602 bp, Zea mays
  misc_feature (2064)..(2064): n is a, c, g, or t
caaaattcgtgatgcatatgtcgtagttcctcaatggatgtaaggtcccggtcaacgatgtcctagccttgctatactaacttggccttagtgatgcaaattcatccccgtcgggcgttatggtcgattgtcgtctcacggtggggaactccaagcgttgtggtgtggaggggagcattgagcaacactttgtttgtttgtttgagctgcatctcctagagcgtttttttgttgttgcaaaacagcaaaatggtgttgttgggctttcaaatttaagaattcaatgataaaatttcgataatactgttagcttcataaacttaggaagttacaaaagtcccataaaaatagactttccagtttttcatataaactcagcttttatgaacttttaacttttttcggaatctaaaaaaacatgtgtgtttgtgtttaattttctgttttctcacgaaacagacatggcataaaaacgtgttgactgaaggtcatgcaagcatggcctaactaaagacgtgttcgctgttggcctgcaatactagtttggttccagggtttcgtggactcaccgctagatcggaaatgaactgatgcttgaatgaatgagtttaatgaagagccgattttttaatcgaatgtagaggatattgttatctggaactgtgtttacaagaatgtcacccacttccatttgggttcatattactgtgcgttagttggatcccagatcggaggaaagtcaggtttcatcaccaaacccactattaaaattcaaacaaaatgttgatcaaagaaacggccacatgtaacacactcttgagattttaggaggtgggcacatgtaatatgaaagcaaaaaaaaaaatctcctttttttgttgttgttctttgtcgttgagtgcgtagtagtgagaaagaaagaaagcagtagaggtaggtgggcagtccaggttgcagtcccagatcgtcaaagcctcgcctcgcctacactccaccacctccatctcgtaagctccaacacaccatcaaattaatcgcgctccttctcccaccagctctccccctttttttcctgcccacatacaaatgcttgggcattagcgatcctcctcctcgttctccttccccttctccctcctctgggtctgggtgcgccctcccctgctccacttctccggcgctgacatgacgtccacggcgtactcgcggtcgtccaagctgccgggcggcgagcggcggctgcccccgcgcctcatgcgggggttcgcgtccaagatcgagcccaagaagctgggcgtcggcctcatcgccggctgctgcctcgcgctcctcacctacgtctccctcgccaagctcttcgcaatctactcccctgtcttcggtgcgtgcgctcgagttccccttcattcctcctcctcctcacgaatctaaccacagctgccttcctctcttctcagctagctcggccaacacgtccgcgctgatgcagcagaacgcgccgccgacctcgtccaagccgtccgtgccggagacggagaccatcccgccgcaggagacgataggcggcggcggcgacagctcggatcccgtcgatctgcgtgagggcgcgacgggctccgaggagcccggcttgccggaagctgccctcacgaggaaggacatggcggcgggctccgacgagcccggcttgcccaccaggaaggacgacggcgaggatgcggcggccgagcccaccaccaagccatgtatgtactgtatgctaatcccacctctcttttcgttttcctttcattgacaaaaggggatctttttctttctcgcacaacgcaactttaataaatggacgcaaaggaaagcagaggcagctaacgaaccattagcttagctgtgtacttgccaaaaaaaaaaaggaaatcttgttggctggcgaaataaaatttcggcgttggaaaaccagtagcagattttgtggtacgagtagatccgacgcgtcttctctttcaaatggcgctcatttaacttagctgctgcagcggaggatggcaagggcaatggcagtggtgncgggcaaggagtaggcaagatgatttgcgacgagaacggcgtggacgaggggttcccgtacgcccggccgaccgtgtgcgagctgtccggcgacgtccgcgtgagcccgaagcagaggacggtgtacctggtgaacccgtcgggcggcggcgggttcgacgagcgcggcgagaagcgggtccggccgtacgcccgcaaggacgactttcttctccccggcgtgacggaggtgacggtgaagtcggtgccttcggccgcggtggcgcccaagtgcacgaggcagcacaccgcgccggcggtggtgttctccgtggccgggtacacggacaacttcttccacgacatggcggacgcgctgatcccgctgttcctgacgacggcgcacctggacggcgacgtgcagctgctggtgaccaactacaagccgtggtgggtgcagaagtacacgccggtgctgcggaagctgtcccggcacgacgtgatgagcttcgacgccgcggacgaggacgacgccgtgcactgcttccccgcgggcgcgttcctggggctgtaccgcgaccgggacctgatcctgtcgccgcacccgacccggaacccgcgcaacctgacgatggtggacttcgcgcggttcctgcgcggcgcgctggcgctgccgcgcgaccggcccgcggccctcggggagcagcccggggcgcggccccggatgctgatcgtctcgcgcgccggcacccggcggctgctgaacctggacgaggtggcggcggcggcggacgagctggggttcaacgtgacggcggcggaggccggcgcggacgtgccggcgttcgcggcgcaggtgaacgcggccgacgtgctggtgggcgtgcacggcgccgggctgacgaaccaggtgttcctgccgacggaggccgtggtggtgcagatcgtgccgtggggcaagatggactggatggccaccaacttctacgcgcggccggcggcggggctggggctccgctacctggagtactacgtcggggcggaggagacgagcctcaaggacaagtacccgcgggagcacgtggtgttcagcgaccccatggcgctccacaagcaggggtggcaggcgctcgcccagaccgtcatgaagcaggacgtcaccgtcaacctcaccatgttccggcccgtgctgctgcaggcgctcgacaagctgcagcagtgagggaccgtgattcgtcttcatggaattcgccattgccgaccggccatcccgagactgtggaggctagctagctgctgctgctcctgccaagtacagtactatcgctagaaaaagaaagaaaaaaaatgagagatagagggaatgaaggaggcttcaaatttgcaatcgagttggtttgtatttttttggtttcaaccgtagcagtgcagcagtaacaacagcttggatagtgcgttttacatacactacagtctacacacgaacaagaatcatgttcattcttttccttgacgagttgactccacctggcaatggcattcttcttctactgatgaac

SEQ ID NO: 14334 - DNA, 887 bp, Zea mays
  misc_feature (12)..(12): n is a, c, g, or t
  misc_feature (18)..(18): n is a, c, g, or t
  misc_feature (848)..(851): n is a, c, g, or t
ggccggccgggnaaaaanaaaaaaaaaaaaaaaaaaaaaaaaaaaaaaaaaaaaaaaaaaaaaaaaaaaaccattgggtacctcgaggccggccgggacgaccacacaccaccgctccacacacaagaagagagccgagagctagctacctagcgcgcgatggcgatgtccgcttccaagatgatggcggtcgccgccgctgccctgctagccctggtcctggccgcgtcgaccgcggaggcgaggaacatcaagacgacgacgacgacgacggagaagaaggacgatgcggtggtgcagccgcagaccttcccgcccttcgaccgcctcggcggcggcgcgtccccggcgtccggtggcctccccggcacctcgggcggcagcagcattccagcgttcagcatgccaggcagcggcagcagcagcatccccggcgggtcgttcttgcccggcagcggcagcatcggcagcatgcccctcttcagcggcggctccccggccttcagcggcttcggcggcatgcccgggtcccccgccgccggctccgccgtcgtccccgtacacggcaacaagccctgaaaatccgtccgtcgccggagcccggaagtctgtcgggccaacttgtgccctagtactcctttgcctgcattatattggagagttggtatcgcgtttcgtttggtgtttgctttgttatatattaggccgcctatctaccgagacatgtgatgtttgttgcggtaaattaaaaccggttgtattcatgctgctgctgctgtctttaatttgttaagaacggttcaaattaaaaaaaaaaaaaaaaaaaaaaaaaaaaaaaagcggccaannnncctaaaactccgaatatataatacctttagggggcc

SEQ ID NO: 14335 - DNA, 882 bp, Zea mays
cgaggccggccggggatgagctcgctgcgccgtctttcaatgctccccggccgcctccccgctataaagcacctgccttgccacctctctctcctcacgaccacacaccaccgctccacacacaagaagagagccgagagctagctacctagcgcgcgatggcgatgtccgcttccaagatgatggcggtcgccgccgctgccctgctagccctggtcctggccgcgtcgaccgcggaggcgaggaacatcaagacgacgacgacgacgacggagaagaaggacgatgcggtggtgcagccgcagaccttcccgcccttcgaccgcctcggcggcggcgcgtccccggcgtccggtggcctccccggcacctcgtcgggcggcagcagcattccagcgttcagcatgccgggcagcggcagcagcctccccggcgggtcgttcttgcccggcagcagcggcagcatcggcagcatgcccctcttcagcggcggctccccggccttcagcggcttcggcggcatgcccgggtcccccgccgccggctccgtctccgtcgtccccgtgcacggcagcaagccctgaaaatccgtccgtcgccggagcccggaagtctgtcgggccaacttgtgccctagtactcctttgcctgcattgtattggagagttggtatcgcgtttcgtttggtgtttgctttgttattataggccgcctatctaccgagacatgtgatgtttgttgcggtaaattaaaatcggttgtattcatgctgctgctgttgtctttaatttgttaagaacggttcacattattgatttgtcaaaaaaacaaaaaaggcggccgtttaaagggtcccagtctcggacggcgggcttcggaggt

SEQ ID NO: 14336 - DNA, 1454 bp, Zea mays
tggtattgacacctttgtggatgtcatttcaaaatccctctattttgtttattacttatgattttttgggaagtgggaatgacccacttaaataaatattaaagtttgagaagatctatctgctaattactgttgccttgatcaggaagcaaataagaggaacaacaactggctcccacctccatgggcacttgctgcaatggctatccttggattcaacgagtttatgacattactgaggtatttctgttgtctgcagaaacatacatgcatgccagttttggattattacttttgaccaggctaacttttttacttgaataacaggaatccgctttacctgtttgccatatttgtgatttatcttgttggaaaagccctttgggtgcaatcagaaattggcagggaattccaacatggatttgtgagtgttcaaattactttttgttgcactcgttagccacttgaatattgtctaatcaacttctcggcccgggccaccatggatttcttcctgccatcctttcactgtcgacgaaatttgttcccactgtaatgaacatcctgaagagattagctgacgcgggtcaagaacctgcagcagcccccgagaggcaaagagagatggagctccaaccaaaatccaccaggaacggttccttatacagcaatgtgacatcggcagggtcatctagcgtaaccacttcggagattggacctgaatattcaagcccggttgtgcaatgattttgctgatctttagctttttggctggaaacatactctagcagttgagaaaaacagggtgcctcaagaacgtacgaagattttggtgccttgcagtttttgtaagcttgcccttcccagactgattcaaggtggcactgcccctcgttgttattcaaggaattttggggctggcggggttgtttgtaagagcattgtaaaataacttgtttcattttttggtttctgtaacatgaatacatgacatgtgatagttgtatataagatctgtggactgggggcgtatcagcgcattctacacagctaagggttgcatagttgcgagaactgaagcatgtaaatgtctttaaactgccatctgattgagatgcagtagtactgctgttctggaataagacatgtctgcttttggggaaaatgattcaaaaaatgtttcgtttgaactcagcgtctgctgaaaatgaatttggttcccgacccctgttctggttggccgaaattcacaagtttggtgttctttttgtgtactgtccgtacaataatacagtccaggcaaaggacaccagacgcagacggaactgccttcctaggtttacaacaaacgccacagtccacacatcgcccaatcgaacaatacggttgcatatccacggtggagcttcgtgcttcgaagatttgaaaggacgcagttctaaaaattggttgca

SEQ ID NO: 14337 - DNA, 1014 bp, Zea mays
ttgtccgatccactagcctccagctcatgggaaagggttgctgaggagaagactttaattacccctgtgcagtgcaaaaatttgtggaggcaattcaaagctgaatctgaatatacagtcactcaagccatagctgctcaggaagcaaataagaggaacaacaactggctcccacctccatgggcacttgctgcaatggctatccttggattcaacgagtttatgacattactgaggaatccgctttacctgtttgccatatttgtgatttatcttgttggaaaagccctttgggtgcaatcagaaattggcagggaattccaacatggatttcttcctgccatcctttcactgtcgacgaaatttgttcccactgtaatgaacatcctgaagagattagctgacgcgggtcaagaacctgcagcagcccccgagaggcaaagagagatggagctccaaccaaaatccaccaggaacggttccttatacagcaatgtgacatcggcagggtcatctagcgtaaccacttcggagattggacctgaatattcaagcccggttgtgcaatgattttgctgatctttagctttttggctggaaacatactctagcagttgagaaaaacagggtgcctcaagaacgtacgaagattttggtgccttgcagtttttgtaagcttgcccttcccagactgattcaaggtggcactgcccctcgttgttattcaaggaattttggggctggcggggttgtttgtaagagcattgtaaaataacttgtttcattttttggtttctgtaacatgaatacatgacatgtgatagttgtatataagatctgtggactgggggcgtatcagcgcattctacacagctaagggttgcatagttgcgagaactgaagcatgtaaatgtctttaaactgccatctgattgagatgcagtagtactgctgttctggaataagacaaaaaaaaaacttgaacgtcctcccgggggggcccggtacccaatt

SEQ ID NO: 14338 - DNA, 1593 bp, Zea mays
cacacgacacaacaagtacccaaccactccttgattcccctttcctccctctcgcattcgtctccaccagccggtcggacttcttgcgctccaagaactcggcgaggatggaaatgttttttggcagctttctcagtgaatcagtatcaccgcagaacctttttggacacccagatgtcgagagatgcccattcctgaggaatatcaatggagctacaaccttttccctcgcttctgctttgccagtagctactcaaggaggcaagggtccaatttttgaggaagggtcaggctttgagtcagcattcaagcttttccatggccgagatggaatagttcccctttcagaaagatcatatgtatctgatgaaaaccacaatgagagcattgatgtcaggactgaacctgctctgccgtttaatccattggctgctagagcagccacaataagtctatcagcatttggaccatttggttttggcttcttcaacggcaagggcaaaaggcagaacaagaaacccaacaatctagatcagtcccaccagaagcccaagacaccagatcagtcttccatgaaacaaaaaggagtcaacccaccatcacatgaggcattcagcgatgagtggttggaaaatggccagtgcccacttgcgcggtcttaccgggcaatgagtggtgttttgcccctcgtcgccaaggctttacagccaccagctggtatgaagctgaagtgcccacctgctgtggttgctgtccgagctgcccttgcgcgaactgcgcttgtgaaatccctccgaccacaacccttgccctcaaagatggtagccattgcactactggggatggcagcaaacatccctcttggggtgtggcgggagcacaccaagaagttctctcctcagtggtttgcagctgtccatgccgctgttccgttcattgcaatgctgaggaagtctgttgtgatgcccaggactgcgatggcattcaccatagcagcctccattgttggccagacaattgggtcaagggctgagcgcatccgtctaaggaatcaggcggcaaatggtactggtgattcttcaacgcacacttctatgtatccaaacaagaatgggcattgcagcgacactgaaggcaaggcatgggaccctcttgcgacgaagataacaggctcaactgctaggggttctcctgcaccaaccccaaccgtgtgcttctgattgtgttaagcatgtgattcacgcacacctgtgaagagattatacatgaaccggtttatcttatagtgccatgtaattgccttgtgtgtcccagaaaactgagctgcccgtgtgcgataagtagaataagaggtgctaccccactgtttgctgtgttgctatggtcgagaatcgagattgatgtattgatgctgctgcatttctaattttttttcttcaaaaaagcgtgccttgttcgattaaagaaaaaaggctgcattgttttccactttgaatgaaccatcatggcgagcagttttgcaagatgtgctattgcatgtattgcatatatgggttggttttgtgaattaaaaaaaaaaaaaaaaaagcggcc

SEQ ID NO: 14339 - DNA, 1092 bp, Zea mays
cattgggtacctcgaggccggccgggaacccaattcatagatgagtcccaccagaagcccattacccagatcagtcttccatgaaacaaaaaggagtcaacccaccatcacatgaggcattcagcgatgagtggttggaaaatggccagtgcccacttgcgcggtcttaccgggcaatgagtggtgttttgcccctcgttgccaaggccttacagccaccagctggtatgaagctgaagtgcccacctgctgtggttgctgtccgagctgcccttgcgcgaactgcgcttgtgaaatccctccgaccacagcccctgccctcaaagatggtagccattgcactactggggatggcagcaaacatccctcttggggtgtggcgggagcacaccaagaagttctctcctcagtggtttgcagctgtccatgccgctgttccgttcattgcaatgctgaggaagtctgttgtgatgcccaggactgcgatggcattcaccatagcagcctccattgttggccagacaattgggtcaagggctgagcgcatccgtctaaggaatcaggcggcaaatggtactggtgattcttcaacgcacactgctatgtatccaaacaagaatgggcattgcagcgacactgaaggcaaggcatgggaccctcttgcgacgaagataacaggctcaactgctaggggttctcctgcaccaaccccaagcgtgtgcttctgattgtgttaagcatgtgattcacgcacacctgtgaagagattatacatgaaccagtttatcttatagtgccatgtaattgccttgtgtgtcccagaaaactgagctgcccgtgtgcgataagtagaataagaggtgctaccccactgtttgctgtgttgctatggtcgagattgatgtattgatgctgctgcatttctttctttttgttaatgtgtggtggcgtttctcgcttctgtaaagcagctgaagctgtcacatcatttgatcagttgaagctgtatgttaccatgtgtgtgccaaaaaaaaaaaaaaaaaagcggccccaaaaaaaaaaaaaaacaaaaaaaaaaaaaaaaaagcggcc

SEQ ID NO: 14340 - DNA, 864 bp, Zea mays
ataccgcgctgtgcccaccacacgactcctctccctctctctcccccaccgcacggacggagacaagcacgcaggcgagcagctctccggcgactcggcgaggatggaaatgctcttcagcagcctgttctgtgactcagcatcatcggagaacttttctggccatccgggtgttgaaaaatgcccattcctgaggaacatcaatggagctacaaccttttcattttcttctgctttgcctgtagctgcccaaggaggcaagggtcccatctttgaggatggaccagggtttgagtcggcattcaagcttttccatggacaggatgggatagttcccctttctggaagatcatatgtgcctgatgagaaccgcagtgagagcactgatgtcaagcctgaacctgctctgccctttaatccattggctgctagagccgctaccataagtctatcagcatttggaccattcgggtttaacttctttaatggcaagggcaaaaagcagaacaagaagcccaacaatctcgaccagtcacagaagaagcctaacaagccagatcagaattccatgaaacaaaaaggaggcaacccaccgtcccatgaggcaatgagtgatgaatggctagaaaatggacagtgcccactcgctcggtcttaccgggcaatgagtggtgttctgccccttgtcgccaaggcactacagccaccagctggtatgaagctgaagtgcccgcctgcaattgttgctgcacgagcggcccttgcacgcacaacccttgtgaagtccctccgtccccagcccctggcctgcaaagatggtagccatcgctatgctcgggatggcagcgaacgtcccctctaggg

SEQ ID NO: 14341 - DNA, 1073 bp, Zea mays
  misc_feature (1058)..(1058): n is a, c, g, or t
cggcccgggccctcggagctcggcccggccatcacatgaggcattcagcgatgagtggttggaaaatggccagtgcccacttgcgcggtcttaccgggcaatgagtggtgttttgcccctcgttgccaaggccttacagccaccagctggtttgaagctgaagtgcccacctgctgtggttgctgtccgagctgcccttgcgcgagctgcgcttgtgaaatccctccgaccacagcccctgccctcaaagatggtagccattgcactactggggatggcagcaaacatccctcttggggtgtggcgggagcacaccaagaagttctctcctcagtggtttgcagctgtccatgccgctgttccgttcattgcaatgctgaggaagtctgttgtgatgcccaggactgcgatggcattcaccatagcagcctccattgttggccagacaattgggtcaagggctgagcgcatccgtctaaggaatcaggcggcaaatggtactggtgattcttcaacgcacactgctatgtatccaaacaagaacgggcattgcagcgacactgaaggcaaggcatgggaccctcttgcgacgaagataacaggctcaactgctaggggttctcctgcaccaaccccaagcgtgtgcttctgattgtgttaagcatgtgattcacgcacacccatgaaccagtttatcttatagtgccatgtaattgccttgtgtgtcccagaaaactgagctgcccgtgtgcgataagtagaataagaggtgctaccccactgtttgctgtgttgctatggtcgatattgatgtattgatgctgctgcatttttctttgtttttgttaatgtgtggtggcgtttctcgcttctgtaaagcagctgaagctgtcacatcatttgatcagttgaagctgtatgttagcacctgatcgtttgcttgcgactggccaatactggtatacgctagtatgtaccaaacactcaaacttgagaaagcaacatgcaaggaatggtgcaaccagagcagcagcactgtcgttctgctgcacttctgnaaaaaaaaaaaaaaa

SEQ ID NO: 14342 - DNA, 4636 bp, Zea mays
  misc_feature (2402)..(2402): n is a, c, g, or t
cgccgcacgcgccgctgtgtctcgcccacctcatctcccagtagtccacgcgttcccacgctgccacttggggcccacctgtcaatatcacgtcacccacgcccagcattcagttcccacttcccacccaccctccccatccccaaaaggccaaaaccaaacccgaggctgcgcctgcgctgcacagcagttccacacctaaacccctcgccgccggcgcctccgaatccggcgatgtcgtcgtcgccgcctcgccggccgcagcgccgcgcggcgtcgtcgcggccggcgtcgtacgatgagtccctcctcgacgccgagctgcaggcctacctcggcgacgccgcctcgcgccgcgtgcggcggctgcgccggctctcggcggaggagcggcagcgggagacggagacggaggcgctcatcgcgctctccctgggattccccatagacgagctgctccccgaggagcggcccctcctgcccgcccacatcgccgacgcgcccaacgactacatcgtcgtccgcaaccacatcctcgcctcctggcgcgcagacccgggggcgccgctgccgctcgcgcgcgtcctcgagaccgtcagcgccacctacgaccgcctcgtcgccgccgcccacgggtacctcgcccgcgagggccacatcaacttcggcgtctccgccgccttccccgccgcgccgcccccggacgccgccagccagggcgcggcatccgtcctcgtcgtcggcgcggggctcgcgggtcttgccgccgcgcgccagctcgtccgcttcggtcttcgagtgctcgtcctcgagggccgcgcgcgccccggtggccgcgtctacacggcccggctaggtgaggacaaggccgccgttgagctcggcggcagcgttatcaccggtatccacgccaacccgctcggcgtgctcgcgcggcagcttgcccttccgctgcataaggtgcgtgaccgctgcccgctctactacccggacggccggaccgtggagaccaggctggataggagcatcgatctggtgttcaacacgcttctcgaccacgccaccaggctccgggagtctctcaatgaggctgcggagaggatctcgctgggggaagctatagacaagctcaggaggctctaccatgtggccaggtcggatgacgagaggatgttattggattggcattttgcaaatctggaattctccaatgccggttgcctatgggagctttcgctcgcgcactgggatcaggacgatccttatgagatggggggagaccattgtttcttagccggagggaattcccggctcatacatgcattgtgtgatggggtgccggtcttgtatgagaagaatgtgacacggattgagcatggagtggacggggttagtgtcacagtggaagaagggcagatttttcaggctgatatggtgctatgtaccgtgccccttggggtgctcaagagtgggagcatagtatttgacccagagttgcctgaagagaagcttggggcaataaagaggttggggtttgggttgttgaataaggtagccatggtgtttcccagtgtgttttgggatgaagatattgacacatttgggtgtttgaataaggagagcagcaagcgtggagagttctttctcttctacagctaccacactgtctctggtggtgcggttcttgtcgcacttgttgcaggagaggctgctttagagtttgaaaaggttgatcctgttgttgcacttcatcgagtacttggcattctaaaaggtaaaaatctggaactaatagtcctttgtatttttgttagtttaatttaatcacatttagagacacccataattacaaaaatggaaacaaattgcttcccaatgtagtaagtaaatgctatctacctgtgttgcttggtggctggtgcattggaattagtaagatgaatccatactttgtattagcgtggataacttaatgactaataagtgtaagtcactaaacaatgtatcttatagtgtcatatgctcactggatggctgaacatagtatatacttgtctctcactccataattaattgaagcaacatgtgctggtttatggttaggtttaaatgatgctacatcatatatttggaactattgaattgttcacaccatacattacacaatacatgcttcatagttattattgtggcacttcagctgatttaagttgagattacttatcagtgaattagtttttgtgtttactgaatcatttatccctataaattttggtatattttaacatttcataaatgatcattaatgaacaatggtcataatgctagtttggatgaacgagctagcatctgatgcatgtgcattacgctataaacttttctgcttatgattaagcatatanaatggagctattagtacaaatgaaattagggccagcagagtttttgactaggattggcagagcaaactaatcaatgatcttctgagcatatgcttagaaatttttgggtcaaccactctttgtgatttgaaagcaataagactaccttaaagtattagcgtgtctgtagtctactcctgtaaactacaggataatctaagggcctctttggcacggctccttgggtggctccagctcgagctcattgtgaagccctaccaaacagtaaaaaattgcttctcgtcgagagctctccaattgctggagccgttttcttgctgggagccaagcacaaaaaacgtggcttctaccggctcttacattttactcatacatcattcgaaagaaaaacacatgagaagctgttttgtcaaacgaattacaaaacggctctggctcctttagagaagccaactagccaaagccgaaactgtttttaaaggagccggagccctgacaaaaggggcctaaatacttcctttaacaaacttgtgaaatacctatagtattaaggtccttgttatgcatatgaattgtaattttacccttttagttattgcttgtataatataaaatgtgtgttacgaatggctactttgataaagtgctagctagagagaaaaaaagggttgacccagtgccggatacttgagcagggtctagggaatggataaattgaggcaaaccttctaccctcaaatgcggagaggctgctctgaacccgtgacctggtgactcggtgagatagttctcaccactgcgccaatgctcaccactgcaccaatgcaagagagaaaaaggggaaaaaagcataaatgttgtttaggaattaattgcatatctaccttttatagatgagacagggggggggggtcgaacacagacaattcttttggagtggcagtataaacttgaggagaggaatatgtaagaacttaggaacatatcactatggcatatggccttgaataatgttcgacgcatggtttgattgcacatatatatgctttatgatattttctttcattagtcattttgataaacaactaacatattactcttgttatgtttaggtatctatggcccaaaaggcgttactgttcctgatccggttcaatcagtttgcacgagatggggcagtgatcctttttgctcaggttcatactcgcacatcagagttgggtcttccggtgctgactatgacattctttccgagagtgtgaatgaccgactcttcttcgctggagaagctacgaaccgcgcgtaccctgcaaccatgcacggggccctattgagcgggttaagagaagcttccaaaatctatcgtgcctcagatagcttagtgaattatgaccagaagaagaattcactgccaaagagcctcaaaccaccagatggtgcccttctagatctcttcttggagccggacctagcattcgggagattctcgttcgtgttctcctcactgacacccgacgatccagcggctccagggttacttcgggtttcgctcgacaagcgtttccttctgcagcccaattataattcagagctaaagggcgaccaaaaggatcacagccacagccacgcatctggggccttccatctgtacgccgctgtctctcgggagcaggcagatcggctacaaaggtcaagcgaagatgacagaactaggttaggagtgttatgcaaggatcgtactgtaaagctaatgggttacgatagtacttgcgacgtaggtagcgatctgatctcgagcatcttgggtgcgcggaaagccaggaaactcctgcagcacccaaagaactccaagatcccgcgttgatgtgtacccagttcctcttttttttcccctttgtagaacagaatgcatttttttgttatgtacacaaggtacgaagggccggccgccggctggtggagctcagattttgctgtggcgtgtacaggctacgaactgtgacgcttcggcaggaacgtaactgagatcctccatgttctggtcctcacttgtaaaaattgccgttcatgtgacttcagacttcagttgattagatattgttctgtggatttaactgcaggcaccattgtgatcttgctctatctatctttcgcctgagtatggttggaaatctgaatgtgaattcaattttagactagcacaacctgcagctccgatgttccatacttccatt

SEQ ID NO: 14343 - DNA, 1499 bp, Zea mays
gggtcgacccacgcgtccgccttaacaagcaagacttcaaattcacagagcatcaaacaactcttcttctagctgcagattcaattgggaagaagattcaatccattcgtcgtggcttctgcccacggccgcccccgtaccgcatggccgggttggctgctattgagattgctcagaaagtgtccaaggcttggcgctttctaaggaatccgaagaacatcgcaaagttagttaggaaaagggataaacttaacatgagccagaacaggggaggttattgtagcactagcactttggctggatctccaacttccagcccaaatgaagacagggtctcctccgggatctctctttcctggcaggatgtctataacattgctgttaagtggagacaaatttctgaaccttgtgatccagttgtttgggtcaataagctaagtgaagagttcaattctggatttggttctcataccccaatgcttcttggtcaagcaaaagttattcgctactatccatattaccaaagagtcttggaaactgcgaagactataatgcttgacttgaagtatgtcaataatgcagaggaccgtgcaatttttcttacagatattgacaagttgaaaaagatagaaattgcatcgtcatgctcagatttgtaccatgtagttggtgagacctactgggttgctacaagatgtgatagtatggcgtttcgggggaggcgccttgaagggacaagaattaccactcaaaacataggcaagacaggatttgactttgcaattcgaacaccttgcacgccatcgagatgggaggagtatgatgaagaaatgactgcagcctgggaggctatttgtgaggcatattgtaatgacacaaaccccacacgagaccctggtgtgcttgatgctgtgaaggacgcgatattgcggatgacatattactggtacaattttatgcctctttcgagaggctcggctgttgttggctacatagtgttgctcggtttattcctggcagcaaacatggatattactgccagcattccacccggtgtccaagttgattgggaggcgatcctgtctccagatcccggcacatttgttgacgccgtgaagccctggttgtacccatccacaaaaataagcaggtgcctgaaagattacacggacgtcagctgcgcgttcagcacgacaggttcggttgtagcggccctaacatctgttgacccataggttatttgtccaagtgttataggttgctccagttgttagtgtatttgtttcaaaatacctcagctttgcttagcttgtcagaatttctcagtttgcaaaaagtttgtatgtttctgtgttgtatacagatatgcagtaatgttgtaacttgaaaaaaaaaataagatttattttcattggaacaagttttttttttttgtaataaacagttaaacaccaataagttttgcagttacttctcaaaagggggggggggggggggag

SEQ ID NO: 14344 - DNA, 2175 bp, Zea mays
gcacgagaccattacctagaacatcctaatcaaaagtcccgcaacaattacagagagaagcagggttgcctagggttttagagcaaaggcggttctccgcggcggcgacggcgagccatggagaacacgaagctctcgtcggcgctattcgccgggacccacttcgaccgcaagcgcttcgccgccgacttcgcccggtttcgtaaaggcccggctctcccatccgccgccaccccctccgcaccgtccccggagaagaagcggaagcgcaagagcggcaaggcaaaggcgaagaagaataagaagagagcccaggatgcggcggccgccgcctcgtcggattttgtggaggggttcagcgtgttcaagggattggctgataataatgcggagctgcgttctgagaaggtggatatgaggaaagatgatgattcggtggctgtgaggagacggaaagagattgagagggaattcgagagagctgcagttcttcgtaagaggtttgatatccacattgccgggcaaaatgctccagcaccacttgagagctttgaagaattgatttcaaggtatggttgtgattcttatttggttggaaacttgtcaaaacttggttttcaagaacctacaccaattcaaaggcaggccatgcccattcttctttcgggtagggaatgctttgcgtgtgcacctactggttctggcaagacattggctttcttgtttccacttcttatgaaaattaagccagggtcaaaaggtggtgttaaagccgtgattctttgcccaacaagggaattggctgcacaaactgtgagagaatgcaagaagttagttaaggggaggaagtattatattaaattgatgaccaaagagctgtccaaatcagggaatttcaaagatatgcactgtgatatccttgtttccacccctcttcgtttggaccatgctgtgaagaaaagagaccttgatttaagtagtgtggaataccttgtcttggatgaatctgataaactttttgagcttggatttgttgaagtggttgattcagttgttgaagcctgttccaatccttcaataattcggtctctgttcagtgccactttacccgattcaattgagactcttgcacgcactataatgcatgatgccattcgagtcattgtcggcagaaagaattcggcctcttcactgattaagcaaaagttgatttttgctggaactgagaggggaaagttgctaactcttcgccaaagctttcaagagtctctcaatcctccagtattgatttttgttcaaagcaaagagagggccaaggagctttacaaagaactggcctttgatgacattagagttgatgtaattcatgcagatctcagtgagcagcagcgtcaagatgctgttgacaatttgagagctggaaagacctgggtactgatagcaacggaagtcattgcccggggaatggacttcaaaggtgtcgcctgtgtgataaactacgattttccagagtcggctgctgcctatattcacaggatagggcgatccggaagagccggtaggtccggggaggctatcacgttcttcacagaggaggacaagccattcttgaggaatatcgccaacgtgttggtatcttcaggctgtgaagtgccttcctggataatggcactgccaaagctcaagcgaaagaagcacagagtggatagggacccaatctcctacctacctgacgaagtttgagagcggcttggtaagatgctctatttatttatttttgtggggagggggggatatataacacaggctgtccagagtggtactttaaccatgcacttccgagaggtggcacgttggcttcagttttccctgtttgagcagtgcaccgatcagtttgtttagccacaacccaagacgagggatcagtatatctttgttaattggagtacgttacagtttgtgtggaaaaaaaaacaaaaaaaaaaaaaaaaaactcgagcccggctgtttggcctagcgtagtcagattgcaattagggtccgtttggttgggctgtggctgtgaaaaaagttgttgtgggctgtgagctgtggaaaaagctgctgtaggctgtgagctgttaaaaagctaaaaccgtttggtggaaagcactaatagtcgttaaaagttcttcg

SEQ ID NO: 14345 - DNA, 3319 bp, Zea mays
aagagcttcctagaagtgtctcctaaatcatgttttgtaggaaaaacacaaaaagtgtctccagcaatttacctaaagtgcttccaaattttttatagcccttaaaactactttatttataatgacaaatgaggtttttttggctccccagaaataatctaccgctttaaaaagtctgttggagaaaaaattaaaatctaccgccactaaacttggattttcagaagtcatttccctcttggtcgcttggagacccttaccgtatccgtgtatgcgggggtcacccattaattgccggcgacattttggcggtaacgtggcgccgcgaaccagatgatcgccctgccgccttggctggcgcagacgatcggggttcaggcagagcagagcacacgcgagaggagcctgcggcggttcgcggttagcggcggagaccggaacggaacacgcaaagagccggccaccctggccttgctattgcctcggcgcgtgatgtggacacgagatcggcgagccggccgggctctctccgccgcgaaacgtgccgtatccttcgtacaaagcgtgagggggccgttacggcaagtagcagggtccgggcaggcgcctcacgtactgcgccgcatccatgcccaacgcaacagacggccaggaatggcggagcttgggccggacgccgcctctggcgtttgacatgtcacgggggcgttacgacgaacggaagcagcagctagcagggcaagctgcctgagccaccacaccagccaatgcaacgtgtacgcgcaagcacaaaccaaaaacgagatggcctccagcaaaataataataataataataataataataataccagctagcagctgggcttacgtgctgcgcgacaagtcattgtgtaatcatatagacctaacgggcccaccctcacttgttgagctctcttcctcttccacacctctccccgtctcctccctatatataggacgcccctgctgtctccaaggtccccaagagcccaagaaggcagctagctgagagcctccagctcaggtagtgagcgagctcctctctgcccctggcctcttcttcgttcattcttgtccactcgaggactgcccgtttgacgactgctcgatcagtgtgctagctagctagagcaagagaagggctgtaagcgaggagatcgatcgagatggctttcctcaacatggagcagcagacctgggccttcaccttcggtatcctaggtatacattcattctgctgcattgtttccttctggctcccatgcccttggagataaatggatccgccgaaagccaaacttttagtgccggtggttagcccaaacaaaggaagcagagccgtcatgcgtcatacatgctacatgcatgtaccttcacgagaaccgtaccgtgcaacggcgcgtgtatatgatatgaggacttcaaccaattaagcaatttattattaattgactgctttgctttgctttgcaggtaacatagtctcactgatggtgtttctttcaccgctgtaagtagctctcttattaattggctgctttgctttgctttgcaggtaacatagtctcactgatggtgtttctttcgccgctgccgacgttctaccgcgtgtaccgcaacaagtcgacggaggggttccagtcgacgccgtacgtggtgaccctcttcagctgcatgctgtggatcttgtacgccctgctcaagcccggcgccgagctgctggtcaccatcaacggcgtgggctgcgtcgtcgagaccgtgtacctggccatgtacctggtgtacgcgcccaaggccgcccgggtgctggcggccaagatgctgctgggctcaacgtcgccgtcttcggcctcgttgcgctcgtcaccatgcttctctccgacgccggcctccgcgtgcacgtgctcggctggatctgcgtcagcgtctcgctcagcgtcttcgccgcgccgctcagcataatgcattcttctgttgccttttggtttcctttgtctgttattagttaaatggtttgtaatcgttcaataaactaactacctgcttgcttgcagcggcaggtgatccggaccaagagcgtggagttcatgcctatctcgctctccttcttcctggtgctcagcgcggtggtctggttcgcgtacggcgcgctgaagaaggacgtgttcgtggcgttccccaacgtgctgggcttcgtcttcggcctcgcgcagatggcgctgtacatggcgtacagcaggaacaggaagcccgcggcggcgctggtgataataccggagcagtccaaggaggaggtggccgagggcaaggccagctgcggcggcgccgaggtgcaccccatcgacatcgcggaggtccacgacctgcaggccgtggtcgtcgacgtagacgtggagcctgtcacctacgccgctgcgtccggtatggtcgacggcagtgtcggcaggcctagggcgccggagcagctggtgatcaagcccgacatggtcaccgtcattgcggcggaggcgtaggttggttaagtagtagcagagtgagtcgatatcgatctgcctacctacagtacagccgcggcggccagatgtactggcagcgttcatgcaggctcgttgacttgaccggtcgagatggttggagtagccgggccgagtagcccagacgtactggcctgtgtcatgaaccggcaagctgataacgcgagcgagagggacgttggttcatcacattcagaagacggcaagctgatagtttctgtctctaggtctgtgtgtgtgtgtctgtaatcgactccatcagcttgccgcctttcctgtcctattctgattgttttcatccattgatgccgtcgtcgcagtaataaacttggaacgaacgattccacactacaaaaataataaaagtttcgccgtgtgttcatggcggttttgtgcaaaccacaccgtggccccgtcaaacttctcatgcacccaccgagactttcgtctccacgggcacgactaggcctgggaatgggtcaatatccagccctaaccacactccaatcctagaagactaataagaagttgactcgtccctacctaaatccaaaatacctacctaaatctaaataatttgctgcagctcaattccaattgattttaaaaccttgtcatcctaatccgcaccgatccttttaaaacccatgggccaatccacattagcaatccaagggccctcacaaacaagcaaacacctccagtgactaacgaatcagcacaaatctatgagctcacgctgtcctcatgggcgcatgacac

SEQ ID NO: 14346 - DNA, 2081 bp, Zea mays
  misc_feature (14)..(14): n is a, c, g, or t
  misc_feature (17)..(17): n is a, c, g, or t
  misc_feature (26)..(26): n is a, c, g, or t
ccggccggggaaanatnaatagaaancattgggggcctcccgggcggcgccgggaagcgcccaaggcagcggagagagctagctccctcctcctcctcaggtagcgagcgagcgagctcctctgcccctctgcacacctggcctccccttctccgctgcaggaccgccgttgacgactgctccaccagtactgcgcgcgcccgcgctgcctacccttacctagccagagcgcggcgcgcgagagggagaacgaccaggaggggaggagatcgatcgatcgatcgatcgagatagatggctttcctcaacatggagcagcagacctgggccttcaccttcggtatcctaggtaacataatctcgctgatggtgttcctttcgccgctgccgacgttctaccgcgtgtaccgcaagaagtcgacggaggggttccagtcgaccccgtacgtggtgacgctgttcagctgcatgctgtggatcttctacgcgctgctcaagtccggcgccgagctgctggtgaccatcaacggcgtcgggtgcgtgatcgaggcggcgtacctggccgcgtacctggtgtacgcgcccaaggccgccagggcgctgacggccaagatgctgctggggctcaacgtcggcgtctttggactcgccgcgctcgccaccatggtggtctccagcgccggcctccgcgtgcgcgtgctcggctggatctgcgtcagcgtcgcgctcagcgtattcgccgcgccgctcagcatcatgcggcaggtggtccggaccaagagcgtggagttcatgcccatctcgctctccttcttcctggtgctgagcgccgtgatctggttcgcgtacggcgcgctgaagagggacgtgttcgtggcgttccccaacgtgctgggcttcgtcttcggcgtcgcgcagatagcgctgtacatggcgtacaggaacaaggagcccgcggcggtgacggtggaggaggcgaagctgccggagcacgccaaggaggtggtggtggccgcggcggcggccgaggccagggcgagctgcggtgctgaggtgcaccccatcgacatcgacatcgaagctacgccgacgccggtggaggaggtgcacgagccgcaggtggtcgtggtcgtcgacgtggacgtggagcctgtcacctgcgccggcgccgccgaggcagctgcgggagcaggggcagatgcgtccggcgtggccgacggcggcgtccctggacccatggcgccgccggagcagctggcgatcaagcccgacatggccatttccgtggaggcgtaggttggttaaagtgtaatagcagagtgagtcgatatcgatcagtagtagatttgtcgagtcaaggaaggggcctgctgctgctgctacgcgacagcagcggccagatgtactgcctgcatgcatgcagtccctcccgttgactcgacccgtagagaagggatgggatggaagtagccgggtccttgggcgagtagcggcgccttggcacccacgggccagccgtactggcctgtgtgatgaaccggcgagagagatgagataatgtgcgagcgagagagggttggttgggttgtggtagttgaagaagacggctagctagctgctgctgctgggctctctatctgtctctagatctgtgtatgtctgtgtaatcgaggattccctcaccttgcatgccgcctcccttttgtgtccttctagtctgatgattgttttcattccatccatgccggcgtcgcagtaataaaatttttttggaatggacgggttcactgcctacctacattgccggcgtgagtccgtgactccatggcggaccggtcctcctgcgacgtccggccgtgccaaactgcaattggtccaggccccgcagaggcagaggcaggtggtcacgcgcaggcagaggaatagtacggcgcgcgggcggggcggacaagtgtgcggcgctgcgcgactcggcaggcaggcaccggggcagcggcatatgcacgcacgcgcaagcgccccgggaaagctggagcccggagggacgggccgacggggggtccaggcgtccagccaagcca

SEQ ID NO: 14347 - DNA, 1476 bp, Zea mays
cccaagaaggcagctgctagctgagagcctccagctcaggtagtgagcaagctcctctctgccctggcctcttcttcgttcattcttgtccactcgaggactgcccgtttgacgactgctcgatcagtgtgctagctagctagagcaagagaagggctgtaagcgaggagatcgatcgagatggctttcctcaacatggagcttattaattggctgccttgactttgctttgctaggtaacatagtctcactgatggtgtttctttcgccgctgccgacgttctaccgcgtgtaccgcaacaagtcgacggaggggttccagtcgacgccgtacgtggtgaccctcttcagctgcatgctgtggatcttgtacgccctgctcaagcccggcgccgagctgctggtcaccatcaacggcgtgggctgcgtcgtcgagaccgtgtacctggccatgtacctggtgtacgcgcccaaggccgcccgggtgctggcggccaagatgctgctggggctcaacgtcgccgtcttcggcctcgtcgcgctcgtcaccatgcttctctccgacgccggcctccgcgtgcacgtgctcggctggatctgcgtcagcgtctcgctcagcgtcttcgccgcgccgctcagcataatgcggcaggtgatccggaccaagagcgtggagttcatgcccatctcgctctccttcttcctggtgctcagcgcggtggtctggttcgcgtacggcgcgctgaagaaggacgtgttcgtggcgttccccaacgtgctgggcttcgtcttcggcctcgcacagatggcgctgtacatggcgtacagcaggaacaggaagcccgcggcggcgctggtgatactaccggagcagtccaaggaggaggcggccgagggcaaggccagctgcggcggcgccgaggtgcaccccatcgacatcgcggaggtccacgacctgcaggccgtggtcgtcgacgtagacgtggagcctgtcacctacgccgctgcgtccggtatggtcgacggcagtgtcggcaggcctagggcgccggagcagctggtgatcaagcccgacatggtcaccgtcattgcggcggaggcgtaggttggttaagtagtagcagagtgagtcgatatcgatctgcctacctacagtacagccgcggcggccagatgtactggcagcgttcatgcaggctcgttgacttgaccggtcgagatggttggagtagccgggccgagtagcccagacgtactggcctgtgtcatgaaccggcaagctgataacgcgagcgagagggacgttggttcatcacattcagaagacggcaagctgatagtttctgtctctaggtctgtgtgtgtgtgtctgtaatcgactccatcagcttgccgcctttcctgtcctattctgattgttttcatccattgatgccgtcgtcgcagtaataaacttggaacgaacgattccacact

SEQ ID NO: 14348 - DNA, 1477 bp, Zea mays
cccaagagcccaagaaggcagctgctagctgagagcctccagctcaggtagtgagcaagctcctctctgccctggcctcttcttcgttcattcttgtccactcgaggactgcccgtttgacgactgctcgatcagtgtgctagctagctagagcaagagaagggctgtaagcgaggagatcgatcgagatggctttcctcaacatggagcagcagacctgggccttcacctttggtatcctaggtaacatagtctcactgatggtgtttctttcgccgctgccgacgttctaccgcgtgtaccgcaacaagtcgacggaggggttccagtcgacgccgtacgtggtgaccctcttcagctgcatgctgtggatcttgtacgccctgctcaagcccggcgccgagctgctggtcaccatcaacggcgtgggctgcgtcgtcgagaccgtgtacctggccatgtacctggtgtacgcgcccaaggccgcccgggtgctggcggccaagatgctgctggggctcaacgtcgccgtcttcggcctcgttgcgctcgtcaccatgcttctctccgacgccggcctccgcgtgcacgtgctcggctggatctgcgtcagcgtctcgctcagcgtcttcgccgcgccgctcagcataatgcggcaggtgatccggaccaagagcgtggagttcatgcccatctcgctctccttcttcctggtgctcagcgcggtggtctggttcgcgtacggcgcgctgaagaaggacgtgttcgtggcgttccccaacgtgctgggcttcgtcttcggcctcgcgcagatggcgctgtacatggcgtacagcaggaacaggaacccgcggcggcgctggtgataataccggagcagtccaaggaggaggtggccgagggcaaggccagctgcggcggcgccgaggtgcaccccatcgacatcgcggaggtccacgacctgcagaccgtggtcgtcgacgtagacgtggagcctgtcacctacgccgctgcgtccggtatggtcgacggcagtgtcggcaggcctagggcgccggagcagctggtgatcaagcccgacatggtcaccgtcattgcggcggaggcgtaggttggttaagtagtagcagagtgagtcgatatcgatctgcctacctacagtacagccgcggcggccagatgtactggcagcgttcatgcaggctcgttgacttgaccggtcgagatggttggagtagccgggccgagtagcccagacgtactggcctgtgtcatgaaccggcaagctgataacgcgagcgagagggacgttggttcatcacattcagaagacggcaagctgatagtttctgtctctaggtctgtgtgtgtgtgtctgtaatcgactccatcagcttgccgcctttcctgtcctattctgattgttttcatccattgatgccgtcgtcgcagtaataaacttggaacgaacgattcc

SEQ ID NO: 14349 - DNA, 1737 bp, Zea mays
cttgagctctcccctcagctcatctccctccctatatataggagtgggtgcctcgaggccggccgggaagcgcccaaggcagcggagagctagctccctcctcctcctcaggtagcgagcgagcgagcgagctcctctgcccctctgcacctggcctcccttctccgctgcagcaccgccgttttctccgttgacgactgctcgaccagtgcgcgcgctcgcgctgcctataccttacctagccagagcgcggcgcgcgagagggagaacgaccaggagggggaggagatcgatcgatcgatcgatcgagatggccttcctcaacatggagcagcagacctgggccttcaccttcggtatcctaggtaacataatctcgctgatggtgttcctttcgccgctgccgacgttctaccgcgtgtaccgcaagaagtcgacggaggggttccagtcgaccccgtacgtggtgacgctgttcagctgcatgctgtggatcttctacgcgctgctcaagtccggcgccgagctgctggtgaccatcaacggcgtcgggtgcgtgatcgaggcggcgtacctggccgcgtacctggtgtacgcgcccaaggccgccagggcgctgacggccaagatgctgctggggctcaacgtcggcgtctttggactcgccgcgctcgccaccatggtggtctccagcgccggcctccgcgtgcgcgtgctcggctggatctgcgtcagcgtcgcgctcagcgtattcgccgcgccgctcagcatcatgcggcaggtggtccggaccaagagcgtggagttcatgcccatctcgctctccttcttcctggtgctgagcgccgtgatctggttcgcgtacggcgcgctgaagagggacgtgttcgtggcgttccccaacgtgctgggcttcgtcttcggcgtcgcgcagatggcgctgtacatggcgtacaggaacaaggagcccgcggcggtcacggtggaggtgacggtggaggaggcgaagctgccggagcacgccaaggaggtggtggtggtggccgaggccagggcgagctgcggtgccgaggtgcaccccatcgacatcgacatcgaagctacgccgacgccggtggaggaggtgcacgagccgcaggtggtcgtggtcgtcgacgtggacgtggagcctgtcacctgcgccggcgccgccgaggcagctgcgggagcaggggcagatgcgtccggcgtggccgacggcggcgtccatggacccatggcgccgccggagcagctggcgatcaagcccgacatggccatttccgtggaggcgtaggttggttaaagtgtaatagcagagtgagtcgacgatatcgatcagtagtaggtttgtcgagtcaaggaagtggcctgctgctgctactacgcgacagcagcggccagatgcactgcctgcatgcatgcagtccctcccgttgactcgacccgtagagatgggatggaacggaagtagcggcgccttggcacccacgggccagccgtactggcctgtgtgatgaaccggcgagagagatatgagataatgtgcgagcgagagagggttgggttgtggtagttgaagaagacggctagctaggtgctgctgggctctctatctgtctctagatctgtgtgtgtctgtgtaatcgattccctcagcttgcttgccgcctcccttttgtgtggtcctcttctaggctgatgactggtttcattcca

SEQ ID NO: 14350 - DNA, 1803 bp, Zea mays
atatataggatgccctgccggctccaaggttcccggaagcgcccaaggcagcggagagagctagctccctcctcctcctcaggtagcgagcgagcgagcgagcgagctcctctgcccctctgcacacctggcctccccttctccgctgcaggaccgccgttgacgactgctccaccagtactgcgcgcgcccgcgctgcctacccttacctagccagagcgcggcgcgcgagagggagaacgaccaggaggggaggagatcgatcgatcgatcgatcgagatagatggctttcctcaacatggagcagcagacctgggccttcaccttcggtatcctaggtaacataatctcgctgatggtgttcctttcgccgctgccgacgttctaccgcgtgtaccgcaagaagtcgacggaggggttccagtcgaccccgtacgtggtgacgctgttcagctgcatgctgtggatcttctacgcgctgctcaagtccggcgccgagctgctggtgaccatcaacggcgtcgggtgcgtgatcgaggcggcgtacctggcgacgtacctggtgtacgcgcccaaggccgccagggcgctgacggccaagatgctgctggggctcaacgtcggcgtcttcggcctcgccgcgctcgccaccatggtggtctccagcgccggcctccgcgtgcgcgtgctcggatggatctgcgtcagcgtcgcgctcagcgtattcgccgcgccgctcagcatcatgcggcaggtggtccggaccaagagcgtggagttcatgcccttctcgctctccttcttcctggtgctgagcgccgtgatctggttcgcgtacggcgcgctgaagagggacgtgttcgtggcgttccccaacgtgctgggcttcgtcttcggcgtcgcgcagatggcgctgtacatggcgtacaggaacaaggagcccgcggcggcggcggcggcgatagcggtgacggtggatcaggaggcgaagctgccggagcacgccaaggaggtggtggtggccgaggccagggcgagctgcggtgccgaggtgcaccccatcgacatcgatatcgaagctacgccgacgccggtcgaggaggtgcacgagccgcaggtggtcgtggtcgtggtcgtcgacgtggagcctgtcacctgcgccggcgccgccgaggcagatgcgtccggcgttgccgacggcggcgtccctggacccatggcgccgccggagcagctggcgatcaagcccgacatggccatttccgtggaggcgtaggttggttaaagtgtgatagcagagtgagtcgatatcgatcagtagtaggtttgtcgagtcgcctgctgctgctgctacgcgacagcagcggccagatgtactgcctgcatgcatgcagtccctcccgttgactcgacccgtagagatgggatgggatggaagtagccgggcccttgggcgagtagcggcgccttgggttggcacccacgggccagccgtactggcctgtgtgatgaaccggcgagagaaagagatgagataatgtgcgagcgagagagaaggttgggttgtggtagactggtagttgaagaagacggctagctagctagatgctgctgggctctctatctgtctctagatctgtgtgtgtctgtgtaatcgaggattccctcaccttgcttgccgcctcccttttgtgtccttctagtctgatgattgttttcattccatccatgccggcgtcgcagtaataaaaaaaaaattggaatggacgggttcactgacaaaaaaaaaaaaaaaaaaaaaa

SEQ ID NO: 14351 - DNA, 1047 bp, Zea mays
aacaccggcctttggaaggcccacggagcggctttgacgggcagaaatagaaaggaaaaaaaaaacacgacacctcccccctctgcgccgccctcacccaccgccgtcgccacctctctcaccgcggaacaagacgctgaggaagaagagccggtacggagacggcaagaagacgcggagcagtacgtacgtctccgatctggatgttggtaaggttcttcctgatttgaacgacaagctcactgataatgagttcctggaaggagaaagctagacagtttctgttagaggaggaaaaagaggatgatgaactcttcttagtaattgtccctgctgttctcttggccatgcaagaagagaaaaggtcagtccgtgcttccggtacgtcagcacatggaagcgcgaaaaagcggaagaaaaatcaggttgcaagtgttctggaagactatttggagcacaggaagaagcaaacggagaagactgtagaggcgttacttgagatgaagagtcgtgaagaggagtactctattgagaggtgtcttgacatagttgatgcattggaggagttgacggatgaggagaaggccgctgcagcagaggtgttcaataatgaagtgaatcgggagatgtttgtgattgcaaagcaaaaaattccaaatgtggggttgatttggcttcggaggaagataagtaggattgcatctacctgagatggataaggtgcgactgatggagtgatggctcattgagttgcttgctgtgtgcgtgcgcatttgttttctatgcccgacgatgagtagcttgttgtggtgcctgatccaagagctcacaccagtttattcagttcagttcagagcttgcatgctccatataagcagaccgctgcatgctatgtgttgttaagcagactgctacattctatacggagtttgcatgctccatgtactgttgcatgccacttgttgctgatcgaaaattttagtttgcgaactacatgttgaggacagatattttgtaaactgctactagcactgatgcatgcttgct

SEQ ID NO: 14352 - DNA, 1348 bp, Zea mays
  misc_feature (1317)..(1317): n is a, c, g, or t
gcaggcgacgatcgagaccaactgttttgtctagtagcgatagcgatcgagaacgcgcgcgacatgctgtcgggtgggtcagacatgactcgtctaccgctggtcttatatgttcaagtcagccgtgctaaatagactggtattagagcatctttgagagacttgctaaatagcttgtcaagttaaattttagctatttaatagtataatagctctccaaaagactagtcatttaactttttaatttatctgggtctttaaattaactctctcactagccaaatttggctagcaactctcgctatctaagctaacttgtatgttggagagtatgttggaatgagacgttatatatagagtttaatatttatagagatacaaataaagagttaagcttggcgtgctatttagctagtctcttggagatgctcttaaacacgatacaaagtagcgcttggacaggttacagacgcatacatgatttatatggtacaagtaccggcagtccggcacgacacaaatcatccccgcccccggatcctccgccgccttcgcccccacgttacaaacaacaaattctccgaccaaatcccctctcctactactacccacttccaactccttcagagaccctaattaccagctacagccagcatccgatccagcgcccgcctctgctccccatggactccgaccaggagtccgtcgacgactgggtcgtcctcgcctcgtcctccgacgacgacgagcgagtcatcgcgctctcgtccggctcctgctccgactccgagcccgatcacgccgccggatcccccaacctcctccccgcctcccttgaccccgacgacgccgagggcttgtacgcgctgtcggacgccgaggacaccgacgcgtctctgcagccttccccgcggctgcccaacccgctctcgggactcttgcaccacacgctggccggggacgtcgcctactccgccttcgacccggtgcctcccgccgccaagcagctggtcccggacaccaccttcgccgccttctttcccgagcccgtcgccgcgctcgcctccacccgcggcctcgtctgcctccgcggcgcctgctccgccgcctactacgtcgccaacccggccaccttcgccagcgagcgcctcccggcccccgcccgcgaccaccgcgcccacggcgaccccgccgtcgtcatcgccttcgacctcgacctcgaccccgacccctgcgacgccgaccccgagcgcgccgagtctgagggcgaggggttctaccgccactaccacgtcgtcgtcgcggtcccccgtcggngaaggcatctacgctttcgagtccttctcgt

SEQ ID NO: 14353 - DNA, 743 bp, Zea mays
acccggcccagcacaggcgtagggtttattggcatctgtctcctgtcgcgccggccaccacagcgcagaagaacacagcacccgcctgcctcgccgccgcaatggccgccgccgcctccgctgcgagatccttcctccggtccagcggctcatcgtctctccgcagcgcggcggccagagccgcctcgcgtgcgggaccgggaccggctccgctgccgaggcggatgcccacctctgccccccgtgtactcctaaggtcgccggtggaaatgagcagcgtgtgtctggagtccttgatgcccatgcacagcgccacggcttcggcgctcatgacgtcgcttctcgccgccccggcttgcaagggattcggttggctatcagaagatggatgatttgtcgttactggagatctgcagtgatggtatcttgtctggattatggatacctcgtgaatttaaagtacttggttggcgtctcagttaacatgttttgtgctctgggattgcagtttgtatgaaatttgcagaattgatcctgagatttattttggctggttagctgtcaaaaagactttggtcttgacgacttgcctgatcaagtagatctggaatgaataaacttaatagaagggttttttcacaaaaaaaaaaaaaaaaaaaaaaaaaaaaaaacaaatgctgattgagcttcaaaattatctcaatccacatggtttcttgaaaaaaaaaaaaaaaaaagcggcc

SEQ ID NO: 14354 - DNA, 898 bp, Zea mays
accggttgccacacccggcccagcacaggcgtagggtttattggcggctcccccctgccgcccggcggaccacagcgcagaagaacacagcacccgcctgcctcgccgccgcaatggccgccgccgcctccgctgcgagatccttcctccggtccagcggctcatcgtctctccgcagcgcggcggccagagccgcctcgcgtgcgggaccgggaccggctccgctgccgaggcggatgcccacctctgccccccgtgtactcctaaggtcgccggtggaaatgagcagcgtgtgtctggagtccttgatgcccatgcacagcgccacggcttcggcgctcatgacgtcgcttctcgccgccccggcttgcaagggattcggttggctatcagaaggtcaagctgaaactagatgaacttcatgggacccaaaaggtgaacaatttttatagatcccaccaataatgactgttgatggctagattccatcactatttcacgcgtcggaatgatttgtggaaagaagagcccactatcttcatcttatggaacttgccttaaagtcatctattgactattgtgcacttgcacattagcatgtacaatatggaacaaaagaagtctgcattttcatgagccatacattgtattgagccacatatttttattgttccttttggaactgcaaaatgcacctagcgctgctgtgccacgattgttgtgccgtgtctaagattcccattgtcactttgagcgatcttttattgaagttctggaccttttggcaataaaaaaaaaaaagcgcccgggtcgacttttgcctatggtttgctgaagtcgaactattgatgggtttacaaatagcgtttataaattcgaatacaacatcatcattaat

SEQ ID NO: 14355 - DNA, 755 bp, Zea mays
cattgggaccagtagggtttattggcatctgtctcctgtcgcgccggccaccacagcgcagaagaacacagcacccgcctgcctcgccgccgcaatggccgccgccgcctccgctgcgagatccttcctccggtccagcggctcatcgtctctccgcagcgcggcggccagagccgcctcgcgtgcgggaccgggaccggctccgctgccgaggcggatgcccacctctgccccccgtgtactcctaaggtcgccggtggaaatgagcagcgtgtgtctggagtccttgatgcccatgcacagcgccacggcttcggcgctcatgacgtcgcttctcgccgccccggcttgcaagggattcggttggctatcagaagctggtaatgatgacgtgtgacggtctctagatggaaattagcagattattatcccgtcacctcagatcttcaggcctgtgattagtgcgatggaggtcaacttggatgaagactagactgctatttattttgccatctctgttgccttggttttgcccattataaatggaacatagagcaatgtagctttcgtcgctgttaatttatatgatgttattctagagcttgagcccagattattgtgtttctatttgtagatggatgatttgtcgttactggagatctgcagtgatggtatcttgtctggattatggatacctcgtgaattttaagtacttggttggcgtctcagataaaaaaaaaaaaaaaaaagcggcc

SEQ ID NO: 14356 - DNA, 661 bp, Zea mays
caccacagcgcagaagaacacagcacccgcctgcctcgccgccgcaatggccgccgccgcctccgctgcgagatccttcctccggtccagcggctcatcgtctctccgcagcgcggtggccagagccgcctcgcgtgcgggaccgggaccggctccgctgccgaggcggatgcccacctctgccccccgtgtactcctaaggtcgccggtggaaatgagcagcgtgtgtctggagtccttgatgcccatgcacagcgccacggcttcagcgctcatgacgtcgcttctcgccgccccggcttgcaagggattcggttggctatcagaagctggtaatgatgacgtgtgacggtctctagatgggaattagcagattattatcccgtcacctcagatcttcagatggatgatttgtcgttactggagatctgcagtgatggtatcttgtctggattatggatacctcgtgaatttaaagtacttggttggcgtctcagttaacatgttttgtgctctgggattgcagtttgtatgaaatttgcagaattgatcctgagatttattttggctggttagctgtcaaaaagactttggtcttgacgactttgcctgatcaagtagatctggaatgaataaacttaatacaaaaaaaaaaaaaaaa

SEQ ID NO: 14357 - DNA, 569 bp, Zea mays
aaaccacagcgcagaagaacacagcacccgcctgcctcgccgccgcaatggccgccgccgcctccgctgcgagatccttcctccggtccagcggctcatcgtctctccgcagcgcggcggccagagccgcctcgcgtgcgggaccgggaccggctccgctgccgaggcggatgcccacctctgccccccgtgtactcctaaggtcgccggtggaaatgagcagcgtgtgtctggagtccttgatgcccatgcacagcgccacggcttcggcgctcatgacgtcgcttctcgccgccccggcttgcaagggattcggttggctatcagaaggcctgtgattagtgcgatggaggtcaacttggatgaagactagactgctatttattttgccatctctgttgccttggttttgcccattataaatggaacatagagcaatgtagctttcgtcgctgttaatttatatgatgttattctagagcttgagcccagattattgtgtttctatttgtagatggatgatttgtcgttactggagatctgcagtgatggtatcttgtctggattat

SEQ ID NO: 14358 - DNA, 618 bp, Zea mays
  misc_feature (581)..(581): n is a, c, g, or t
  misc_feature (593)..(593): n is a, c, g, or t
  misc_feature (603)..(603): n is a, c, g, or t
  misc_feature (610)..(610): n is a, c, g, or t
gtaccccccggcccggccgcgccgctcatacaagcctgtcgtcgtcgtaaacacagagagggagctcgtccatgtcctcctgattcctcttggcgatcgagggagtggccgaccggcgataatctagctatagccagcctcgccatgcctcgccagaggaccctcacctccgaggcggccggcgggcggctgctgctcgtggtggtcgcggtcctgctatgcctgtccgtgcctctggggcgtgcggcacccccgggcgcggaggtcgcggagttccctgggttcacgggcaaactcccctccaagcactacgccgggtacgtaacagttggtcgacatgagcaacgaaagagacacctgtactactaccttgccgtctctgaaaggaacccaagcttggatcctgtggtcatctggataaatggtggtccagcatgttcagggtttagtgcatttctgcattcatttggaccttttcgaatggagggctcccaagttcatatcaacgacggtccacgagtagccgtgaacccttactcatggacaaagatggctagcctcctcttggtcaatccccacangtgtggctatcntacctgatcntgaagangactaccc

SEQ ID NO: 14359 - DNA, 1928 bp, Zea mays
aacacatgtgtgtgcagtgtagacgagcgcgtacgtaacttattgggaggttgcgcgtacggcaactcccgtcgcctccgcgctcccctaaccgcctcccccttgtctcatggtggaagtggaacaaccctccgcctgcgccgctgcgaagtaagtgagaagggaaaacaagaaacgaggagggagggaggggacgacgtacggagcgagctagcggcgcggcgggcgtcgctcggcatggacgcggaggcggcggcggcggcggcggcgacggcggtggaggagagggagcggctgcggaggagcttcgcgtcggggaggacgcggccggcggcgtggcgggaggcgcagctgcgcggccttctgcgcatggccgccgagagggaggacgacatctgcgccgccctgcacgccgacctcgcgaagccccttaccgagtgttatgtacacgagatatcattggtcatttcttcgtgcaaatttgctctcaagaatctcaagaaatggatgaagccccgaaaggtccccggcgggctgctgaccttcccgtcggcggccagcgtcgcggcggagcctctcggcgtcgtgctcgtcatctccgcctggaactaccccttcttgctggccatcgacccggtcgtgggggcattcgcggcgggcaacgccgtggcgctgaagccgtcggaggtggcgccggccacgtcgttgctgctggccgacctgctgccgcgctacgtggacccctcgtgcgtcagggtcgtgcagggcggcatcccggagaccaccgcgctgctggagctccagtgggacaagatcttctacacaggtaacagcagagtaggacgcatcgtcatgtcctacgctgccaatcacctgacgcccgtggtcttggagctcggtggcaaatgccctgtcgtcgtcgactccgacgtcaacctccacgtcgctgccaagaggatcgccgccggcaagtggggctgcaacagcggccaagcctgcgtctcgccggactacgtcgtcaccaccaaatcgttcgcgccaaagctgctggagtccctgaagcgagtgctattcgagttctacggggaggagccgctgcggtcgccggacctgtcgcgcgtcgtcaactccaaccacttcaacaggctcatggcgctcatggacgactactcggtctccggcaatgtcgcgttcggcggccagatcgacgagcggcggctaaggatcgccccgacgctgctgctggacgtcccgctcgactccgcgatgatgaaggaggagatcttcgggccgctgcttcccataatcacggtggacaagatcggcgagagcttcgctgtgatcaactccatgcccaagccgctggcagcttacctcttcagcaacgacgggcagctcaagcagcagttcgagaggaccgtctcggcgggagggatcatgttcaacgacaccggcatccacctgacaaacccgaacctgccgttcggaggagtcggggagagcggcatgggcgcctaccacggcgccttcagcttcgacgccttctcccacaggaaggccgtcctggaccgcagcttcctcggcgaggccagggccaggtacccgccgtacacgccggcgaagctcgccatcctcaggggcgtgctcaatggcagcccgcttgccacggttcaggcggctgcggggtgtacaggaggggcatcagctgactgactgactgaccccccttcatgcttattattaataataagcataaatattcaccgcatacacattgctgtgcttttattaaggttgttgtgagggcgaaaaatgtattgaccctttgcgtgtgcgcgtgcgtgtatagcaactattaataaaagaaaaaagtgatgttcatttcgtacagagtatactaaattaagatcacatcacgagttttaagc

SEQ ID NO: 14360 - DNA, 646 bp, Zea mays
  misc_feature (14)..(14): n is a, c, g, or t
  misc_feature (624)..(624): n is a, c, g, or t
  misc_feature (627)..(627): n is a, c, g, or t
gagtcagctacgtnggcccccaaaaaaacactacatgcacgctagtggctagcactgccgcagtaggtcagtcgggtgtacgtacggtgccatggcctcggcctcgctgccgctcctcgtcatcgtcctcctcgtctcggtcgtcggagcttgcactcgtgctgccgaggcggcggctacccgtagaaggacgatgtcatcacaacaaccaccagcagcagccgtggatcatcctcaccgtcgtcgtcaccctccccaggagcagcagcagagaagaaggagaagcccaagggcggtggcggcgcgacgtccgcgaagaagccgtcgccgccggccaagtgcgtgacgagcaaggactgccacctcaagcggctggtgtgcgccaagaagtgcaccatggccgcacacaacaagtgcgccgccaagtgttcccactcttgcaacgccctccccatctgcacctagctgacatgcatgctatgtaacccccagtaaaaatattatttatttaataaaatggaccacatgtctgtagttcaatccgtatgtcagcctgtgcaatcaaagaggaatgtgaattgatatctatactacttattaagacgacaaaaaaaaaaaaaaaantgnctcagtcgtccattctatc

SEQ ID NO: 14361 - DNA, 1969 bp, Zea mays
  misc_feature (11)..(11): n is a, c, g, or t
cgccagccggncagcaaactcatctgcggctactgttctcaaccagttggcattggcactccgccagacgcaagcgcccccctccgctcctctcaaccggcacggcgccagctccgcggcgaaaccggtggacggcatgccgcggcgcgaggcggcgaggcttctccgccgcctgggcccgatcgctgtccagtcgccgaagcgaggcttttacggcatgcctcataatcaatatgcacccatgattctttcatattgcaacaccaaacgattggcggtgcttccacaaggtggcaacacaggtcttgtaggtggaagtgtgcctgttttcgatgaggtgattgttggccttgcaggcatgaataaaattatttcctttgataacgtaaatggaatccttacttgtgaagctggttgtgtgttggagaatttaagtaccttcgtggaaaatgaagggtttattatgccacttgacttgggagcgaaaggtagttgccacatcggtggaaacatttcaactaatgctggcggcctgcgttttatacgctatggttcacttcatggaaatgttcttggtcttgaagttgtcctggctgatgggactatccttgatatgcttactactttaaggaaagacaatactgggtatgatctgaagcacttatttataggaagtgaaggctcgctaggagtagtcaccaaaatatcagtacttacgcctgcatgcctgcctcctccccaagttgcatttctttcctgcaatgattacacaagctgccagaaattactactggcagctaggaggagcttgggtgagatcttgtctgcatttgaattcatggatcatcactgtattgatctggctatgcaacatttggaaggagttcaaaatcctttacctgcatcaccgtacaaattttacgttctagttgaaacaacaggaagtgatgaatcatctgacaagacaaaactggaagcttttttgttgcgttcaatggaagatggtttagtagctgatggagttatcgcacaggatatcagccaagcatcaaacttttggaggatccgtgagggtatatcagaagcatccgtcaaagttggagctgtgtacaaatatgacttgtccataactgtagagaagctctatgatattgttgaagaaatgcgctgccgtcttggtgataatgcagaggtattgggctatggccaccttggagatgggaatctgcatttgaacattgtatcaagcaaatatgacgacaatattctcgcacaaattgaaccattcgtctatgagtggacatcagcacaaagaggaagcatcagcgcagagcatggtttggggctaatgaaagctgagaagattcactacagtaaatcacctgaagcagtacaactaatggcctccatcaagaagttgctggaccccaagtcgatccttaatccctacaaggttctgccgcagtctgtactgtagctaaaaggttaggaccctgtaagtaaaggagtttgttagggctgcttgatgcttgaatggactgtgagcggaggcaaccgaataattgaggcgaacatgcttatcggcgtgcccaatgtaatgattcagttggtggcgtcgtcaaaccacatcggatgtcatctggagaaagagtcattttactgtcgttcaaacttttaggattagcattgaaattttcaggattcacagtacataatttgaatgctaacaattcaggataccatctgctagcatataagatgtccagtccagaggataaactgctcattagggcgacatctgctagctccaattggcaagcactgaaacttgatgttgctctgtaggtatggttggtgtgggaacaaatgaacggagaatttcagggagaaaatcggtactttagggctagtttaccccgtttttctaagaaatttttattttcccaaaaaaataaagtaaattttcttg

SEQ ID NO: 14362 - DNA, 1000 bp, Zea mays
aagctttttgttgcgttcaatggaagatggtttagtagctgatggagttatcgcacaggatatcagccaagcatcaaacttttggaggatccgtgagggtatatcagaagcatccgtcaaagttggagctgtgtacaaatatgacttgtccataactgtagagaagctctatgatattgttgaagaaatgcgctgccgtcttggtgataatgcagaggtattgggctatggccaccttggagatgggaatctgcatttgaacattgtatcaagcaaatatgacgacaatattctcgcacaaattgaaccattcgtctatgagtggacatcagcacaaagaggaagcatcagcgcagagcatggtttggggctaatgaaagctgagaagattcactacagtaaatcacctgaagcagtacaactaatggcctccatcaagaagttgctggaccccaagtcgatccttaatccctacaaggttctgccgcagtctgtactgtagctaaaaggttaggaccctgtaagtaaaggagtttgttagggctgcttgatgcttgaatggactgtgagcggaggcaaccgaataattgaggcgaacatgcttatcggcgttcccaatgtaatgattcagttggtggcgtcgtcaaaccacatcggatgtcatctggagaaagagtcattttactttgtcattcaaactttcaggattagcattgaaattcataatttgaatgctaacaattcaggataccatctgctagcatataagatgtccagtctagaggataaactgcagcatatgaaccttgctcattaggccgacatctgctagcgccaattggcaagcactgaaacttgatgttgccctgtaggtacggttggtgtgggaacaaatgaacggataaattcaggggggaaatcggtactttagggctagtttgccccatttttataagaaaatttcattttcccaagaaaaaataaattagttttccttgag

SEQ ID NO: 14363 - DNA, 1955 bp, Zea mays
gggtacctcgaggccggccgggaacggcgtccaagccctagcctaacgatacttgcttcagcccagggctttcctccgaatccccttctcgtccaggcagttgttgcaaaaatcccgcctccctgattgcggttgttgcaaaaatcccgctacgctagtcgctaggctttcctcagcagcacttccgcgcttcgactcctggcagattggattgggtcgctgcttccaccagcaatccaattccggagatgactaccactcagttcgccatggttgaggagctggcctcgctcatcaaggacaacctgcacagcaagcacctgatcctctccaccgaggaagccctcatcgcagccctccagcagctgcactgccgcgacggcgaccgtgaagaggacgacgatgcggcggatacgatagagcttcagcctgctggggcctaccaccgccttctcttgcatcgccttgctgaaatctatgggttcgctcatgaatcggttggtgaaggcgaggatcgacatttagtcctccagtgctgccctgaaacagccatcccatctgtccttgttagtgatatgatatggaagtttgataacagtgacgatttggcgtccgttgtgctaaccagaaatgatatagattttcaaaaacctcagaaggcagatgttgtcaaagatgtttctgttaaaaactcacatctgaaagataatacagacttgaaacctctgaagcagccagcagtacttccagcggcgtcattgaaggagagggaagctgcttatcgagctgctcgtgaacgaatcttctctggggatggtgccaagggaaatgatagatcatatgtgaaatgtagacaggttcctgtcgttgcaaaacggatgattgcccatgcactcggtcaaaaggttcaaaataccacagagacagccgcctccaaagaaagcaaagggaaacaactgtcgaatgggaaaactattccgacacatagcaggaacaacttctgcccagttacaccagataacatagaagcagttctaatggggatgccaagctcagctggtagtaactcgtatcaaactccaccaagccaaaggtgccacgcaactaatactagagctgttactgctgaaagcttgaagaaagagcagactggagcagctaagagaatgtttgcgcatgcactggggctgtctgcagctcgaggaagttgtggtacgctgcccaaaccgaagtaaagatctggagtcgagaacgcggataagtgaagaaggttggctgttgccgatgcaaggtccgactgagcttcatgtcctatcatatgtgagccatgggaatggaatgagcctgcaatggttggtgccatctactgatctacctctgcgaaacacgttttttgtgatgtgctagtagatgaaagggtttgttggttggatgttaattgttgggacccagagaggatctggtagccctggttcgaaacgcaacctcagtcggtgagagagcttgctggaatgctggatacgcatggacatggcatgccaagccaagtggatgttcttcaccagagtggaagcaaaatgatccttcacatgctctaggttgctgcaatgctgcatatgtttactctagcatgttgttaggctgtctccagcaaaacttgtatacaggcgtttaaaacactttttatactgtagacatgaggctttccatgcttacgtaagcatgaggcttttaataagtgttaattagagctccagcctcacgaattttgtagctgtctgtctctagctatagaaacttaagctgcgggtaggttgaaggcatttaattgatcctttctttttcttattttggattggattaattttaaggtttagtccatttcaattatcatgtgaacctgatgtactaactaaaacaggctcctgtttatctgttcatagacaaaaaaaaaa

SEQ ID NO: 14364 - DNA, 2229 bp, Zea mays
cattgggaccctcgaggccggccggggaatccctcttctccagcctcagctcccctctccatcgcagttgcagttccgcccgggctaggctttcgtcagcagcactttcctcccctcggctcttgacagattgaactgcttccatcagcaatccaatcgggagatggccaccactcagttcgccatggttgaggagctggcctcgctcatcaaggacaacctgcacagcaagcatctcatcctctccaccgaggagtccctcgtcgcagccctccaggagctgcactgccgtgacggcgacggcgacggcggccgtgaagagggcgacggcgcggcggatacgatagagctccagcctgccggggcctaccaccgccttctcttgcatcgccttgctgaaatttatgggttcgctcatgaatcggttggtgaaggcgaggatcgacatttggtcctccagcgctgccccgaaacagccatcccatctgttcttgttagtgatatgatatggaagtttgataacagcgatgatttcatgtctgttgtgctaacccgaaatgatacagattttcaaaaacctcagaaggcagatattgtccaaaaagacatttctgttaaaagctcgcgtctgaaagacaatacagactcgaaacctctgaggcagccagcagtacatcctgcagcatcattaaaggagagggaagctgcttatcgagctgctcgtgagcggatcttctctgtggatgatgccaagggaaacgataggtcatacgtgaaatgtcggcaggttcctgttgttgctcaacggatgattgcccatgcactcggtcaaaaggttcaaaatactacagaggcagttgcctccacagaaagcagaggaaaacataaacagctgccaaatgggaaaagtattccgacacatagcaggaacaacttctgcccagttaccccagataacaaagaagcggttcgaaatggtaggccaaactcagctggttgtaactcgtatcaaactccatcaagccaaagacgccacacaactaatactagagctgttactgctgaaggcttgaagaaagaacagactggagcagctaaaagaatgtttgcacatgcactgggtctgtctgcagctcgaggaagtaatggtgcgctgcccaaaccgaagtaaagatgtggatttgagaacgggtaagtggagaaggttgcccagtgcaagctcaagctcctgccgtgggatgaacctgcaacggttggtgctcttctgtgccatctactactgtggagcgatttttgtggtgctgtaggagatgaaagcggttattggttggatgttaattgttggacttggacccagagaggatatgtggcccggcgctggttcgaaaattcaagctcagatggggaaagatgttgctggatacgcattacatgccaagccaagtggaagagaaacgcccctcctgtcactcgtatggtaatatcgctctaaggttgctgcaatttgtttactctagtacgttatttagagaggcacatcctgtgccgttacttttttcctttgactatacttatataaggacgacttgctggatttgtggtcttgatttaatttgtactcttagggcttgtttagcagcaagtgtaatggacgaaattgagaagtttaaaatctcttactatttaattttgattggtcccctcaatccactctattaccctccggccgccctgggtttgtttggaagcagagcaatagaattggaggagctaaaatgaatagtaaaggctgatttggtgacaaggggatcctgtgaggatcggaggattgagggagaaataaactaattttctctttaatctcctgtgatccctgttcaccaaatcaactctaagaagatttgagcccctctaatccacttgctcccaaacacgccctggtaaatgtttgtatttgaattacataacttagtcgttgaaataagagtctgtttgtttaggattataatatgaccagattatataattgatcaaattttgaacaaaatgttagtttaaaatttattatattatataatctagatagattataaacccaaacaaacaccccctaactatgcgtacgtaagcatggggtttcaccagtgtttggtgcagctacgttgcttaacttgttgtcagaaccgaagctgcgccaaacgagccgagcttgccaaacattaagctgca

SEQ ID NO: 14365 - DNA, 1362 bp, Zea mays
atggagaggataaccccggggagatggtcacctctagtcacggttcaaaggacacgcgcaccggtccggtcatgtcctggaggcagcagtgaaccggacagaggaagagagagagagaagtagagaacgcccgccacggcgccgccgacgccccacccggccgagccgaaaccgagactgcatcctccttcgcggcgcgccgagatgagcggcatgagcctctcccatcgtctccctcccgccgcggcggcggtggacccctactacgtgtatgcggcgcacccggacccacagcggcagggcgtgctcacgctcttcgtcgcggggctccccgacgacgtgaagccccgcgagatccacaacctcttctcccaccgccccgccttcgatcactgcctcctcgagtacaccggccgtggcaaccaggcggttgcttttgtgacgttcttcacccatgaggcggccctgtcggcaatgagttccctaaatggaacaatttttgatccggagagtggcgaccgtttgcacattgagctagctaaatcaacttcacgcagacctcgtggaggtgtcgaaggctaccgagttattgacaaacgggctaacaaaacagaaggaaatgctgaccatgagaatgttggtgatgaagatgatgacgaagtatggggggaagatgaggatggaggcaatgacaataatggtgatggaggatcagatgagccatcgggcacagaaaatgaaaatcccagtaataagaatgaattgcctacggataagagtgatcaaccagggcacaagcagcagaatgggcaatctctctcaaatgaaggacgagacaaatcttcaagtgatataccaccttgctctactatcttcattgcaaatttgggacatacatgcacagaggacgaactcaaggaagttttatccaaggaacctggatttcatgttcttaaaatgcgtcgccgtggtggaatgcctgtagcttttgctgattttacggatattgaatcgtctaccgctgctatgaatagactccaaggcactgtactggcatcttctgataacgatggattgcacattgagtacgcaaggtcgaagatgaggaaaagctaagttgttggactgcaaggattggcagtggcatctcctgtctgtcttcctggaggctaccagtaggcatccctgcacacgtagctgcgtgtagctgcttgcttagtcgttttatccatgtaagcgtgagaatccagaacggtgctaattgtcctgtatgccattatacaatactccctcttttaaatcatgagatactctcttcgtttcaaattcaaattacaccccttttgaatcaaaaaaaaaaaa

SEQ ID NO: 14366 - DNA, 1892 bp, Zea mays
  misc_feature (65)..(65): n is a, c, g, or t
ggcggcgggaggaaggccggcgccgccgccgcctgcttcccgctgcgcggggagaaggaccgccngcagctgctgcaccgcgcgctgcgcctgggcggtcgccgcagggccggcgtcctgctgctgctcgccgtcgtgtccgccgctgtcttctcctctctcttcgccgtcgtcaaagatgacagcaattcaatcagtattgtaaataattatgaagtcccaaatgcaatacagaagtcagtgtttcccagcacatctcggcctctaatgatgtctggacaccaatactccaccagtgttgtccacaaaatcgagcttccaaatcggcttcatcttacgtatgcaaacttcacacatccttgcgaaggtctctcagttcctcctcccctggttgataagaaacgcactggaccccgaccatgaccctgtttgctatgtttctgtggatcaggcatttgccttgatgcccctacaagcttcaccatcacctctcgtggccggccgggactatgtatctgaagatggtgttactgcaaatttatcaaatctgggatctggatttggagggcatccatctctggagcagagaaacaaatctttcaacattaatgagtcaatgactgtccactgtggctttgttagaggaaagaagcctggccaaggtactggattcgatatcaaggatgatgatctgctagagatggagcaatgccgtgagctagtcgtagcttctgctatttttggaaattatgatatgattcagcatccgaggaacatcagtgaattttcaaaggcaaatgcatgtttctatatgtttgtagatgaagaaacagaggcttatgtcaagaattctagttctttgtacaataataataaagttggactgtggaggctggtggttgtccgaaacctcccttatgaagatccaaggcgtacgggaaagattccaaaacttctgctccataggcttttcccaaacgtgaaattttcagtttggatagatgcaaagcttcagcttgttgcggatccctatctcctgcttgagaggttcctgtggaggaagaataccacttttgcaatctctcggcattacaaacgctttgatgtgttcgaagaagcagaagctaacaaagctgctggaaagtattacaacgcatcaatcgattaccaaatagagttttacagaaatgagggcctaacacattattctcctgccaagcttcccatcacaagtgatgtccctgaaggctgtgtgatcatcagagaacacatccccatcacgaacctcttcacgtgcctatggttcaatgaagttgatcgcttcacctccagggaccaaataagtttcagcaccgtccgggacaaaatcagggctagagttggctggatgcccgagatgttcatggactgcgagaggcgcaactttgtcgttcaggcgtaccacagagagctactggagcagatgattgcatcaggtaggatgcccccttcgggggctgtggtggtgaccgacgcagcaccatctcggaaagtccgggcaggtagcaggaaggctactccgtcgaagaagccctccgtgaagcggaaaaaagagaagaaatcgagctcgcgacggcgtctcccgaaacccgtcgccggtggtttgggtgctatgtgacctaagttttcgtcgagtagcagagtcttgatactcccacagtcacacacttatacagcgtgtaccggaatacaaacaatgttccattacttaggtctggggcttgtaatcgtgccccggcgaaatttgttcatattactcttcatcgttgttgtacataacatctccaaaccaatattcaattttgttcattgatgttaaaaaaaaaaaaaaaaaaaaaaaataaaaaaaaaaa

SEQ ID NO: 14367 - DNA, 2338 bp, Zea mays
ccttctttttttttttttatcaaattagtttttatatatatatataacacatacactaagtattatatgaatccattagaaaccaaaacgaattttaatttatgacagaaggagtacatgacattggtttaatggcaagggcaacatctaaatgccttatatttttatagcgaaaccaaaaatcaaaatgtggcgccggtgcactggcaagggcaacaggaaggggcttcgctacaatgctgatgtccaatggttattggcccgcctattgatgatcgagcacggtgtatgatgctgatgcatacgcccttaactttccagaaatcgccacatagctgcagttctagcagtacagaatactgatagggcaacccgcgtggtcgcttggtgttgagcttccacaaaacatgagcttcttttctgcatagtcatcttagcctatcctcttgaatttcagtccggacaattgatacaacgacggctatgtcatccagtttgcccccactgtagccaaggtacccagccgagagagcagcatctgaaaatgggcttctcccagccccagacctccctacttcctgggccttcacagccaagtgttccgcaatctccgctggttctagatctgcctgtaacgatttggagacaattccagctatttcatgctcgtatacattatcaaaaaggccatcggttgctgtcacaattgcatcgccgtcctctagatcaatagcataattctgtacaaactttgaggggtcatctcccttctgaatttgtagtgggaaattgaaaccataaagcgtaggtttagactttttgaacacttctccatttcttatcactataaacccagagtccccaatatttgatgcttgaagggcctggccatcaaaatgagcaactaatacagtgcaagaaccaggtgaacatgcttcatctactgctttggaaagaatctgctctggtctaagatctggagccccttgattctcggtaacgaactttttgcagccatccattagttctcttgcataaagccctgcgttgattccttcaaatgaccactggccaactccatctgctacaccaaaccagccattggctgcaatgaaatatgcatcttctccacctgttgctacctttgacggatgaggcaatattgcagcacctgacgataacacacgtgtccgttgagctattggaatcatcctatcagaactcttcacctctgaagtgtcatttttccaatccgccttgttgctaacttgttccggtggtggtaaggaaaagccgaactcagctctctgctcgtcgctgctggagccgctggactccgtttcaacgtcggtgtagaaatcctgtgcagtggagccttccgatgcggcttcggagtcctccaaaccggaagtcgccgcctcatccaagccaccactcacatcaactgctgagtcatcctcgcttgccccgcgcccctccaaagcagtctcaatcgtatccatggcagcaccactggtcggcatgccagcctcaacagcgacgccgtcgccctttggcccatcctctgatctcgacgggacaagagactctgcggatgatggcctggtgtccacctcctcaacggcagcattggaacccgcctcctgctccggcgcctcctctagcgcagcggaagtggcaccggttaccgcgccggcgtcaggaggtggaggtgtcggccaggcctcggctgcggcattcgggctcggcttctcaaccccagccgtggtgcctattcgcacgccgtctaatccatgttcagagtcaatctccggctccatctggctgccgggcacagcgcccgaggcaggggcaactctggagtaagggctggtctttacgctcgccggctccggctccagcgccttggacttaggatggccgaaacggaagacgatgctcccgtccgccagctcggtagtggagtggagttcggggaccgcatggcgcggggacggggccgtcgtagccgtggcgcttgtgtgcatgcggcggagcgcggggagtggcaagggcggcgctggcttcggagagagcttgcagttgcgaaggtccatcagccccgctgccaaaggcaactctgccatggcttacctcctgtgagagagagagagagaaagagagagattgatttgaatgctgtgactgcggagcttcagcctccagctgtggagtcgaatggtggtgaggatggatcgtttttttcgattaggatcttctaggtaatggtctgggtcgctgctgactgctgagtgggctcgacgtccttgtatttttcccgccggctcgaggtcccaat

SEQ ID NO: 14368 - DNA, 811 bp, Zea mays
  misc_feature (741)..(741): n is a, c, g, or t
aactacacacagacagtagcttagctgggtttcacattccatcggatcgacctagcctcggactcggagaacatgggaggtggaagggacaatcatcatgttgataaaggatgttatcctccaactgtctatcctccagtacattcaactggatcatatgcatttgcgcctccagttgcatatccatattcgtatgcacaacatggatctatggctccacccccattaggatcatatccatatccttcacctatgtactcttcacatagtggttacccaccatctggatatccaacatacaatcaaagtgcttacccatcaatgggtggctatcctggtgctagtttgcatgctactcaacatcatggtaatggatataacatgggggcaacgctcattggtggagcagcagccgccgccgccgctacctatggtgtgcatcacttaacccatggccatcaccctcacaatcaccatttagggcattttggcaagtttaaacatcattataatggacactatggcaagttaaagcatggaaaatttgggaaacacaatgggttaggaggaaaacatggccttctagggtggaagcatcaccgtcatgggttctttggaggaaaatacaagaggtggaagtagttaaaatatagggaagggtatgcaattggatcctgcaagtatgataactaacatatgtaaaataaaaatggttgggttcgtgttaatgctatacatgcnatgtaatggttttataagttacttgttggatgtgtcattatcaatctataataagaatacatactttgtt

SEQ ID NO: 14369 - DNA, 2143 bp, Zea mays
ctcctccgggactggacctcaccgacgacggtgacaatgtatgcgctcgcggtcgcggactgcccgccgctaccggtattctatttggcgtatttatatattcccccctgcttgcttcatgcggtggttcccgcatccgcctccaccccgcccgcccgccccgcagccactgccttcctgcctgccattatttcttcctcctcctcgctgtccatccgtccgtcggtctcctctgcccgcccgcctgccatcattttcgccccgcccaagctgggagcagggaggcggtaagcagcatgctgggagcgagcgccagcaggggcaggaaggcggcgccgccatcagtgaagctgggggcggcgaaggaggcgccggcgaccgtggccgcagccgccgccggcggcaaggtgtcggcggaggaggtgtgggaggtgcggcccggcgggatgctggtgcagaagcgcggcgggggcggggcggccgacgacgagccgtctcccggcgtcaagccggtgcccaccatccgggtcaaggccaagcacgccggcgtcacgcacgagatctacgtcagctccgaggcctccttcggtcagtcactccatccagtgtagttcgttcgtcggtcagtcaccgtatctgggtcccgggtctgacgagcgagacgaatgctgcgtgcggcgtgcaggggagctgaagaagctggtggccgccaagacggggctgcacccggacgaccagaaggtgctgtacaaggacaaggagcgcgactccaaggcgttcctggacgtggccggcgtcaaggaccgctccaaggtggtggtcgtggaggacccggaagcccgcgcgcgccgcctcatcgaggagcgccgcaacggccacctccagaaggccgccagcgccgtcgccgcggtcaccgccgaggtcgacaagctcgcccccaaggttggttggttcgttgttactacttggcatggcacagtacccatccatcccaagattgcatctttttccgagcccatctatagcagtcagtcagcagatgcagaacgaccggaacagggaggggagttgaccaacctctgaataaaatctgactggaggcttgctggcaggtggcggcgctggacgcgtcggtgcgcaagggggagaaggtcgcggagaaggacgtggtgcaggtgacagagcttctcatgaacgagctgctcaggctcgacgccgtggtcgccgacggcgacgtcaaggcgcagaggcggatgcaggtgaggagcaaggatccgtcgatccgatatctcgccttcttccccgttgaattccagtgccgcggccgactgaatttgaatcgattccgccgcccgtcgcaggtgaagcgcgtccagaagtacgtggagacgctggacgcggtggcggccaggaacgccgccaccgtccgcaagtccggcgccaagccagcaccgccgccgccgcagcagcagcagcagcaagcgaggcaggcgcggtgggagatgctggccctcccgtcggcgctgccgtccacgtcctcggcctcgtcgacgacaaccgtgagctccacggcgtcctccggcgcgccgccgaccaaccgcctggactggatgctgttctgacgggcgggcgagtgcagggcagcccggcgccggccggccaccggcgcgaaagcagtcaagccggatgtgggggaaagcggaaggcggagtgcagaactgcagatgcgatgcttgtgtgccaagaattgcaccccctgcagaaatctggtggcctccatgattgggcacgggctacctagcttggccacaaactgcattgctctgcatggtaccgtaccagccaactcgattcatcaaccatgtcttcttctttcattccttttgagattctttcctttttcctcatcttcttgttcatgaaacgtttgaggttctttttgtgtgcatactattcagatagacagagagaaagagagagagggttggttacttggtttagggcaaatcaaatgtattcagattgggaataaacacactactggagtcaaaaaaaaaaaaaaaaaaaactcgagggggggcccggtacgtctcaactcggaagaaaggaacaatgggagaaatgtagacatgcctgcctacac

SEQ ID NO: 14370 - DNA, 2672 bp, Zea mays
cggccgccggggtggctactgaggaaatactgcaaactgccatggctgttgaggatgcacctccaaccaatttagatcaccgagaagtcattaatgaaagatgcttcagaggagccagttcaaactaacgaaccatctgagcagccactgaaaactgaagagattgagaagccacaacaaagtgaaaagattgctacggacacgagagggagtgaagtatctactgaggagatgctagagcttgaaagtaatgccactaaattaaacaaggatcaatcagaacttgaagggcgttcatctgggaggaatcctccaaacttccaaagcaatccaaatgctgggcagcgatcagagtccaaaggcattgtggccgagaaggcagctgaccatataatggaagctgaagatgatgtggatgctgagcactcatcagaatctcaaagcgttgcacctgctgaggttcgaaaggagcaaccatcagaacatcaaaaggatgtggatattggagcagctattggaccctcaaaatcaggatcatccttggaatccactagatcctgttagggatacagctgccaaggattcatcagagcctaaaagtgacatagctacagaaaaacctgcagaatctcaaaacaatgcagaacagtcagttgagcagcaatcagaaccgcacagcgataaatcaactgagaggccagaagtgcatcaaagtaatacatctaatgatgagctttctaggctgctacccgcggctcgcgcccgggaactatcagtacagtcatcagatcctgagagcaatgcatctgtcagtaagccatcagagtctcaaactgatgtggctaccatggaggcactggaacctcaaattgatgctcctcctgataaggcaactgaccagccagtgaaacctcaagatgatgcatctgctaagaatccaatgggaactgaaagtgatgctgtttgtgataaaccttcagaaagcagctcagatactgaaacacttcttgtatgccatcagaacagcagcataaccactgatgaacctgtacaaggtggcatttcttatgatacaccacatcagagaagtgcacccatagaaacaacaccaggaagtgaaacagttgttgacgattgcatacatcacgaagataccagcagcaaaccatcagaggaaaacaaagctattgaggagccagaagaggtgagtgccaagctgccagatgaccatgtaacttctgagaagtcgtcagaggaagacaaagaaaacgcagaggcatcagtagacagtgctcccctggggaacccattggaggtcaatgaggagagctccaatccttcaggggatactgtaactcctgagaagccactggaggaggataagacgagcgcagagccatcagaaagcgatgcatcctttgggaaaatattggaggccgatgaagtgagtgccaacccatcagaggatattgcaactcctgagaagccactggaggaaggtgtgggaagtgtggaaccatcagaagacaattctgttcttgataaaccattggaggaagaagaggttgatgccaaaccggtgaaggacgttgtaactcccgagaagccattggaggaaggctcaacaactgcagagccattagaagacaatgctgcccatgaggaagcaaaagaagaagatgaggtgattgccaagcccctgtccagtgtggcacttgagaagtcactggagggaagtgaggcaagtgtagagccatcggaagacaatgctgctcttgagaaaccatcggaggacgacgaggcaaatgccaagtcatcagaggacagtgtatatgtggagaagccacaacaggaagaagatgacaacggtgtcaaggcattagaggagggcgtgtcccctgagaaatcagccgctggcaaaccattagaagaagacccagtccatgagaagccagcggacgcagtagctgagccgtcatctcaggacgacactgccactgaaaagccctcagctacaactgacactgcagaaactgcatgagacatcagttagctggttaaagttagttagcaacagttttaaacggagtgtggatcgaatactattggtcatagttcggcgtggcttctgtttgttttttttttggtggggtgggggtggggtataatgcttgagttgtaaaatttgagggaaagaaactatagtattgatttggtttttttacaagcaataatcccctcctccacatgttaggaggaggataccattgaagttctatacataggatttgtgtgcggtttgattttttgtttggaagttgtactttgtaatcgattttgtgcaaatatgactgtgcttgctcattattcggttttctgcgtgtaaattgatctagcaagattttatgtgcaaatggtgtggctaagctttcaataatactagaaaaagaaaacgccctatcggacgctggttcatatacggaggggaacaaactaaaccacatgttatagcgtacatgacaaacattttaatacggccacaaaattagacaaagaaagccgtaattattgtggaccaacatggtctaacagataaaaacgatgtattagcttgtctccactagtaaacaaattcaacaatgacatgcagtggtagcaatatcaaacgggcc

SEQ ID NO: 14371 - DNA, 1344 bp, Zea mays
cgccaaaaagtggagaagccaaatccaagcctcgcacgcagcagcccctctgcctcctccctctctcatgctcatccatctccggcgctatatatatcgagtccgccaggccgggccccgatcgagtcaccaacaagagtagtagtcggagccgtccgtagtagctagcgtacgtacgtgtgagtttgtgaccaattcagagaagcctcgatcatcgttcgcttcgcttcgcttgtgtgtcgatatatatggcgagatcgccgtttgttccgatggatcaggggaaagagcaaggcgccggacgaggagcggccggcaataataaggagcggcaggaggaggaggtgctgctggtgcacagccaggtgcggcggatcaagaaggaggacgaggaggccttcagggagcgcctcctgaagctgcgcctgctggagacccggcccaacaccggcgccggcggcgtggcctggcgagccccgcgctccctgtcgccgctccgccgtgccggcagcgccatcatcccggtcccggtgagcgagtgactagtagcgagcatccgtcgacacgcggttctctcggctgcccgcgcgcccgccgccggttgtagatatcgctaggcgcgtacgtagcgagcgtgaccagtgttcttggggggtgttagtgagtgagcctgcccgtgctttgcgcctgcgcgcgcggacatgggatcggagcttggtagacgacgacggtatatagtaggtagcatcgccatgtgtacgtactgcgtggttcctggtacagtagcatagcatgctctgtttctgtatcctgctgtgctcttcttcttggtggtggtggtgtgtatgtatatataaatatatgtttacgatgagttatgagagggagtttattacctgcttaaatcaaaaaaaaaaaataaatccttaattcgttctgttctactatatgcttaccagctgccatgtgttctcaaatcatgtgatccaatccaagaaccgaagccagccatccttcgtgcatgaacacaatcctcgtagcaagcaagcacctggatagggctaatactagtgtgcagggatgatatatacctagcgtacatggaggtttgatgcgcatatatatccacatacataaaatcccggcctttaaaatcagatctaatagtgtacggttgttgtattttttttttacgaaacctaccctctcccatgcctggtttgttctgtagaaaaccctatatagtatcgtgctcgtgcaccgttgaatctggttctaaaactgaagattaactctatagatgcacatatgcatcgtcatgtgcactggttatcatcgtcttaa

SEQ ID NO: 14372 - DNA, 766 bp, Zea mays
gccggccgtagagtcaccaacaagagtagtagtcggagccgtccgtagtagctagcgtacgtacgtgtgaccgattcagcgaggtcgccgtttgtgtgtcgatatatatggcgaggtcgccgtttgttccgatggatcaggggaaagagcaaggcgccggacgaggagcggccggcaataataaggagcggcagcagcaggagcaggagcaggaggaggtgctgctggtgcacagccaggtgcggcggatcaagaaggaggacgaggaggccttcagggagcgcctcctgaagctgcgcctgctggagacccggcccagcgccggcggcgtggcctggcgagccccgcgctccctgtcgccgctccgccgtgccggcagcgccatcatcccggtcccggtgagcgagtgactagtagcgagcatccgtcgacacgcggttctctcggctgcccgcgcgcccgccgccggttgtagatatcgctaggcgcgtacgtagcgagcgtgaccagtgtcttgttggggggtgcgctagtgagtgagcctgcccgtgctctgcgcctgcgcgcgcggagatatgggatcggagcttggtagacggcgacggtgtatagtaggcagcagcatcgccatgtgtgcgtggttcgtggtacagtagcatagcatgctctgtttctgtatcctgctgtgctcttcttcttggtggtggtggtgtgtatgtatatataaatatatgtttacgatgagttatgagagggagtttcccct

SEQ ID NO: 14373 - DNA, 2827 bp, Zea mays
aaaccctctcctctcgagaagcagagcggcggagatccggagagaagccatcggcagccgggaagcccgtcgcgtgcctttcttcctcgacgtgccatgattaacggaatatttgagcactgggacctggagcgacagtgaagtgtgacccaggagagttctggtgccatgtttcacaggctattccattattcccaaaagcagatgatttccagtgatggggatgaatgtgagaggtcaaatgaagaagatgaagactccaaaggacttctactcgaaagtgaagtagcattcatggactatgttagggaagttcgttattaggcaactgaattgtgggtttgcgtttactgctacaaacgggctctaaggcagcatcacaatgtccgatgcgtatttgattattgtgggttgttggaaagttgctgttttttctgctcaacagaatgtgtaattgagattttcttgaattagaaagttgttgttttgcagcgggtattgacatataacccctcatttccttaccgtaccgtctggaagttctgaacacaaacgcattatatagcatgcttgttagaactggacggattttcaggaatcatgaacaacgaccttctatataaaaaatggtaatttgaatgatacgaaatttacataaaaaatggaactactcttttaatggcaatccaccagaatggtagtcaactagtcatgatggtcgataaacatggaaccgcatatgagatgagaaagtatccaaagtagcctttagaagatttttttgcgcttcaactctcgtcgtttgtccgcatgttcttcttgcatgcatggccggccttggcgttgccttccatctaccaagcttgcgtgctcacgattcttggcgctgatcgtgacaccatgaacaggagttcactctccccgtgctcccatatgctccattctgcagaacgccgccgtacgtgaaactctgcaacttcctttcatctatcggaccaccgcgcgctcatgcaacacgccgcgccggtcttcctccgccttgtcaaacacggcggacgacacgatccctgtccacacgccggggcagtggtaggcctggcggcagagggtgtgcgccacctggttcccctctcggtacacgtgcctcacgtcgcatccttggaaacgacgaagcagtccatggatctcctcctgcaacgccacggggatccgcgtctgtgtgtcctcgccgcggagcagctgtaccagcacgaggtcgtcgccctcgaccaccagccgttgcaggttaagcccaagcgccaggcggaggccgcggatcatcgcgcgcgcctccactatgcccaccgtagagtgctccgtcggctcggcgaacgcgagcacgacgcggccggcgctgtcgcggatggcgccgccgatgctggctcgcgccgaaccatcgtggtagacggatccgtcgaagttgagcttgcaccagccgcgaggtggcggcgaccattgcaccaggacgacgcggccaggatggtacgaccgtgcccatggagaaagctgcggcgcagggtggcatagattggaggtggacgccgccgtcgctgctagagagcacgtcatgccgtggtggtggatcgatcagagtactgatcttgcagcgcgtctgtagccggtggataatggaaggtgctgtgtcgacgaggtggctctatatttataggtacgtgatggaagtggatgaggatggagggtcctgtcagcaccaggtgccaggtggctgtgtacgctgggtgaagcgtcccgtgcaagcaacctgagatgggcaaccaaattaaaacgaggagggggcttgccatttttctgatctttgtccgaattctcctctcccctcccgggcatggcaagcagcgtcgcgtcggttcggccggtggcgctcggcgacgagccgatggagatcccccgcctgaagatcgacgccgagacgtcgcatctcctgcgcatcctgctggcgctgtggcgctggagcagagcaacctggcggaggcgggcagccatggtcgccgtcgtctgcgtcctcttattcatgtccgccacgcttgcgcaccgcgtcgtcgacgtctctgcctttaccaccggccggctccaacttcaccgccctcgttcgtacacgacggtctacgacctgcagcggttcgccacctcctccgacagtccgagcctccgacttcgacgcggcggtggccgacggcgacggcgacatggagtcagtaccccttgccttcacagattcgttgccttcacagcaacgccgccgcctgaagatctggactcagatacgtaagcaaacttgagatggacaaccaaattatatcctagcatgcccctatggcttgcgagcattctgatttttttccgggttccgaattcacaaacatgaaacggtggcagactagtacgtgctcataaaccaaagagagactggtgtcatttctctcatgactcattgttgatctgataaacaaattggttgacatgtataatcgacatgagcacgaggcctccttcgaggtaaaaaaatcggtcatcgactgcggcgacttgaccagattcataagatgtcaagtatgaaaaccaactgccagacagtgatttgacacacttgaacacatataaatctaggggtctaatgaaatcgcgaaggatctcaaacttttccttcgcaaccaagatcgtaataaattagcattcactacatcgcgtgatacaacattccacaaaaaaataaagtagatcggagtaaattagagttattacaacttagtcggcaaaaggcccaaag

SEQ ID NO: 14374 - DNA, 2962 bp, Zea mays
ggtatgaatttgagagttcaaatgaagaagatgaatactctccaaaggtgtgagcattttaagtcgccttgtccttttttttttgacattcccttaaactttattttgtatgatattctgatgttagtttttttttatgcagagtactaagagcaagaataggccaagcagcctcacccttgaagacacctccagggaaaaaggcaaggatcacaacaccgtctgtgggcaaaaaaaacctgctgagaagtgttacattcgatcgcaaacttgtatagctcatagttcttttccatggcactggaacctcaatttgtgatgtgtagtttgcagttagtgatgatgctaagaaaaatatccacgtccatgtcgaagttggtgaagacggctcgctcaatcattgacaactacaagcaatccactggtcatagctgcaagtcgtgcagcaagtaattttctcgcctcgtgcggtcgaagcacagtgctcattgcaagatcaaggtgaagcaagcacagtgctcattgcaaggtgaattataaccagtgctcattgcaaggtgaagctagtgatgatgctaagaaaagtaccataatttttctcacacatgggcgtcctttttggtcgtggactttctactcgtccgttagtctggaaactcattgcaaggtgaagcacagtgctcgaaagtgaagtagcattcatggactatgttagggacgttcgttattaggcaagtgaattgtgggtttgcgtttactgctacaaacgggctctaaggcagcatcaacagaatgctattgcttattgcgggttgttggaaagttgctgttttttctgctcaacagaatgtgtaattgagattttcttgaattagaaagttgttgttttgcagcgtgtattgaaaaaaaaaaaaaaaattccttccttaccgtgcattgcttagtgatattgttaaagttctgaacacaaacgcattatatatagcatgcttgttagaactggacggattttcaggaatcatcaacaaccttctatattaaaaatggtaatttgaatgatacgaaatgtacataaaaaatggaactactcttttaatggcaatgcactagaatggtagtcaactagtcagtagtcatgatggtcgataaacatgaaaccgcatatgagatgagaaagtatccaaagtagcctttagaagatttttttgcgcttcaactctcgtcgttgctgatgctttgtccgcatgttcttcttgcatgcatgtccggtcttggcgttgccttcatctaccaagcttgcgtgctcacgattcttggcgctcatcgtgatgccatggacaggagttcactctccccgcgctcccatatgctccattctgcagaacgctgccgtacgtgaaactctgcaacttcctttcatctatcggaccaccgcacgctcatgcaacacgccgcgccggtcttcctccgccttgttaaacacggcggacgacacgatccctgtccacacgccgggccagtggtaggcctggcggcagagggtgtgcgccacctggttcccctctcggtacacgtgcctcacgtcgcattcttggaaacggcgaagcagtccatggatctcctcctgcaacgccacggggatccgcgtctgcgtgtcctcgccgcggagcagctgtaccagcacgaggtcgtcgccctcgaccaccagccgctgcaggttaagcccaagcgccaggcggaggccgcggatcatcgcgcgcgcctccactatgcccaccgtagagtgctccgtcggctcggcgaacgcgagcacgacgcggccggcgctgtcgcggatggcgccgccgatgctggctcgcgccgaaccatcgtggtagacggatccgtcgaagttgagcttgcaccagccgcgaggtggcggcgaccattgcaccaggacgacgcggccaggatggtacgcccgtgcccatggagaaagctgtggcgcagggtggcatagattggaggtggacgccgccgtcgctgctagagagcacgtcatgccgtggtggtggatcgatcagagtactgatcttgcagcgcgtctgtagccggtggaagatggaaggtgctgtgtcgacgaggtggctctatatttataggtacgtgatggaagtggatgaggatggagggtcctgtccgcaccaggtgccaggtggctgtgtacgctaggtaaaccgtaaagcgtcccgtgcaagcaacctgaaatgggcaaccaaattaaaacgaggatggggcttgccatttttctgatctttgtccgaattctcctctcccctcccgggcaaggcaagcagcgtcgcgtcggttcggccggtggcgctcggcgacgagccgatggagatcccccgcctgaagatcgacgccgagacgtcgcatctcctgcgcatcctgctggcgctgtggcgctggagcagagcaacctggcggaggcgggcagccatggtcgccgccgtctgcgtcctcttattcatgtccgccacgcctgcgcaccgcgtcggcgacgtctctgcctttaccaccggccggctccaacttcaccgccctcgttcgtacacgacggtctacgacctgcagcggttcgccacctcctccgacagtccgagcctccgacttcgacgcggcggtggccgacggcgacggcgacatggagtcagtaccccttgccttcacagattcgttgccttcacagcaacgccgccgcctgaagatctggactcagatacgtaagcaaacttgagatggacaaccaaattatatcctagcatgcccctatggcttgcgagcattctgatttttttccgggttccgaattcacaaacatgaaacggtggcagactagtacgtgctcatgaaccaaagagagactggggtcatttctctcatgactcattggtgatctgataaacaaatggttgacacg

SEQ ID NO: 14375 - DNA, 1364 bp, Zea mays
ggaacgtgttggccggccgacctcatgcctcaccccttccccgtcggcccccgactccccgagtcgccattgcctgccctcgttcggctcgatccccgcactacagcgcccgccaccaaccccgcccgcgcctccgctactaaagccgaggcctcacccaccacctgaccaccatgctcctccccctcctcagatcccacccgctcctccaccacgccgcgcgcctgtcctccccgcgcacccgcctgctcctccgccgcgacgcaatcccgctcgcacgctccccgcctatccgcatggcggcctcgtccggctccggcgccagctcccctgcctcggcgccgccagctgccgtggtgcacaagtcaaagatcaaattttgccctgcttgtggaagtccaacgaaactggccatacctgatggcgatgagaagatgagggctgtttgttcttcttgtggaagagttcactatgaaaaccccaaaatggttgttggttgccttgttgagcatgataataaggttctcctttgcagaagaaagattgaaccagcttatggtctttggacacttcctgctggttatttagaggtgggggagtctactgctgaaggagcctctagagaaacattagaagaagcatgtgcagatgtagagatagtctcgccttttgctcagttggatattccactgattggccaatagagttacattattttccgagcaagattgaagacccccaacttttcacctgggccagagtcgctggaatgtgcactttttgctctggatgatataccattcgattctctagcattttcttcaatcattgtcaccttaaggatgtatactgaagatgtgaggtctggaagcatcaaatttcactattgcacgataaacaaaaggttaggagccagcccttcagatcttcggagtttcgatattgataaccatatagccgtgtgaggttgaaaggttctaaaccttttgcgattgaggagaatggttttggcatacaacaggcgcgcgcacacacaccattggagccttgtttggcgcctccctgcacattggaacagatttaaagtaggtgctggaacatattgatagccattttaggagattatgcgtttcgatttcatgggagttgggaggacagaattgtatcatagtgcagtaactcttggttgtaggattgagttatcctgcatgccatggttgtggcgcttcgtcagcgaccgaatgctgtaatgtggttacgattctctgagctccttttcaaccattaattccagttgtaaagcctgtattgcttcatcttttatcttttaaaagtcacgttatcttctaaaaaaaaaaaaaaaa

SEQ ID NO: 14376 - DNA, 787 bp, Zea mays
gtagagatagtctcgccttttgctcagttggatattccactgattggccaggggagtgaaaaattggcttggtcacaaagttgtaggttatttcgtccgctactaagttgattatctttgtattacaatgagatgcagtagagttacattattttccgagcaagattgaagacccccaacttttcacctgggccagagtcgctggaatgtgcactttttgctctggatgatataccattcgattctctagcattttcttcaatcattgtcaccttaaggatgtatactgaagatgtgaggtctggaagcatcaaatttcactattgcacgataaacaaaaggttaggagccagcccttcagatcttcggagtttcgatattgataaccatatagccgtgtgaggttgaaaggttctaaaccttttgcgattgaggagaatggttttggcatacaacaggcgcgcgcgcacacaccattggagccttgtttggcgcctccctgcacattggaacagatttaaagtaggtgctggaactgtaaatgattcggtatcaaaaaggctggtttagccattttaggagattatgcgtttcgatttcatgggagttgggaggacagaattgtatcatagtgcagtaactcttggttgtaggattgagttatcctgcatgccatggttgtggcgcttcgtcagcgaccgaatgctgtaatgtggttacgattctctgagctccttttcaaccattaattccagttgtaaagcctgtttggctccaaaaaaaaaaa

SEQ ID NO: 14377 - DNA, 868 bp, Zea mays
gagtcgccattgcctgccctcgttcggctcgatccccgcactacagcgcccgccaccaaccccgcccgcgcctccgctactaaagccgaggcctcacccaccacctgaccaccatgctcctccccctcctcagatcccacccgctcctccaccacgctgcgcgcctgtcctccccgcgcacccgcctgctcctccgccgcgacgcaatcccgctcgcacgctccccgcctatccgcatggcggcctcgtccggctccggcgccagctcccctgcctcggcgccgccagctgccgtggtgcacaagtcaaagatcaaattttgccctgcttgtggaagtccaacgaaactggccatacctgatggcgatgagaagatgagggctctttgttcttcttgtggaagagttcactatgaaaaccccaaaatggtaaatgctgaacaaataaaagaaaaaggaaaggatccatatacatttgtatttgggctttaaattacgacactgaatgcctgttcgcacagtggccgtggattttgtagttctacctacagtattttgtaggaggcaaatcacagctgcagctttaatctgcggtgaacaccccttcaattccatgattatagagcccgcattttttcattcatgtatgaagtgcttttgatgaacagatgtgtccccattttcttttttgtttaatctattggtgaaacaagggactatagctggcaatatttttttgttatatatgtgtaacacatgttggcttctattttctgccatttacaatatatatcatctggataggttgttggttgccttgttgagcatgataataagggtctcctttgcagaagaaagattgaaccagc

SEQ ID NO: 14378 - DNA, 2580 bp, Zea mays
  misc_feature (2389)..(2389): n is a, c, g, or t
atggctatagacatattattgttctttgggctagaggtccattggagaacaatatcgtaccatgattcaactgattcaccgaccattatccataaggataattgagcttgtgttgttcagatggaaacaggttatatcaggagcaacattaataaacatattgctcctaaattgttttatccccatgacttcaggaaaatggagatataaacatcttgcaaacaaagtcttgtgataatcttgctgatctattcacaaaatctccaccatactcaacattttcagaaatgtgttgatgtgattggtatgagaagacttaaatgcttgcaaggatcaggggaagtaattctccatgatatttgacctgttttgatccatcatattacactcttttctttgtatgagttttgccttgttaaggttttctcatccaaagtttttaatgaggtaatatcaactaagctatatgcttcatcattgattttttcctaaaggggtttttacgaatgatgattacaagcatatttttcttttgaagttcaatgtgagttttactcatgatccaaaagcattatgtactccttgattctattattctctctacttctcgttaccactgccccagcgtacttcgttagcattaggcccaccggacagcgtgtagccagcaaagtcgaccacctcctctcaccgcacggcaccacgtggatctgacaggcgggccttgccatctgggccctgcgcgtcagtggagggacggtgacttctcgcaacgtgaaggccggcccacgttggcccagccgtccaacgttgtccatccacccagctgtaattattcctgagagaaaaaagggtttggccctcgatgccgtcctatccacgggtttgccactcacaaggacgtcttatttgttcttgggaagactatcgatttaatttttattcgaggtaattttttatattcatacatacgaccctccgttctgaacacttgggtctttggctgttagttaattattctggacaaaaattatcatgctccgagagcaaatatttagaagtaaaactacgaaagctcaaggggtagaatgcaaaatccaagtagtgaataaaaatgtcacagcaagaggacgacaaaaagagggcagcttccgcaagatctacctacgccttgcgatgtgtgaggactggagaagaccccgcatcagtcaggcaccaccaccaccacctttttagttgctgcctccagcgtccagccaccctccccaggacatccaccccgcaagtttggcaccaccaccttctcatcacctatccaggaccaggatcgacgacgaggaatcaagcagccagcagcgaccgatcgagacgcagccctgtggctgtgccgctgtgggttggatccggccgattcgacagcacgcggcacctacggatgccccacgcacccgtctcctgagagaactcgatcgattgcttcatggggagcggcaaggcgtcgtctccgccaggccccactgccggcgggcgcggctcgccgccaggtgccgccgtctgctgcatgtgcggcgaccgcggcctcctgcccgagctcttccgctgctccgcctgctccgtccgctcccagcacacatactgcacggatcggccacccgccctataatcagttctttttttaccttagtgcgcgtcgtcgtcgtcgtcgttcgtgtccgtacctgcggccgatccctaattcgatctgcactcgcagtagcgtcgattacgctacttatgaatatatttaaaaaaaatccccatctatatctgcttgtgatcgtgcgcatcgggggtttaatcactttatttgggcgcttttatttgtgaatcgaatcggggacagatacgtgcgctagctgctttggctttcttagcccaagcactattcctgacagttttagaaattactcccatgagtgcaaaaatgcgtggttctcctgcacattctcaaagatttaaaaaaaaaactgttgaatttggaatataatcttgaagaacgacgaccacacgatctagcttctttgaatctggaaatgcccaccacacgatcgaactgatagttcatgagttgatgttaacctgcacagccttttttccaggacaacacgtgaaccgcctgcacaaactgctcatcagcgctagctattccctcaatccctccccccgtacgtcagaaaatatcatcgtctgtgtactcactgtactgctacttcatctgatctctgtctcccatccttttccgtacgtcgcacgtccttgtactcataaattatagtcatttaaaccttttaaataaaaagggttcaagcatcggtaagttcaacaaaattatataataaaataataatanttgtgatatcaaatatatattattagatttttttatcaattaaaattttatagtacaaagatttgatggcataaatgtttataatttttttctataattttaattaaacttgagatactttaactctgtgaaaatgttagaacgaattataatctggaacagcgtgctgtcaccaaattgtcaaacgaaca

SEQ ID NO: 14379 - DNA, 1330 bp, Zea mays
cattgggtacctcgaggccggccgctacgccttgcgatgtgtgatgactggagaagaccccgcatcagtcaggcaccaccaccaccacctttttagttgctgcctccagcgtccagccaccctccccaggacatccaccccgcaagtttggcaccaccaccttctcatcacctatccaggaccaggatcgacgacgaggaatcaagcagccagcagcgaccgatcgagacgcagccctgtggctgtgccgctgtgggttggatccggccgattcgacagcacgcggcacctacggatgccccacgcacccgtctcctgagagaactcgatcgattgcttcatggggagcggcaaggcgtcgtctccgccaggccccactgccggcgggcgcggctcgccgccaggtgccgccgtctgctgcatgtgcggcgaccgcggcctcctgcccgagctcttccgctgctccgcctgctccgtccgctcccagcacacatactgcacggatcggtacccgaaggtggagtcatacggcgtctgcaactggtgcctcagggcggacgggggcgtggcttctacttctaactcgccgagatccgccggcaaagcggttgtccagcgcccggctcctcacggcggtgacaaaatcggcagcggaacatcacccaaggctgccgctcgtggcgacttcgcgtcttccaacctgagcaagcctatcaagaagcagccgcagcagcatgcgcagaggctgttgctgcggcggtcggcgtcggacctcggcagtcgcgtcgttcgtaccgaccacgacgcgccgccttcgcccggcgttactacgcgtggcaggccgagggtccggaggtacaagctcctggaagaggtgatcactagctagctaactagccgtacccggggcgtgtgtgttgtgtattaggtgtaaaattaaatatacgtgcgtttaatttgtgtatatatatctacttagctacatctaggggtagacacggcatctcttgcggtgctgccatgcatgcatggagatcgagcagtgtgtacgtatgtactacgtgctgatcatctcaggcgttaattcatcaccatgcatcagggtgctcgcgtcgtgttgtacttgtacatgaggaataatgtagtgcttgctaccgcgcagttcggtcatccgagatgtgcagctatgctcgatgatcccaatgaattactctctgttagatcgtcacccgattggctgattaatttatgcagacgtttttataaagaacacaaacagacgcccaccgtacctctgcatataaacaataacaagtgagccaagggtacc

SEQ ID NO: 14380 - DNA, 3541 bp, Zea mays
tattttgagagcaatagtttaagataaacaattatgtttatttgtttaatctgccttcttcatctgcaagccatgtttaattatgaaatggacctgtgtagctattttacatgtttacatgtcttagaattgctactgttcattgctgctataatttcatatggtatttatctgagttatatgattgttttattcggaattagaatatttaatttatttaaatatgaaggaagcatgtcacttatttctataatattacaacaatttgtaacaacaggaatatcaatgtctcgaatcttgcttagaaactcatctatttccagttccaacttttgaagtgctttctataaaatattaagaagtgtttttgaccatgatagctttaatgcaagatatgttgccatttaaggcagatgtgtggcatgtgccttaaatcctaaaccctaaacactttaagaagtgtttttgaccatgaacgctttaatgcaagatgtgttgccatttagggcagatgtgtggcatgtgctttcaagttctcattgacatttgagtttttttttgtcaatatagaaacatttttttgcatattttgtccatctgttcaatatattttgtgaaggtaaaacgaaaatatctttcatattgagtatcctcattgttaaataaaattgttgctccacaatctaaattcatatgtgtaaccatgaatgttgatacgaaccccacattctgtaacaatttacaggataatgaaaatcgacctttatattcttccccaatctggacgggcgctgaaccttcatagagcacctcaaccggagccagagagcaggagagggggtgacaccctcggatccgagtcgaccatcgagaaccggtgtctacaacgacgacaacgctagggatgaccatgttgccagcttgggacatagcaggggtctcgtcggtctcgtcaccggcgacgtgttggacagggtgagagaagtagtggcggcgatggtcgggtctcatgggggagagtgagaaagaggacgtagcaggggtctcatcgcgcgatgacgtgttggacaaggtgagagtgaagtagtggcagcggcggtcggtactcgtgggggagaggaccggggaagatgcagcacgaggagaacgagctggtcgaaggacacaacagggacatgaatggaaaacaaagtaccttaatcatgtcgaacacgaacacattgagtgaatgtttcgttgatagtatcattttgttgagtatgtcattcggagtactaaagtagccaatgattattccaacagaccgtataaacggtcgtgtaaaatactattttacactgtagtggagagtcttttgcatatagtcagtgacacggggtccccctcgcggtctcggccgccagaccatggccaccgcggggtcaatctgtcggcaactcgccatggcctccctgtgagccaacttggccgcccgacaaaacgtctctcgtcgtctgcgcgtctcttccccaccgaggctgaggcggcgttccgcagcgatgctgcgccttcaacatcatttcttgtcctccatccgcgcgtcctcccatcgccactgcagcctcctctctattgctaccactgccacttctcccgatcgattcgtcgctgaggaatacctggtcaccacctgcgggctcaccccagcgcaagcgggcagggcgtccaaggggctcacccacctcaagtctccggttaagcccgacgccgtcgtcgcctttctcgtgggcgtcggtctcgccaaagacgacatcaccgccggtatcgccaggtacccgcggctcctctgctccaaggtggacaaaaccctaacccctcgcttcgctcagctcatgagccttgggctatccccttcccaaatctcccgcctcattaccatcgtccccaacatcttcgtcgctcccaaaaagatctcccacctccagttctatctctccttcatgggttgcttcgatcgggttcactccgccatcaggatcaatccaatgctcctcagtcggaaccttgaggatgtggtcaagcctaacatagcattcctactgcagtgcggtctaactgtttctaatgttctagagttcccattgctgataggcatgaggcccgagagtgtcagggaaagggtggcatgcgctgagaagcttggtgtgccgcgcaatacagggatgttcaagagtgccctgtgggccgtctattgcgttggtcccaactccattggtgcaaaattggatgtcatcaaggcgactcttggatgctctgaggcggagctgacccttgtggtgcgcaagtcacctccaattctgaggatgtcagaaggcaagctgagtcgcgcattgaagttcctgaaggtggatgttgggttgaagcttcagtacatcttgcttaggccagcaatacttgcctttagcatgcagaggcggctgatgcccagacattatttcatcaagattctgaaggcgaaggggcttgtgaaggaaaatgttgacttttataatgctctttgtttaactgaaaagagatttgcccagaagtttattgatccttacaaccagagtattgcagggcttgcagatgcttatgctgctgcttgtgctgggaaaatgcctcatgaagattaggcgcattagcagcagcatgctagggatcatggtgaagcaaaggcagagatagtcggttcaggtcttctctgcatgtacttgaacagcccctcgccaaactattgtgcagttccttgatgcataccaatgcttgcaacagatgctgcctttgtgtgttgaaatgaaattagttcttccttaagaccggtgttgtgacctatcatttcaggtaagccattggctattttcagatgggtataatgatatgttactctgttctttctgtgtttcaggtctaaatattgtctgtacttgaagtcttgaattaattatgtattgaacttgtcacacagttaattatttgatttaatcaaatatttctatctgaagtatgattcttatttcaatattataaacaatatttccaactttgaatagttcaatgattgtcatgcagcgctctatggcggtgcactggtaagcagtgtatcgtattgtttgccaactatagatatctcatatctggatgcatttactttatccttgtaaaagaacacttagttttgtggcatgaattcagtaccactatttagtatatttattccaaggcctccatgctgtcagttggaatttgatttgctttttgggtgaatacagctcgtactcctgcatagcctccctcttttatgccaattagttattcttacaccttagaattctgacttagtaaagtctcttattcctctttgtagtagttattacaaaaacagtgaaatgaatgtatccttgttttgctattatttcatttttggtttaggttaatgatccgaactaaatatgaaagcatactggattggttgttctgttaagctctataaactgatcccccctccccacccctccccctc

SEQ ID NO: 14381 - DNA, 5083 bp, Zea mays
agtcgtaatatgaactaatttttctttcaatccccttcaatacacctcaatccatttcaatccctctacacccaaacaaagcctacggggtagacggtaggggagctgttggaggggttgctccccaaatattactctaccggttcgaaacctgcggacccgtcctgaaccggcccattcgccaatcatagcgggcagcccacttcatgcacgcaccgcgcatgtgagtcgtgtcgaacgaaggagcagcaaatgggggtgtccgatcgatgtgaagcgggtcgggttgtttcttcttttgctcagcctgtctagcgcctgggagccaggctccggctggccaagcccaatgcaaggggaggaaagtgcagtgttcggttgtcactttgccagaacttcgctgccgcgtctggctattttcttctgtctctgtgctttggtgggcatcacacggcatcacgcgtcgcgagccaggcgctgcgccggaggaatgaagaatttttttcccgcccgccgcgggcggcgagtctggctggcggactggttttgcattacacgaacctgctgtggccattggccattgcatcgccggggtctggttggggcgttgtgcattgcagggaccaaacgcactctgagcctcttagtttacggcccagcccacgacgcacacctcgttctctgggcgtctggaagcaacaggggcaccaaccagctcggctcctccgttccgcccataaaagatgcgccccactcccccccgtcccattcccttctccatccacaactgtcctccacacacacccacacacgccacactgaggagccctgagccctccgcccttaaaccctagcgagcgagccagcgagaggtctcatccccaccaacaccacccatggagctccgcctctaccacctcgcgctgctgctcggcctcgtcgcctgggcggcggctgctgccacgggagccgaggcgcagccggtgtgcgacccctccatcatcgccacccagatcgcgctcttctgcatgccggacatgcccacggcgccctgctgcgagccgatcatcgcctccgtcgacctcggcggcggcgtcccctgcctctgccgcgtcgccgcccaaccgcagctcgtcctcgcccgcctcaacgccacccacctcctcgcgctctacgcttcctgcggaggacaacacaccgtgggcgctcacctcgctgccgcctgccaaggtccgtcacctcccgccaccgttcctgttatcgccctcgccgccgcccgccgcgccccgtgcgcgtgagtgcggtgtgtgcgcgagggtgtgtgttcgctcggatcgagtggtggtctgccgtgatcctagtgtactgttctactgtgtcttcggatttggtttttgagcttttggcgtgcgtttttgtgtcatggtatttcgttgcgagttcccgtcttccgctgtggcgacgaacccgtaccgtacgtcttgataaagtttgttcgatttttcttcgcaagagcgctactactgggtgggcatatttggggcgagatcaccagtggctccatagtccatacgcgcgcgactcgtgttttttagcctattctatttggcctgaattttgaaaaagtttgttcgtttaattggttgccttctctgggcttgttttgccccattgatcacgtgacccgtttctgatgtttttgcttactgaaatatacatttgctttagtattaagcgacgcacggacgctgcgtttctttttcacttattcctttttgcgtcattgtctgcttgttctttgttgctcgaaagtttgctggcctgaattctgaacatagagagtaactgccctctgggctctggcctctgcaggagcaggctgcaagccggttgcagaacctgcagcagcgctgcagcctttcaggatgccggcaaagaccagccccgtttctcttgcccgtttgttttcttggcccgcacgaaatggcgccgcgtcgcatgcttttctacgcgagagacgatactgcccttgcactaattatcactcttgttgttttatttttgaacgtgaaattattgcatgtctgggcggactataacgctgttaaaaacttaaaatcacgtgctattgcctgcaggtccgtcacctcccgccaccgttcctgttatcgccccgccgccgcccgccgcgccccgcctcaagcagccaacacgtacgaagccgctgtcacctagtctgctctgtgctatttccgctttaacttttcgcgcgctctgtttgattgatgcgagaattggactaatccgtgctgtgcataattttctgttgcgatgtttggcaggcgaggcccctccccctccgccacaaagcgagaagccgtccccgtcgccccagcagcagcctggcgtcgccgccgcccacggcaaggccatccccaccagttcggccgccaacttctccacgctggcgccggccgccgcgcccacgactcccacgccaccacactctggctccgacaacgggtgcgtcgtcgtctcctccacgattgtcatcttcgtcatcgccgttatcaccatcctcgaatgagcctcacggcgccggcccggccggccgccaaccatcgccggtgcctggatagagcccgtagcagcagcagaagtcgtagtgcaactcgttttcaagatccccctttggcagtagtagtagtatcatcaccagtggtagctagtgccactaggtcatcgtagttctgttgcatctcagtatagtaacgtgatggctggtctggcgttttttctgcttggtgtcgacccatagatcgatcacttgcctggacgaagtgagtcgatctaataagagaatggactgtggccgaggggaacactgctttttttggttggttaatcttgtctccgtagttgaactatggtttcggaattcggatggatggtgatggaataaatcttggatggttcgatctggaccttattttttttcttgctcatgatatatgcacatggtaatggaatgtgaacttagatacacatggctcgttatttttatcttagcttattattgtttctgtttctgatcccatgttgcttgttgtagtgaagtttttggctctgcttgtgttttttctcgtttgttgctgatgataagttgatgcttaatggtcatagtctaattttacctgtagcatgtcctatctaatctaattatctcgtcgtagcttaatattccccctgcatattgttgtgttggtcatggttttaccagcagtgcttttgaacctttttggatgatggatttcatgtggactgctatgtatgtggtactgccgacaaactttgtagaaacatgaatgaatcgtcaacaatatagtttcactattttatggaagtatgtcatctctttcccgtttgtctgaaatttagaagtccgaacctgaatgaattgtcgacgtagtttcagtagttgtacagttttgtattgaaaacttaaacatatagtccgtggctccatcccttaattagtggctttcatcgcatttgattcttttcacatgaatatgtttatctattaattaaccaattaaaaataactaaaaagtacctccttcaaactacactagcaaactcctaagacgttcccgtcggtgataacagtggctataacggacctaacggcgacaagcccacccccactacacttatgtccgatggtacaattggtcatcggatataagagggctatatctaaacgtttgtcgtcgagtataagtcgactatgtttgggcgtcagcaataaccaaggcgtcggaaataataaattatgaatcatggaattatggaagatgatatgaaaagaagccacatgttggctgtaaaaaatgatcagacaattaaaactagctaaacaacaaaatatagaagagatggaggaggaggatgctgacgagaagtagtactatatatttctttaagaactttgtaattttattatttttattcctagttatttttatttaaatcatgtgattttcctttaattttttgaggaaattattgtagggagtgatctctacggttatcattcattaaagtttatagaaaaatatttaaagtttacagagaggagggggaaatgggggagggtagggagctagctctatgcactagttgtttatatttgttgtagccaatgtctgatgctattcgccatcgcgggctttactctgtacccgttgtaggtggaatagcttcaaaaatccaattatttctgcatctctagatacaccaggacatgatgattatggctagaggtggtaatagatcatggctttaatacttgcttcacaaactaacaaggcccttaattttgttagttcaaaattgtattgttttatgatccggccctaacttgactcgatccttaaatttgctaggctaaattaaatagcccgttaccacccctaattatggcttccattttccatggttttatcatttgtcgtctcgtcctctgcattgctaatgatgtttgggatatgggggggaggcgtgacactcacaagttactagcaacggcgtgcgaagttgcacctcaggaacaagtggctaatcgtttcttccatttgcaagatacaaatggggggcgtgacactcacaagttaccagcaacggcgtgcgaagttgcacctcaggaacaagtggctaatcgtttcttccatttgcaagatacaattttcacaggtgtatgattccaattccatactccttctgggtagtgatctagtatttagcatgtcctttaaaagcagccaaaagaagaccttgtgttttggttggcatttcgatttccatagccagcgatatatcgaatggatcggttcatggccgatcatgtgcttataggctttctgcgacgagtactgttgcgctccccacgtgcaccaccagtggtctggagtatttgtgatctggtatttctgcagggtctccccaagcagtagaagttgttgaaatgcctccatggacatggggatgtggaacatatctatgggttgtccgagagttttcg

SEQ ID NO: 14382 - DNA, 2074 bp, Zea mays
  misc_feature (2063)..(2063): n is a, c, g, or t
  misc_feature (2068)..(2068): n is a, c, g, or t
gggtacctcgaggccggcctcggggccagctggccccctccattttgttgcggtgcagaatcccacccgccggcaaaaaccctcttctccttcttctctccgccgccgccgccatggccgccgccgtcgcacgctcccgcgccgccgcggcgtgggtccgcctcctttccttgcgtccgcatagcctcgcgggttccaccgcactcccacgccacggccatcacctaggctcgcggatcacgccgccgcgccgccacctggcattctccgcctcatccggggacgccaggccccaccagaagttccagagcgagtgggtcgtgcacgagctgctcgctgaggtcgagcgcgagcgccagcgggagcgacaggaccgccgcgcaaaggacggcaaagaccaggaggaagagccggaggaagacgaagaggactacatgggcgtcaagccgctcattgagaagctcgagcgacgcaagaccaaggatatggccgccggcgaaggcttctgggagcccaccgactccgacagcgacgaggacgacgagcgctacacgcccgatgccatcaagcagcgcgtcgacgagttcgagcgcaagtgcaagcgccatgaggagttcctgcaatcattcgcagaggccgacaccctagacgaggctcacaaatggatgaccaaaatcaacaactttgaggagcgccatctcaagctgccactggagtacagggtcatcggcgacatgatgaaccgtctcaaggatgccacggggaaagagcgcttcgttctccttcagaagctcaaccgagccgtcaggatcatggaaatcaaggaagcctacgaccccagtaaccctgcaaactttgggatcatccagcaccagcaggttggttctcctgaggatgtcgtgctcaatgccggctttgataaggagaagcagatgatccaaggggcagaacttgaggatgtcgacgaggaattcaatgatgtgaaggagagggatgatattctcatagataaactcgatgctattgaaaagaagattgaggggaagctagaactgttggatcataccttcggtaagaaaggcagagctttggaggaggaaatcaaggatttggtggaggaacgcaattccctgtccgagaagagcaggagacctatgtacagaaaaggttttgatgtgaaagttatcgatgttaacaggacatgcaaagtcacaaagggaggccaaatagcaaaattcacagcgctattggccactggaaattacaatggtgttgttggcttcgctaaggctaaaggcccaacagccaagattgcaatacagagagcgtatgagaaatgcttccagaatctccactacatggagcgatacgaggatcacacaatcgctcatgctatccaggccaaatatgagaaaacaaagatatatctctggcctgggccaatgaggagtggaatgtctgctgctggtaggactgttgagactgtgctgtacttggctggtttcagcaatgtcaagacaaagattatcggatcaaggaacccacttaatgtgattaaagctctcttcatagctttgaatgctattgaaaccccgaaggatgtccaacagaagtttgggcgtactgtcgtcgagtcatatttattgtgatcatcatgattgtttggaggacacagaggcgagcggagcctgtataggttttgccatgagaagaccaaagaggcaaatgccaggtccaaccaacgtgagccctctttgttttggacttttggtggtgatgttgaccagaccattgatgttgaagtggcaagaatgtcagtgtcaacagtaatcggataaatagatggtatttccctgaccctttgtttgtagaacttgaatgaacctggggacagaaacacatttgagggttcttgtataaatcaaggtcaagatcagaattgcctcgtcgtgcctttgttttgttaccatagcttcttctccctacatactgttgtttggatgataaatttaattgaatattaatttctcccgaaaaaaaaaaaaaaaaaaccctgggggggncgttncccaat

SEQ ID NO: 14383 - DNA, 1362 bp, Zea mays
cctgggccccgctcgggccggccaggcagaaacccccttccttcccattcccactgctcggattgctttccccacctccaccgccaccagaccagatagcaagcaaccgacccctcctcgctgtattcgcagggaaggagaagatggagcctggccagagcgggactgagcaggcctctccacgcgggaacgattgggaggtcgtgcagctcaccgcgtccgcatacgccgccgcgcccgctccgaggaagcccgagccctccgacgaagcggaagctaagagatacggcgcaaagggggacgatctagccgccggcctactcatgtccggccacttctccgtgtctcagagcgaggtcgagagcctcctcgtaggcgccgacaccaaagaaccaccgcccaaggacaaggaggagccttgcgagcatactaagctgctggaggacgacgtccccaccatcccgttcgatgacggcaaggcgctgaaaggcatgggtctggtcggggaagagccggccgggttctcgtcgcctgtctacagctccatcacggagagcaggagtgacaagaggagcgaggagcctactactctgcatagtttcaaccccgtgactggctcaacaaaggtcgtctcacctgacgagcagagcgagcctgctgctgggtctgggtccgggtctgggtcaggcccgcgtgaagcgtggtggaagaagcagcttctctccctttacaggaacgccaaggagagcaagcatctctggcctatcgtcgccaccactgctgctttggtgggcctggcgtatctggggcggcgctggcataagggcaggctgcactttcagctgctcaagatatcgccttctaccaacaaggagaaaatcagcgacgcggttggaccgttaaaccgcatcaacgacattctcgttgctggcaaccacccaagtcacggtgtccatgggcatgcccgtgcaggctgaatgcagtcagttcgcgaacccatcgggcgtcctggacccatatactatcatgtgtcgctttgagaatcggctcaagacaaaccatcgggcaggactggagtagttgtccaaggactgaggatgtttatgcagacacaagtatgtttggtggctcgatgtatgtgaattccaaaactccatctgggtatgtaaatatttgtatgggtttagtttggttgctttttcgtttggtcatctcatgaaacctctgctggtggtttccttgtctatattactgtcttatttggggttcgttcatgcatgcatacatgtgatggggcataatatcactggattttatttcaaaaaaaaaaaaaaaaaaaaaaaaaaaaaaaaaaaagggtta

SEQ ID NO: 14384 - DNA, 963 bp, Zea mays
ctgttctccaccagccccggaggtcgacacgtgcgccacaccatagggcagggcccagggagcccggcgacctccatctccatggccgagtgcgaggagctggtggagagcggcggcgccgaggaggacatgccccgcgtcgtagccgccctcgccggcatcctggagcgcgtcgcgaaccgcaacgacgctgcggcggtcgcagaggtctcggccgtagccccggcgtcggcgttccgggcgacgacgaagccgggcatctcggtgcgcgcgtacatggcgcgcatcgcgcggttcgctgggtgcagccccgcgtgctacgtcgtggcctacgtctacctcgaccgcctcctgcgccgcggccgcctcctggcgctggccgtcgactcctacagcgtgcaccgcctcctcattaccgccgtgcttgccgccgtcaagttcatggacgacatatgctacaacaacgcctacttcgccaaggtcgggggcatcagcctggtggagatgaactacctggaggtggacttcctgttcggcgtcggcttcgacctcaacgtggcgccggagacgttcggcgactactgcgccgtgctgcggtcggagctactgtgcgcggaggctgcccccgcgccactcaggctgcagcactgctgcctgtccgaggatgacgccggggccggatgcagcgcccagcagcagctcgctgcatgaatgaaagaaacctaagcccatcgatcgatcgacgactcatccggtggcttgggcgcaggagttgtaagccggtgcaaattgttccaaattattagatgttttgtcttttctagattataaagctttcgatatatacacacatctatatatacagtgtgtctagaggtgtagtggtggtgtaggtcgtcgtcggttgtaccagctgctacagtagattgtgtatacagtgctggtgtctttggtgactttctg

SEQ ID NO: 14385 - DNA, 982 bp, Zea mays
  misc_feature (103)..(103): n is a, c, g, or t
  misc_feature (122)..(122): n is a, c, g, or t
catcctaatcgaaaaagcccccggaggtcgacacgtgcgccacaccatagggcagggcccagggagcccggcgacctccatctccatggccgagtccgagganctggtggagagcggcggcnccgaggaggacattccccgcgtcgtggccgccctcgccggcatcctggagcgcgtcgcgaaccgcaacgacgcggcggcggccgcggaggtctcgaccgtagccccggcgtcggcgttccgggcgacgacgaagccgggcatctcggtgcgcgcctacatggcgcgcatcgcgcggttcgctgggtgcagccccgcgtgctacgtcgtggcctacgtctacctggaccgcctcctgcgccgcggccgcctcctggcgctcgccgtcgactcctacagcgtgcaccgcctcctcattaccgccgtgctcgccgccgtcaagttcatggacgacatatgctacaacaacgcctacttcgccaaggtcgggggcatcagcctggtggagatgaactacctggaggtggacttcctgttcggcgtcggcttcgacctcaacgtggcgccggagacgttcggcgactactgcgccgtgctgcggtcggagctactgtgcgcggaggctgcccccgcgccactcaggctgcagcactgctgcctgtccgaggatgacgccggggccggatgcagcgcccagcagcagctcgctgcatgaatgaaagaaacctaagcccatcatcgatcgatcgatcgatcgatcgacgactcatccggtggcttgggcgcaggagttgtaagccggtgcaaattgttccaaattattagatgttttgtcttttctagattataaagctttcgatatatacacacatctatatatacagtgtgtctagaggtgtagtggtggtgtaggtcgtcgtcggttgtaccagctgctacagtagattgtgtatacagtgctggtgtctttggtgactttctg

SEQ ID NO: 14386 - DNA, 4831 bp, Zea mays
ggccttatcctccgttctattctataagagaggttctgataaactctcccccacctgttctccaccagccccggaggtcgacacgtgcgccacaccatagggcagggcccagggagcccggcgacctccatctccatggccgagtgcgaggagctggtggagagcggcggcgccgaggaggacatgccccgcgtcgtggccgccctcgccggcatcctggagcgcgtcgcgaaccgcaacgacgcggcggcggccgcggaggtctcggccgtagccccggcgtcggcgttccgggcgacgacgaagccgggcatctcggtgcgcgcctacatggcgcgcatcgcgcggttcgctgggtgcagccccgcgtgctacgtcgtggcctacgtctacctggaccgcctcctgcgccgcggccgcctcctggcgctcgccgtcgactcctacagcgtgcaccgcctcctcgttacccgccgtgctcgccgccgtcaagttcatggacgacatgtgcgtcctccgatcgcctctactctccatgcctatgccctgtggggtatcgcgatcaaacgaaccaactgtcctgctgaatttgcggcgcccctgcacatgatcgtctttccccattaggtatttatttgtcggtctataactgggagcacgtaggtcaagtagcttggtgcggttcactctgttcttggtatgttcagatgttcttgattctgaactgtccatgtgctattcgtagaactcctggattcaaacaccgtgatggtcaattgctcgggagaaaaaacaattggaccacctgattttctcttctttggtattaagatttatctaccatggaaaaattcaaatgctttggattcttgtgcaaagagtagctgtgacaaagtgctctattagtactagactattagtacaactttacgtaggcatctttttgctgctcccctgttctctcagctcccaagtttcagaattctgctaggcagccaggaatagtttaggagtgccgtccaagtaactctagcatcatttcctactcctggaaggcctggagtctccagaatcgcgtcccgtttctatccaattgttcagtgaagttgcttctgataaacgtgaacaacaaaaaaaacaaacttttgatgacattatcacgcgtccaagtgtcggtgggtgttacagtgtcatgtacagaagcgtgtcctagtggcataagaaaagtgtgccaaacactcatcagttcagaattttggcggcaatcatcgatgcaaacatacactaccgcgctaatgatgatagaaggtaaggttgttgtagcagtagtagtaggccgcggctaggctgggctctcacttggacagttcaactgtgctatgtgaagcttggcctttcattgggtaaatccaagccttcaattctgtcggccttgcaaacaaaggcgggtatcgtccacggacgacaaagttaagcctgtccagcgaagcgacccggctgttcctcagttgcttgcgtgcatccaaccacgcacatccaccgtggacccgaagacataaactagaattccaccccttcccggccccgtcacctctgtgcggcttggaatttaattctggcgccagttgtaggggattgggactgccaacttgcccggccatctgctgctggcctgctgctgatgtttgcccccttgctcacttgtcacttcacttcttcctcatgcctgcagggtcccaggagcatccacacctctagtctcttcttgttgctttctgctttagtctttgcttattgggcaacttgccattctttaaaaaggctccgttcggtggcctgtttggtaaaactttgttggtcgcgctctttgttcggttgcatgattgttctgaaacttctactgtaattttgccgtcaatcattggcgagaagaagttacaggcgttgagcactagcttagtactgaaagatagagtcaaactggctagagctgatctgcgagtgccgcctgatcttgtatcatgtgacgacatatgctacaacaacgcctacttcgccaaggtcgggggcatcagcctggtggagatgaactacctggaggtggacttcctgttcggcgtcggcttcgacctcaacgtggcgccggagacgttcggcgactactgcgccgtgctgcggtcggagctactgtgcgcggaggctgcccccgcgccactcaggctgcagcactgctgcctgtccgaggatgacgccggggccggatgcagcgcccagcagcagctcgctgcatgaatgaaagaaacctaagcccatcgatcgacgacgactcatccggtggcttgggcgcaggagttgtaagccggtgcaaatttttccaaattattagatgttttgtcttttctagattataaagctttcgatatatacacacatctatatatacagtgtgtctagaggtgtagtggtggtgtaggtcgtcgtcggttgtaccagctgctacagtagattgtgtatacagtgctggtgtctttggtgactttctgaaaaaaaaaaaaaaaagttccggtagcgaaggtaacttgaacaagcaatgaggtgcgccatgcagtgttcttctccattggaagcagcgatgcgccaaccactgcttaaaggtaagggctggggagggcggtagggctcacacgaaagatacgaatccgatcgtatggctggcaatgataacgtgcaggcacccaaatctttggtacagggactccgcaccacgatggactttgaacatggttcccgccggtgcatgagtaaaaggccgctctcggtacaaaaattccatattctcgtttaatagagcgtgaaaaaatcaatgcaacgagtgtagttgaaataatggcttgttgtgtatttaattcaaccgtggcttctacagtattttgtctctatagatcgtaactgtagcagtctgaacagttgcagtaactacggctgcagaacagctgagcagtattagaagccttactatgccacaaaattaaatgcggtgagcttatttgaaacataaaaactgaaactaggcattatgctaaggttgaccgttgacctagccatggatcaaatgttggatgtgtttggttcggtgtcaacgagggatgggacaggatcaaccatgagttgaccatgtcccttattttttgagagatgacctcatccactatttttgaataatattttttgacccttactctagacttccaaaccaaacatgagtcaagttggaatgatcgcatctcatccctcttcatcgtttctcatccatccatccaaacactactaaggtcttgttcggttagctcacaatccacatggattgagtgggattggataggtttaaatctcaactaagtcaaaccctttttaaatttttttccaatcttatccaattcatgggtaacgggattaaccgaacaaggcctaatgtggcataactggaatttggaaacaacataatggaaccatcaacccaactgaggttggtttaaaagtcaatccacgtacgactagtgatgatgcactctggaggcaactctactcaggccacactcaattctcaatgactcaaacttgcaaagtagcactacgacttgaccctattttgattcagctaacttttgggccattttaagttttcgtatggcccagtttggccaaacatgccctgccatcagcccattaggaaaagggttcgtcttcgtgcggtgggagatgaacgcgggcgttgtttccgatgggaagcgcttgggcttggacttggagacgctctagatgagctgccagacggccgccactggcttggagacgctctagatgagctgccagacggcgacgagtgacgagtgacaggccctcctcccctgagggctagtttgggaggctcaaagcccagaggattggaggggattttagcctcttcttattcaattttaaataataaggagattttagcctttttaatttattccggattttagacttccaaactagccggaagcggcgtggatggagaacctcgcgaccgatgcgaaaaacgaggttccgaataacagaggtggcgtcgcgatggggatggacatacgaccaagcacgacgtaggctggacacgactgtttatcctttcattttactctgaataaaggaatagacaatagacagaaaactttgccagtttttgcagcaccaaaaaaacagcctctattcgttttcaagcgagattgagtgactgttccagttcacagaatcacgtggccggtgtaaatcgccggaggacgggtgcctaacagtatcgacggcgatcgggctgccaaagagggcgattcgctacccaaagatggcgaatttcctgtggaccttgagaacgacgtagtcacagcagatccccatgggatagccaagcctagcgatctcccgggttttcagaacaatggccctgccgaggagatcagtttggccgtgaacaactcagagtatattgtatgacccgtgggggcactgtaccaggttgcagaaaggggcgcaaggatcctgcgccctggaggttccagagagggtacaagcccaagtggtgacaaggtttatggagaggttctgtgccaattacggtgacatgaagtatggcgaaagcatccctggagtttgtgtaatacccaatttgtaagagaaaaaataaaaggggaagaaaatgttatttcctttatttcatacgcgtgggttggacctatttgccatcacatgtgagccatctctatttatcattccatgaggacacctcacttaaata

SEQ ID NO: 14387 - DNA, 2862 bp, Zea mays
  misc_feature (1789)..(1789): n is a, c, g, or t
  misc_feature (2031)..(2031): n is a, c, g, or t
  misc_feature (2246)..(2246): n is a, c, g, or t
ctcgaggccggccgggcttcgcccgcggatccacacgctaccctcggcaccgtagccgtctgccccgcgctccccgttccccttcctcgctccccaccagtccgtcccatccctcgcctgccttcgcacgggtgcgccgcccgctcgacagccacgccgcgccgcgccgcgccgctcagctgcccggcacccgcccttcctcgccgagctcgggatcgacgtctcccgcacctcctccgcgcccgttccgggctccgcatccggcctctcccccgtccccaaccccattccgcagcaggcgaccagcacaacatctcgaatcccccgcctcgcattcggctcgccgtcgctcctcctccgcgtcccgccaccctccgcacgcacaagtttactatgtctgggatggcatctgatgattcacctgcccaagtgaatgttgaaggagatgtttcagagaaaaaagtagaagttcaagaccagaatgaagtgggtgggatgccctcacgacaagaggaggaggcagcaattaagaaaaagtatggaggaatattgcccagaaagactccacttatatctaaggatcatgaacgtgcttactttgattctgctgattgggctctaggaaagcaaggtggtgttcccaacaagcctaaaggtcctcttgaggcactccgacccaagcttcagcctacgcaacagaatgcccgcgcccgccgaacttcatatgcgtctgcggacagtgacgacactttgaatctgtcccccgaggatctggtcccgcaaggagaacccagccagcagggagaaccagtcgaggacaagaacaaggaataaacacatgcccagcatagctactgtactgtaccccttttcatacacaagatgccattttccgccgtcgcacaaaaaaaaaacttcttttgccttggtaataagcgtgttgattcggttccggcccaacggtcccggtgaggctgaggttgagacacgtgcagcttgaactgcatgtgagatgtggtatccgctgcactgggctgttgggggtccttgggatgcatgaacaaataaacaatgatgcttgcgatgtttacattgctgtacctggacctgtgttacctctatgcaaacacatgcaaatccgatggtccgagactcgaaactctcccgttgagctgaaggagttgctgtactaataataatgaagattttttttttgttctaaaaaagaaaaaaaatgcatcgcaatgctttcttttatttgcaccctgtgcatgttattattattcgcctgcttggctgtcggggtactggttggtgcgttttttctctgtaaatgagttctgcgcccctatgctggttaacaactagtgtattacgcgcgcccttgctcgcgtactgaacaacagtgtgaaataataattttatgagcatgttgaattagatatcgtatcacggtcatatgtacaatggaaatagtagttatgaagcaaataagtacataagtacatgaacaaacttaaacagatttgtatcacgatcatatgtacaatggaaatagttacataagtgcatatccaaacttaagtagattgtagttcttacaacagttatagagtaaactgatctgctaatacatagtattaagtagtatttgagtaccatacatcaaagagttaactacacttcgttcgtgggggttgcatgaatatatacaaagatgtaaaggctttagcagtttggttatctatacacaaaggcattcttgcttcaaaagtgatgatgctacgcnaaacaactacctatacataaacacgaagagaagatcaattatgtctaaagtgcttgttagttactatattgttgtgcaaagtttagagggggcgaggaataatatacaaactatattgttactaagctctgtacaacaaaggatcatagatggcgttgtaccttcatgcaattcacaacaatctaatggtaatggtattggtgtctatagaatctgatcgaagtttgtgaagttggctagantttatcctacatatgcattatgcgatcaatatgaattacaacctatagctataaaaagaagttatttgccttttgttttcaataatcctatataccacatacttcttaggtggtgatgaaaagtcttctttgttaagttgacttgcattttgctcatcgtcctatgattaagtggataagaactataaaaccattttgctagtttaaagtagtanagttgttctctctctttttccctttcagaacatgtatcaagggataatggactccaatatttgttattgtggtgttaagaagagacaactaagtaactttagcaacatatagtagctaaataacaataccaaacttacctctgtattctgtagcgcatgggaatatgcaaggctacgtcgtgcgtggcaaacatatttgatcagactgtatacatataagatgttttaaaatagttccaatcagtattaaataggaatcatttaccacatttttatgatcgatgtgagtggatagtctagcaaacgatgtcgttggagagttctatgtggttgtaagaccaaatgtcatcctgtgtgagcatttcttgttggggatattatacatggtagatgatactgatgcttgtcttccaagacttgttagcacagaggaaacagaaaagactattggtgacagagaatgctgacatgttaatggtaaccgcaaaggtaaacttaagcgacacattggtaccaagtctgtcggaggaccttgagaatcattcgctgttctaacaagggtttcacaaggctttctactatccatctagctatattatcgaaacaaaaaactgct

SEQ ID NO: 14388 - DNA, 1428 bp, Zea mays
gagccggccgggatcgttgccggctgccccgcgctcccgttccccttccgcgctccccaccactccgtcccatccctcgcctgccttcgcacgggtgcgccgcccgttcgacggccacgccgcgccgcgccgcgccgctcagctgccccggcaaccgctcttccttcccgagctcgggatcgacgtctcccgcacctcctcgcgcccgttccgggctccgcatccggcccctccccgtccccaaccccattccgcagcaggcgaccagcacaacatcccgaaacccccgccgccccccgcacgcacaaggttattatgtctgggatggcatctgatgattcacctgcccaagtgaatgttgaaggagatgtttcagagaaaaaagttgaacttcaagaccagaatgaagtgggtgggatgccctcacgacaagaggaggaggcagcaattaagaaaaagtatggaggaatattgcccagaaagactccgcttatatctaaggatcatgaacgtgcttactttgattctgctgattgggctctaggaaagcaaggtggtgttcccaacaagcctaaaggtcctcttgaggcactccgacccaagcttcagcctacgcaacagaatgctcgcgcccgccgaacttcatatgcgtctgcggacagtgacgagactttgaatctgtcccccgaggatctggtcccgcaaggagaacccagccagcagggagaaccagtcgaggacaagaacaaggaataagcacacaagatgccattttccgccgtcgcacaaaaaaaaaaaaacttcttttgccttggtaataagcgtgtggattcggttccggcccaacggtcccggtgaggctgaggttgagacacgtgcagcttgaactgcatgtgagatgtggtatccgctgcactgggctgttgggggtccttgggatgcatggaacaaataaacaatgatgcttgcgatgtttacattgctgtacctggacctgtgttacctctatgcaaacacatgcaaatccgatggtccgagactcgaaactctcccgttgagctgaaggagttgctgtactaataataatgaagatttttttgttctgatgttgcctatagatgcatcgcaatggtttcttttatttgcaccctgcttggctgtgggggtactggttggtgcgtttttctctgcaaatgagttctgcgcccctatgctggttaacaatgtgtttggtttagctataggttcaagtgaactgtgagtaagctgttgctagttgacggttgtgtgagaaagataaaagtagtttgtcccgtagacactgccctgtacgtatatacgacgtgccgacgtgccacatttttatattaccaccttgtttgtcccgtatgtccattcacaaatatatatgacatcgttgattttttg

SEQ ID NO: 14389 - DNA, 1054 bp, Zea mays
atttggaaggacacaagacgctgccaatctgaaggaggaggagacagagatcaaggccaagtttgttgatattgaagaggccaaagactcgggtggtggcgcagggtccgtgggaggaaagagtaaagagggaaagaaagacagagagagaaaggaggaggagaagtcggtggagcatgaatatggcgaaggcgatgagaaggcgatcaagaagaagccgggacggggcggcggccggcgacggtaggaagatgatggagattctgggaaggcagagaaagataaggaggataagaaggctaaagagaaggatggatcagagttgaagggttcaagtggtgagaaacaagagaaaatcaaagataagaaagagacaggagatggcaaagatgtgggggaggaagagaaacgcaagaagataggaaacaaagacaaagataagaaggataaaaaggccaaagaaaaggatgtatcggaaccaaagggtgacaaggatgaagatggtaagaagaaagaggccgatggcgatgaagacgaagaaggtaagaaggaggacaaggaaaagaaagagaagaagaggaaacacaagggtgcaaaggagaagacgaccgatccggtgaagctgaaggcaaaactggagaagatcgatgccaaattgcatgacctacaggccaagagagaagacatcctgaggcagctgaaaaagctggaagaaggcggcaagggaaacgcgaatgaagaggagcctgcacatgtgcaggaggacaaagggaaggatgttgtgcctgcacagatactggaacaggttggagagagcaaggtcgaggaacagaatcctgttgccacagcctgatcctgtggacctcctgtagcggttcatgtaacaataactctgatctggttttgcacacatgcattacacagtgtaaaggaatgcagccatatatggcgtgtttgaatgcctggatgggctgagacatgccctggccgtgcatcttcaattgtttgtgtgcatagaccgcatgggagcttggagcttgtgcgctgcaggtcg

SEQ ID NO: 14390 - DNA, 4226 bp, Zea mays
atgaaacagctcgcaagtaggcctaaacttcctgccagaaccgagcggagatcatctggagccgggtcccggcgattaccctgcgcggcgccaatggagcccgaggcggcggtgttggcacagctgcagctgcagctcctcgtcctcgtctctgagttccgccatctccgcgagcgggagcgcggcgcccgcgaggagctccgagacgccggccagaggtgggaggcggcggcggcggaacaacgtagggaggcccgggagctgcgcgcggaggtggcctcgcgggacgactcgctacggaggctcgaggccaggataaaatgccttgagaatgagaatgagcagctggagaaaaacgaaaacaacttgaaaaagcatggatgtgctgcttcaatccagggaggctttcataaaacactatgaggcaggcaggactctacttgttctatgcagtggacaatccagctgaaggataaacagattgctgtaatgtcagagaaattgaattcacatcttgttttgtttagttcggtagaaaaggaagttgctgctgtgaaacaagtactaggtgatgtgcattgtctagttggtgagaaggaaaatgtagttgctgacttgaaggataaagtccaaaggatttctgtgcttgagaaagattttagaatcttaatttcttggaaagcaaaatcagtgcataccagcttgaactccgtagtagggcgaggatcatatatgagttaaaaaattgccttcaggatgagaagcttaacagcagttttcagccccatctggaagaaatatccattaactaagtcaataaattgcatatgtttaatcttcagtttatgtcaaaatcatgtcggttgttttctaccttaatgacgttaccttaataaaactttgttggtgaaggattacgctattgatagattaacttcagagaatcaggcaatgcgtttggaacttcataacatggaaattgctttacagaaatttcaagatttattcagtagtattgggcatgagggaatgaatagtttttcagcaatttctgaaaatcaggacgtacaggatgtgaataatgaacaacatgaaagggttccaggtacacaatgtggtctagcaaatgagcataccttggtaactgcagttgtcaaagaagccaccacacaaaatgtagatcaccagttggaaactgatccaggcagcatgcaagtacaaagcccagtgcacttcaagtctggtgcaatgccatctccggagctagtagctgcaaatacagaaaaagctgacagccttcttgaacccaatgtagacattggcatgggcagtttatctcctgcacgaccaacagattgtttgaatatggatcttgacacggagagtcagtcctgacaatgcaatttatatcccttcacacctggtattcggatacgtatatctaacaatctcgtagttggttgtggagcatattttattattttcttgtagttgatcaactgtcttgtgtgcgtagcctgtttagttagccactaaagagatagatcaggtagtgtaaagagcatcttggctcatctctctaccgccacaatgtccgagattcggatggcagctcagctgatgagaccgaggagaaagaaatgatagctgtcattgtctcttgggataaatctgagggctcttattggaggagatgaaaaaaaacagactcttaaaaataggaggggctctcaaaagaaaaatagagagctatatttcgagggctgttgctagactggagatgctctaaggtgtatttgttttttggcttttgttctaagactgtctccaacaacgttctttatattcatcctctatatctgtcttttacagtcttctaaaagattcttttctctatatcttctctatctctagcagcgtcctctatatctcgtcctttatacataagtatcgatattagagacataatttacttttaatttttgcacatatgtatttatcatactatcaaatgtattatacacattttagtttaatatgtggtgttaaactaaaatatgtagagatttttgttggagttagtctaacatagggtgtcttgagaaccatgtcagcagtattattgtacattgcaattgttgaacgtcgttgatatgaatttaagtcaaccctatatttgttaataagttctgtcaacgttacacatcgtttgcttaattttgtaatatcgagcataatatttgttatgtaacccttttttctggctaactttacacgaagaaaatagtaacaacactattatattttcatttgagcggaacaatttcatttttacatgatctttttaaggggtcgaatttgtgttgattctttcgagaggaatgtagttgtttgcattcggcctaaaaaccttttaattaagaagacgaagtggcctaaaagagatcccatgaggctgctgttgtctgtttgtcgtccgcagttgctgtctttaaaatgtgaaatgtcttggtagtgtactgggcttatcgagttatgggacactgctttatctttgatctggctaaggatggaatgagggcttcactgtcaagacaaatccatcaacccctcaggctgaccagctgggtgtagctgcccctcaggctgaagtcgccatcttcttcaccttctgatgggctcaactgtagcaagaccgaaaagccagcaaaacaacaccagtaattttcagctgaagcgtctggggatgatgaccactgtgaggccaggacactgacattaggctcctttttccttaccatgacatcggtgagatccacactccgctccttagggccgttcgcttctacaggaatgaactaggattcatttcagctcgccaaaatttatataaattaaagaagtaatccggctaggaaccattctagagctccaatccgtgaaaaccgaacagggcccgaggaagttcatgaaccctggaagttctgctcatcggtcgggcgataatgcccgctgtgagtgaggccacacagcctgaaacgaccacatctctgacgtgagcgaaaaaagaaaccagtgtactgtacagatatctatgccacgcctagggctgacaatgggctataaaacggccacaccttgagaatcccatcttccacaaccagtcttcctgcagcagacgtggctccccctgcaaggaagcttgagtgctggaacacgcccttcttctgcaaacatatatgccgaagtttcggcctcgcttcagtcgctgaatttctcccagtgttcaaagagaataccgtccgaaactgtcagtggattatcattcacctggtctatgtagagagtcttgcatgtactgagcacaaagatccacttgctccccttgtcgcttccagccgtgtcgactatctgacggctcagcttgtactacatcagcctctttctgcacaagcatgagacgacatatttggttaatgctataatatgacatctgcagcacctaacaggttctattctgcctgaatatattcttgtttcacttcaaatcagaggaggggcaaacagtgaaacttacagggccaaggtacttgatgcactgcttgtgcaacttccatctagagcaaatgctcctctaagaactagtttgagaactacaattttctaagggatttttatttttccaaagaaaaataaactaaattcctttggtaaaatagaaatcccttagaaaaattaggttctcaaactagccctaagttaacatctttcccttctacgtccaacctgtccaaggaattacagtcagaaccatcggtaggtacccacactacgtaaaaaaggcttaaaggggacgtgaccatctgtgacacttgttaaaaacacatcactaatttttcgcaagtgacgtattttttataaacatgtcactaataattgtggacacgtgacatctattataaaaacacgtcactagcaaaatatggtaacaagtcagttacatcatttattttacgtgtctgtactatgatttgtttagtgacatgtatatataaacatgttactggcttcagatgtgaaatctatttagtgacgtgtttatataaacacatcactggcagcttcagacgtcgtatctatttagtgacatgtatttaaatacacgttactaatacatatacattagtgacgtgtatatataaacgtgtcaccgacctcagacatca

SEQ ID NO: 14391 - DNA, 750 bp, Zea mays
  misc_feature (715)..(715): n is a, c, g, or t
  misc_feature (720)..(720): n is a, c, g, or t
gcacgagaccattacctagaacatcctaatcgaaaaattcgagaaacagtagaagactaacgcgcgacgtccattcttctatcagcggaggacttccagattttttgtcatcgtgatggaggaaatgaaagccaggacgaccaagttcgcagctatcgttcttgtatttgctgtagtcagccatggcctgatgagccctgccatggggatgctcgagaacaagggtgccggcggagagacgacgacgatggccacggccaggtccgcttataagcccacgcttggtgttggcggtggaaccgccgtggacaaccaccatgccatcccacgagaccagtacagcagtcatggaggagacgacggagggagtggtggtgatacaaacaactagtgcgcaagcatgcagctgctcatgttctctctgtgtggtgccagtttctacatatatgcatgttgctctgtttgcgtggaagacaaaggatatatatgtaattttgccgaaacactagttttcgtgatatatcttgtacatgtatatatatattgtacaaaaccctagtcttgtagcatcacaaaatctaccctctgcttgtacatgtatatactgcaccgcgcgctgattccttaagagcggtatatgtatatgacaatatgataaattaacgatgtttgtgtaataatatatttcagaagatatgtgttttaaccaaaaaantaatnaaagagggcgcgccgctcagaggatcaagc

SEQ ID NO: 14392 - DNA, 1657 bp, Zea mays
ctttagccactcgaccaacagttttgatgtcatatcatacaacaggacctcacctcccaccttcacaggtggctcggccaccggcttctggggctatccaactgcaacctgttttacctggaaaccattccagagcagcaccatcacctgttggttcaatgcatccacgacatggaatctacagagctgttggagcacaatcacgtgggcctgctcctcatctccagcaactcaggatgccagcaccgtttgcaatggttcacagagatggacagcatccacccagtatcatgaatcccggggttataccatcgagacagtctgtccatggtaattttgaaagctctgcttctggcaatgcactggcaggtatctcatttgcatccatggcaccaagttcaggtcaccaggcgatgtcgtccacatcagactcacatccagttttcccagcatcctcgcttctaccaggttcaggtccagggtcgatgacaaactttgtgcggtcaagtaccagaatccctgttgtcatggcgagcgaacaagcaccacgcctgaatccatatgttcaccacatcggaggtggtccactgaacgctgcaccagcaggaattcagcaagctagagctcatataggacgcactcctcaggctgcctcagatcagagtcaggacgtgctgcatcgcctactactacagttgcccgaagtcatggcgccaagcttagctcagccaaccgcatcaagctcacacccggctcccatggcagcccggcagcaagcagggctactgaatccagctcctgacaacgtggcatgtccactgaacgcagtggctggagttgggcgccccggagcccgcataggcagccagtcgtaccaggtatcggcttcgttgctcgagtgggaggcgacgctcagggttggcctgattcgtggacaccaaggcacgtaccccttgggacagggatgttctgacctggctggaggaccccccggcacatccgctgcccagggatgcggctccggcgccagcagagaggtggtgtgcctatctgatgacgaggagtagcatagcgtagagagtagtagttttttttttgggctgggctggtctgtgcaacgtagatgtgcatgggttggataggcaacagtagagcggcacgatatcgtcgcccccttttagcagcagcggcatccttggaagcaggagatgtctggctctgatgagggtagtatgtcgtatttttggggggtgggggactggtggcgtggcgtggcggcagcagcatattagtgaatagtgatagcatatgaaccctaattctgatatatagtcttgtcgtttcatagcctggtggtgattgtttggtgtggggctggaatgatcatatattattattatcggtctggttgtggatgtggtacttggtgttgctgaggcctttgacctgagaaatgtgattgtgcctcggatgggatctggtgaatgtgttgttggcatggcatggcatgtcatgtcatgtcatgtagctgggaggatcggtcacatgcctgcctgtgcctgcctggtggcgatggctgtttgtttgtttagtagcgcgtgaaaacatgttggtgcggtatatgaatgacattgggagggagactcactgcaggtcg

SEQ ID NO: 14393 - DNA, 947 bp, Zea mays
taccggtccggaattcccgtaatatgcaaaggtcgacccacgcgtccgtgcaacagaatcggcatgtgaacacagatggcaggattgagttacctgctgaccaagtacagcataaccaggtaatgtcatctgcctcacttgcaagaagtacagattcaggcagcccaggaatctcatctataagccagcggaaacaagagtcatctcatgacccaagtgcaattacctcaacctcgcagctagctagctcacctcaagacacctttgttggaagtgatagggtgttgccatcatccagccaaagcatgccgcaaaggcaaatgtccggtggtgtgcctgtacatggatatggcattggtggccaggtgcagctacaacagtctcggcagcaactccagtctcagcagcagcagcagcagcagcagaggcctgttgtccaaggtggtgtatatgctcacccctcaaattcaggacaaggatgatgctgaaccatactgggcctgcatttctgaagagcctcccttccccttgtaaagttacctgtacaggcgtccgtgctgtggaagatgtgtgcggatgatagtgctctttattcccaactttgagctaactgtagcctcctcggtgccaggtagataattatttctcctcaccattttggtgccacactgctaccttccatgtagtttgaccctaggttgctggaggtggttcttgtgagggcaaactccttgagtcgtcaaattgtaaccacgacactgggcccagttgtatatttttgccgttgaggtccatgttagaggcaatctcttttgtataagcctgtatattcagctcacaagccagtcaatgaatgcaaagcctttctttgcgtcaaaccaggaatgtaaaaagctcgcgcgcccggcgtcgatcacttatcttaacttgtggtattcaactccgtc

SEQ ID NO: 14394 - DNA, 2286 bp, Zea mays
ccccgggttggttggcttggaattaaaccgatattttagcctagacaaaatcctatatatctatctctactaactataaagaagctaacgtataccatgccgtgctcccgcctccccttatcgcgcgtggcatgcgccacctaccctcccactgcatgcaagcatgcaattcgcagcagctgcatgcaagccgcagaacactatgcaagcactgacccaccaaccgcacgtatctgtaccaggtgtacgcgctctaccgcgccggcttcgcgggcgtgccgctcgatctcacgaccatcggtgacctcttcgccgtcagccgcttcatggtcgcgcacgccaacaacctctccaccacgaccgtgcccgccaacgggcagccgctgctcgtgccgctccagtgcggctgcccctcctggtcccccagctcgtacgcgccgatgcaataccagatcggcccggggacatctactggatcatctccaccaccaagctgcagaacctcacgcagtaccaggccgtggagcgcgtcaaccccacgctggtgcccaccaacctcgacgtcggcaccatggtcaccttccccatcttctccccgtgcccggccgccgccgactacgccaccgcgctcgtcacctacgtcatgcagcccggggacacctactcgaccatcgccgccgccttctccgtcgacgcccagtcgctcgtctccctcaacgggcccgagcccaggacgcagcagttcgccgagatactcgtgccgctccgccgccaggtgccgggttggctgcccccaatcgtgctccgaaacaacgcctccgcgacgccagcggccccgccgccctccgcttctcccaacgcgaccgtcgtgagaaacgaccggaacggggtcgtcgccgggcttgccgtcgggctgggcgtcgtcggcgcgctctggctgctgcagatgctgctgctggcctgcttgtgcagacggctcagggcgaagggacgaggaggtgacgcagtgctaagcggcgacggcgtcgagggcggcgtgttcgctaagggctcgtccgccgctgctgccggcggcggggagaggttcctggtcagcgacatgtctgagtggctggacaagtacagggtgttcacggtggaggagctggagcgcggcaccggggggttcgacgacgcgcacctcgtcaacggcagcgtgtacaaggccaacatcgacggcctggtgttcgccgtgaagaagatgaagtgggacgcctgcgaggagctcaagatcctgcaaaaggttaaccacagcaacctggtgaagctggaggggttctgcatcgactcggcgacgggcgactgctacctggtgtacgaatacgtggagaacggatcgcttgacctgtggctgctggaccgcgaccacgcgcggcgcctgaactggcgcgcgcgcctccacatcgcgctggacctcgcccacggcctgcagtacatccacgagcacacctggccgcgcgtggtgcacaaggacatgaagagcagcaacgtcctcctggacgcccgcatgcgcgccaagatcgccaacttcggcctcgccaagacgggccacaacgccatcaccacgcacatcgtgggcacccaggggtacatcgcccccgagtacctcgccgacggcctcgtcaccaccaagatcgacgtgttcgcctacggggtcgtcctgctggagctggtgtccgggcgcgaggccgcggacgagagcggggagccgctgtgggcggacgccgaggacagggtgttccgggaccgcgacgagaggctggaggcccgcgtcgcggcgtggatggacccggcgctcgcggagcagacgtgcccgctgggaagcgtggcgaccgtggtgagcgtggcgagggcgtgcctgcacaaggacccgtccaagcgacccagcatggtggacgtagcctacacgctgtccaaggcggacgagcacttcgccgactactccggtgagagcgtgtcggttgacggcagcggcgagatcgctgctcggtgaaccaccatccttcgtttcgtcgtgtactcggtcctactcagtagtaatatggtttttagccatcagttcgcgttgtaaaggtctagcgagcggaggatgagtcagcagcagtgagtatatatagtagtattgaataataacaccggcattccgcgagcctgtgactgtgagtgtgaggtgcatgaaatgaaataccgacaacgaggtgccttaaaaaaaagaaaaaaaaaaactcgagaagggggcccggtccc

SEQ ID NO: 14395 - DNA, 1996 bp, Zea mays
ccaaccctgtgctcttcttcttggttcttgcgcgacacgaccacgacgacgacgatgaaagcctcggctccattcagcccgagccagcctctttcttgtcgcacccatggcggtcggccgtcgtccatgtccatgtctgccggcgcacggaccgcaacatcagtgggcaccagctctaagaggccttggttcggtgacctcctggggcgtctgtcgtccacgatggacggagcgtccagggccctcaaggatgcgccgcagaggtttctcgatgcgctggttgacgcaaccttcagattcaccgatcaagctctgaattccgccgagagcaatttcgcaccggtcgatgagactggcgaagccatagagatacaccagagccagatccgaggggcgataccggacggtttccccgagggggtgtacatcagaaacggttccaacccgctctttggcgccctccattccacgtcctcggtcctgggacagtccagggagatctgggtcgagggggagggcatgctccacgccgtctacttcaccaaaagcagcgcgggtcatctatggtcagtctcctacgccagccgctacgtgcagtccgagacgctggagctggaaacggcgcggcacaaaccttgcttcctccctgccgtcgagggcgactctgcagccatcgtcgccgcctacgttttcaactatcttaggtttggcaaggtgagcaaggacatcagcaacaccaacgtgttcgagcatgccggcagggtgttcgccgtcgccgagaactctctgccctacgagatctgcgtaggtagccttgacaccggagacgcctgggacgttggtggggaatgggatcgccccttcacggctcatccaaaggtagctcctggatcaggggagctcgtcatctttggaacggacgcgaagaagccattcctagtagttggagttgtctcagctgatggaaccaaactaaagcacagagctgacctcaagctggacaggtgcacactttgtcatgatataggagtcactccaaagcacaatgtaatcatggacataccacttaccatggacgtcggtagaatcgtcaaaggcggacagctgattcagttcgagaaggaaagctatgcgagaatcggggtgatgccccgctatggcgacgcagattcagctatctggtttgatgtagaaccgttctgcatgttccatcttgtgaactgcttcgaagaaggcgacgaggtcgtggtacaggcactccgttcgccggactccataataccaggctcaacaattgccctcgacaagctcgactctgaaatgcctgaggttgcaggagatgacaagcccgcgaaacggccaactgccgaggagtttttctttcggttgtaccagtggagattgaacttgagaacaaggagtgtctcaggggagtatctatctgggacagactattcgctggagtttccgatcatcagtagccagtacacgggcttgcagcacagatacgcctatgcgcaagtggtggactcctgtggcaattgtgggaaagtaaacccaaagtatggaggatttgcaaaattctaccttgacgagagaagcaacgcagagataccaggtgctagccttgtaaagacgcaataccattggcttggtaaacacgagttctgctctggagcatcgtttgtaccgagagctgggtaacatgaagacgatgggtgggtagtttcatttgtacatgatgaggaaactaatacatctcaggtgcacatagttgatgcgaagagattcgaggatgctcctgtcgcgaaaataacgttgccacgaagagtgccttatggctttcatggaactttcgtcagtaagaaaatgaatgatgtaatgtgattccatcagatgttaaattttgttttctctctcaaaaaaaaaaaaaaaaaatatcgataccgtcgacctcgaggagggcgccgaaaaggggtttagccgtgtacggcgg

SEQ ID NO: 14396 - DNA, 1587 bp, Zea mays
cgctcgagcggctcgagcggctcgaggaccaacgatacagttggatcattttgcaaagatgtcacggaagactcgctcaaaagacatgcagagctctaaaactagaagcagcaggagacaaaagattgcagatctagtggatggttcaacggaccatgacaaggagaacatactagtcgatagtaattttacttccaatacaaaacgtggaaataacagcatgagttccaaatccaacacaaagacattacaaagtagcaaagctgtgcttgatgagagtagtgtgatcaaaaggaatggttatggaaccttggatgtgccagaaccaacatggtttattctaagtggacatcgcctgctgagaaaagagtatagggctatacttagacgtttgagaggtagagtttgcagggattcacatcactggtctttccaagcaacacaccttgtcaccactgagatgcgcagaactgaaaaattcttcgcagctgctgcggctggcaggtggatactgaagcctgattacttgactgctagcaatgaggctggcaagttcttagaggaagagccatttgagtggcacggtgaaggccttaatatcggtgatacgatcagcttggatgctccaaggaagtggcgccagctgcggcagcgtactggctatggcgctttctatgggatgcaggtcatcatatatggggaatgcattgctccaacactggacacgttaaaacgcgcgatcaggtgtggtgatggcaccatcttagcaacctccccaccttacacccggttctttaagtccagtgttgacttcgctgttgtatccgcgggcatgccaagcgcggacgcgtgggtgcaggaattcatgcggcatagcatcccctgcatcagcgcagattacctggtggagtacgtgtgcaagcccgggcaccccttgggcaagcacgtccgcctcgacatgcacgatctggccgagaggtccctgcagaagctcctgaagaaccaagaggatgctcccgggagctgttccgcttgtgggtcagacaaccgggaagtgccgatgctggtgtgcggcggcggcgacgggaggagccagtcttccggctgtggggtccggacgcatgccgattgctgcaaccctcccgtggaaggctgcgatggtggtgagtggctgtgcggcaggtgcgaccagcagaaatctgcaaagaaggctaagaagaccgctgcgaaaccgagggtgctgaaacagagatgattctggtttggcccgtacaagcgatgcaaaaggtcgtctcccaaggtaacgacgaatgatggcagcgggggtgctcttgctctctacaagttgatgacaactagctcgttgcctttggaaagcacccgtgcatgtgatctgacgaatgaaaacaaagtgatgggtgtaaacgtgtaaggactttaaactggtgccaataaatattacgtatttatgtaaatgcacggatctgatggaatgccgtgtgctgcccatccatatggtgcccatcaatctgggcattgcgcgctgccgaatgtccggtaaagcgcgctatttcggaaaaaaaaaaa

SEQ ID NO: 14397 - DNA, 979 bp, Zea mays
ttctgggaaatttaacggtagcgtggccttttccggcttgacctgcctcgcttctcgtctcccgtctcctccgcgttcccgctttccacccaccgccgccgccgccgccgccgccgccgcccaccttaccgtcccctgccccttgcccagcatgtggggtagcaccgacggcggaacgccggaggtcaccctcgagacctccatgggcgctgtctctgttgagatgtactacaggcacgcgcccaagacttgccggaacttcgtcgagctcgcgcgacgcggctactacgacaacgttatcttccaccgcatcatcaaagatttcattgtgcaaggtggggatcctacaggaaccggcagaggtggcgagtccatctatggagcaaagtttgaggatgagataaagactgagttaaagcacactggggctggaattctgtccatggcaaacgctggcccaaacacgaatggaagccagttcttcataactcttgccccttgtcagtcacttgatgggaaacatacaatttttgggagggtatgcagaggaatggaaattgttaaacgccttggaagtgtgcagactgacaaaaatgacaggcctatccatgaagtgaaaatcttgcgagccgttgtcaaagactgaagcattatccagatgtaactccgagtgttggtttaggctttaataatggccatgttcatgtaagtggtgcctttgcgaaaaggtgaaaagtgcagctagttccagcctatatgactatggtctctcgatgtggctgacctgaaaccctacctgatgagtagattggaccttttgatcaagaaggtatttgaaacagtttatatgcgtgtgtggtttgagtttctctgcgaggtatttgaaacaaatagtaccaaactatgttcgcttcattttaaagtcaattgtttggactgctgtaaaacaaaaaaaaaaaaaaaatcgagagtcttctag

SEQ ID NO: 14398 - DNA, 1166 bp, Zea mays
cctcgaggccggccgcacgagaccattcacgcccgcacagacctgcctcgcttctcgtctcccgtctcctccgcgttcccgctttccacccgccgccgccgccgcccaccttaccgtcccctgccccttgcccagcatgtggggtagcaccgacggcggaacgccggaggtcaccctcgagacctccatgggcgctgtctctgttgagatgtactacaggcacgcgcccaagacttgccggaacttcgtcgagctcgcgcgacgtggctactacgacaacgttatcttccaccgcatcatcaaagatttcattgtgcaaggtggggatcctacaggaaccggcagaggtggcgagtccatctatggagcaaagtttgaggatgagataaagactgagttaaagcacactggggctggaattctgtccatggcaaacgctggcccaaacacgaatggaagccagttcttcataactcttgccccttgtcagtcacttgatgggaaacatacaatttttgggagggtatgcagaggaatggaaattgttaagcgccttggaagtgtgcagactgacaaaaatgataggcctatccatgaagtgaaaatcttgcgtgccgttgtcaaagactgaagcattatccagatgtaactccgagtgttggtttaggctttaataatggccatgttcatgtaagtggtgcctttgcgaaaaggtgaaaagtgcagctagttccagcctatatgactatggtctctcgatgtggctgacctgaaaccctacctgatgagtagattggaccttttgatcaagaaggtatttgaaacagtttatatgcgtgtgtggtttgagtttctctgcgaggtatttgaaacaaatagttccagactatgttcgcttcaatcttaaagtcagttgtttggactgctgcaactgcaattcataaagaaaaaatattgtagaagcagtagaagccggtacggattaaagctaagcgaaaataatgcaccacatcgaaagtctgccactgatagctccctagtcggtggaggcatgtggggctttggggtcttgaggttgtctaatgcagttatcctatctcatccctgttcattttctattttaaacttcactatgtaaacaatgatatttcctatttcaactttac

SEQ ID NO: 14399 - DNA, 1677 bp, Zea mays
tcctcggcccgtgcgccgagagcccgcagccggaacggaacggactggatggcgtccagttcgctcctcgcaatgggagcggagcggagcggacccaaaaactcgaaaagtcgaaatccaaacccgctggtcagcttatccccttcgcaggagccaggacggacgaactgcgagtacacgagagaggacagaggagaggagacacaggcgacacgcgccatttgggagagggaaaggaatggagctgacgtcttcttcccgctccgtgctctcctcctgcaaccggccggtcgctcgagctctttgcaggacggcgtacccgggtgcaaggaggaaggagaagggaatagtatgtatcttgagcgaggagaaagaagtggtacaaaggacgatccggaggcgagctgccttttctttgttgctggcttcgccggtgctatcagtggcgttctcggcctatgggaagagtaaaaccatgaacccttacgatgaaaggcgtctgcttcagcagaataagaagattcaggaagccaaccgtgcccctgaggatttcccaaacttcatcagagaaggcttccaggtcaaagtagtgacaccggacaactatattacacgggcctctggactaatgtatgaggacattaaagtcggtacaggcgactctccaaaggatggtcagcagattatattccattatgtgggctacaatgaagcaggacgaagaatagatagcacctatattcagggttcccctgcaaaaattcggttagggaacggaacactagttccaggttttgaagaaggcatacgggacatgaaaccaggtggtaagagaagaattataatacctccagagcttggtcctcctgttgggccttcgacgttcttcagtgcgaagcagttcgaagtgttcgatgtggagttactggcggtgcaggactgccagcggaggacgatagcattttactctgatgtcgtgtgcagctgaacttcggtttgtctagtcttccgcctatggcacatcgcagcagcatcctgcacttttggctgctggtctgagttgccgtccaattgtgtgtatgtatatagccagctgttgttactgcggctactgatgatgggcaatggtagtgtgttattagttcttcatttttgtcttgaatctcctgatggcgggatatgcgcatttggtgtgtctgtttagaagttggcatgtgtaccttgatgttgaggttactcctggtcctacctctaccaaggactccacaccatctgactctgcttcttattcagtactaattcttgcgagtttggtggcggtttttgtaaactattttcaaatacctagtgatggtataaaaatttgttgaattgagttgtttgtattctggaggaaaaaatacaacaaaattttccaaatagttttaagtgtctcaatgtaccaccttagagtctattggttttaatctcaatccatgtgaattggacagaattgaatgagtttaaatctctagcaaattaaaagtcttaattcttttcccaatctcatccaatagctatgtaacgagaataaataaatgagtctcagttgaattcctcgaacattcctaggcaagttccaggatcccatttcactgaacactggccggcgtactccagggacgagatctcctggca

SEQ ID NO: 14400 - DNA, 799 bp, Zea mays
tgtggaattcgatttcgagcggccgccgggcaggacaggcgactctccaaaggatggtcagcagattatattccattatgtgggctacaatgaagcaggacgaagaatagatagcacctatattcagggttcccctgcaaaaattcggttagggaacggaacactagttccaggaaagtattcactgtctcaatagttttttcccctatgctctgattcagctaccactattcttactgcttgctggaggtgctttttttaagccaatttgagaattgaaatattgctctgatgaattttttgggatatggaattgtaatagatcacatctcattctagacattgatacttcaggttttgaagaaggcatacgggacatgaaaccaggtggtaagagaagaattataatacctccagagcttggtcctcctgttgggccttcgacgttcttcagtgcgaagcagttcgaagtgttcgatgtggagttactggcggtgcaggactgccagcggaggacgatagcattttactctgatgtcgtgtgcagctgaacttcggtttgtctagtcttccgcctatggcacatcgcagcagcatcctgcacttttggctgctggtctgagttgccgtccaattgtgtgtatgtatatagccagctgttgttactgcggctactgatgatgggcaatggtagtgtgttattagttcatttttgtcttgaatctcctgatggcgggatatgcgcatttggtgtgtctgtttagaagttggcatgtgtacctcggccgcgaccacgcta

SEQ ID NO: 14401 - DNA, 892 bp, Zea mays
ccacgcgtccggaacaaggacaaggaaaaggtagccagtggcctgccagatcggaatttgctgtttacccttttgacctggcgaaatcgaatcagaataaaagaaagctctgcacttcgttcatcgagagcatccatagcaagaggaagcggctgaggttggctcgggtgagcaacatggcggagaagctgacgccggagcaggtggacgagtgcaaggaaatcttcgacctgttcgacgccgacgaggacggtcgcatcgccacgggcgagctcgtgacggcgctgcgctccctgggccagaacgtggacgaggcggaggcgcggcgcttcctggaggacgcgggcatcgcggcgggcgccggcgacatcgacctcgcggcgttcctggccgtggcggcgcgcaagatgggcgccaggcagtcggaggcgcgcctcgccgagtgcttcgacgtgttcgacgacgcctgcagcgggtccatccccgcggagcagctgcggcaggtgatggtaagccacggcgaccgactcacggaggaggaggccgacgcgatgctccgcgaggccgacccgcgcggcgagggccgcatcgagtacaaacactacgtcaaagtgctgctcagggacaataagtgatccggtgatccttcgcccgccggtggccacggccggccacgagtgggggaggaggatgtcaactcgatctgctctttgatcatgtgcgcgtcctagtcctagcaccgccgcttaattattatcacggcatcagatccagtagctagtggctaccgaattcttgaagttgacatcaccagttctgtatactggtttcgcttgtgttgagcgtgtaagatgtctgcgatcgcagctttcgagcccaactccgtccgccg

SEQ ID NO: 14402 - DNA, 694 bp, Zea mays
ctgcggcaggtgatggtaagccacggcgaccgactcacggaggaaggaggccgacccgatgcctccgcgaggccgaccccgcgcggcgagggccgcatcgagtaccaaaccacctacgtcaaagtgctgctcagggacaataagtgatccggtgatccttcgcccgccggtggccacggccggccacgagtgggggaggaggatgtcaactcgatctgctctttgatcatgtgcgcgtcctagtcctagcagcgccgcttaatttatatcccggcatcagatccagtagctagtggctaccgaattcttgaagttgacatccccagttctgtattctggtttcgcttgtgttgagcttgagcgtgtaagatgtctgcgatcgcagctttcgagaccaactccgttcgccgtagactcatcgtcacccaaagcaccggcgccggcgttttgttccgatgcgatgatgcgaaggcggcagcaggagagactgtcacttttctgctgggctggacgggccgcacgccacacgccacgtcgcgtagggatagaacagatgactattttttttatgacgtttcgacgagagtcacacgaagttgtaaacaccgaaacaatttttgttgacggtgtggtcctaaaaaatcaaacggacggtgtcgttcccgtcttccaattcaaaaaaaaaaaaaaaaaa

SEQ ID NO: 14403 - DNA, 1963 bp, Zea mays
cttgcttaaatggtttttttagatgcaactgtggtcctcttgttacctttagaatgtgtatttgtactgctgtagaaaaacacctcatcagactatttccaatgttggtgtatatttacttgaaccagtgttctctcatggtcaactacatcatctaccgtgcctatttttctaggactcttaatgccatcaggctggcattttgttcaactcattaggtgcgtcaacactgaaattcactcttacggtcatgttttgttattgcattagagtttgcagcatgaatcagggacatccaatgttgttagatctattaatgcgatgttctctgtcttatttttatcctacaagtcatttcgagatatgtggttgctgatcagatgcgggcaatgtcaattttattattggaattgttaacttgacactcattcaccttctggactgaaaaccaagacagtactgcatctatttagttaaacatatattacttggctgctaacacaactaagagaaatactgaaaatcaatccttcagtctatccttccataggattttaatttgtgcatgatagagagttttacatgtcagaaatttatagatgtcagagagttcattgcagttcatctccttcactgcatcttgcatattttttctctctttcagctggttacagtaacaaggaaccaccattttgatgcaaaggtaagcatctgcattttactcgagttacatgtcactgctaccccttaatcccggggtgcctttgatttgcgacatccaggagcagatgcgacaggatcacaagtaggaggagctgcgacgatgctgtagcgagagacatgggtgccgaggtcgttgtgctgcggtggtggcaggacaggaaggaaacgaaaaagcaggagccagggttgttcaacaacgtgaccgagtcgctgaggcgaggaagagtaaggtgaaggcactcgtcgacgcctttgagactgacagagcgtcatctcgctgcaggaaaccagcaagcctgctgctgctccagctatgaaagtaggtgtcgtgccatgagtgcttcttgacctgcagtgtgcatgatcacctttcttggaattttaaactttttttggttgttagtgaccgtaaaagtggcgcttgttgaggtttgctcgttcccatgtaaactgacttttctcatgggagttttcatacttttgtagtgctagaaaaaggaaagtctgtacaggttttgtgtctatgcaaggcttgagaagttggcattgtactgataagtgataagtaaacaagttattgtaatgatttaaactagattgttttgaaaggaaatggaatgcataaagcaaattaaactttgtattatgttactaattcatgaaaaatggtactaaactttccgtcaacgtttttatgtttctcatttcactcgctctatttttcgttacaactacactgcatatgctagcatatttgttcatatagtactcttgctgacatttccactatcacagcagcatctctactactatttgtgttttttatataaatgtattttatcatattgatttcgtccatgcaagaggatctctatcgtgtttcgcaagttaggagctgccaagcacctgttcggttttgtgtagaacttcacgctccttcctatcctggatacttatatctttactcaaatgatggtgtctagcaacaacgatagcctatcattgacttggacgagcagccataaatctctttcaacaacttatgtcacgtcgcaacgcacggggacccgagtcgaaatagaaacggaaataaaaaatcgttcatcttcttctccaagcagatttctgttggttagctactcacgtcaactcaaaatctcgcgttaaccaccttcatagtctctccgcctcccgcttacctctttggctctagtctatccccctctcgtttcttcctgtg

SEQ ID NO: 14404 - DNA, 1204 bp, Zea mays
  misc_feature (1160)..(1160): n is a, c, g, or t
tccattgccatctctagatgaaactacccacatttcgtttctcttcctctccggtccccactagtccccttcccttccctcgcctaccttcgcacgggtgctctgcccgttcgacggccacgccgcgccgcccagctgctccggcacccgcccttcttcgtcgagctcgggatcagcatctcgcttgttctgggctccccattcggcctctcctcgccctaactctattttgcagcatgagaccagcacaacagcccgaatcataggcttgacgcagagaccccatctcatctgcgctcccgcacgtggcctaacgctaacggagccagaagcaaaggagaggattccacaagcttcgagttgccgaaacattttgttaaatctactgcttgtgtgggatcattagtgcaaatccggtgcttgcgcgtgcaggctgtgctacccatgcgtcttggctattgtgaataaaagggtttagagggatgtcttcagaggagctgagggcgagcttttcagatttggcggtgggttcgccaacccagacagagggcaaaacgtatccttcagatctatgtgtgggttggatgcaacacagcaaagtttggccatttatacgctgctgcaaccactaggccggataacagagtgagcgtgacctctgtactaggaggaacatctgataacaccggatcaagtatggctcgccgtctagcttttagtaccagaaaggctgcatcctacatgtcccagtgttgaagaccggtctgaacattgtcctagcatgcagcatcccaaaagacagccccgttcttgaggcagctgcggagaggaagctggtggagaagctgaaaggtttgggctacattaaaaccgcagctgtgaatgctaacacttccacggcaccatgatccgtggcatgatctagtgagctttcggtcgacgttcatcactagatgcatcatgatcatgagcagttgtgatgtttggtgggcttgattggctaactgtttcatctgttctttcgcgtggtaaaagttattatgaacattttggtgtatggagtgtttaaaagcactagagctaatagatagttggctaaaactactggtgaatttagctagttaactattagctaacttgctaaaaatagttaatagttngaattattaactagtatgtttggatgtctttagctaattttaac

SEQ ID NO: 14405 - DNA, 1725 bp, Zea mays
catggcggccctcgatgggccgagccgggctgaaccttatgtttcccctgcctgctgctgctgctgcgagccgaggtcaggtcggctacagtgcacattgctaaacgctcccgccgtctcgcgactcgcgagccgccgccgggtccttacgcaagtccgcgacgtgcatcgcctggagaggctcccgtctcgccgccctgcggatcccatctcatctgtgcagctgcgcgtggcccaacggagccagaagcaaaagagttagagaggcgcgtgatgtcttcagaggaggcgagggcaagcttttcggagttggtggttggttcgccaacccggacagagggcgaaacttattcttcaggtgatatgtcgtctgaggagggtgcacacgtcacttgtttcacagaggatcttcacgatgtaacacttcactttcagatagtgaggttttctaaacagatatacgtgtgggttggatgcaacacagcaaagtttggccatttatatgctgctgcaaccactagaccggataacagagtgagtgttacctctgtactaggaggaacatctgataacaccggttcaagtatggctcgccgtctagtgctgaagactggcctgaacatagtcctggcatgcaacatcccaaaggacagccccatacttgaggctgctgcggagaggaagctggttgagaagctgaaaggtttgggctacattaaaaccccagctgtgggggctaacacttcctcggcacaatgatccgtggtgtgatctagtgagctttcggtcgacgtgtagcttcatcactacatccagcagagagcggttgtgatttttggcgggctttgactgtgctacctgttctctcatgtggcaaaaggttattgtgaacatgttcgttgtgatgtactccgccctaaaataaacccccttcgtatttcaaggagaaacaatcttaattctgactaaatatataccaaaaatactgatatttatgataccggataaacatcattagattaatcatgtcatacattttatagtaaatatgtttagagatccaaatgtagatacaatttttaacctaatgaaagttaagattgattgatctgtcgaaataatgagatgaggacgtagggagtaaatacgatagtggaatgcatattgtacaatgccttgcaactttgagatcttcaagctaagcataaaaatcggcattcagatcattcaatggctcgtcccatgcgttgtgcgtatggacagaagagcttgcaaggttttgtgtgctataatgcctctgctctggtgcgatcgagctacaatggcctgcaggctgcagggatggtatatgagatttgtgcaggccgcatgcttcactctagggcaacaacggccattgtcgacgaatccaagttgcattttatttgtccgtgggatccatatacataaataaaggaatctgagtgagcacgcacgcgatgtggagacgcgatgtggagacacggagggatggtaacagatcacgatcaatatttcttcataataaattaaattatttaattaattttagctcaaaaataaatagtaataaaacccgattctaattaaatttgatttttaaattttatattgtaaaatctagagctcattaacatcctaattataataccaagttatcgcgcatatttgactcaaaccgtagcacaacgccaatttggctttggg

SEQ ID NO: 14406 - DNA, 1714 bp, Zea mays
cccacgcgtccgcttggctcaaaacaagttaagtggtgaaattccgaatctaatatattggaatgaggttcttcaatacttgggattgcgaagaatagtttagaaggaagcctctctcccgatatgtgccagttaactggtctgtggtactttgatgtgaagaacaatagcttgacgggtgcaataccagaaaccatagggaactgtacgagctttcaggtcttagatttgtcaaacaatcatcttactggagaaatcccgttcaatattggtttcctgcaagtggctacgttatctttgcaagggaacaagttctctggtcctataccatcagtgattggccttatgcaggcgcttgcagtgctagatctgagtttcaatgagctatctggcccaataccctctatactgggcaacttgacatacactgagaaattatacctgcaaggcaataggttaactggattgataccgccagagcttggtaatatgtcgacactgcattacctggaactgaacgacaatctgttgactgggttcattcctcctgatcttggaaaacttacagaattgtttgaattgaaccttgcaaacaacaaccttataggacctatccctgagaatttaagttcatgcgcaaatctcattagtttcaatgcttatggcaataacttgaatggaaccattccacgttcatttcacaagctcgagagtctgacttatctgaatctgtcatcaaatcatctcagtggagcacttccaattgaggttgcaagaatgagaaatttagacactctggacttatcctgtaacatgatcactggttcaattccctcagctattgggaaactagagcatcttttgagactcaacttaagcaaaaataatgtggctggacacattcctgctgaatttgggaacttaaggagcatcatggagattgatttgtcttacaaccacctcagtggcctgattcctcaagaggttgggatgctacaaaatttgatactgttaaaattagaaagcaataatattactggagatgtctcttcacttatttactgcttgagtctcaatatcttaaatgtatcatacaaccatctttatggtactgtacctacagacaacaacttctcacgattttcacccgacagcttcttgggtaaccctggactttgtggctattggcttcactctgcttcatgcacacaattatccaatgcggagcaaatgaagagatcctctaccgcaaaggcctcaatgtttgcagctattggtgttggtgccgtattgcttgttattatgctcgttatcctagtagttatttgctggccacataactctccagtgctcaaagatgtctctgtaaacaaaccagataaccttgcttcagcatcaaacaacattcatcccaagcttgtgatcctccacatgaacatggccctctatgtatatgatgatataatgaggatgactgaaaacttgagcgaaaaatacattattggttatggagcctcaagtacagtctacagatgcgacctgaagaactgcaagccaattgcgattaaaaagctgtatgctcactaccctcagagcttgaaggaattcgagactgaacttgagactgttggaagcatcaaacaccggaatcttgtaagccttcaggggtactccctgtcaccatctgggaatctcctcttctatgattacatgg

SEQ ID NO: 14407 - DNA, 1062 bp, Zea mays
  misc_feature (15)..(15): n is a, c, g, or t
cattgggtacctcgnagccggccgggaaaaaaattcatctctccccgtcctcccgtccccccggtcgacttgtcgagacaccacaggctccaactccccggcccgctgcatcttctccccgtgaccgcccatcccacattcacagtgccgcgctgccccgcagcctcagccgcatggctctcctcgcctcccccacgccgttcggcgctgcagccatccgccgccgcgtcgccccgcttcctctcatccctgcaggcggtcgcgccgccctgcacgtggccctcgcgcgccgcggcggggtctcgtcccgcacgcagcggcgcctcgaggagcgcggaggcaagaagcgccgcggcggggtcgcggcgcccgacgtggacgaggacgcggcggaggcggggacggcggcggagtgggaaggggagccgctggggttcgaggtgtcgacggagcccatgccggagctgccgaacccggagaagcccgacttctgggaggggcctcagtgggaggccctcggcttcttcgtgcagtacatgtgggcgttcggcgtcgtcttcggcctcattgcttgtggcgtcgctgtggccacctacaacgacggggcaacggatttcagagacacgcctgcttacaaggaatcccaatcacaggagttccctgaggagtcggaatcatcgagcgctgatgtgttcgaaggcaacccgactgaggtagcaccagctcttgagtaggactagcaaggaggcacgggggagaaaacttgtctgtctattcaagctttagcaccagctcttcgcgtttgcagtatagatgtaaaaaggtttggttaaaatctgatgctacgaaaattggctggtaattattttgtactggatttccccttagaatcaaatatagatggatggctagtgcctggtggtgatgggattcaactgtgttattccaaaaaaaaaaaaaacgtgtggtgatggtgggggtgggagaaagagttactgtattttactatgatttctacagtattttagctgcagcaattcgaagccaaaaaaaaaaaaaaaa

SEQ ID NO: 14408 - DNA, 3064 bp, Zea mays
  misc_feature (327)..(327): n is a, c, g, or t
gaaattacttaaaaaaaattagttctcaaactagcccgtagtgtgtagagcaaatggttcccacctccttggctgtctacaaatatatggctgcagctgaggtccgacaccacacaaacagcacatctgtttagccaagctgtggccaacctctgcgaggaatggagatggagtcgactcctctcttgacaccatacaagatgggcgatttcaacctggcacacaggttagtggttattatattattgcataaataaataaataaataaacaaataaagatgtatgcctacaacatgctctaaaatggaatccacttagatcctccncatagtgcatcgacaacgcacataggttcattccttgggtatccttcgtgtgcgaggatacgtacatgtacatgcagggttgtgctggcgccgctgacgaggtgccgggcgttcgggaacgtgccgcagccggagcacatggctctctactaccgccagcgggcgacgcccggcggcttcctcatcgccgaggcctgcgccgtgtcggagagcgcgcgcgggtacccggacgttccggggctgtggacccaccaacaggtcgaggcctggaagccgatcgtcgacgccgtccacgccagcggtgccgtcttcttcgcccagctctggcacaccggccgggcctccccctcaggttctctgccattggctttgtggttttctcattcttgttgaaatcggttttctttttctttcttttttttttgttgttgcattttcgcttgttccccgtgttgctagttgcatctcaacacaacctcagagattttttttttcttctgttcgcttggctggcagcgcatcgtccggtcatcttgtggccccagtgccagtggccactgctggctacagcgtatgtttctgtggctgcacagaaagcaggcaatgatatagcagtatggtaatctgattgatggctggcttcattttcgacagaattccaaccaaatgggcaggcaccgatctctagcacggacaagcaaatcccagcacaggtgaaccattccggtgacgtcaacacgttcgcggtgcctcggagactagagacagaggagataccacacgtcgtcaatgacttccgggttgccgccagaaacgccatcaaagcaggtaaataaccatcaaagaccagaaacgatgcatctctgctagcagaggcacataccgtgataacagtattcaagatcaaatagagagcatgttatttctagagccaagcatctgaattaaccggaaatataggtagagccaaaacttgaatgatgtatgcatgacttcacctatcgaagctagattgacgtgtgagtgatatattccacctacgaaagctagaatagtactgggcgcgtgtgattacacctactaaagctacaataattgacgcacttgcttccacctatcatatctatagcgatagatacgttactgaatatatgtataagagacaatcattatctatagaaacactaatgaaaatttcagtgtaatagccattagacgattagaaagatttacatgatatcacttaaagccatattacaaagtaactagtgcatgcattttgcagggtgtactacaaaattactaacacttgatctactcctgtgactataaggctttgatggagtggagatccacgcggcaaacgggtacctgttcgatcagttcatgaaggacagcaccaatgaccgagacgactcctacgggggcagcttggagaaccggtgccgtttcacagccgaggtgatggcagccgtcgcggacgaggtcggtgccaaccgcctcggtgtgcgcctctctccgttcgcggattatatggactgccacgactccaacccagaggcgctcgcgcttcatgtcatcgacgagacgctgaacccgctcggcgtgctttactgccacatggtagagccaaggatgcgggtgaacccagacgacggtattatgactctcgagcacatgctgctaccgttcaggagggcgtttcgcgggacgttcattgctaatggaggctacgaccgtgaggaaggcaatgacgccattgcccgtggccgtggctatgcagatctcatcgcatacggccggatattccttgccaacccggaccttccgatgcgttttgccaagaatgccccgctgaacaagtatgataggagcaccttctatacctctgatccggtggttgggtacacagattatccatttctcgatcaactctaggatgattggcttataaacaatttccccacctggagtactatcttgaccttaaaataaaatgagtgtcactataatattaatgtcgatcaaagttttctaagtctaactaaatctacaaaaattattattaagcatttgtcaaagtatctatacacttagtgattttgttcattaataatgatacaagattattaatggggtgtgtgggactgctccactccaagaaatctagattcaatccaacttttttcaaccaaacacctccatcaccaccaactctagctccacaaaatatgtggatctagccataagctctagattttttttgttgagctccaaggaggtgctctagaaatctttattttataactcgtcatgaagttgtgggttaataacccgctaccaccatttacataactctctcttgtaacctagttcgaaggaaaacgtagaagagcttctcaagggagtggcatcgaaaagctgcaacaaggcatcattgtcggccttgtagaagggttgtcatgtgtggcaagcactgaggcagcgatgatggtggtactagagatgagaaggttgtggaaaatgtggaagaagaggcaactcttggtggcaaagaagtcacgggcggcgccacaggcagcgcagatccatctatggatcttggcctcgagcatgtccaactttcctcagttgggaccctgcacacacgtcttaaccaaccttcagctttgaaacaccctctcaatccattaacgagggctggttgtgacatgcatcactggtagcccttgtccct

SEQ ID NO: 14409 - DNA, 1475 bp, Zea mays
gggacacaaacagcacatctgtttagccaagctgtggccatcctctgcgaggaatggagatggagtcgactcctctcttgacaccatacaagatgggcgatttaacctcgcgctctcgggcctctacaaatatatggctgcagctgaggtccgacaccacacaaacagcacatctgtttagccaagctgtggccaacctctgcgaggaatggagatggagtcgactcctctcttgacaccatacaagatgggcgatttcaacctggcacacagggttgtgctggcgccgctgacgaggtgccgggcgttcgggaacgtgccgcagccggagcacatggctctctactaccgccagcgggcgacgcccggcggcttcctcatcgccgaggcctgcgccgtgtcggagagcgcgcgcgggtacccggacgttccggggctgtggacccaccaacaggtcgtggcctggaagccgatcgtcgacgccgtccacgccagcggtgccgtcttcttcgcccagctctggcacaccggccgggcctccccctcagaattccaaccaaatgggcaggcaccgatctctagcacggacaagcaaatcccagcacaggtgaaccattccggtgacgtcaacacgttcgcggtgcctcggagactagagacagaggagataccacacgtcgtcaatgacttccgggttgccgccagaaacgccatcaaagcaggctttgatggagtggagatccacgcggcaaacgggtacctgttcgatcagttcatgaaggacagcaccaatgaccgagacgactcctacgggggcagcttggagaaccggtgccgtttcacagccgaggtgatggcagccgtcgcggacgaggtcggtgccaaccgcctcggtgtgcgcctctctccgttcgcggattatatggactgccacgactccaacccagaggcgctcgcgcttcatgtcatcgacgagacgctgaacccgctcggcgtgctttactgccacatggtagagccaaggatgcgggtgaacccagacgacggtattatgactctcgagcacatgctgctaccgttcaggagggcgtttcgcgggacgttcattgctaatggaggctacgaccgtgaggaaggcaatgacgccattgcccgtggccgtggctatgcagatctcatcgcatacggccggatattccttgccaacccggaccttccgatgcgttttgccaagaatgccccgctgaacaagtatgataggagcaccttctatacctctgatccggtggttgggtacacagattatccatttctcgatcaactctaggatgattggcttataaacaatttccccacctggagtactatcttgaccttaaaataaaatgagtgtcactataatattaaaaaaaaaaaaaaaaaggaaaaaaaaaaaaaaaaaaattaaaaaaaaaaaaaaaaaggcccctagggcc

SEQ ID NO: 14410 - DNA, 4764 bp, Zea mays
ttacgtacctcggcgccgtagcctatggcgccgcgctgtgttacctcggcgccacagcctatggcgccgagcaaagggtccaaaaataacattaaaattttttagggtcgaaacgtgatttttttttttcgagaaagggtcaaactgcaaaaaaaattcggtcgcttggcacacggcaagggtatataggtctccgcagaatagccatacatacttgtgcagtctttttaaagttacttttttttaagaaaaagaacggcaagagctttaccgttatttttattaggctgtaaaaaaaaagaagagtgagtcagtgcagagttactgaagatcgactggagtcgaggacgacggagtggcgtgcgcgcccttcctgcctgccgctccttcgtcccctcttggtcaaggctgccggccgggtgacccgggcgggcagaggcaggctggcaggtactacctaatacaatcacaagtcacgttgcgctgtgcacacatgctgcggcctctcattgcctgctctgatctgttcctctcaacaggcgccatcaccaccgcctgccctcgctacaccctcttcctttcttcttccaaatcacctctctctctcaaaagcgtgtggcagccggcctgtgagtctgtgtctgtgaccggctgactctgccagccgcacgcacgccctcgcgcttggagcgttgcgaggatcggctcacaggtcacagctcagtctcagatcggccaccggccggccgggcaccggaccacagctgtctgctgcctgctccgcttgccgccattgctggccagcgcgagcgagctgccgggaccgcacggaggtagcgtctacggggcagcaccgcgcgtcgtggttcgcgctcttgaagctggatctggaccgacggtcgatcgagcgagtgcagctgcctgcgagctcttctcccgccgcgatatgggcgccgtgagctgccggaggcggacgagccggcgccgctgccacgccgccgccctcctcgccgccgcaatcttcgccgcggccttgggtgagtgccaaaggctacagcttttaattaatctgctggccgtacctacgtgctcgttcttttgtttttgttcgagggctgcttgctagctcttgccaagaccttatcttggcgcgaaaagaagagcgcgcgtgtaggctttgtgtcttcgattctctctcttttagtttccggtcttttcatgcatgcgtttcaactcccatttcgatgccttctccctagctcttgactaacaagttagctgctaatctaacttttaagtttggttcctcaaggtgctatatgctacctagctaggtgttcacatgcatgttcacttagttttatttaatttccactaggattagcagctagatagataagatacacatcttgctcatttaacaattaagtagcctgctaggtatggtgttgttctttcttaattactctatatagctatacaaagtagatataggtttacctcccttaaacgccccctccctccttgcctctatcttcagtgacaccttgctgtaaagcaactaacaagaaagcaggtacaaatttgaactactaattaatcaactaacgaccctaactactagtaggccttagcttgtgttgccgtccttattagtttcggagaagtagaacactgctggccgggttgtgtgtgccactgccacgcatgcatgtccgtcctttttattatatttggtgagattttctgaaacaattacattcaaatttcggcaagctaggcattagttttcttgtctcttgatgcatgcaaacccagtgttgcgtgtagaatcttgcacacgaggaaaatccattcgcttgtgtctgctccatcctctccgagcacatcttgctcgcatccagaccaaatagcaactatatatatatatatggttacgacgtgaccattaaaaacttaaaatggtttatgttaccaggcaaacagcaacgcccctgcaccgcgctgcagccaggcgtcccgggcgccagccccaccccaccacggcactggcagtctgactctgacgaggctggtccagaaaagcacacccggacacagacagacacacgttcatgcatagggatagcaggcgacacactttcagtgcaggcagggagaccagccagagagaatctgcccgtaggccgtagctttctttctttctatagcctgatcgaccatggcgacgtggtgggcggcgtacgtacgtgccagtcggtcacagataatactgcatgcgctctagtttggtctcactcgcttaacgtttaggacaccaaccatatgccccctagctagcccttccaggagcctatcattagtgtaggtcctaacggtaaccacacaaaatatagtaccaatatatacacccggccctcacctccatcatgcacgtctattgattagtacgtaatcttattgtcacctccatcaagaagatgtttcagctcatatcacgtacgtgaatgtactgcatgtgcatgcagttgtggcggcagggcggcggcccatccgtctgccagcagcggcgctggcgaggaggcgagtagactcgtcgacggcaattgccgccgccgccgacgaagtcctcccagccgcccggcggcggtggctgctggcggggccggggtcgtcgccgccgacgtgccgcgcgaggtgcgggcggtgcgcgccgtgccgcgccacccgcgtggccatccagcccggcgtcggcccccagtgggagtactacccggaggtgtggcgctgcaagtgcggcaacaagctcttcatgccatgaccagtacgtgatcaccaacggcggaggggctgtcgggccggcatgcaggcgcgcgcgtggtcttccttttgtactacaagacgacgatggattgatcgagacgacggcgaccactccgatggatcgatcgatgcgttaatttaattttgcgagacttaagtgtacgtacgtacctacctgcgtgcgtacaaattgaaaggggaggacggattttggatgctactaagaaagaagctaggggattgcattggtgaggtgattaggcgtgcgtaagtggtggtgctgtgtctgtgatctgtgtatatatatgcaaatcagtagatcttatgttgactactactacgtctacatgcatcttctttcttccttccttcctttggtgagactaaactgttttaatttctcttcacagcaaatcagaatgaatggaggagcgaggtcattgtaattatatttttataatgtaatttctacattgtttttattctatttattttgcatgtcgatatatatttcttgtaccggcgcctgcctggaaattaatttggtactggctatacatgagcatgtagctcgaggcccgattttttggcccagctcaagcacgacacgacccggttgggttcgtgcccggtccggcctaataaaccatgtcgtgcctgggttgggttgccgacagtgcccgctaggcggcccggctcggcccgccataaaacggtacgcacggggtcggcccgatgtcggggtgcggggcataaggcccagcctcccccatcgcgtcccagactcccggtgtcccactcccatatggcttctcttgctcagctcctcttgacctttcaccactcgcttatccacggtcgtcaccgcctcgtcgtcaccattgtcagatgtactctttttttctttttagggtttctcacgaggtgtgagttttatctagaaaggttttcaatatttatgtacattttattcaaaatgtgttgaatgttgaattgtgcatgtttttattcaaactgttcaagctgtgttttttctgttaccgggattcggacgggcccaacactcttttgggctagggcttttcgggctggcctagcccgaaaaatggcctgaagggccgtgcgtggactcctaacgaggcacgcagtactgtgcaggcccggcccggtagacccgtggacctgatcgtgtcgtgcctatttagactgtgccgtgtcgtgcggtccgtttgctcatctatggtactggcaacatcccccgatctaggtgccgatcgatgcatgcatacgggaccgaatttaatatgcacgaatgctgcattagttagtagacgattttcggagagatcttgccacgattttggatctggagaccgttcatgaatgaatgctgcacatattgttttggctgcccgctagctgtggtgttggttgtcatcaattcatcacaagtcttttcagtggacacacacacacacaaccccggccggccgtacgtagccgcgagaccgtccatcacatggacgttgcaattattgcgacgcactctttgttcgtagagtaatactgcattactgctccctcgctcggtttcaaaagcataacactgtttattttgttgaataattttgaccacatttatagaaaaatgtatcaacaaacaatacaacgttttaatcattgtattaaacctccgtgaacgtatcttgatatatgccatattttagtatacttgaacttgtatatgctcatctattttcttaaatttaggttaaaaatgaagaagtatggctcagatcaagctaaaattaaatgcatttataactcaggttaccctaagccctgaactgcagaaataaaaaatttccacatagtatccaagatcgagtttattaaaataaaataaaatgagaataaaaacacaaggcatagaacactaat

SEQ ID NO: 14411 - DNA, 1243 bp, Zea mays
ctggctggtctacctaatacaatcacaagtagcgttgcgctggcacacatgctggggcctcacattgcctgctctgatctgttcctctcaacaggcgccatcaccaccgtctgccctggctacaccctcttcctttcttcttccaaatcacctctgtctctctctctctctctctctctctctctcaaaagcgtgtggcagccggcctgtgagtctgtgtctgtgaccggctgactctgccagccgcacgcacgccctcgcgcttggagcgttgcgaggatcggctcacaggtcacagctcagtctcagatcggccaccggccggccgggcaccggaccacagctgtctgctgcctgctccgcttgccgccattgctggccagcgcgagcgagctgccgggaccgcacggaggtagcgtctacggggcagcaccgcgcgtcgtggttcgcgctcttgaagctggatctggaccgacggtcgatcgagcgagtgcagctgcctgcgagctcttctcccgccgcgatatgggcgccgtgagctgccggaggcggacgagccggcgccgctgccacgccgccgccctcctcgccgccgcaatcttcgccgcggccttggttgtggcggcagggcggcggcccatccgtctgccagcagcggcgctggcgaggaggcgagtagactcgtcgacggcaattgccgccgccgccgacgaagtcctcccagccgcccggcggcggtggctgctggcggggccggggtcgtcgccgccgacgtgccgcgcgaggtgcgggcggtgcgcgccgtgccgcgccacccgcgtggccatccagcccggcgtcggcccccagtgggagtactacccggaggtgtggcgctgcaagtgcggcaacaagctcttcatgccatgaccagtacgtgatcaccaacggcggaggggctgtcgggccggcatgcaggcgcgcgcgtgggcttccttttgtactacaagacgacgatggattgatcgagacgacggcgaccactcgatggatcgatcgatgcgttaatttaattttgcgagacttaagtgtacgtacgtacctacctgcgtgcgtacaaattgaaaggggaggacggattttggatgctactaagaaagaagctaggggattgcattggtgaggtgattaggcgtgcgtaagtggtggtgctgtgtctgtgatctgtgtatatatatgcaaatcagtagatcttatgttaact

SEQ ID NO: 14412 - DNA, 887 bp, Zea mays
acttgtgcagtctttttaaagttacttttttttaagaaaaagaacggcaagagctttaccgttatttttattaggctgtaaaaaaaaagaagagtgagtcagtgcagagttactgaagatcgactggagtcgaggacgacggagtggcgtgcgcgcccttcctgcctgccgctccttcgtcccctcttggtcaaggctgccggccgggtgacccgggcgggcagaggcaggctggtcaacaggcgccatcaccaccgcctgccctcgctacaccctcttcctttcttcttccaaatcacctctctctctcaaaagcgtgtggcagcccgcctgtgagtctgtgtctgtgaccggctgactctgccagccgcacgcacgccctcgcgcttggagcgttgcgaggatcggctcacaggtcacagctcagtctcagatcggccaccggccggccgggcaccggaccacagctgtctgctgcctgctccgcttgccgccattgctggccagcgcgagcgagctgccgggaccgcacggaggtagcgtctacggggcagcaccgcgcgtcgtggttcgcgctcttgaagctggatctggaccgacggtcgatcgagcgagtgcagctgcctgcgagctcttctcccgccgcgatatgggcgccgtgagctgccggaggcggacgagccggcgccgctgccacgccgccgccctcctcgccgccgcaatcttcgccgcggccttggcaaatcagaatgaatggaggagcgaggtcattgtaattatatttttataatgtaatttctacattgtttttattctatttattttgcatgtcgatatatatttcttgtaccagcgcgtgccggaaatcaaaaaaaaaaaaaaaaaaa

SEQ ID NO: 14413 - DNA, 1167 bp, Zea mays
gggtggatgacgaggacggcctgagctttgagacagcatgcatgcatggctccgcgacccccacgcgcctatatccatccatcatcctatcccgagcccgccacatactccaccacctattattccgctcccgacgcccagaattcacgagaacgcacccgcccgcctcctccttccgtccccatccagatgatgcttagggtttccgcgtctccggccgccgcggtggccaaccatctctctggtggggccgcggcgaccacggctcctgccagggtgacggcgcagcgcagcggcgtctcgctgtccgccgccgccgccgccggcaaggggaaggaggtgctcagcggggtggtgttccagcccttcgaggagatcaagggggagctcgccctcgtgccccagtcccccgacaggtcgctcgcgcgccacaagttcgtcgacgactgcgaggcagccatcaacgagcagatcaatgtggagtacaacgcctcgtatgcgtaccactccctcttcgcctacttcgaccgcgacaacgtggccctcaaaggatttgccaagttcttcaaggaatccagcgacgaggagagggagcacgctgaaaagctcatggagtatcagaacaaacgcggaggcagggtgaggctccagtcgattgtggcgcctttgaccgagtttgaccaccccgagaaaggcgatgctctgtacgctatggagctgactctggctctggaaaagctggttaatgagaagctgcacagcctgcatggtgtggcaacaaggtgcaatgatcctcagctgatagacttcatcgagagtgagttcctcgaggagcaggtggaagccataaataaggtctccaagtatgtcgcgcagctgaggagagtgggcaacaaggggcacggggtgtggcactttgatcagatgctgcttcaggaaggggcctgaaggccaacaagggtggcgtggacggagctgagctctgggtggtgtattcttttctttttcttttctttccagttggttagtgttttagttgtagaacggtgttgcgttgcccacatgacatgatggatgttacgtggaggattgtctcttatatttgaacattatattgtcgttcgtttttggcaaaactctgccactgtcgtgactttcaaaaaaaaa

SEQ ID NO: 14414 - DNA, 1260 bp, Zea mays
cattgggtacctcgaggccggccgggaaatccttacgaaatctgttctccagtccacccattcccttccactaccgacgcccagaattcacgcacacgcacacgcacacgcacacgccacatccagatgatgcttagggtttccccgtccccggccgccgcggtgccaacccagctctccggtgcgcccgcgacccctgctcccgtcgtcagggtggcggcgccgcgcggagtcgcctcgccgtccgctggcgccgcgtgcagggccgcgggcaaggggaaggaggtgctcagcggggtcgtgttccagcccttcgaggagatcaagggggagctcgccctcgtgccccagtcccccgacaagtttttcgcgcgccacaagttcgtcgatgactgcgaggccgccctcaacgagcagatcaacgtggagtacaacgcctcgtatgcgtaccactccctcttcgcctacttcgaccgcgacaacgtggctctcaaaggatttgccaagttcttcaaggaatccagcgacgaggagagggagcacgctgaaaagctcatggagtaccagaacaaacgtggaggcagggtgaggctccaatcgattgtgacgcctttaaccgagtttgaccaccctgagaaaagagatgctctgtacgctatggagctggctctggccctgggaaagctggtcaatgagaagctgcacaacctgcatggtgggggcaacaaggtgcaatgatcctcagctgacagacttcatcgagagtgagttcctcgaggagcaggtggaagccataaacaagatctccaagtatgtcgcccagctgaggagagtgggcaaggggcacggggtgtggcacttcgatcagatgctgcttgaggaagaggcctaaaaagaagaacggacagatgaatgaaggaaacaagtgtgtaatgttgatcaggcggaggaataatgggtcaactgacaactctgggtcggtggatttgtagttggtttgggttttttagttgtagaacggtgttgccctcctagagagggatgaacacattatgcatgcgatgtgtcagttcggtcggtgctatgctcgttgggatttgattgtcggaaataaactccctaatctatgtcttggtgatgaagttgagaaagccctgcgggtgtaggtggatttgtagaggtttttcttcagttggttaggttcgctgttgcctacctcatttgcccctaatcatcatccccgtaatttttttataatat

SEQ ID NO: 14415 - DNA, 1375 bp, Zea mays
  misc_feature (24)..(24): n is a, c, g, or t
gggaccctcgaggccggccggganaaaaaattcaaaacacatgggttacctcgaggccggccgggagccgcacaatccatccatccatctattctccagtccacccattccattccactaccgacgcccagaattcacgcgaacgcacacgcacccacacgacacatccagatgatgcttagggtttccccgtccccggccgccgcggtgccaacccagctctccggtgcgcccgcgacccctgctcccgtcgtcagggtggcggcgccgcgcggagtcgcctcgccgtccgctggcgccgcgtgcagggccgcgggcaaggggaaggaggtgctcagcggggtcgtgttccagcccttcgaggagatcaagggggagctcgccctcgtgccccagtccccagacaagtcgctcgcgcgccacaagttcgtcgatgactgcgaggccgccctcaacgagcagatcaacgtggagtacaacgcctcgtatgcataccactccctcttcgcctatttcgaccgcgacaacgtggctctcaaaggatttgccaagttcttcaaggaatccagcgacgaggagagggagcacgctgaaaagctcatggagtaccagaacaaacgtggaggcagggtgaggctccaatcgattgtgacgcctttaaccgagtttgaccaccctgagaaaggagatgctctgtacgctatggagctggctctggccctggaaaagctggtcaatgaaaagctgcacaacctgcatggtgtggcaacaaggtgcaatgatcctcagctgacagacttcatcgagagtgagttcctcgaggagcaggtggaagccataaacaagatctccaagtatgtcgcccagctgaggagagtgggcaaggggcacggggtgtggcacttcgatcagatgctgcttgaggaagaggcctaaaaagaagaacggacagatgaatgaaggaaacaagtgtgtaatgttgatcaggcggaggaataatgggtcaactgacaactctgggtcggtggatttgtagttggtttgggttttttagttgtagaacggtgttgcccccctcctagagagggatgaacacattatgcatgcgatgtgtcagttcggtcggtgctatgctcgttgggatttgattgtcggaaataaaacatgggtgatgaatgtgtaccctccctaatctatgtcttggtgatgaagttgagaaagccctgcgggtgtaggtggatttgtagagttttttcttcagttggttaggttcgctgttgcctacctcatttgcccctcatcatcgccgtaatttatttatttataatataaaagatccagattttcccccaaaaaaaaaaaacccacgcgtccg

SEQ ID NO: 14416 - DNA, 3077 bp, Zea mays
  misc_feature (2491)..(2491): n is a, c, g, or t
tttgttctatttggactgcggctaacatgtcttaaaatttgaacttttcagtggtgaaaagccatcattaaaagattggcgtagctttattgagataaagggaagagttaaacttagtgcttttcaagagtttgtcgatcagcttcccaaatctaaaagccgtgctataatggtatttctttttcttgctgtagtctgtttatgtattcctttcgtaacaggtttaatatgccgaggctggtgaaaatatcttatctttgtgtctaattacctcatggatattattgccatgtggcaaagtattatatatattctgagttggagcacaagcgcttatttgatatttgagattgaacaatggttgaacggcgcgtgttgggataatcagtgctaaaaagaaaaccacatcattgcttgtcaggtttgtgtcggcacacctatatgcaaatggaattctaagcaattaccagtttcttaatacctggactctaaattgacatcatgttatataatgtcatttggctttgttagccagagtattcatagggtcctagaagatatgaactgttgtttcagattagctgttggttatctatttcgtcaatttaactacccgctaactatttttgttagataaccgagctgtgttggaaggagggttcatcggaaagtggccgccaaaatatcttgcaggttacattctaccttttgcctctcactactgttggagcgatcttaataggatatagaggattgggtatactaaatttggttcttgttgtgcagactatcgatgcatatatttcagatgagagagtaggattagctgagcctgcagaaggaatagagctgtacctgtgccctcctcatgggaaaaccgtggaaatcctctcacggcacttgccaaaggagcaccaagagagccttgctgtggcgggatcatccttcatcggagttgtggtatggcggaggcccagcatttccagggcacccacctcccaccacaacaacaggcatgatggttccaagaggcagtcgatcctagggaaaccacaggttacaaatccggccgcaaggccctccctacctcccaactcatacggcgcaccaccaggctttaccagccagcgcgaagaggaagatgtaactgatgacgcccctccaggctttggacccggtgttgctagggatgaggatgatcttcctgaatttaattttgttaaatcgtcacaccatgccgcaaatgtaactgcgcatgcctacaagggcccgtggccacatgtaccaccaccctctgctcgcccagcagagcaaatgagggaactggttcagaagtatggtaaaagatcatctgttcaagaaaaaaaaaaaaaaaagccccccgtgcctgggatgacgacgacgatgacataccggagtggaaccccacccaccagacgattaagcagcctccactgccgcacgccccacagcaactgccgttgcctccgcctcccgtccagcagatgaacgccgcctaccagcagcagtaccacatcccaagtgctgtgcagcctcaggttcccatcacttcgcttccccatgcctatctccggacccagcagcctcagcctgggcaggcatggcagcagccgagcaatgcttggtggccagcgcagggcgttgctgcccctgccgcacagcaaccccagtatggggtagtgcctggcagcagtggcgtccagggctacgactctagcaacgcgggtggtatggcatggaggccgagatagagcattgtaaaattcagctggttttctattgtagctgtggtcaacctgacgagcgtccgttgtagggtgtctttttttttttattatggttggctgttcatgtaagtataaatggtgtacaaccgtacaaaggatgtaatcttgatagactagatagatagttgctggttgtacccgttcatccgttaggacttgctgcaatcgttttgaacagcagtcgctcttcacttaatgctcttattaggcactgccaacaatagcaataatgtaccgcaaagtttctaaatcattttatgcattgcatggtatttggtggactgggatatacgcatcgaggaaaggcattctgccagcggctgctgctgctgcattttcactatctatttaagcagtagttgtatgttcaagtggaagccggctgaggctgtggccgctaataatgccttccggacggattttgagacgctttatcacttgtgggttgtaacacattcgttttctctttttttccctaagaaatgcaactggtattgttggaacaacgggtttctccaatataaatttgctttaccataagtcgtgacaaatcccccgcgttttaaagagtggtgattttcacaggcttgttatgcggttatgcctttggatgtaaagtttagtttagaactacattttctcgagagatttctatttttcccaataaatttcacgaggaaagnaataaaggctagtttagtttagaaactacattgttccaagatatttccatttttccaagcagaattggttcatttcaaactagcactaagcatttagcttgttcggcaatattatttccccgcttttctgtgaacaaacattgtttttctttaaaagattaaaaaacattacttcgccggtccaacacactaatacacacaagctttatagtggttgttctagaactcttcgcactattttttcggtaccgccagtgctaggagccttccattggcgattattttaaaacctttagtgaaaatgcattttccactagcggttttctttatttagccgccagttgtagttttttcgactttttcaaattttgaaacaaaactatatatatatatatatatatatatatatatatataacaacatagaaataaatttatcatacatttatatacatcaaattcttatatttacaaccatatatgcatcacacattctatacataaaagttttcatctaagctctaataactatcttgaataagagatagtctactaatttccactagcagttgcctagtcaggcccaa

SEQ ID NO: 14417 - DNA, 1724 bp, Zea mays
ctgcagaagaacttgcctccaaagaactctcagagtggcggttggctaaggccgaccggcgcgcccacgggcgcgtccgtccgactatggaggttgaccctaggcgtttggttagaaaaactcacaaaggagagttccaagttgaagttgaagagccagatggtttctcagtggaggttgaacttgggagtaatgttactaacattccatcaaaagctgttgaagatcagacaaagtctaatggaacagatggtaaagtagatgttcaagaaaaggacaaagcatctgatagcgcttcacacgatgaggatggcagaacaggcaacaatggtataccaggtgatgtagaatgtatcgataatgagaaagctgatctcatgcaggaacttatcttggatgatgtgaaggacactgtaaacctcccaccaattccttcgttagatgaattcatgcagggcttagattctgagccaccttttgttgatatctcagttgggactcctcaagaagatgtcaatgactctgacgaacttgacaccaccatggagccttcggatcttccagagacagaagataatgcatctgcaccagaaaaaactgaatctaaatctgataagtcatctgcacaggttaacagcgagcacaggttagagtcaccaggacatatagcggttcaaaattcggatcttactgaaccacgtgatggagagctgagcaaatcctccccatcccctgacaaagatgaagcaaagaaaacaactgttgataatgcctctaattccgattctgttcatcacaatcaggcagccagtctccctatgatacgtgagagcatttgggagggtgcaattcagctgaccgtatcttcgctctgtaatgttgttgctattttcaaaagtggtgaaaagccgtcattaaaagattggcgtagctttattgagataaagggaagagttaaacttagtgcttttcaagagtttgtcgatcagcttcccaaatctaaaagccgtgctataatgataacggagctgtgttggaaggagggttcatcggaaagtggccgccaaaatatcttgcagactatcgatgcatatatttcagatgagagagtaggattagctgagcctgcagaaggaatagagctgtacctgtgccctcctcatgggaaaaccgtggaaatcctctcacggcacttgccaaaggagcaccaagagagccttgctgtggcgggatcatccttcatcggagttgtggtatggcggaggcccagcatttccagggcacccacctcccaccacaacaacaggcatgatggttccaagaggcagtcgatcctagggaaaccacaggttacaaatccggccgcaaggccctccctacctctcaactcatacggcgcaccaccaggctttaccagccagcgcgaagaggaagatgtaactgatgacgcccctccaggctttggacccggtgttgctagggatgaggatgatcttcctgaatttaattttgttaaatcgtcacaccatgccgcaaatgtaactgcgcatgcctacaagggcccgtggccacatgtaccaccaccctctgctcgcccccagagcaaatgagggaactggttcagaagtatggtaaaagatcatctgttcaagaaaaaaaaaaaaaaaaggatgacgacgacgatgacataccggagtggaaccccacccaccagacgattaagc

SEQ ID NO: 14418 - DNA, 1140 bp, Zea mays
attgtcgtaatattaaatcgggtgtcccccggattatttggataaccggggggtgagtgggagaaaagggacacgagttgtgagtgggcatatctttcggggatagtgaggaggtacaaagagaatatattttttggagtattttctccagaggggaagaacgaggatctggggtttgagaaactttaggccatcgatggtgggtgagaaaaaaggcattggcccccaattttcgtgggctccccggggaaagatttggaggaaaccacctggagaaggacgggtccccttaccagggggttggaaatttgtggtgaaatatccggggggggaaggctttggctggggcttccacaaagcggttacttggggaattttgtttgtggaacccctttttccaagcttttggaaagattggggttggagggatttccctcgcccgcttgcccagggggggttggtaccttccctttggccggcacccagctcccaaggaagggaggacttaaattccaagaatgaaccaccgccattaagcccttcgtctggccaccacggatgatggttggcccttcgagtcgctgcacatatcttaaccctccctccagtggttgtgtgcagcgtctgcgaaaagagtaggtactagatgatggaatagctcaaagggaggcaccccaagaaaagctcaaaacttatgagaagaggggtgcacttcagatcctgcatcggatgctgagaagctgagcctccagcagctgccatgatggtgtacagtgagttattgaaggttggaaacggagtggaggcttacatgtgtgtggggtcatttggtcttctagtttgtttctgttgtttcttgtaaatattagttgtgaagtggtaacctatgttcatgtggtgggttttgtttctgaccaatctgtgaaattaaggccagcccccgtttggcaggtctccggctcctcttaaaacggctccggctctggtttctctgaaagagcgctcctccgcaggagccggtgttttttttaattgtttggcaaaacagattcttttgtgttttttatttggtggacgagccaagattatggtgaaaaaatattttatggaagaatgttccccccaaaggatattatggtg

SEQ ID NO: 14419 - DNA, 1183 bp, Zea mays
ctcagatgtcgtcagtccaagtattgttgaactctaaagacttgctggacactgagcctgaaggaatacgtgaactaataagcagttgcaaagtcgggaacgctacaaaatcaaagttaagaaaagtggcagaatggatcatacacactaaatgtgctcttggggaaagtcatcatcagatgcaggtggtatctaagaactggaaactagcaaaagaaaatgaatcagcacattttttgtctatatcagagctaatctctcagagaaagttatgtaatataaacatttttgcatgcatcggcaagatggttctagtgagttctccgacctctcctttaaaggtaaacttgtcggacttgtcggtcatcgacagacgttctttcaaagagcacagtgatattgtcagagatttggttactgctggatgtaagctgtgtggttcgcctctctatcacaaaaaccttcatggggaaaacacgtctgcactcgattgtcctaataacccaaaatatctccatgttcctggtcagatatacaggccatttctgatatatatctatgaccaatctggacaagttcctttgcttgtgaggaatagagctgcggagaccttgtttgccaatatcactgcagatgatgtatctgaatgccacaacagccacatgctgtcagaaacctatgaatcgtgtaacctgagcacccctggtacggtagatggttgcggcaacgaagagatagcgaaaaggagaaaaacggaacgaaagcctaatttctatcttatttggcttactctggtcaagtgtctgctgagccaaggcagcaacagccccttctgcttccagatctcagtcaaccccgagaagaatgttgaggatggacgtttcgaattggtttgtttgacaatgccaataccatgagatagcattttttttcttatgcaacacatggtttaagctgaaccaactcgtttttttttcctagaaaaatagcaaagcctctctttttccccccacaagaatgttcattggtcattccattagttgaaatcttgctgacatactgtcctgcataggaacttggtttggatggcagaactatcggatgttggctgggcatggatatgattccactggtccctatccatttgaatactagccttggaagcccagctgaaagttaaaaa

SEQ ID NO: 14420 - DNA, 950 bp, Zea mays
aagacagcaaccacatgctcaccagtgcatgcccccgaagcaaaagacttgctggatatcaccaaagattaggttaagaagcagctcgagccgcccttccttccagtcccatggccgcgcccgcttcttcggttacctccagaggcttggcactccgtagcagtacctccgtgggttttcatcgccaccgcgggaataatccggtgatcagccccgcgtcttctcgtcgccgacgaagccttactggtggatcaacgatgaactcctcgggcatgaacggtgccttccctcctatcaaaggaagtacacgaatccccgcagttggtcctggccctgccagtccgtcaggaggaaacctgccgatacccaacatgcctccatgggccaagtggctggtcggcgccgccatagtcgcgataccaatctacaggaggttcagaacactagaagataagatagagaagacggcggaggtggcgatcgaggtggtggacacggtggcggggtcggcggagaaggtggccggcgaggtcgccggcgcgttccccggcaacgagagcctcagggaggcggcgtcgaggatcaaggcggtcacggatgagatcgaggaggacgccgagagagccgaggccctgatcgagaaggttgacgagataaaggaacaagttgattcaatcgtcgatcccttaatcgacaaggttgtcaaggataaagaaacctagagagaaggaaccaaggaggaggcaatgacatgatgtagattattgaaggtataaagattggttaggcggtgccgcggtggtaaccggaagaaaatacctaccgcatgtaaaaaaaatcactaaatataaatataagaagcttttcagaaaaaaaactcttctctaacagttatgtaagacaagttcttaaatttacaaacttcttctaaaccaaaaaaaaaaaaaaaa

SEQ ID NO: 14421 - DNA, 815 bp, Zea mays
gaacgccggcacccaccgccggcctactgccggcgtcggccggcaccggcaccgccggctgcgggggcagcgcgatgctgtgcccagggtttgagaccacccccgcgggggaaggtgccggggcctgcgctggaggaacgctcatctgtggcgtggccttgggtgcccacggtagccatggctgccactggtctggcttgaacgtcgacgctgggctttgagaagaactgcctccaccggctggagggtactcgctggagtctggcaacgacgacaccttgtcgccgaaatccccggaccagtacctgttctgctgctgctgctcgtgcaggaatttcctggtccggtcaccgtggtgggttgtcctgctagcttcggagacagagaccatatcttcctctgggttcgtagttcctccttgtccggcatcatctttgtggcagctcccgagatcagggagcgcggagaccagcaccaccaccagcagcagcagcacagccagcacccggtgacggcgcgtcttctccatggacgccgacgagattctgctacggagcaacatgggaacgtacgcccggaccaaccatgcactggtcatgagaagaaggccactctcgccttagcatgcggccagtgccggcgagggaagagctagacgcctcagcattaattcgtctagctcttgcagtggagagtggagacgaggaggaagatggccacgcggagcgggtggtgttggtgtggttggggctagcaaactcgcaataatttcgcgcccgcccggccggctcccgaccgccgcctgagcgccgcac

SEQ ID NO: 14422 - DNA, 1769 bp, Zea mays
  misc_feature (120)..(120): n is a, c, g, or t
  misc_feature (481)..(481): n is a, c, g, or t
atgacctttctgctttgttttgcagtgccgcgaacaagctgacgagagacgggagtgccagagaccagctcccctggaagtgcatgaactagtcagctacaagtttagtacatggagcanacgcgcacgggtggtgccggggagcagcccaggggggctcccggcgaggaagcggcgaagaggatcatcgttggcggagacgcgccggcgtcggggacgtctggctctggctgcttcgactgcaacatctgcctcgagtgcgccacggagccggtggtcacgctctgcggccacctctactgctggccctgcatctacgagtggctacgccccgacgtcgccgaagccggcgccaggagctcggcgaggcggcagtgccccgtgtgcaaggccgcggtgtccccggacgctctcgtgccgctctacggccgcgtcgggagctccagcgccaaaaagccgctggcccagcatcccgcgcccngcgccggccggcccttgcgacagagcacgcaagacagcggcagcggtggccaccaccaccaccatcggcacgcagagaccggcacgccagcccggtcgccgcggcacccagcccacgcccacgccgcgcagttcgacgccctcctctccgcgccgttcggggaccgcgggatgctgcactcgacgtcgacgaccggcgggatgctcggagggatggcggtggccgtcctcccgttggtgctccgcgggcaggcgcgggtgccgggcatgtactacccgagcccgtatcatctgatgagccccaggcagagacggtggcatgtggaggtagagagatccctgcatcagatatggttcttcctctgcgtgttcgtggtgctttgcttgctcttgttctgatttctgaagcaggacaccatcctccgcctgcgggccacgagacgtgctctgtacatagcaaagggtgcgcggtatggatatggtgcggcagtgacctatatttggtgattgcatgacgggcgttcaagatgttaaattgagaaccagctgagttctggtcctagcaaggagaaatcggtttcgaaactgcaaaggacccttgagaagattatcagaagccatcgtccacatgttcatgcgcagacagtaacacataagctactggtaatatagagcgtcagaaaaaaaatgcttcagtatctaaatgtcacgctaccattttgagcgctttgatgacctgtgcagctgtgctccctccatctcggtctcggtggtcaccagcaatgcagcatttaactctaaaagtctgcaatgtgtgcgaaaaaggaatgccactcgtggcagcttacatagctccctttgccaaaagaacaacagcaccttgattcaaaacgtcacttaagattgtgttaagatctatgatcatcttctgtcaactctgctgattttgcagctgattaatccggctgaggaatgaggatgttgccggagcgcgtctcaaaatcacgaatctggatgagagcacttcacgacaggacctgctaccaccgacgtgagtgtgatttgccattgatatacagcctgatcagttgcaactccacttagtactatgatgacgagtaacagagcgtctgtgaaagggagcacggccggctacaacagcagctgaagtagcgcataagtcacaagttacagtccactacaactgatcattcgagctttgcttcttttttttttgtaacggcaacagtcgttgatgactaacataccgaacaatacatgattattat

SEQ ID NO: 14423 - DNA, 1255 bp, Zea mays
aaccgtgtcgagaacgaggtccctgccgccgccaaagccgatgcatcagctccagctgcgtatggtcacgcccagcgagagctccgaggttttttcatcagaaacaaaggattctggtgtgaaaagaaaggcacatgcgatttctgcaactactgaatcaacaaaaatacaaaatgctgcaagggactggagctgtgcactctgtcaagtgagcgcaaccagtgagtctggtctgaatcagcatcttcaagggaaaaagcataaggcgaagctggttcaatgtggagcgatcaaggtgatggatactaataaaagtggtttacatgtaaccactggaaataacaatggcgcaggcccaagtgacgcgcctaagaaaatccacatcctggtcgatggagaaatgcaccaggtcgtccaaaaaagcaaccgtgtatggtgtgagcgttgcagggtcagctgtaccaatgccggtgccatggctgaccatctgcggggcaagaagcacagtttattgaataaagtctgggcgtcaataaaagccgtgagaaggaacaatggaattaaggaagattcagctactgctacatgtgagagaaaggtaaatgaaagcggccctgctggaattccagaggaagaggaacatgaggaggagggagacacatacatggctagcgaattcagcggagatgcttcttccgaaattcctatggaaacgaaggaaaccactgacatggccgaagaagcagatgcagatagtcacagcgtaactcctgtgggaatcaacaaggaagacaccgacactgcgagcaaagcaaccggaaattaccccgcgggaaccaagcaggaaggcactggcgtggtcatggatgtaaacaagaattctccgccgaaagttcatcagaaatcaaggaaggcatttccgttgaaagtccatcaggaatcaagaaaaaggaggcaaaataagaaatttctgtcgaaagtgcatcagaaggcaaacgagaatttgctgccgcaatgtgcatcagaatccaagaccaaaggattcgggaagtaaatggaagtagtagctctattgagattccagctgggggaagacataatgacgaaaccatagacgcatgcactgattttaggcaagaacctgtgcgggaggaggaataacacgccgcaccagtgttgtaatttggttagcagtaagctttcagtatcgtgcgacgaactctagtagaatccatccgtattatgggccttctgt

SEQ ID NO: 14424 - DNA, 2672 bp, Zea mays
accggagacacgtaccggaccagcagccggacgggcgtatcaaacataacaagctagctaaggccgcctcgctcgctcagcatatacggaggcagccgccggtaggccgcgcgcgcgtgcatccatccatccatccgtcgtccaccgcccgcgcgcgctcgccaccgcacccagctagcagcacaagaaaagtctggtggtggcgtcgacggcggcggcggccggcttgcctcagtccaatccttggaccggccaaaaagcagttgaaggcgcgagcgagcaagctagcgcgccccttcgtcgctacgcctacgcgcgatcgagccgggcattgctgacctcgagttaagttgggcgaggagaggtggttcattccagcagggatccttctcgtgagcccagtcgatctgaccgtccttggtatctgggggggttgttctgtactctctctttaatttgtgagtcgtgacaggttcttgaagtgcaattgttaagagttttagttgtagaggaagagaaggatttgctaatatggcgttggcagggacctccaaagtagtgctgggatgtatcgcctttgggattttctgggtgatggccgtcttccccaccgtcccgttcatgcctgttgggcggacggctgggtccctccttggtgctatgctaatggtcctgttccgcgtcatctccccggaggacgcgtacgccgcgattgacctcccgatcatcggcctgctcttcgggacaatggtcgtcagcatcttccttgagagggctgacatgtttaagtacctcgggaacctgctctcgtggaagagcagaggcagcaaggacctgctcttccgagtctgcatcgtgtccgcgtttgccagcgcgcttttcaccaatgacacatgctgtgttgtcctcaccgagttcatcctcaaggttgctaggcaaaacaacctgccaccacagcctttccttctggcccttgccactagttcgaacatcggctctgctgccacgccgatcggcaaccctcagaaccttgtcatagctgtcgagagtgggatctcatttggccagttcttgctgggagttttcccagctatgatcgttggggttctcacaaacgctgctatcctccttttgtacttctggaaatacttgtcggtggagaaggatcaggagggtgggcagcccacaggaccagaggtggttgccgacgatgaggttacttcccatcggttcacaccggctagaatgtcacatgtttcttctctgaatccagatgacatggattgcgtaagcgaaccgatcatcaggagcaacagtgtcagtactactgggaatgagaacctgagaagcagaagcatcaattctgaggctgacattcagcttgcgatcaagtctctgcgggcatcaagcatgtcgcatgagatggtagaggtctcgacggttcctgatcggagagatgaaggtgcatcctcaaggaagttcacaaggactgctagccagcaaaggagcgtgataatagaggatttagcaccctccccagagattaatggggaaaaggagaaagaaactgaagttgcagagaagagatggaaagtacttgtgtggaagactgctgtttatcttatcactctcggtatgctcattgcacttctaatgggactgaacatgtcctggactgcaatcactgcagctcttgttcttctggcactcgattttacggacgcacaagcttgtcttgagaaggtgtcatattcactgctgatctttttctgcgggatgtttatcactgttgatggcttcaacaaaacgggcataccgaacacactatgggagttagtggaaccatattcacgaatcgatagtgcgaaaggtgttgcacttcttgccgtggtgattcttatcctttcaaacgtggcctctaatgttcctacagtcctattgctcggtacaagagtggctgcatcagcggcttcgatttctcatggttcagagaggaaagcctggctcatccttgcatgggtcagcaccgtggctgggaacctcaccctcctaggctctgcggcgaatctgattgtctgcgagcaggccaggcgggcccagttcttcggctacaacctcaccttctggagccacctccggttcggggtcccgtcgaccatcatcgtcacggcgattggtttgctcatcgtcatcagttactgaaacagctgaaggcagaagagcgtagtgtacgagaagcagaatggataaaaatccttccaataagaagtacatgtaaattaggcttgccctataactcaagtgtgtatcggtacattatgtctccgtctgagctcttgctcgtgagcaagcagcacatggctgaccgtgtagcttgcatttccattgcataataggcttatgaagaatgctttggtaatatgattttacagtctgacaaggattgtgaagcagaggcagtgtaccatcaagataatacctctggaagcatataaaaaaaatcgtatatttggatttcaaatccagtctgcttcagactggaaattcatattatcttctggaatcgtgctttattgtcagaaacatgggctaaaattggaaagtccgtcatttattggtcttgcaatgggacaaccttttgggtctgttatataccaaaaaaaaaaaaaaaa

SEQ ID NO: 14425 - DNA, 1013 bp, Zea mays
  misc_feature (9)..(9): n is a, c, g, or t
  misc_feature (25)..(25): n is a, c, g, or t
  misc_feature (937)..(937): n is a, c, g, or t
taccctcgnaggggccggccggggnaaaaaaaaaaaaaaaaaaaaaaaaggcgagccctgagctctctggtggccgcacacgtcgcaccggccccgcttatttaagcccgcctgcgtcccccgcgggggcgggaccggagacgtagcggaccagcagccggacggccgtataaaacataccaaggccgcctcgctcgctcagcatacggaggcagccgccggtaagccgcgcgcgcgtgcagtcacccatccgtccgtccgtccgtccgtcgtccgccgtccaccgccagcgcgcgctcgccaccgcacccagctagcagcacaagaaaagtctggtggcgtcggcggcggcggcggcggccggcttgccacagtccaatccttggaccggccaaaaagcagttgaaggcgcgagcgagcaagctagcgcgcccctacgcctacgcgcgatcgagccgcgcattgctgacctcgagttaagttgggcgaggagaggtggttcattccagcagggatccttctcgtgagcccagtcgatctgaccgtccttggtatctggggggggttgttctgtactctctctttaatttgtgagtcgtgacaggttcttgaagtgcaattgttaagagttttagttgtagaggaagagaaggatttgctaatatggcgttggcagggacctccaaagtagtgctgggatgtatcgcctttgggattttctgggtgatggccgtcttccccaccgtcccgttcatgcctgttgggcggacggctgggtccctccttggtgctatgctaatggtcctgttccgcgtcatctccccggaggacgcgtacgccgcgattgacctcccgatcatcggcctgctcttcgggacaatggtcgtcagcatcttccttgagagggctgacatgtttaagtacctcgggaaactgnctctcgtggaagagcagaggcagcaaggacctgctctttcgagtctgcatcgtgtcccgcgtttgcagcgcgcttt

SEQ ID NO: 14426 - DNA, 3151 bp, Zea mays
atgcctcctgtgtctcagtccagagtccaggctccaggactaccaccactccgtctcgtctcgtcctcacaccccactccaccaccacctctgccttgcaaagctttccaccgatccgccgcctcgtccgcgcgctcgcaggcagcagtgtggactacccgccccatactccatcccctactcgaaggatacaccgtgagtaggcgtgatggtgcttgataccccgttttcgtgcagcttgttgctaattcgttttagtttgagggatcaagaaccaccttgttctttctttctttcttttttggactatgatgaatcattgcaaatctcttgaatacatttttcactataaaatactgccttgcctttgagctccttggttcacgtgcaatgtttctttgccctccgattttgcaggacctcgagttattaagttgggcgaggagaggtggttcattccagcagggatccttctcgtgagcccagtcgatctgaccgtccttggtatctggggggggttgttctgtactctctctttaatttgtgagtcgtgacaggttcttgaagtgcaattgttaagagttttagttgtagaggaagagaagggtttgctaatatggcgttggcagggacctccaaagtagtgctgggatgtatcgcctttgggattttctgggtgatggccgtcttccccaccgtcccgttcatgcctgttgggcggacggctgggtccctccttggtgctatgctaatggtcctgttccgcgtcatctccccggaggacgcgtacgccgcgattgacctcccgatcatcggcctgctcttcgggacaatggtcgtcagcatcttccttgagagggctgacatgtttaagtacctcgggaacctgctctcgtggaagagcagaggcagcaaggacctgctcttccgagtctgcatcgtgtccgcgtttgccagcgcgcttttcaccaatgacacatgctgtgttgtcctcaccgagttcatcctcaaggttgctaggcaaaacaacctgccaccacagcctttccttctggcccttgccactagttcgaacatcggctctgctgccacgccgatcggcaaccctcagaaccttgtcatagctgtcgagagtgggatctcatttggccagttcttgctgggagttttcccagctatgatcgttggggttctcacaaacgctgctatcctccttttgtacttctggaaatacttgtcggtggagaaggatcaggagggtgggcagcccacaggaccagaggtggttgccgacgatgaggttacttcccatcggttcacaccggctagaatgtcacatgtttcttctctgaatccagatgacatggattgcgtaagcgaaccgatcatcaggagcaacagtgtcagtactactgggaatgagaacctgagaagcagaagcatcaattctgaggctgacattcagcttgcgatcaagtctctgcgggcatcaagcatgtcgcatgagatggtagaggtctcgacggttcctgatcggagagatgaaggtgcatcctcaaggaagttcacaaggactgctagccagcaaaggagcgtgataatagaggatttagcaccctccccagagattaatggggaaaaggagaaagaaactgaagttgcagagaagagatggaaagtacttgtgtggaagactgctgtttatcttatcactctcggtatgctcattgcacttctaatgggactgaacatgtcctggactgcaatcactgcagctcttgttcttctggcactcgattttacggacgcacaagcttgtcttgagaaggtgtcatattcactgctgatctttttctgcgggatgtttatcactgttgatggcttcaacaaaacgggcataccgaacacactatgggagttagtggaaccatattcacgaatcgatagtgcgaaaggtgttgcacttcttgccgtggtgattcttatcctttcaaacgtggcctctaatgttcctacaggtaatttttcttacgcatatgaccatgtataaccatttaatactttatatacatatatgctcttctgtttgcaaaattcataacacatggtatttcgagaggttgtgtgctcaatgccgccatctggcctctgttctttattcatgacaagcatgattaaatgaaggaaatggaagcattacattatcttgtgtacctcggccgcgacctcgcatagcttcaagagaaggtgttaaatttcctataaagaattaaactgaattgctacaatgattcttgtttgcagccacaataggtctggtttgccactgactttaagaactgaaatatatattgaactctacagcagagtagtttctgtacagtaaaatatgcaatcctgagaatatttctgcagaaaataatcttgaaacactatgctcttctcacagaaataggttgtagagatatttgttttgtcctaaccagcgagccatatagtacactgaacccgaacaagctaattttcgtttgatccatgtttcagaagtttgggagagtaattaattattggttcattctgtccatcctacgtctgattttttttctcactctttttttattcagtcctattgctcggtacaagagtggctgcatcagcggcttcgatttctcatggttcagagaggaaagcctggctcatccttgcatgggtcagcaccgtggctgggaacctcaccctcctaggctctgcggcctaatctgattgtctgcgagcaggccaggcgggcccagttcttcgcctacaacctcaccttctggagccacctccggttcggggtcccgtcgaccatcatcgtcacggcgattggtttgctcatcgtcatcagttactgaaacagctgaaggcagaagagcgtagtgtacgagaagcagaatggataaaaatccttccaataagaagtacatgtaaattaggcttgccctataactcaagtgtgtatcggtacgttatgtctccgtctgtgctcttgctcgtgagcaagcagcacatggctgtccgtgtagcttgcatttccattgcataatcgcctcttctccgttgcttcggtactctatctatattttatactaatttttaaattccgttgcaa

SEQ ID NO: 14427 - DNA, 2595 bp, Zea mays
cccacgcgtccgccctcccggccgccggcgtccaggccagagtccaggctccaggactaccaccacttcgtctcgtcctcacacctcactccaccacctctgccttgcaaagccttccaccgatccgccgcctcgtccgcgcgctcgcaggcagcagtgtggactacccgccccatactccatcccctactcgaaggatacaccgtgagtaggcgtgatggtgcttgataccccgttttcgtgcagcttgttgctaattcgttttagtttgagggatcaagaaccaccttgttctttctttctttctttcttggaacaattatgatgaatcattgcaaatctcttgaatatatttttcactgtaaaatactgccttgcctttgagctccttggttcacgtgcaatgtttctttgccctccgattttgcaggacctcgagttaagttgggcgaggagaggtggttcattccagcagggatccttctcgtgagcccagtcgatctgaccgtccttggtatctgggggggttgttctgtactctctctttaattttagtgctgggatgtatcgcctttgggattttctgggtgatggccgtcttccccaccgtcccgttcatgcctgttgggcggacggctgggtccctccttggtgctatgctaatggtcctgttccgcccccgcgtccccggaggacgcgtacgccgcgattgacctcccgatcatcggcctgctcttcgggacaatggtcgtcagcatcttccttgagagggctgacatgtttaagtacctcgggaacctgctctcgtggaagagcagaggcagcaaggacctgctcttccgagtctgcatcgtgtccgcgtttgccagcgcgcttttcaccaatgacacatgctgtgttgtcctcaccgagttcatcctcaaggttgctaggcaaaacaacctgccaccacagcctttccttctggcccttgccactagttcgaacatcggctctgctgccacgccgatcggcaaccctcagaaccttgtcatagctgtcgagagtgggatctcatttggccagttcttgctgggagttttcccagctatgatcgttggggttctcacaaacgctgctatcctccttttgtacttctggaaatacttgtcggtggagaaggatcaggagggtgggcagcccacaggaccagaggtggttgccgacgatgaggttacttcccatcggttcacaccggctagaatgtcacatgtttcttctctgaatccagatgacatggattgcgtaagcgaaccgatcatcaggagcaacagtgtcagtactactgggaatgagaacctgagaagcagaagcatcaattctgaggctgacattcagcttgcgatcaagtctctgcgggcatcaagcatgtcgcatgagatggtagaggtctcgacggttcctgatcggagagatgaaggtgcatcctcaaggaagttcacaaggactgctagccagcaaaggagcgtgataatagaggatttagcaccctccccagagattaatggggaaaaggagaaagaaactgaagttgcagagaagagatggaaagtacttgtgtggaagactgctgtttatcttatcactctcggtatgctcattgcacttctaatgggactgaacatgtcctggactgcaatcactgcagctcttgttcttctggcactcgattttacggacgcacaagcttgtcttgagaaggtgtcatattcactgctgatctttttctgcgggatgtttatcactgttgatggcttcaacaaaacgggcataccgaacacactatgggagttagtggaaccatattcacgaatcgatagtgcgaaaggtgttgcacttcttgccgtggtgattcttatcctttcaaacgtggcctctaatgttcctacagtcctattgctcggtacaagagtggctgcatcagcggcttcgatttctcatggttcagagaggaaagcctggctcatccttgcatgggtcagcaccgtggctgggaacctcaccctcctaggctctgcggcgaatctgattgtctgcgagcaggccaggcgggcccagttcttcggctacaacctcaccttctggagccacctccgattcggggtcccgtcgaccatcatcgtcacggcgattggtttgctcatcgtcatcagttactgaaacagctgaaggcagaagagcgtagtgtaagagaagcagaatggataaaaatccttccaataagaagtacatgtaaattaggcttgccctataactcaagtgtgtatcggtacgttatgtctccgtctgtgctcttgctcgtgagcaagcagcacatggctgaccgtgtagcttgcatttccattgcataataggcttatgaagaatgctttggtaatatgattttacagtctgacaaggattgtgaagcagaggcagtgtaccatcaagataatacttctggaagcatataaaaaaatttcgtatatttggatttcaaatccagtctgcttcagactggaaattcatattatcttctggaatcgtgctttattgtcagaaacatgggctaaaatt

SEQ ID NO: 14428 - DNA, 5991 bp, Zea mays
ctgcaggccgcttctctgcagccggctgcagagattttttcctgtgaaataccctgtcaatatatgtcatatgcagtttgacggcagtagtatgcccatgaccttattttttactatggtctatggggtttggtgatggatggcctaacaaggtaaacagctcgggcacttacctagccaatttacatggacacatggggttttgttttctatgatatgttcttcattcagtttgcactaattatgactactatgcaaacagataatattcagaaataaatttgtcgatctctcagtctttggggttttgtggaacggtctcaatataatatatattttacacttgtccctttttgtttacgtgttcaggtaggatgccaaacacaccggattggctggaagctaacaaggacatgttgcgagtactctcctggtgcttctagaaagaagcaagagaagtatgagcaacaaccacagaacgtcgatcttccagaattacacccaaaaaacaaaaagaaacccttccctgttccgattaaaaagatgctgcaagcttctcggcgagagaagaggcttgcacaaatgcatatagagaagcctcttgaacccccaaagaacggtttgcttgtgccagagcttgttccagttgcacatgaagtccttgataactggaaagtgctaatcagagggctctctcaacttctgaatgttgtttcagtttatggttgcaggtaactaaaaaaatgtttcagtatagctgcccctgttattacaagcagtattgcagtagtatcgtggtggtgtctatgcatgtgtgtatgcatcacctttataatcataaaaagaaaaggaaaaataatagtattacactcgtacatgcatggaatcagcattgtctgcaagcatttgccaagtaccctgaaattctgtcactggctggtgattttttttcagaaagtgtcctcaagtccatgttggtccagttggccaccagatccaagactgttacggttccggaagccagcgtcggaacagtcatcactcttgggctagaggttccatcaatgatgttctcatcccaattgagtcttaccatctttttgacccatttggtcggagagtgaagcatgataccaggtttgattatgataggataccagcaattgttgagctatgcattcaggctggtgttgacttaccacaatacccctcgaggcgacggactgctcctgtccggatgataggcaagaaggtgattgaccgcggtgagtttgttgatgagcccaagccacaacgttcagaacactgtgtatctctgcttgccgagctcgacacattcagcaaccaacaagtccagtcaccttcaccatcaaatatgaaagagcttgccaagaggacactgaaagcataccttaatgtccggcgaggcgtcgagcagctgatgagcaagtacactgtgaaagcatgtgggtactgctctgaggtccatgttggtccgtggggccacaatgtgaagctctgcggggctttcaagcaccagtggcgggatggcaagcatggatggcaggacgcggtggttgatgaggtcatcccgcccaactacgtgtggcatgtccctgaccccagtggctctcctctcagatcctctctcaggagtttctatggcaaagctccagctgtcgtagagctgtgtgtgcaggctggggctgaaatacctgacgagtatcgggccatgatgaggactgacattgtcatcccggactctgtggaagctcggatggctgcataacaacaatgttctgagcttctacgactactatcctgcagttcttgtccagagtacagattccaaccaaatgtgccgctttctgggcatgctgtgatggtgggtctcttagccctgtggtaattgctcagggagcagcagatgcatagtttgtataatataattagcatagctaaatcatgatcgtttgggatttaaagctgagttgaagatctgatttaagtactattcgttgaaaggtatattccttaccaacgccttttctgctattccatttcaattcatctctcttatgaaccagtggacttcaaacttttgcaggtttaacgcatgaacctaggacgcgcaatgacaagcctgatagcctgaaagctaaaaggaatggtctctgcaccatttataaggtccatcccatcttgtttacaggccgcagatgctttattcctgcctatgctagactgtgaggcacctagaatgctcaggagtcgccatactgatggccttccgctttctccatcggtacaattgcgagctaatgctttggattaaactaatcacggtggtttgttcggggtatttgtgcgcctggctgtagttaatcatggactaaaagcctgtgctgtgcacctgtgcccgcccccagatcgacactttgggggtatggctacatgtatagtcctaccagatcgtcggcatattgtgttctctttttgctgtatactagtactttgtaacatgcaagcggaggctacttattcagcgccgttccctaattgtgcttatgaaatgttttgagctgtatatggaacggatggtgatgaatgatccatgggcgaaagattcatccatgtgtgatcagctctgtgatgaatgatccatgagacctgattggctacaagaggtactaaactcttaggccacttatcgttaatagagggattacccaggtctcaaagctatagtgtcgttctcgtggtggagactgattatcacttcgtggcagtgaagcacccctacacaacttcttcaatagcccaactcttgatggacaacattgtcgcactccatcgtcttcttcctcactgtattgtcactgacagagacatcatatttctcagaactcttcaagctctacaaagtcgatctacaactgagtacaacctatcattctcaggcagatgggcaaaaaccaagaagtcaaccagtacagatgggcaaactgagagagtcaaactagtgtctggagatgttcctctgttgtgcagttcaggactccccgaatacatggaagtcttggttgtcatttgcagagctatggtacaactctgcttaccatgcatccattggatgccctccattcaaggccctatatggttttgagccatacagccttctactcctgctacagtgtctggcttagtggaaagtagagagctacatttacgatcaccgaaacataatgaagctcatggtagataggaagtgctctgacttgcagttccaagtgggtgatctagtattactgaatttacagccatacactgagttctctgtggctaacaagtatggattattcaggaaagcacattcgctctctagaaatacagaactagctcttgtttattggagtgtcaagaacatgacatgtcatcacataacaacctacgaatccatgatgcctgctggcgcaagcacagaaagagagaaaaggggggaggggagaaaagagtgagcagctgcactgcaagtacacgggcttgagttgtcccggtatataccctcttctcccttaagctagggcgattaaaataacgcaagtaaatacagctcggaatcgagcaacgggccgtggacgtttgggtatctaatggtccatcagttgctaataaagctgcctatgtggccgtgtatgcagccacggcggcggcgcccggcgcccgcggcagcagcagctcccacgcagaggcagtctctccggcgagctccagcgccgtagtcatcatcgccatggctagggaagaagagctcaaggttcgcaccaaagcttagcttgctcggccgcgcgcgtgcatcctttgactcgttgctagctcgtcgtatcgcctgctgccattgatcgactgacatccatggtgccgtgcagaggattgacctgaaggtgaacgtgagctgctgcgacggctgcaggaggaaggtgatgaaggcgatgagcctcaaaggtgatgaaggcgacgagcctcgagattttcaagtgtctgtgtcgcgtttgttaggggctgtgacagacaagtctagttggtgctgacgtacgtgtgcgtcgtcgtcgttgtgcgtgcaggcgtgctgaggacggagatccagccgtcgcacgaccgggtgaccgtcgtgggcgacgtggacgtcaacgtcctggtgaagaagctggccaaggtgggcaagatcgccgaggcgctgcctcccgcgcctgctgagcagggcaagaagcagcgcgatgacggcgacagagcggtgccggcgcaggcgcaaccgcaggcggaggagaagtgcaagggcaaggacgacgccggtggcaaggcggcggctaaggcagcgccgggcaagcatgaggggtgcaagaagtgcgcgcgcgaggccgccgcgcgcgccgtgggcgacagtggcgaccactgcagcgggaagaaggcgccgtccaaaaaggacaacaacgccggcggcggctggggcggcgaggaaggcggcgacgccgacgccgacggactcgacgccgagcccttggcggtggcgccccaccaccactatgcgcaagcccagacgcagcagcactaccaccgcgcggagccggcgatggtggtgccggtgcacgtgccgccgacctactactacccgcctccggccgccgcggcgatgccgtactacggctactacggcatgcccccgcccccgccgccgacgatggcgatgacgatgggggtggcaccgccgtcccagcggcacccgcaggcccggccgcagccttcccgcttcgacgaggacttcttcgacgacgacaacacggtcggctgcagcgtcatgtgaaccgttgacggacggccgccgccacgcgccgtagccggccatgctttgtagcgccatgccatgtcgttttcccgggcagatcgcacccgatggcgatgccatctgtctgccccatcccccgcgcgcgtgcacagtgtgactatatatgatgtgcgagaaagaagcaaaggaagccacccccgacgttctgtcaacgtaccatacgatgtgttagcttatcgatcgaaaggagggaatggaacgggatggcattgctgtcggggggacctgttgcgcggttccgccactgctcggcggcgtcccatcgcgggcgcgggccgattcgcgcgcgtgtccccgcgagtacgcaaggaggacaccaacaacagcacgagtggagaagagtcttttttgtgtgtgattcggcgttcggggtaggtaggtactaggtaggcaggcaagcgggctgctttctttgctgcctgaattccgtggcccgcggcttagcggatggtcgcggattccatggccggctggaccgaccaccggagctgccgattccatggctgagcggagctgagcttgtgagatcgagggagacgaagagacgggttcggtcgaggctgctttgctttggtcttgacccgcgtttgttcgttcaacaagggaataattaaaggcgatggagagaggcggattggactggaccgcacattcgcggttcacgcgtgatcgctgagcgtagtaattacatgcatcgccaccaagacaagcagtgagtgattattgctcattcactctgcatccaacatgatcgtcgtcctcatgtttatatatatatgtactacttatgaagttgctgcaatcatggaggatgtctgtggtgttcaccagcttcagtagaagtttagagcaggatgagtgcggaactgcggatagcctaagcatgcgttcgataccctcttagcttcttgcaaccttgtctacaatttggtcataacgaagcaaaaccaaaaaaaaaaacaatcaggaaaagaagaactcgaaactttgttcaggatttgctttgtgcccgtgcccaaaaaccaagtagcgtgcccagctgatctcggaactcccacccaatatggaactagcccaacacgctacgg

SEQ ID NO: 14429 - DNA, 5972 bp, Zea mays
  misc_feature (2665)..(2665): n is a, c, g, or t
  misc_feature (5144)..(5144): n is a, c, g, or t
  misc_feature (5469)..(5469): n is a, c, g, or t
gcacgagaccattacctagaacatcctaatcgaaaaaatccaacccagtccacacgagacgaaacgagccgagcccatccctccgtcgccttcgccaaccctagcctagcctccttcttctcctcctcccgcggatccaacctccgcccgcccgcccgccgccgccgagagagccctatctcccccacgccgcggtctccgcgcaagcgggggcaggggacgcggatcccgcagctccccgccatctccggaacggccatggaggtggcggcggctgccgcagggaagccgctgacgccggaggaggaggcactccggcgcagcaccgactgcgtctacttcctcgcctcgccgctcacctgcaagaagggtaatgaatgcgattttcgtcacagtgagggtgctaggatgaaccctagggactgttggtactggttgaatggcagttgtttgaatcccaagtgtgcatttcgccatccgccaattgatggtctctttggtgccccaacttctggactacctccagtttctgcgcactacggtgcctataacttgggcaagcagatggtcccatgctattacttccagaaagggaactgcttgaagggtgatagatgccctttctatcatggaccacaaacagctagtaatgatcttgcagagcaagcggcgaaggtttcttcctttcctttggaaccgtcccaggctcaaaataacgaagaggctgtagctccaaataattcaacgcagcaagaggcccgaatgactgaaaacaggacttcgattcatgtttccaagagtggtgtgggtgcaactcccgctgatgtagcttccaatgcattgaagcctgggaccaacttcgagcaggcacccagtaatacgcttgcagcaaagaaaagttccacaactgaggatcatcctatgcactatcagaaccaggttcctgtggagatcgatcctgtcaaagactggaaccaaaattttgaagtgtctcctactgattacctgccacaggatagtagggaggctgatgatattttgggggagtcctctcctggttttgatgttcttgtagacaatgatgtagatgttgctgaagattttgcaagggatatgtacccggtagaagattacgagtatgttacatctgattttgatgctcgggcccatcatgaaagtgagcagttcaacgatggaatgggtgtgaatggacggattggacagtatgatggctatgagaggaaacgccgtagatcttcatctgagaggaacctagacagacattaccatccagatggaaggtttcttcacagagagcttgatcgtggcgagatagatggatcagatctacgccatcagctccgcaggagaagaataaatgggccctcaacaaccattagcccagaacgggctaatggggaccgacatgggagggatgaaccctacagagaaagggcacatggtggtcaccacacgtacagagatcgctatcagggcccacgaggaagcaatctaagttcccgtctgcaggccagaataaagcttcctcgaagatcacctgatagagttgatactcgcttcgaggatgagcgagacaggagaagattcagggataggttttctccaatgaggcgtatggatttccatggtggtaggcatcaagaggctggacataatcaagaaaggggccacaggaagttaagcgagcttgtctctactgtcaggcatgcagatggcctctctgctagaagagatgcagtgggttcaactcattttgctgctcgcagaaacttgggagagccaaggaaggcaaatggtcttgtggaatccgaagcatctcttgattttgagggcccaaaaccccttagtgtcatcttacagagaaaaagggaggcagcacagggcaataactatgagaaatttgctgaggttgcagtcacgcagacaggttctctggatgaaactgagaagaaaagctgtgacaacgttaccaggtttgcagattgcaagagtggttcaggtgacgaagagtataaagagcaagatcatatccttgtggatgcacacaggcagtcttcggatcatggtgataagtttgaggctgggtatgctgctgaagtggatgcagaaggaaaacaagaggcagatgactatgaccagagagagggcgagtccgacgactacgagacatttgaaggccatgactacaaatctgaagatgaaaatgtgtaccaagacgacgaggatttcgatgataatgatgactttgctcggaaagtaggggttttattgccttagacgccgcggtgtcattggttctgttgcttgaggcaacgagctctagtttttgccatcggttctgttgcttgaggcaaagctgaaatgccgatcataatcgatttgaggtttacatgtaaactgctgtgtgatgttcagcacatctgacctctcctcggactttgttgtattagtttccgtactaacagcaggatatattccttaatcaatttgtgcccggaatgaaatataatcaactccacaatgggggggcgttttgcttaaaaaaaaaaaaaaaaacgcgggcccggtatgcatgtattttggccttatgctttgagataccatggttgttgttgcctagtcgtgtgggtttgctgcaaaatcnaagtgatatatatgtgtttatggtacttgttgaaaatgaaatcgtgtgctggagttggatacaggtgaatgcaacaggagctcaagagatgcctccccagtgcaacgtgatctgggttgctgacgaccgaaaacaaaattacaatattgattgctgacgagtgaaattattgcactgaacactgtaaattcatcgttcagttaccaatgaaaatattctcagaaaaatgaagagaaaacaagacggtatgcatgttttcttttttttttcttttggcgtggaagcgttccgttggttagggttagttattatgtatgtatgtatgtgagatgagttggacaaatgaagtttgtgtagaaaacttgtttattagactgacagtgtaccgctcaagggtctcttcgtctatcactgtagaaaatgttgttgtcctctggaatctctccttgtacgtccaactaaacacacccttaattcgatggaatcgatccaaaaggcttgtccctgaccatattagagatgataatggatcacgatctaaatatttatcctcaaaatggtagggtaataaataaattttagtttaaaaataaataaaaatagaacatgatcatatccttaaatcttatagcgtaaaatttagatctcgtataaagaccagttcatggccgccacgctacgttgtcagtcctgactcctgagtgcgaggcggttagtattggtttaggtcgacggcaggtaaagcagctgggcacgtaggaccccgatgggaaaaccggaaaaagggtcaccaaaaacacaagaagacgccggccgctttccggtcacgccaatgtcatcatacggcacttactagctactaggctaggtagtagctactaagccatgattgataaccactcagcaactggcgtgcgaatgcgcaatgcgacgcaacgcaacgcaacgcctctgcctctcctctagtctggttcggccgccgtgcatgtgcatcctgctgttgtgctctgtcctttaaattcacgcaggccaatcatgtggcaagttgctagacgccaatggcctatttgctatcgcctatatatcgttgtatagaatagaaatgcatgggtcgtcggagtactcctagctggctggaacatgcatgcacatcctggctctttggctagctatctatcgctgtgactgtgaagatactactcactctgatacacgtgctagctgacagtgatgcatgagatattattattcagatggaccatgctacgtgctgctagccgcctgagagcaacagggacggcaagctatagatagggcggcacgatggatggggatgcattttgcatggtgcacgcatatggtccagacggatcatgcatgtctcactctcacagtcaactagagagagaaatacatgattttttttaaagaaagttttgaacacagcacctcttcctcaaataaaatcctttttgaagttgagcaaagtttgtatccaaacacgtcacgggtcctcgcccgctgctagtggcagtaccctgtatccctcatgtgtgcatatcaacagtagtgaccgtgcaaagagaagtagcaaccggccggttggtttgggagtggtggcctcgatcgactcttcttaaaagggtctcggatcggtctaatcatgtagagcaggttctttggtaaaaactcaaaccgttttaaagaaatatttgacaaaaaaaaacagttctaatgctagttttattattgtagtctatgtcaagttcccgagaaaggaccagaaaaaagacatgcctttacccaccaattctataaaaggcgaggaaatctgcatagtggacgcctggaccgacgcggacgccgccggctcgcctttgcgaaaaagcccaaaaggattctctgcctctacgatgaatctcatcgggagcacaaaaatctgtatccaaatcctaaagagctcgcttttatagcgaaaagttttctttttttttctttttacaaatccacaactcgtaaaaggttgtgcagatcacacagaagcatgcttagattttgggactttgttcaaattgggaaggaaaaaaaaagttacgcgtagatttatgtaaaagcaactaaagaagatttatcgcgtacgtatgaggtcctaattactgacatgaaatgagatgttcacaatcacatgcgagggttgggttccggtggggagggagatcgaaatcccggcggcacgcggcgaggtgggcaacactaaaatacgaggtacagtactagcttttggttgtttgtgttattaagcttctgcactaaaacgacacgggctatctctctcgcgtcaaataaacaactgctacgtggcggagttagaggcgtgtttgatttctaaggactaaaatttagtatctccattttattacgttttaatccttaaatttaacaaacctgtatttatagaataaaatagagaactaaaaantagttcttataaaccaaacaaacccctcacagttagcctgtactgacagataagtatcgtctaatatgtcaggtcgtctgaagaactagatcgagcgcgggcccaaggaacctaataattggatgccttttggggtcctccatcaaacaaagggggataggatggtcacaggttccgagatctttttcgtgagcgccgtggcgtagtacgtggaattcgctcgccgccgagctagctttctataattactccattttggtaatggggcttaattatgatttgtacaatcgcaatctactttttcaaagaacgtttggttccttancgccgctgctgctggtgcacctcccctcgctcgctccaagatatgttgtgggtgcctagcgggtggccggcctagctctacgatgaccatcacgatcgagttcacaaaccggtgaacatttgttattggtatgtgctatttagccaaggaaaaatcacggtgtctttataattacgtaaaaaaaatacaagctaagcacgatgtttggtaacaatcacaagaaaaaatcacaaggcgcagctctagaaaatcaggaaaaaaaaacagagaatttgcttactatgaacaaattaatatagacttttatcttccacactctctcaacctgaacgcagagatgtcaggttgagattgcgcgctgaaattggtgaatggaagagccgagagagtgacttgttcagtgcattggcaggttgaaattgttgattggagcgcctgaaatcgtttggcccatagaagagttaatttcttgctgtaagtttcggacgaccaccgaaacgacg

SEQ ID NO: 14430 - DNA, 1281 bp, Zea mays
  misc_feature (9)..(9): n is a, c, g, or t
ccggccggngacaagcgaactcacgcgcgcgggttcggcgccaccctccaatccaaagggcaaggcaaaagctcgccccacccccagggccccaacctgcctatacggccagacctgctcgcctgattcgctctcccgcgattccacccccacaaatcctccgacccaacccaatccagcgtctcaaaattcacgcaacttcgcgtcgcgtcggctccaaatttgcccccttcgatccacaaatcccttcccccacccccgattctgcgccgaattcggttagcttattactctccgagcttatcgccaaccgtctgtcccgacctcgagatccggctcattttttcaccctcttacgtattcggatcgagcccgagctgccaattcgaggagctccgaacgcgggccgcataaagcgaatcgaatgaatcaagcttgcgcgacgggcagttgatgccacccggcgatggatcgccgcatcctcaggacctcgtcgtgcaacggcagcggtaagaacccgtccccttcctctcccgcggcggtctcacggcctgcgtcctccgggggcatcggctccaaggacgacgccgctgccggcgagcgcaaggcgctgctgccgcggcagcctcctggcggcatggcgcggaagggccgcaaggggtccaaccgccgcgtgcagtggaaagataagcatggcagcaagctcaccgatgtcagggagttccagcctagtgactcaagtgactcagatgatgaatatttggatacatgcatatgctcaatcatgtaaatacatcttgcacaggtggattctatcatgtgtataaggagctgtatctcagtattactgtcttcggcttggccctaacagtacagtgacaatcatgcatgcatgcatagttcgttccaacagactccgaactggtgataatcagctggccttaactgggagttacatcaaagacctagaaaatgatcaccggattcagtaggtagacatgattaaagaagccgagaaagaatgcctttctttggtttaattttggataccaacagcatcctgagtttttggcagagtaatgattcatgtgataatgcaaatgctattagaatcgaacattactaattcctgtgcatgattcagatcgattttgtcaaataggatttgatgtattaacatggtatgtttcttttaaaaagaatccttgctaccatcataaaaaaaaaaaaagtgcccagatttgtgctgaacactattaacaaactgatctgtgcaatttc

SEQ ID NO: 14431 - DNA, 1211 bp, Zea mays
ccggccgggggtcgtacactcgtactccggcccggcccggtccggcctaaacacgcattcttccttctcccaacgacggaagaaacttcctgcctggatatccatccatccaaccgctcctccctcgtccggcaggcgacgactcgattccttcctcccttcctcctcctcgtctctttcatcggcgactccgatcttctctgccgtcgccgccgccgccaagagatcgacccgaccccgagcgcccgacccgaccccccaatccaaccaccaaccgccggcgcgcgcggaagattcagatttggcccctcgccggtaagggagaaagcgaggatgggtgcgtggatgtcgcgcgtgtggttcctcatgttcccagcgcgggagtacaagctcgtcgttgtggggctcgacaacgcggggaagaccaccacgctctacaagctccacctcggcgaggccgtcaccgccgcgcccaccatcggcagcaacgttgaggaggtcgtcttcaagaacctgcgcttcgaggtctgggatctaggagggcaagaaagcctgcgcacttcgtgggcgacgtactaccggggaacacacgccgtgatcgtggtgatcgacagcacggaccgcgcccggatcaacatcatcaaggacgagctgttccggctgctgcagcacgcggacctggagggcgcggtggtcctggtgttcgcgaataagcaggacctgaaggacgccatggcacccgcggagatcaccgatgccctctcgctccacagcataaaggaccacgactggcacatccaggcctcgtgtgccatcaccggcgatggcctctacgacggcctgggctggatcgcgcagaaagtcgccggcaaggcgaccgcgagctgacgtgcaggagagcagtggttgtgtgttcatgaacggattggatttgttgaagggtaggggtggtggcagggcgggtttgtttcttcctcggcgtcacgcccaatgcttatttatgtttttttaagaaaagtggcttgaaactttgtgtctgtattccaatcaatatgaatatatgaaaattgggaaatttgcatgccaaaaaaaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaaaaggggcgggcccttt

SEQ ID NO: 14432 - DNA, 967 bp, Zea mays
gccggccgggaacagtgttacccttacagaggatgattgcggtgtctctcagatagacttcggaagggtcaagctctaaacaaccttggaagtgtttatgtggattgtgggaagcttgacctggcagctgaatgctacattaacgccctaaagatcggccacaccagagcgcaccaaggccttgcgagggttcatttccttcggaacaacagagtcggtgcgtatgatgaaatgaccaagctgatagagaaggccaggaacaacgcgtcggcatacgagaagagatctgagtactgcgagcgggagctgacgaaaacggacttgcagatggtcaccaaactcgaccctctgcgagtctacccctacagataccgtgctgctgtgctgatggacaaccacaaggagaaagaggctgtcgcggagctgaccagggcgatcgccttcaaggcggacctgaacctgctccacctgcgcgcggccttccacgagcacatcggcgacatctcgagcgccctccgggactgccgcgcggccctcctggtggaccccaaccaccaggagatgctggagctgcaccaccgggtgaacagtcaggaaccatgagcggagcgccgccatggtgtacatacaggacgtgataggaagcccctcatagccaacccccccgccataccagtgtatgttttgtaccatacacagcatgtcaatgtaaggatagtagaaaagccactttaggtccctccctggctccctccccttgcaaaccaaacacctacattccttgtgtgcctagttagatatgttgtttgccatatagcctttcccttagtaaattattgttgtctactgtgattaagcctcctaattgtacccgccatgtggcccgtgctgccagaatcaagaagttttgactgtaaaaaaaaaaaaaaaaaaaaaaaaaaaaaaactcgagaggaggcgccggtac

SEQ ID NO: 14433 - DNA, 1481 bp, Zea mays
cattgggtacctcgaggccggccgggaagcagctgagaatgctagtgctagagaatgtagagcagtggacagctgctgactgttggatgcagctttatgatcgctggtcatctgtggatgatatagggtccctctctgttatatatcaaatgttggagtcagataccgccaaaggagttttgtactttaggcggtccctccggctgcccgggttaaactgtcctgaggcggcaatgaggagtttgcagcttgctcgtgagcatgctgcgagtgatcatgaaaggcttgtctatgaaggatggatattgtatgatactggccactgcgaggaaggattgcagaaggcagaagcatccattgcaatacaaaggtcatttgaggcattttttctgaaagcttatgctttggctgattcgagtcttgatccttctacctcagcaacagttgtatcacttctagaagatgcattgcggtgtccctcagatagacttcggaagggtcaggctctaaacaacctcggaagtgtttatgtggattgtgggaagctagacctggcagctgaatgctacattaatgcactaaagatcggtcacaccagagcgcatcaaggccttgcaagggttcatttcctacggaacaacagagctggtgcatacgacgaaatgaccaagctgatagagaaggccaggaacaacgcttcggcatatgagaagagatccgagtactgtgaccgggagctgacgaaaacggacctgcagatggtcaccaaactcgaccctctgcgagtttatccttacagataccgtgctgctgtgctgatggacaaccacaaggagaaagaggcgatcgcggagctgaccaaggccatcgccttcaaggcggacctgaacctgctccacctgcgcgcggccttccacgagcacgtgggcgacgtctcgagcgccctccaggactgccgcgcggccctctcggtggaccccaaccaccaggagatgctggagcttcaccaccgggtgaacagccaggaaccctgagcgcgcgcccacggtgtacgtgtacatacaggacaggaagcccctcatcatagccaaccggccataccggtgtatgttttgtaccatacacagcagatcagatcaatgtaaggacacagtagaaagccacattagatccctccccttgaaaaccaaacaccccattccttgtgtccctaattattagatatatatatgtgttgtttgctatagcctccccttagtaagttgttgctgctgattgtgattaagcctcctaattgtacccgccatgtgccccagcggcccgtgctgccagaatcaagaagttttgactgtaccatgtgtatgtaagtgaaatgggggaacaaaggatggtggaagcttttgtccgcgccaaactgtcaagcatgcaggcacctgttcttgccgagcacttgattgattgcatatacagatgtgtgtttc

SEQ ID NO: 14434 - DNA, 2917 bp, Zea mays
cctttgctttgcatatcgttcatttacaaatttatcgaatattatttttagcattaattcaactttgatgaaattattgggctcacaatatacatatatacgcgtttctgatcacacaaattacttcaggccactgtgtccttattttctccaggacagctcggacagggattagcactacatctgccatgcacgcgctctagaaaccacaaataagctcgcaaaataaaagttttgcatatcgatcattgactaatttatcgaatattattattagcagtaataattcaacttcgctgaattattgagctcacactaatgtacatatatgcgttgcagaattaatttctaccggaaattaatggtacacattctagcagctggagacgacgtatggctaccccaccgaaaaatgcctccctctaggtggagaatccacattctaaaaaccactacaacccactgtaaaaaggaaatcttcgtaaaaaaacaaaatcggtcctgatatatccagctgtatatccagcactttctgcctataaattacgtaccacgcacgcacgtttaatcgcggccgcgccactcataggccgtgtgcggcgttctcaataatcttgttgcgccgccggcctctaccgatcatcaccttcctagctacacgccactggccagtttctttcattcaccatgacgaagctccttcctctgttgttccttgcaatgatgatgctgaacgtcgcttgcagtgcggcacatcacaaggtggaattattggtgcacaaggtgaaggcggggacgacgacggcggaggggacgtcggtcgacaatcaccatgcgataccacggcccgagtatgatagctggagcagccctggaaacatgccgggaagtggccatgacgttgggagccaagaagttaagccatgagcagccttcgctctatacatttctagtacgtcgtagcaaagcttgcatgctagggtacgtacacatataatatatatatgcactatctatgtatacatgttgggttgttgttgccatatgtctggatgatggtatatctctttgttttgtgcacttgtgctgtttgtgtaataatggtcatcacttattatgtataccaataatgtcaattccatactgaataaagaaaatatagctccattttaaatgtttcagtgattatttttgtcagtttggactgcctatatagatattggtcatgcttctatacatgtgtgcgcttcactaaaaattgtagacaagactataaagactgtttttttgcgaccctctctataagacacaataaactatgccctcactatgatttgaattgcctatatatcgacaggcactaatgagtttctattaacaaacaacaatctgaggttgaattgaaagcatcaagattgacatccgtagatacatttatttgatgaacacaaaatgtcaatattagcttgcattagtcacacaataataacggtatttctgaagtcacggcattcatttatatgtttattaggaactacaaaatcacatcatcattatgaagtagaaaagctaacggtctatatgctaacatgcccttttgattcatgaagaatatgcattgccaataagacttctgttaataataaactgcatgaaacagccgagaaaacatccttttgttacaggctagataaagtacatataattatgaacagatccagttgcacatagggcataacgttatattcccagaagaactaacttcatgtgttcagctcttgataacatttgcagtatgcaagctgttcttggttattaaacttaaacttaagtaaccctttcttttacgttcctatttgctatataattaaaaggcaaaaaaagatgtctcatatcacaagcatcaccactcaaaaatcactattatgtaaaaattcaggtacaaaacacaaactgcaacaaaacaaaattataaatattcaaagacaaaaacccagactatatgcataaattaagtgcattgcgccctttagcttttctaataatccattcaataagattgaggactatctgcagcagcagaacatgattttaacggttctataaattacatgtctttatttttgttgcagtgaatattatttttaatgtttccctaaatactgtttgacaagatttgtttttcttctgcatatatatgctacattctgaacagctagatttattatcgctgaatgtctacctataaactatatcgatcaataaactgaagtttgatttattcatgatggtgtgctacaacatcctttatctctaacatgaacgaactgatggctggcgagatcgtaatagttttaaattataatggctattaacaagctgtttggatctattggctaattgtgttagccgcagtaagcatagggagacagtaaaccgccttatactagatgagttaatcagcctagagtttgatgtcctattatactatgtgtggttttggatgtcatcgctctattgttagcagctaagattatgctatgtgatccaaacagaccccctcagcattagtttttatagaatgtcggaagtatgacctgattaagcagtgctgttcttaatataaataaaatggttcacatactatgcattactgactgcatcgaaatagcacattgatcttttatgaacagagaaacaataatatcacaaaaaaattccttaacgcaatgttgaaagaaaaaacgagtcaattttttagtgaccacagcttcctcgcggtcaatgccaccagaggatggataatgacccattagttagtagctagtatcatagattcataaatagctcccgtcgtatacatgccaacttcgcttaattttttacatgtccaaactcaaaatattaattaattgtt

SEQ ID NO: 14435 - DNA, 2661 bp, Zea mays
tggtattattatatgtccccgttgcaacgcatgggcacccacctagtatactctttatgttccaaaatatagttctttctagcgctattttttccgctcacattcaatttaaagataataattgtagacatacacacaaactacatccataagttaattgatgaatatatgtttagtctaaaataaattatattttgggacagagggagtagtaaaaatcacgatatttggaaaataccactgaaatagatgaaatgccatatgtgtaaggtattcacaatagtagtttcaagatggtttcatgcacatttaatattatggcacatcactattttggatgatatgacatagcatttaagataaatgagtttcatgagatgaaactagtttcatgtggatgaaaccatatcaacccgtttccaaagtcttggaaacagtgtgaaatctccattgagagtgatttgtttcatcgtcacatgttttattgatttctattggctatatatttagttgtaacatttaactgttatgttagactatgaaatagtgaagcgaaatttcattcttaatttcatgacactcttgatgcaatgacgatgtgggagtgttggaaagagcgttatgaaatgaccatatattgagattagcctaatgatgcaaatgttaacttattagcgctctatatatattgtcatcacttttggtagccgacaccgttagattgtgtggttaaattagcgtcatgattcatgctttgtgttagcacgtataggtatcctaactggacgatgcaaatgataatgcacgtcatgatatatatgaatgttattaagcatgcagcatggtgcgtgatgacatgagaccaccacccgacctcttaatataaaagccttaattaaagagctagcaaccggacgagggtgacggcaagaagcactagctagctagcaagcctggatgttcttttaggtttccttgcgttgtaaacataccctacaagtgcggctgatagcagcagtggtgcatgatggatgccgaatgaacttaacgacaggggttacctcttgcctacattgcactgcatgccggccaagtcattccagacttgccctctcctcctcgatcagtgatcgatcgcaagctaactatgactgcaacgcgtctccggcctcctgctccacttcccagctgtatatatatacacatagctctctttcgtcaccgccaccggccggcaagctagatgcactgaccacggtgacccatctcgatcgatcggcggcttcgctagctagctgggacacagcccccatataaatcatccactcctccgtagcaagcacatcctgaagctgcctttcttttccaataagctaagcagcaggtgcaaagggaattcgagatccagagagctagctgatcgatggatccgaaagttggcgttgctctgaccctctccctcgtcggcgggctaagcacctcccttggtgcactgttggctatcctcaaccatgcgccaaacaacagaacactcgggattctacagggctttgctactgggctcatgctcagcatgtctttctttgacttggcttacgatgctgtcaacgccatcggctttctgagagggaacctctggtttttcgctggagcgctgctgttctcaacaatcgcggacgttttccctgagccagactgcagtgcggcagatgaaaatgggaagcagcagggtggaaaggaactcatgatgagacatcgccgaagagttatatttagcgtcattgtcacagcaattgttgctggtgtgagtttgcaaaacttccctgtgggcactgctgcatttcttggaacaacaaagggcttccgtgttggtttgaacttggctcttgctatagcactacactacattccagagggtatttcagtagctctcccagcatactttgccactagcagcaaatggcaagccttcaaattagcaactctatctggttttgcagagccactgggtgtgattattgtggcatacctattcccaagcaatttgaaccctgaaatactggaaggtctacttggattagtgggaggagtcatggcttttctaacattgtatgaaatgctaccactagcatttgaatatgcaggacgcaaggatgctgttaaagcagtatttgttggtatggcctttatgtctatgagcttgtattttctagatgctagcctcccaaaggagatgagcgcttaacataatttgcgcctaaaccaattcatgtgatggtcaagagaatgtcatcatgggtgctgcaacaaggtgttagtgggaaggacgtgcatccaactcgagatcatgagagatgagatgtttccagcaacagtacacaatacagcgactgacagatcaagcttttatcaatgtccatgggacatgtgaccaaaatggtttgcaacacaatcatatttatataaaaaagggaagtacaattgtacaaacaggcatatgctaacaacatatcatgtacatttttaattagattcggtcatatcatgtacataaagggtaagattaagtgtatatactgaataaagtaggcacaaaccactgatacgatgtaaaataatggaaataaacggttgcatacatgatgaatgattgaccgacgt

SEQ ID NO: 14436 - DNA, 881 bp, Zea mays
  misc_feature (878)..(878): n is a, c, g, or t
  misc_feature (880)..(881): n is a, c, g, or t
acatgccggtgccacccgagcccctccccaagcccgagctcccggtcccgccgcagcccatgcccaagcctgagcttcccgtcccaccgcagcccctgccgaagcccgacatgccggtgccacccgagtccctccccaagcccgagctaccggtcccaccgcagcccctgcccaagcctgagcttcccgttccaccagagcccctcccaaagcctgagctgccggtgccaccgcagcccctcctcaagccggagctccccgtgccaccggagcccctcgcaaagcccgagctccccatgccaccgcagcccctccccaagccggagctccccgttccaccagagcccctcccaaagccggagcttccggtgccaccggagcccctccccaagcccgagctccccgttccaccggagcccctcccaaagccggagctgccacccccggtgctgcctggcgagcttccaccgaagccagagttagtcccgctcccgccgaaggctgaaataatgccgccgctgccgaagccatgatcgatgagctacgacgacttcacgggcgcacatatatatatatcgatcgacactgcgcgcgctccacgatccaaatatttacgatttgtctactttccattcgattttttgctgattcatctgcgtgtttggtttggattggacgagggtgtgcatagctaggtagcgcatcttatcagaattgcagcgtggagtgtatattgccatgccatctgattcgtgaccgcgatctgtctatgtactcttgctgagatccatatgtatatacctaataaatggattcgtttgtatatataataaaaaaacgacttaagtgattacgctcaataaaaaaaaaaaaaaaangnn

SEQ ID NO: 14437 - DNA, 4517 bp, Zea mays
gaatttttatttattcgaattatccaatccaaattttcggtaacctaaatgtccaggagaagataaggtgagaacgcaggctactgacgtgacagtgacagacgatatcaaattgagcggaccatacccgaaccagctttgcagcaaaatctcaccggcccgggcagcgaccctaccaagtctgtcgctttggaaaccgttggtgacaccataaccactcctgttcgtcgtgcacccacgcgggcgaacagtgaaaggcatcgtctcgacgtctcgtgaccgctggactcgccgccgccccaggctagctcgatgattgggtgcgccaagccgctcgcggcgccgctgcaggcatgggctcgcccgccgtctcccgccggtcgccgcctccccccctcgttctgcgcccctgacacctccccagctctcacccgcgccgtcgagagcccaggccagtctcagtctgacgacgccccgccaccacgctcgggtgaggccgcctcgtccctggcgccgcgcgcgagctcgcatctcgaccgatggtcccggtcgcgggcgctgcggtcgggccaccggccggcgctgaaccgcgcggctctctcctcggcctcggtctcggcgccgccggtgatcaagtcgccgcggcccgaggacgctgccgtggcggtggaggatggcgaggacgacgacgtgtgcgaggccgagagggacgccgcggccgggaaggccatctacatagtgtcagacgggaccgggtggaccgcggagcactcggtgaacgccgcgctcggacagttcgagaactgcctcgccgaccgcggctgcgctgtcaacacccacctcttctccttggtaaaatatctggccatgcatttatgtaccttttttttgctggaagtacggtgtgctaacggctaaccgttgatagagtgagtagttatgatggaagatgtcctgttttgtcatctaactatcgaattagccaactaggctatcaccaataaggagctttaaaatctcctgtactttctcactatagtagggcacatgtctcgtttaatttgtgtcatattagatgtttgattgataattataaatattagatataatctaattgttaaattaattatatagacaaaggctaaatgacagaataaatttattaaccttaattaattcatgattagtaaatatttacttggtttatctggggagatcgagcttcaagaaattgtgaatggtcttatcaatacacaaatgtataactcctcatgaattccaattgtgcttatattcatcactgtaggacttgggtttaagctttccccagcccgttttcatcaatggacttctgacaaagcaaactatggaatacttttatcttgtcgtttagtccttagttgtataattagttatgtaattagaatatatttaatacttttaactagcatttaaatatccgatacggtagagactaaagtttagttgctgcatccaagcagggttatatagaagatttcgttattacccttgagcaactgggacattgcttcgtcatctatatatagagattttctcttatctcttctatccattttaatattttaaacaacatattaatcaaaacttaaaaatatataaaatatttaagtatatgacaaatatgtaggtacaaaactttaaagcaaactatgtatttaatatatctatttacgtatagaagatgagatatacagatcattgctggaaaaaatcaaatataaaggatgaaatcttttagaatagacagtaaaggagtgatatataggaggaaaatagtcaccggagacagtcttagggggcctgcaatattggctgtagctgtaaatttgatgatgccacatgtaactgagtaattgaatgtgaaatgctaatttggagaaatgaaactgaggaagagccagatcttgtaggacaaattcttgactgctagttttacggatggaatttatatccacatttctacttgaaaaacgtcactttttggtaaggggctgcatcttttgtaagtaacagcttctgctaatgttctgtagattgacgacatggatcgacttattgaggtaataaagcaagcagcaaaggaaggggcactggttctctacacccttgccgatccttcaatggccgaggcgactaagaaggcctgcgatttctggggtgttccatgcaccgatgttcttcggcctactgtcgaagccattgcctctcacatcggtgttgctccatctggaattccacgaagctctccgagtcgaaatggtcggctatcagaggattacttccaacggatcgatgctatcgatttcaccatcaaacaagacgacggggctctgccacagaacctctaccgcgcagacatcgtgcttgccggcgtttcgcgtacagggaagacgccactgtcgatatacctagctcaaaagggatacaaggtggcaaatgtcccaatcgtgatgggagtggaccttccaaagtccctttttgagatcaaccaggacaaggtttttggactgacaataaacccagcgatccttcaggcgattagaaagaccagggccaagactctaggttttgatgggcgtcagagcaattacgctgagatggaccatgtgaggcaggagctggtccatgcgaatcaaatctttgctcagaatccatcgtggccagtcattggtaagccaagctagctgtatccatggaactcttttgtttgttgtttcttttgtttaaaaaaaacatgtttttttatatactgtttccatgcagcggtcactggaaaagctatcgaggaaacagctgctgtcatcttggggatcctccatgacaggaagcagaagtgctccatgccacgcatatcaaaacgatactagcgctgtgttctatcccttctctactacaccttgtaacgtgtgcatgttttgaataagctttgtgtcaagcaccatagccttcatgtaatttttttttgttggaccaccttctaggtggtggcgtttgtatcataaacataacttgaagtttagtgcagcagaaacacatgtatattgcgttgcgtttacgaccttctattggcgttaaagcctcacgttatttggtcattatcgaatttctattatgtcaggtaaaatagtagggtgaactgcctttgtgcaaattaccagaaaatcagagtaatatatctcctgcaggaaggaactcaacccaatgaccacaaaaacttttccagtgactaatcattacatgtggagatatattactctgaaggaaggaaaactcaacttgtgcaggaaggaaactcaacccaaaaactagttgtctgagtggcagggactaatcattacatgtggatctgaatattctacagtttctataatgttagtgtttttatctttatggattacagctgacaactgattttgattcgaagcgaacagtctctagcttttcttctaaacaaggatttttcaagacagtatgtttggacgttcaccttttttttttcaagtattcgcccatagtattgtttgatttttttattattaaaacacacattttttttttgttgctgatttgatttttttcctgtttccttgtcaagtcgtgtttcagtttttcctgttagtgttcatttatcttgatagatcttgctctttggcccgatgcctttacaacgacagcataatgtggaatgatgttttctactctttctttcttttttctggttgctgttcgaactaagcatcttgtggatgtggttggaagtaccaggatgagcttctggcagtatgtacttgggtttatctgatggaccaggaacaaccctggagtgagatacaggcatctagacgcggaaagtctggtcgagatgaaactgtagcagactcaagagctcgcataaggatcttttttttgacggttcataaggatctttgaaatgatcttaagataatccttactgcttgatatctgtttccatttgatacaactacacagaaacaggctatacttgcaaccgagtgaaaacgagttttggacctgaaaaatacgatatggcaaccgttggtgtcgataagtgttggcttgactttaatctatatcgatttctactgtataaacagtgttttgttattacaactaactttaatttaaagcgaacagcctattaaaaaaaaaggcaaatgtcgtctatcttattcttatttccgtggagttgcaagtgtaaggctgtcgaggcttccaaaagtcttcgttatagacggttaacatgaaatttttagcattagactgagcaaagaaatccgtttgtgctgttgcagccagttctagtctacgacggttatctgtcagctcatgtagggtatcttcgctacggagttttaagtcacactctgcttcagtgaagtgatttcaaaagccgtaaacctatccaacgcggcaaagtttatctaagtctagccggttagattagagtagctaca

SEQ ID NO: 14438 - DNA, 1704 bp, Zea mays
ctcgaggccggccgccacgcgtccgtcgcgcccgcggcgccggccggcgttggtgacaccataaccactcctgttcgtcgtgcacccacgcgggcgaacagtgaaaggcatcgtctcgacgtctcgtgaccgctggactcgccgccgccccaggctagctcgatgattgggtgcgccaagccgctcgcggcgccgctgcaggcatgggctcgcccgccgtctcccgccggtcgccgcctccccccctcgttctgcgcccctgacacctccccagctctcacccgcgccgtcgagagcccaggccagtctcagtctgacgacgccccgccaccacgctcgggtgaggccgcctcgtccctggcgccgcgcgcgagctcgcatctcgaccgatggtcccggtcgcgggcgctgcggtcgggccaccggccggcgctgaaccgcgcggctctctcctcggcctcggtctcggcgccgccggtgatcaagtcgccgcggcccgaggacgctgccgtggcggtggaggatggcgaggacgacgacgtgtgcgaggccgagagggacgccgcggccgggaaggccatctacatagtgtcagacgggaccgggtggaccgcggagcactcggtgaacgccgcgctcggacagttcgagaactgcctcgccgaccgcggctgcgctgtcaacacccacctcttctccttgattgacgacatggatcgacttattgaggtaataaagcaagcagcaaaggaaggggcactggttctctacacccttgccgatccttcaatggccgaggcgactaagaaggcctgcgatttctggggtgttccatgcaccgatgttcttcggcctactgtcgaagccattgcctctcacatcggtgttgctccatctggaattccacgaagctctccgagtcgaaatggtcggctatcagaggattacttccaacggatcgatgctatcgatttcaccatcaaacaagacgacggggctctgccacagaacctctaccgcgcagacatcgtgcttgccggcgtttcgcgtacagggaagacgccactgtcgatatacctagctcaaaagggatacaaggtggcaaatgtcccaatcgtgatgggagtggaccttccaaagtccctttttgagatcaaccaggacaaggtttttggactgacaataaacccagcgatccttcaggcgattagaaagaccagggccaagactctaggttttgatgggcgtcagagcaattacgctgagatggaccatgtgaggcaggaactggtccatgcgaatcaaatctttgctcagaatccatcgtggccagtcattgcggtcactggaaaagctatcgaggaaacagctgctgtcatcttggggatcctccatgacaggaagcagaagtgctccatgccacgcatatcaaaacgatactagcactgtgttctatcccttctctactacaccttgtaacgtgtgcatgttttgaataagctttgtgtcaagcaccatagccttcatgtaatttttttttgttggaccaccttctaggtggtgccgtttgtatcataaacataacttgaagtttagcgcagcagaaacacatgtatattgcgtttcgttgaaaaaaaaaaaaaaaaaaaaacttaatgccgcacgttatttgggcattatcgaatttctattatgtcaggtaaa

SEQ ID NO: 14439 - DNA, 972 bp, Zea mays
cttcatgtgccgaggcgactaatatgatcggcaaggtgtagagaaccgtgccgatccttcaatggccgaggcgactaaaaaggcctgtgatttctggggtgttccatgcaccgatgttcttcggcctactgtcgaagccattgcctctcacatcggtgttgctccatctggaattccacgaagctctccgagtcgaaatggccggctatcagaggattacttccaacggatcgatgctatcgatttcaccatcaaacaagacgacggggctctgccacagaacctctaccgcgcagacatcgtgccggcccccggggcgcgtacagggaagacgccactgtcgatatacctagctcaaaagggatacaaggtggcaaatgtcccaatcgtgatgggagtggaccttccaaagtccctttttgagatcaaccaggacaaggtttttggactgacaataaacccagcgatccttcaggcgattagaaagaccagggccaagactctaggttttgatgggcgtcagagcaactacgctgagatggaccatgtgaggcaggagctggtccatgcgaatcaaatctttgctcagaatccatcgtggccagtcattgcggtcactggaaaagctatcgaggaaacagctgctgtcatcttggggatcctccatgacaggaagcagaagtgctccatgccacgcatatcaaaacgatactagcactgtgttctatcccttctctactacaccttgtaacgtgtgcatgttttgaataagctttgtgtcaaggaccatagccttcatgtaatttttttttgttggaccaccttctaggtggtgccgtttgtatcataaacataacttgaagtttagcgcagcagaaacacatgtatattgcgtttacgaccttctattggccttaatgccgcacgttatttggtcaataaaaaaaaaaaaaaaataaaaaaaaaaaaaaa

SEQ ID NO: 14440 - DNA, 852 bp, Zea mays
cattgggaccctcgaggccggccgggtctttttcttttcttttcgaaagacaaggtgccgcccagcgtcagcgaaaaaggtcagggtcagcagcattctcccttccaaatgccgtcctccccgtggcctcccgctgccggagcgccgccgccgccgcagcagcgagcggcgcagggcacggtctccaccgtggcgccggagcgtcgacccgtcgagggttcccgatctgggccagcgaaggaggaggacacggctcggcttccgtctgtcgactactactcagagctaaagaccctggagcatgccgagaaaaccaaaaaatatcagggtaagcttgcagcacggttgaaggccaaatatttttccaacaagacttttgaagaaggatatgtgtttgaagaaattgttatagaatcaaagaccgtccggctaagcaggtggccgtttacaaggttgtttgcagatccagcaagattttgccgagaaaagagctctactgagaagggcatttctccacctctggctggtgttgccatgtcagatgactaagcacctcattaatatctgactcctggcatgtggcaactatccatcatgaccacccgacagataagaaccatagtttgcgtcactaacctgtatctgttatccttaaaatcagtgacctggagcttgtatattttcaacaggccaaagttaaaaccttatccagttttgaaccaaaggcaaattttcgttttgtagacatgaaaaaaaaaaaaatgagacccatgcattgcctatatctatatcgatattattcctcctgagggacgtttcaaaaagcaaaaaaaaaagcggccaaggccccta

SEQ ID NO: 14441 - DNA, 7790 bp, Zea mays
  misc_feature (847)..(847): n is a, c, g, or t
aatccggttttccagcaaaaatggcggtttatcggtttaaaataacggtttaccggtccaaaaaacggtttaccgacggttttcagtttttatgattttttttcatttttttgaatttggaacgaatttgggaaaaaacggtggttaaccaaaaccgcactccggcggtttcggtaaaccgaccgatttaccgtcggtttttaccggttttgtaaaccttggttgcgaggcaaaactacgcctctggaatcgcaacactctgaacaaccaggtaaggtgccatccttatcgctggaaggggaacagaagcattcaacaagaaccatgtcagcaagagtttcagtatcccccctccttccaggaaccgaataaaaaatggaaattgatggtcacactcactcgacactgcaaattggcaactgaaaagaaaaaaacacaaagatagaaaagaaaaacaaaatccatcagagttgcaatacttgttgggagcctagttggctcaagatctacaaaacaactaaccttcagcataaacataatatttgtaaatcataattgtaaacttgtgggcatggttgttatttcatacgaagttgtatccctcctttataaataggtgattagtatcatatataaattcacctttttagagggcatcaaacttcatctcttttagcctttaaaggtccttcgagctgtctcttgtataaagacaaaggtacgcttgtacatttaattcagaaggaagaaataagataataagaaggcatacaagatgagtagcatgtttcatcctttgttgcacttttgtacatccttacttcgtctgtgccatttatttattcgntctcttttaaactatctcttcaaaaaatgatagttaaagggagaatgttccaatactctaacttgtattgctttattttttatatcatataacaatcaagaacaaataaacaacaatgctcatatacaactatataatcttatgttctatagttgcactgtctgatcatgctgtcggtatttttatacatgaaacaaaacgaacatttttttcgaacagaaagtacaaatgaaatgttcagaatcttcatttcgagttactatgatgtcaataacgttagataatgtttgtttaagtctaaccataatcgataccatactacaaatggataccttcttattcaaatttgttactgccagtattcgagtgtaaatcgttatcatcaccatttacgttatatcgggaaccaaacggcacccgaaactctgcaagtcgtaaaaggagaaaacaatgctcgtccctttcagtcagcgccatttataaacgaagtatatgagttatgagccagcaattcatcagaacatcataatcccagattgggtagcatattgcacccataagacaaataaaatatatatcacgtgcttggcaaacacattattttcgttggtcacataaggttgttaataatcaacaaaaaaaaaatacgacacatataaatatacacgacgtccgatctaaaatgaactatccagatcgaatttcagaggacgttcggcaaattttgaattttttttttttttttttttcgaaagacaaggttgacaaggcggtcatccgtcaggtcagggtcagcagcattctcccttccaaatgccgtcctccccgtggcctcccgctgccggagcgccgccgccgcagcagcgagcggcgcagggcacggtctccaccgtggcgccggagcgtctacccgtcgaggtaccacttccctccctctgtgtctctcgctctcgggcctcttgtctccactcagctcgcactaaggctcagctcacctgacctcatcacctaacctagggttcccgatctgggccagcgaaggaggaggacacggctcggcttccgtctgtcgactactactcgtaatgccctctcacctgcgctcccctctcccgtgctccgtgtttgtgcgcaactgtcacccaggaccaggagttgtgcagctacgtacattgggttccggggttcacgaactgagcgcattccagcacgctgtctactcttgctacggttggacggcagcgttgctactgacacattcgtgcgcttctttgtatgcacgcgtgtgcccagcccaactgtggggtgcttaattgatactgccaactgacgagactactagtccctaacctacttttgaaacgatttaggtcttgcaaattttttttgaatgtcaacggggaggaaaggttccccacctgcttttccattgctttgttctttttttttggcccatggggcataacagattgttacataaccgggcttgcagtttcttgtttgcttttctttgtagctcgctcagagtttgggaaaccacattgcatgtgttcaagatcgacgagaacgtttctgtcagatgttttatgcagttcgttaaaaagaaaagaaaaaagaatattttgacgagatgcagccatattagtatttcctatccaacattcctgctggagtagcaatcttttcttctgccatgggtgaactggccgttccaaaatttgactaacgagtgttagttagcagttttggaactgattctgtttttcaatagttatacaaggatcgcttggtctttctggtttgacagcaccctgcagtgaaaatacatctctgcgagtttatatggctacacaagttgtcaatagtataaaacaagagataccttttctgcaacctgtttttatgtcaaaaatcatgttagttcccctgggactacaacacaagcgattagcccatggaaggcatctccattcagattttcaaacttattcacttttcttcctaacaaattgacagtggatccatgcgttcattggaaaaatattagaccctacttattgattgttactgataatgcatcttttcaataatttgttagattttttcacagcctcattcttatctaatgcctttagttgtgaaagctgtagaagctgttccttggtcactgtgaaaaccatgaaaatttactctaagtgttctttttattactccgcgtagagagctaaagaccctggagcatgccgagaaaaccaaaaaatatcagggtaagcttgcagcacggttgaaggccaaatatttttccaacaagacttttgaagaaggtaatttgtaacaactgaatggcctgctaaattaatatgaacatttgtttcacttattttgtgtcagacaatataatctgtcagttttgttatccagcattagctgtcgatatgtagtccatcatatttcaggatgtgctactctcgaatcaagaagtcaacttaatgaattaaaatgaaatgtgttagcatcaaatttcactaggtatgagtaaaatatcttctggagtctacaaatccattgtttccaaggctagttcatactgtatagagaagccaaggagagccaggttggaaggagacagttggggaatggcattttaatttacaatgaaccgagtatgtatttactggtctgaatttcaaatattttgcttaaatcttgaggcacatttgaaggcatttatgctgcccttgccaactagtgtgtgtaaaacctaatctgaatcaagatcctgtcctacaaatgcaagttgacacactgatgatatgcagactgaaatccaatatttccttagtggccaagcataatattgttgaactgcaaaaattctggataatcatagcatgagtctatggatcacgcgttattagttgatcgataacccgatgccttaccattatgtgatattgtagtttcataagaaatgaatttctggttgccttccatgctttgtacaaaaaaacaagaagtttgatagccaacttgttttctttctcctttttttttctttttaatctggctgatcagttgactgcaagtggaatgtctacactggcaatgcggtcatatgtgttattctgattctctttaccgtgtttaccatgccgtgaacaggatatgtgtttgaagaaattgttatagaatcaaagaccgtccggctaagcaggtggtgttctattgatttgcatcttggagtgctgatctgaagtttcactgcagcaaccatcttttttttctccttcaggtggccgtttacaaggctgtttgcagatccagcaagattttgccgagaaaagagctctactgagaagggcatttctcgacctctggctggtgaagccatgccagatgactaggcacctcattaatatctgactcctggcatgtggcaactatccatcatgaccacccgacagataagaaccatagtttgcgtcactaacctgtatctgttatccttaaaatcagtgacctggagcttgtatattttcaacaggccaaagttaaaaccttatccagttttgaaccaaaggcaaattttcgttttgtagacatgcttacaggtatactgagacccatgcatttgcctatatctatatcgatattattcctcctgagggacgtttcaactttttacctgagatatgggtgccgtatccatgacctttgcatattttctgggttccctctcttctgaaatgatgtaatttttagggcagtagcatcatgtctcctgatattctgtttgcagtaccaagatcgtagcactatggagccaattattgcaatgctccaggctgtaattggaatcatgatgagcagcagatgggtgaacacacctgagctgcatcagctactccttatcttcatgcaactgtggtgttgcaggtgagacggcgccccctgggactgggactgggactgggagggactgtttgttgaagtgctctgccctcttgtactttccagttgtttcttccaggtccatggccagcactgtgagacatggcatggtggatgatggtgcattggtgcttcttccaccggcgcctggtgtcttttgttcactgttgcttgggccctgtgatgtgagcatctcgcgcaggttgctgacctttgactccccccgtgttcacacgtacagcctgagctgatgccgcacttgcactcgcatttgttttgctctgctctcatctcagtgccaggggccgttcctatcttgagccacacatattttttttctctctcgtttctggtcaactggattttatgcggcttgttgctctctgtcaagagttcctggccatgcatagcatagctcacatctacatttgatgactgagaaatgcctcttttttgctgcaactgagagaagctgtgtatgagctcataagccatgcctccaatagaagctactatgaacgagcagtcctagcttgatctgatgttccctttggatgaacagaacatattataggcgtagatatttgtgatgcagcacatgcgcatgcgcatgcacagaatttaggttcactggaatcctgtgcgacaagcatctcaatgaatgggataggatgttggtggttcggttcaagacaagattgtttgatacacatatactgaaacttgtctgatactgatacaggctctgcttctgatgctgtacgtactgaaatagattgcagcatatgcagtccattaatcagttttttttttttaaaaaaaaccgcacggttccacttccatcttatggctgtcgctctcgttctttcattgtcgtttttccactgctgatgttgccccgttagccaatgtttgtagtaataccatgataggagtatcctcgttaacttatccttatccttaattagggtaccaaaactccctagatagaacagaattagcttgatcatcacacatgcatgttcttattagttatcgagatataaataattaactcctctcgactaaaaactgggtcgcccgggcggatgataattaattaactccatcttcttggtcattcagcaatacgacttgcatggctcggccgcctccgataacgagcccttctccgcctgcagcagctgctcgagcttcttcgtcagctcggccttctcttccctcagcctggcgctctcccggcgggcgtcggcgcagctcctgagcgcgcggttgaggtcgtcgaggaggcggcggttggcgccgcggaggtgcgagacctgcgcccacagctcgctgagctgccgctgcttgcgcatgcgcgaccgccgcgccgactcccggttcgacaccatccgccggcgccggcgctcctcgtcggccgccataatcacagcagcgtccagcagctggtcggagtccgacaagccgccattgttgctgccggtgaggtggcagcgggctgcggctgcggcatctgcttccgggacgacgacgatggtgtcaagctcatcaaaacaggccgcgtcaccgccgtcgatggctgcaagggtagcgtcgtcgtcttggaagtaggatggaggcggcagtgccatgttcatgtggtggtgcgccgcgaaggacgtcgagacgttcggaggggacaggaagcggaggctagccacctcgccatggaaatggtggtggtacatgattattgctctctcttctagtcttgctcgacggggttctcttcttctttgctagttagtgcttatattacttgcttgcttgtaatgctttggtttggtttggtttgctaggcctgggttggtgaggccccttttatagtcaggcacacagctctatactctcatcccgtctgagacttggagagaagacttcgctatggtccaccatattatagctgtgcatgcatttttatattctaaccatttttctctctctctctcttttttagttttgagaatcttgtggatcgatcgagtagagtttggtggcatgtgcttggcttaaatttgtaagtagatcctttctcctgttcctgtacgtacacaacacttagcttgttatcctattttcaattcccaagagaatactcctatttaacttgcctttttttgtattctcctgctttcggttaccacttttaacttgtcgagtaaagattattattaattgcacgcatgtagggcgtaatttatgcagaaatcttttgctgggagggtgcactactttatatatggtgactggcacacatacagtgacatcaaagctaatcggatgtggcgctctgtccttgttcatcgatcatatacagcgagggagggagggagggagtcgtatgcaaagcaatgtccattaattatatttgcccacagattaaagttgctcgcattatttgtggctgagactgccaaaaagaggaggaggaggaggaaggtggtgacgccatccaagtggccgctcgatcggtgcaaaggttgaaagctaataggcagggggggccatgaagcttttcgctgattgaggttcttgtccattctcctacaaacattgttaggccatactcgaattatggataatctataccatcgtataatccaccgatttaaattttgaaatttccacctaacaaaatcactcctacacatatagcctctattaaatccatcaaacgaattacacaccatcaaaacaaacggttcaaatcactggataattctctctcatttactcacttaaatttaatagacaatattatttagataatcctcatctctcatccccacgatcccgccacccctatcgttaccacaagttatatgctactagagattaaagagtaatatgtacactcactctgatttaaaataatagctatggaaggggtactctggctatctatctatgaccacgaattatattaacactagtagctcatctcattgag

SEQ ID NO: 14442 - DNA, 1030 bp, Zea mays
aaactaatctttactattccttaagagcataacgagggcgtccaccgtgcccccgcctgctcccgcaagtccgcaatacccgcccccccccccggcagtgtccgcgagcgaccctctgcgctcgcgcgaatcccgcctgagatcgccgccgatccgaagcagcggcaccgtaaccctccccctcgcgagatccgcgaccgccccatcccggcgccacgggatccacgctccgccctcgcccttccccacccccatccgctaatctcgcggccgatccgcgcccggtcctgaccccgcctccgtcctccgcaccgccactccgtcccccgtcctcggcgccgccgtctcccgctcccctggcacgccttcggggtccttgcgggcggcaagcacctccgtcccggagacatctgccgctgcagcatagaccaccatgtcctcgctcggcagcaccgatgttgacgatggcaacgaggaggaggacggctccgcgagcacccccgagatctaccgctgccactcccacgcagttgcgtgtagcctctccatgtgatttccccaatgtttcccttcctctgtagcctctccgacggcgccgccgccgttcttcctcggccgtcggcgacattttaagaacgcctgaggctgttcaaccacttcatcgtctttttgactgcctcacattgaaggaactttgcagcggactgttatatgatctatgaaagaatgcatgcaacaagatctccagtctgatactgatgaagaaactacaaaagaacacatagccaccatcaatcaagacaaagggaaaactaccattacctcaattggatttctggtttttgggctatcattggatttctggttaactgaaatatgtaccttgcagtagctctatgtctctatatggcattatggtgtctaaaactggatcattatattttcatttgagtgaaattcttatcaaatgttgaaccttcaggctccagcttgatctggttcatgttttttctgaaaaaaaaaaaaaaaa

SEQ ID NO: 14443 - DNA, 1356 bp, Zea mays
ccggccgggatgagatcttttgagttcgcctaagaagaggctgagcggcttagacatctcgcgtctcctgctggaaagaaggagtattcacaatggatagtcacaagccaaagaagtctcttggaagttatgtcagagttcccatcagcaaagcctccacttggtgttttctttgcagctatttgtcctcgcctgcagccaagatactactcaatatcttcctcaccgagaatagcaccaacaaggattcatgtgacatgtgcactagtatatgggccaacccctaccggaagaattcacaaaggagtctgttctacttggatgaagcattcgactcccttggaagatagcaaagactgcagctgggctccaatttttgttaggcaatcaaacttcaaactgcctgctgatcctactgtgcccattataatgattggccctgggactggtctggcacctttcaggggcttcttacaggttttttttttgttgttgttgtcttaatgtcgtccattgttcttccaactttgccccctctaagattgtgaatggctgctgtattttgcactggcaggaacgactagctttaaaacaggcagaggtggagctgggccatgctgtcctcttctttgggtgcagaaatcggaagatgggcttcatatctgaggatgagctcagtagttttgttgatgccggtgccctctctgagttgatcgtagcctttttctcgtgagggtcctacaaaagagtatgttcagcacaaaatggcgcaaaaggctgccgagctttggagcatcatttctcagggcggctacatttatgtttgcggtgacgcaaaaggcatggctagagatgtccatcgcacgctacataccatcgtccaggagcaggggtctatggacaacaactccaaggcagaaagctacgtgaagagcctgcagatggaagggagatacttgagagatgtttggtgacgtatgccaaagaaacgtggaccctgtccgtcgtagttgccggcgaatacaaacctaaatcaacgtcgtggaggaaaattagatgcaccggctggggtatgattagtaggaatttttacatgatctgttcgatgggaaacatatatactagtgatatggttctatttttttaaaaaaaataaagaagaaaagaaacagaggtttccccgctttatatagttatatttatttaaaagtgacatagccagtcacctagtgatggtagagtatcaggcgccagcaggcagcagcggtgcaggtgcttatgtatgttcgttctggaaatcatcgttgtgatttctggcgctaaggctatagtgaataaaacagccattggctcatc

SEQ ID NO: 14444 - DNA, 1929 bp, Zea mays
gagaggcgagtggttgaataatcttcggtttggggtgtttggcctcggaaatgacagtatgagcactttaacaaggttggaaaggtggttgatcaactcctcgcagaacaaggtgccaaacgtatcgttcctgttggtcctcgacgatgatgatcaatgcattgaggatgactttaacgcatggccaggaacttctatggccagaattggataaattgctccgccaggaagatgattcttcaactgcaccaactccttacacagctgctatcccagaatatagagttgtgtttgtcaaaccagaggatgacatgtacattaacaagtcttttgctctcagtaatggccatactgtttatgacattcaacatccttgcagagcaaatgtggctgttcggcgagagcttcatacaccagcttctgaccgatcctgcattcatttagagtttgatattgctggaactggcctaaaatatgaaactggagatcatgttggtgtctatgctgaaaattgcatcgaaactgttgaagaggcagaaaaactgcttggttattcaccagatactttattctctatttatgctgaccaagaggatggtaccccgctctgtgggggttctttgccacctcctttcccgtccccttgcacagtgaggactgcgcttacgagatatgcagatcttttgaattcgcctaagaagagtgctttactggcgctggctgctcatgcatctgattctaaagaggctgagcggcttagacatctcgcgtctcctgctggaaagaaggagtattcacaatggatagtcacaagccaaagaagtctcttggaagttatgtcagagttcccatcagcaaagcctccacttggtgttttctttgcagctatttgtcctcgcctgcagccaagatactactcaatatcttcctcaccgagaatagcaccaacaaggattcatgtgacatgtgcactagtatatgggccaacccctaccggaagaattcacaaaggagtctgttctacttggatgaagcattcgactcccttggaagatagcaaagactgcagctgggctccaatttttgttaggcaatcaaacttcaaactgcctgctgatcctactgtgcccattataatgattggccctgggactggtctggcacctttcaggggcttcttacaggaacgactagctttaaaacaggcagaggtggaactgggccatgctgtcctcttctttgggtgcagaaatcggaagatggacttcatatacgaggatgagctcaataattttgttgatgccggtgccctctctgagttgatcgtagccttttctcgtgagggtcctacaaaagagtatgttcagcacaaaatggcgcaaaaggctgccgagctttggagcatcatttctcagggcggctatatttatgtttgcggtgacgcaaaaggcatggctagagatgtccatcgcacgctacataccatcgtccaggatcaggggtctatggacaacaactccaaggcagaaagctacgtgaagagcctgcagatggaagggagatacttgagagatgtttggtgacgtatgccagagaaacgtggaccctaaatcaacgtcgtggaggaaaattagaggcaccggctgggatatgattagtaggaaattttacatgatctgttcgatgggaaacatatatactagtgatatggttctattttttaaaaaaaaataaagaagaaaagaaacagaggttttccccgctttatatagttatatttatttaaaagtgacatagccagtcacctagagatggtagagtatcaggcgccagcaggcagcagcggtgcttatgtatgttcgttctggaaatcatcgttgtgatttctggcgctaagcctatagtgaataaaacaggcattggctcatc

SEQ ID NO: 14445 - DNA, 773 bp, Zea mays
gtaggcgttcacagtccgtgcaccacggttctgcctcctctcaccgcgcgtccgcgtctgccgtctggcccctccgcgcccgcaatccacgcctccgccgccgcaatccgtgcccccacccgacgcaaccctcgcccattgtcccgtcccgcgatccgcgatgccctcccccacgcgcagaaactcccagtctcgccgatccctggaagcctgctcggcacccatcccccgacgtccagcgagggttttgggagcggcgactagggtttcgagaccgctgatgacgtcaccttcctcggtcgccggcaacatttgcgaccgtctgaggttccattttcagtccccgtgtgatttccccaatgtttcccttcctctgtagcctctccgacggcgccgccgccgttcgtttcctcggccgccggtgacattttgcgaatgcctgaggttcgttcttcacttcatgtgcgatttccccattctttctcttcctctgtatccccttcgacggtgtcgtcgctgtttttgccgatcgtcagcatcactgtcgtccgcttcgcttggatgcaccgttgtgaacatgcagatacgtggttgcgaattatgcggctagacgcgtgggggatttcaattgacgagtatgagaaacatggatggtcgattgaacaaattgctcaagagatttcaaggctaccattgcttgctcgctgcaaatactactgcaatatatttaaattgtattgtacaatgttataggaaattaacaatgcatacat

SEQ ID NO: 14446 - DNA, 2211 bp, Zea mays
ttaaacccctagaggaatctatctagaaagggattgagtgatatgggagggattcactcaatccctctatgggtagaatccctttggggtttaaaaacctatcaaccgaacatggcctaaacggttgcgtgtgaatccatgagaattggagatattaaatatctccttaattaaaattgaatagaagggatttcatcagcttaatcctcttgaatccaaacacaacagaataagacctgaacgggcctgagttaggataatttaagtttcaggcctgagttaggataattttaagtgaaagacaaatgctttgagctagtgagcctcgcgtccatggtatgcgcgggaacctcccgtctctcgccgcggccagtaatggcgtcgccctccctctgtccttctcccacacgaagcagctccacgcgcgcctcatcgtcgcatccccctcctccgcctctggccctgcctacctccgcctcctagtgctccgctcctatgccgcccgcggagacctttcctccgcccgccgcctgctggacgaggctccccgcccggcctcgccgcttctctacaacgccctaatccgcgcgcacgcccgccgtctcgaccttccagccgcgctcgcgcttttcgcccgcatgcgccgctccgccactccgcccgacgcgcacaccttcgcctgcgtcctccgcgcctgcgctgaatcctcgcgcccggatgctgttaaggtcgttcatggtatcgctacaacatgcggtatgtgctcccgtccgattgtcctgagctcgcttgtcagtgcgtacgcgaagcttggcctcgtggacaatgctcgcagcttgttcgatggattgtgtgagccggacttggtcatttggaactccatgatgtccgcatatgggtaccaagggatgtggtatgatggtctacagatgttctccttaatgcggagagctgggcagcatccggatgggtattcaatggttagcttagtctcatgcttctggaatccggaaatacttgcatttggtcaagcagttcatggaatatgtgtcaagggaggttatgactctggacaccatgtgagaagcacacttgtgtcaatgtacatgaggtgtgggtgtgtggaatctggccaaagattgtttggtagcttgcctgatgtggatttgattacctggtcgtcactgattactgggctaatacaaacgggcaagtatgaggaatcatttgatttgttccggaaaatgtgctttacaggtaggaggcccgacagcatattgattgctagtgttctctcggtatttgcttctactgctgctattagctataccaaggaggtccactgttatgcagtcaagcttggagctgatatagacataagagtctcttcttcgctaatggatgcttatgcaaaatgtggtttcactgagctcggatactgggtgttccgccaagtacctaataagaactcagtcatgtacaacacggtcatatcaaaccttgaatctcacgggtttgcaactaaggctattgaagtcctagatgagatggttaatgataagctcaggcctgatagtgctaccttctcctctttacttgctgcttgttgtcatgtggggcacttggaggagggatggaagttgttcaggagaatgagggatgagttcaagatagttgttgaaatggagcactatgtgtacatggtgaggcttcttgcaacatttggccagctgaaggaggcatatgatcttatacagacaatgcaaatccaaccagattgtggtgtgtggggtgcattgctttggggttgttgtgtccatcgtgattctagcttcggcaggattgttgctgaaaagctatgtgaactcaattcagacaaagctgcttacagggttatgctctcaaacatgtatgcctcacaagagatgtggtgggatgctgaggaggttagggatgagttatcaaaagaaaatatgtacaagaacacagggacgagttgggttggtgaagtaaaaaaatgatggttggcatttgtcattgagaaagcatgtcagatatcaagtacatatgaactctatattgttatattctggtagagatgatatcttgtgaaactccaaacatgtactcgttggattttagcttaaccagttttgtactcagtctttccttataatcatgggaggttcatttgcaaaaaaaaaaaaaaaa

SEQ ID NO: 14447 - DNA, 1956 bp, Zea mays
ttggtgttagtaccttgatactagtttgtaatgaattttggcattttacacaactacagttagataattgtacgcaaacattttttagttgtaggagtatttagtacttttagtaatcagtaaaatttaatgtttgtgttgctgtgttaattagcatgggaagctttagaagtccaatgcataattgcagagccagctgtatctcacatgtaatcaacttaaattctgaaccagggggccggagaacagcatggacagtaaaatgaatgacatgtttagtttctaggctccctgaattctcaagaagaaatgatgtattcatagacttcctcttaaggaacattgcatctttctaggttcatggaacaattcatgcatggtattgtctcagcgaagcatcttttgttcttgtggacctatggtgtagttagcagaacatgtgagctccgggtatctattgcctttgttttgttaagccattgagtcaagctgcaattcttaatgaccattttacttcaatcccgttttcttcagttctgtgtttgttctgactaacgatttgcattcaatgttttttctgtctttcctaaagctcttaaaggcaagaaaaaattgcacaaggaaaagcacaagtctcgatctgaaagacctcaccgccaatctaatatcaccgaactggataaaggcaaaaaacgacctgcacaatcctccaagtccgatctgcctaataaaagatctaagaaagaagggtcccaagttccttctaggaaaaaggatactggtggtaggatggcaaagaaaaatggtccctgccaagataagagcatttgtactggccagaacagctctctatgcaaagacaatagggagaagcacagtcatgctacctttcagaaaaagtgtcacgctgaacctctcaacaacggtccatctggttctgggtggaacagaactgctggcggacacagccaattcgaaggaagacacataactccagcttctcacgtcgaggcaaatcatggaaattgggtttctgtacagcatccttgcgtcgagaggcttcaacggcctactcaatcgcgtgaagttgctctggctcaccccggcggcggccatccatacgtactgtccagcgctgcaatgggcctccgacatcaaaatggagcaacggccggtgtgcacgcaccggcatatttcaagggatttccactcagtcaacagagggcaggatttccttcagccagcatgccgcaaactgggtaccatcctcatccagaagaattatttgttgcgtcacacttcagatatcctagagggagtgctggtttccgccgataagacagtctggttggcgcctgctgcattttggtaactgcattggtggtaagacatgcggtcttcggcttattttcattgatgccatttcgttgccatgactcatgagcaaggagtatttgagtcttacctaatgtgcagagaggccagaactttgtttcatcttgagataaagcttccttcgtatataagaaaaaggaagatcctcacctcaattgaaggacttgattttctttgctttttttggggggcaggatgtgatggaaaaacagtgttaccatcgagtcgcataatcagggctctgcgtgcttcagacgggggaagggtttaatacaaacatgaatgctgctttttttttgtcgatctgagtccttagctgcaagattgacgcgagacatcggcttccaatatatgtacaccaatggtttctggaatttgagctagtaattatttacagctctgcaaatccatcgttcccagtatgtagggaaatttggatggaactaacgctaaccccgcaaggttgtgaggagatcaccgtccaaacacccatgtcagaatgtcaccaaaaggtacatgggcacgtgcgtgcatctgcacaagccaacaaagaaatgtcgg

SEQ ID NO: 14448 - DNA, 2257 bp, Zea mays
  misc_feature (54)..(55): n is a, c, g, or t
ttcccctctgcacaggtggacagataggtacagatgatatacaatgagtactcnntagtatatatgccaaaggggcataggttgatccttgtgacgtcaccacagttggaacagaaaagagaaaagacatccttttttgttctctcaaagtcagagagagagagagagagagagagtaaaatcttcaatcccaatccgtgagaaagaccgtggcctggaattatttccatgctcagagctccgatcaacaaaagatagtgggtgggggagggggaaggcgccgttctgatccagcttcagttgattggcagctcgaggaggaggattggctgatctgagatggtcgaatgaatcatgtgagatccgaattattatctagagaaatgtacgtaaaatgtaacaaatgggaggctcgatttgatgaggactgaggagtccattgactgctgctactaattctatgtactactcaatgcatacatacatgctgttctttggaggcaccgtcgatggtgcattgcttagttgcttcgatgcatgatttcagaaagtaaaactctatctaagctaccctccgccggacgccggcaaggttcagccaggtcacctggcgtcgccggcggtgctgctgaacccgatgtcgtggccgcccctccgcagcgtgctggtgagcgacgacgagctgagcgagtccgaggacgagtccgacagggcgagccccagcatggcgttgtagtccgacacgctgtcctgcaggctgagcagcagctgctggttgttggcgctgctgaggctcatggacggccgggccgccggcacgaacggcgggtccgcctcgccgcccagcacctgcaccacggcgcgcatcccgggccgcagcgccggctccgggctggagcacgccagccccagcagcagcacgcgcctcgcctcgccctcctcgaactccccgcccagccgcgggtccaccgcgtccagcagccgggcctccccgtgcaggctccacacccactccaccaggttgccgccctcggccgtgccggcggcgccgatcggccgccgcccgcacgccacctccagcgccagcacgccgaagctgaacacgtcggtgcactcggtggcgcggcccgtcaggaggtactcgggcgccaggtaccccatggtgcccgccgccgccgtcgcgtcgggggactcgccgtgctccgcctgccgcgccagcccgaagtcccccagccgcgcgcggtaggcctcgtccagcatcacgttgctggacttgacgtcgcggtggaccacgcgccgctcgcactcgtggtggaggtacgccagcgccgacgccacgccggccagggcctcgcgccggtggcgccacggcagcacgggcgccgacgcgtcgaacagcgcccggtccaggctgccgttgcgcatgtagtcgtacaccagcaggatctcccccttctcgtagcaccacccctgcagccggagcaggttgcggtgccggagccccgcgatgatggacagctccgacaggaactccgaccgcgcctgctcgccgctcgcgttgcctccgccgcgcgcgccggtgctgctgcagcgcttcacggccaccatggcgcccgtgtccggcacgatgcccttgtacacggtgccgaacgcgccgttgccgatgacgcgggacgcgtcgaagccccgcgtggcggcgctcagctccttgtagctgaactcccgcggggaccgcgccagcgccgccgccgacgccacgttgctgtcgcgcttggtgcccaccgccagcgcggcctcgcgcctcctggccttggcgcggcgcgccagcacccagaccgccacgcccgcgaacgaggccgccacgaaggcgcccgccgtggcggcgccggccacggccgcgtgcacgggcgggcgcgggccggcattcctccccgctgcggcgcccgacggtgcgatcgagccggccggcgcagcgacactgcctgtcggcggcggcggcggcggcgccgtcgtcgtcgtcactcccgggagcacctggttggaaacgggaggcgggagcgcaggggactcgggcggcgccgaacgtggggacggggccggcgacgcggtggagaagctccaccactcgatggcgtgcgcctccgtgctcccctgcgtggaggcggagaagccgacgaacgcggcgtccttgacgtcctcgctgaggtcgagcggcgcggacaggacggggcctgggcggggcgcttggggtgccgta

SEQ ID NO: 14449 - DNA, 2545 bp, Zea mays
  misc_feature (2391)..(2391): n is a, c, g, or t
  misc_feature (2412)..(2412): n is a, c, g, or t
atctcatttagaattgaagatataatcccgagtgtggtaatatgaccaggaaggtgatcatattcagttcatccctcatcacgaaaccaaacaagagatgatgcagctccaatccactttaaccttgtaatcaaataagaaactaggtttgacctgtcaatgaaaccaaagaaggaacgagtccgatccaatccagaaaaatggatcagcttcgacccgacccacatcgtttcgaaaccaaacacatgctaggattcttcttcaacctttcctccgaaaccaaacacatgctagattcttcttcaacctttcctctaccctgcctcacgagtgagaaaattggatttcatgctttaaataatttgtttctcactttttctgtttgtaatattgactttataaaaataagactcatttacatttgggtttaataatattttggatatttttgttcttctataccattctgtgtattgcatctgtacgtattcatgcgaggataaaaacgtctaaaataacattaaaaacaagtgtgatacgttttgattttacgaaatcaatgttatgaatggcaaaaaaaaaaaaagatgaagcgaaacatatgctttggagtccaaaaatctaattttttctgggaaaagtgcgagcacattgtttgtttggagaaatccaattttctactcacggacgccgcccctgtgcctcgccatcgcctcaggtacgcaaggcggccgaacacgagcgcccgccttcgttcttgcctgcgctgcccctctcctcgccgtttattcgggctcctacctcttgttacaacttgcgcggtgggggcagtgaggcagcaagacgtgaggtccaggatgatgaacaacaacagtggcggcggtgccggaggccctggagggggcatgggtacgggagtgggtggagggggggacgggcggcacgacgacgaggctgcgctcaccgagttcctctcatccctcatggactacacccccacgattcccgacgagctggtggagcactacctcggccgcagcgggttccactgccccgacctgcgcctaacgagactggttgctgtagccacccagaagttcctatcagacattgctagcgattctcttcagcactgcaaggccagggtagcagcacctatcaaagacaataagagcaaacagccgaaggatagacgtcttgtattaaccatggatgatctttctaaagctgggatctgatcagtgccatggattaaagttaataacacaaattgcttgatttcttgcacacataatctgaattcgtgttttacagaacgagactggttgctgtagccacccagaagttcctatcagacattgctagcgattctcttcagtgagtaaattcatagtctcgttattgcaaagtaaaggattctcttcttaatttcaatgatgatagcatattcatgaatgaaacagtatcattcttttattccatgggaatgcaaatcttctgtgcaatactgcaattccatgtttttgtctggttgaacaagtttgttaggcttcaatcaaaatccctccctaattgcatgtacttgtgaaattattcatcgagacatggttatgtttattaggcttcaatcaaaatccctccccaatgaaattattcattgagacatggtttttaaggtgccgcttacgtgatatggctcgctggaaatctaggcatccctatcgccatgatcaaatataaatatagagacagaggggggggagggcatctaggtcaagaacccgagctgctgccatccctgctggatccaacaccagtggctggcacagaacttgctccggtcagctgtgacacagtcaatctggaaggtgacggcagtggtggtcaatttgagagcacagataagtgaggaaagcggaaaaagtgggaggaaggagaagtttcaggcagtggtaggcgcatctggatagaaagggagaggagggagtatgctggatatgtgggggtgaccatgtatatgcgcactggagccattgatacaggaagggaaggagaggctaaagaaaggaggagcatgaagagaaccaggcaaggctgcacctgcacctgcacctgccctcgcccatctctgttggctccggcgcctgtggtcttgcagatcttcactggtcaactgtatagctcgatctgaagggggcagcaccagtgcacaatctgcatgagtagagctctatttcaaaaggggtggcgttggccctcaatctgggaggcgtgctcttggggcagccaggcttgtcattgctcaaagacggcattggaaaggactgatgtaaacaggcaaacagcatcaagtgaggaattggtggattagggattgaggggagagtgtangggtgttgctttatgggctgntgggttaattgggttctaatgagttagtggggtggctgctaatagttaatgtggcccatcgatgcttgtatttacctcttattctacattatatatcttactacatattttatgttccatatcatttactttt

SEQ ID NO: 14450 - DNA, 979 bp, Zea mays
ctcgcgcccggccggtttggagaaatccaattttctactcacggacgccgcccctgtgcctcgccatcgcctcaggtacgcaaggcggccgaacacgagcgcccgccttcgttcttgcctgcgctgcccctctcctcgccgtttattcgggctcctacctcttgttacaacttgcgcggtgggggcagtgaggcagcaagacgtgaggtccaggatgatgaacaacaacagtggcggcggtgccggaggccctggagggggcatgggtacgggagtgggtggagggggggacgggcggcacgacgacgaggctgcgctcaccgagttcctctcatccctcatggactacacccccacgattcccgacgagctggtggagcactacctcggccgcagcgggttccactgccccgacctgcgcctaacgagactggttgctgtagccacccagaagttcctatcagacattgctagcgattctcttcagcactgcaaggccagggtagcagcacctatcaaagacaataagagcaaacagccgaaggatagacgtcttgtattaaccatggatgatctttctaaagctttgcgcgagcacggcgtgaacttgaaacacgcggagtacttcgcagacagcccttcagctggaatggctccttcgaccagagaggagtagactggattaggccaacttgtacggaactagggagggatcgcgtggaatggatgggcatgttggcattcttgcccgatcagatcgatgggatgtattactattaagtactgctactatgactagtatatttctcaattaccattgtcactgagagaatccagacacaagtcgttttgcccatgcgcttttatttgtacaaactgtcaatcatctgtaaccctatggggcccaaggatgattgggcaaacatcatgagttttttgttttctacaaaaaaaaaaaaaaaaaaaaaaaaaaaaaaaa

SEQ ID NO: 14451 - DNA, 1992 bp, Zea mays
cgcctccaaccgcgctttaaagcgcgcgtttcctcttccgcgataaacccgacggcccggcggctgtctgatcagccatcgctccgttacccctctcttctcacaaaaggcatctgcttgcttgctccggctagccggggagctagcgcgcgggcaatcgagcaatgcacatcgcgacctgcgtgtggcaagagaaggcggcgccggccggcggcatggggggagctcgagttgctggtggaggtggtggcggcgagtggggtgcgagggcggcggcggcgctggtcgtggccggtcgcgcgctcaactgcgcggtgagcttcgtggtgttcttggcgctggacgtgctggacgtggtgctgtgcctggcgtacaagctggcggactacgcggcggaggcggagtggaggccgtgctactgctccgcggcggcgggtccgcacgtggcgcagcagctgccccccaagcccaaggtggtgcggcccaggatgcacttgcagctggaggacgtgtcggacacgctgtacgcgcggccgtcgctgctggccgacgccacccgagccggcggcgacggcgtcgcccccgcgttcaccgtgagccccgccgccatcgcggcgctgatccgcgagaagacggaccgcgctccgcgggcgccgcggcaggcgccgcgctggtccgactgcgactgcaaggtgtgccacgcctggagcgggtccccggcgtcgtcgtcccacctgtacgtgcacgtccaggcgccgacgccgttgacgccggcggcgatggcggcggtggagacggaggacgtggtgttcatccacggcttcatctcgtcgtccgtgttctggacggagacggtgttcccggcgttcagcccctcggcgcggtcccggtaccggatgttcgccgtggacctgctggggttcgggcgcagccccaagccggcggagtcgctgtacacgctgcgcgagcacgtggagatgatcgagcgctccgtgctccggcgctaccggatcgggtcgttccacgtggtggcgcactccctcgggtccgtgctggcgctcgccctcgccgtcaagtaccccgccgccgtcaggtcgctcacgctcctcgcgccgccctacttcccggtgccggagtcggagtcggagtcggcggcgcagtacgtgatgcggcgcgtggctccgcggcgggtgtggccgccgatcgcgttcggggcgtccatggcgtgctggtacgagcacgtgagccgcaccatctgcctcaccatctgccgccaccaccgcgtctgggaccgcctcttcaggatccttcaccaggaacagggtgcggacgttcctgatcgaggcgttcatgtgccacacgcacaacgcggcgtggcacacgctgcacaacatcatctgcggcagcgcggggcggatgggcgcgtacctggacgcggtggacagggggctctcctgcaaggtggcgttcttccacggccgcgacgacgagctgctccccgtcgaatgcacgctggcggcgggcgccagggtgccccgcgcgcgcgtcaccgtctacgaccgcaaggaccacatcaccatcgtcgtcggacaggagcgactcttcgccgccgagctagaggccatctggagggccgactagctagcgctagtacgtacccgttgggttgcgttgcttgcgtacgtccctctcggacgacaaacgcttttgatgctggttctggcagtcagtgtgcacagaacgaatgaagctaggcaataacatgcatggtagcctgcaaaacatccaagaacatgtacgtacaattgtaggatgaccgctgtatcatctctctctctctctttttttttttctggtataaattcgagtgtcctcaacggaccatatatatatatgtgtatgtataccctaaacctatacgagagtacgagactcactcgtcagtccgtccaaaaaaaaaaaagggccggccgctcgcgatctagaactagt

SEQ ID NO: 14452 - DNA, 894 bp, Zea mays
cagatgatacgagcacctctgagcttcgatcttttttttttgctttctttttttctccggccttgcagacaattttggtccgttgatttattttaagtagtccaaaatgccaatccaccgcagtcgcaggctcgcagctgcccttgcccgccatgatgcctccaccgccgctgcgccttcacctcctcttccgctccgaaaccctaatccctctactccggcaacgacccagctgcgacgcgccccattgccggaccaggaggtacatctccgttcgcgcctccgctgcacagctcgccgccgcggacgtctcgacggcgcagcagcctgcacttgaacttgggttggaggcagcggcggcgggcttcgtcaccggtaagaggaaggccaccgaggtagcccacgcgtaggttctggagaaatattgttcagaaaggggatacggtggtggatgccacatgcgggaatggcaatgacgcgctcgctatgctgaagatggtggttgatgaaacagtccgtggacgtgcttatgggatggacattcaagattctgcgatagagaattcttcgtctgttatgaaaatgtccgtggatgatgagcatcaggtatgagctcgatgttgatgaatcattttcatcaagccttcctgtggatacctgggtgacctgcaaacttcaaatgctcaataggccagttgctccagtactagttgttctgatcaagaaatgatggcagtttcgatagagcagatgggacttttgggcattgacttatgagtgatgacgcttggtgatggagctcaatacaaccagctaccagcgtaacttgtcataattttgataccactcatgatgagtcccccttattatattctccgccggatggcatacaac

SEQ ID NO: 14453 - DNA, 816 bp, Zea mays
tcagctacgccggcccgcccccgcagctgcccctgcccgccacgatgccgccgcccctacagcctccactgttgctgcgccttcacctcctcttccgctccgaaaccctaattcctttactccggcgacgacccagttgcgacgcgccccattgccggaccaggagggttggaggcggcggcagtgggcttcgtcaccggtaagaggaaggccaccgaggtagcccaagcgtaggttctggagaaatattgttcagaaaggggatacagtggtcgatgccacatgcggccatgcgggaatgacaatgacacgctcgctctgcttaagatggtggctgacaaaacaggccgtggatgtgtttatgggatggacattcaagaatctgcgacagagaatacttcctcttttctgaaaatggccgtggatgatgaacatcatgtgtgggtttgaactatgaagcttttacctaatttcccctgaagaatgaaatagaaaggagacacttatgaattctgatttgacattattatttactattcagatacagaggatacttgtcatcttctcactgaatatttgatatatctgtacctgtcattgtatttgttttatgtggcagcagggactggtaaaactatttcctatatggtcatagtagaatggaagagattgttcccaaagacgctcctgtcaggtgatcaaggccttcctataagttcgttgctgtttgaaaattccaactcaattggtactataattcaacaaaacagtttcctggaaaagtggaaatgccaaaaaaaaaaaaaaaaagcggcc

SEQ ID NO: 14454 - DNA, 2047 bp, Zea mays
ctgccacaagaaatagtttatttagagcaactaaaccagccagattagtgtctgctaccaatatgtgccttttccccatgacagatatgagaccagttttgattgaatcacctcatattttcatctaaatcattttttggtgtatctctctacctgtttgagtttgccggcaggtacaggggaaatacgacagcatcatcgtggaggtgaagagctactacatgtcgatgagcaggtacagggatgataaaaaaagaaaggtatatcttcacgtcgatgagcgggtacagggatgacaaaaaaagaaaggtatatcttcacatcatgtgctatacattctttaatggctttctattgtttctttttttgttggattcgatagcttggtcagttttttcttgtatattagattagatggtggtatatccagatgcgcttttggttataattcatagcgcaactcattagctatatgctggtagtgagggtgctaacacaagctgatggtttaaaatattttctcttgctctagggtgagattatgaaggtttatgccaatgatcaaataaaaacatgtgttgagtttccagagtgttttgtatgtaagtagtgcacattatattttcttttcatttttgcaccttgtatgttttaaaatttaaaaatgattgggtatctgagctccatgccttctatagaggattgctggtcaaacatgagctgttagtgagagaagaattgtgccctcttccctctggttctccctgattctcacaggtgtgttttgcactggcacacttacattggtgctctttctttttgctgctagcataagtactatactactatggcctacttaagaactaggaaagtttatgttatcgaatcatcaaacatgttagcatcttgttagtattaagaagcaccagtgaatcatttacatatatttctaatttgtcaatagcagatgaacaatcttctacatgcaaatttctgttatgcgcgctcgtggtcattggcaggaagactcatgtggtcggaagagggctgatgagcacgatcaccatggatgtggacaccacggcaagggtggacgagttcttggttaccacctttgtaggcccattggtggaggaagacttgacgagaggtgtgtggtgatcaccatctgaatgtgggcgtccaagcttctttgatgccgggtgtattgtcctaactgtgactatcgtcgctggtcgaacatttggctagcatcgatgatgtatactgcaatgtgaatccaataattggcttggctctccatacaaccaataactaggagatcaggtgattgctaattggacaataggggtgctcgtgttgtaatggtgtaataggttcaatgccgtcgtttttacagtcacagtagtcgtgggttaagtgtccaaggtgatttacctctgccctgtttccggtgtcttagcctgattggatagcttctggggtgcgggatgtgatggagcaaagggattaaaaacatgctgatttatgttgcccaaggaattcgccagttgcttaacattttgtttttggcatacttcgtagtcaattactgtccacggattcttgcatatgtgaaactgaggaacatttacttcgaatatcattattggcttggctctgattattcttgttttctggttctcgttaggaccaatgaatgttctctcttttaagaatcttaataagccacgggagcaaagctggatagtatacataagtctgttcaccgtaaccaacaacagcggcctcaccgtcacgcaccgccaactgaagagcaaggtgtgaggatgtgtcatcctagaaatgccgactgctcccattagaaaattagaatatactctcttcgttcttttttatttgtcacggtttagtttaaaaataaactagcgggcgacaaatattcgagaatgtaggtagaaacctttagtactgatgttttaaaaaagcacccttacatgagtgctgagttcaaacgacttaagatagctgtgaacaaccgtgcaca

SEQ ID NO: 14455 - DNA, 783 bp, Zea mays
  misc_feature (773)..(773): n is a, c, g, or t
gtatgaaccacgccaaaagctgaggccgaatggttcgctaggtttactctcccctcctcttccacggccgcgcctgcgacacccatccgccgccacgccatggccaagtacaacgtggtgcagaagaacaagcgccagtgcaatcaggaccgcaagcgcgccgcgcatggggagcccgggaccggcaagctcaagcagcggaccgcgcccgtctccatgtccggcaagcggaagaagaagctcgagcgccgcctcaaccggaagcagaaagaggctgcgatgattaaggcgctggagaacaacatgggggatgtcgacatggtctcagttgaagagtcttcagaagctgcaaagggcaagtcccaagtgaagttcagtgtgaagaaaaactcaagaatacagataaagagattaaagggcaaaggcaggaagaaagccaaaaatgcaaaaccacctgccaaggagaaagttgatgccatggtagaatgacagttgatgccatggtagcatgacggacaagactacatacatccatccctttgtatgttttctcagagtttgcagcatggaccgacctcaccgaacactggcgcgtgtctcttgcatcttctgcctgaatgttaaatagaagctacttaggcctggtgttaatgtacttcaaacatgaatctacctttaatagtggactatgcgaatttgttcatgttcttaaagaaaaaaaaaaaaaggcccattgcggcccaaaaaaaaaaaaaaatttgcggccctcgagnctcagctttt

SEQ ID NO: 14456 - DNA, 830 bp, Zea mays
ggaccctcgaggccggccgggccgggtactcgagttgggtcccgagccccggggggctctcccctcctcttccacggccgcgcctgcgacacccatccgccgccacgccatggccaagtacaacgtggtgcagaagaacaagcgccagtgcaatcaggaccgcaagcgcgccgcgcatggggagcccgggaccggcaagctcaagcagcggaccgcgcccgtctccatgtccggcaagcggaagaagaagctcgagcgccgcctcaaccggaagcagaaagaggctgcgatgattaaggcgctggagaacaacatgggggatgtcgacatgatctcagttgaagggtcttcagaagctgcaaagggcaagtcccaagtgaagttcagtgtgaagaaaaactcaagaatacagataaagagattaaagggcaaaggcaggaagaaagccaaaaattcaaaaccacctgccaaggagagagttgatgccatggtagaatgacagttgatgccatggtaccatgacggacaagactacatacatccctttgtatgttttctcagagtttgcagcatggaccgacctcaccgaacactggcgcgtgtctcttgcatcttctgcctgaatgttaaatagaagctacttaggcctggtgttaatgtacttcaaacatgaatctacctttaatagtggactatgcgaatttgttcatgttcttattgcgtttatggagatgcttcattgtgaatgtcggcttctatagtaagcaactagcataatcttatcccccacattcttctaaaaaaaagaaaaaaaaagcggccctccggcc

SEQ ID NO: 14457 - DNA, 2527 bp, Zea mays
  misc_feature (2286)..(2287): n is a, c, g, or t
  misc_feature (2322)..(2322): n is a, c, g, or t
  misc_feature (2325)..(2325): n is a, c, g, or t
  misc_feature (2335)..(2335): n is a, c, g, or t
  misc_feature (2350)..(2350): n is a, c, g, or t
  misc_feature (2356)..(2356): n is a, c, g, or t
tgaatatagacataaaaatatagagttaaaacgactactattttaaaatggagggagtattttagtatatatattgacatacattatatctactagttaggtgttcatatgttgctacggtttgtatttacatttgggtataaagtataaaacacaaatatatgtctattctgttggctagatgtgtgaatgggaccagagagaggtgatgtccaagtccaagcctttttcacaacacgatgcggatcagcggctgcctaaaccatggatatccctaattagatatctagctagctagttaacctgcagtgtctttcagataatagtaataacaagggcatcccagtaaaatcacatctatctgctcacaagctagcgcgctcccctctttctcagagaagatacatatagacaccccctcgacgcccggcaataatattacaatccaaacacgcacacacaccccacctacctacctagcaagctggagtaggaagccggccagcaaggaaggaatacctcgtggcaatttcgtcccctcctctcttggattcttccatggaggagcaaggtgagcgacacatccagcttcagctactgctcctccctgcgcctgcaggtcatcatcaagtcctgcgtgacgtaccggcggcggtgccagccagcgccgtggagcccccccagctggacctcgatctgaccatgagcatcgggccgaggcggcatccagcggcccaaacaccggcgccttcgccgccgccgccgcgcgcgcggtcgccacccacgaacgagaacaggagggcgtcggcaatgatgatgagcacggtgctggcgccggtaccggccagcgcgaggcagcatcagaagcaccagcagtatgcgggcgctgatgtgcgcgccgtgaagcagcaggccgcggaccaggcccgcatggcgtctgccgagcgcgcctacgcggagcgcgtccgggagctggcgcggcgggagctggagctcgcggagcgggagttcgcgcgcgccagggccatctgggagcgcgcccgcgaggaggtggagcgcgtggagcgcatgaagcagatcgcggcgaggcgcctcgtcggctcggccgcttcgtccgccgcggtgctggagatcacctgccacgcctgcatgcagcgcttccacccctagctagctagctagcccctgctgctctactccgggccagatcctagctagtactagactactagctcctacacttcttgatgacgaagtgtaagggccgggtgcccgggtgccctctctctccgcgacgccggcagttcgaccgtggatatggccaccattgctgaaactctctttcttcgtcatagcttttgtgcacctcttgtgaattaatgccgtacgtacgtgttcagcttgagttccagcgtcttcatcgtctggttcctgtgtttgatcgatgcacgcctcatatcatcaatgcaacgacgagcaagttcttccttctaaaaaaaaaaaaaaaatttacagaaggtggttcatgagagatgatgaactaataaaacaacagcagcgttgtggaacaaacgctgaggtcgtgtggcggtcgttttgtgatcggttgtgttcctaattttgtgtataatagatctggttttctattttgtccatgatcgagcagtggaagtggaacccctgcggctgaggcgtgcagtctgactgaaattactgttctgcccatgatgctttggctgagtatagggcgagcagggaaaccagccaagtcagactgcgtgcattccatgcatgtattcaacctgctcattccagtcaaccatgatgaggtatcagatgctgcttggttacttgtcactcgcgatcgatcttactgtatatgcacactgtgtaatttgaaaaaaataaaactgtacgatcgtgcatatacttatgcatgcacatgcatgcgagcgaagatggtgccctacgcatgcatgcgagcgtaatagccacacatgtcatgttcacatagacctgaatgtagcacaacagtttccttccatgccttttgagttgaatggtctttaaatcgtgcatgtgcaaaatacggttttacaccgtagatcatactattcacaaagataagtttgaaatagaagatagaatagagatagaatgaataaagttgctcgagacattttaaatgtagcacagtaatttctacatatatatcttctaatttccttcagagattaaggaaaaaaattagttcatttctccgtcaaattggtttacacattatcnnaatggtaaaacacattattacacggtgggttcctncgngtatatatancatatagatattgtncgtcantatatagagaaagtacccttctcgaataaaaattcatctgagtaagtaaataagagttacataatgtctaaaataataattaaaaatacatataacttgaaaagataaaaataatataatttacaaaaaataatatctcatcacaagagcttatatatttttaaagggaaa

SEQ ID NO: 14458 - DNA, 6205 bp, Zea mays
  misc_feature (5577)..(5577): n is a, c, g, or t
cttgacttgtttacatgtgttcgtagccgatacaggaaagaattgagaaactgcagctgataaacgaaccgtggaatcaggtctagcagcaatgtgttaggatttgtactcatgacgattgttcggtttgccaccaaacctttttttattgagctccaaggctgatgtctaggccgtcttgatttgttaaatctcacaagattggaaccttttacctgacataaggtgtttgatggcatccacttttataggtgttatggtgtgctcaagtgccaacttgatctagaactaagaccatatccaacagtttaccatatggttacacaaaacactggtttgcatggttatgtattatagactgtaatgttcgtagagtgaactttaaatatagtgatgataatgagtaagctgtccaataaaaaaacaaaaatttcgctaatcgagtcaaatacctaagtttatgagtttatgacaattgagcccgggccgctgtttttttttttttttttttttggaaaatatggttttatatataagaaaatgtcaccaaactattttcaactttattgtgcgctctaaatttagataaaagattcacgccgtgtacgacaaaataataataaaatgagcacacttgtaggacgttgcagtggtagctataattcacgctttacgtggaacgggagcgtagtgggcgtatggaggccagtacaagtgaagctccatcttgtacgtcaccgttcgtcctcgcaagtccaccggcgaggaccggacgtatcccagagcgtacgcgaagtcgccggtgccacccaccaccgggtagtcggacggcttggtgttgtaggtgcccccaaggaccgagacggagccccggtggccgcggtggtggaccgtgatcttggccagcgacatgctctgcagcccgtcgaggctggtggtgatggaggtcccctccgcgactcccgccacccgggagtccctgtccgcgcgcaccgtcaggtcgtcgcggaagacgtagatggtgccgaagggcgtggtggtctggctgacgcccgcgcccgcgacgccgtccaccacgatgtagccggtcctgttgatggtctcgtgctggtacagcgtgaagctgagcgtcttcccgtgcccgtctcggctctcggttttgttcttcggcgtcgcagctgctactgctacaggcgggatctgaaactggaggcggtggagaaaggccaccaacacgcagagcagcaagcccctggcactggcagcgctcgtcgtagctgccatggtaaaaccgaaagatcgctactggattattatgcctcctcacttcccggccggcctcgagggtccccatgttatgcactgcagcctggcagccagaatggactagcgatagattctcaaacagctgatcttgacgaaaaaaaatgacggatcgagacactggacattcggtcgccgtcggagtaaacctgatcatctagatggtagacttttggtggaagacaccgttctttctctctctgaactctgaagactcgtgacctgccgtgcgacgtcctgataccaactgcggctgtgtaccaggtcgacggggagatcggatttgctccgtaaatacgcactgatgcggttgcttatatgtcagtgcgtttgaagtcttctttttcatctttctctctttttggttttttaggcgcacctttctctcattttagtgagagtagttcttttcctttcctagacccaaacccaagcagacctgtgggccgtggccttgctcgagaccaacagcaaatttcggctgtgcctttgtatgtcctaacaagcccatagtggaagaccggcccggtccacgaaacctgttctctcctgttaacgattccatagaaatacgccgtcgtgcgtcattgcttacacgatagtgaccacgcacgccgcgggccggcaaaccgtaccgtcgccggaagattcgtattgcttgctgcgtttcgactttggattggacccgtccccttgcgaccaaccgaaccgcccctcaatcgtctctctgaatcatccctctcgcactctcgcgctgcacgtgctcccctccacgggccaccaccacaaaccaaacgcgagcgcgacgcacgcgcgcaaaaagaagatccagcgcagcgagcgcgacgacataatggggcagagccaggggagagcgggcagagccaaaccagagacgcggcacgcgacgcgggagggcgagcagcagcggcggcgcggcgacatcgcgaggccagggccagaagcaacagccgaggaggggcagcagaggcgaccgccgagagtcccggccaccatggacaccttcttcctatcgcacggctcgcccacgctctccatcgacgacaatatcccggcgcggcacttcttcaagtcgtgggtgccggcgaaggtcgcgggcgaccagcccccgcgcgccatcctcgtcgtctcgggacactgggagacggccacgccggcggtcaacgtcatccgcggcagcaacgacaccatctacgacttctatggctttcccaagcccatgtaccaggtgcgctcgatgcctacctaccaccgtactccctccatttctccgttccccgcgaatccgttgggaagcctcaccgttttagcagatgacccagcgcgtcaaaattaggttggcaacattgcgtctcggactctctcggtgggtccttgttttcctctgctcagtgcttttgagtcacccccaccagatcatggtccggtccaatgcaggtgcagaaatggggattcttgtcgcgaatcatgagaccatgcgccttttttttatcctgaaacaaggatcgctagagccagtgaccaatgttctggtgaaatcaacatgaaaatcagatgtgaacaggccattggggaaagttgccggcctagagcttacggtagttctacaaaaatgaatctgcatatgtagatatctacctgacctgaataggtagtgagatgcttgatagcttgcttgtcagcagcaaacttaggggcagtgaagcttgttggcccatgcgcatcgaagtaggtaaggtgcggttgccgctagcatttaccgaattgactacattatatagcctggccggattctgtatttctcttttatgatctcaaagttaaaaaaaaaagaagaagaagaaagtaaagaaaggcatctttgccagtaaggtgcgttttttctgtgatgtatgcctactgaattctctcacgagcagttgttttaatagtattcacagtttagctagtgttacatagtactttagcacctgaatttcataatactgtataatggttgagtcttgagatatcatatatgcatccaggattaagactttaggtgccctctaggtccccaaccttgtttgatctgacgttaattgaaattttgtagtttgatatatatattttttgcgcttaacttagtttagttaaaaacaatttattctttttttaggtacgtgtttagcctccatgtttccattccacttattaggtagagacatccaccagcttgtctttaggttctattttacgactggttggtagcttatgcttctagataacgtggcttcagtgagcaggtaggttggtagtagctaatataattctgtacttgggatattgcaaatctccggggccccacaatcataccatagactataagcagctgtcgatttcacctctagaagatgtaaatgtaagttctaacttctgcagcactaatgcggattagcgtaatttgctatcatatcacatctctgaaactttctgaatgaaatcgctataccttttatgcttgaccaaacacagtgtgttaatttacaaacggaaatgtttaccgctgctgctgcaataaataaataaataatcgatggagcagctagtaaaacactggttgtggttgtggttgatgatgtttgtagcaagcagctcattcagtcttgtcgacatcatgcttcaattggtctgaagtccaaagtttccccgctgatcctgaataaactcttttgtcccgttccagctcaagtaccccgctccgggcgctccggacttggccctgcggaccgtagagctcctggagcaagccgggttcggccccgtgaagcaggaccacagccgcgggctcgaccacggcgcctgggtgccgctgatgctcatgtacccggacgccagcatccccgtgtgccagctctcggtgcagaccgaccgcgacggcacgtaccactacaacctcggcaaggcgctggcgcccctgcgggaggaaggcaccctcatcatcggctccggcagcgccacgcacaacctgcgcaagattagcccgtccgacgcgcccgtgccgcagtgggccgccgagttcgacacctggctcaaggactcgcttctcaacggaaggtgaacctgaaacgaaactgctcagcgctcagagtcgagagacctgttggcctgttggctgttgctgctgctgctgataaaaaaaactcgtcgtattgaccgtcaggtacgaggacgtgaagcggtacgaaggagaaggcgccgcacgcgagggtgggcgcacccgtggccggaccactttctacccgctgcacgtcgcgctcggcgccgccggggacggcgcgaaagcggagcagatccaccagtgctggtccaacggcacgctctcctacgccgcctacaggttcaccaccaacacctgacgcgctgctcgtggtgtcggtggaataccaccgtcccgcccggccagctgctgaattcgggggaagcatccatcgacgggtgtggcactggcagcattgcacatactgtatttctaataaacccccgtgtgcctgccgttccgttcgcggtagatatgcgtttgttattgttttgcattgtttggtgcagcagcttaggctgattgattgcctgcatggtggtgccgggttctcgctggcctagctgaagcgtgcattctatcgagaaacgttttgtttgttaatgtattctatcatcgtttttaagagttgaaggccttcatcaatcccccagtcgaagcccatcacattgtctcgaggtgcatcccaccaacttctctcggcccatgacaggttcccaacgcgatagttcgggatttttttatttgtaactcttttttataaattatttttaagaaaaaataaatcacaatgcttttatttctaaaacaaactccaaactacgttatcatgttattttgcccgacgtggtcgacctatcaccatagcatgttagtcgccttcgcctggctaacccggccaaccgctaccgcaccaacaacttgagcgcaccatttctccatcgtccctctctgtggccctctcacatcaacccaattccactctacaacaggctatagttttagtccacaactacattaatttttctatttcagaattaagtaattcacgtgaatttgtttaagcgtttataaatcacacaacataatattttttatttaattaaaaattataaagtgcataataattaaaataaaagtacatgacaattacnaaaatacataaacctaattggagttctagatctcatcctcatcttcctgttctgctttcggttcctcttcttcagcatcgaccggaccaagtttctttgacttttttaatgattttttttgaactccaggcggccaaaaacaactagaagcaacgattaaaacacgtggtgttgacgttaacaagtggatcaatcgaaacatgccacctcgctctcgcccacaccagccagcgtgtttcctaccttccgcccgtctctcgtccgagcgcgtgctccaacgcgggcgagggcggggcgatatcgtctgctctcggtagacgtgagcaacactctgaaagatctttgtggaagcctcaagatcaacctcaatgttgtacttgagaatagaatagggttgaaagagactcaaagtctttgtggcttccttggtaacatggacactggcaagccatggtggtgacctccacatgataaatcaagtattttgcctcttatgttttaaattacaatatttttgcttccacttgatctacttggttgtgcatgtttatgagtaactacttagtggactttctattggatatatccaagcacttctataagcttgatttgagtttatttcgcgagg

SEQ ID NO: 14459 - DNA, 1377 bp, Zea mays
aatgtttttgaggcgcccatccaagcatcccatccattctctttctctctcgctgctctgctccccacggaccacggggcaccaccacaaaccagacgcgacgcacgcgcgcaaaatcatccggcggagccagggcggaggcaagccagagacgcggcacgcgacgcgtgaggacgaggagcagcggcagcgcgggcgcggcgacaccgcgaggacagagcgagacgcagcggcggaggaggggcagaggcgagcgccgcctagagtccctgctaccatggacactttcttcctgtcgcacggctcgcccacgctctccatcgacgacaacatcccggcgcggcacttcttcaagtcgtgggtgccggcgaaggtcgcgggcgaccagcccccgcgcgccatcctcgtcgtgtcgggacactgggacacggccacgccggaggtcaacgtcatccgcggcagcaacgacaccatttacgacttctatggctttcccaagcccatgtacaagctcaagtaccccgctccgggcgccccggacctggccctgcggaccaaagggctcctggagcaagccgggttcggccccgtgaaggaggaccacagccgcgggctggaccacggcgcctgggtgccgctgatgctcatgtacccggacgccgacatccccgtgtgccagctgtcggtgcagagcgaccgggacggcgcgtaccactacagcctcggcagggcgctggcgccgctgcgggaggagggcgtcctcgtcctcggctccggcagcgccacgcacaacctgcgcaagatggggccgttcgacgcgcccgtgccgcagtgggccgccgagttcgacgcctggctcaaggactcgctcctcgacggaaggtacgaggacgtgaaccggttcgaggagaaagcgccgcacgggagggtggcgcacccgtggccggaccacttctacccgctgcacgtcgcgctcggcgccgccggggacggcgcaaaggcggagcagatccaccagtgctggaccaacgccacgctctcctacgcgtcctacaggttcaccaccaagagctgacgcgcccgtgcagctgtcgggtggaggaccaccgccccgctcgccccccggggccagctgctgaattcgtgggaagcacatccgtcgacgtgcgcgacagcattcatatacacgcaccgcatgtagaaatgcgtttttcttaataaactcccgagtgccgatcgcggtagatatgtcttgcattgttcaacgcagcagcttgtttcgagaagcattctgttgttaaatctcattccatcatcattgtcttcaagtggtgcaaaaaaaaagaaaaaatgcccttctcaagggcggccgctcta

SEQ ID NO: 14460 - DNA, 1330 bp, Zea mays
ttgggtacctcgacgccggccgcctccgggcccgccggcataatggggcagagccaggggagagcggggagagccaaaccagagacgcggcacgcgacgcgggagggcgagcagcagcggcggcgcggcgacatcgcgaggccagggccagaagcaacagccgaggaggggcagcagaggcgaccgccgagagtcccggccaccatggacaccttcttcctatcgcacggctcgcccacgctctccatcgacgacagtatcccggcgcggcacttcttcaagtcgtgggtgccggcgaaggtcgcgggcgaccagcccccgcgcgccatcctcgtcgtctcgggacactgggagacggccacgccggcggtcaatgtcatccgcggcagcaacgacaccatctacgacttctatggctttcccaagcccatgtaccagctcaagtaccccgctccgggcgctccggacttggccctgcggaccgtagagctcctggagcaagccgggttcggccccgtgaagcaggaccacagccgcgggctcgaccacggcgcctgggtgccgctgatgctcatgtacccggacgccagcatccccgtgtgccagctctcggtgcagaccgaccgcgacggcacgtaccactacaacctcggcaaggcgctggcgcccctgcgggaggaaggcatcctcatcctcggctccggtagcgccacgcacaacctgcgcaagattagcccgtccgacgcgcccgtgccgcagtgggccgccgagttcgacacctggctcaaggactcgctcctcaacggaaggtacgaggacgtgaagcggtacgaggagaaggcgccgcacgcgagggtggcgcacccgtggccggaccacttctacccgctgcacgtcgcgctcggcgccgccggggacgccgcgaaggcggagcagatccaccagtgctggtccaacggcacgctctcctacgcgtcctaccggttcaccaccaacacctgacgcgctgctcgtggtgtcggtggaataccacccggccagctgctgaattcgcggggaagcatccatcgacgggtgtggcactggcagcattgcacatactgtatttctaataaacccccgtgtgcctgccgttccgttcgcggtagatatgcgtttgttgatgttttgcattgtttggtgcagcagcttaggctgattgattgcctgcatggtggtgccgggatctcgctggcctagctgaatcatgcattctatcgagaaacatttgtttgttacgccccgtttggatcattgaaattgaattccattctaataatagtaacttagg

SEQ ID NO: 14461 - DNA, 1282 bp, Zea mays
gagccaggggagagcggggagagccaaaccagagacgcggcacgcgacgcggaaggaccagcagcggcggcgcggcgacatcgcgaggccagggcagaggcgaccgccgagagtccctgccaccatggacaccttcttcctatcgcacggctcgcccacgctctccatcgacgacagtatcccggcgcggcacttcttcaagtcatgggtgccggcgaaggtcgcgggcgaccagcccccgcgcgccatcctcgtcgtctcgggacactgggagacggccacgccggcggtcaacgtcatccgcggcagcaacgacaccatctacgacttctatggctttcccaagcccatgtaccagctcaagtaccccgctccgggcgctccggacttggccctgcggaccgtagagctcctggagcaagccgggttcggccccgtgaagcaggaccacagccgcgggctcgaccacggcgcctgggtgccgctgatgctcatgtacccggacgccagcatccccgtgtgccagctctcggtgcagaccgaccgcgacggcacgtaccactacaacctcggcaaggcgctggcgcccctgcgggaggaaggcatcctcatcctcggctccggtagcgccacgcacaacctgcgcaagattagcccgtccgacgcgcccgtgccgcagtgggccgccgagttcgacacctggctcaaggactcgctcctcaacggaaggtacgaggacgtgaagcggtacgaggagaaggcgccgcacgcgagggtggcgcacccgtggccggaccacttctacccgctgcacgtcgcgctcggcgccgccggggacggggcgaaggcggagcagatccaccagtgctggtccaacggcacgctctcctacgcgtcctacaggttcaccaccaacacctgacgcgctgcttgtggtgtcggtggaataccacccggccagctgctgaattcgcggggaagcatccatcgacgggtgtggcactggcagcattgcacatactgtatttctaataaacccccgtgtgcctgccgttccgttcgcggtagatatgcgtttgttgatgttttgcgttgtttggtgcagcagcttaggctgattgattgcctgcatggtggtgccgggatctcgctggcctagctgaatcatgcattctatcgagaaacatttgtttgttaatgtattccatcatcatttttaagagttgaagggcttcatcaaaaaaaaaaaaaaaaaaaaaactcgagggggggcccggtaccc

SEQ ID NO: 14462 - DNA, 2843 bp, Zea mays
aagatagtttttttttctatagtacagattccttttattgtttgtccaagttccctatattaataagcaataagggtattttaaataaaaaaattattacaatggaattgtacgatttatttataaaatatcaggaacacaaatgttaaatcaatttttttttttttttttttttgattaagaaatatatttaaacaaagtgcatatacatagagaatatattacagcagatgcagagcaacataattcccttctcctaaacaaggccgtcaccgtactaacccgcgcttggggaatccaccaaatacacgcacaatacaatactccaggactactgcacgacagtgtgttacagcagccaagattcttatatttagttatctaccattaccacgaaaagtgttcgtaaaattgccatcagatccgtatttagattgacccataatccatagacacagtcacaactaaaataaggtaaaatactaattatttcgttaccacactctctctcaacctcgtacgtactcgtacacatgtaggtacgtacccaggcgtatccacgaatgcagtgcacgtagcatagctagtacaagaggggcttcccggcgtggaggtcgcggaagtaaagccgggggttgttctcgaacgcgccccgcggcatgcgcgcgccgccgcggcccggcgcagccataaagcggcggccgccgcgcgtcctgcggcaggcgcagcagcagcagcgccagcagcagcaaagcacgagggcgaccactagggccgggatcaccacggtgacggcgacgcgcatccactgccggagcgtctccgagcgggtctccggcgggaagatctcgtccgccttctccgccagcgccgcgaagagggcagcgaggtaggccgctgcctcggcggccttcgccttgatgagctgccacaggccccagaaaaagtcgccggcgccgtccaggtcgaagctaagagcgccgccgctggccacggcggttcgtgctgcggtgaagccgcctggtacgatcttcctcgccggagtccctgggaaggccatggtgtctgtgtgtttgtggcttaaccggaggcaaccacttgcgtgaggggggccgcccacgcgtccgcccgcgcgtccggtcttaataaggagtatatatgtacgaaacgacgcaacgcaatcaccggctaattaaggggccgtttagttgcacttttggaccgattttattttataaaaaacaaaagcccaaacaaagaatctactgcttgtaaaatcgtttgtaattgcttggtgcattttttttgtgcttatgtttttctgcgttgaaatggataaaataacaaaatagttgttttaagaggaataagataaagcctatattttacatttgttttaattaaatttccagtttttcacaagtcacaacgaccttttacaactcacaataatttttattagccacaactaaatctaaccgcccctaagatagtgtagattgttggacgttggattttcagttttttttttttggggggggggggggtacttcactggttcaaccgctcaagaccactgatcaggcacaagctctcccgaatgacaaacaaaccatgcgttaaattagcgcaacaacaaataatgcaagaggtgatggtagaaccgtagaatactcctcgagttctattagtcaactaaacgtaggagctttacatcatgcagacatgctcatacagtcatgcatactcatgcatgagactatgagactagcgtctcgtaggaatgtaggatctacttccctcacttctgctcgtgccatgcttgaccagttcaccgccggacgccaaaaagagcggcgaccggagaagcgatgaccgaggccaccgtttccgtgcagaagacggtggcggccacgatgggtggagcggctcgcatcagcgcgaagaagagcgccggcgctgcctcgaaggcagcgcgcgatatcagcatgccggacgcgcccggggcgttcatggtgaccccagcggcgcagttcaggcactgcatgcaggacggcaggagggaggcgaacgccgagaaaacggcagagcaaacgtagaacagcccgtgcccgaggtggaaggcggcgatcacgagtacctggccgaccccgacgctggcggcgaggagggccggagcaggacagcagaaaaaccagacgagcgccgcgacgaggacgaccgcagctatgcccagcacgtacgggagcaagacgggggcagcggcctggatccaccggcagagctccgctagcttacgggggatctcgtgtgctgcgttcaccagggcggcccaggctccggggaggaagcccgcgacgacctgccacgggccgtcgagggcggagatgatggcgcccacggcatcggccatgctggtggcgagccactgccagagcgtctctagcggcaggaccaacaggtgggccgcgccggcgatgcccgcgacgatatgggcgaagaagcctgtgacgtgctgccacaggccgttgaggccggaggcgatggcgccagcggcgccggtgatgacggtgaccagcgactgccagagcacctccagtggcaggacgagcagctgggccgcgccagcaagaaccgcgaagaggccggcgaggatgtcggcgaagaagccggtcaccatctcccacaggccgaagctgatgccgcccacgtcggcgacgccttgcgcgatggtgccagctgcgccgccatgcaggaacttccgtgctgtgatagccatgccagaagccagatgcagcgcctcttctctcaagtctcgagaacgattagtgagggtgtgaaaa

SEQ ID NO: 14463 - DNA, 1555 bp, Zea mays
gctcaatgtttccacgggttaagcacttggctatcgaagagtccaatgtcacgaaagcgtaagacccaaatatgctatagcgcaattaccaccgttcatggtcattaaaatagctataatgctgtaaatgaaatctctttccatttatgatttgcagcattttgtcgagatatcatgtccgtgcactaccttccataataatagctcgcagctcatacatattctgggcgctcggttcgaaagatctcgactctctagtcaacctttacactgctgctacgggtacgtatgttactcctatgttcttacaaacttgtgatgtttatggtgagacaagcttaaatcgatatatgttgttgtagtatcaaacacgagttttaccacactgtatagttctactgcatgtctatactatggtctagggttattagatccaattacccaggggtgctccttttgatttgtacagaacttttcagagctgccttgtacaggtagcatgcaagctcacctgattctagtaaattcagaagatgtagatgggagtttcgctatgctatgtattgttgcaattaccgttacatttcactatctttgttattcatgctgcactgttgtttggttactcaaaattgaaatttagaatattattattattggtggaaaagaaaaacaatttagttacttattaaatgagaggtgatttggtacaggtcaagaaccagtcgcatatattggtactcgcaagtggagggccacgcaaagcacagactatgctaagatttggaacagctcgattagtgaaacagtgaagcaagaaccctgcctagcattcagtatcctgtttgtttgcctgaggatattcatcttcttcttcccaaagttctttgctctcgtccaagacttctggacccaatactatgagcaaatcaaccttggaatcctcgccaaattgacccagctgcttgaatgtgtgcctcatgctgtggacgtgagaaaggtgtggagcaagttgaggctcatggttggagctaagaacggtaggatatgggcatcatctctaacttcggtgtcacttggtgggcagccttccaggcgagttgctgttggactgatgggctcgaccatctaacggcaacaagagaacgtgctgattcattgaattgctcctgttaaggttgtaactcacatgagcatatttagacagaaattgaattgctcatgttaaggctgtaactcacatgagcatatttagacagaaaaggtctctggctttctgcttagaaacatacatcctgtttgtagcatgtaaatcttagcgatacttgtagcctttgtaagtcatgttgtaacattagtcgtcagtgccccgatcaggcaggctgcctttggcaagagaaaatgcagcacaagcttggtcttcccctccccagaatacatggtcaaatgcgccgttttatcatgtaatctgcaatgatcaatggacatccttcagagatccctctcattttctgatggctttgaatttcacccactcggtaattctaaccttgtc

SEQ ID NO: 14464 - DNA, 1731 bp, Zea mays
ttttttttttttttttgataggaaatgacctcttcttatttgcttttcatctcagaacgaaaatcatccaacacttcctcatttctcatcattcttgctatgcaggcttcttgcatcagctaagacctctctctaaccacttattatttgttacacttcccccaaaccaccggacgacattaaggatttcttcactgctcgtcaacctcccccagctttccgtccacaccaaaaaaaaaaacgaatatatcaccagatccaaaacgaacagacctaacaatgatgctaacgctgctacttccttcctaactctgcctgctaacacactacctaacaaaaggtacccaagctagtttcttcgattattaggatcaactggagtgcggagtgccggcctccaaacgaaaggggggtgttgtcgacggaatcttggcggctccattcccgtccgcgtcccccctcccaagtccagccggcgactggacgactcaggtactgccgtggcacactgccgcagcggcagcggcagcggcagcggcagccgcgcggcgcttctggctcgcgagcatggcgttgctccggctaatcaaggcgtcgtgatcgagaacgaagccgccagggtagtagcgaggctgcgcgccgaggtcttcgagcctgaggttgagggcctggacgacgcgagcggggacaagaaccgtcgaagaacacgcccccgccgtcctcctcttggggctccgccgcgggcgcgccggccggcctggggaggaacaccccggtgccgttacgctcgcgcttggcgccaggcggggtcaggaacaccgcgcgcatgccggaggcaggatgcaccggcgcctggtggtgctgctgctgctgcggcggcggtggcttctggagcggaggccacgccgccgggttcaggccaagcggcgcgtcgcctgcgccgcagccgacgggcttggcacaggcgctctggcgcgcgctccacgcggcgatatggcgctccctctgcagcttcagcagctgatgctgcttcaggagatggaactgagcagcctgcatctggcgctgcgaaaccaagtgcgcgagcgggtggtagtgaccgccggcgccggcagggaccttggcggaggagggcggagcgatcggcggcggcggcggggatggcttgctgaaggcgtaggcgttggccggcacgctgctggcggcgcgcatgcgtgcgacctgccccgccgcctcgtacaggacgtcccacgggtcggccggcttctgctccagaggcggcgacgacggcggcgacgtccccttggacgccccgccgttggggctctcctggcccgacttgggcagcccgcacagcgtcgactgcggcgacccaatcaccgccacctccgccttggcggtaggcggcttccgctccccgtcgtcgccgaggaggcccgcgagcctgcgcgagagccccgccaggctgtcctcctcgtcgctctcgctcctggccgccacggccgccttctcctcctcggagaagaagtcgtcgtccaggaactcctccggcagccagaactcgtccccgaggtccgaacactccgtcgacatttttccgccggtggtggggagcagcgcccgggacctgcagcggcgggggtggacgggctggagaaggcggcgtgcttatcagcgaaaagaggtgggacgggcgagaaagagagtgtgaggccggagggagaatttttc

SEQ ID NO: 14465 - DNA, 2433 bp, Zea mays
gaaaaaacatgacctagaatccggtccggtacgtcctctgcgccgcgcctcctcggctcctcccatccgtcgccagcgcccagcgccgcccgactccgccccacgtcgcgcgtagctcaagaccaagcacgtcttgcaccgcctagctcacctctacggccgccgaacctgcctccgccgttgccgactccaagctccactcgcctgaggtcccctcgtccgaggtgctcgactggacttcctccccccgaggtcccctcctatccattgccgctcctccccgacatgtccaagaaggtcggtaagctaccgccgccggcggcggcgcatgaggaggcgagagaggagctgtttgcttcatgctctttcgccgacctcggcctccactctaccctctgcgcccaccttcaagataagatgagtttccaagcacccactcgaattcaagctcaggcaattccagttgccatttctggacagcacatgctagtgaaggctgctactggcactgggaagactcttgcgtaccttgctccgattgttcacgttctccagatgagggagcctcgtgtggatagaactcatggaacttttgcgttggtacttgtgccaacgcgagagctatgcttacaggtttacgggattgcacaacagctggttcatcgttttcactggattgtccctgggtatgtcatgggtggggagaacagagcaaaagagaaagcaagactgcggaaaggaatatcaattctcattgctactcctgggcgccttcttgaccatttacagcgtactgcttcatttagctattccaatctgcagtggatcgtttttgatgaggctgacagcattctcgaacttggttttggaaaagcagttgaggatattctagagcacttgggttcaaggaatggcgctactggtcaaattaaaaacaaaggggggcatatcagaagacaaaaccttcttttatctgccactcttaatgagaaggtgaatcgtttggcaaaaattagtttgaaaaacccagtgatgatcggccttgatgatcaaagcaagccatcaggaaaatccaacaatgtagggaacaatcatacttctctattatctgatgaggatgatgaaatactggaaaagcagaatgatttaatggagcatgcagttgatgatttcaagcttcctactcaattggttcaaagatatgttaaagtttcatgtggttcgaggcttgcagttcttcttatgattctgaaatctctatttgaaagacaagtctctcagaaggtcgttgttttcttttcaacctgcgactctgtagattttcaccacacagcactcagccagcttgagtggagctctggcccacagcgtgatatggataagaagcaaaaatttcttagctgtaaagtgttccgtttgcatggtaacatggagcaggatgatcgcaagaagtcatttttgggttttggttctgagaaatcagcaattcttgtatctaccgatatcgctgctaggggtttggactttccaaaagtcaagtacatcatacaatatgattctccaggagaagcttctgaatacgtccacagggttggaagaactgcaagaattggtgagaagggggaggctctcctctttatgcaacctattgaactcgactacttgaaagatctggagttacacggtgtatcactgacagaatatcccttgcaaagggttttggatagttttcctgtaaatggacagaaacctcacaaaaggaagcaaatatccttagacatgcatccctgcataatgtctccgcagaggtcacttgagggtttcgttgcagctgaggacgcaacgaagaagcttgccagggatgccttctgttcctgggttcgtgcctacactgcccaccgaggtgaactgaagaaaattttcatggtgaagaagctccacctgggccatgtagcgaggagcttcgggctaaaggagcagccgtcgctggttggaaggtcacatcaggtgtctcttaaaaagcggaagaaagagcagaagcgcgagcggcctgccaaaaggaggaagctcccctccaagaagtgaatttgcacacccggaatgctgcatcgcttgacttcggatcatgacgcccgccatttttgcgaccgacaaccgtggtggcctatgcctcggtctgtagactattgacatgagctatttttgttcgcgatattacatgtagaaatgtaggaactatagcaacaaatgcacaatcacattgttcgctgcagcagctgtttgttgatgtgagatcatctgttactattattattttagtatccgcttgggtttctcttaaatctcacgcctgcttttgttctactgtactgtataaatattgcagtttacagtgcaaaattaaaattaagttttatgaaaaaaaaaaaaaaa

SEQ ID NO: 14466 - DNA, 1613 bp, Zea mays
acacgcaggctgcgccgactggccgtgcagtcgtgcaccagccaccaggtcacgcgcattcctgcatttgcattctattccattccataattccattcatccgctccgctccactccagtcggtcctactagtcctaccctccccgcctccccggcatcccttcgccatagcagcaccagacagcagagcaccaaacccacacttctttcacctcccctgccccctcctccattctccatcgcaatccgccgccgccgatggcgaggccgacgcgcgcgctcctgctcccgctcctcctgctcctggtgctggcccgcgcgtcgggcgacgtgccggcggcggcgtccctcggctgggacctccgcgtggtgggcgcgggagaggacgaggagttcggcttccctggcggggactccgtggcgtgccgggtgctgcagggcggcggctacctcagctacggcgcgctgcgcagggacaacgtgccctgctccgtccggggagcctcctactacaactgccgccccggcgggcaggctaacccctactcgcgcggctgctccgccatcacacgctgccgcggctgatctcggcgtccgccaataggaagaggaggttcatatccgtttatcctgcgccgttgttggctgatacggagaaaatcattcatctccctccctgcccctttaatcgattattggtacatgtacgctactctctctctctctctctcttgttgattgattttgtttctcttgttgattgattttaacgagaatgattgtgttggttgtgggttatgactggagtatctctctctcgctccggtcctgtaaattccatgattttcgagcagctggtgtataaactacaaactgatgatgacgatttccccgtcaaaaaaaaaaaaaaaaaaaaaaaaatagccacacggtgacacgggtccgcgtcgcaagtcgcaacaaccagctccatgatttcaagtttctttctttatttttttgtcctcgctgcaagtaattatactgatagcgtagcgattctttgcttggtctgagcaagttgcaattcttctgacatcttgcgtgcctgacaattttgcctgctgggctgctgcctgccaccagccatagatcatgcctcggaggaagcgaggtcaacgagagccttttctgttattaattatctgggcgtttcgaaacgggcagaagaatagaacaacagttctggggtctatttctttccttttttatcgtttccttctggaggagccgagcctacaagatattaaataatgataaatcaaatcattctattccaggaacccaacaataaaacgaggaatggaaaaataatagactattaccatatttctcaaaccaaacctacataaatggttagaattaggcttactagtgtgtgacccaatttaataacgaagccaaggtgatgtgtagagattgtttgcggctttactctcatattgtccatctatgtaatagagaaccagattatatctaggagtgttcactactattcacattaaacaaataaaaggctatgatggctgccacatgcgctcgctcgcgttttttcgtgttatttatcgcgtgac

SEQ ID NO: 14467 - DNA, 2145 bp, Zea mays
  misc_feature (2100)..(2100): n is a, c, g, or t
ccagcccctctcccctccctctctcctctataaacccaaccacgggaagggaaccaagagagagaagagaagcatcccttcgccatagcagccagcggagtaccaaaccccacacgagcaaaagcagagcacacagcacaaacctctttcccctcccctgccccgcctcctcctcctccattccccatcccccatcccccatccaccgccgtcgatggcgaggccgacgcgcgcgctgctgctcccgctcctcctcctggtcctcgcgctggcggcgctggcccgcgcgtcggggtcgggcgacgttccggcgtcgtctctgagctgggacctcggcgtggtgggcgcgggggaggacgaggagttcggcttccccggcggcgactccgtagcgcgccgggtgctgcagggcggcggctacctcagctacggcgcgctgcgcagggacaacgtgccctgctccgtccggggcgcctcctactacaactgccgccccggcgggcaggccaacccctactcgcgcggctgtaccgccatcacacgctgccgcggctgatctcgccgcctacgcgtccaccgacggaaaacaggaggttcatatctgtcaatcccacgccgttgttgatttgagacacaccaaaaaaaatgttcatctccctccctgtccctttaatcaattatcagtacctgtatgctattgcttgttttctcctgtcgtttgaatttaacgagaatgattggtggtggttgtgggttatgcatgagttggcgcccacttgattccagccggattcgcctctctctctctctggtcctgtaaattccatgaatccatgattcgtgagcaactggtgtacaaactacaagctgatgatgaaaattccaccgtgaaccaaaaaaaaagtgattgtaattaagttagcggcggatccgagtcgcaacaaccagctccgtgatttcctgtttcattattattattattattattattattattcgtcagagtaatactgacatcatagcgattctttgcttggtcagttgcaacttgcaatccttctagacggctagacctcgcccagttgccctgccctgcttgcgtgcccaccaattttggtttggtgccggccgggcccagaccgccgctggccctcagccatagccatggatcgtgcctcggaggaagcgaggtcaactagtagagttttttttacatcgaggcgtttcgaaacgggcaggagaacagttcttgggcatatttctttctttctttctttttttcccattcttgcctctcgaggtgaacaagttttcttgttcgagactggtaccaaaaccccaaagattttgcaagcatatcttccgatcacaggcagcaagcagcctttgttcaggacaagtgagataggttctatggtttggttgctgtggcaacacaataatcttctgccctgtctagcaatatactacctctgtactatggcaattggcaatgcacgggatggacaactgttgcgtgtttaatggaagaatatcgcaaggacaagacacccacgcgattttgatttggggtatcttccgttccctggagtccttcgcttcgtcgtccttgctgcttccctgccattgattcaccccgattcccagactggccacatgggcggtggcggcgcattcaataggacggaaatctcggtgagcatgaaatagaaaggaaaaaaaaacctctgtaaaacactactactgcattttgctcgttcccccgaacatttatgcaaaaaatatactacgtgcatgcacccataaaatattcgatgacagctaggatcaacgacttgatagatactcgaccaatcccacgccagcagcggccccgccccggcatgattagcagtcctgacgaagtggtcagcgagaaacgcagccggtgatagtgccgttccgttggttttgaggattgatgagaagagtcagctttccaacccttcaccgtgttcaggcaggcaggcaccaatcagacagtagaatagtgggtctgctttactgacagccgagcacggaggggcgatcctattggccagccagcagggagcaaagcgngggggcgcggggctcataaaaaagcgagggcaatggaaagctcag

SEQ ID NO: 14468 - DNA, 1793 bp, Zea mays
atcgtcgaatccctcctcaacgcatcggtttcgacgaaaccgaatgtgccgtgttttataatggaaaaaatctcctcccgggattcccccagccaccaagcccgactccgctgatcccctcaccacgcaaccctcgccggatcccggcatgccgtcgtggaagcctctcgctggcggcaagctcaagaagccgctcactgacaagcagcgcgctgccgcggagcagcgcctgtcccacctccgcgcccacctcatcctgcgctccctcgactccccagctggcggggcccgttccctaccgccgccgcaggaggcggcgctcgatgccctcggcctgctcatttttttccgcctcgacctgcagtccggcgccccgcgccccgacctcatcgctccgctcgtcgcctactacgaccgtgtctgcaagcgcagcttcgtccgcggcgtccgtgtcggcgtctcgcgccaccacatcatccgcgcgctctgcctaccctcgaagcccgcctctgcggcgccggccccagcagacgtcgatcccgcagcggtggtcgctgccgttatgcagctccttcaggattatgtcctgctcccgttccagggggacgacaggtgcatactaccgcagcaggtggctgccgcagagcagatggtcagggagggggcggcgcatagggttgattggggagagctgatctggggcctcgtcgagaaggagatgctcgagctgcccaagagggaagactgggtgtgctactacgggccgcacctacagcggctcatttatgcccaaaagccacatctgttggagctggtggaggaagggcctgttcaggagccgtctgctaatgtggatttgaaaaggaagagcatggtggagctggagcaaggggatggggatagagaagcgggtaacaatgtcaaaagcaagagcttgaatgattcagaatcggggaaggctggtgcaaggaatgatggtttggacgagttggagttggctgatgctgttacgaggaacaaggtcatgggggagttcggtttaggggatgtagatgctaggaagaacagcatagtgaaactagaggttgtcgacgaagatgcaaggtgcaagtgcttgaatgaaattcaggctgtggatgctatcaacaacaatatagttgaattggatgcggccaatgaagatgcaaggtgtaaaagcttgaatgatgaatcagagccagtggaagaggatgttaagggtccaagcttcgatgacatgaacaccgtggatgagcacgtcgatggcacaaacacggatggatcatgtttgggatttgtggcagttgaagcggtgcctgctgtaaatgtagagcctgacgttgttccagattatccagtcatcccaactgcttcaccaacaaacataaagaggttgaagacgttccacaaacctagtactaacacgaaatcaaacattggtcaaaatttttctaggttgctagaagaacacccgaaaatagcatatgatatttgcaatggtccaataaatatgtacaagtgtactaagaaacttttggagtgtggtttcacaggcaaagtacttcacattgcaatcaaaatactaaaagaagattgggaagctcgtcagatattcatggcattagatagatctgaatctgtaacctttatttccaatgccgttggcgattatagctagatgatgttgtatggatgttgaataatgtgaacaataatgtagtgaacatgaactctgagttatgaactattaagtgattgcaaaaaaaaaaaaaaaa

SEQ ID NO: 14469 - DNA, 3902 bp, Zea mays
  misc_feature (1245)..(1245): n is a, c, g, or t
gcaaagagtgataaggagttcatctttcgtacacattttgtttaagcttccaatttataacggattacagactctagcgtttctgaagcagaacaatagatgacaagtacttgaacagtagataaccgattccattcaagagcgctgttgactgcatgaatctgtagtccaaattgaaaaatagcacaacaaacatttttaaaaaagcccctcgtctctctcaattatttgatccacacccccgcgcgaggccgaagccaaaacccacgcgaagccacctccccgaattccccaacccgccatgcccgactccgccgatcccctccccacgcaagcctcgccggatccggacatgccgccgcggaagcctacagctggctgcggcggcggcaagctcaagaagcctctcactgacaagcagcgcgctgccgcggagcagcgcctgtcccacctccgcgcccacctcatcctccgatccctcgagtcctcagctgccggggcccgtgccctaccgccggcgcaggaggcggcgctcgatgccctaggtctgctcgagtttttccgcctcgacctgcaatccgacaccctgcgccccgacctcatcgccccgctcgtcgcctactacgacccggtctgcaagcgcagcttcgtccgaggcgtccgtgtcgccgtctcgcgccacaactttacccgcgcgctctgcctaccctcgaagccctccccctcggcgccggccccagccgacatcgaccccgcagccgtggtgcctgccgttatgcagctcctgaaggattacgttctgctcccgttcctaggagacgacatgtgcatactgccgcaggaagtggccgccgcggagcaggcggtcagggagggggcggcgcatagggttgactgggcgggcctgatgtggggcctcgtcgagaaggagatcctcgagctgcctaagagggaagacggggtgtgctactacgggcctcatctgcagaggctcatttatgcccaaaagccacatttgttggagctggtggaggaagggggcacaggagagcctgctccggaggcatccactgatgtggagatggaggaggatggtgatgtggatatgaaaagcaagagcttggtggagctggagctgggggatagggatggggatgccagtaacgacgtgaggagcaagagcttggaggagtcggaattgggaaatgctagtgcaaggagtgatggtttggacgagttggaatngggggtttctgttactaggaacaaggtcatggaggagttgggtttaggggatatggatgacaggaacaacagtatagaggaactagaggtggttgaggaagatgcaaggagcaagaggttggatgaatatgagtctgtggatgtggatccggatgccatggataacaatatagatgaaataaacacagtcaatgaagactcaaggaggaaaagcttgaatgaatctgagactgtggatgtggatccggatgccatggacaacaatatagatgaaatgcaggcggtcaatgaagactcaaggagcaagagcttgaatgaatctgaggatgtggatgtggatccgcatgccatggacaacaatatagatgaaatggagatggtcaatgaagatgcaaggaccaagagcttggatgaatctgaggctgtggatgtggatccggatgccatggacaacaatatagatgaaatggaggcagtcagtgaagattcaaggagcaagaccttcaatgagtctgagtctgtggatgccatgaacaacaatatagtcgaattggatgcggtcaatgaagacacaaggagccagagattgaatgatgaatcagagttggtggaagaggatgttaagggtccaaacttagatgacaagaacactgcggatgagcatgtcaatggcacaaacattgatggaatatgtttgggatttgtggcagttgaagtggtgcctgctgtacatgaggcaaggcttgacaataatgaggaaacagcagaggtagcaccaatggggggcgatgatgtgccagtgcctacagatgtggatggtgaagaacccttggtggaggcagcagctgtaacacaggaggtagtggctgttgcagaggaattgggggatgatgaggctgaggaggatgaagagaaggatgcaatgggattgagcttggggtttgactctaccaatggttatgttgctatggatgtggaagaggaaactaatgttgagaatctggacgaggatgagagtgacagtgccaatgaagaggcagaggagtcagaggatgatgcatttgaggttaatgatggagaggacatgaattggagaattggggatggcaggggggatgagggaatgtcacattctttgcaacgctgtaacacatttggaggcatggagtttgtgaacctgaatgaaggggagactgtaatgaaggatgagttgaggtttgatgatttccctgcgagggcatcttcagaaaggatgacaccatcaaacctcctccaagccatgaactcaattccctcaacgtacaatgtagcagggaatgtgcatgatctgccttctggggatttcttggctatgggggctgatgcacataagaatggagtggatctgggaccagggagctcatatttatttgggaataatggtaagaggaatattgatgatattgatggttacgatgacaatatgcaggcgcaagaggactttcctcagtctaatcagcagaagaggatgcgccatagtaacagtggcaacatatcacctggatcaggctttttcaacgcaagcttttcggtacctatacagaacttgatggttgaggcaagcaggctctatgagcagaaggagcaaaaacttcagagtttgcaatttgagaaacaacattggtctgacatgctgcaagagaaggaagccattatccaatccctaaactcagctcggtttgagcaacagaacaagtatcaagtggagcttagacgcttcgagcatgatctgaatgttatggcccatttggtaactacctacaaaagagctttaaaacagacccgggcttcttttgatgagtacaggaagaagttcccttgcaatgttcctctttatgatgatgttgctggtggtggtggtcttgttcttagtgtgagggagttggagaagaggcggtgtgaggaggagcagcaaaaaattgccatggtaaatgatatgatcgaaagattccagtacaaatggttctcaaagcttgaagagtggggactgtctgtcaactcactgtggagcagaatggaaggactctataaggagattgagcttctgaaggaaaatagaagatcaagatttgctaccccagctacagaggaatctctagctacagaagaacctaccccagctacagaggaatgagttccctgacagtcagaggttcagatgtgaatatgactcccagtcactccgctagatgttttgatgtcaacgagcatacattccctctgctggatgactcccagttagtccctaccctctgctgccaccaagagtgtggctgcctattggtacatactgtagcaaggataaatagtttcgcaagtaaccctgcttgtatcctcatgtgggatattttgattattagtgatcaaggccctgtttgtttccttccaggattattagtgattaaggccctgtttgataaatagttctctagattatataatccacctaataatctatgatgtttgtttgcctcccaacttatttaagctggattatataatctcgagggtaaacaaacatggcttaattcaggtgcatttagggtttcttaatctacgtggaaagtgtgtgctttcatatccaaaaaaaaaaaaaaaaaaaaaactcaagggggggg

SEQ ID NO: 14470 - DNA, 2474 bp, Zea mays
gaatcggaagagtagcaaatatcgcatgccccacctcccgcccggccgggacctctcgttcccgtctccttcctctattcgtgttgtccgttcgctgccgccgtcgcctggttcgcatcgcatacagcgcctcagtccagatcgatcctccctcttcccagatcgggtctagttggacggcagcagccgccgccgcggcatctgtcatattcacgccgcgtgtgctctctctttctgtctccctctctatctgcgacgactgggtgtgataccgcagccgccgccctacgctgggttcccgagccttcgccgatctcttctccggcgaagagcgcccaccagatccgccgcgcatcgatgtctcctttggctcttctccaagctctcatcttcatcctgtgctgctcgcctctggcttctgcttcctcgtcggagctaacccttgcaggagctgcttgtggagatgatcagcttgtcatcttcgatgcttctgatggcctccttaacctgtcggtcaatggggttctgatgcaagatcgcgtttttgcctgccagaagctcggcttctactttggcagtggatgcctccgctgcagcaacctttcagatgcgtggaggagtgccgtaaagcagtactgtggtgaagggagcgaaaagagccatgcaactttacatcaagatgtgccaaggaagctcttgaggtggtccacagaaaatagctcaaggaatgcatgtgaaaggtctgggttgaatgaaaataatcaggacattggtgattcttcagaaaagcaggagcatctcctggctgtgccaggtgtgattctcttatgctgtggccttatgttaccatgctttcatgctgaaaggaaagaagtcagcaggcatgacaatgcaaccattcagcgcaacgcacttgaatcagtttcatcctatgaaggaagcatgtcatctgagaaagtcccaccaactccacatcgaatacctccaagtccctctagatttgcgccgtctccacagatagctagagttggatctgtcaacttaagcatccagcagatcctcagggcaactcagaacttctcaccttcatttaagttaggtgaaggaggatttgggatggtctacagggctgtattgccagatggcaatgttgttgcggtcaagagagctaaaaaggatcagtttgcaggtcctagggatgagttcagcaatgaagtagacttgcttgctaagatagaccaccgaaatttggtgaggttactgggttttactgataaaggaaatgagcgcattatcatcactgagtatgttccaaatggtactcttagagaacatctagatggtcaacatggaagagtcctagattttaatcagcgtctagaaattgcaattgacgtggctcatgcacttacttatcttcatctgtatgcagagaagactataattcatcgtgatgtgaagtcatcaaacatcctgctgacagatagctatcgggccaaggtgtctgactttgggtttgcaagaagtggccctagtgacacggagaagacacacatatcaacgaaagtgaaaggcacagctgggtacctggaccccgaatacttgaggacataccagctaactccaaagagtgatgtcttctcatttggcatattgcttgtagaaattctttctgctcgcagacccgtagagctgaagcgaacccctgaagagaggatcacaatcagatggactttcaaaaaattcaacgaaggcaacacgagagagatactggacccattgctggaagatcacgtggacgacgaggtgcttgaaaagctccttagcctggctttccaatgcgctgctccgacacgggacgaccggccgaccatgaaggaagttggggagcagctgtgggagataaggaaagagtacggaaagagtgttaggaaggtgtgaagatcatggaaaacatttccctgtttctcaagactttccctggaccaaggggactaagggggtgtttggttttatagggattaaattttagttcttccattttattctatttaagtccctaaattaccaaacacggaaatcaaaactttattttagttttagtatttggtaattcagagacttgaatggaataaaatggatagactaaaaataagttcctagaaatcaaacaccctctaagcatgcgaagtatttgtgcccattggataaacacctgatcatctatgtttcttggaagatgtgacctgaagaaatgtacagtgcgataacaccgccatcagtttgtgctttcttgtctcagtttgcagtgcactccctctatggagaatgtatattttggagttctcgcatttcttgattctgttgatatggtattctgatggatgtacccgcatacattactgcaaacggtctgaaataatatacgaagggaaattgtttgtattggaaaaaaaaaaaaaaaccgcggccgc

SEQ ID NO: 14471 - DNA, 1916 bp, Zea mays
agcggagcggaggaggagagactgatccagacgcgagaccattacctagaacatcctaatcgaaaaaaatcttgctggatacatacaggaaacagcgcgagggaacgagaagttagtttccatggagaagaagcagaagaagcacgcacacgcgaggtcaaggagcttcaccggcggcgggctggcctccttcctcaggtccaccgtctcctccttctcctccgccttcccgcccagcggcaggaggtcctccttcaaccaccgcaacgccttctcgggccccatcgtcgtctccatcgtcccgccggaggctcgcggcggcggcggcaggaggaagcgcccggggtacgtgacgcccgagccgtcgtcgcccaaggtgtcctgcatcggccagatcaagcgcagcaactccaggcgccagaagaaggtcaacccgtcgtgcggcaagggcggcggcgcctgcccgctcccgccgaggccgccagcggaggacaagaagccctgcagcaggaccagcagcagcaggggctccctcgtgaagcggatgcccttcttccgccgcagcaggtcgcgtcctcgctcaagggcggcgtcgtccaaagatgggctcatcgtcgtcggtgacgggaaagagagcgacggcgacagcgcggtggcggatccagcgccgccgccgccgccgatgggcctcggccagatgaagcggttcaccagcgggcgcgccgcgtttcaggacttcgactggcgggaggaggagaggacgacgggccgtgacagcgatgaggacgacgacgggttcgtagcgcattcggcgccgctggtgctcgggggcggggtggtagcctcggagccgaggaaggaggtgaacctgtggaggcgtcgccccatagttcctcccactcagctacagcttccctaggatagcgagctgcatctgcatgcgcgcgcgttcgttcgtctctgtgtgcctgccgatgcctggtgttttctttagtttgtatatacagctcacgcgtgtataatgtgatgatcatacgggtttagttgtttttgtaagtgtgtggtgctcatctttggaaatgaagaccattctgcctagctagagcttggcgttttacacatatatatcttcttcattttggtctgatctttcagattaatatgagcattcatgccgataagttcaccaaccaggaacttgtggagaggagctcaacaaattatggacatgtttgacatgcgtgttgattcaattcaacggaaattcaaatgaagcgtttcaattttattttatatacatgaatgctggtcagcatcctgcactgcgctcacggtttattcgaagattaattatgacccatatatacaatgatatactaagttgcacggattaaccagttcaaccttaatgccgtgaatagaaaagagtaacaatttattttatttaattgccctccagcccttggattcgttgtcataagttgcatacaccaacaaccagtttaaatccaaattaaagatttagcttatagaaagagatggaaatttcacttagattccgacacaacttagtccttgttcgtttgtgtcggattgcatccaaagtcgttccagctaatcaaagtttatacaaattagagaagcaatacggttagaaatagttccgaactaccaatccgtcacaaacgaacaaggccttagcaaattccgagtccgtttgtttctaccattatctgtttgcctttcctccacgagaatgggtggtctccactctccagctcgaggagatttgtatgtacctgctcggtgttaacgccgccgaaacagtcaagatggatgcgttcaacaatggcatgtgcccaccatatgctccaggccccactctgttctgggaagttttctccgcacatttaatt

SEQ ID NO: 14472 - DNA, 783 bp, Zea mays
  misc_feature (15)..(15): n is a, c, g, or t
  misc_feature (21)..(22): n is a, c, g, or t
  misc_feature (650)..(650): n is a, c, g, or t
  misc_feature (696)..(696): n is a, c, g, or t
  misc_feature (706)..(706): n is a, c, g, or t
  misc_feature (717)..(717): n is a, c, g, or t
ttggggtacccttcnaggccnnggccgggccgggggaccctcgaggccgggaagcaagcaaccagcggagcggaggaggagagactgatccagacgcaaagggcatcgacagagaccgagcccaataataaatcttgctggatacatacaggaaacagcgcgagggaacgagaagttagtttccatggagaagaagcagaagaagcacgcacacgcgaggtcaaggagcttcaccggcggcgggctggcctccttcctcaggtccaccgtctcctccttctcctccgccttcccgcccagcggcaggaggtcctccttcaaccaccgcaacgccttctcgggccccatcgtcgtctccatcgtcccgccggaggctcgcggcggcggcggcaggaggaagcgcccggggtacgtgacgcccgagccgtcgtcgcccaaggtgtcctgcatcggccagatcaagcgcagcaactccaggcgccagaagaaggtcaacccgtcgtgcggcaagggccggcggcgcctgcccgctcccgccgaggccgccagcggaggacaagaagccctgcagcaggaccagcagcagcaggggctccctcgctgaagcggatgcccttcttccgccgcagcaggtcgcgtcctcgctcagngggcggcgtcgtccaaagatgggctcatcgtcgtcggtgacggganaagagagcgnacgcgacagcngcggtggcggatccagcgccgccgccgccgccgatgggcctcggccaagatgaagcggttcaccag

SEQ ID NO: 14473 - DNA, 1958 bp, Zea mays
cagtattacttaccgttttttatcctgttcttgtggcttaatatattcttgctttgaaacataatttgttcaatatggagaaaggaaaatgttatttgtaccagttcaccccaattctgaacagttctgtttctgtgttctgcagcccatatctttcttacattatcatagtgagatttgggatatgttatgttcaaacgcagaatcaggagaactaaaacaatatggacactttctattggctaatgttcatcgcattttttattcttatacagctcttatccatcgaaatctctatatcttagtttctgtaggctgctgtctagatgaaaagttaatgaaatacattattgaacatacaacatatagttactggctctgagtttgcttgcattataatatattactatactatcgacgagttgtttgtcattttttaatgtgacaagccttggtatgaatcattttcttctgcttgtttttaacgcacacaatcatgttgtttcttttttgtttcttttttccagagagcttgcataagttccctaggagggggaattcaggggttagttctgttcaagtccagcaggagtctgaggggcagaaacctgtcccacagaattctaaccagagtggccaaaattctgctcctgcaactggaatggaagcctctgcctccggcaatggtgatgctacgtcaaacaattcactcaattgtgcaccatgtacttccgcaccatcttcttcatctgttgttggtctcctccaaggctcagtaagttacagacaagaccatccaacaagcagtggcaatggtatctataatggcggaaacagtggtccagctgccaaggccaactcaacgaactccatgcaatcaaatggaccggcatcgtttcccttgccagcaccctcagcatcaaatggcaatatgatgcctgctccccagcactctagccaaatgaattcgccgaccatgccatcaagcctacctcctatgcaaacgcctgcaagtcggcctcaagaacccgagccaaacgagcctcaaagctcagtccagaggatactgcaagacctgatgatgcagtcccatattaacagcgttgggccagtgggaagcaatatgaagacagcaaacacggttactcctggtcttaacggtgccaactccttagctggcaatcccatgacaaatagccctggaatcatcaacggaatgggattcggggctatgggtggccttggtcagcagatgagaacagcaatggggaacaacgcgttggcgatgaacggaaggaccggcaccatgaatcacagcgcgcatgacctggcacagctgagccaccagcagcagcaacagcgagatttaggaaaccaattgctcgggggccttagggctgcgaacagtttcaatagcctccagtacgactggaagtcgtctcagtagagtgaacaggagccagccagagagcttgcacctgatatttatactcgttgggtccatcactgacaacataaacgttacatccctcagaagcggcgggttcttatgttacagcaaaaaggaaacattagcaatgttacgacaagtgtctgtatggctgtgttcctttgtaatccgcaaataggaggaccgtacccaacccattgggggctgggggcaagtgtcggcggattccaaactggggggaagatcggagcgtctttcccctgtttttttttcgggttggatgacgatgatttctctcttgcagtctgtgtaccatggctcaccgtactcttgtgtaccttttgatggccaagaatctcactgtagctgtgctatactatgtataagctgttatttactagtggaaagcatgaggaaaagtttctgaatcttggatgacgacccatctgtgtaactgtttttttttccttttcttttctgatgaatgttcactagtattaattaatat

SEQ ID NO: 14474 - DNA, 839 bp, Zea mays
cttttccgtcgtgtcgtggtggccggtcggcaggcacctccgctcctgtcctcttctctcgtggtaggctgtaggcaggcacctccgctcctgtcctcttctctcgtcgcttcctccgtctctcggcgtcgaatctcctccaaccaccgcgcacactctactcgacgcccggtggaaggagttctccgggatttgagctgtttctgccctcacctccgctaggccggcgtcgagtggagatccaatcggaaatcgaactgacttcatcttctgttgcatccccgtcaggataagccatgccaggagtgatcacaaagttcgcggttacatccatggtgatgtggatggccccggttgcgatcgtttatgggttctactaccaggcgtttccaggtgtgagtcggatgtcatcctcggcgcagacactcgccagcgggttcctggctgtcatatcagttaatctggtgatcggcttgtacatattcatggcgatgaaggagactcgacaccaggagccacagccagacccgaccttcctggcaaacgccaaagcgagtatcaaccagccaacatcctctcaaccgagtgatgattccaaggggaagggaaaggttgagtaagccgtagcatgtcatgttgatttttggtcttgtgtatgttaagtgcgtgctgtttaggaggaatagttgtgcgtgcacgccataacacaacatcgcaatctttaaagttcatgattttgctgtaattcttgacagttatggtcatggagcaatgtgaagttgaaacttttgtccgcaaaaaaaaaaaaaaaaaccgaaactcgagggggggcccggaac

SEQ ID NO: 14475 - DNA, 5311 bp, Zea mays
cgcctcacatccaggcaatgacacaagctgacacgctcaaagtccaaaatagccccatcgctctggacgatgtcatatgatcccttaaggctttgtttgggagcaagtgtaataggggattgaggggattaaaattccttactattcaattttaaataaagtgccctctcaatactctccaatacccttgatctcaaacgagccctaaattatttttaattccttttaccctaccatttatttgagttggtttaatctatcacttaacaaaacctatcttatttacaaactaagttttcatttttatattttgttgatttgtagctagataatgtcataacttagtctaaaaaatatattataatttttcataattattttgatagattagggatcagattagataataactttaataataaaaaattaaatataaaataacgatgaaaattcttaacatattttttaaacataagttatgatgtctttaaacaccttacaaaatatgaacattaaattcaacttgtaaaactaaaatgaaaaagataagtctttttttaataagatttgtttttttggtttcttcacatataagttgaacttaaagttatatcttatctaattcctaatatattaaaataatataaaatcataatatatttcctaggttaagttgtggcatcaactactaaccagaaaacttaaactaaaaaccaattcaaatagatagagggataaaatgaactaaacaacacttatactttagaagggcatatggacatcatacatatgcaaggggagtaatttaattttttttctttataaaactaatccctgctacattttttatcccaacatggattgcataattaaaaaaacaaatcgcacacatcctagtcctacctcacgcgaggatgagcggacaccctgtcctccactggtttcgtctcacgttttgtttacttccgctgagtagtgagctatgcttcagcttgcagtgttcaagcatctaggtctctcgggtgagccccgtggcgtcccacgggatcttggaatggacaaggaccggacctccggagccgaacttggaaacatcacgttgagcctgtgcatcaagacgtcggccttggatggtatctcgttcaggaggaactgctggacaatcggcttcttaaaccactccagtaccgagtcgccgggtgcccgcaagacgactttgctcacctcaaacggcgactccagcgacgccagcacctgtgccaccaccatcttcagtgtcggcccagtcaccagcttgatgcgccgtggcacaaccccgtagtagagcatccgcttcctgaaccgatgcagtgtgtgcacggtagccacgagagctgcgcccacggataagctcctgacatccagggaccaggcgatgtgctggtcaaaaacgattgccttggcgaacagcttattctcgtaggcgaccttccaaacacagcgggcacggttcatctgccccatgagcaccaggtagttgagcaggacgttcacaaagtacctggctgcactctcctcgttgtcgtagtcgatgccctggaagaactcgcgcacgaaagagagcacgggctgcttccgctgctccggaccagtgaacagcccgcacatgaagtcatgtgctttgtgcttgctggtgcccaggatgtccatgattgtacgctcgctgctctcgtcctggcaccggaccaagtgcgcgaggatggatgtgtagagaatcaagtccaccttggctgccccagcgacataagcctcaagcaacgaccgcgctgagtcatacagccccgtcttcatgcaagactcaaacagctgcctaatgatgaagttgttggtccttatgccagccgaacccatgaaccgtagccaccggagtgcaaggtcagttgacccatccttgatgtagatcatcagcaggtcacttgcggtcacctctatcgggaaacctgacgccttcatctccaacagcacctttgcagccaaatccagcagactcttattcgccagcattgtgagcaacgctgtaaacgtgctaagccctggccttgtccctgaattcgccatggagtgatacaaccgcattgctgcatccacctgccctgcggaggcatgcatttccaccagacaggcatatgtggccggcgtagggaaaaagccagacttctccatgtcaccgaacaacttggcggccatgtccaaccttccagaccgtgcattggcctcgaccaccatcgtgtacaagccaaagcttggtcggagccctcccctcctcatctcctcccaaagctccatcccagcatccagcttcccagatctcaccagtgcctccaccatggcggtgctcactgctgtgcttacccgatgcccgaccaccaccatctctctgtacattcccatggccgcatcaagcctccctgccttggccagcacgtccaccatcaccgaatacacgcccaccggcgcccgcccaattccctccctttgcttcatttcatcgaacatcttgcgggcggcgtcgatcctcccggcgcgcgccagcgcaggcaccgcgagctggtatgtgccctcgtcgagggcgcagcccgaggtcgccatttcgtcgagcacttcgaaggccttgaatgcaagccccctggtgagcaacagagagaggagggcgttgtaggcgggcgtctcgaggcccctgaagctgacgtcgcggaggcgcttgaagcagtagaaggccggctcgagaaggccgtgggtggcgagcgcggagacgacggcgttgaaggtcttggggaaggtggcgaggtcggagagcccgagggtgtcgtcgaagagcgcgaggagttcggaggagtgagttgccggcgggagacgcgcggcgaggagcgaggagaggtcgtcggaggggacgaaccacggctggaggcgcgcccatgcgacaagggagatgagcgggacggggtcggaagccgggagcgaggcggccgcgaggaggagcagcgcggggtctggcggggagggcagtgcggagagcgcggcggagagagtcgcgcccgatcggtgccggagcgcgagcgccgcgaggcgggccgccgctgcggggcgcgggagcgggtgcgcggaggcgccggataggatggtggggtcggcgcccggcacggccggccgcgccccgcgcgccgaggagagcagcgcgcccgactcgtccaggtagtccaccgtgtccgtccactcggggtcgggccgggacgggggcactggtggcggcgactcgaaggagagatgccgcgctatggctaaggagagggagacgccgccaccgccgccgcgaaggcgggcgctgcgcgcgaggccaacgcggagcagcatctcttctccctgtctcactcggtggtttggtcgccgctgccatcaggtggaggtggacattcggcaacggcaagcgcgattcaacggtccagattgcaaaggatcctcccatcccatgaatgacagaatgagcgaggtagcccaaacagaaattttggcccattcgagacggcctactgttgtggtccagtgatccagtctgcgtctctttccccgtcgtggtgggttccgatccaatcgacgtcgacgactccgcagccaccgctcctctcctctcgtcgcttcttctatctctcggcgtcgaatctcatccggccagtgaccacactctactagccgcccggaaggagttcttccgggattcgagccgttgctgccctcacctctgcaggcccagcgtcgagcggagatccaatcggaaattgaactgacttcatcttttgtcggtaagaaatccaactgtttcgtgtcaccccttcttcgctgtgaatgatctagtctaaatatttctgcaacactgctccggcgccctctgctaggtactgcagaacatcgcagctcgcagtaagatccgtatctatttgttcctagttccgtgtcttatacttttatgaatgacattgccattatgccagtgtgtagtaacaattgaatgccaatcacagacatatataaaattttggctcttccttttctatttctctatctacaatgttatgcgattaattgagcacttcgaaattgatattgttaattatggtcttcgttatatctattgtgtctactacactactgctagtgtatgtctagcaagatttctagccctgttttatttagcccccttgcctggtttttggatcctggctgagtctgtacgttggtttcagcatcccagtcaggagaagcaatgtcaggagtgatcacaaagttcgcggttacatccatggtgatgtggatggcccctgttgcgatcatgtatgggttttactaccaggtgtttccaggttcagctgctgtttctgctctcattactgcatggtgtactccatctactatcttcacatggagtacataaattttatttagtagctcttttatgtatcggttctactaccaggtgtttccaggtgtgagtcagatgtcatcctcggcgcagacacttgccagtgggttcctggctgtcatatcagttaatctagtgatcggcttttacatattcatggcgatgaaggagactccacaccaagagccacagccagatcccaccttcctggagaaagccaaagcgagtatcaaccagccaacatcctctcgagtgagtgatgattccaaggggaagggaaaggtcgagtaagctgtagcatgttggcttaggtctcgtgtatgttaagtgcatgttatttaggaggaatagttatgccacaccatcacaaggaccgcaacctttcacaatttatgattttgctgtaaatcttgacagttatggctatggagcaatatgaagttgaaccttttgtacctatttgatttggaaactctgttcaatgttgttttagtcaggatactcatcagaactactgctggttgcattttggtcctttttggtgttttggtactccctcctttcttttttatttgtcacggtttagttcaaaaatgaactaattggcgacaaatatttgagaatggagctagtatgattctttttaaagatgtgccttgaacacacatatgctgatatgtggtgccattctggcttttcggatttgaaatccatcaacatagttacatggtgatatttctaatatttgtttcagtgtgcattagatattttctgtgcacactggtgacctttattagctctggtccaagtcgttgttgactattattaatgctattgttccataaggagaaaaattgg

SEQ ID NO: 14476 - DNA, 945 bp, Zea mays
gcaccggatcctcccatcccatgaatgacagaatgagcgaggtagccccggcagaaattttggcccattcgagacggcctactgttgtggtccagtgatccagtctgcgtctctttccccgtcgtggtgggttccgatccaatcgacgtcgacgactccgcagccaccgctcctctcctctcgtcgcttcttctatctctcggcgtcgaatctcatccggccagtgaccacactctactagccgcccggaaggagttcttccgggattcgagccgttgctgccctcacctctgcaggcccagcgtcgagcggagatccaatcggaaattgaactgacttcatcttttgtcgcatcccagtcaggagaagcaatgtcaggagtgatcacaaagttcgcggttacatccatggtgatgtggatggcccctgttgcgatcatgtatgggttttactaccaggtgtttccaggtgtgagtcagatgtcatcctcggcgcagacacttgccagtgggttcctggctgtcatatcagttaatctagtgatcggcttttacatattcatggcgatgaaggagactccacaccaagagccacagccagatcccaccttcctggagaaagccaaagcgagtatcaaccagccaacatcctctcgagtgagtgatgattccaaggggaagggaaaggtcgagtaagctgtagcatgttggcttaggtctcgtgtatgttaagtgcatgttatttaggaggaatagttatgccacaccatcacaaggaccgcaacctttcacaatttatgattttgctgtaaatcttgacagttatggctatggagcaatatgaagttgaaccttttgtacctatttgatttggaaactctgttcaatgttgttttagtcaggatactcatcagaactaagcgcaaaaacaaaaaaaaaaaaaaaa

SEQ ID NO: 14477 - DNA, 3243 bp, Zea mays
ctattattagtaatatgtgagagatatttatatgttaactttttactataaaggagtgagctgaaaagtgtattataatttgcaaagtagaaatatattttttgatacataaaattatttcatatacttcatctcgtgaatttaagatagtcttatatcctagctttgaaaagtggtagaacattaaattcaaagccaaatagactactttaaagtaagtaattttgaatttatctgaacatcccgtaatagattttggtatctgatcttccggtggcggaaaatttctagtgtttcgaaatgaacgaaagatagaagtaacgtccagcaagcaccagcgcggggttctgctggtgtacggtgtaccatcactttacattggagtattttgtacacttcgtcgcacgtccttgctgctattgcgagaccttttttcgttggaaaaagaaaagcaacgcacaaaccacgatcaacgaaatactactttgatagtcgcatccgccgaacatttgggagcaatggcaacagcagtgcagcgcggtccacgggccacggcgggtgggtttggcttcgggcctctcggcgacggacctcaaaacccaacggaagccgacgcggacgaagtggagaagtcgcggtttctgccaacacacgccgagtggacggggccctttattcccagtcgccggcccccagcccgagaccgtgcgacccgttaaaaataataacgcgtccgctcccctctcgagtcccttgccccacccaagtacccaactcgagcggtggagccttgcgtgtgtctaaaaatagcgcccgaatcgcggcggcagccacatcgagtaatttatcgagtcaggtgagagggcggagcagatctcgccggccggggccatgggtgctgccggcgcgatccggcgggcggcggcgtcggtggtcgacagggcgtgcgcggggacgcggggcttccgccgcgcgctggcgcggttcgcgccgcggccgtcggcgttcggccccgccgcagacgcggaggccgcggcggtgcgcgccgtgcggaacctccggaccttccggttccactacgccgtcctgcagtgggtgctgctgctggcgtccctggcgccgcggcaccgggcctccgtcgtcttcctcatggcggcgtccaagggcctcctcgtctacggcggcctcctcaaggcgttccccaactcggcgctgctccggaggctcctcgaccgccgcctcgtggccgccgtgttcgtcgcgctcgtgctcgccgacatcgtcgccgcgggcgccgtcgccaacctcctggccgcgctcgccgcgggcgtccccgtcatcgtcctccacgcgtccttccgcgtccgcgacgatctcgaggcgccctcgccggacgcggcggcggcggccgagaacggcaaggaggacgaggcgtcggcggtcgtcgagaagaaggaggacggcgacgtcgaggcggggcccacgcggcggtccatggcggcggcaccaagatcacccaaatgaggaatttactagtaatacgagctagtgaaaaccatacgtttttcgtaggtttttaatttaactactggccccgttgtcatggaacataggaacaattcgtggccaaacctgtcttcctgcctgcttgttgattcatactttgagcctaggatttttttttttggagaagttcaatcagtagaatgtagtggtagctgtgacagacattgaacgtggaattgaggattaatacttataggggactcagttgtgaagtcctctattcatacaccttgagtgtataatctaatctaacacacataaagcatgctccactgatcgattcggttaactgctacttgtttgaggcgcatccatttgatcatagtggcatatttgcttgatcatggtggcatagatcatagcatggatgaattctgtattcacaggctctaataccaggcatgaatgaatgctgtattcatccatgtaaatatttgcttgatttccctcaaaacctctaatatcaggcatggatgaattctgtattctcaggctcgcagcggtgttgatttcccagatcctgaaggtccgtggtggagaagagaggaggatgaggaagaactgcaccttcccccctcctgcgcgcgcgcccaactaaaaaacaagccaaccgacttggaaatgctcttcgcaccgacagctgccccaccacaagtccacaagcaaccacaaaagacaggtaatgcctcgaaggagcaagcaactcgccttccccagttgttgacactccggagatgttgatgtatggcctgtccctccatgtaggtgtagccttccaactggcaagtgaacctgcaggccgccaagaagacaactctagtcaacaattacgtgaaaatgtgaaaccttctgcactagaacctacatatatggaggagtcacaagccaagcgtgatgacgatgagccatcagacatcacgtattcacgtgctgtagatgagcaagcagatcgtatgcacaacctgaaagtgtcttttccttttgctcttcacggggcatgtatattgttgtttaatgtagaggctgttaaaatatttaaataagctatttgcaaaaaaatagtgaaggtatttgtaaaaaaatcgtggcactgaagagacgtctctggctcgtaacccaagaaacaacagacgactcacttcccaatgtacgaattcgtcgtctattctatctattcgatactgtacaaatacatttatgtgtgtatttattaataaactacaattatatacaacccattgtataataaagtcttttatttgacttttgtgtttggagaaccgttttgatgtttctctactacatatgcccttagagcatcttcaatagttatgtaaatttagcaccctaaattatatatttaagaagttgctaaatcactttaaagagtacaaaaatgtgtgtgttccaacatttctctatttattggttgttaattcttaaaattgtcaatgacaacaaaaaagtgagcatgatttctatttttaattgagatagcacatcaacaaccttctataatgtcttggaaagtcgaatttgtcgatggaaaaccaaatagtcgcgccgacgacatagagacaacacatggcactgaagatagatttgtgtcaatgaaacggtgggcgaaatatggttttcgtgatggatttagaacccacattgattatggagtcccac

SEQ ID NO: 14478 - DNA, 1280 bp, Zea mays
gcacgagaccattacctagaacatcctaatcgaaaagcaacatcatgttagcacaaaatcatcctctggtgacctggccgaatcaggtctgcaaagtacatcagatcaggaggcacttcctataaatttggtgaccgggtttcctcgcaagtagccacgcacaaagagggacttgctcgagggtttagctagcttggaagccctccgcaaactcccatggcgtgcctcctcgtgctcgtcatcgctgccacagtactaacgggtccaccgggaaaactgacgcacgccgctcggacgtcgccggcggaggccttctggcatgcggccctccccggcgctcccatgcccgaggccatccgcgagctcttgcgcccagctggtgctgccgggaccaacgctccagacgccgctagtccaggcaccacgacgccgatccgccgccgatgaacttcaagtacgaagactacaggtcctcgcgtcggaacgaagccaccgccacctccgccgaggccctggaccgcgctggcggcgccgggaacgcggccgcgtcgccggcggtgttcttcctcgaggaggcagtgcgcgtcgggggtgtcctgcccttccgtggtatggtcccgcggggcaccgccagcgtggcagtggcctcgcctccgatgcggctgtacaaggtccgcgccgtgcgggccatcgacgggcgcaggttcatggtgtgccgccgcgaccgcgaggacggccccgacggcgacgccgtgtacgggtgccgcgcgacgggccccgcgagggcgtacgctgtgggcgtggtcggcgagcgcggggagacggtggccgcgaccgtcgtgtgccgcaccgacacgtcccggtggaaccgggtgcgcgccgcgttcaggctgctcgacgtgaagcccggaggcgcggcggtctgccacgcggcgctcggcgcgcaggtaatcccagtcaagaacgacagtggctcctccttggtgtgaaggaaggctccgacgtgttccgtttgtcgtcgtcgtcctggacgttgtgatgcaacgtttctagtagtagctatgtatgctgtatgcatgtggtgaagcaagtgctcgtcggtgtgtagtgttcgctcttctgatccattgtctgtgctctgtactgtagtgatcagcgtcaaaataaagaaatgcctgtccttgtttagaattaaatgatcactctgtcttttggtactcaagaataaacaatcacaatgaaaaaaaaaaaaaaaaaaaactcgagggggggcccggtac

SEQ ID NO: 14479 - DNA, 1057 bp, Zea mays
gccctcttcgtcccccccccccctctctctctctctctctctagtgcagtggaggcgtggagagcgaatcaactgttctacaacaccaaaccacccttgcttcgtctccctccgctacactatctggatccaaccacgagccagctcgctataaaggcaccctctccctttctgtctccctcacaactcagttattctacagctttaattttgcagagcgaccaccagtccaggtccagcgcgggacgcatcacatacacgcggtaccttcgttcgttctcaagcttatagcgcccgatcgaccctgcgcggagctagttcgttcgttccggcaggcggcggcagcgaagtagtgcgacgacgacgacgaggtacgtagagagcgagaggatagatgtcgagccgaaggtcgtcgtcgtcatcgtcgcacggcaacatctccgaggacgagatgaacgagctcgtctccaagctccaggccctgctccccagctcccgccgccgccgcggctccggccaggtgcgtcgtcggtcgcgaacagatggctgacccgctcaacatctccggggcgctgtgcagtgcatatgcatgcatgctcgcctttttttccagttttaaacgtctaaaatcgacagcaccgggcggggacatgacatgcataatgcaggcgtcgacggcgaagctgctgaaggagacctgcagctacatcaagagcctccagcgggaggtggacgacctcagcgaccggctgtcggacctcttgtccaccatggaccacaacagccccgcggcggagatcatccgaagcatcctccgctcctgagcgcgcgcaagggcgaggtcaacgaacgccggcctccgatcgatcgccgacagcgcgcgctctccggccggctggtcacgtgcgggagctgagctcaattaggtagctagggtatatatacatataatatatatatctacatgtacgtgtatctaccttttcctttaccagtctccctagatctgagatcatgtggctagctccgtataaaaatgtactagccacacgctgac

SEQ ID NO: 14480 - DNA, 685 bp, Zea mays
ggagcagacgcactggcaccaaggtctactaccactacctccgtcttcaaggtaatctgattgttcttgccgacatcaccacccaattatcttccaaccaatcaacctcgtctgagttgttccttcattatgagaacaaatatcccatggcttatcatatgctgagacgctggagccactggacgcctcgacgtgatgtggctgagacgctgagggcgatatggctggaccgctggagcgcgctgcctggaactcgacgcctggacggcgcgtggcgtggctggacgctggagcgcgcggcctagggagctggacgcctggacagcgcacggcctggagcgcgaggcgtggcgcggcctggagctcgacgcctagacggcgcgcggcgtggcgcgacctggagctcgacacctggatgacgtgcggcctggagcgcgcggcttgggagctagagcgcgcggcttgggagctagagcgcgcgtgcctggacggtgaggagctcgcgcctgtgacggagatctgctcgacggccacgcaggactgatggagccgcgtagaggcgaggcacaacgccggcagcgtgcggaggcgccgcccggccgccgctagatgggagggagtgaggagaggatgtgaggatttagggtttgttgtcccgtgggattcggcctcgagggtcccaatg

SEQ ID NO: 14481 - DNA, 2441 bp, Zea mays
  misc_feature (247)..(247): n is a, c, g, or t
gacctctatgcattaaatatgtatataaaatttatttgatttaattaagtaaaatatagatatggtcatatcaaatctaagagtttgtatcacatgatccttgatattgagtctgtagactatgttagctcattgtgtttggtttaggtgtttcatccatattcactatcaaaaatctaaaatccaaacctaacatgtacaatagcataacattctggatcttctgaaaaatctataaattttttangcctagtttgggaaccacaaaaccggagaggattggaggggctaaaattccctccttatttaaaattgaataagaatgggattttagtccctccaattcccttctctttttggactcttaaactagcccttagtttaattcagaatcatcttataccccatattttctagactcttagacatctactccctccgtttcgttttagttgtcgctggatagtgtaaaattgaactatccagcaacaactaaaaagaaacggaggaagtatattacaaagggaatcaatatatagttgttctaaccaaatatattttagcttcttcacaacaataagctcgaaacaattttctcacgattcaccgctagaatcagatttacagaagaaaaaaaatagctaaaccaaacagacaaacaatcaaacaaaatctcagttcatttatctgctcgatcgtgttacctcaccaaacactacttcatattttctaaagtatagttccacgtcgtctgcctccacttgatcatgataaacaatgttaagatatcagcacacattacacacgtgcccagcacagcgaatcactcaaagaagatatcaagggaagaccacgccggatcggagctatatataaaaggcacccgcgcggaactgacatgcatatccttccagtgcagccttgtgttttcatcctccttgaagcgaaaacgatcgagcttactgtatcgcaggcatttcggtacactacgttctccggctgtgtagagcttctgcgcagatgggtgccgagttgggagaagcgggtgtccctgcccgggacatggtggacgcgctggaaggcgtgcgctccatcctgctgaaaccgtcggagcgcctcgacgacaagcgcttcacgaggatcgccggcgccgacttcgacgacgccggcctcggcctcgccgggttgctcggctcgctcgcgtccacggggttccaggcctccaacctcggcgacgccatcgacgtcgtcaaccagatgttggactggaggttgtcccacgagaagccaagcgacgactgcgctgaagctgaactcgatcctgcgtacagagaatccgtcaagtgcaagatattcctggggttcacttcgaaccttgtgtcttccggtgttcgggagatcatccggtttcttgttcagcatcgcatggtggacgttattgttacgactgctgggggtatagaggaggacctcatcaaatgccttgcgccaacctacagaggcgacttcactctgcccggagcgctgctgcggtccagaggacttaaccggataggaaacctgctggtgcccaatgacaactactgcaagttcgagcactggatcatgccgatcctcgacaagatgctgctggaacagtccacccaaaatgtttggacgccgtccaaggtgattgctcgccttggcaaggaaataaatgacgaaagctcctacctttattgggcgtacaagaacaacatccctgtgttctgcccagcattgactgacggatcaattggggacatgctgttctgtcactcggttcacagtccaggtcttgttgtcgacattgtacaagatgtacggctgatgaacgcggaaaccatccacgcaagcccaaggaagacagggattatactccttggcggaggccttccgaagcatcatatatgcaacgccaatatgctgcgcgacggagctgactatgcggtgtatgtcaacacagctcaggagttcgatggcagtgattccggggcgcggcctgacgaagcggtttcatggggaaagatcaagagctcagcgagaactgtgaaggtgcattgtgatgcgacgattgcctttccacttcttgtggctgcaacatttgcacgcaaggttcacggcactaaatcaacaaactgaatcggaggcagtgaaattaaaatatggcgctctataactagctgaaactttcctcatatgatggttgagcttgaagcatgaacttttatttgcttgaagggtgtctatctcttagctcgtttactatttatacattactgtaacatatgtatgatatatattcatttgaaaccatttgggttattatcatacaataaaacttgtgtgtacgagaacatttgtgaccctctcttcaaattctcaaaattgttgctctaaaaaaaaaaaaaaaaaaaggtgac

SEQ ID NO: 14482 - DNA, 3083 bp, Zea mays
  misc_feature (19)..(20): n is a, c, g, or t
  misc_feature (128)..(128): n is a, c, g, or t
  misc_feature (976)..(976): n is a, c, g, or t
gctgatggaacttctgtgnnctatagttttaatgtcgttgagggtggagaatgtgggtcggttgtctatcgaccccatggtgtcagcagcttatacattttggaagaaatatggggggagacgaaagnagatccccccatccatagatatgtatgaagaagagccggctacgtactatctaacacatcctcttttgccaccccttttctgccgaacttcctcggagatcttgacgatagcgaagaaaatcatcctgtacaccagcatcatcccgcagaggatggcaaggttgacccacttggagtaccccatctccacctgcagcttgtactcgaggacctggaggccactgacggtgacattggagtcgacgagctggtcgctcgggaacgacagccccacgaactcgttcttgtagagcccctgcacggcgtacttgtggaaggacaggtagtagcaggggtacttccagacgggcttgggcagctcgttggggaggcggaagaagccgccgttgagcatcatgaccccctgcaccccggcgccgacgatgatccccatcaggaagtccgggacgacggcggcgatgaccatcatcatgctctcgaccaggaggcagcagacgcagagcaccatgacgaagtagacgaagtggtcggcgcctttggacaggcccgtgaggtagtacagcatcgcgccgggcagtagggaaacgacggacaggtacggagtggcggagatggtgttggagatgacgaactccgacacgccgtagtggccgctcagcctctcctttctgaacaccttgacgtcttctacgaaggatggaaatcctccgatggacatgaaagttaggagtgcgatggtgtacatgattacttcacatcgactctggatagagctgtagctgctgtagccaagttggtagaagatagcgccccggctcgcgccaccccccatgtagatggccagacgnatccagtagtaccctacgtccctgtgcatgttcaggaacgatctcctcgtcagcacaaggagcttggtgccaaagcttgcgtgttctctccgccgaaatgaagctccatcctgcagccagtagggaatttcatttccacaattaccatgcacagctctatccaggtaaataaaactcaggtttattaccatgcttttcatttcgacaatttggtctgtggttttgtccaagtaaatggatgatctgtatgcagtcgccaggatttctattgcctctccccctgctgttttccttttagctttgtcagagctctccaccacggtttcctcgtcaaagtctttgttgattgttctgaggaagtggtctgacgggcttctcaggcgtgggcatgggaagccgttcagagagaagaactgcatgcatatatatatatgcaaggaggaacgatcgatcgagctaattaacacaagtcagagatatatatatgcatggtcctggtcctcttaacttctctctgatgcatgatgatcaagaagtacgtacctcggtggcgtcagagatggtcccgaagaacaccgtccttccggctgcgagcaggcataggccgtggaagagctccaagacgtcgccgctgggctggtgcacggcggctacgacggtcatgccgtcgcgggcggcgacgcgcgcgatgtggctcatgacgtggtaggacgcggcgctgtcgaggccgctggtgggctcgtccaggaagagcaggcgcggccgcgtcagcatctcgatgcagatgctgagccgcttccgctgcccgccgctgatgcccttggtgacgcggccgccgatgcgcgtgtccatggcgtccgcgagccccatctcccggatcacccgctccgcgtgcgcccgcttctccgccgccggcgtcgtgtcgggcagcggcagctgcgctgagtagtacacggcctcccgcaccgacagcgtcgacatcagcacgttgtcttgggtcacgtatgccttcaattatattcagcgtttatatattattattcattcgtccgatcgatcatccgctcatatgcatttagaaaaaaaaagaacaaggatagatgatgtttgtttttaccgaggttccataggcaagcttctcctgccggccattgatcaaaatcagacctgttttattcatgccgggtcctaaccttcctgcactcaaaatggtaacaatgtctagcttccatttcgttttgtatgagtgtatatatatgctgcaatatatgccaatatttttttatgaggctctaaatgataaataaataccccctccatcctaaaatatatataatttcttgtagattaaatatacatttattaattaatcttgtaggtatgtctacgttcatcgccatcgaataaatgtgaacgaaaaaaaggtaagaaaaaactatattttagtacaaagggagtaaataatagagagaggggattcgtcattttccaaaacaaatagtatcatgcatgactatacactagtacagtgcccgtgttttacgacggtaagaataaatattacactttatatctaaaatccttaaaaagatatatgagttgaaaaggaatatgacccattttttatagctcatcactcggccgctcaccgtcctttagctagcgtggtggtactattgcatagtcctacgcacgtacacgtacgtatatgttccttcgaatgagagtacatatggaataatataaatataaaacatatgtgcagtaaatcacagggagcactattccagtcattaatttatgccccagttagtttggtggagagtctagagtggatcagcagtgccagagattctgatcgctgcaaatgaattataagcattccccacagtagtagttatggacaggacagttcatcaggtccggaccaccgtgacatgcatgttgcatactcctaccatggtggcgagcgcgacgcggcagggaaaatacatttctgtgctactaatcgcgagcgtggtcctgaattgaatggtgtgggttccgtccctccatgggcatgcatttatggtgtcaacgcgtggttggtttgggcggcaagcagaag

SEQ ID NO: 14483 - DNA, 5041 bp, Zea mays
  misc_feature (2680)..(2680): n is a, c, g, or t
  misc_feature (4566)..(4566): n is a, c, g, or t
tgttatgtaaaattgtagggggttttaatacaacatataagggtttagtttccttgtcactaactttacattaatcattttacgtgaagtgagaacgaaaatataagcggataggtggaagtgtgtggttcaacaacttgtagagttgaaccgagccatttggactcgatgttgcgtactgttactaaccgaaagcctgttgccttctcttatttatataagttttgtcttataaaaagatataaatttcatagccaatgttaattttcaggtgggatatgcttcctattttacttagataatatatatatttttttctaaatcgatttactaagtgaactctgttgcattctcgtatgaataggtacttggttgttattgatgacatatgggatatatcaacatggaagctgattagatgtgctttggtggaaagtaaccctggaagtagaataatcataactactcgcatttgtgaagttgccaaaaaggttggtggtgtttacaacaagaaaccactctctcttgatgactccaagacattattctatactagagtatttgctggtgaaagcatgagtcttgataacatatctggtgaagtgtgcaacaaaatcctaagaaaatgtggtggtgtgccattgtccatcattacgatagctagtctgcttgttggtaaacagagggaggactggtctaaggtgtatgattatattggttttgggcatgaagataacgaggttattgggaacatgagaaagatattagctttcagctattacaatctacctccttatctaaagacatgcttattgcacctaagcatatttccagaagatcacaagattgagaaaaattcattgatatggaggtggatagctgaaggttttgttattggcagagaagaactagggttatttgaggttggagagagctatttcaatgagctcataaatagaagcatgatccggtggatagagctctctagtagaagcaagattcgagatggttgtggtattcatgatatggtgcttgatcttatccgcactttgtcaggtgaagtaaacttggtcacggtatcagatgtggagcagcagtgtaccacatcatcatcatattcaccagtcagaagcattagcgctcgaagattagccttccacaaaaaaagaagcattgaacacaaccctggcacagaaataggacaggtgagatcattcaatgctttcaactgctctggtagtaggatgccccgacttttaagcttcagggtcttacgtgtactagctctggagaactgtaatttctcagcaggaaactgttgccttggaaatattggcaaattgcatcagctgaggtacctagggctagtggagacatccattcgtgacgacttgctgcctggagaaacaggacgcctcaagtttctgcagacactagatgtaagacgaagtggcataaaaatattgccagcgtctgttggtgagctaaggaaactgatgtgcctgcgtgctaccgagggcacaaggatgatggccgagattgggaagctggcgtcactggaagagcttgaggtacactctgtggacaagtcgccaaacttcgccacggggctggggcagctaaccaaggtgagggtgcttgagatccatttcgacgaaatggacgagagcacagagaaggctctcatggagtccctgcgcaacctgcggaaaatccagagtctgcagatatggtccaagaaggagaggacaattgaccttggcggcttgttggaagactggacgccaaccccttcagatctccgtcaactgatgctgcgtggcatccatttgcccaggcgtccgtcatggattgatccctcatgtgtcccgctcctctcgtacttgtcgctcacggtccaggccgtgcaagtgcaggatctagaaatcctcgggaggctgccgttgctcagctacctctacatctggagtgagggcatcaactgcttatcctatactgctaccagcagagacgagtttcagaatctgagacatctggacacaaacctggagatcatgtgtggacagcagggagcactgcctatggttgagaagttgacatgccgtgccagcatggggaagtatgttgcctttgccaggagcagcatgcctttcgacgatggcagcgtggtgaatcctgctactgttgctgaggcagaattgccagtaattctacctttggacattggctggcccgtgaacatgccttgcctccggggcatcacctatttgctggattaccaggactgcagtgccaaggagtgggctcatgtggagacattgctcttgcacgtgagaaaaatccaccccaactgtccacccttccgaatcaaaaagaactgcagagacaaggagattaccttgatcgacgcaatcatctaccttgaagatgtcaaggatgtgttcaaggacaacccctccaaatactcggagtttcttgatctcttgcaagattataggagagacaggtcccttctattgcatgctctcctttagtcctttcatatcttggcatcgcttgcattgcatgccaagcatgatgtgtccgtttcgttctatcgttaacactataatattcctccttgtttgtttttcttatttatcagaatcaaaatcaaagatttgatcatccgtctcaagancctatttactggacatgatcctaatctcatccttgacttcagcgtcttcctgcccggggagtgggccatcactctcggggacctgtagaagaagccccttcatgatcgattctagctaggccatcacccatttagttaataagaccaaggtctcatttaaacaagatagctagttcttttcatgtactactagttcctaatgcctttgttgtaatttttccagtcgggatgacggcgatggatctgatcatgttacccgcacaaatggcgaagaagaggtatgtgcaacatttcctttattgctcaaagagtcaagaattaggatcggagaactatactacaagctatttatttgattctctcttccgccattcccattaatctcataccatgccgtggcaatattttacaggacgatactcatgaagcgtaatatgcaatccctgtcaccagtggatgatctttgcttcagttaattcatcatccaaagaaaaagagaggaaaggctgatataagaacaaaaacattttcccctctttgttccgacccctgtgttccatcatggaagtcttcctctagaaaaaaagacctatattttttaaagaacccctagtgcccggcaagaaaatacctaaataaaatttggcgggatttaggatttatatatacttctttgggatttaggatttatatatacttctttggggttttgtatttatatatacttatttgtttctttgtcgttgcatatgaatactccctcttatcaaaaaaatgatgttttttagtttgttataagacaaactatataaaatttagccaaatttatacactaaatgcttttttctgaaatacacgggaggattgtatatcattgcattaatagaagaaagaggggaaagacctccatagtacaacacacccatatacccaagtaacccaaagatctcacttggaaaaaaccaaaacacacgaccgacacactgatctacctaaactaccgatcctcggcctgagggcggatagatctgtggccctagccttagaccaaaataccacctcattcttggcagccctaagggcagaggccaagctaggattacaaccatcaaaaaacatttatttctatgcttccaaatggtttaggcgccaagaatcaccaatgagttgaacccttctctcacatgatttgccacatgagagatgccaatagtccaccaagaatcaaagaaaacctcgaaggtgggacaactcttctagccccaccgtcttgaggaggtaaaatcaaaattgtctagcaaaaacacatttgaccaaaagatgattgatggatttagcctcttggtcatacaatgaacaacacttaggatggttcaaccccctcttttccagtctatcagctatccatcacctattaaataaattcaaatcatgtaatggacactaattgtatgttaaaatcatttaatagacaccaattacatgttaaaattatttaacacacatgaattacaagttaatatacagtaattatatgttactagtcatgtgctctcattgttgcaacactggttgacattcagaactttaaatttgtttaactatgtgcatgtttggtagggcttcggctttgactactctgctggagcagcttatccacaaaagctagtgcccttttaacaaattgtttgacaaaacaactcctcctttattttttatttgatgtataaggcaaatgtccttagtgccttttttagtcatttgatggaacacctcatatacgtacatacaaataatgcataaagaatctacgaccatgataaaaatcatgatgaaatataattttattaaagtctggcctcgcagatggccagctgcggagatgngctgcgcagtaagggcaaggatgggccgtgccagggaagatttggtccaagagaaactatcttttcttttccctttttattcctgttttctttttagtattctattttctttctcctattaaagatctgaacccaaattcaaatataatttgaattcctaaatttcaaaccagatgcaacacaaggaactccagcatgagaggcatactatgtatttttattcatcctttattaattaatttaaccaattgataatgatgtttacatatatgctaaatgagaagaattgcacaaaattaatgagctctcctttttattaatctataatctaggtgttacatctaccacaaaagctgagtttatatctttgtctgaggcagtgaaggaagctatttggttgcatggttttcttggtgatttgggcattgagaaagttggtcatgttgtcttttgagataatcgaagtgtgatttat

SEQ ID NO: 14484 - DNA, 3006 bp, Zea mays
acggctgcgccgctgctgggcctgcctggggggacgcgcctcgcctttccgccgcctcggcgtggcgtgattccgaagcgttgccggggttgtccgcgttgctggtacatagaaaaacaccgcatcttttttggagggctcgtctcggctggcacgaaggttcctcgcggacaatgccgagcatccgagctccggcgtccaagcagacggccacgctacaggtggctgtcaagtgcaggccattgaccgacaccgagcagcggcgttcgcggcatattatacaggtcattgatgacaagactgtggtcgtgctggaccctgatctgtcaaaggattatctggacctcatccagaaccggaccaaggaaaggagctataccttcgatcatgtgtacgcgcctgggtgctccaattcggacgtgtataagaatatatcctctacaattgctggtgtagtccaaggccttaacgcgacagtctttgcttatggttctactggaagtggcaaaacttacactatggttggaacccatagcgatcctggtctgatggttcttagcttccgtacaatttttgagctgataaaaaaggacgacagtaaggatacgtttgaagtttcatgttcatatctggaagtgtacaatgaggttatctatgatttgcttgagagatcctctggacacctggagcttcgagaagatcctgagcatggcataatagttgctggattgagaagcattaaggttcattccgcagataggattcttgagctgttgaacataggcaacagtaggcgcaagacagagagtacagaagcaaatgctacttcttcacggtcacatgctgtacttgagattaccgtaaagcgaaagcagaaaggccaatatggtaaccaagttcttcgtggaaagcttgccttggttgatcttgcgggcagtgagagggcctctgaaacaaacaacttcggtcaaaagcttagagatggagccaacatcaaccgatcactcctagcattagcaaactgcatcaatgccctaggcaagcaaaataagaaaggtcttgcctatgttccctatcgcaacagtaaattaactcgtattcttaaggatgggctctctggcaattctcgaaccgttatggttgctacaatatcaccagctgatgatcagtatcatcacacaacgaatacactcaagtacgcagaccgtgctaaagagataaaaacacatgtccataaaaatattggaacacttgacactcatgttgaagactatcagaggatgatcgacaatcttcaggttgaggtttctcagttgaaaaaggaattagctgagaaggagcatcagttaagtgtaaagcctactgaaaaaactgcagatagtgagctatcttggttaaatgtcttgagccaggaaactggtgagaatgttcaagaaacgcataactcttcagaagggctctgtttgaactcgaagaaaccccataagcgaaaccgcatggaactccagcatcttgatgattctattgcaaggcatcaggtgaaagaaatggactctaccattctccaagctttaacatcaaggagacaagttattcttgacaacatccgtgataatgacgaagctggttctggatatagaaaggacatcgaaatgaatgagagtcgcaggcgacaactccaggatatgattgaagaggccatcagtaacaatggcaataaaacctcccgccccgcccgcggccggtacagactacttggaatgactaacgctgaacttcaaattgagatggctatgcgggatcaagttatacataatcagagggaagctctaaggagcctgtggaacattctctatggaacagggctaaaccagaagcagattcttaaattggctgcaaagcaagggttaaccgtagaaggctgtcctttgcctagctcaagcccagatgttaccacgccaccttcctgtcaacctcataggtttccatcgtttatgccatttcctagtccgcagtcagagccttattctccatctgcttgctttttccaacatggtttcagcactatgtctttgctgaaaaatcagcatgagacgcccacaatatgtaggcaggagcacctcagttcttactacatgatgtctggctgctcgccttactctggtgatggaaaacagtggtcaagtggaagacctacggcattcttttctactccagaaaaacctaaggaggctcagtcccaagacaacaaggaacattctggcagccatgatttcagtctgcacagaaaggatctgtggtccacggaaaggaaatgacgggcctcgagatccttctggtacttaaaaacacctgtgatggctacaatgcggcctgtctgatgttcctaacctcggtcgctgtgtgcaccatcttctgtctaccaccgacgttcccggggttcctgagatctgaagatatggtagtggtagatttcgcgggagctgttgccttgcccacgtccattttggttgatcctgctgggcgttgcccactccgtccaccatgtacagtagatgcaagtcctctcagtttttttgggggaaggggggtggatatctgatttctggaccaagaacagtgtaaatttgccgcggttctcgccctccttcagtaaatccaccggtaaagctttccggattggtcttcaaatcgggcgggtgacgacgatcaggatgggagttgggtgactgatgaacagtctaagggctacagtagcatgtggtaggaataggatctcatcagtcatctctctagatcattgaataagccctggtgaggctcacctgccctggagaccacattgaagcaggagcagcgctgggcatgatggtccctccctcacattcatgtttctgcgcaacagttgtgctgaatgctacgctggagcagccgaggccgcacggcacgcacatcgcagtcgcgttccacatgcccggcgcagccaaagggctggctggctggctt

SEQ ID NO: 14485 - DNA, 1301 bp, Zea mays
ttttttttttttttttgttaaaattcactttttatttaaaattaattaagaaggagatttcagacaattcaatccactccggttttgtggctcccaaactagcccttagaaagaaaaaaacacctactcaagaagggaggagtatctgttcatacgggactagcaagggaggagtatctgtcatgtattgtggactacttaactatatatattttgtactaaaaggagcaatacacaaaagacgatagagctgtgccggagccgcagaatgatgtgctgtcattatcttgcttctaagaacttgctaagttttgcttccgaacatcaggtatccaacaagtgaagataacaagaagacaagcagcacagacgtcgccgagaagtccccaggagatgcatgtgtcttccggaggagatccagctctttctgaatcttcttgttttcctctgcatatctactttccagttctaactcggatatagaggcatcctgtatcgggtctttctgaaccatcttgttttcctctgcatatctactttccaacttggatgtagagtcaccctcgtcatctgaagcttgtgatctacatgtatgcccttgtcctgctgcgcagttggacgtcgatggtctccccacttcatggtccacatctgaatcaagagatccgtcatcttcctctgtttcctcgggcactggtgacggagggttggcagggacatagaccaccctcaacttgaactcctcaaccaacttacctggcgctttgctgaacatgccagggacaatgcccttgtgcgtcgtcccctccgcggccgcgacgctctgaacgagaaacttgtccttgcactggtagtccgggggcacctccttgggcgcttgcatcgtgattgtgatgccgcaggatcccctgggctgcacgacgccggaggcaggccgcaccgagtacttcctagggttcgtcgtcttgaccttgaaagccacccaccgatcggtcctgttgacgagctcgagacatgccgaactgtgcttcttgacctcgaatggcatcttgaggtcggacgggcagacccgaagcagcgtgttactcatggcggcgatcaagaaacaaggatcagccccgctttctcctctctctctctctctctctctctctctctggagtctcgagaaccaaagaatatggaagatccgatcccaagaacctgaaaactgatgagatatcccaagacgggggaaggccccggcgacgttttccgagtgtagtacggttggcagcgaagcaaagggctcgatccttttt

SEQ ID NO: 14486 - DNA, 1113 bp, Zea mays
atgttcctcttcttgtatccttcgtttccgttcctatccaagctgctaacaaactagtatcagattaggcgattccttgctctgtcccatggcgccgccatctccatctgatgatgcgtccctcactcttgccttggaaaaccaaacccgggcggtccttgccaaattggataaacggctccaaaccctcgacaacaaatgggagacgcgggtggcgctctcgaatccgcggcgacggatgcggctcgatccgtcaccaacttctccaccgggctccgcgctgatgtcgaagctcacctcacggcgtccgacgcggctactgatgcccgcctgcgccagatcgaggtggataccggctctcgtctcaccgccatagagtccgcagtccagctgttcgactgctggcgcccccgagtggactcctccctcgacgccatgaagacgaacctggatcggctctgttcggaggtgtccaggatggaggtcgcaggcttccaaggtgtgttcggcgggtttccgggcgtactcggatctcccggttccggcgcgacttcgtcaggcctcctcggatccccgccttccttcgctcctaccggagcggtaccggtgcgcccatctgccaccgtcgaccactccgacgcctatcgttttgggcccagctacgaaaactatctccgagacagtgggcttcggtatccgactgccgatggccgcttcccggtcaagggtatgtggcgtcccccgtctccactattttcctttccataaccaggtcattctgtaggaagtgatttggatccacggggcaaaccaacccctccatgcaatcgtgcaaacttctaatctgtaccatataatgttgatccaatggacacaagggcatggataattttacacttaaaaaaaaaaaaaaaatcacattttttcaaatcccccctcccactccccccgcacaccccttggatcaacatcatgtggttcagattaaaagtttgcacggttgcacggaggggttggtttgcaccagatacgttcccctgttgaatcgccatggcggagggttacctaaactcaatttccctgtctttgatggctccagtcccaagttatggc

SEQ ID NO: 14487 - DNA, 1979 bp, Zea mays
tttttttttttttttttttttttttttttctaaaactggtgtattttattcttatcgattagaacgtaatataatgtacgattaaatttagaataaacaaccacactataaacataagaaaccaatgttcaacaagagaggcaaagagctcacgtgtgtgtcagtgtgtgagagaatgtgcctgtggatcagggcgagcgctcacctgtaggaagtttgatcagcgagccgttcccaattcaacttgctcagtcggccgtgcaatcgggatttagcggtggggatccttgaactagcctgtattgcagcggagccaccgccgacccggaacaattgcatcgctgcatcggtgtttcgccgccgccgcaaaaagaggcggccgcggtggagttcaagggaggaggaggaagagggtgtgaggcgctgcagaactcctgtggatcggtgagccgagggcgatatggggatattcttcagcaaggcggaaccgccgccgcccatggtgctggtgccgccgctcttcgactaccctcccatcgctgcccgcaccaggatggcggtgccagcatatgagctaatgtttgggaaagtctccctgcagaatctgtttgaggactactttgatcaagctgggaatatgacctcaaggatcatgttgaagccgcttgaagatcctcacgttgatttgattgctactgtgtctgctgctgctgatagaaacagtggaacagaagtaaaaggggatgctttatttcgctggcagagagagctggatgacccccatacctttgtggaccttcttgtgtcaacttcaaatcccttgttgcagctgagattatgtgcatatcatcctaagtatcgtattggtgcctttggaacattacctttgctaatggggaacagggtgcattcagaagactatggggtcatgggtgtaagatatggttcagagaatttatctgttggagcatcctttgtgccaatttccttatccagtgaggtaccctttggtgcatggttggttgggagaaaagggagcttatctgcaggagtacaatacaagccacttagtggcagcaaatatcctatgccatttacagaattggagaactggaattatgcaatcagttatggtgttggctcaactagcccgctcagcccttcattcattttctccctggaacttgccagaagcacacagctaaccgcatcattctatcagcacctggttgttcaaagaagggtaaaaaatccttttgaagatgatcaggttgttggcattacaaactacatcgattttggacttgagttggctgccaaggttgataaagataaagtgagtggggatggcaactcgtttcagttggctgcaagttggcaagctaacaaaaactttctgctgaagggaaagcttggtccttccacgtcctctgtagctctggcattcaaatcatggtggagaccatcctttacatttagtgtaacagctgtgaatgatcattcaaagggcacaacatcgtatggatttggcctccgtgtcgaggaccttagacgagcgagttaccagcgagctgatccaaactacgtcatgctgacgccaagcaaggagcacttggcaccaggtgttctgcgcgagtacgggaagcggcccatgttccagacacaaatcgattcgggcaactacgaccatctgcctacagagctgaagcctcttggcaggattttctaactgtaggctggctgctcgtgctcgtctttcgctaggagatttttctttgttgttgttgtagatcttatccgtcttggtcctttagacatgctgctgtaacttgcattgacacgtgagcggattgcgtcatgatagctgcatggcttttggaagccagaaggatcatccaacgcttcttgcattgctatgtacttgggtggatatatataatggtatggtgcagtggacaggcggtcttgaatccttattc

SEQ ID NO: 14488 - DNA, 877 bp, Zea mays
ttgggtacctcgaggccggccgggacggttgagcgaagtcgtcactgtaatctactgatctgtaaatggcggaggcggaggcgacggtggggcgactgatgctgtactcgtactggcgcagctcgtgctcccaccgtgcccgcatcgctctcaatctcaaaggtgtggattacgagtacaaggcggtgaaccttctcaagggcgagcagtctgatccagaattcgtcaagcttaatcctatgaagttcgtccctgcgttggtcgatggcagttctgtaataggtgactcttacgcgatagcactgtatttggaggacaagtacccagagcctcctcttctacctcaagaccttcaaaagaaagctttgaatcaccagattgcaagcattgtagcttctggtattcaacctctccataacctcacagtgttgaggttcattgaccagaaggttggtgcaggggagagtgtgttgtggactcaacaacaaatcgagagaggtttcacagctattgagaacctgatacaactaaaaggatgtgccgggaagtatgcaacaggagatgaagtccaactggcagatgtattccttgcaccccagatctatgcagccattgaacgcactaaaattgacatgtcaaactaccccactcttgctaggctccactcggagtacatgtcacaccctgcgtttgaagcagcgctccctggcaagcaaccggacgccccttcatcctcctaggaactgcaccctagtgtgttgttcctctgaatatatatatgtatacttctgtaagaattaataagtacagagtttcgtctgctatgtcaaaagttgtcgtgagttcttgtgatttcaaaaaaaaaaaaaaagcggcc

SEQ ID NO: 14489 - DNA, 996 bp, Zea mays
tcctcttcttccgtcgctctcgctctcggtctcggactacggttgagcgaagtcgtcactgtaatctactgatctgcaaatggcggaggcggaggcgacggtggggcgactgatgctgtactcgtactggcgcagctcgtgctcccaccgtgcccgcatcgctctcaatctcaaaggtgtggattacgagtacaaggcggtgaaccttctcaagggcgagcagtctgatccagaattcgtcaagcttaatcctatgaagttcgtccctgcgttggttgatggcagttctgtaataggtgactcttacgcgataacactgtatttggaggacaagtacccagagcctcctcttctacctcaagaccttcaaaagaaagctttgaatcaccagattgcaagcattgtagcttctggtattcaacctctccataacctcacagtgttgaggttcattgaccagaaggttggtgcaggggagagtgtgttgtggactcaacaacaaatcgagagaggtttcacagctattgagaacctgatacaactaaaaggatgcgccgggaagtatgcaacaggagatgaagtccaactggcagatgtattccttgcaccccagatctatgcagccattgaacgcactaaaattgacatgtcaaactaccccactcttgctaggctccactcggagtacatgtcacaccctgcgtttgaagcagcgctccctggcaagcaaccggacgccccttcatcctcctaggaactgcaccctagtgtgttgttcctctgaatatatatatatatatatgtatacttctgtaagaattaataattacagagtttcgtctgctatgtcgaaaaatgtcaaaagtttttgtgatttcaaaaaaaaaaaaaatgaagcgtcgttgtggatctggccgtcgtcctcatgtggcatctgtgatttcagggcatgcacttcgtcttagaagggaaaaaaaaaaaaaaaaaaaaaaaaaa

SEQ ID NO: 14490 - DNA, 2280 bp, Zea mays
ttcggccgcgcgagggagagaggcaggcagctgcgtctgcgtcgtggccggcgcggcgctgcgctgcgcggaaaccaaatcctcagctccggtgttctctccaatctccatccatccatcctcctcgcggctcgcgccccgaaaaatggcgccaacccctccccagtctcccgcgcggcgctgccccagctatttccccctcccctgaattgaccccagccgcgcctcccaaaccctaacctaacccccgccccctgggccccggccatggcgtcactgcccaagccgccgccgccgccgcgccccaagacgcggggcaactacaactgcggccgctgcggccagcccaagaagggccacgtctgcgtcggccccggccccggccccggcgccgctgcgtcgccctcctcctcgtccggggccggaggggagcacgggctgcgccgcgccctctccttcgacgaggccggcacgccgtcctcgccggagaagaagcccaaggtggaggacgttcggacgaggcggagctggacgaggaggccacggtggacgtgggcgcccgcgcggtgtccagggaggtcatggcggaggttctgcaccgcctcggtccccgcggggtcatggccgccgcgggggtcagccgaggctggcgggactgcgcgggccgggtctggcgcgcggccgaggagctccgcctccgcgtcctcgcctcctctggcgccggcctcctcgccgcgctgctcccgcgctgccccgcgctctcccgcctccacctccggatggaaagtgatgttgatggcactaccctggcttgtattgcattttcctgtccaagtttaagaactcttgagattaccatggctgctgatgctgtcaacaggatgactggggaggatctaagtcgttttgtttcagagaagtcttctctctcagtcctcaaaattggtggttgctctaatttggatattcttaatctgtgctcttcaagcctttcaattctttggttgtcagatctttgttccctttcgaaatcggttatgaactgtcctaatatgagcgagctatcactgtgcttcacagaacatagtagtgattgtaccaatctgattactttgatggatggcctaggtcgtacatgtcctaacttggaaaaaatgcacatatcatcaaaacaattatctaatgaagctgtatgtgctctagagaatgctaatctcaggggactgttcatgctatccctgattctaggttcaaaaataactgatgcagctgttgcatctattgttcggtcatgtgcaagcttggagttacttgatttaagtggatctagcattagtgacaatggtgttgggatgatatgtaaagcataccctcgtactttatcaaggctgctccttgctctttgcccaaatgtgaccacacgtgggatccagctagccacagcacagttgccatgtcttcaactcatggactgtggaatgagcctatgtgctaatgtgaagaatgaaaaagagggtccatattttggtgaaatcaatggaggtattagaattattcgaaaactgtccatcttaaagaggcaacctattcaccaaaagcttattataaagcatgggaatttgaagaagctcagcctgtggggctgttctgcattagatgctctatatctaaattgtccagagttaaatgatctcaatcttaactcttgcacaaatctacatccagaacgtctgcttcttcagtgcccaaatttaaagaatgtctatgcatccggatgccaagatatgttgattggagcaatcagaaatcaggttctgaatgagttcgctgcagttgaaccatctcttccatgcaagcggctagcggatggctccaaacgggttcaactccctcagttcctaaagcagcagccgtcgaaggacaacaaattaattgaattgagccagacccagtgcactgtgcatcttggttcataataacaccaccagagccagttaacggagcattgtacacaccgaattatgtgaatcatgcaccacataacattatcaattcgttgtatacttctgtattgcatcagaacctgtagtgattgttgtataagctgctaattgctgcatggacatgtctgaatccatcatggatttcttgcgaccgttagtctgttctaggaaacattatataggaataattcgtaaccatgacccgtattctctagggaaaaaaaataatgatcctaggtcactcattttggttgatgttggccgcgtcctcgcccgc

SEQ ID NO: 14491 - DNA, 1458 bp, Zea mays
cagacacctaaacgatgacacagcgtgcacccaccaccaccaccagcgccgactgccgagcgccggccgcgataccgtcgtgtcccccctccccaccgcattgggtacctcgaggccggccgggagcgccggccgacaaaattactaggtgcttaatttaactagtggccctaggcgtgaaacttcaccagctccgccactgcccatggccaacggccttccggaccctcgctgcgtcgtcctcaccgccgacgctgcccgatccctcgtcgattccgtcgacgccttcctcttcgactgcgatggcgtcatttggaagggagatatgctcattgaaggggtcccagagacgatggagctactgaggaaactgggaaagaaattagtttttgtaacaaataactctagaaagtcaagaaggcaatactcaaagaaattcagatcacttggacttgaagttactgaggaagagatttttacatcatcgtttgcggcagccatgttcttgaagttaaataattttcctccagaaaagaaggtttatgttgttggtgaagatggaatcttggaagagctcaagttagctggttttgaatgttttggtggtccggaggatggcaagaaaaacataaagttggaggcggatttctactttgaacatgacaaaagtgttggagctgtcattgttggacttgatcagtacttcaattattataaaatgcagtatgcaagaacatgtattagtgagaaccctggctgccttttcattgcgaccaaccgtgatccaaccgggcatatgacatctgcccaagaatggccaggagctggagctatggttgctgcagtaagctgctcagtacagaaagaacccattgttgttggaaaaccttcaggctttttgatggacttcctcttgaaaagcttcaatctggagacgtcaaggatgtgcatggttggtgatagactggacacggacatactatttggccagaacaccggctgcaagaccctccttgttttgtctggttgcactgccttaccagaagtgcaggatgctcgtaacaatatccatccagatctctacacaaacagcgtgtatgatctagttgggttactgcagaagtaattctccttggccgcgttgcagcgcaatctcagcacgctttggatagcgcctatcagcaatttattacgtggattacttgcatgaagccatgtgttcttgaaacaacaattttgaactttctttggggtaacctgtttgacagtaacaaaatctttcaattggatcctacaaattagaccaatttgacaaccttgtaagcgtggctgtaaagctttaaatctggcaacttgattcccttgctggaaaatatattggttggagtatggaattgtacagaatcgaattgtaatgaagcaacgtgttgtactttgttgctaaaaaaaaaaaaaaaa

SEQ ID NO: 14492 - DNA, 1290 bp, Zea mays
agaaaggtggtcatcttgcaggatggtgaacctcgtacacgtagccaagaaacagctggtgcagcgcctggcgaagatggccggactgcggcagcgcgccgtcgacgtcgatgatgccggcacagtcatcagtatctgggtacccaaggacaagctaccggctggccccaccgctgaggagatggagacggagaggaggaagaaggagacgaagcggaacggcggcaggctctccgtcgtgctcctgcacggcttcgctggtgatgggattctgacgtgggtgcttcaggttgtcgcactggcgagacactacgacgtgtacgtgccggacctgctcttcttcggtggctcggtgtcgccggcgggcgcggaccagactccgggtttccaggcggagtgcgtggcgtccgcgctgcggaggctaggggtggagcggtgcgtggcggtcgggttcagctacggcggcttcgtggcgttcaagatggccgaggcggacccggctctggtcgtgtccgtcgtcgccacgtggtcgctggtctacatgacccgctccaccagcgaggccatgctgcggaggctcggcgcggcgtcgttcgccgagttcctcctgcccaacgatgtcgccgggctcaagtcgctcttcgccgctggcacctataggaaatggtggctgcctgatcgcgtcctcagtgactatatgaagctgatgatctttaaccgcaaggaaaggacgcagctgctggaaggcttggtggtcagcgatgaagacgcagctgttgtcgtccgttcttatcggcagcttctctatgcatcccggctctactcatgcaaagaagcgaccgcagccaggcttccgagccgaagctcacggcgagcgtacgcgcccagccaggctcagccgcatgcagcggcacgtataccgaggagatactcttgctctggggcgacaacgacagcatcttcaacatggagcttgcgagaagcctcaaagagcagctcggcgagaaggcgacgctgcgaagcatagccaaggcgggccacttggtgatgctggagcggccgcgcgtcttcaaccgctgtctcagagagttcctgttgcggcagtcacgctgatgcatcaccacgacgacggcgcgggcgcggcgtacgcccaggcctgctatctagctaagatctagtcaagctatagctagacttgtgtacatatgctaataataaagaacattgtgctagtgtgttgaccagcttcatgcatatatgataattattatcggaaaaaaaaaaaaaaaa

SEQ ID NO: 14493 - DNA, 2044 bp, Zea mays
gccggccggttccggaagcccgtggctcccgcgccagccatgggcgccacaacgcggcgcgagccgctgaagcagcgcgtcaaccgctgcctcctcaagctttccgaccgcgctcgccacggccgcggctgtcgaggcgtccgccgtcaccgacgacctcgcttcctacctccacaagctccaaccgcgcctcctcaagttacttcgcagcaatgccttcaaggccaagcccgcgctcatcacactcatcggcgcctccgctgccgtgggcggcgatgccgaagtcactgcctccatcccgtgcctccgcgatgcagtcgctagcgatgactgggcagcgaggaaggccgcggcggaggcgcttgctgcattggccctagagcacacggatcttctcacgacctacaaatcctcttgcgttaccttcttcgaggccagaaagtttgacaaggtcaagatcgtgcgagagtcgataaaccggatgattgaagcgtggaaggagatcccgggtgctgaagaggacgagtgctcctccgctccgccatcagcgtcccagtcacaacgaagatattctcttacaggaagtgcaagtgatggacgatatccagctgcttcgctgggctcaaactcagttccatcagcaacaaggaggagcagattacctgtgagcagatcatctccgcctgatgtgtcacccagtgtcaccaaaacatatagtccttcatccatcaggaacaagaagctgtcaccgccttcatatcgcaaagcgcgccaagcaaataattgtaactacaaggttgagatagctgttgctccggatgctacaccaatcaaagtggtgacggaggagaagctgctggaaggaggcaatgtgagaggcagactggaggctaggagggcactcttccaaggcagccaggataggtcggccaagctggctggacacaaagcagggtcacgagttgttccatacgagggtggtggtaatttggaagagatttcagaagttgaaggtagatcggaaaggtatgcagttcagaaagatgagagcttgtcagaaataaggacgcagctccttcagattgaaaatcagcaaagcagtttactggatcttctccagaaatttatggggaagtccgagaacggtatgcattctttggagacaagagtgcatgggctggagatggctttggatgagatctctcgtgatttggccttctcttcgggaaggatgtcaagcagagagcctgatgcaaagacgtgctgcattccgagcccaaaattctggagaaggcacaatggtggtaggtcttcctcaaggttttctgtctcagacgcagcaaacagctcagatgggagcagaacttcttacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctctttttttttcccctaaggaacgtacgttgtcatttttggaagcttctgaaagcatggcgtgcgcgtgaactatggatgtatgagtcactccgaagctaaactgtttgagtactatgctaagctgaggagctgcattcacatcatgtggtggagcgcgagggaggcttctttatcggacagcctcacttgtcaccgacgcaatcaggcacccccccaagccgtggactacgctgggtttggctttggcatgagaacgaccgctgtgtttgtcgtaagtcatatcgtaactagagaaacaagtagctttataatcacaatgtatcaccatcctacagagctatggatgcgtcttgtacatatgccggataaagcgcttctatgttcccgaacatcttttctttaccaaaaagaaaaaaagtgggtgttcccccgt

SEQ ID NO: 14494 - DNA, 2393 bp, Zea mays
caatacctatggtaccttagatcaatagatcctttaggtccggcttctctactggcttcaggtgctgtctattacagccgtgctctacggaacggggcacaacaaaacagttttacctaaagagcccccgtaaatcgtgtttttttcgaaggtttgaggtgggacacaacgagacgatgactttatcaacatccagaaacgctgatagactcgctaatggtttggatgtgctcgtatatacacaagcttctttgtgagttacagcattgtgtgggcctagaagcgcgtgatgggccttgatccgttcctcttgacgcaggccgcggcgtcctggccccataaccacagcacatgacaacggtcaaaagcgcaggcatccgatgcgtggtggcccccctcggcgaccggccttctacttcttcaccgccacgcgccgagagcgtgacaaggaaaagaacggacgccgcctccgctcccgtcgcagtcgcagcacattcaccctacctcactcgccctccccaccctcccctccagaccctcacacggtcacaccaccggcgccgcccgccctgtatggcctactactcgggcggcggcaagctgtcggcggtggacgccatcctggcggaggcggcggacctggtggcgctcgagcaggtcgccaagctcaacacggcccacctcgacgacgactccgcgcttccgtccagcctcgaggcccgcttccgcaagctcaagtccctcccctcgcccgccgcagtgccgcccgtcagcactctcgcccgcagcgccaccgcgccgcgcccggcccccgctctgcccggccccgatcctcccgctcctgctccgcctgtgcatcacccggtccacgaagacccgccgccgggagacgcggagacgaagggcggcgggtcctcgccgcggcaggctcgcgccccggcacccgcacccacggtccacgccgacgacgccgaggacctagatcagctgttcgggtcggcgccgcgggggcggccgacgctgcgggagcggaacagggggagcgactcctcctccgtctccccctcgccgccgccgccgccgcgccaggcgtgctgcttcggcttctcccccaagaagcccctgcagagggcgccgtcggccaagggcaagaagaaggaggtccgccacgggtcccgcgacgtcctcggcgtcgacgccgacgagtggggcgacgagaacaggaggatcgccaccgagctcagggagcagcagcgccggctcaggaaggcgctggaggaccaggtgcaggtcagcagggagaccgccaagatggcgcgctgggtcaagcaggcgtccgcgcgcatgacgcacgccgaggccattgacgacctgctcagtgactgcgaggacgacctcaaatgagctcacgccgacgctttgctcgtcggttcttccactgtctttgtcttgttggtgatcacaagtctgtcaaaaatgctcatatgttttcatgagtgcatttgcatccatgctttggtacaatgcttatacagaagaagcagagtcacgaaacaatgctatttcttttatgtcacatattattaggaccaggcaaagtatatgaatcgatggggcatataaggttttcatgagtgctgaactgctgatataggaaccaagaacgtggtgttgtgaaaaagatttgatcatgtgttctgtttccatgagaagtaattacacctggctattctaattttagtactgcatcaagtatttacaacctgtcaggcttgaatcataattgcttgatcctactttgaatgtacatccttaaaatagaatttaagcagcataatgtgatactactacctccccttttgatacttgtcacccctattcatttttgagacatgacaaataaaaaagaacggagggaatatgaagcagagtaaaaacgcaaatggcgttataaatagtgaagatgtggttgtctacactctaccgctagatagactagctgattgcataaacaacatacagttggatccatttacacaaaagtcaacaaccagaacatctaatgtgtccagcaattccttgtcacgccaaagttcctaatgggtgactcagaacgatagcaacgtgaggaaattcaacaatgtcgatgtgctttcgttttcagagctgttcatgattcgaagagttgcatatatttattgccttaaccacaaccctaactatgtacaagtacaaaggcggaaaataccggtttatcctggttcattgtttgcttaaagtgcaaaccggcattggtaaacctcatacctttttttcacacttctgtccagaataaacattcaagagccatgcaaaaaaaaaaaaaaaatcttgttgcaaagaccatcccaagg

SEQ ID NO: 14495 - DNA, 1614 bp, Zea mays
acttcggcacgaggtaacttaaccgacacccacctgtcttcctcggcctcctccaccccggtcctctcctgccgcgtcgcgttcgcccctcgcagcgggcaactcccaccgccgccgcttcgcatccgcccatctgcttccatcgtctcacggaggtcgctcacttcgccgccgcccgccccgcctctcccggtgccacggggccctcggccgcgccgtggcgcttaaaccctagatctgtgcctccgcgctggccgcggccgcgtcccgacgccggcacgccgccgatcgccgcacgtcgctcgatcccaggttttgccgctcgagtttagataagttccttcaatgcatcgtgttgggagtgctggtaacacagctggctcgactcgaccgagaaaagagaagcgcttcacatatgtactcaatgatgctgatgataaaaagcattgtgcggggatcaattgcttggcttatctagatggttccatatttagtacaagtgatcatctttttagcgggagccgtgatggtaccttgaaaagatgggaattaaataatggggatgcaagcttctcaggaactttcgagtctcatgttgattgggttaatgatgccattatagttggagacaagcttgtttcctgctcctcagacactacaataaaggtgtggaattgcttctctgatggtgcctgtaccaggactctccgccggcattctgattacgtgatttgtcttgctgctgctgagaataatagcaatattgtagcctctggtggtcttggtggtgaggttttcatttgggaccttgatgctgctcttgctcctgtagccaaatctgtggatgcaaaagaggatgaggttcctaatggaaactccgggcctgctttgacaacactgtgcagcataaattctagtagcaatattgcttcctctaatggtcaatcacatgggtacagtccaatagctgccaaaggtcacaaagattcagtttacgcactggcgatgaatgatacaggaacccttcttctctctggtggcactgagaaggttgtccgagtgtgggatccgaggacaggatcgaaaaacatgaaattgagagggcacactgacaatatcagagccttgcttgttgattctacagggaggtattgcctatcgggatcatctgattcaatgataagactatgggatctaggacagcagcgttgtgttcattcttatgctgtgcatactgattctgtttgggcacttgcaagcactcctgcatttggtcatgtctacagtggtggaagagatcaatctgtatacctaacagatttgtccacaagagagagtcttttactctgcacaaatgaataccctgttctacagttgtctctgcaagatgacacaatatgggtggcaacaactgattcttctgtttatggatggccagctgaagggcgcacaccccaaaaagtcttcgaaaagggtgcctcattcttagctgggaatttgtcattctcaagggcaagagcttctttagaaggatcggcacctgtccctgtatacaaagagccatcttttgtcgtcccaggggttccaagcatagttcaacatgaaataatggat

SEQ ID NO: 14496 - DNA, 909 bp, Zea mays
tcgggggattccccctcccctaacactgctcggtttccccctcccctaacactgtagccgctccttcaacggcgtcctcctcctcctcctctcccttcctgattctttctctctcccgctaaatcgatgggcacgctacgccgtattccttccccgcagccccgcagccgcttcttcgcccgcgcgctcggaatactccgcaccaatcctagctgcgggcaggggttccagccgcttcttcgcccacacgcccgctcgctcggaatactccgcaccaatccgtgtcggaccggtacgtgtgcgagatctgcgggcaggggttccagcgcgaccagaacctgcagatgcaccggcggcggcacaaggtgccgtggaagctgctgaagcgggaggccggggaggcggcgcggaagcgcgtgttcctgtgcccggagccgagctgcctgcaccacgacccctcgcacgcgctgggcgacctcgtcggcatcaagaagcacttccgccgcaagcacagcggccaccgccagtgggcctgcgtcttctcccgcattgtgtggggatcaattgcttggcttatctagatggttccatatttagtacaagtgatcatcttttttgcgggagccgtgatggtaccttgaaaagatgggaattaaataatggggatgcaagcttctcaggaacttttgagtctcatgttgattgggtatgcttttttctgtttttaattaagtaggcttactgtttcatcaatcagtgctttaaatagacattatgtttataaattagttatgtttatgtttatcatggtgtctgtggtctattatttggatccaaagcttagcacatttctagtgtccatatattttagcatcaacattctaattgacattttgagttcattatgtt

SEQ ID NO: 14497 - DNA, 2469 bp, Zea mays
gcacgagaccattacctagaacatcctaatcaaaaagtaaattcttataatagcttacagggaaaagactcttcaatctgaagcaaaatgtaccgggaatgttgaagagcgggactcttaagcagtagtgagatgcggcggtggtggtcgccggcgttggcggctgtggagccgcggtccgtgcagctcctgctcctgggcgtcgctctcgtcgcagcttctttctacgccggcaccctcttcggctcctccgcgtcccctgcgctcgtactgcccccttcgcgcccccgatcgcccgattccttcagggccaaagttacagatgttccagtgtttaccaacagagtttctcgtacgtaccgggcaaaatcagtgacagttccagatcacggagttgatgtgtgtcctttggaatacaatgagtatgtcccctgccatgatggagcctatataagcagcttgaagagcctggatacatctaggcatgaggatcttgaaagtatttgtcctccatgggagaagcggttgttttgtttggtgccccctccaaatgactacaagataccaataagatggccaacaagccgagactacgtatggcgtagtaatgtcaaccattcacatcttgctgaggtcaaaggaggacagaactgggtgcatgagaagggcaaactttggtggtttcctggaggtggcactcacttcaaacatggtgcatcagaatacatagagaggctaggaaatatgacgacaaatagtactggtgatcttcgttctgccggagtagttcaagttttggatgttggatgtggtgttgctagcttttctgcatatcttcttccgctagacattcgaaccatgtcatttgctccaaaagatggccatgagaatcaaatccagtttgctttagaacgtgggattggtgcaatgatctctgtgttggccacaaaacaattaccttatcctgaaaattcatttgaaatggttcactgttcaagatgtcgtgttgattggcatgaaaatgatggaatattactcaaagaggtagaccgtcttttgcgacctaatgggtattttgtatactctgctccaccagcttatagaaaagataaggactttcctgttatttgggagaagctagttaatattacaacaacaatgtgttggaagcttattgctaagcatgttcaaacagctatttgggttaaacctgaagatgagtcctgcagacagaaaaatgttgatatgaatctactgagtatttgtgaatccaatgacaacatttcaccatcatggaaaattccgttaatgaattgtgtgaagctcaacaaggacaaatccaatattcagaaattgccttccagatctgatcgcctatcattttattccaagagtttggagataataggagttgcaccagagaggtttgagaagaataaccagttctggaagaaccaggttcacaagtattggtcatttcttcatgttgaaaagactagcattcgaaacgtcatggacatgaatgctaattatggtggatttgctgcagcactaagcagtgaccctgtctggattatgaatatagtaccctataccatgatgaacacattgcctgttatctatgaccgtgggttactcggttcttaccatgactggtgtgagccattctcaacatatcctagatcctatgacttgttgcatgctttccacctcttttctcattataaacgccgcaaggaagattgtttgttggaggatatcatgttagaaatggatcgcatcattcgaccacagggttttatcattattagagacgagaatgacactctctcaagaatcatcaatctagcaccgaagttcctttgggatgttaccacgcacatgttggaaaatgaggaaagcgggacagatcaagttctgttttgcaggaagaaattctgggctattgtttgagttatacttgggtggaaattgggaagctgccatattttatcctacttttggttgccctttgtatcagtgacagagcagagcgtaaggagagctgtttggcatgatagatgttccaatgaaacataatatttcattgcacgttctctgcagttgacagtagtgcattgttgagaaggcatatggtacggtggtgcggttgacagggttatccagaaactagctcggataatttttgcttttgagctgtactatttgtctacgaaggacatgggtgagccggtaaggtgtagtcttactgacagtgtttgtagtttctctcataatgaatagccgttaattcttttgttatcttattcactaatggctaattaggtttaggttctcaagttctcaacaatatgttggtagtgctgtttctgttgttccatctggggagcatctgtagtactataaaccttatgtaaggtactgtttccagccaatgccgaggtgcatttgttaaaaaaaaaaaaaaaa

SEQ ID NO: 14498 - DNA, 694 bp, Zea mays
aatctgaagcaaaatgtaccgggaatgttgaagagcgggactcttaagcagtagtgagatgcggcggtggtggtcgccggcgttggcggctgtggagccgcggtccgtgcagctcctgctcctgggcgtcgctctcgtcgcagcttctttctacgccggcaccctcttcggctcctccgcgtcccctgcgctcgtactgcccccttcgcgcccccgatcgcccgattccttcagggccaaagatattccagtgtttaccaacagagtttctcgtacgtaccgggcaaaatcagtgacagttccagatcacggagttgatgtgtgtcctttggaatacaatgagtatgtcccctgccatgatggagcctatataagcagcttgaagagcctggatacatctaggcatgaggatcttgaaagtatttgtcctccatgggagaagcggttgttttgtttggtgccccctccaaatgactaccagataccaataagatggccaacaagccgagactacgtatggcgtagtaatgtcaaccattcacatcttgctgaggtcaaaggaggacagaactgggtgcatgagaagggcaaactttggtggtttcctggaggtggcactcacttcagacatgctgcatcatggtgcatcagaatacatagagaggctaggagatatgacgacacatagtactgg

SEQ ID NO: 14499 - DNA, 1177 bp, Zea mays
gcgagggggaggaggggagccccgtgaagctgcccaagccggagcaggccggcagcgacagctccgtcgaggacggcggcgcgcagaaccagaagccgccgccgccggggaaggggaagaatgccaagccggtggagcctcccagggactacgtccatgtccgggccaggagagggcaggctaccgacagccacagcctcgcagagagggtgagaagggagaggatcagccagaggatgaaggtccttcaggacctggtgccaggatgcaacaaggtgatcggcaaggcgctcatgctcgacgagatcataaactacgtgcagtcgctgcaacggcaggtcgagttcctctccatgaagctcgcaaccgtcaacccactggacctgagcaacctgcccacgctcctacaaaaagatatgttccaggcctgcggcgcttcggcaagctcggtcttctcgctggagagctgcagcccggggttcccgttcggcgggcaaggggacgtgttccagtccttcgtcccgaacggcctggagaacccgtgcggcggcctgaacccgctggacctggctctgtcccaggctaccggcgggcagttcggtttccaggacggaacggccggcacaaacctgcagcaaaggaactactgggaggaggaggaggaggacctgcagagcgtgttccacatcgacgacaacgggcagagccaggagcacggggcctcagcttcagcacaaagcttccatggtcagcttcaaccacaagagggccacatgaagatggagttcttctgatcgggcctcgacacccagccgccgacggccgagggagcgacctgtacatagcgaagactcgaggtacaagtacaaaagcaccagcggcggtggcggcggcggggacggaagctctgaagctatagctaacagcaagtccgtacatgtaggcccttccttgcccttggagaggcgagttcttcgctcgccgtagcgtgaaccagggggtgggcgatcgtgtgatttctttgaacgttttcgatccggcgattaatttgattgattaacacagccaccccgacgatagcgtacgtagcaatcacccgaacagtgaagctgtcacttttgtgtataagataatgcatatggtgcagatattagtatcaccggcgcttctctctttt

SEQ ID NO: 14500 - DNA, 1784 bp, Zea mays
cccacgcgtccgatcatttaaatgagggcaacgagaacaacagtagcagaattaagtttttgaggacggatgacaccatttcagagagctcgagctacgcagaggagagggctgccagggagaagcctcctaaggatgactctaatgtaatcaaccccacttccttggtagaggaaccgatagtgctccatacccctgatcagattgaacatggaaattctgtgccgtcaggaactaattcatcacagatggtgggtgcagcatcgcacccgccgccaccgccagctccgcctccaaaatcattgttggggaatagtgggttgtggagaatgggacctggaagttccaacagtgtgcggattggatctccaagaagaccagtagcttggccaccagtggcagctcggacatctgcttcaggttctcgtccttcttcgcctaggtcactcgttgatggtgaaggttacaatagtgctgatgaacagggtccctgttacgcctcgagttatgatgattcggaaagagagcgtatgtttgagcatgacctaaggcgagtgaaagggttggaaatcagaaagacggccgaagatgggaactgtctattcagagctgttgctgatcaagtttatggagatgcagaagcttatgacatggctaggcagatgtgtgttgattatatggaaagggaacgggatcatttctctcagtttataactgaaatttttacattatactgcaagaggaaaaggagagacaaggtttatggcaacaatgttgagatccaagcatttgcagagatgtacaatcgtcccattcacatatattcctacagtacagagcccattaacattttccaaggaagctacaacacagacactcctccaattaggttaagttaccatcatggtaatcattacaattcagtggttgatccccgccgacagactattggggcaggccttggatttagctcttttagagggactaatgttgacagggatcaggtgaaggctgcaataaaagctcagcaagaccagcaaattgataatgcactgatggcagaagggcgattctactctgatctggagttaacagagagggaaatagaacggatggtgatggaagcctcgcgttcagaatatctggccaaggagaaaaagcttaacataagggaatcatcgacatcaggggcagagccatcttcatccgctgcaattagtggttcctctcgatcagttgctggggcgggcagaagcagcgaggactactttgtgcttccagacactgtgctgactcgcagcatgcagctgcttctcgcaatgggcttcggctacaaccaggtcatggaggcctacagcatattcggcgaggatgtggactcgatggtctgctacctggtggagaccggaggagcctcggcaggtggtagcaatcgccggaaaggaaaggctgctgagtgatgtgtgcaccttcattgctgtgaatgtaattgatggaaaacgttgggcacaactcataccagataatgacagccttatgagttgagatgtcgatatacctgctaccttatgggtgatgaataaatggaactcacaactcttctcgatgccttctggtgatcaagttaaataattaatgatagttggtggttgggattctgggaaaatttgtgggtcaccctggtgccctcattgtgatttttgtgggaactgcgaagctcgtggtgtatgtggggtgtgaacattctctatatcttttcatctttaacgtctcctaaaaaaacc

SEQ ID NO: 14501 - DNA, 2494 bp, Zea mays
ctgtgcggcgctcccggcgggcctcgggcacacacaccatcgtcctctcctttgccagcgccgccgaacccgccaccagccttctcccatcctcgaagcacggaaggctcccagaaggagctctcacctcgcagccatctctggcacgtccgtccttcttctccctcggtccctccccttctccacagctatcggattggcgttggagtggagatcgacccgggctcggaattcccttcgttggtaaggaaccctaatttggtcagatgggatttccaacttcgacaaagcccgcgaggtcgatcgatctcagttgacgcgagggattggaaaactaagttgcgggtgtagttaattttctaggaagattggggtttcagctcaaactcccatgctcgacgctgaggacgaccctggcgggagatgacgaggatcttcgtgcagcgcgggaccgccggctcctcgtccagctccggccgctcggacacgcagccagtgcagccggcagcagctgcccgggaggaggagttgccgctgcaacctcaaccacagctgccggagctattggccatagatgatacaactgataatttaaatgagggcagcgagaatatcagcaataagcctttgaggacggatgacaccatttcagagagctcaagctccgcagaggagagggctgccagggagaagcctcttaaggatgactctaatgtaatcaaccccactttcttagtagaggaacctgtagggatccagatccctgatcagattgagcatgaaaattctgtgctgtcagtcactggttcatcacagatggcaggtgcagcatcgcacccaccaccaccgccagctccacctccaaaaccattgttggggaataatggcttgcggagaatggggcctggaagttcgaatagtgtgcggattggatcttcaagaaggccagtagcttggccactagtggcagcccggacatctgcttcaggttctcggccttcttcacctaggtcacttgttgatggggaaggttacaacagtgctgatgaacagggcccctgttatgccttgagttatgatgattcggaaagggagcgtatgtttgaccatgacctaaggcgagtgaaagggttggaaatcagaaagatggccgaagatgggaactgtctattcagagctgttgctgatcaagtttatggagacgcagaagcttatgacatggctaggcagatgtgtgttgattatatggaaagggaacgggatcatttctctcagttcataactgaaattgaaagttttacattatactgtaagaggaaaaggagagataaggtttatggcaacaatgttgagatccaggcatttgcagagatgtacaatcgtcccattcacatatattcctacagtacagagcccattaatatttttcaaggaagctataacacagacgttcctccaattagattaagttaccatcatggtaatcattacaattcagtggttgatccccgacggcagacagttggggcaggacttggatttagctcccttagagggacaaataatgttgacagggaccaggtgaaggctgcaataaaagctcagcaagaccagcaaattgagaatgcacttttagcagaagggcgattctactctgatctggagttaacagagagggaaatagaacggatggtgatggagtcctctcgttcagaatatctcgccaaggagaaaaagcttaacattcgggagtcatcgacatcaagggcagagccatcttcatccgccgcaattagtggttcctcccgttcagttgctggagctgatagaggcaaagaggactactttgtgcttccagatactgcactgactcgcagcatgcagttgctcctcgcaatgggcttcagctacatccaggtcatggaggcctacagcatattcggcgaggacgtggactcgatggtctgctacctgttggagacaggaggcaccggagcctcagcgggcggtagcaatcgccggaaaggaaaggctgctgagtgatctgcacaccttcattgctgtggatgtaatcgttgatcgaaatcgttgggcatgaggaagcataccagataatgacagccttgtgagttgatatgtcgatatacctgctaccttttgggtgatgaataaatggtactcacacttgagacttctcgatgccgtttggttgcttaagttaaataattaatggttggtggtggctgggattcagggaaaattaatgttaatcattggtaattttttggtgtatgtttatttaaacttttaaaaaatactttccaaaatgtgagatctgcattgttttgagaactgagggagtagatgtttttttccatttaggtgttgtttggttcacaaaatgtaatgtaaatgtcaacgttaatgattcacacttaagtaccagcagtaacaagtttaaataagctcaaaaaaaaaaaaaaaaaaaaaaaaa

SEQ ID NO: 14502 - DNA, 2450 bp, Zea mays
cttgcttattttgcacatttgtgtgttgcgttttcttgcttattttgcacatccgtttcagtttgatgtaccgcaccctcggcccgcccgcggggcagacctcaaagcatcactcacacaccatcgtcctctccttttgccagcaccgcgaacccgccaccagccttctcccacccacgaagtacggaaggctgccggaaggagctctcacctcacatccatctctgtcgcgcccgtcatcctcctcctcctcccctcctcaactgctatcggatttgcgctgcagtggagatcgacccgggctgggaatttctttcgttggtaaggaaccctaatttggtcggatgggattttcatcttcgacgaagcccgcgagattgatcgaccttagctgacgcgagggattggaaagcgaacgctcgggcgtagttaattttctaggaagattggggtttcagctcaaacccccatgctcgatgctgaggacgaccctggcgggagatgacgaggatcttcgtgcagcgcgggaccgccggctcctcgtccagctccggccgctcgggctcgcaatcagcgcagcagccggcagcagctgcccgggaggagttgccgttgcaacctcagccacagctaccagaactattggctatagatgatgtaactgagcatttaaatgagggcaacgagaacaacagtagcagaattaagtttttgaggacggatgacaccatttcagagagctcgagctacgcagaggagagggctgccagggagaagcctcctaaggatgactctaatgtaatcaaccccacttccttggtagaggaaccgatagtgctccatacccctgatcagattgaacatggaaattctgtgccgtcaggaactaattcatcacagatggtgggtgcagcatcgcacccgccgccaccgccagctccgcctccaaaatcattgttggggaatactgggttgtggagaatgggacctggaagttccaacagtgtgcggattggatctccaagaagaccggtagcttggccaccagtggcagctcggacatctgcttcaggttctcggccttcttcgcctaggtcactcgttgatggtgaaggttacaatagtgctgatgaacagggtccctgttacgcctcgagttatgatgattcggaaagagagcgtatgtttgagcatgacctaaggcgagtgaaagggttggaaatcagaaaggcggccggagatccgatccctctgtgcggagctgttgctgatcaagtttatggagatgcagaagcttatgacatggctaggcagatgtgtgttgattatatggaaagggaacgggatcatttctctcagtttataactgaaagttttacattatactgcaagaggaaaaggagagacaaggtttatggcaacaatgttgagatccaagcatttgcagagatgtacaatcgtcccattcacatatattcctacagtacagagcccattaacatttttcaaggaagctacaacacagacactcctccaattaggttaagttaccatcatggtaatcattacaattcagtggttgatccccgccgacagactattggggcaggccttggatttagctcttttagagggactaatgttgacagggatcaggtgaaggctgcaataaaagctcagcaagaccagcaaattgataatgcactgatggcagaagggcgattctactctgatctggagttaacagagagggaaatagaacggatggtgatggaagcctcgcgttcagaatatctggccaaggagaaaaagcttaacataagggaatcatcgacatcaggggcagagccatcttcatccgctgcaattagtggttcctctcgatcagttgctggagcggacagaagcagcgaggactactttgtgcttccagacactgtgctgactcgcagcatgcagctgcttctcgcaatgggcttcggctacaaccaggtcatggaggcctacagcatattcggcgaggatgtggactcgatggtctgctacctggtggagaccggaggagcctcggcaggtggtagcaatcgccggaaaggaaaggctgctgagtgatgtgtgcaccttcattgctgtgaatgtaattgatggaaaacgttgggcacaactcataccagataatgacagccttatgagttgagatgtcgatatacctgctaccttatgggtgatgaataaatggaactcacaactcttctcgatgccttctggtgatcaagttaaataattaatgatagttggtggttgggattctgggaaaatttgtgggtcaccctggtgctcattgtgatttttgtgggaaccgcgaagctcgtggtgtggtgtatgtggagtgtgaacattatctatatttttttcatctttaacaatgtctcctaaattcggttctctat

SEQ ID NO: 14503 - DNA, 921 bp, Zea mays
aaattgctatttccgccgccctgcccccctccaggtccaaactgttattgcgtttacattcttgatgctgctcgagaaggatgtgagatggactggagtaggttttgcagggaagtagggctgacacctgatatagccaccgcaattcgtcttgcaatctcaaaggttggatcacgtgagaaaatgaagccaatcaaagaggagctcccagagaatgtaacttatgacatgatcaagacattcctgactattgaggggtgtggattgtcagagcaagtctttggtaacggtaccgctgacggtgtctctagtagaatagcagagtcaccaatatcttcctgccgtgcaagtgaagcaggcggaaatggtgtcccagcagtggcagaggccagtgatgcaaacccttcagcaaagagaggtcaaactgtttgtgctgaggagccagcaacaaaactgcaaaggacagacgagcatggagctgagttaactggcacggcgactgctactgtagattctgtgctagatctggttgcgagctgcaatggggtatcgctggaggatgttgccaagcacttcaagggatccaagagagaatcggtcctggagatattggagggccttgaatctgaattcacaatttacaagaaaaacgggaactacatggtcctgtgacaaacttgcccgtgtagtctgggaaggggatatgcctcagctgtgtgtatatatctatctatcctatggtgggtgactttggactatggtagcaaagttgttggctggtgtgcatgtgctcattttggggattgggcagaactagcagatgtgtttggagttgggatcctttctgtcatctcgtataggagtatcttggactaaaaaaaaaaaaaaaaaaaactcgagggggggcccggtacccaatcg

SEQ ID NO: 14504 - DNA, 1192 bp, Zea mays
  misc_feature (6)..(6): n is a, c, g, or t
  misc_feature (12)..(12): n is a, c, g, or t
  misc_feature (24)..(24): n is a, c, g, or t
ctctanaactantggtcccccggnctgcaggggctcactagtccccccccccccccacagaaggtcctggatgggcgggattgcctcgtcgtcatggccaccggaagcggcaagtccatctgctatcagattcccccactggttacgaagaaaacagctgtcgttgtaagccctcttctgtccctgatgcaagaccaggttatgagtttaaaacaaaaaggtgtgaaatctgagtaccttggcagcacccaaacgaatagctccgtcagtaatgaggcagaaaaaggcacgtttgatgtgctttacatgacaccggagaaagccatttcacttccttcaagattttggagtaacttgcaggcttctggaatctgcttgttagctgttgacgaagctcattgcatatcagaatggggccatgatttcaggacagagtacaagcagctgcattcattgcgcaaccttcttgtgggtgttccctttgttgctttaactgctacagccacagaaagggtacgccaagatatttctacttccttggttctttgcagtcctcacgtggtggttggttcatttgatcgtcataaccttttctatggtgtgaaaacatgcaaccgatctatgtcctttataagtgaacttgtgaaagatgtttcaaagaggagtgatgtgggtgagtcaacaataatatattgtacgaccatccgggacacagaacaggttcatgaggctttagttacttctggaatcaagactggaatctatcatggtcaaatgggcagcagagctagagaggaatcccatagatccttcattagggatgaagttcttgtaatggtggcaactatagcttttgggatgggtattgataagcctgatgttagatgtgtaatacactatggatgtccaaagagcctagagtcttactaccaggaaagtgggcgttgtggaagagatggactgccttcaatctgctggctatattaccaaagaagtgatattacaaaagctgatttctattgttctgaggcaaaaaatgaaacccagaggaaagcaatcatggattccttcatggcagcacaaaaatattgcttgcttgctacatgccgtaggaggttcttattgcaatattttggtgaagaatgtgtttaaacacagtaaagttggaactgggaggggggaaaggagtttt

SEQ ID NO: 14505 - DNA, 2056 bp, Zea mays
ctctccccgcgtccgctcgtcggctggtccggccccagcgattcggtttggtgcgcctcgtggtccacgtgcgcgggctttgtgctctctcttccctctgtgtgtgtgtgtgtcagttcatcgggtaggttggtggcggcgtgagagatgaagagctgcggcgggggaggagcggacgggcagcagtgcccgtgcgactactgcggggaggcggcggcggctctgcactgccgcgcggacgccgcgcgcctctgcgtcgcgtgcgaccgccacgtgcacgccgccaacgcgctttcgcggaagcacgtgcgggcgccgctctgcgcagggtgcgccgcgcgcccggccgccgcgcgcgtctccctcggcagccgacccggcgttcctctgcgcggactgctgcgagggctgcgccgccgcttccgcggcgcgcgggccgggcgagggcttctcggggtgcccctcggcggccgagctcgccgcgtcatgggggctcgacctccgccgcgcggccgtggccgtgggcgacgacggcgacggcggcgacgacgacgaccccttcctctcggtgctcgactactccgtgctgggggtgggggtggccgacacggacctgcgcgacctctacgtgccgtgcgacccaccgcgggtgcccgtccccgacgccggcgcgcgcccgctcaggggcgaggcgctgtgcgaccagctcgcggagatggcgcggcgcgacgaggcggacacgtcccacgcgcacccgcactcggatctgagcccgcgcacgcctcgccgcacctccgcggcttccagcggacgcctgccgtcgggcaagatggcgccccccgcggcgctgccggtgccggctcatcctcctcccgccgcgccgcaggaggtgcctctcccgcacgcgtccctgctcatgatggcgtccgccaactgcagcgacctcattggcggcgccgaccgggtgggtgataccgacgaacaactgctctgggactgtgctgcgccctcggtgccgcccacccagatatgggacttcaatttaggacggtcaaggcatcacgatgagaaatctgctcttgaagttggatacggttctaaccatggaggctttatgattaagagttacagtgacatgcttaaggaaatttcttcggggacaacgaaagatctggaagatatttatgaatcaagatactgctcaaccgccgaagatatcatgtcctctaatatctgtcagctgtcatcgaaaaatgtgagcaccgggagcaacaaacggaaggtgaggtcatgtgctgcgtcgacgatggatggaccaacgacctccgggaaccacaaccacgtacccgcttcagcttcaggtccaggagcagcgctcaccagggagatctccttcggggatcagacggtgtccgcccccgcggccgagaccgagaggcctgccgccgtgaggatcgacagcgagacgcttgcgcagaacagggacagcgccatgcagcggtacagggagaagaagaagaaccgcaggtacgagaagcacatccggtacgagtcgaggaagctgcgggcggacacgaggaagcgggtgaaagggcggttcgtcaagtccaccgaagcactcaacgccgccaggtacaacggatgaggcagccatatatatatatgcatggcctgtgaagcccgcgagtttgctgcgcgcctgcgttattacgtgcggtagcaacggatgaacggggagctaggtactgctacctggaggtgctacgtatgtatggcgcggccggaatcgctacgcacgcggcccaagtttaattttgcgttgaagctatagcgatcgtggccattgttgggcagtcaactccagagattgcacggtactgcttgtttgtaacagacgaccctccctttccccttttttctctgttgttgccgtcatccccaccagaacagaaagtatgtagcttacctacagcaccgatttaccatgcatgcatgcatctggtcttaacgagctactacggtcgtcgtcgtccccgtgatgcgttagttcgcagtg

SEQ ID NO: 14506 - DNA, 2593 bp, Zea mays
cacctctctagttattcagaaattggaccttagctgcttgacgtatcagaaattcctgaaacgtttggctttgcacttctgttgcgtgttgctgatgctttattgttggatcttagaaatccaacaaatgtctgctgtatccaaagagtcagcttgacgactaacctgattggagagccaatcactgttgaagatccctgtccaggattagatgttgatgatgatgtggctgcttgtgctttgctagaattgagagattctggtaataacataatgaaggatgatggttatatggacattgatggtgttgacagcagaagtaatgtgaaaccaaggatcgtttgctcgtggagctgggagccacctgaccctgtcaggcgaggatgtgcaaggcttctattttgtttggatgatggagaatttcatattttggaatttactttggatgttgaaggggcgaagctgtacacatttgaatatattgataggactttgccttgtagacctcttttttggatgaaaaacagaatgataatagggtttgtagagatgggggacggcatgatttttaaacttggccaccgcaggttgcttcataaaagcactattcagaatgtagcaccaatattggatctagcaattgctgattaccatggtgagaaacaggaccagatgtttgcatgttgtggaatgtcccctgagggctctcttcgagttttaaggaatggtgtcaatgtggacagacttctgaaaactgaagctatttaccagggtgtcactggtttgtggactttgagaatgaaggcaactgatgcctaccattcttttcttgtgttgtcatttgtggaggaaaccagaatactgtcagtaggactaagttttaatgacatcagtgatgccgtgggattccagcctgatgtttgcactttagcatgtggtttggtggctgataatctgctagttcaaatttacagcaaaggtgttaaggtctgtttgcctacagtatacgctcaccctgaaggtgcccctttaacttctccaatttgcactgactggtatcctgctatcactatcagtgttggtgctgtaggacataatattgttgttgttgctacatctaatccttgttgcttatatgtccttggtgttagatcatcatcttcttaccagtacgagttgtatgcaacacatcatgtgcaattgcagtatgaagtatcatgcatatcaatcccacaagaggattgtatacatgataatgtatctttcagctgtggagagggtgatgacatttgtaagaacccccctcctaaagttaatgtttgcaagtttgctgttattggaactcatagaccttcagtggaaatcatctccttggaacctggagaagcattaagggtattaactattgggactgtatctgtgaataatgcacttggcgcacctatgagtggttgtatacctgaaaatgtcaggtttgttgcggctgagaggttttacattcttgcaggcttgagaaacggaatgctactcagatttgagtcagaaacacgtgattatctccctggttttctctacaaggactcttctattccttctgttaatacattccttcagttgatttcgatacggcgtattggaattactcctgtactgttagtgccaatacatgattcagctaatgctgacatcattgttctcagtgatagaccttggctattacatgcagcaagacatagcctggcatattcgtccatttcatttctttctgcttctcatgtcacacctgtttcatctgttgattgccccaatggtctactgtttgttgctgagagctgtttgcatttggtaagttactgtgaccagtaacaccagcaaaagaaatacatatatacatctgtttttcttccctagggatcaagaattatatcatgcattgagtgccctaagttactggacatgatacgagagtagaaatcaacagaactgaattccatgctagtaattatctaaatacgtatttgtactggctgatttttgttgcagctatcacattgaatgcaaagtgaattgaagtattagactaacaatagcttttccttttctctccttgttgcttttatctgggcacatttattgacaaacaatttggcaatgatgcatacttattttttctcacttgcagcaacaatttcaaggtaagttcatcaacttagggcttgtttggatgcccatgtattcacctcaatccatctgttttggggtgttccacaccaatccactcaacacacatggattgaggtgaatacatggcatcgaaacaaggcattaagttgtcagctttcctggccactaaacaccatttacagtattgagattgttctgcttttgttgaaagcagtaactgctcaactgccaatacgcgactatgcatttcggcctttgtttaagtggcccagagttgtgacttttaagtgttcaattttaacttcacttgattaagtctggaaccgttgaacttcacttgttacttgagttcagtttctccttttgttttaacaattcactttgaaagagtctgaattatgaaatgttc

SEQ ID NO: 14507 - DNA, 2533 bp, Zea mays
  misc_feature (1810)..(1810): n is a, c, g, or t
  misc_feature (2250)..(2250): n is a, c, g, or t
gaaaacagcgaaaatgcatgcaaattgcaaaaaaggaaatgatcaagtcgtttcggctcggcccactaagtctgctggacggccgatgatgtcaaatggtgaagcagaaagcatcaagggacgcctgattgttttaagcttggaggccgttgaaagtcctcgtgagagcagttcgtttattccaacttttaggtttaatccctcttcacattctggttctcctttccacgagattgttggatatacaactgaggaattttctagtaacagcatgtgcagcagtcctgatgagtttagctgcaaccagatccaagctgaacaaatgacagggcaattgagatcattgactcaatatatattgaatggcgcagttcttgctctgtgtccctatctagatcgttatgtgttggcagctgctggtaatatgatttatgtatttggtttcacaaatgaaaatccccacagaataaaaaagtgtgctgttggtaggacacgatttacaataacttgcctgaagacatttgcatcacgaattgctgttggtgattgtcgtgatggtgttctcttctattcttataatgagagtcataggaagttggaattggtctattctgatcctgctcatagattggtgggtgatattgctcttttaaattgtgaaactgctgtggtatcagatcgacgtgggagcatatctgtattatcatgcaccagattggaagtttcagaaagtccacagaagaacttagccgtgaattgttcattttatatgggtgaaacagccatgagcattcagaaggctgcattcaggtatcggcttccaattgatgatgatactgacccggtgcttgagacagtttacaactgtatcgtggcaagtaccatgttggggagtctctttgttatgattccactttcaagtgaggagcatcagcttttgcaagatgtccaagaaaaactctcagtacacccattaactgcaccggtcctgggaaatgatcatgcagagttccgtcagcgtggtaccccttcggtagtgcctcccattcttgacggtgatatgcttgtgcaattcttggagctcaccggtgaacaacagcaagccatccttactcatgctttgccagggaaggggcaacataggcccctctcggttttccaggttttgcaaacattagagcgcgtccattacgctcttaactgaggctttcttcaatcacagttactacaaggtttggatattagagctggttgaccttcattgtttgagatgccgtcagagctgaggttttagtgaccttcgcaatctagacggccgattccaagtctgccatgatatttatcagaacgtttgattgatgatgcaactggagcttgatactgggaagtctcatggtggcgagtatcccgtggaggcaccagattcgtcgaacctcctgtgtatatacagtcggccgcttttggtagactgttgtatggcgcattctgcatagaaacgaatattctttccgtttgtttcaatagataatgtaatgtttcttacgtcagctggtcggatgctcaacgagaaataagggaaacaatgaattgcattggccgtcctgctctaaaacaggccattactgattagtgatgaatgcatgcaccagctgccgcagtgatgatcttgccgcggcagctcctggtcagggacggcgcccacggggacgcagcgagcggtgatgtctggcagtgagctggttgctgaagagcacgactctggtagagagacaagctgttggttgcgattctcggcaaggtagaggcgtanagcagcttggggctttcatattgtgcaaacaggggggctacgcggcttttggttgtggcttgggacccctaaaaactaaaggcctgtttggttcgtgtgtaactttgtctaaaattagtcgtttgaattgaataactaagcttagataaaaaagttaggtaaaatatagtaagttaggcagtgaaccaaataggtcctaaatgtcaaactaaatgtcaaaccgtgaaccaaacaggtcctcaatgtcaaaccaaaaagttcgctgcttccgaaagtaggctttcggacacttgaaagcatctctgacattcttttagtgttttttttggaagaacttttcaaatattacttgcctgtcactaataagtaaaagaatattgtttcttttttttattgctccgaaccgacagctaaaacatccactcgtctatgactcctantcacagctaattttaccaagcagtttttagttttttttaatctataaccttttttacatccataacaatattttcacggccatagtacaagccatagtacaacgaacaaactttaagacttttttttatttgctactgttgccttgttttcttaatccctcttatctagatataatacgctttatctagatataatgttacacccgaaattaaggacaaattcgggtgtatctcgtatgcgcgccaaagcaaatccacacatataatgactcaatgtataaaa

SEQ ID NO: 14508 - DNA, 1575 bp, Zea mays
gcacgagaccattacctagaacatcctaatcgaaaagtcgttctctcgttctctctatctcctccttccgaaccctcgccctcccagcccccaaaccccaatctgtctcttccgctaggtttagcgtaattccatggccggcgccggtatccacccgttccagcagtggccacccacggcggccgcgccgcccccgccgggggccgcggcctcggtcgccgtccctcctccaccccccgtccccggcgcgcctggcaccgttggcccggacgaggtccgcaccatcttcatcacggggctccctgcagacgtcaaggaaagggagctgcacaacctgctgcgctggctcccgggattcgaggcgtcccagatcaacttcaagggcgaccagcccatgggcttcgcgctcttctccaccgcgcaccaggccatcgccgcaaagactgcgctccaggatatggtgttcgatgctgagaccaaggtggcgctgcacaccgagatggccaagaagaacctcttcgttaagagatgtgtgggaattgatgcaaatgctgtggatcaaagtaaacggttgcgaacaggtggagattatactcattctccttatgctcctccatttcatccacctccaccagctgtttccatgtggggaaccccaggttatatcacagcgccacctccttacaatccctatgctgcgtatccagtcccccctgtagcgatgacttcacctgctcctgttacaggaccaactgcctatgctcctgtgcagaacacaaaggataatcctccctgcaatacccttttcattggtaatctcggtgatactgtagtcgaagaggaattgcgaagcctcttcagtgtgcaacctggattcaagcaaatgaaagtgttacgtcaagataggaacactgtttgctttattgaatttgaggatgtgaatgctgctacatctgtgcaccaaactctgcagggtgctgttattcctagttctggtcgtggtggaatgcgaattcaattttcaaagaatccctttgggcgaaggaaggattcagctgctggccttgcgagcgttctaaatggagctcctgcaaattgattgcagcctgaggggatgtatcttgaactttagcatgccatcatggatttcatactaccacatcttatttatgatctgcatacttctgctgaatgcacgctctctcatgtggcatcatcatcttcatttggtggagtatctgggacatgatcatcatctatcatctttattaggtggagtttcaggggcatgatcatcatctggctgacattgcattgtcaccaaaacatgctggtgttacttttttttacattatctttgtagcttgtgaaggccatcctagtcttctagatgtgcatttggcgtttgtcatggacattacactttgtagtattcgtattatgtatttccctttgtgcagttgcaacgttgtgttttcattataatagttgatgtggtttcgctggtttactaaaaaaaaaaaaaaaaaaaaaaaaaaaaaaagaaaaaaaaaaaaaacaaaaaaaaaaaaaaaa

SEQ ID NO: 14509 - DNA, 2903 bp, Zea mays
tcttgacaggtctagcagtgtaaagtgtgagacaaccatttttctgtattaagttttttctctgctgcatgacaataacttgcatgattcatatttcatctacaaatatttgaggccagggcttgtgttataacaatatcaaactgtgactccttcaccctgtttctcttgctatgtctgcttggatatcattagttatgtgaacttctgataaatactgatagtttgctgaagcctatgtcactgcaattctctatctactatataaagcaccagtttcaatggtcatcccacgtcacccttcctgcttaatgcaaaaataaagtaaaattgtgcacaaatggaggtttgaaccttggttgttggctccacattcacacccacataaccaatagaacacacatatttttgtgtcttattaaaacaaactctactcatatgatatatagaaaccgtggcaatgcacgtgcaactgactagtttcatgatatgtatctgtatcattggttgggactcgagaaaacttgagaacgaagaattggattgacaattactgttggactcttggtataaattgccttaagaaattgttctttcagatatgtcaatcaagaatatttattgtttagtcattctacgaaattcctttcccacttattcaatttgctgtcaacattgttttatacctttattgaactgactcattggtgtatctctcatggtcaagtttcctttatgtgtatatggaagcataaagcttgattgtcacaaaatctttacatttggatgaaattagatgatcagttaattgctagaatattttattaccctttgaataatttcagtacatgaaatactatatagaaggcaaatcagcaaatgtttgcagcattattttgtaatgtagttgaagtttgtcttgggtctatggtgacaactgacaactcattctaagttgttcatattgaagattctaaaggttataatttattatgaaaaattaaaatttactatcgcagaacacaaaggataatcctccctgcaatacccttttcattggtaatctcggtgatactgtagtcgaagaggaattgcgaagtctcttcagtgtgtaagtccttgcacttctaacagcaacattctacctctggattccattttgcctactgggtttatggctgctgaatgttttggttctggttggtgcaactttttctcaatttcttgcaggcaacctgggattcaagcaaatgaaagtgttacgtcaagataggaacactgtttgctttattgaatttgaggtaagtagttatgggttttcagttaatatagtgagacactaccttcgtttcccaatcacatgttttaaagcttttctttttctcaggatgtgaatgctgctacatctgtgcaccaaactctgcagggtgctgttattcctagttctggtcgtggtggaatgcgaattcaatatcctttatttattcgaaaaaaatggattcttacattgcatcagacctatatctcaattttcaatttaatactctcttcataataacaacacacccatatacctattacatgcctacatgtttttatatcttagatacacacttccatcttgattctaatttggtttgtatcaaattttggcactccttaacatcctgcacattttcaaagaatccctttgggcgaaggaaggattcagctgctggccttgcgagcgttctaaatggggctcctgcaaattgattgcagcctgaggggatgtatcttgaactttagcatgccatcatggatttcatactaccacatcttatttatgatctgcatacttctgctgaatgcacgctctctcacgtggcatcatcatcttcatttggtggagtatctgggacatgatcatcatctatcatctttattaggtggagtttcaggggcatgatcatcatctggctgacattgcattgtcaccaaaacatgctggtgttacttttttttacattatctttgtagcttgtgaaggccatcctagtcttctagatgtgcatttggcgtttgtcatggacattacactttgtagtattcgtattatgtatttccctttgtgcagttgcaacgttgtgttttcattataatagttgatgtggtttcgctggtttactaacaattctgaaatcttggatgattcattccatcatgtcatggcattttgacgaggaaattttgtagacatggcatggcaatatggcatacttcattccatgcatgctggagcattgccatcatccccacgaagcatgtaatcacaacgttgattggtttgttcttaaatgttttcatccaggctgagaggctaacagggatagtaaaattgcaaaaaagtcgcaagctgtttcattcttttactacagtggtggaacaccgaagcgttgctacggtcccttttggaaagccttcttgttcttttcttacagtggaacgccttggttcttttgctgcagtggaacaccttcattcttttgctgcaggtgaatgccaaggcgtggctatgtactttttggttagagaaccttagtgatgctaaaatataagctaactgaagcttagtgatgttgatgagatgtaaggaacttatggatctgctgaggtgggttctagcttgactaggcaaccctttcggtttttatcctgccttgtaacaccaaggcatggttgtggcccttttgtttagagaaccttagtgatgctggtatgtaagccaacttaatcttagtgatgttgatgagataacaatggatccgatgaggtggtttatagcttgacgagttcttttgataaatgatgaaagctgagaagttcccttgacttttgcatcagatgaatgtttcatttttttc

SEQ ID NO: 14510 - DNA, 1874 bp, Zea mays
cagtttcagggacggaggtttggcagtacgggggcgtgaagcgttgccgtgcctgattggtgcggatgtgcgacgtgactgggataacagacacactcggactcggacgaaaaatcttgcgaggcttgacggggacaggattcacagctgacttcggtgcgtgccgaaagggacacgacagccattggggaagctctgcctctctctctctctctcactgacgcttcgtgttgatgacgaatgatgcaggacatggtcggatgtgattctaataaaattttaggactccaagcatgcccttgagtactttgcaggcagtttgcagaggatcgaaaagaagatgtgtttgctgttgcagtacaagaggaaaacacatacgtattaatttaccaagtcaaaccgaaaacatcaccactccataacatttagcgcaagaactaatggtacacagctacatgaacatatatctctactgggtcgcagccgatcgagtcgggtcgggagggacaccatcctaatactagtccccctcctccatctccatctccatctcctccgcagcaacaccggcactcgccacgctattcatttttttttaacaaggacggacggaagctggaaaggttcaagcacacgcacgtatgtacagacacgggctgccacggcgatctggccggcggctagggcctggcgtcgggcgcggcggaggcgaggcgggacgcgatggcggagtggtacatggcgtcgtggaagctctccgtctccatcatctgcacgcgcagccgccgcgccttgtcctccgtcagcacgccgaaccgcctggccgaggccgaggccgaggccggcccccgcggcagaggctcgtcctcggacgccggccgcgcgtcgatgtagtccggctgcccggaccaccccagcagcggcgcccaccacttggcgccgtcgccgacggggcgcgccctcgccgtggcagagcaagcgcagggccgggccggagccggcgggcggacggagaagaccatccctgatgacactgccatggatggaagttctggattcggacgagaaagaggtttgaggctgactgtgtgttgagtttgcgacctgcgggtggattgggattgggattgggattgcgagggcccgcccggcgcgggcctcccggggttataaagcgtgcgacaagaacggaggggccgagcccaacgagtggataaggtttcgtgcaggccaggcgagcggggccgcggcatgcgtcgtgcggtgcgctttttctcgagcgcgggccgtcgcttttagagcatgtatttcaactatcaagggctaaatgaaaaaacaaagacggggttttataagtttagaaacggttctagtcatacaatcaacacaaataagctagtcatataatcaacacaaataaatcgtattttgagaggttctattataaaaaaaatataagacttaaatacattagattatataacaaggtttttacgtatatttaatgctcagagaactataacctagtatcttacacatgtcctgggttgggccgatcgggatggggccggcttttttcttgcttttcggacaacttcgctgggacggtggctcgctctgcggcttctctgccgtcgggttcggggtccgtttcaaatacgcgggcggcgggcacaccgcctttttttttactctttagatcgtttttaaaaggaaatttgaaattaatcccatcaaaattttatttccaaatcaaggtgtcgctaatgtatactgtcaaaaaaaaactatgccacatcggtcaacgtcctactgactaagagcatctccaacaacgtgatctataaaaatatcttataatttaaaaataagta

SEQ ID NO: 14511 - DNA, 620 bp, Zea mays
actcctatgggcgattgggtttctcgaggccggccggggcctcgccgaaatccacaaaagggacttccgttccgtgctagcgcgcgatcgcgtcggcctccactccaccttcccgaaaaagcttaccctttgtgtttgtgtgtctgtctggcaatcgatcgatctccatgacgacgtccccgccgcgcgcacgcctgctcgccatggcgctggcgctggcattcgcctgcgtgctgctcgtcaggtccgcggacgccgccacgcccggcggctccgcgtacgggtgcaacccggccacggacaggacgtgcaggcccgagggcgtcggggtggtgctgcccgacggcggcattgacctcgacggcgacggcgacgaggacgagctgccgcagttcgacccacacttcacgatcctcggccatgcccagtgagtgtgagtgcaggtgcagctggctggttggtcatctcagtcggtgtactggacatgcgtcgtaatctctgtcgttcattcgacgcgagaggaattgaatgggcatgtatatgatggtaatctgttcactgttcaaacttgaaagcgcactgattcaagggcaaaaactgtgacgttacagcgcccgggg

SEQ ID NO: 14512 - DNA, 679 bp, Zea mays
ctccgcccgggagctcgacgcatcttcgccgccgctaaacgttccccccacgccccaacctatccacgcgaaaccttctttcccccgggagacgattcgtcagggagaggaaagaggcaagaggggccatggacgctgccaagttggtgacgccggtcgctgtgtctcacattctggcgcacccgtcggcgggctccgacggcgcagtgaccgatctcgtcgttcaggtcctcgacctgaagtccgtcggcacgggcagccggttcagtttcacagcaactgacgggaaggataagatcaaggcgatgcttcccaccaacttcgggtcggaggtccgctctggcaacctgaagaacctcggcctcatccgcatcatcgactacacttgcaacgtcgtcaaaggcaaagatgacaaagtcttggttgtcatcaaatgcgagcttgtgtgccaagcgcttgacgccgagatcaacggcgaggccaaaaaagaggagcctccaattgtgctgaagcctaaggacgaatggatgggcgtgacatccccactcgctatgaagcccaagcaggaggtgaagtctgcgtcccagatcgtgaatgagcagcgtggaaatactgctcctgtcaagcccctttccatgacaaagagggtccatcctttgatcactctgaacccctacca

SEQ ID NO: 14513 - DNA, 3549 bp, Zea mays
tggctacaatttataattcgttgcattttttgaggctctttctgaacctgagtttcttgcttatattgtattgtatagttaatgtttctccccctcctgtaatgcagagtgctggacgtctcttacgggcactattcgagattgttttgaagaggggatgggctcaactagcggagaaagcactgaatctttgcaagatggttgataaacaaatgtggagtgtccaaactcccttgaggcagtttactggaattcctaaggagatcttgatgaaacttgagaagaaggagttggcttgggagaggtactatgatctgtcctcacaagaaattggtgagctgatccgctatcccaagatggggaggccgctgcacaagtgcatccaccagttaccaaagctgaatctttcagcccatgtccagcccattactcgtacagttttgggttttgagctgacaattacacctgatttccagtgggatgataaggtacatggatatgtggagcccttttgggttattgttgaggataatgatggcgagtacattcttcaccatgaatatttcatgcttaagaaacagtatgttgacgaagatcatacattgaacttcacagtgccgatatatgagccgctgcctcctcagtatttcatacgtgttgtgtctgacaagtggcttggttctcagacaattctccctgtctgctttaggcatttaattctaccagaaaaatatgctccaccaactgaattgcttgatctgcagcctcttcctgttagtgcattgagaaatgcaagcccggtcggccccgcgtccgcttttaagcatttcaatcccatccagactcaagtattcactgtcttgtataacagcgatgacagcgtgttggtcgctgcaccaacaggcagtgggaagacgatatgtgcagagtttgctatactaaggaaccaccagaaggcattgtctggcgagagcaacatgcgggttgtttatatagctcccattgaagctctcgcaaaagaaagatacagggactgggagcggaaatttggagagtttgccaaggtagttgagctcactggtgaaacggcagctgatttgaagtttctggataaaggtgaaatcataatcagtactcctgaaaagtgggatgcattgtctcgccggtggaaacagcgaaagcacatccaacaggtcagcttattcatagttgatgaacttcatctacttggatctgataagggacatgttttggaagtcattgtatctaggatgaggcgtatttccagtcatattggcagtaacatacggatcgtagcactttcagcatcacttgctaatgctaaagatcttggtgaatggattggtgccacctctcatggccttttcaacttccctccagcagtgagacctgtgccactggaaattcacatccagggtgtggatatagcgaactttgaggcaaggatgcaagcaatgacaaagcctacctacactgccatcacacagcatgcaaagaacaataaacctgccctggtgtatgtaccgacaaggaagcatgcaaggttgactgcattggacttgtgtgcgtactctagtgttgagggtgctggaactccatttcttcttgggtcaggagatgagatggatactttcaccagaggtgttgaagaagagactcttaagaatacacttaaatgtggtgttggctatttgcatgagggtctaagtgagcttgatcaggaacttgtaacccagctgttccttggtgggaggatccaagtgtgtgttgcaagcagcacaatgtgttggggaagaccattgcctgctcatttggtcgttgtcatggggactcagtattatgatgggcgggagaatgctcacaccgactatccaattacagatctgcttcaaatgatgggtcatgccagtagaccacttcaagataactcagggaaatgtgttatattgtgtcatgcacctcgcaaagagtactacaagaagtttctttttgaggccttccctgtcgaaagcaatcttcaccatttcttgcatgatcacatgaatgctgaggtggtggttggtgttgtagagaataagcaagatgctgtggattatcttacttggacgttcatgtatcggcggctagctaagaatcctaacttctacaatcttcagggtgtaagtcacaggcatctttcagaccatctttctgagctagttgagactattctgaatgatcttgaatcgagcaagtgtgtggctatagaggaggacatgtacctgaagcccctcaaccttggccttattgcttcatactactatattagctacacaactattgagcgttttagttctatgctgacccagaagactaaggtgaaaggactcctagagattctagcatctgcctcagaatatgcagagcttccgggtcgtcctggtgaggaagaattcattgagaggcttgttcgtcaccagaggttctctatcgagaaacccaagtatggggatccacatgtgaaggccaatgctctgctgcaagcccatttttcaaggcacacagtggtcggaaatctggcagctgatcagcgcgagattctcctttctgctcataggttgctccaggcaatggttgatgttatatccagcaatggttggcttagtcttgctcttagtacaatggagctgagtcaaatggtgacacaaggcatgtgggatcgggattctgtgctgcttcaagttccacacttcacaaaagacttggctcggaggtgccaggaaaatgaagggaagcccatcgagagtatctttgatctagctgagatggctgtcgatgagatgcgggatctcttacaactatcgaactctcagctgcaagacatcattgaattcatcaagcggttccccaatgttgatatgacctatgaggtccgtgagggtgatgatataagcgctggtgacaatgtaacagtgcaggtaactctggagcgtgacatgactaacgtttcatctgaggttggtccagtccatgcgccaaggtttcccaagcctaaggaagaaggctggtggctggtgattggggacagctccacaaaccagttactggcaatcaaaagagtggcactccagaagagggcgagagtgaaacttgagttctctgctccggcagaggctgggagaaaggactacatgatttacttgatgtcagactcttacttgggctgcgatcaggagtatgaattcaccgttgatgtcaaggatgctggaggggattgatgatgaagactgtgacactatgtcgcatagaagtagaattgagtgtgtactgtaacgcgatattggaacattctgtgttgtaacctcgaacatgtggaagctgtaacaccaacgtatgtgttattgtactttgggcgttgctgtgttatcctattctagtattattgtaaggattacgctcggttacacttgagccacagtattttggatcaacttgttgcttctataagcttgctgatgctataatgtttgatcgacctgttgatgccct

SEQ ID NO: 14514 - DNA, 2870 bp, Zea mays
  misc_feature (2363)..(2363): n is a, c, g, or t
  misc_feature (2421)..(2421): n is a, c, g, or t
caataaacctgccctggtgtatgtaccgacaaggaagcatgcaaggttgactgcattggacttgtgtgcgtactctagtgttgagggtgctggaactccatttcttcttgggtcaggagatgagatggatactttcaccagaggtgttgaagaagagactcttaagaatacacttaaatgtggtgttggctatttgcatgagggtctaagtgagcttgatcaggaacttgtaacccagctgttccttggtgggaggatccaagtgtgtgttgcaagcagcacaatgtgttggggaagaccattgcctgctcatttggtcgttgtcatggggactcagtattatgatgggcgggagaatgctcacaccgactatccaattacagatctgcttcaaatgatgggtcatgccagtagaccacttcaagataactcagggaaatgtgttatattgtgtcatgcacctcgcaaagagtactacaagaagtttctttttgaggccttccctgtcgaaagcaatcttcaccatttcttgcatgatcacatgaatgctgaggtggtggttggtgttgtagagaataagcaagatgctgtggattatcttacttggacgttcatgtatcggcggctagctaagaatcctaacttctacaatcttcagggtgtaagtcacaggcatctttcagaccatctttctgagctagttgagactattctgaatgatcttgaatcgagcaagtgtgtggctatagaggaggacatgtacctgaagcccctcaaccttggccttattgcttcatactactatattagctacacaactattgagcgttttagttctatgctgacccagaagactaaggtgaaaggactcctagagattctagcatctgcctcagaatatgcagagcttccgggtcgtcctggtgaggaagaattcattgagaggcttgttcgtcaccagaggttctctatcgagaaacccaagtatggggatccacatgtgaaggccaatgctctgctgcaagcccatttttcaaggcacacagtggtcggaaatctggcagctgatcagcgcgagattctcctttctgctcataggttgctccaggcaatggttgatgttatatccagcaatggttggcttagtcttgctcttagtacaatggagctgagtcaaatggtgacacaaggcatgtgggatcgggattctgtgctgcttcaagttccacacttcacaaaagacttggctcggaggtgccaggaaaatgaagggaagcccatcgagagtatctttgatctagctgagatggctgtcgatgagatgcgggatctcttacaactatcgaactctcagctgcaagacatcattgaattcatcaagcggttccccaatgttgatatgacctatgaggtccgtgagggtgatgatataagcgctggtgacaatgtaaccgtgcaggtaactctggagcgtgacatgactaacgtttcatctgaggttggtccagtccatgcgccaaggtttcccaagcctaaggaagaaggctggtggctggtgattggggacagctccacaaaccagttactggcaatcaaaagagtggcactccagaagagggcgagagtgaaacttgagttctctgctccggcagaggctgggagaaaggactacatgatttacttgatgtcagactcttacttgggctgcgatcaggagtatgaattcaccgttgatgtcaaggatgctggaggggattgatgatgaagactgtgacactatgtcgcatagaagtagaattgagtgtgtactgtaacgcgatattggaacattctgtgttgtaacctcgaacatgtggaagctgtaacttattttgcatgttgaccggtgcactttgggcgttgctgtgttatcctattctagtattgttgtaaggattgcgctcggttacacttgagccacagtattttggatcaacttgttgcttctataagcttgctgatgcgatcatgtttgatcgacctgttgatgcactaatggtgtgttgatgttttaacctgttctattggcaggacaggcagtaggctagttcgaaaactcaaacctcatgggggattaaggccccgttcggttccctctcagtccattgtggtttgctcactatatttactcttataattacatttatctacttgtataatatttgctcaactagctttgtatagattataactagtaatgattgaatttgattaatatctctcgctaagtatgtatgtacatagatcaatgcaaactcatgaccgagcaactagaattgtttaaaggcttgcaagagtgaattagtgttagtgcaaagtagttnctttaacactacttttgtattaatcaaactttgttctagtgacttatgagtttgtagnataatttttataggctattcaccgcatatatccatctgtcttaccaactagtaagagatgcgctctgcagcggcgccatcctcaaggaggatattatccttcaagtgcatgatgtggaatttgatgaaacaagtggctttcaaaacgaatatgaaaatatagatgaaacgtgaggtatccaaccaggcaattccatgaaaaacataaaaattagtgatgtgaagccaatagaagtggaagatgataaagatcaagtgattcctccatcaagtgtgaaaaccaatgatcaacctagcaaaaatgggttctaatgaccaagatcaaattcaacaagtgcaaggtcaacacttggctagtccaactcaagtggcacaatcaagtaatcaaccaagctcaagtactcaatatcttgtccaatcggtcactattgcaatagatcatccattaga

SEQ ID NO: 14515 - DNA, 1261 bp, Zea mays
tgcagcttctgcatacacacacacactgccaagtctccatgtccggcgccacctgagtcctgagcctgctctctccgtctctctccctcccctccgtttccttggcctttttattcaccgcagccgcagcacccgtgcactaccacacaaacagacacaaaggtgaccaacgcttttgggagaagctgggcggtttcgttctccttcttgccgctggccggccggctggtggcaagctcgatcggtgtgtgcactctctcttcctcgttctgagcttcacagcctactatactttcttccagtttgtgtgtgccggccgcactgctaatgtttgatgccgctttctcgcggtgttatctcgcgcagagctaggagtccgatggaaggcacgatgaagcacagcaacgctgcggtaagttcaagaggttcccttcatgaatggcagcctgcttcttctcgcgcgcgcgcgtgtgtgtgatctcgcactcatggtactcatcctgttatctcatcagacggagaggagctctgtgaccgccaagccccgtgaacaggaggtgtccgcttggcatgaggaggctggagagcgtctggtttggacgccaggagcagcagttcagctgatgctttgtgcctagcactagcgtggcgttatcctaattgagcttttcagccaccatctttatcctttctcatattctccgtatcgtgatgcttgtggtttcgcaagaccaggtcttcttgaccttgcaagaccttttcttgaccttgtaagacccaactttacgatacatctcctctttgacctaatcttctctatctcacacctttctctccgttcttacttctcttctatgtctatcccttctgagctgtgttgagctacgctgataaagctaggtactatatataggttaagtgtttttaggaggtgtttctcatatgtgtaatgttgtgagcttgccgtgtgggaaaagaaaatccatatatttgatgttgatggtagctatagagtgaggcacgagacaaacaaaagtatgttcctgatgcgccatgagcacatgatgctcggccatgtgaagtaggcgcctacatgcaagctaagctatagctagctccgtatgtatcgcctcaatggaataagctggctatgtactgctgctcgaaacattttggatcgtccaaaaaaaaaaaaaaaacggcccatgtggtcctttgtagttactagtgacaactggtcgtttggctctgcaggcatgca

SEQ ID NO: 14516 - DNA, 908 bp, Zea mays
ctgctctctccgtctctctccctcccctccgtttccttggccttttgaggcgccgcagccgcagcaccggcgcactaccacacaaacagacacaaaggtgaccacttttgggagaagctgggcggtttcgttctccttcttgccactggccggccggctggtggcaagctcgatcgagctaggagtccgatggaaggcacgatgaagcacagcaacgctgcgacggagaggagctctgtgaccgccaagccccgtgaacaggaggtgtccgcttggcataaggaggctggagagcgtctggtttggacgccaggagcagcagttcagctgatgctttgtgcctagcactagcgtggcgttatcctaattgagcttttcagccaccatctttatcctttctcatattctccgtatcgtgatgcttgtggtttcgcaagaccaggtcttcttgaccttgcaagaccttttcttgaccttgtaagacccaactctacgatacatctcctctttgatctaatattttctacctcacacatttctctccgttcttacttctcttctatgtctatcccttctgagctgtgttgagctacgctgataaagctaggtactatatataggttaagtgtttttaggaggtgtttctcatatgtgtaatgttgtgagcttgccgtgtgggaaaagaaaatccatatattttgatggtagctatagagtgaggcacgagacaaacaaaagtatgttcctgttgcgccatgagcacatgatgctcggccatgtgaagtagctaggcgcctacatgcaagctaagctagctagctccgtatgtatcgcctcaatggaataagctggctatgtactgctgctcgaaacattttggatcgtccaaaaaaaaaaaaaaagcggcc

SEQ ID NO: 14517 - DNA, 2455 bp, Zea mays
cccctcgccctcgccctcgcccccgtccgccgccgagtgtttgggaagcgagcaagccgctcctccccatccttgttctacgattgccccgcgcgcatcccattcccacgtcgaagcggccgaggtagtcccggctgttgccagcgagcgatggcgagcaacggcatgtcgcttgtgcatcgagccgccgaggcggtgcgccgcacgccgcgatggaagaagaggctcgtcttattcgccgtcggagctagcaccttaacttacgcttgtcaagacaatcgagttcttcaaatttgtgatgggactggaaacaagaagaaggtggttatccttggtacaggatgggcaggtgcaagtttcttgagaaatatcgacacatctttgtatgatgtccatgtggtatcacctcgcaattacttcaccttcactcctttgttgccaagtgtgacatgtggcacagttgaagcacgtagtattgtggagccaattcgcaatatcgtgagaaagagaaatggttcatttcgattttgggaggctgaatgcatcaagattgatccaagaaacaaaaaagtccattgcagatcagatgttgggacaaacattaatggaaacggtgaatttgctgtggattatgattacctgattgtcagtattggggctagacctaatactttcaacacacctggtgttactgagaattgccatttcctaaaggaagtagaggatgctcaaaagatcaggaagagtgtcatgaaatgttttgaaagagctgcccttccaaatctttctgaggaagagcgaaagaagaaccttcattttgttgttattggtggtggcccaactggggtagaatttgctgcagagttgcacgattttgtgaatgcggacttggcaaagctgtatcctgatgtaaagaagtatgtaaacatttcagtaattgaagcaggaggtcatatccttacaatgtaagttcgttcgatgctttgtaacccattagatatctacttcggttaatctaattaaccgacagctatattgtggagacaccaaatgaaatggttagatgtgactttgctctcttctcttttttgcgaaaaacaaagtattatgtgatgtttcttatgtttatgcagctaatatgagaggttcgtgaaatatctcctgaatcagcttatatgtttaatacacctgttgccttctgatatcttagatctgttgcgatctttttataatattccatggtttatttaggtttgacaaaagaatcaccgaatttgctgaagagaagttcaagagggatggcatagatttgaaaacaaattttaaagtcgtgaaggtgtctgataaggatattaccatgaccaatcctgctacaggagaggtcgctgttccttatgggatggcagtttggtcaactggaattggaaccatgtacacaccaagttcaatatcaacatgacttttgcaggagaaccggcgtgtgctagctactgacgagtggcttagggttcaagggtgtgaggatgtatatgctcttggtgattgtgcaacgattgctcaaagaaaagttatggaagatgttgcttccatattccgagtagcagacaaggataactctggcactttaaccgtgaagaaaataaaagatgtccttggggacatatatgagagatacccacaagtggaattgtatcttaaatccaaccaaatgaagagcttccacgagctacttaaagactcagatggtaactccaaggagttgaaagaactgaacatcgaacagttcaaaaaggcccttgctcaagtggactctcaagtcaagatgctcccagcaacggctcaggttgctgcacaagagggaagttacctagccgactgcttcaacagaatgaagacgtgtgaacaatatcctgagggtcctataaggatcagaggtgcagggcgccatcggttcaaacctttcaggtacaggcatctcgggcaattcgctccactgggtggagagcaaactgcttatcaattgccaggtgactgggtgcatgttggacacagcacccaatggctgtggtattctgtctatgcaagcaaacaattcagttggcgcacgaggatgctagtcatatcagactgggggaggcggttcatctttggaagggactccagtagcatatgaattcaaatctcccgattttgtagttcacctgcgttctagatactacttgcatcagttttgctgtcccactatttccgaagcttagcctcgcaaggtttctgataccaaattttgaccttgccaaatgttttgttacctcgtcatgcacactgagtgattcagatgttatatacgtcttatcggatatttgcttttttatgtagggcactatgatatctagctataccgatactaattgtaagtttgagttattttggtcattggcaatcaagtatctatttt

SEQ ID NO: 14518 - DNA, 1165 bp, Zea mays
ccgggtcgggatgcgtgagatcgagtcccccccagaccttgtcgatgctttgaccaacgccggcgacaggctcgtcgtcgtcgacttcttctctcctggctgcggcggctgccgtgcttttcaccccaagatttgtcaatttgcggagcagaatccagatgtgctgttcttgcaagtgaactacgaggagcacaagtctatgtgccacagccttcatgtccatgtcctacccttgttcagattctacaggggagcacagggacgactctgtagcttcagttgtaccaacacaactattaagaagttcagggatgcacttgcgaagcacaagccagatagatgtagccttggcccaaccagggggctagaggaatctgagttattagccttggcggcaaacaaggacctgcagttcacctacgcgaaggaggaaccagaactgatccccaggggagatgctcctggggaggtcgttgctcccgagcctgcaaagcttcctgcggctccaaagcctttggtcaggctggggtccgaggagaggtcactggtctcgtcaggaagatgaaatgcatgagattatcttgaggatgattagatgcttccgttctgtatagttccgcggttcttggtgtgtacaggttgtagcttcccatggtagcagagtgcaggctaagattttttacatgtgaagcctgcccgcctgtcgtccagtagtttagctcggttggattagcaagtaccaatgagcggtgttgtggagctctgccttgaggaaatcgtgtggtagatgtatggatgattcgtctacatgctatttcgtcgaattctgtagatcaagtgtatgagtagctcttgtttcactctagcgttgggatctgtccgtcgcagaacagaataatcgatcacgccttatgttgtgtcagacattgtggtgcttagagatcattgtttgttgtgatagtattcgagtccgtgactagtttccttatgttgtatcagacactgtggtgatcattgttgtgataacatttgagttttgtggctagttcctgccttgccttcggggcagggaacggccgattgagaaactggtgatgcttcaatagcgttgttgtgatcttccaagggtctttgtgatggaataagaaatatgaggcttgccttt

SEQ ID NO: 14519 - DNA, 4273 bp, Zea mays
gcgagggtggttttgtcttctcaaggtcgcccttctgatagcgaagactcctttgggagtggactatctatgggctaccaaacctgcaactaatttgaagagtcagacaggttaattgaactatagtgtcctaatcacgaggacttaaaatattttatattagactttcatcacctagtataaattataatgtattattgtcatgtaatagaattgtagatcttaagttctgccttgttatatctctactatataaagcatcagtttccatcgtctccaccatcgttgtgcgtcaacacttttgaaaaaaacccttatatttcactgtaatcaactagtggtccttccattcacctcaaaaggcaactgttgcaacccaatctcgcatcgcatcttccatctcgttcaccaaaccctacccacctgctcccgtgtacgtgagcgcgcgagccacgccaaggatgacgataacctcatccaaatggccccactcgctccggtcgaagccgacgtgccaccgtgctcgaggtcgccctaggacagggaagagaagccaagcacggggcgcgcgccaccggccatgctttggcgtgcacctcctaccactccctttgcaggcggctgcactcgcagtcattctcttcgctatcgtgtccgccttgttgctccttgtcctcgtcctcgccgtgtgtgccttccgccaccatcgtggcaactgctaccacatcctatcgctcgaccatgtcccttcgtcgctgcctctcagcgtcaggctcttgcctgccgacatccgccgcctcctgagcttcgccttcccctccacgtgtggctgcaccgacgatgagactgtcatcgactctccctcataccctgtgtgacttgatgttgcacgcgtcgaggagcgaagacgtgtgatgtcggccttcacgcacgcgttccatgctgcctgcgtcgaccattggcccgtcaggacactcgtcctgcgttgtaaagaggaatagaagaggtatgatcccataaatctttaccatcataaagacttattattttgaattcctaaacttcttggttgcaacatgtttagattgatgtgttgtaacttctacttggaaccaatataatgattaagggctcttcgtccaaatcgtttgctagagttacttatcaaatatgacggtgtggtataacaccgacagagcattgtacttataaatatgaagaagaagaaaaatagacaagtacggaaaaaaacgagaacgagaccaagcgaattgggagcggcgcggcagccagagtcatctggaaggttcgatcgcctatcgcaatagaattctaaccgctgagttttggattatttttcttactctagggcacatattgtagtcgtcggtgcctaatctcggcagaaacaagattgatcacgcatatctgggccaggcttacccatgtcggtgtctaagaaataacacacagaggaattcactatcgcgacagtgacatccctctgtacgttatttataataatatttggatcaaaatatttataataatattatgtatttatatcgttatgtatctatgtttaatcacggattttgtcgtcatcattataatcatgttccgtgacatcgcacggacaagtacctagtataatgattaagggcacttcgtccaaactgtttgctagagttacttatcaaatatgacggtacaccgaaagagcattgtactataaatatgaagaagaagaaaaatagacaagtgtgaaaaaaaggaaacgagaacgagaccaagcgaattgggggcggcgcggcagccagagtcatctggaaggttcgatcgcctgtcgcctcgccgccatccattccttcccttgcgcccgaagaaagacacggaaattccccccaactgataaaaggaccatggtactcgcaaagcgataggaagccaccgaaggagagaattggatagcagagagtttgcgtgtgactgtggaagcagagatggggtccggcatgagccgcggccggcggcgcggtttcggcgcaggggcgtcgggagggatgctcccactgctggcgcttcaggttctgatcgagtacggccgcgcgggcgcctctcggccgcccgtgacggcggcgttgctcgccggcaacgcgctcatctatctccgtcccggggcgctcgacgggatcctgccctctgtcacacgcgtctccttcaatccgcggctcatcgtcgaggtacccaatcttacctactcatccgtagcgcagttagaaaacgaaattcctgtacacgtatcgaaatcccacccctgtttttctgttgatctgcgagaccgcgacttgcagcagacttgcagttgttgggggtatgtggtagacaagggggaagaataaccgccaccaataataatgagattggtccacttacaaatttgctactacaccatcgcccccaatgattccccatagcaaatcacacatataggcatagcacatagcagtgtattcagttgaccagttctaagttcgcaaactaactaactgtgatttaacacttttgcagaatggcgacttggtgcgcttcttcttgtcaccattctaccacttgagcgaaagccacctgttctacaatatgacatcgctcctatggaagggtattcagcttgaaacatccatgggtagtgtcgagttcgcttccatggttgctgcattgcttgggctgtcacagggcatcgcgctgctcttgtccaaaggcctactcttgcttggtgattatactgcgtactacgaccaatacgcggttgggttctctggtgttctgtttgccatgaaggttgtgctgaacgcctggtcagaagattttgtctatctgcatgggatggtcattccggcgaaatacgctgcctgggctgagttgatcctcatccaggtcttcattcctggcacatcttttcttggccatctcagtggaatacttgctggattggtttacctttggctgaagcgggcgttgaatgggccagatcccctcactcttctggtgtcaagcattaccaaagtcgtgacctggccagtaagatttgcgcagaatcttctatggtctgcccatccacagggacgctttagaggccggggcagggttgggcgccggcaatcagcaagagatactcctcgaggtctatggagatgcccagcctgcacctatgacaactcagtttccacagatatctgtgagatgtgcagcactgcacgagaggaccatgatttttcgctgaggcagtatcatcaggctggaggtactggagaactcacagttgatgagatacgccgaaggaggctgcaaagattcagtagatgatgtaaatccattgttatcagcacactttgtgcggcgctgaacgaagctctatatgagtatgtatgatagctccattcctctgctacatagcgtaggcatatttggttcttctcgtgatggagaatgctttacattattgagttgtttctcatttttgaaggagacagttactgatgtaattttaggtacatcaaagccatagaagtatagtaatacaaattatcaagggcatatatataaatgattgcgctaatctgtgcgccgcgttgtttattattcaaagatccgggcaaactccttactactgagcatgatcttactaccaactagaatctcatatgcactcacgtgtgtgtatcctgttgaatgaatttaatgcaagttgcggcacatttttagtagtaaatatccactagaatatgatctcgtagtactagaagataaaatttgctttgtttttttgtttcagccatggtttagtgatttgaagttgaagcgcatttgtaatttgaatgcactccaacagtcaatttaatatacggccgccatgtgatttcgctcaactataaaaaagagtaagacgagtgtttggtttgaggaactccaaaatgatgtggtgcatcatgaatttatctctcaaatttggtgggttggccaaattcttcatattagtactaactaagtaactatgagaattgagatggtgatggatcaactcatttcattccacaaaccaaacaaaaaaagagaggagtgagaagatgatgagttagctcattcctcaaaccaaacacattataaatagtttccactcgatgtagcataccatcaaatgattgaaccaatcaccaaccatctcatttattaaataagtttttgataattctcactgtagacaccaggaatg

SEQ ID NO: 14520 - DNA, 1523 bp, Zea mays
ccggccgggatagaagcgttaatcaaggggaacgagaacgagaccaagcgaattgggggcggcgcggcagccagagtcatctggaaggttcgatcgcctgtcgcctcgccgccatccattccttcccttgcgcccgaagaaagacgcggaaattcccccaactgataaaaggaccatggtactcgcaaagcgataggaagccaccgaaggagagaattggatagcagagagtttgcgtgtggaagcagagatggggtccggcatgagccgcggccggcggcgcggtttcggcgcaggggcgtcgggagggatgctgccactgctggcgcttcaggttctgatcgagtacggccgcgcgggcgcctctcggccgcccgtgacggcggcgttgctcgccggcaacgcgctcatctatctccgtcccggggcgctcgacgggatcctgccctctgtcacacgcgtctccttcaatccgcggctcatcgtcgagaatggcgacttggtgcgcttcttcttgtcaccattctaccacttgagcgaaagccacctgttctacaatatgacatcgctcctatggaagggtattcagcttgaaacatccatgggtagtgtcgagttcgcttccatggttgctgcattgcttgggctgtcacagggcatcgcgctgctcttgtccaaaggcctactcttgcttggtgattatactgcgtactacgaccaatacgcggttgggttctctggtgttctgtttgccatgaaggttgtgctgaacgcctggtcagaagattttgtctatctgcatgggatggtcattccggcgaaatacgctgcctgggctgagttgatcctcatccaggtcttcattcctggcacatcttttcttggccatctcagtggaatacttgctggattggtttacctttggctgaagcgggcgttgaatgggccagatcccctcactcttctggtgtcaagcattaccaaagtcgtgacctggccagtaagatttgcgcagaatcttctatggtctgcccatccacagggacgctttagaggccggggcagggttgggcgccggcaatcagcaagagatactcctcgaggtctatggagatgcccagcctgcacctatgacaactcagtttccacagatatctgtgagatgtgcagcactgcacgagaggaccatgatttttcgctgaggcagtatcatcaggctggaggtactggagaactcacagttgatgagatacgccgaaggaggctgcaaagattcggtagatgatgtaaatccattgttatcagcacactttgtgcggcgctgaacgaagctctatatgagtatgtatgatagctccattcctctgctacatagcgtaggcatatttggttcttctcgtgatggagaatgctttacattattgaattgtttctcatttttgaaggagacagttactgatgtaattttaggtacttcaaagccatagaagtatagtaatacaaattatcaagggcatatatat

SEQ ID NO: 14521 - DNA, 1173 bp, Zea mays
  misc_feature (4)..(4): n is a, c, g, or t
gccnggccgggcgccccgaggcacatcaacaacaaaaagatggcagcgccacctctcggcctcgcttgcagggtcgccggcgccttcaccaccccggccgtggcgcattccggcttcctcccccgacaccttgcccgtggtctcctcccttcaaagagatggagcggggtggtgaggatgggggcggtggtcggaggaggaaaggagggagaagatgacgaggagctgagacagaccaaggagcaggctgccgccaggaggcggtgggaagccctgattagggagcagaaaattaaaacccttacaccgagggaagctggctatacgttcaaactgacggacaaggttcttttggatgttaggccttcaaacgagcgtcaaaaggcttgggtgaaaggctctacctggattcctatatttgatgtggatgcatcggttgatctgggcggacttagcaaaaaagtcagcaactttgtaatgggtggctggtggagtggcagctcaacattgtccttgaataagaactttgtacagcaggttgaggagaagttttcaaaagatacagatataatgctagtgtgccagaaaggacttagatcacttgccgcctgtgaacagctgtacaatgctggttttgaaaatttgttctgggtacaaggaggccttgaagctgccgaagaggaggattttgaaagggaaggttcccagcctttcaagcttgctgcaattggagggatttctgaattctttgggtggacggaccagcaacgcgcgcaggctgcaaaggaagggctgggataccggctcgtcttcactggtcgcttggtcggagcattggtgctacttgacgctttgtttctaggcgcccaaaggatcggccctatgctccaagaaatgcaaccgcgttgatctcctccgcagaacgtttctgtagccaagggtagctctgcaaacgcgtccgcttgggttttctgcgtcgtaggctcgtagccctaatcatgctgtccgctgtgcaagtgtacatgtatgttcgcatctgggtcttctcggctgcggacaggcggtgcgtagtagattggctttgttgtaggcttaacgccattttttgtgtgtgcacatggcaaaaacaaacaaaaaatgtttatgcagaggaacagatgctatttctactcc

SEQ ID NO: 14522 - DNA, 702 bp, Zea mays
tataatgctagtgtgccagaaaggacttagatcacttgccgcctgtgaacagctgtacaatgctggttttgaaaatttgttctgggtacaaggaggccttgaagctgccgaagaggaggattttgaaagggaaggttcccagcctttcaagcttgctgcaattggagggatttctgaattctttgggtggacggaccagcaacgcgcgcaggctgcaaaggaagggctgggataccggctcgtcttcactggtcgcttggtcggagcattggtgctacttgacgctttgtttctaggcgcccaaaggatcggccctatgctccaagaaatgcaaccgcgttgatctcctccgcagaacgtttctgtagccaagggtagctctgcaaacgcgtccgcttgggttttctgcgtcgtagccctaatcatgctgtccgctgtgcaagtgtacatgtatgttcgcagctgggtcttctcggctgcggacaggcggtgcgtagtagattggctttgttgtaggcttacgccatttttgtgtgtgtggctgtgtgcacatggcaaaaacaaacaaacaaaaatgtttatgcaccggagcagattctatttctactccactctcgtaaaatagttgactttatagggttcaaattttgttctaaactaatggttattctcacctctcaatgcaattttatctttttctca

SEQ ID NO: 14523 - DNA, 1443 bp, Zea mays
taagtgaccaaagcatatatgaattttacaaacaatacagctagaaatcattctacacaaccgttccataaaaatcgaaagggcctatagactttcaattcaaatacgaggcgggatagcatatgccattaactgacgaggcagtggcaattttattgtcatttaatattatcttgttatttatgcatacagcatacttggatatcacaacactcaaggcccggagatcacaacactgaagcttcagcagttgacaattacagggacagatgcaaggacataaaacaaaggtacacactacacactgtgaaggctctactagtactgcattctcatttcttttccgattctgcgcagaaatgaatgtgccatttcacccttcaaacaactcgttgattttgctcttccactccagcttaaaatctgcagcatttccttttacagggttcttcaccctctccaagtatgcatggtatgctccagtaagaagcgcgagtatctccccacgaagctcttcgcgaagaactggactgggtactttccgggacatctgagtctggcaagtttcatcgaacgaccaagagaaattctgcacaggagtgggactgctatgcaggaaattcaagacatttgtcttgagccttttactaggtgtcatgccttttgcagtctctaaattggatataactggtccccatgacgcagacaggtagcccttcatgtgtttcttgaaacggtcctggcgttttccaatccacatggaccctaccatcaaccttacatctgaccgcttgacttcttggagtatgaaatgcgtgttgttcatcaagaacaagcactgtagttctctagaagaaaatgattctgtctgtttctcgagcactgaatccaggtcggcaatgagctcaagcagtagacgagctgttgggtttattacctcaactgtcaatagatgatcagtgtgaccatgtcctagcatggtatcaagtgaactcttatgcttcgtcagtaacctgatgtacctcatgaggtacgcagtgagtgacgtgatacctccatcctgctcctgcaccgctctccgtgagctataattctgaaccaagcttctgagctccttaactatctcagttgcagagtccttcagttttgcaagaagaccctctgcatctctgctgatagaatcagtgtagaatacatcccagagagcaggggtggcatccgtgagtgatgtgtacatgttcaacacagtgaagagcatttccggtgacttcctaacctgatggacgcagacaacggaagcaaccgtgaacagacggcgcaaaggcttttccgctgcttctaagaggccttcacgtgtaaatccatcacatgcttggctctgcatgagtcgcgtgcgcagtgtgttgagaatactgacgatgtactccagcaccgcaggccaga

SEQ ID NO: 14524 - DNA, 3546 bp, Zea mays
tggccaatagtgtcgggctaatcgggccggcccggagcacgacacggcccgtagtgcctgggcacggcacgacacgggtggagccgggcccgtgtcggcacggccctatggttagtgccgtgcccgggccgagtgccgggcacgctgggccgacacggacacgacccgattagctctaaagcacgattatgcatgattatacccaagcacgactagttagctgtgcgctgtactttttttcctatctagggttttctcacaatggtgagtttttacctcgataggtttttaatgagtcagccattgcactaaacagcttaatattagcaattttagtatgttttaactgtgtttgtgaatgtctgactaaaattctgtggtgtagtgctaaatgggcctaccatgccggcacgacacggctattaaacgggccaaacgggccgtgccctaaccgtgccgtgcctgactgtgccaaggccgtgccgtgccgggccgcctgtttggccatctctagcagcaggaaaaacaccttccggacccaagattttattgaattcagctctaagcgttcccaatcctctctttcttcccacctctgccatctcggtcgaggtggaggatccggtggccacgatatccacactcttcccctctcccccttccactccttccctgtacgctgcatcgcgagggcggcctgctcaatgccgcaagctgtcccgtttgcatcgcgagggcgatctgctcaatgtcgggagttgtcctcgtcgctagccatctttgccgaggtgggctagctcgccatctcccgcccgcgtgctctcgcgtcctcccgctcccgtgaccttttgctccgcgccatcctgatgtcggtcccacgcccgcgatcttgcgaactcgcctccgtgtacagcctccgctgtcggtcccgcgcccgcgatcttgcgaactcgcctccctgtacagcctacgccgctgcatacttccatcgccgacattcagccatgctcagaccgccgcgaccccgtccaacggagagtagagaaaatgggatgtggactggacctgcagagaagcgccatgtttcctagtttctcccaggaagggtgaacaagagttgggtcatctggagagagaatttgacgaatccactgtcggatcgatgcacaatcggttggttcctctcacaattgacgatcagattctagaggatgtgtcaaatggtactgaattccatggtaaggatgccttcactgcttacatgttcatttgattgtagctgtaacttcatcttacaacacaacacccccgacatgtattctggttctattgggaatgctaaaacgaatatcccagcatgtgagagtgtcgcgacagcttggttgtgtcaatttgttttttattgcttgtatttggccacatacttttttgttagttaaaaagaatagttataggtatggtgtgtaatctgaataactcttgttcttccttaaagtatattggaagattacgccctgtcattaccattgggttcaattgtctcactgttttatgcacaacactataatgatgtttttttggcatgcctgatccttttgaaacaatagattgattggtgattgtttgatgtcgcaatcacgtaaaaacctaatttgcagcaggggtgcagattttgagaacactatgtattctaactggaatttgctcgctcatataccttgttctcgtgatttgctctgctgtaattatatggccataatcaatttggatttggtttaccatgaaacttgttttagtttaacaataaatctaggtatattcttgtactggtttcagtttgtaatggtttaaaggtcatggatcaactttcataattcagcaataaatcattggctttatagtccaagattctttttttgctgccagatttctctgttcccaaagtttgttgtctctgtgcttggcagggaagatggctaccattgttactcgattgttcctgcgtgtccctgctatttgtttgacaggaaattgtgcatcgcattgttgtttgacagagaattggctaggttcactgtaattttaagttgcagggctgcacaatgaaagatcaggtttagtctacaaacagcacatgttcagtgtactctggaagttgctgttctgcacactcaaacacatgttcagtcaaacacaggttcagtctacattgcaggtttgggttagcagctgaaccttgtgcatgtatattctgttttttgtcaggccttgttgattaaagtgattagttttgtgtactctggaagagaaaccattcagtgcttactggtcacttattattattgttagagataaatttgtgcagccgcatagggcttctatgtttttggtatgattctatttatggtagagatagagcttgttgcccattaggttgtacccagtgcttcgtagggcaatggttaattttaccacatgcctcttcttctatcaggattgatctttacacgtacagtcaatcatataggctccttaacttgactgagttgttttgcttattaaaaattgcaaagtgttcctgttcaagttgggcaaacgcccccactcttgcaatactttggcccattgctaactcgagggaagctcaacgcctttcagtctcttgagctatctcgacttgtcgtcaataagaacaaaaataatcttctgaaaaattggtttgcagaagataagctggagggaagcagtgcagaagataatcacctgagttgttgcagtgctgagcgttggcgaagaaaagtaaacaagcgacgcaaaaaatgacatgtggacacccaactgcatcgtgcggtggctacgacagatgaaaaataaaaaagcgacctgtggacgtccagcgcgttagctacaagaaatgaaaaatcatgcgccacacgtcatgatatcaacaggcctgcaaaattattctggttgtttcttttgttctctaggaaaatgacaagatttatcaggtgcgtgtatggtctttccttcagcagtcacacagctgcaattgctgctagaaacaatgggattccagtgcaaattatttgacagtgaatgtctccattttttccttttcataattcacttatgccatgtgttgctcttatgctctctttttgtgtgactattatctcgcactgtaggtcaaacaatggacttcagaacacagaacaacaaaagatatccaagtatatcagcacacatgttacagaggctttccctgtgagaaaagcaggaaactttggtaacgaaaattgcaagttggatatttggttcggtgctaagtgtgaataccctacatgatgccttacagaatattgtgaaggtttctaagtctgttgattctacaacagcctcaagttttgcaccatcttcactataatgctgcaaaaccaggtttcaaggaagttgagaaatggagtgaaaatgctttgtggagtgtatctgagcttcaagttggcgatgagaagcagactggttctaacaaaaaaaaaaaaaaaa

SEQ ID NO: 14525 - DNA, 1596 bp, Zea mays
atctccatcccactggactcactccacgaagcggcgaagtctatctttttctcctcctgctgtacgtccgttccagcttgcaaagcgctcgcgagctgctgccatggcaggcgccggtgcgcccgcagttccccaggccggtcgcccagcccccaacttcaacgtcatcgtggtgggcgccggcatcatgggcagctgcacggcgcacgcggcggcgtctcgcggcgcccgcgtcctgctgctggagcgcttcgacctgctccacccgctgggctcctcgcacggcgactcccgcatcatccgcgacgcctacgcgcagccgcggtacctccgcatggtgcgcctcgcccggcgcctctgggccgccgccgaggccgaggctggctaccgcgtgctcaccccgacgccgcacctctccatgggcccgcggagcagcgcctcgctcgccgccgccatcgctaacatcggcgccgaggaggtggacgaggacgaccttcaccgcaggtggggcggcgccttcgccctcaccgtcccgggcccggtggacgcgtgggtcaccgcgctcagcgaccacggcggcgtgctcagcgccaccaaggcccgtggccatgttccaatcgctcgccgtcgcgaaaggcgccgtggtcagggacaacaccgaggtcgtcggcatcgacagggcgccccgagcccgacggcggcggcgtcgtggtgagggccgccggcggcgaggcgttccgcggcgccaggtgcgtcgtcacggtgggcgcgtgggcggccaagctgctcggctcctggggcgtggacctcccaatcaggccgctgcacacgctccacctctactggcgcgtgaagcccggccaggagcagactgtctcggcgagcgccgggttcccgaccttctccagctacggcgacccgcccgtgtacggcgcgccgtcgctggagctcccggggctcatcaagatcagctgcgacggtggcccgccgtgcgacccggacgcccgcgactggctcgcgggcgacgcggaggtcacgcaccgggtggccaggtggatccaggaggccatgccggaccacgtggacgccgcgggagggccggtcgtccggcagtcgtgcatctgctccatgacccccgacgccgacttcgtcatggacttcctgggcggcggccgggacgtggtggtcggggccggcttctcgggccacggcttcaagatgggccccgccgtggggaagatcctggcggagatggccattgatggcggctccgagacggcggaggaggctggcctggacctcggcttcttccggatcgggcgcttcgatggcaacccaatgggaaatgccaagaaggattgatgcatgtagttctaaatatggatcgatggtggtcaataatgaaagtaataaaacattcatattctagcatcgtaggctgagaatactttcttcatgtatggcacctgagaaactatcctcttccagattttgtatggtcagtcactctaataaacgatttgctgtattttaaacatcaaaaaaaaaaaaaaaaatacttcttcgtttcttcgaatcgaagaacgactttgaagc

SEQ ID NO: 14526 - DNA, 700 bp, Zea mays
  misc_feature (694)..(696): n is a, c, g, or t
gtcctggcgtggagctcgcgcagccgcctcgcctcgcctggggctcgcgcagccgcctcgcctggatctcgcgctagggttggagccagggtcctcacagccgcctctatcctcgcctggagctcgcgctagggttcctctcgcagccgccgctgttgaggtgctacttgcaaaagcgtgtactgaacagctcaaaaggccctgttgtacgtgcactgcgtgctcagactgataagagagagtatgcaatagagatgaagaacagtgtggaaagtatatgctgtaaaccttgcaggtccatatggtaaaggaaatcagtggcgaagtctatctttttctcctcctgccgtacgtccgttccagcttgcaaagcgctcgcgagctgctgccatggccagcgccggtgcacccgcagttccccaggctggtcgcccagcctccaacttcgacgtcatcgtggtgggcgccggcatcatgggcagctgcacggcgcacgcggcggtgtctcgcggcgcccgcatccagttgctggagcgcttatttgagaacagatatggtacccatagaacaatgatgtttttcagagttagattaacttgagttctatgcattttcttatttgagaataaatatgctacacttgtatagaacaatgatgtttttctaagtaaatactatcagtaattctggctgnnnaaaa

SEQ ID NO: 14527 - DNA, 2859 bp, Zea mays
tagtttgatttttttaaaaaataaaaattatacaatttttagcttcaaagtatatagtttttatttatggtttatgaattatataatttttatttgttctgaattataatttttaattatattctttgataaatttgtatttcaataaaatattacaagcaaagcaaggtggacagtgcacacaagagacaaactcctccagcaggggccccaacccaagcaaagcaatcttgtcgtttatcggacaggtcacggtcgcggccaccagttacgatcccatctccatcccactggactccacgaagcggcgaagtctatctttttctcctcctgccgcctacgtccgtcgttccagcttgcaaagcgctcgcgagctgctgccatggcaggcgccggtgcgcccgcagttccccaggccggtcgcccagcccccaacttcgacgtcatcgtggtgggcgccggcatcatgggcagctgcacggcgcacgcggcggcgtctcgcggcgcccgcgtcctgctgctggagcgcttcgacctgctccacccgctgggctcctcgcacggcgactcccgcatcatccgcgacgcctacgcgcagccgcggtacctccgcatggtgcgcctcgcccgccgcctctgggccgccgccgaggccgaggccggctaccgcgtgctcaccccgacgccgcacctctccatgggcccgcggagcagcgcctcgctcgccgccgccatcgctaacatcggcgccgaggaggtggacgtggacgaccttcaccgcaggtggggcggcgccttcgccctcaccgtcccgggcccggtggacgcgtgggtcaccgcgctcagcgaccacggcggcgtgctcagcgccaccaaggccgtggccatgttccagtcgctcgccgtcgcgaaaggcgccgtggtcagggacaacaccgaggtcgtcggcatcgacagggcgcccgagcccgacggcggcggcgtcgtggtgagggccgccggcggcgaggcgttccgcggcgccaggtgcgtcgtcacggtgggcgcgtgggcggccaagctgctcggctcctggggcgtggacctccccatcaggccgctgcacacgctacacctctactggcgcgtgaagcccggccaggagcagactgtctcggcgagcgccgggttcccgaccttctccagctacggcgacccgcccgtgtacggcgcgccgtcgctggagctcccggggctcatcaagatcagctgcgacggcggcccgccgtgcgacccggacgcccgcgactggctcgcgggcgacgcggaggtcacgcaccgggtggccaggtggatccaggaggccatgccggaccacgtggacgccgcgggagggccggtcgtccggcagtcgtgcatctgctccatgacccccgacgccgacttcgtcatggacttcctgggcggcggccgggacgtggtggtcggggccggcttctcgggccacggcttcaagatgggccccgccgtggggaagatcctggcggagatggccattgatggcggctccgagacggcggcggaggccggcctggacctcggcttcttccggatcgggcgcttcgatggcaaccccatgggaaatgccaagtagtgagctatgctgctgctgccatgcatgtagtactaaatatggatcgatggtggtcaataatgaaagtaataaaacattcatattctagcatcataggctgagaatactttcttgatgtatggcacctgagaaactatcctctttcagattttgtatggtcagtcactctaataaacgatttgctgtattttaaccattaacgtattctcaagtgatactccttcgtttcttcgaatcgaagaacgactttgaagcatagtaattgccacaatcaaaaggtcaaggcaatgttacgattctctgtgtcagcacccgtgtatataatggaaggcagatcactcttgaggatttgatggaggaaacttgggtaggcagtaggcgtacgcatctccgtgtcatgtgaggctccaaatcctagctctacgagactacgactaccacaaatccagagaatactgagcaaaaaaagaaaaaaaatgacagctgtgggatttgaacccacgccctttcggaccagagcctaaatctggcgccttagaccactcggccaaactgtctttgttgtatatttttatgtgtttgtttaataactattgcgagctcatcaagcacaacaaagtccacaaacgtgtgtctggcctgggtggtctaccaaactcgcatgtgaatcaaagcgaagaaaagtaccatgttttcattctagtatatgtttcgacaaatttaaaattatgacaacatagcgaattcatggtaatattttttttggttaaaacaatgttttataattttgttactacatatgttcacaaatatatgaaaccgttgaatttttttaaaaactttgacaactcgtcttattcaaaatatttattaaaaatgtaaacttttaaatcaagcacaaactaccttaagtaataaaaaaatcacaaaaaatatgataactcgttatttttttaataagacgagtcatcaaagttttttttaaaaaaaatcaacggtgtaatatatttatgaacggagtgaatataatatatatcaaccttttataataaaaattaagattataacaaaattataaatttgttgcaataaattttttaatgcaatggattacaatttcattgcactaaatatataaaccttatgcaacgacatttatttttacgacatcatagtgacttcatggtaacaaatcttttttaaacaacgccttacaattttgttgc

SEQ ID NO: 14528 - DNA, 3976 bp, Zea mays
  misc_feature (349)..(349): n is a, c, g, or t
gtaaccacggttgcttggcgctgatcacatacaggtaggcaacccaaccacatccactgtctttggcatgattgtattatgcctcatgaatatacatacagctgcacactctactgcctgctcagtgctcacatcagttttgatctgtacacttctaacagttagagtacctgtctgtgatttaaacaaaggctaacatcgaaaggccatcttatgtctcaatattttaatgacagactgcggcaagttatcatgctattgctattgctttgtctttaatggaagcgtactcattgagtgtccaacatgaaaagaccacgctaaggatacttcaagcaaagcttggatncgaggatcttcggacccaggtaagctgaaaaggctggcttggttatgtgtaattccacttagccaccaattttcagttaaatgatctacctttcttgttgcaccaaggaaatctaatagccatattttccacaggatgcttctgcttggctggaatactttgaatccaaggcactagagcagcaggaagcagcacgaaatggtactccaaagcctgatgcttcaatagcaagcagaggacatctgaggtagatgttgtaactgattatgtttgtgaaatattatcattcacgaaactaaactacaggaagaagtttttacttgatttgctaaagaatagttaatcttctaagtttctgtatggattttataggtgataacttgttgtatactggtgattgtttcctttaccctaatactgtcaaaagcagtgcgtaaaaaatatttatggaactgtgtttttaagtagatcatttgctgaaagtgttgatcttctatttttctttatcagtgtatcagatcttttggattatatcaacccggatgatgagctcaaggctaaggaaatgcaaaggaaacaagtccgtgctaaggtagggtcttccgttgagactatatcacatttatattccactattggtcattctcatacatgcacattatgaatcatagatcaaaggtcgcactgggcaaaaccaatctgaacttgttgatgatgaagatcaaaggagtcctgcacctaacaatgataaaaatttattaaccgagaatggaaactctggagtaaaagagaatggaacctttgttgagcatgtgaaagatgaaatatcaagtgacactgcaatccacatacctcaagatggttttactgaagagtgcacatctgatgaggggtggcaagcggctgttccaaaggggcgatccacagggagccgcagaactggtgcaggcacgaggaggccaaatctggcaaaaattaatactagttcactaaacagtgagaatggaagatacaaaggaagaggtatatctaacttctcttcccctcgagtttcacctagtgaggctgcagtttctattggttctagacctcttgcaaagaaattggctaagagttcaagcttcaattccaaagcagttagcactgccgtctcatcgaatactggtgagaattctttcaatctcaactccaagccagcaagccctgccattgccacagctgctgccaaggtgataccatccacaacaccaagtgctagtcaaacagtaaggaagtcactttcatacaaggaggtagcaatagctgcaccagggactcttgccaaagcatcgagtgatgtacacacagaagaaaaagatacaggtgaccaaggtgcaagtcctgaaagttctaattctaagtctccaaaagaaatcaatggtcacccttctggggagaaagatggggcaatagaagtgtcgccacaggatgatacttcacaggtatctaaatcacctgatggaggtaaacctgagcaaactgatgttttgattggttcaaatcaaccagatacagtacataaaaaatcctcagatccagcagagacatctgtagcaaaggacatagatcttccggccccggtcacatcatctggaacacaaactgaggctgacaccccaaatgatgaagcaccaactgcaattgaggcaaatgattcttcctccaatgacgatgaaagagattcaggagcagatacaccagaacaactgtctagtggaggtgaaaatgagaaatcttcactatctgagagtgaaaagaatgatacaccaagagaaggtgctaaagagacaacaagtaaactttctgctgctgcggctccattcaatccatccagcgtaccagcttttggttcaatggctgtcccaggtttcagagaacatggagggctattgccatcaccagccaatgtgccccctatgctgtccattcctctccgcaagcaccctcaccaatctgcaactgcaagggtaccttatggtccacgtctggctggaggctacaatagatcagggcaccgaggacttcgtaagaagcctgtgttgacaagtggtgaggcccctacagaaacaaacacgtctggccccaggattatgaaccctaacgccccagagtttgttccaggtcaatctcggagtcctaatggccatccagcatctccaaatggtcctttagcatctccaggtggtattccatcttcaccacaggaccttctatcctctccagatagtaccttggagtcaccagtaactgcatccccacaagtttctgaatgtagccagattagtcctgaaggagatgttgagggtgtgggtgtaaagcagaacatggatgacacgaaccacccagaaagtaaagatggtgaagtggagcctgagcaaaccaaagctcctgaaggtacagaagaagaggcgcagcggtaaaagatgctgctgaagagttgattgcagccgagcagcccaaatcctgggctgactacagcgatggagaggttgaggtcgttgaggttgcaagctaatgaaaatacgaccttctcagatagccaacacagagtggaatttttatttctcgaacagatgagcatttctccttctcaatagatggtgcatttttttacagtgcgggcttctcccgctgtattttctgctaaagaaaagatgctgcttttttggggatagactgaattgccttccagtggcattcaatgacctttgggacttgaaattttgaagactttccagaatgtgtcagcctttgggatttggcatttcttcatctatttttttgctgcgaagaattttggggaataagagcacctcaaagtatcagcaggggagatacggcgttaacatttcatcatttccccatcttgctcctgatttcccccccttggtgaatgtactgtcgacttaacgtctttcatagttatttctttgttacaataaatagactttttgaaccatgtataaaatataaagcaagagattttatctttccaaaaaaaaaaaaaaaagcccctagtatagcatcgaaaattcgagatcgaactaaagaaagcttcctattgaatttcgcttttaacactagctctgttggctcatttagatgattcctatgattcctgtggttgtcacctaacttgatctgtgataaaaatcaactggacttggagcttgtctgtggataaatccataaatgatacaatgataaatggtactccattcctatttatatttcatttgacttttttaccctaaagtttggctcgtcttattcaaaaaatttcataattattattaaacattaccgcgatatcgtttgccatataacatactttagtgattttttttatttttttcttaaaattttgaataagacaagttaaaattttgaataagacaagacaatcaaatttgatataaaaaagttaaataagttatatattaggagaaatggagtatgggtctgcgtttaggcttcgtataactgtataagataccatccgcattgccaattaccaaggtgtagattctaatgtatggaaattctaataaaaatgtgatgaaacagacaaatagcttttaaagggat

SEQ ID NO: 14529 - DNA, 4274 bp, Zea mays
taccaactttaaaacggagtaaaaacgaaatcacatctccagataggggtaaccatgtaatagccaaaaaaaatatgatcatgcatgttgtgcgttggcgaaagaaacggagctcttgatttgaccgacaccattgatgcacttcacgttgcagtgacctggtggtcgctgcaggaaagtatggaacgtataaacggaatacagtaagacaaatatatttttaaaaataaataaaataaatggaaacgggccgtgggcgtgcggccataggggcccgtggacctgatccatgtgactcacgtcgtcgtcgacacgctcgcgcaggcgcacccttcctttcctagttcctactgccatcggccatcgcgcaccgccgccgctctgcagggctgcgactcctgcctctggcagtctggcaccctgtctacgtttccgtccggcgtccgcccgcccgcccgcccgccaccatcgtgcctgcgtcaagcactcaagccgcccctgccctcggagccccgcgccgctgatccactccggaactcaagcatctatataaagcagcacctcaccaagcacaggaacaaacgctcaacttgaaagtcacaggacagcacacaccccacccacaactaccaaccttctccggaaggccaaatccccccgggccaagggaaacgagggagagagaccctccgcccctctcctctccctctccttccggtgaggcggtgagctatggagtcggcagcggccgcgaagacggtggagcggctggcgcagcgcctggtgccgccggcggagcccacccccactgccccccaccgcctgtcgtggctggaccggtacccgacgcagatggcgctcatcgagtcgctgcacgtcttcaagcccgacccggcgcgtgacgggctcagccccgcggagaccatagagcgggccctcgcacgggcgctggtcgactactacccgctcgccggccgcctcgccgtgtccgagagcgccgggggcctgcacgtcgactgcagcgctgagggcgtctggttcatcgaggccgccgtacggtgccgcctggaggacgtcgactacctcgagtacccgctccagatccccaaggacgagctgctcccgcacccgctgccgaggcccagccacgaggaggagagcaagctcatcctgctcgtccaggtacgcacgcccgcagaggcctcgtccggtcggttgattccagctgcattgtgtgggattgcgttgcttcgccgtggatttgggattctcagctctcagaccgctgccccgacgcgtacgtgcaggtgacggcgttcgcgtgcggcggcttcgtggtgggcttccgcttcagccacgcggtggcggacgggctcggcgcggccaagttcatgggcgcggtgggggagctggcgcgcggggcggacctcggccccgccgcgcccacctgggcccgcgacgccatcccagacccgtcgggcgcgctggtcggcagcctccccgagcccacgggcgccaagcgcctcgagtacctggccatcgacatctccgccgactacatcgaccacttcaagtcccagttcgcggcggccacgggcgggggccgctgctcggccttcgaggtcctcatcgccaaggcgtggcagagccgcacccgcgccgcggggttcgaggaccccgacacccccgtgcagctctgcttcgccatgaacgcgcgcccgctcctcggcgcccgcctcccgcggggcggcgccggcttctacggcaactgctactacatcatgcgcgtggcgtccacggccgacaaggtgtcctcgtcgtccgtcaccgacgtggtgaagatcatcagggaggggaagaagcggctgccgttggagttcgcgcggtgggcggcgggggaggagggcgccgacggcgtggacccctaccagatcacctccgactaccggacgctgctggtgtcggattggacgcgcctcggcttcgcggaggtggactacgggtggggcccgccagcccacgtggtaccgctgacgaacctggactacatcgccacgtgcatcctcgtcaagccatgggcccacaagccaggggcgaggctcatcacgcagtgcgtgacgcccgaccgcgtctcgcgcttccacgacgccatggtggacatgaactagcgccccgcctcgtcctgcgttcaccagccgccgtcgtctccgccggcctcccgtttgttcatgggtttcttgtttttttttctcctctcagttactgtggtaattattagttggtattacaattactaatcacattgctgccttaggacgagtggtcatctagaaaaaaaaaccgaagcaataaactactaatataaagagagaaaaagataagaaaggaaaaaacatgataataaagtgttgtacatactgcacaggcaggcaggcagccagctagagccaggtgaggtgaagaacagaaggagaggtatgggcgggggacagatagacacagctagatagtagttggcaatagtgggattggtattggattccttatttccgttggatgccttgttctcttttgttggtgtcgggtgtaagtacactgcatttttcttttcttcttgcctgttgttctttgggggctttgatcggagaaaggatcaaaactggacttggtgggaagccaccaactagtctgcccctaaataccataataagattgtatttgtaatatagtgttcaacttttgttttctgtctagtatatacatgaactacaagacatgtgagcttaagtctcaaaggaaggaaaaaacgcagtaatggttacatactgcatacagacagccctctgattttagcgcgtgaagatgtggcttccgctttgatgttggacgctggttgatgtgtgcaaagcctgttcggtacccggatattatagcgtggagttgtttcgtttttagtcgatgaaaccactacgttttttttatcttctctgcaagcagtgagtttgtagcttcctacgtgtaaaaaaaaatctattagacccatttgaaatgtatgaattttagaaccgaaaaaacaacatagaaaacatgaaaaaaaatctggaacctttaatgctgtgtctttacgatgaatttggtgaccgccgagcatagttctgtgaccgtgtccattggccaggtcgatttctagggctcctctgcaaagtcgtaacgactttccttacgaattcggtaaatttggcgcacaattcgagcgtccggtgaagagagcacgcacgcagacgttgaggcgtatagagcgtccgcattgacgaccacaccacccgtctcttcgccgtttggggaatggggatgtcgtcggtgtcaaagccagctagctggtaggtaccacgtgcggagcagagagcactgagcagtgggatggtcaggtccttcgtccgcattaaaataaaaataaaaaatttaaatgtgaacgtttttaaaataaataattaaataattaaataaatgtgttgtaggatttggcagtgttatcgcgacgagtcgctttcgtggtcaagcaagctatagcctgacgctggcgagaaggtttggtattagtgacgacaacactagtggagtagcgacgcggcaaaggcaggcgtggtttgccgttgccgaagagggttcggtgcgtgtggtggtttcgtaacgccgacggctccctccccatcgatcccatccatgtcgaatggacgacgcttcagtccgaccgacgcccatgcccatcgcgagcacattcggtacgtagtagaagtagcgtccacggaagctacaaagtacgtacattacaggggaagaaaacatcaaaacagtgtcgccggccggatggtttgagcctcgagcggggggttggtggtcggtcgttctcacgagccagcgttttgctgtgtgtacgagtatatatgtatgtatatatctcaagcccggagcttctgtttctcgtgtaaacaaaaatcttcaatccgtaatgtgtgcgtttgtggtagttgcgctccaatcaaatctgtcagaatccattttctgtttccggctgaatcacattcaatatgttccaaccaatatacgtgactttacctttgtccattgaattactcaaaagcctatgttaatcctacgagtaatgacctgttcttttttatatggatatctatgtatacataaactagttagttacccgtatattttttttcatttttatatatcatatatttagaccttgcttaaattaaata

SEQ ID NO: 14530 - DNA, 2797 bp, Zea mays
ggcgtcccctcgcccgccaccgtgcgccagccgccaaccctcccctcgtacccggagccccgcgccgctgatccactccggaactcaccatctatataaaccaccacctccccagggcccaggcacaagaaaccaacacttgagttcacttcacctctactacacaggacagcgcacacggcacaccccacccaccagggccactaccaggtcaccactcaggcactcaccaccaccgctctctcggaggccaaatcccccaagaccaagggaaaggagggagagaaagagaccgtcccctcccctcctttcctttcggtgaggtggtgagcaatggagccggcagcggcggtggagcggctggcgcagcgcctggtgccgccggcggagcccacccccaccggccctcacggcctgtcgtggctggaccggtacccgacgcagatggcgctcatcgagtcgctgcacgtcttcaagcccgacccggcgcgtgacggggcgagcccctcggagaccatcgagcgggccctcgcgcgggcgctggtcgactactacccgctggccggccgcctcgccgtttccgagggcgccgggggcctccacgtcgactgcagcgccgagggcgtctggtttatcgaggccgctgtgcggtgccgcctggaggacgtcgactacctcgagtacccgctccagatccccaaggacgacctgctgccgcacccgctgccgaggcctacccaccaggaggagagcaagctgatcctactcgtccaggtacgcgcacacgcacaggcggccgtccgtggattaattccatctgcattgtgcgggattgcgttgcttcgccgtggatttgcgactcccagctctctctctctctctctctctctctctctctctctctctctctctgacctctccgtgcaggtgacagcgttcgagtgcggcggcttcgtggtgggcttccggttcagccacgcggtggcggacgggctcggcgcggccaagttcatgggcgcggtgggggagctggcgcgcggggcggaccgggtctccgtggcgcccacctgggcccgcgacgccatcccggacccggccggcgcgctggtcggcagcctccccgagcccacgggcgccaagcgcctcgagtacctggccgtggacatctccgctgactacatcgaccacttcaagtcccagttcgcggcggccacgggcgggggccgctgctccgcgttcgaggtgctcatcgccaaggcgtggcagagccgcacccgcgcggcggggttcgaggacccggacacccccgtgcagctctgcttcgccatgaacgcgcggccgcttctcggcgcccgcctcccgcgtggcggcgccggcttctacggcaactgctactacatcatgcgcgtcgcatccacggccgacaaggtgtcctcgtcgtccgtcgccgacgtggtgaaggtcatcagggagggaaagaagcggctgccgtccgagttcgcgcggtgggccgcgggggaggaggacgccgacccctaccagatcacctccgactaccggacgctgctggtgtcggactggacgcggctgggcttcgcggaggtggactacggctggggcccgcccgcccacgtggtgccgctgacgaacttggactacatcgccacgtgcatcctcgtcaagccatgggcccacaagccaggggcgaggctcatcacgcagtgcgtgacgcccgaccgcgtctcgcgcttccacgacgccatggtggacatgaactagcgtcccgtccaccacggccttcgtctccgtcagccccccgtttgttcatcggtttcttgattttttttctctcgtctccgttactgtggtaattagcagtcggtaattagtaatcacgttgcagccttctggcgagtggtcaacaacaacaacaaaaatgcaaacagtaaactaatacgtatagcaataacaaaaaagatactaataacaaaggtggtggcgtacatacagacaagacaagcagccagctagagccaggtgaggtgaaatgaaggacaggaggagaggtatggcgggacagctagaatagttgttgggattggtattggattccttattttctttgggtgtattctcttttgtcggtgccgggttttttctcttttgtgctcctttctggttcttgggggctttgatttgaaggaaatatcaaagctggacttggtgggaagccaccaactagtctgcccctaaatactataatcagattttatttgtaatatagtagtgttaactcttttttttgggtcaaattgtatacacatgaactacaagatatgtgatcttgcaaagaaacatagcagtaatgggtacatactgcatattatttttcgcgtgaacatctgcatgatttattacgggcaatttttctatctctatttttttttaattttcactttaatttcgtttatatcttatatgttaaatttagaaccgaatcaattaaatcatgggcgagtcggttttcttttttacgtgagatcatttggagttggagcccactctataaattaggaagacaacttctaaacacaagacaaaaagataatctagtaggtcgtggtgggagagtttttttgtttctcggtagaatctactaggtctaggtgagattgctctcgacctcaggctaacttcatctctggcatcggctttactaaggccccatttggtttcattagctataggactaaactttagtccctagactaaactttagtctctagcctgtttggtt

SEQ ID NO: 14531 - DNA, 1798 bp, Zea mays
tgcatgcctgcagggctgcgactcctgcctctggcaccctgtctacgtttccgtccggcgtccgcccgcccgccaccatcgtacctgcgtcaagccgcccctgccctcggagccccgcgccgctgatccactccggaactcaaccatctatataaaagcagcacctcaccaagcacaggaacaaacgctcaacttgaaagtcacaggacagcacacaccccacccacaactaccaaccttctccggaaggccaaatccccccgggccaagggaaacgagggagagagaccctccgcccctctcctctccctctccttccggtgaggcggtgagctatggagtcggcagcggccgcgaagacggtggagcggctggcgcagcgcctggtgccgccggcggagcccacccccactgccccccaccgcctgtcgtggctggaccggtacccgacgcagatggcgctcatcgagtcgctgcacgtcttcaagcccgacccggcgcgtgacgggctcagccccgcggagaccatagagcgggccctcgcacgggcgctggtcgactactacccgctcgccggccgcctcgccgtgtccgagagcgccgggggcctgcacgtcgactgcagcgctgagggcgtctggttcatcgaggccgccgtacggtgccgccttgaggacgtcgactacctcgagtacccgctccagatccccaaggacgagctgctcccgcacccgctgccgaggcccagccacgaggaggagagcaagctcatcctgctcgtccaggtgacggcgttcgcgtgcggcggcttcgtggtgggcttccgcttcagccacgcggtggcggacgggctcggcgcggccaagttcatgggcgcggtgggggagctggcgcgcggggcggaccaggtgtccgtggcgcccacctgggcccgcgacgccatcccagacccgtcgggcgcgctggtcggcagcctccccgagcccacgggcgccaagcgcctcgagtacctggccatcgacatctccgccgactacatcgaccacttcaagtcccagttcgccgcggccacgggcgggggccgctgctcggccttcgaggtcctcatcgccaaggcgtggcagagccgcacccgcgccgcggggttcgaggaccccgacacccccgtgcagctctgcttcgccatgaacgcgcgcccgctcctcggcgcccgcctcccgcggggcggcgccggcttctacggcaactgctactacatcatgcgcgtggcgtccacggccgacaaggtgtcctcgtcgtccgtcaccgacgtggtgaagatcatcagggaggggaagaagcggctgccattggagtttgcgcggtgggcggcgggggaggagggcgccgacggcgtggacccctaccagatcacctccgactaccggacgctgctggtgtcggattggacgcgcctcggcttcgcggaggtggactacgggtggggcccgccagcccacgtggtaccgctgacgaacctggactacatcgccacgtgcatcctcgtcaagccatgggcccacaagccaggggcgaggctcatcacgcagtgcgtgacgcccgaccgcgtctcgcgcttccacgacgccatggtggacatgaactagcgccccgcctcgtcctgcgttcaccacggcctcccgtttgttcatgggtttcttgttttttttcctcctctcagttactgtggtaattattagttggtattataattactaatcacattgctgcctcaaaaaaaaaaaaaaaaggggcggcc

SEQ ID NO: 14532 - DNA, 3901 bp, Zea mays
  misc_feature (254)..(254): n is a, c, g, or t
  misc_feature (905)..(905): n is a, c, g, or t
  misc_feature (2363)..(2363): n is a, c, g, or t
cccttacattctttcaccattagtgcaactgaaataaataagggacaaaaggtggaactaatatggtttagttctttttagtcaccccttaagcgactagtactaaaacagtttagtctcagttttatttccacaatttaaatatttcggaactaaatgagactaaaatagagggactgatttattagtccctcaaaccagtcgtagccttaattcatgtgaacgacaccatctcattgtaggcaaccaataanaagcaggagggctaccggcgagaaaaaaatgttttagtcccctttagagcatgtataacctagagctacttgctcggttttctaagaaaatgtatcatacaacactgagccactagcatattaatgcagttaagagacaatatatatagaaagccgtgaacagatggactcctcgtgaagagtttgtttcttgattttttttcagttaaccccagagaccctaaagaaaccacctcaattaatagagttgtacatgcccttagcactcatttgagagactagatactaaaatcaattagtctctactttaatccttcagtttgataaaaaaactaaataagactaaaaactagggactaaccattaatccctctaactaaacagtgccaatttctccatgtgttttcgattagacttcgtctttgcctcatgaattgattatgcaaatgagtacaagagagacggttagtggctccccagctcggacagtaataaggttggcgcgatactaacttcatctacaaagcaaacaaaggcaaccaccttatcctttacgattcttgattatttataatatgtttggtttgaggttaaaataggataagatggaggcgacgacacgtctccacgattttttaaaatcacgccacnacagaaaattgttccggtgttcagctcgcaaacatggtcgtctcttccatcccatgttcaatcaaacatatccttatgttacggtcaaagtcatgattgatgaatgcctttaaattaaagaacaaatgacgttttcagttgctcacatctcatacagaaaactgattttatggatggaaactttttctttttcaattgcttcaaagcgataacccgaatttgccatttaaaagttcgaaccaacccatttggaagcttcctatcttttacatccaagctatatataaagatgcgctcacgtcattgggccgcgatgattgggatggcgataagtttaccatgttaattttttctttgtcatgataaagagctatggtgttgtttggttcacatatttataatgtgataagtaactaataacgataaatcatgtttgttcaagtccaacgtaatcatatgccacactagaaagtgatattgacttatttaaacttattatcactgatattcgagtaaaaatcattatcatgccatttacgttacatttcgtgaaaaccaaacgacacctatatactaccttcaatcaatttataatttgtttgacttttttactaagttatctggtccgtaatcgttagactttaatgtgatatcgtttaacatatgatataagttacctttaaattttttttaaatgaataagacgagtcgatcaaacttagtataaaaaagttaaatgaattataaattaggacagaaggagtagttcagattttgcatttccaaaccattcacattgaaaatcatagagcatctctaagagaggtcctaattaacaaagatgtattttaaaatataaggttttagaccatagaacgctatccaacaatggtcctattacattaaaattcatctagccattgtagggtctcaaatcctaaatataggatccgatatattcgatccctatcctcgtttctttttaatctataactatttattttttaataatataatttattttctaaatagtattatttaagacctaactgttgagataaaaactttttcaagaccctaaatattttaaatgcggtcttgtttcaatttttaggttctatcttagagcttcgtgtaatcctgttggagatgctcgagttctaccatgtgattggttgtacgagcgtctagcgcctggctcgttgcagcctgactggttggatacgcgcttagatcgcgtctctatggatgcaagaaaagatgtataatttggctatgattgcaccagcacatccaggctctgtttgttccgtacagataagcaaacacaggatgaggtctggtcaatgcatgtgaagagcctgattgatctcaggcaggtaaccaaacatgaggtatatgaatcagaccatcaggaaaagaaattaaaaggaaaaaactaatccccacggcaacaanacaaccaaccagttcaaccctgcaactgcaggggtattattgtcgcaggctcgcctataaatccctcttgcagccacagctattgacagaacgctcgccttgccaactgccacttcgccgtgagtcaaccactgatccaactcgtcgcgccatggccgcctcgaacgctggccccgaggccgcagccactgccgccggccaccgtttcaacttcgacgtcatcgtcgtgggcgccggcatcatgggcagctgcacggcgcacgcggccgcgtcccgcggcgcgcgggtcctgcttctggagcgcttcgacctgctacaccacctcggctcctcgcacggcgagtcccgcaccatccgcgacgcctaccccaaggcgcagtacccgccgatggtccgcctcgcgcgccgcctctgggccgaggccgaggccgagtcgggctacagcgtgctaaccccggcgccgcagctctccttgggcccgcgcagcaacgcctctctgctcgccgccgtcaggagcgccggcgcggaggaggcagacctgacgcggagatggggcggggcgttccgggtccccgacgggtgggtgaccgcggtgagcgagcgcggcggcggcgtcctgaacgcgaccaaggcggtggccatgttccaggcgctcgccgtcaggaagggcgtcgtggtcagggacaagacggaggtcctcggagtcaggaaggcgctggaggagggaggtgtcgtggtgacgacgagcaccggcgccgagttccgcggcgccaagtgcgtggtgacggtaggcgcgtgggcgagcaagatggtcaggtccatcgccggcctggaactccccatccagccgctgcacacgatggtcctgtactggcgcatcaagcccggccacgagcgggagctcgcggcggaatccggtttcccgaccttctccagctacggcgacccgcacgtgtacagcacgccgtcgctggagctgccgggcctgattaagatcaactacgacggtggcccgccgtgcgaccccgacgcccgcgactgggccgacggtggcggtggcgtggcagatcgggtagcccggtggatcgaggagttcctgcccgatcacgtggacaccgccggcgggccggtcacccggctgtcgtgcatgtactccatgacaccagacaaagacttcgtcatcgacttccttggcggcgagttcgggaaagacgtcgtggtcggggctggattttcagggcatgggttcaagatggcgccgacggtggggaggatcctggccgagatggccatgtatggcaaggagagcacagcaacggaggccggtgtcgagctcggccacttcaggatcaaccgcttcgagggtaaccccttgggaaacgccgggaattagcaactctgaggatccttcgttaaacttgctctgctaaaagcacccgattgatcgtgcacatgtaaaagagttaccaataacttagggaaatttggatatgtaccattaaaaatttacaattttaaaaacaaaaaaaaaaaaaaaa

SEQ ID NO: 14533 - DNA, 3607 bp, Zea mays
ccaacaccccctaagactaaaacaaagcttagcgagtcaaggacactgacctcacactcgcgggatgggcgcgtggtggtacatcgcggatccgttgttgacggaggagggagtgcgtccgtgtgcgggccgctcgccgcaacaaccatccatcacactggttaaacgcccctccatgtgtgcaagttcgtcgagaatgcgctgcattgccgcatccatggacgttaattgatcaggattgtaactagtctgatgccagatgttagcaacgcggaggtggaggacaggtaaaggatgaaaacaacatgaaggagaagaaaggaaaaaaacgtagacggaaattggtgtccatgtattgttcccgtttttcgatgtctctctcttctatccaacacacgcttatatcgaagtcttatagaccggcctgttagccaccacacaaccaattccagtcagttacacacactaccgcgcttctgacgtagtggacgtgtattggcgccctcttcctcttgcttcaactctgtcgaagccactgtttaatctccagtattttcctgcgtatatgagctaacaacatgaccttgtactgacagcatcgcatagcccgtatacatacatgtataaaaaaacgtctaaatatatagaaccacaaaaaaaaggtatagattccatgatgatgatttttttggtgaggtcgtggccgtccgacgaaatgttccctgccagagaaacatgtgtacctcttgttccacagctccaactcctccacccaaagaaaaatgtttgcacacggggagggggaggtgagagacggaggcatgatgaaggagcaggacgaccgaaagcaactcgtaggtgtatatgcataacaaataaaaaaaacaaaaactgagaaggaaaaaaaaacgaaaggagcaagaaggagcgacttgtgcgcgtcctccttttgaccacgcgagctcggcgacagcagaaaacaacaccatgaacattaaaaaatttcccttctttttctccctatctctctctccgtctctccaaacaaaacaaacgattgcgaaagccacacacggggacacggagagagatgagagagagtgatgactcgactgatgagagggagaggtgagggagagagaccatccgagctgtttcgtgccctcctccttatctctttcacagccccaccacaaaccgaaccccgcaccccggcttttctgcccgccatactccattattctcccttccccacctccctcgtcccatacctcctcccaccccacctcttcctcctcttccccactacggcccactctcgccaccgtgtggtccagacgtccagtcctctaaccgaaccaggaagcaccaggcagcggaagctcgcgctgggatcggctaccaacaataatatcgttccccgcctccctcacctctgaacgagaacgcgaacgcgccctgtgatcactaccccacagcatgtgctcaggacctcgcaagccgtccacaccccctctgccggcggcgacggccaaggactcctcggcgatggcggtgctgctggagctggcggcggcggacgacgtcgtggggttcaggcgcgccgtggagggcgacaaagccccagccttggacgacgcgggtcactggtacggcccgtccgccgcggccgccggccgcctccgcctgcgcctcgaggcgcgcactccggccatggtggccgcgctctacggcagcacggcggtgctggcgtacgtgctgtccgccgcgccggcggaggccgcgcgcgcctcgcccacggacggcgccacgccgctccacctcgccgcggccggcggcgcgccgggcgccgtcgcggccgcgcacctgctcctggccgctggcgcgtccgccgacgcgctcgctttctcgggcctccgcgccggcgacctcctcccgcgcgccaacgccgccgccgacagggaccgcgcgctccgcgtgctcctcaagtcccccgcggcgtcgccgtcgtcctcgcccaagaagtccgcctcgccgccaccgccgacggcggcagctgcggcgccggagccgaggaaggagtacccgcccgacctcacgctcccagacctcaagagcgggctcttcagcaccgacgagttccgcatgtacagcttcaaggtgaagccctgctcgcgcgcctactcccacgactggaccgagtgccccttcgtgcaccccggcgagaacgcgcgccgccgcgacccgcgccgcttctcctacagctgcgtcccctgcccggagttccgcaagggcggcgcctgccgcaagggcgacaactgcgagtacgcgcacggcgtcttcgagtgctggctccacccggcgcagtaccggacgcgcctctgcaaggacgaggtcggctgcgcgcgccgcatctgcttcttcgcgcacaagcccgaggagctgcgcgccgtcaacccgtccgcggtctccgtcgggatgcagcccaccgtttcgtcgccgcgctcctcgccgcccaacggcctcgacatgggcgccatgctcaacccggcctggccctcctccccggccagcaggctcaagactgcgctcgccgccggccgggagctggacttggacctcgagctgctcgcgctcgaccagtaccagcagaagctgttcgacaaggtgtcgtcgccgagggccggctggggaggcgggatgggctcgccgctgcccgccgcggcgcccagcaccagggccgtgccggactacgcggacctgctcggctccgtcgacccggccatgctgtcccagctgcacgcgctgtcgctcaagcaggccggcgacatgccggcgtacagctccatggcggacacgcagctgcacatgccggcgtcgcccatggtcggcccgaactccgcgttcgggctcgaccactccatggccaaggccatcatgagctcccgcgcctcggcgttcgccaagcgcagccagagcttcatcgaccgcggcggccgcgcgccggccgcgcgctcgctcatgtcgcagcagcccaccgccggcgcgccgtccatgctctccgactgggggtctccggacggcaggctggactggggcgtccagggcgacgagctgcacaagttccgcaagtccgcgtctttcgcgttccgtgggcagtccccggcccccgcgccggctcccgccgagccagacgtctcgtgggtgaactctcttgtcaaggacggccacgccggcgacatatttgcgcagtggtcggagcaggagcagatggtggcctaatctatcgaccgtcactgctggctcatagcatctagctgaccaaagttcattcctttccttcaattgttttccccctttgtttgcttaattcgattcatatgagatgttttttactagtacatatatataggacgttctataatatttgttcatcaccaaaaagcaaaatggaggcccacgcggggctctgtattggatgaggaaggaacccccagtattttacttgtacgaatttataaatattttttatatttatttaaaaaaaaaaaaaaaaaaaaaaaaaaaaaaaaaaaaaaaaaaaaaaactcgagaggggcgcggtacc

SEQ ID NO: 14534 - DNA, 2915 bp, Zea mays
  misc_feature (646)..(646): n is a, c, g, or t
tgcttgagtgttgagagcagcaccgttagagtgatgtactgacatggatgatttcaatcgtgcggcacacggaactgttattggccctgtttggttttcgcttataatctgtttgttgatgcaaataaatgagaatcccaccaaacacctagccatacagggtgaaatgggttatatgagaggttttggttattgcaaaatgatttagattagtccaattcatgttctcttggacatattgatcttagatagggcaacgactgatgtgcaatcatgcagactttagatgtaagtgtgcaagccagtcttctggtccattaaattatgatctaaccatatatcacatttaacacttaaatcctttcactagagctcgcgaagatttataaaaaaagctaacaaacaacagttatatctaaggttggatcatgattctaatggatattgcacgcttacacctaaaacctgactgcatagtagctgttgtccttagataatatgaatgactctagagtagagtacacagaatatatagacaaattattgaggagtaaaaagattctaaaaataatctttatgtaaatgaatctctaaacaataatttaaagagaattttaaaaagtcttttagattaatctaattcgcntcctcttggacatattgatagtttcatatacagcgaatgattcttgagtagagcatgctgaatacagaatgctagaaaaaatattgaagagtaaaaaaaaatacaaaaataatctttatgtgaatcaatccttaaatgacaatttaaaaagtaaattttagagatgttcgggtgttcctgctatggtgttctcgtggagtcgtagtacatcccggaaattgcgctggttatcgacccggcgggacgtcttacctagttacctttaataaatgaagaaaccacgaaggcacgtagtggtacagtggcacttttctcccgaatgaacagctaggtagaggtaaagcgatttgattttgacatccattttatattcctaaaaaagcgtagcttatgtttaacaagatcgtagactccatccactgtaaatagagggtacatctctcattttatacaataattatagtaatcctattttgagatgagatgcgctaacagtattttatataaatatatagcttaatttaaatcggtgactggtcgaagaacaaaatgtgtttttttacacatggagtaagtgatctaacgccatactgtacctcagggaagcggttggtaaaaaggggggaaaaacattcgatcctgtaaatcgccggtcgtcgactatgcattacagctcataactggctggcgaattactcagattaccaggtacgaatccagtgaagcagcgcggactgacgagtctgcgtgcaggccggagctacgggctacgggctacggtgcgggcgaaacgcaaaaaaaaacgaggggtggatggacagtctcctctcggctcctgggtcctgggcaaaaccgtgtgggaaaaaccgaaaacgaaaacagctgcgaactcatcctgggaacccaggaattcgctcgccggatcgagcaaggccacgacaggtgcgaggcccccacgttcatcacaggtaatacagccacggccggctggccgcatccccgtgccgccgtcctgctcctgcccatcaagcagacgaagccaacgcctccgggctcagtagcatcccgaaaatgtgaaccggcaggtccgtgggtgccatagccaccttcgtcctggcgaacgggccccacatgccacgcccaatcatgtgcctgctgcctccagcagtccagtccagcttaacgcgggcggcgcgagcagctgctaaacgcgttcgcttcctcctcccgcgcccgcgccgctgcaaaccggagcgcgcaagcaacgccagccagccgggcagcccccacagctcctatatatattctccccctccccccccgccgcgcatctcgaactccgaaacaaagcaatcacccgagcaaagcagtgcggagcgacgatccagcggcatttcgcattcgacgaacgaagcgccgccatctgatccgacacgcagcgcaatggcggcgggactgaagaggccgtcgttcgggacgcgggcgtggcggctgctgcggctggcggtgctgtgggcgcggaagggcggcgcggcgcacagcctgcgcctgcgcctgctccgcacgctccgccgccacggccacggcctcgccggcctgggcggcgcgcgcggcgaccggctccgctgcggcgagcgcgagtactccatcgacgagacgccggcgttccggttccgcaccccgtccgcgcgcgtgctccgcctcatcccctgcatcgcgccggccgtgccggacacgccgggcctctacggcgacgaccgctacttcttcagcgccgccgccgccgcgtgggagacgggcgagggcgccgggtgctgctacggcgacgtcgacgatgatgaggaggaggacgacgaagagccgagctgctgcggcgatggcgagatgctgctggagcgcgtggtggcggaggcctgccgcgcgagctcggccggacggtcggtggcagcggacagcggcgaggacgccggggtggacgtcaaggcggacgagttcatcgccaggttctacgcgcagatgaagctgcagcgccagatctcgtggctacagtacaacgagatgatggagaggagcatcagctagatttatttcttcgttcattcttgcttactactagtactaccagcgattgagcttgagctctgtacatttgctctaaaatttcttttgttgctcccaaaaattattattactacaatacatatacatgatacaattttttttcttcaaaaaaaaaaaaaaaaatccttccacgcgtcccggcgcttgt

SEQ ID NO: 14535 - DNA, 2077 bp, Zea mays
gtcatgtccattttgaagtgcgagttgtcatcttgttttatataacagagaatcccttgcctacgcctccaaatcgtcgaagccgcacatgaggaccgtaatgacaaatttctctccaacgagaggccgccaactcacattccgtccctcgcggccgaccgcgaggccggcccgattccccgttcccacacccaccgtaaaccctagctgcgagctatggcccgcaagcgccaggcgccgccgccgccgccgccgccgccgccgcaggaggaggaggatgagtcatcctccgaggaatctggctccgaagaggagtctcctcgcctccccgagctccgaaggccctcgcaggccgccgccgccaacaacgccgactcgtcggacgcggactcggattccgacgccgacgtccaagccttccagatgcgccaggtgccccgcttccccaccaagcagacacacccagtctctcacccagaatccggtgccgaagaggaggagggcgagttgtcagagtcggagcacgagaacccggtgcctgtggttcagaagaaggccgtggcggcggcagggatgtccaagacagggcaggagaggaagaggcccgcctcggatcctgctccaagcgggaaggcaaaaaagaccaaggctgaggctacccctcctgctaaggcgaagaagggagagaagctggcgcctgatgcgactcctgcaggaaaggcaaagaagggcaagaccgagctagagacactggcacctgatgccactccagcaggaaaggcgaagaaaggtaaggtcgagaagacagctcctgaggccactccctcaggcaaggggaagaagggtggggacaaactggagaagccagcagcgctcgatcgctcaccttcagacagcaagtctgaaaagcttgcacatttttcccgcacatgggagaaagatgatgagatgaagatcttggaggctctcgcggcccatgtcaagagtgagggcgtgctgccgaagactgattttcttcttgctagtgttcgtgaccgccttgtcaggaagaactgcaactacacggatatatatgagaaggtacgaaggctaaaggagcgctatgaaaaattggtgagcacgggcactgtaccgagtaaagaagatgagctccagatgtataatctctctaaaacaatctggggagagaagtcaaaggaggctactgctgccattacgtctcaaaaaggtggtgctgtgacaaagcgtaagaaggggcaggctaacaaagagaagatggatggaaatgcaaagagtggtgtggcaatggaggctgcccatagtactgccaatcaaagtggcgattctcataaaggaagtaagaaggggcaagccaggttgtcagacgacgctaccaccactgtatccccaagtaagagtaagaagcaggaaactcgtaatgaggaattggacaaagatggtggtaatttggccaagggaaagaaggggaaaacagacaaagggaagatggacagagacacggataatctgacaccaaaggaaaccataaatgaaaatcagaatggtgacattctgattaggagtaaggaaggagaaattcatgatgatgaaacaggagatgctaatgtgcaaggtgtgcgcagaggttttgataagctgcagaagttgtattccaaccttgctttttatgtggaggagattgaggcccatcatccatgtggggagactctgaagagagcatttgagttcattgctgatgagaaggcagaaggtctggaatccaagatcaagaagcaaagagtagcagaggcgaaggcggaggtccgtcaaggcgacgtaaagaaggaggttcttaatttgctgctcagcttagtggactaaacctttctggattattgtggtataacattctacttgagttatttagtttcctcttgatgtctggtgcattattattgcccaatttgtagaattcataggttcaaaacttggatttcacatttgaatcaattaatcagtggttctaaaaaaaaaaaaaaaagggcgagccgcgccgcacactccggttcggtacggt

SEQ ID NO: 14536 - DNA, 1769 bp, Zea mays
ttgcccccccgccgtatctgcagttctcgacctctcctcctacctcctcttcactccccccctcccttcctccctcttgcatcactatcaccaccaacaacaaggctaacgcacaccaatccaacaaggagaacaaaaaacaattaatcgtgttttgatatcacctcgttcgagttaagtgcgtgaagaggtaataatggtggcagtggaggttgtgccggcgtccgcggagtccccgattccgatcgaggctaaggccgcggtgacgtcggaggcggaggcggaggccgagggcgaagtggaggcggagatgaagggtgatgcggcagccacggcgggagaaacggaggaggaggaggaggaggaggagaaggtgtacaagagcgacctgaagaagctggagaacctcatgtccaagcttaacccctccgcgcaggagttcgtgccgtcgtcgcgccgcacggccccagccgccgtggcggcggcgaagccggcgggaggaagggtgctctccgccgacgcgcccgtgttcgtgtccgccgccgagtactacggcgctgccggcgggcacctggagataggcggcggcggcggcaaagtcgtcgttggcggcgggggcagggactccagcagcgacggatccagcaacggcggcggcggcggcagtcgccaccaaccgaatcgccggaggaggaacagcttcaaccacgggaggcggaggggggccggaggccggccccggcggggtgatagggaggacagcgtgcgccggaccgtctacgtgtccgacattgatcaacatgtgaccgagcagaagctcgctgaagtgttctccaactgcgggcgagtggtagattgccgtatctgtggcgacccccactctgtcctacgctttgcgttcatcgagttttctgacgatggtggcgcaagagcggcgctaacactcgcgggaaccatacttggctgctatcctgtcagagttttgccttctaaaacagcaattctacctgtcaacccgaaatttcttcctcagactgatgatgagaaagaaatggtatcaaggactgtatattgtactaacatagacaagaaggttacggaggaggatgtaaagggtttcttccagcaagcctgcgggaaggtttctcggctgaggctccttactgacatagtacactccacatgcattgcttttgttgagtttgctcaggctgaaagtgcaattatggcattaaattttagtggtatggtccttggctcacttcctatcagggtgagcccttccaaaactccagtccgtccacgttctcctcgtgtgatgtccaattgatcaggctgctaccaatagcaaatcatcctaggcagagcttattgtagctatgatcgccctagaacccacttcacggatcaatgacgtcgttgtcctgagagtgtccaagtcagtcataggaaaccaacttgttgccaaatgctaatgtttttctgtttgccagatccatgcaccatttcccttctttttttcattcccccttatgttaattatgaacataattgtttataatcgcctttctcaggcatcagaataagaatgaataactctggcattttttgttgttgtaaaaaaaaaaaaaaaatttcattgtatttttttttacctcattttgactgataggcatgtgcagtttatttgtgttggtctgcactctgcgtggatacatagggcatgtgtttctgccgttgttttggctcaaaaagtggtgagttttggc

SEQ ID NO: 14537 - DNA, 1693 bp, Zea mays
gccgtatctgcagttctcgacctctcctcctacctcctcttcactcccttcctccctcttgcatcactatcaccaccaacaacaaggctaacgcacaccaatccaacaaggagaacaaaaaacaattaatcgtgttttgagcttttgatatcacctcgttcgagttaagtgcgtgaagaggcaataatggtggcagtggaggttgtgccggcgtccgcggagtccccgattccgatcgaggctaagaccgcggtgacgtcggaggcggaggcggaggcggaggccgagggcgaagtggaggcggagatgaagggtgatgcggcagccacggcgggagaaacggcggaggaggaggaggaggagaaggtgtacaagagcgacctgaagaagctggagaacctcatgtccaagcttaacccctccgcgcaggagttcgtgccgtcgtcgcgccgcacggccccagccgccgtggcggcggcgaagccggcgggaggaagggtgctctcagccgacgcgcccgtgttcgtgtccgccgccgagtactacggcgctgccggtgggcacctggagataggcggcggcggcggcaaagtcgtcgttggcggcgggggcagggactccagcagcgacggatccagcaacggcggcggcggcggcagtcgccaccaaccgaatcgccggaggaggaacagcttcaaccacgggaggcggaggggggccggaggccggccccggcggggtgatagggaggacagcgtgcgccggaccgtctacgtgtccgacattgatcagcatgtgaccgagcagaagctcgctgaagtgttctccaactgcgggcgagtggtagattgccgtatctgtggcgacccccactctgtcctacgctttgcgttcatcgagttttctgacgatgctggcgcaagagcggcgctaacactcgcgggaaccatacttggctgctatcctgtcagagttttgccttctaaaacagcaattctacctgtcaacccgaaatttcttcctcagactgacgatgagaaagaaatggtatcaaggactgtatattgtactaacatagacaagaaggttacggaggaggatgtaaagggtttcttccagcaagcctgcgggaaggtttctcggctgaggctccttactgacatagtacactccacatgcattgcttttgttgagtttgctcaggctgaaagtgcaattatggcattaaattttagtggtatggtccttggctcacttcctatcagggtgagcccttccaaaactccagtccgtccacgttctcctcgtgtgatgtccaattgatcaggctgctaccaatagcaaatcatcctaggcagagcttattgtagctatgatcgccctagaacccacttcacggatcaatgacgtcgttgtcctgagagtgtccaagtcagtcataggaaaccaacttgttgccaaatgctaatgtttttctgtttgccagatccatgcaccatttcccttctttttttcattcccccttatgttaattatgaacataattgtttataatcgcctttctcaggcatcagaataagaatgaataactctggcattttttgttgttctacgggagatcgtatatttttattgtatttttgtttttttaaaaaaaaaaaaaaaaaaaaaaaaaacaaaaaaaaaaaaaaaa

SEQ ID NO: 14538 - DNA, 1208 bp, Zea mays
aaagattctagttgttgagataggagggcctctgcgtcgccctcaagggcgactcgggggcgacccgctcgcaccgccgccgccaaccccaaaagcagtacagcccggccgccgccgcctctcctccggctaccggcggtggcagcaaagtcgtcgttggcggcgggggcagggactccagcagcgacgggatccagcaacggcggcggcggcggcagtcgccaccaaccgaatcgccggaggaggaacagcttcaaccacgggaggcggaggggggccggaggccggccccggcggggtgatagggaggacagcgtgcggcggaccgtctacgtgtccgacattgatcaacatgtgaccgagcagaagctcgctgaagtgttctccaactgcgggcgagtggtagattgccgtatctgtggcgacccccactctgtcctacgctttgcgttcatcgagttttctgacgatggtggcgcaagagcggcgctaacactcgcgggaaccatacttggctgctatcctgtcagagttttgccttctaaaacagcaattctacctgtcaacccgaaatttcttcctcagactgatgatgagaaagaaatggtatcaaggactgtatattgtactaacatagacaagaaggttacggaggaggatgtaaagggtttcttccagcaagcctgcgggaaggtttctcggctgaggctccttactgacatagtacactccacatgcattgcttttgttgagtttgctcaggctgaaagtgcaattatggcattaaattttagtggtatggtccttggctcacttcctatcagggtgagcccttccaaaactccagtccgtccacgttctcctcgtgtgatgtccaattgatcaggctgctaccaatagcaaatcatcctaggcagagcttattgtagctatgatcgccctagaacccacttcacggatcaatgacgtcgttgtcctgagagtgtccaagtcagtcataggaaaccaacttgttgccaaatgctaatgtttttctgtttgccagatccatgcaccatttcccttctttttttcattcccccttatgttaattatgaacataattgtttataatcgcctttctcaggcatcagaataagaatgaataactctggtattttttttgttgtacgggagatcgtatatttttattgtatttttgttttttt

SEQ ID NO: 14539 - DNA, 507 bp, Zea mays
tcctctcatgtgcagcctcgtatttccatccaacaatctctccgcagccaacacaaaaaatatcagaaacggaatacatccctgtgatcgtcatgcggtcttctttctctccaacggttacattgacaacattatcgaagaggtaagccttcccgttcttgcaatggaagctcttggagacgatgtcgtcggcgacggcgaggagtgtgccgcagcgcttgcagctgtagacgttgccgtccacgtcgtcgagcttgagaggaccggcaccggcggcgtccgtgttgacggtgaagcgattggtcgtctcagtgatggcgtccacggcggccgcggcggcggcgttctcctcaggcgtggtggctgctgccatactttcttcggcggcgctaggccgctaaccaccttcttcggtgtgtgccctgccggagcgatcggaagaatcgaggaccgtgctgctaggacggagtggtaagcaaaccaaaccgagcgaggacctggtttgct

SEQ ID NO: 14540 - DNA, 2982 bp, Zea mays
ctgcagatcattccacagaaaagcaaaaagaccattgagcagattaagaaaaatatttgcccggtatggataaatttcaatagtgctattcctatatggtactccttccgtccaaaaaataaagtttggtttacctttttagttgattcatacaataattaatgtatttgttttacatatgtgtctaaatgcatcaccatctatttgaacatacaggttaggcattgatagaattatacttccagtttaaaacccttaccttgattcactgatttctcctaggcattaagtgtgagacagatatatcgcttatgtacgatgtactgggacgacaaatatggtactcatagtgtatcagctgaggtacattctcatcttctcttttgtgacatgcagtcatgcttcttgctttcagctaactcagtgtgttctttgcaggttgttgccagaatgagggacatggtgagtaatgacatgcaaaatcctgtctctaatttcatttcttttagatgatgacttaaggttagttgtccctggaacttcagttcatgaacttatatatcgttctgtcttaaccttttgcatgattcatgcactcattaacttacatctagtctatccttcctaatttacaattgcagcattcctttcacaaccgaggaaattgcagagcaagtaccagatgttgacatgtcaaacatcgaaactcccgcatctcttcgtcatgttcattctgctcagttcttgacgcagcaccttcagccaccttatacgtctcgatgaattgcctaggtttttgctttggtaacaattagtgatgccgaggtagtgaacttagaggatttgataggtcggtggtaactataaccatcattgttgatttaatccatgctaatattcattccaccgtatgcttttttgttttatatttttgacatgcctcgtgtcatcatgtcaagcccaaagtagactacattctttgtaggtcgctgtcaaatttcagatccattatctagtcatcaatccatcattatgctgagtcctttatattgctaaacctgggatatacttgtggtatttttcctcatccctgacctggacaacagaagttcgtattatagtgatgacaacagaagtctagcggtaatgataatgacacaagtatcatgattttcttcaagtaaaaaaaattcatggccaattttcaagtttttacctggcctaaaacaccgatgacctagcaaatgagagttactagcaaacctgtgcatacgttgcatggactccataatttgttgcatgttcgcttgagctttaagtcgcagctgattttcaagttttatctccagtactagcaatcaaaacggtgagataagcagccgctgcagcagccgaccgcccacgaattgttaatatcttggaatcgatggcttcagatatctttcaatcggaatttgtgaaagtgaaaaaaaagacggatagaagaatacggacatagagggtgtgagtgtgagagcgctgtgggaagaaataaatgcatggaaggaatagatctcgtgatattgaccggatcgagttgtgactcttttttttgaacgaaaacggcaggagctctgcccatcatttaagggcaaagagtttagagagtacaaacaacggtctgagaccggacaaaccacacccgagcacactcaaagggaggctaagccccacaccctaaatcctccaggctagcaggaagcagcaatatgaaaattacatgggaagcaaagcccgcctaaattgtgaaacatcttctttaattcttaaggcgacttggaccgggggaagggcgacgctttcgaaaatcctgcgattcctctccttccagatgttccacattgtgtaaatcacgattccattgaaagcgcgtttctgattttttggtagtgggggagtcgcagcttcccaccactcccgaatgttggtggcggaagcaaggtcagactgggcagggaggattacaccttcccaagccaggatttgtctccacaccgcacgggcgaaaggacaatgtaggcacaggtgaataccagtctcaagggttccgttgcaaaaggcacaagacgattgatgaggccacccacgggtggcgagattgttggccgtgagtagtttttcctgcaggagaatccaagcaaaaattttgcattttggttctgcgcgtgccttccagacaaggttagcattaaggtgactgtacgagccaatgaattgtgctctgtaggccgatttaactgagaagataccatcaggagaccgattccaggcaatggtatccggtgagtcaggttgcaactggaaatcccagagtctagtccaaagagagacaaactcctcaatctgaacactggaagtgatcctacttcttagtgttttgatccaatgttgtccgctgagttcgtgggcaaccgaattgttctttctcgggattaggtcgaagaggtgcggggctatattccttggagccatgccatcgagccaactatcgtgccagaacttggccgtcttaccatccccaattgtgacagtagtggaggcgctaaagagcaatctgtcaacccggttacaaggcacatcgaaacctttccaagggtgatcgtctctcgtccattccttccaaagccagcgaaggcgaagggcgcgtccgaacttgtcaaggttgagaacccccaagccaccgagggctttgggcttgcaaactagtggccatgcgacgaggcagtgaccaccatttgactcggccttccctttccaaagaaaggagcgccggatcctgtcaatgcgtttgcgtgcccaagccgcgaggggaaaaaccgataagtggtaggtgggcatggaggacagaacagaagacacgagcgtgagacggccagctcggcttagaagatttcctttccatcctgccagacggttgccaattttttccccacgcgtccgaga

SEQ ID NO: 14541 - DNA, 1186 bp, Zea mays
accaccaaaccagtaaatacatatcagtttattgctcattattagaactgttgggagatgttgtatgccagtaataaagattcactacagtacatggctaaaaacccatagaaacaatctatatgtgattgcgtaattcgtaggggtagaacaccacctaacctgcttcatgctcaaacacttatcaattacaatactataggacaatatgatgttgcaaagatggggcaaaaccatgtttcacaaagttgttattataattatcgacacaaggcctcattgattgatcatccttgtcataatggccatttggatcaccaccatcaccaatgaccttgagcatggttagcgtagatgtaactccttcgccaccagatcagccaactgttctcttgttattgtaggattcaatcatagtcggttcctccatggttagcatagatgtaactccttcgccaccagatcagccaattgttctcttgttattgtaggattcatagttggttcctccgggtggaggggctgtgcagagaagctgttgcagccgatggtgacggtgacctccccggtgccatgcaggaacatcacctagccaacgtccttcatggactcttattctttgagacgttgctcggcgtggcttgaccatcgggtaagctgcgcggagacaaaagcagcgagctggggcgtcctgagcgcctccgacgactgatgcggtcggctgttgcgactcttgcgatgccccctccgtctagatgagcaggtccaccgttgatgtgtgggactttctcaccggtgtcggcctctccatgtcgccgttggaccgttgatgtggtaagcccgggtcgaggtcggcgtggaccacgcccttccatggagcgccgaggttggggcgcgccgcggtggttggatcgagagagtggatctgagcgccttccatggagagccacgtggtggccgggtcggggtcggcgtggaccacacccttccctggagagccgaggtcggggtcggcgtggaccgcgcccttccatggagagccgaggttggggtcggcgtggttcgcacccttccatggagagttggtgcgtggtcggcggagagagagtggatctgggcgccttccatggagagtcggtgtctggtcggcgtggtgggggggagagtggatctagagagaggtagt

SEQ ID NO: 14542 - DNA, 2534 bp, Zea mays
cgaaaagatctggataaccccaggtgccaaaaggcggaaattaattagcagtcgtgttagtgaggcgagaatatcattgcgttggaattcagataaactagtagtagtagtagtaggttgttcaaaggcgagggatcggcttgttatacaaaaggaagggcgaggaggaataataaccaaagtaataaaaaaagccctaaaatgcatgctagatgtcgcttaaccaatgctttgcccacagcaaaagaattgcttgttataggatgaccaggatctcttcaaaaaagagtgagctttggttcctctccagccagccattccgtaaaaaagctcagatgcacggccgggccctctgcgtgttttcagtcctggagctcgactctgagtctgaggcgaggaactaaagcggcgagagctctggtgactggctgtggctctctcaatttttggatgagttgatttgtttaatcgaggctagatagatctcttgcgccttttgagctgatttcgactgtacgtaagaaccttatgctcatggcatattggcacggcaacaatgcaatgcaagaggagtagcacggctgtctccttgcattggtcctactacatgtacacgtttcctagaaagaaactgccgtacctactaggagcacggcggtccggttccatcgccgtcgcgtaaaacggctgtacatacgtaccccttgagcttcgtgcctgtctgtctggaactggatacacgacaccgtcgacctggagtgcattacggacggacatgctagctatggctaacgctgaaagttgagttgtgcgatgatcgccgtgccgtgcaggtgcaggtgcagcccagcgcggacccctgcgtgtttctttggcatctgctggctagcatcatgcaccgtccatcacaacagcctcccatggatcaaatcagtcaggacctgtcgtctccttccaccaactggaggcacttgcattgcattgcatgccgcctggatcagcaggataaaaaaataaatgccgatccattcgttttttttaccgggtggcacggcttttacagacagcaactggccggccggccgtctggtggtgttggtggtgcggtttttagtaggagcgacagcgtctcggacctgcagctgcagcaggttaattagctgcaaatacgcaatgatgcaacaacgcattatatgtcagccctgtctcgatccatctgctagcagataatggcgtggctgtcgtgtaaccagcatatatatctctctcccacttcgatccgtccgatgtatcccactcaccggccagccgggccatttgcccacactcgtctcgcggcagcgcatgtgacgaccgctgagccacacacacacatccatctcttctagcattggtgcgcccacctgcgacgatgtcgacgaaatgacggcaccgagccgccggctttcagagggagacgacgacgaggacccggaagagacgaggagttcgatcgcctcagctaccaaccgtgccaatctggaggctggacaccaacattaggttcttacgcgagcattgaaaaacaaacagaggaaaaatgaaaaaaaaaatgatacatgggctcaatctatgagttaacttagggctgtggcctgtgggctacttttagcctacgcggaggtagagaaattaagggtagtttccttccccactgcatcaggacgctttggtccttgtcgaggtatgtctcagttgggttgctcgtctgtccactgactggggcttggtcgctcagaatatgagaagacataattttaagacgggcataatgcacgattttaactttacattaacttttttttcttattgtgaggagatgaacttgtaacagttctaacatctcatattacagtacaagctagggcaaacaaaccacacaatcccatagaattgcatgttacttcaggaatcacaaatgaagtaacacaggcaataacatgtgggttctggtagcttttttttttagcctaagctcatattactcgacaaacttcaagcttactaccaaaaccagtaagccctgcccctcctcgaactaacagatgagattacacatccatgcttcccaagactacaggctacagccactgagagatccagatttcagaacagcaccatgccaacgacgccaacaatgccaagaaccagtccagcactcgccttcaacccagccgcggtgttcaagccccatacgcggacgtcgtcgatcaccggcccgcacagcgagctgtggtcgtcactcctcgtgttgtagtacacgctgtagaacgccacgcgtgtcctctcagcacgcgcagtgaacgtcacgttcacagcctggctcgtggcgttgcccaatggtgagtaatggaagttctgggcctggtccccggcgaacgccatgatggccattggtggttggcacgagtcccccgccgcgcccagcatggccgtcaggctgtaaaccttctcaggggtcgtctcgaccatctgggagatgataccctccttgc

SEQ ID NO: 14543 - DNA, 733 bp, Zea mays
ccccgcgtccgcccacgcgtccgcccacgcgtccgcccacgcgtccgcccacgcgtccgcccacgcgtccccccccgcgtccccccgccggtcccacaagcagcatccgcacactcccaattcccctcgagcgccgcagcgagcccaagaagccgaccgccgagccccctctccagtccagtccgcggtctcggtttcttgcttgcccggcgcccaatcttcagagagagctccttctcgtcgtctgtctccatggccgcctcgaccaagaccgtcgccgtcctcctcgccgcggtgctcctcgcgctggtcgcgtccgcggcagccagcaggaagctggaggaggacgcacttctgggaagcctggccccagcccccgcgccggccgttggcggtgccgcggggctgcctggcggcaagccgggggcgtgggccgtcgccgctctggtctctctcgtcgccttcctcgtgatctgagggcgtggggatcgtgctgcgcatcgcgggagatggagggacgaatcctgcgatctggatcgcagagagagaggagagggggatatttatgttcgttctgtttgttctagggtgcctctcttttgcctgtataagagaggatcatgattttttttatataataataccgtttatttgtcattctttttataaaaaaagtattccttctgggttgagctagcaaattttattatgcgcgacagaaccccgaaaaaaa

SEQ ID NO: 14544 - DNA, 1343 bp, Zea mays
tgctcctttgactcctgcatctgcaccgacgattgaggagaccactaatcaggcaggtgtgaatgtgatatccaggttgctatttacctggggtgctggtgataagaatcccctaggtcacggggataaagatgctaggctagttcctacttgtgttcaatctctcattgattataatttccatcaggtagcttgtggacatagtatgaccattgccctttctacatctggtcatgttttcacaatgggcagctctagcaatggccagcttgggaatccaaaatctgatggtaaacatcctaccccagtacaagataggctggctggagaattggttgaagagatctcatgtggctcatgccatgttgcagtcttgacttcacgaagcgaagtatatacatggggaatgggagccaatgggaggctgggacatggtggtgttgaagataagaaaaaaccaactcttgtggaagcattaaaagatcgtcacgttaaaagtatagcatgtggttctaatttcacgacctgcatttgtatacataagtgggtttcaggtgctgatcagtctgtctgctcaggttgtaggcaaccatttggcttcacaagaaagagacataattgttacaattgtgggcttgttcattgccatgcatgtagttcaaaaaaagttctgaaagctgctttggcaccaactcctggcaaaccacatcgcgtatgtgattcatgcttcatgaagcttaaggcagcggagaccagcagcaacagctcacatagcaaaagaaatgccattgctcgtcgctctgttgatagcaaagacaggtcagagagaccagaaataaggtcttccaggcttgcaactggatcaacagcagaaccactcaagcaagctgagctgaaagcagttagaaacgagataaaaccagatcctatgtccacgatgagggcaccccaagttccttccatgctaccttttaacaatcttgcttttggcgcaacatttggtggtccagctagtctgaagcccatgacaatggctccaatgccaatggccatgcctatgtcaccagctcctctcacaaagaagccaactccagcagcagcaactcctctttgtggtaaaagtgataccgataacttgaagatggctaaacaggtgctgaatgaagatatctcaaagttgcaatctcaggtatgatttagaacaccgtagatttttcgactttattgtgtttagttgatgtcgataaaatggtcaagttttttttttcaggttaataaactgaaacaaaaatgtgatgcccaagaagagcaactgcaggtggactataaaggatcaacgggtt

SEQ ID NO: 14545 - DNA, 1243 bp, Zea mays
ggccgcttttttttttttttttttggagcacaatttgcgttagttttatttactgctggaggaaaaaaaattaaaaaaaagtacagattcaaccaaaattgtacgttttcttcgtcctttttacccaaaaagaatataaagaacgagcatatgatacaacacttgaccagttgacctctacagcacaggatggtaaaccttccattccattccattcaccatcgattcaccgagctagttttcacttataacggtacagcgatttcttcgccaccgatctcacgcacctacctgcaacctgaatcctcctcttctcgtgcctctcgcccgcttctccgtttccgaatctggagggagatcggccgcaaacagcaccggcaagcgcagcgcggcgcggcgcgaccggcgaccctccttagtggccatggcgtggccggcgtggtggaagcccagcctctgcgcgtgggcgagcgccgccggcttgcagtgcgccggcggcggcagggactgcctctgcgtggtgggcagcgagtgcgcggacacgacgaggcggcggacgccggagcgcaccctgtagaggacgtggccccagccccaggtgcccctgccgccgtggcggccctcgtcctcgttcatctcgaggtcgcccgcgaaccccggcttccgggacagaagccagccgacgacgccccgccgccaccactgcctcagggagccgccgcctcccgcggagagggagggcgccggccgggagcgccggcggaacgcccactcggccgacgcggaggagatgggctggatcttgccggagaaggcggacagccgcttccgcaggcccgtgaggtggctctcctctctgccgccgccgccgaaggttggcagctcgtccttgagcggcctgggcggcaggagcctcgccttctggatggtctccaggatggtggccatggctgggccggacgagtagaggcaagcaggcaaggcaaacagagagggcggagaagctcgctctggagcccgccttcaaggggcaatggtcttctcctgctctctcgccgcccacccccacccagattgccagatctctgtttgcttctccttttaatttggtctggtcgtctggacagaggatggtggagagatggtatgtgtatgtgatggcgcagtgtttgtgtcgcagccacaactttttgcctccgcctggacagactggctttattcaccaggtgtgccagctgaaaag

SEQ ID NO: 14546 - DNA, 1920 bp, Zea mays
gcacgagaccattacaactcccacccgacccgactcaaagtcacccgatccgcggccgcgtctgccgtctggtggcaccagaattgaaccccacccgcggccgccgccgcagcaacgtcggcaatccgagacgccggaggcctcctcctctcctaatacccgccccccctcgggaccgggagggagtccgccgcggtgcggatcgcggccacggccacggaaacaccggggcgcggctcatggaccgcatcgtcggcggcaagttcaagctcggccggaagatcggatgcggctccttcggcgagatctacctcgccacgcacgtggacacctacgagatcgtcgccgtgaagatcgagagcagcaagacgaagcatccacagctgttctatgaggcgaagctgtacaataccctccaaggaggaagtggcattgccaacgtcaagtggtgcggtgtggatggagaagagaatgttctcgtcattgatttgctggggccgagtttggaggacctgttttgttattgtggccgaaaattcacgctgaagactgtcctgatgttggctgaccagatgattacaagaatagagttcatgcattccaaagggtacttacacagagacatcaaacctgacaactttctgatgggtcttggtcggaaagcaaaccaggtatatataattgattttggtcttgcaaaaagataccgtgattccactacgaatcgccatattccttacagagaaaataagagcttgactggtacagcgcgctatgcaagttgcaacacccaccttggaatagaacaaagccgcagagatgatttggtatctctaggctatgtgcttttgtattttctccgaggaagcctcccttggcagggactaaaagccgcaacaaaggcacagaagtatgacaagatatgtgagaaaaagatatcgactcctatcgaggtcttatgcaaatcctgtccggtccagttttcatcttacttccattattgccattcattggcatttgatcagcgacctgactatgcatttgtgaagcgacttttccgtgacttgtttatcagccaagattatgagtttgattatgtcttcgactggacagttttgaaatacaaacaaggccacaaacaaaagcaaagtcctggggcacctattgctcgacctattcaagcacatggaccgaaacaagcaggtgtaaatggtgttattaatcataacgaagcccaggagcatgtagagacaagtcgtccaacagggcaagctgcatggtcgcaagacaaacaggcaaccaacaatgatcggaatcctgacgtgcggcataccgtgaaccttagacaagacatggctgctggaaaagcacagctgacaacatctgtggctcttcctagttcccagtggaaaaattatagtgattcaagacataaaggacaatttgatcctgttcaccacaatcagggtattgtaaacataactagctcatctaacagttggcttcctacattccagcacaatgccccaggaaaatgacagatcatatctggtggagcaaagaggaagtgctttgagagttagaggaggcccctgttcatctgagttggttcagagttaagcattgcacaatctgtagacttgatgtctcatgtattgttactgaggtggctcctgaagcactgatgcatttgatgatactattagctgataatatggaaggtttgctcgcggttgtgatgactcttgaatgcttgggcagtttgttggaccgctgcttaaatgcttctttgtagtagttctggatgccttgtaaattgcttacatgttaatatatgtatgggttgaacattgcaaaaaaaaaaaaaaaagcttggccaaaaaaaaaaaaaaaagaaaaaaaaaaaactcgaaggggggg

SEQ ID NO: 14547 - DNA, 1024 bp, Zea mays
tttttttttttttttttttttttttttttaacatgaagcttaatcttttctattcgtttctatataatcattttctacacaattgatatagtagattaacttctaactctacgtagatgtgaagataaatactgtggtaaaagtttgcaacaacgtacctaatcaaatgacaatggcaggtacatataaacgtaccccacatcgatatatactataaacaaacaaatacaatatggatcgagatatgtatggcgctccgcggattaatcaacgaattaataatcaattaatgaatcttggcgcgggcggcgggcgccggcgccggcgcgtcaccggcgccaccggtggcccgcttgatgagcgcgtgggcgacgcgcatgagcgcctcgaagtccttgttcttggcgagcagcgtggttttgacgggcgtggatggggcgtgcttgcagcagacgtcgcaggaccacgtgtcctcctccgccgtgtccaggaacagcttcacgtcgtggagcttgccgtcgtcgaggccgccctcggtgtcgtccaggtggtccagcgcctcctcgatctccccggcgcactcgttcaggcactgccacatgtcgttgtccttcaccacgtccatctcgtgccgcgcgtagtcgcccgccgcgccgcccgcggtcgtcgccgcgcggagcgccgcctccgccaggtcccgcggggtcttggagtcgctgtccgcctggagcgcgcgcaggcacacgtccgggtccggcgtcgctgcacacgacaccttgatgtcaacgccggcgccggcgccggcggcgcgcacgccgagggacacggacaggaacagcgcgatggccacggccagaagggagccgcagtaccagctcatggccgctctcgcctccatcgccgtggatatgctcgcacgatggatcggatcggagacgcttgctactccgggcgaccgggccggtgggagaggcgagaagaaatagctatagctagctatagtagctagaatgccggccggggg

SEQ ID NO: 14548 - DNA, 3442 bp, Zea mays
tggttgtctcgtattctttatagcggacgacacatgcaacgtggggcccgagtgctatcattcgagctatgccgacccctggtctctgtagcccgaggctcggcttgtcctgttgtgtcgtgcaagcggtctacgcactcaggcctagtcccaataggtcatgagtgcgccgcagagcgggggggaggtgcgagggttatatatgcgccacaatccaaggggttcgtaggtcatgagtgtgctgcagcccgaggggctcgtaacccatgagtgggaggcggaccgacacctctatcgtggctcgatgccagacatagttaacgaggccggcgggtcgttctcggttcgccaggccccccctatctagttctgccacgcccgaccccaggctcggtgccacaaggttcgcccgggggcgggtgcttccagggtagatatttccttttttctccagctgatcgacggcctcagttgcaagatgcttttcgctagtgcgctcgttgactgataggccctaggtaccggggatcttatcctcgataatattttactaacttttattggtcactcagttgcagcatttaattggtatgtcgatctataaatattgaagtgaaattttttattaagagttattgtttcactcctaatttatagtactcttgatgatgtggtagtgttgaaaaagagtgctaagaaattcttattgagaatagccttaaagatcacatccacaactgtttgattattataaacatgactaacttatttttatttttaaaaaggtttgttttctttcagcgaaggggttttttaagtgttttaaagatataaggagatgcggagataaggtacttccgagcttgatttgtttctcaagtgtttgctccactgaaacgtggcatggtaaaatgttgccgaaactaatgtggtcctcacttttgtttgtaaatgaagcacatagtttcgaaaaattatcctacatttcaggctgttcgttttaggataaaaaccagttgttcgaattattgtagctatgatatataatgtctgggcgcgataaaatcagtagaatatattttaaattaaagtcaagcgaataacttacttatttcatgttgaccggacacccctatcaggcaatggatgggcctccttcctgcgatccctcatcaaccaccagtccgagcgcgccaggccggcgcctccccaccggcccacccaccgaccggcccaccaccgtaaatgcgatgcgcccctcgtcctcgtggcggaaggaacacaaggagacggaagtagcagcagaacacgttacagcgccatcacatcatcgccccgtcaagacgaaacaaagtgtcaaaacccaaaccaaccaagcaacacagcacaaggcgcctcgagccacttaaacagagcaagccgccgcggcggcgaccgggcgaccgacgccgaggctgcgcgccctgcgccgggatcgagaggggaaagggaaggggaccagccggctcgcttggaggctggagctcggcccggcgggcccatggggggacgcctggtgtccatgctccggtggccgccggacctgggcctgcccagcctggccgcgctgctccccgcgccgcccgcgcacctccgggtccaggtccaggagtggtggcagtggcagtggcagcggtcgcggcccgagcagctgggcgcggcggcgcggcggtggcccgagctcgtgcgggacgtcccggtcctggtggacgccgcgctgtggggcgtcgtcacggccgtcgagtccgtcgcgctcgtctccatgatgtgctgcttcttcctctgctgcggctgcacgctctgacgatgggctccgcagtgccgccgcctgccaagcaaagcaagtactgctgccgcctgccagtatgggtgatgattcctccgtccgtccccatggcgtccgatctcttcgggtttttttttttactgcgtgttggttgtggtggatcagctgtggctaggtggagttactgtcatggcaatggtaactaggatgtgatctgtgattgtatttgggcgccagttctccgccattttgagatctgacttgaagcagggtgctgtagcgatagtgcgggaaggggattgctaataaattggaagtaggtgcgtggtgggaacgcgaaaatatctaaagtatcgagtcagttgcgtaccagcgtactactcctgaacctctggaaccgactttgtagtttgtatcagtgcagtaataaaggcctcgtggtaccgtcctgtcctattcctatcccgttctccttgggagctgatcatatactcgccgtcgcccaaattcctgggaagatcctctgccacgggttggttcagcctctgggcctgcaatgcacactcaaccgtacatcttctctcttccggtattttgccgctactcaggtaggtcgtggtttcgattattgttgttggcagtaaagtcgactgccattgtatgtggagatctcttgtatgtgccactgccagcctacgttgcggcgggaaagctcagcaccgcacgaagacacagcgcacaagtatatataagaattaatatccaaagggccagctccaaacgtctccacaccacacacgagtacacggctcgagtcgcatcgcattcgcgttcctgccaaaatcatcgggccagcctagtactactagtagtaagtaactgctccagctgccagccaagcaagcagcaatcatgctccccatagtgccacggccgccaaggcggcatgcgaaatacaaagagacgccgctcgtcgacggggcgtcggcactcggcagcaacgccggatctccccaactgctactaagtactaaccaggctccgagagtccagagtccggtcaacacgccgctggtgtttgtcgacggcaagcaaaacacacgcaactacgcaaggattcacccctgccgtcttccgtgccgtgcagcaaaaaactcctccctgaagctgctggtagtggcagtggaagctggacgggcccggataatgatgaaacgccgtttcaggggcacaacctctggtgtcaatccccaacgggtggctgcctggctagtaggaacttcgtaaacctccctttccgtcgctatcgagcataattagcttttcatacgaatcaatgcgtatgcaaccaacgtgagtgtatatccgacgataaccaaagtctgttgttgcttcgtatacgagtcaatgcgagtatcgaacgataaccaaagtctgcctttgcatcattccagtgcttccgataacctcaacatagcaacgtaataaagaagcccgctttctcacttccaaagagagactcattgtttattgcatgcggcaaccaaatatgctgtaaatttagagaaataagtgacatgctttctacatatttatatatattaaatattttaattc

SEQ ID NO: 14549 - DNA, 1437 bp, Zea mays
cctcgagccggcacccgccgctcgcagagcgacatcccgttcggcttcgcgcagctcagcccgccgctgcccccgccggcgccggtcaagcgcgaggtcaccgctgcggccgacggctgcagatcggacggcggcggcggtgatgacgccgccctctacgacctcgtcaacgcgtacatggacctggacgggctggacccgctcaactcgtctgaggaccgccacgacgaccgcgacagtcgtgccagcggcacgcgcgcggggagcgcggccgagagcagcgagaacgaggcggagagccagtccacgtccgcggacaggaaggacgggggcaagtcccgccattgtcgcagcctgtccatagacagcttcatgggcaagctcagcttcgccgcaggggaggagtctccgaagctgccgctgccgtctcctggtggcagcctcaccaggagcgggagtggctcactggaaggtggtgctgtcgcgctgttcaatatggagtttaccaacggagagtttaccgactccgagaagaagaaaattatggcgaatgagcgacttgctgagatagctctgacggatcctaagagggtcaagaggattctggcgaatcggcagtcagcagccaggtcaaaggagcgcaagatgaggtacattcaggagcttgagcataaggtgcaagtgctgcagacagaggctacgacactctcagcacagttgacaatgctgcagagggactcagctggattggctactcagaacaacgagttgaaaataaggcttcaagcaatggagcaacaagcacagctgagagatgccctgaacgaagcgttaaccgccgaggtccaacgtctgaaactcgcgactggggaggtaaccgatggtcggatgccgaagggcctacagcagcagatgaactcccagatgctccagatccagcagctgcaggttcagcagcaggcgccccaggcacagcagcagggccagcgacagcagcagcagcagcctcagaaatcggcatagatcaggtcaggtcgagagaaggacgctgaagctaattgagcttgagcatgaccaattgaaggatgctgggtggggagaaaaaacccgagtcttttgcgtatatcagacatgttgtaggatagctgcaatagtagggcgacaggcaccgttggtttcgccgagtcaagtaccttagctggagtatgtcgtcttggtgtcgtagtaccatacatgattgcctgcctgcctgcctattgttgaggcgtcttggtagcgtccctgaacgttctctcggaggtgcttcttgtgttcttttgtctaagagggctagggtgtcacaaatgtacctgcgtaatagtgtaattattatctatagcgtaccttcagcgtcaaaaaaaaaaaaaaaatcccacgtgcgggggggcccggtaccca

SEQ ID NO: 14550 - DNA, 737 bp, Zea mays
ggtacccccgaggtcggccgggacggcctgcgccccccgggccgccctggctggctttaggtaggtcgctcgtagtttcgtgtaggtagatagctagctcaatgacaatataacgagtataataaatagcgttgtccgcccaccggaacaatggcaggacgtaacacatcacatatggcgatggcgagcagatcctccgcgaccggaacggcggtgctgtgctttcttgtggtggtctccctcttcctggccccgtcgttgttcgttgccggaactgaagcagcagcggcctacggtgcaggcaggaagatgaagcaggcagctgcgggagctgtggcgacgaagcaggatggctacggctaccctgcaaccagttcaccagcgggatacccggcggtgccttgttgccctcatccacctgagggcggtcggggttaagagagagcccagctgcagctagacttcatgtgcatgatattgcagaattaccgtctctgaatacacatacagaaactagcatttatatacggatcatatattatctgtatcctcatgtcatgagagatgtgtatcactctcgctaaataattagcagctacgacgcgcctgcctgtcacactgtgctactattctatattcctgctccctctctattatatacatacacacacgtgtgtgtgaaataaagatcagcttggagcatcgcgcatcaaaaaaaaaaaaaaaaaagcggcccc

SEQ ID NO: 14551 - DNA, 634 bp, Zea mays
cattgggtacctcgaggccggccgggcgggaggacgtaacacatcacatgcatatggcgatggcgagcagatcctccacgaccggaacggcggtgctgtgctttcttgtggtggtctccctcttcctggccccgtcgttgttcgttgccggaactgaagcagcagcggcctacggtgcaggtgcaggtgcaggcaggaagatgaagcaggcagctgcgggagctgtggcgacgaagcaggatggctacggctaccctgcaaccagttcaccagcgggatacccggcggtgccttgttgccctcatccacctgagggcggtcggggttaagagagagagcccagctgcagctagacttcatgtgcatgatattgcagaattaccgtctctgaatacagatacagaaactagcatttatatacggatcatatattatctatatcctcatgccatgagagatgtgtatcactctcgctaaataattagcagctacgatacgacgcgcctgcctgtcacactgtgctactattatattctatattcctgctccctctctatatacacatacacacatatgtgtgtgtgaaataaagatcagcttggagcacagcaaaaaaaaaaaaaaaaaagcggcc

SEQ ID NO: 14552 - DNA, 687 bp, Zea mays
ccggccgggccggaagtccaacgcatcacatatggcgatggcgagcagatcctccacgaccggaacggcggtgctgtgctttcttgtggtggtctccctcttcctggccccgtcgttgttcgttgccggaactgaagcagcagcggcctacggtgcaggtgcaggtgcaggcaggaagatgaagcaggcagctgcgggagctgtggcgacgaagcaggatggctacggctaccctgcaaccagttcaccagcgggatacccggcggtgccttgttgccctcatccacctgagggcggtcggggttaagagagagcccagctgcagctagacttcatgtgcatgatattgcagaattaccgtctctgaatacagatacagaaactagcatttatatacgaatcatatattatctatatcctcatgccatgagagatgtgtatcactctcgctaaataattagcagctacgacgcgcctgcctgtcacactgtgctactattctatattcctgctccctctctctatatatacatacacacatatgtgtgtgtgaaataaagattagcttggagcaccgcgcaaaaaaaaaaaaaaaaatgtttgaatacatttggatgtccatattagggcttcttcggttattcccaatacacatggattggatgggaggtgtaaaaaaaaaaaaaa

SEQ ID NO: 14553 - DNA, 8353 bp, Zea mays
  misc_feature (5922)..(5922): n is a, c, g, or t
gctaatatcattacttgggctttccagtgagcagcagcaggaatatgcagtttccttattggctatcttgagtgatgaagtagatgacagcaaatgggcaataacagctgctggaggtatccctccacttgtccagctactagaaacaggatctcaaaaagcaaaggaggatgcagcttacatcatgtggaacatgtgctctgacagtgatgatatcagggcatgtattgagagtgctggggctgttatggcgctaatttggcttctaaagagtggtagccctggtggacaggaggcatcagttaaagcactgaagaagttgatacgatcagcagattctgctatgatcaatcagttactagcattactgctcagtgactcattgagctcaaaggcccatgtcattactgttctcgggcatgtccttgtgctggcgcctcagagagctctaatccagagtggagctccagctaataaagttcttaggtcactggttcttgttcttgaatcatcaaatgaagaaacacaggagattgctgcaactgtgttggctgatattttcactatgcgtcaggatatttgtgatgtaatggcaattgatgaaattgtccagccatgcatgaagcttttgacaagtggaaaccaagtgattgccacacaatctgccagagctttaggagcactgtcatgttcagctagttccatgtcaaaaaacaaaatgtcttgcttaactgaaggtgatgtgcgacctcttatagagatggcaaagacatcatctattgatgttgctgaaacagcatttgctgcattagcaaatctcctatcagatgcacagattgctaaagaagcattagatgacaatattgtcttggctttgactagagtgctcaaggatgggagtttagaaggcaagattagtgcttcgcggtcacttcgtcagttggtcaaccagtttcccctcagtgaagttctcccagattacttgcagtgctgttttataattcatgcactgttggtatgtctatctggcatcagtttagaaaatgttacaagtttggaaccccttgatgttcttacattgatggctacaacaaaggagggttcgcattatagcccccctctatgcactggttttcttgaagttccagaaagcttagaacctttagttcgctgtacgactcttgggcttcctcctgttcaagataagtccattcaaatcctagcaagtctctgtcagggtcgaccttcgctacttggtgaatatttaaacagaagtcaaggatgcatcacttctcttgctactagagttatagagtcaaatgacatggaaataaggatcagcagtgcagtcatcctcatatctgcaatgagggacagcagagaacggtccatcgatgttctggaagcatcaaaagttctgaagaatctgatatctgcactcattgatatgctgaagcaacattcctctttaacatccctagacattgaaatctggaaaccttccacagaaaaaagttcgcttaattatgagcaggatgttttgagtgtgcctgaacttggaaaggtttctgaagaaactgttgcactatggttgctctcactgatttgttcttatcatggaaggagtaaatatactgttatggagctcaatggcgttgacacagtatctgatagacttgctagctatactgctaaccgacaggtgcatgtttcacatttaattttttctattttcatagaactcacactatctgagtaacttgttgcttaattcgagatattttctgcttcaaaatgctgtactgctgcatggagtaatctatgatgtactggtaatgtgaaaatcttagatccattttgaatcgttatcgtgactaacaatgttgggtctaagttttcctgtatttttacatcctcattttgattaatgctggataaaaaagataggtcacttcatatatccatccattacccatgcttttaactcaagtctaaaggacttctttactctggattggttcctgtaacagactgcttgttgatcaattttaggtgatctgttgacaagtgacaccagctatacagatgcatcagcacatatggtgtcactaagtcttccatgttacatattaaaaagaaaaccaatggccatttagactggtgatgacttttaaattttgggctattggttattaaaacatttagcctagaaacagaagtccactcatacacccacatataaaatgttgtattttgcaagatcaaagcttttggttggtctgcccatctgtttcattttttatatgccaacttgcctagtaagttgttggaaacgctgggctccagatttgtaccctttgttcttgataactccattgcttagataccaggtgcagatgtgcataaatattggacatactagttttactctccccttggtgctgactgctgagaacagaacaaacgagcagaattgtggcggtctatttatcatagctgaattgttctgcattccattagatcagataattttcatttatttgttgcattacttgtctttttgatattgtactatttctactgttatgcctatttccaagtggtaatagctgttccatgttacaggaacagtatgaagactcagaaaatatatggacttgtgcccttctgttggctactctgtttcaggattcagtggttgttcagtcttctgaaataacacgaaccataccttccttagcatccttgctaaaatctgatgatattatcaataaatactttgctgctcaggcactggctagccttgtttccactgggagcagaggtatacagcttgctattgcgaattctggtgcagttttgggtgctgtagcattgatcggacaggtagaatctgatatgccaaaccttgttacaatggctgaagaattcaagttgtcagacaatccatgtcaaataatgttgagaagcctttttgagcttgaagatgtctgcactggtgcttccgcccggaggtccatacccttgctagtggatctacttaaaccaatgccagataggccaggtgcacctctgattgctttgcaccttctgactcaactagcggaaggtagtgagtcaaataaaattgctatggcagaggctggagctttggatgccttgactaagtatctatctttaagccctcaagactcaactgaaactactataaccaatctgttggggattttatacactaatcctgatcttctttaccatgaatcatcacgtagcacttcagttcccctggtagctgtcttgcgtttgggttcgagaagttctaggcttagtgcagtaaggacgttgcagaaactctttgattcagagaatataagggacaccgaagtggcccggcaagctattcaaccactacttgacatgcttgagtcaggaactgaaatagaacagcaggcagcacttggtgcgcttatcaagctttctgctgggaacatcgctaaggattctgctatgtttgatgtagaaggcaacacacttgaaaatctttacaaagttttatccttcagttcgtcattggagctgaagaaggatgctgctcaactctgctatattttatttgagaactcaactgtacgtgcatcaccaattgcaacagaatgtcttcaacccctgatatcactgatgacatcaggatctagtttggctattgaaccagcagtttgtgctctaaacagattactggatgaggactacaatgcagaaattgctgcaactagcgaagttattgatcttcttgtcagttttgttcctggtacaaactatcagttgtctgaagcatgtatcggtgctctcataaagttgggcaaggatcgtccaaactgcaagcttgacatggttaaagctggtatcattgagcatgcacttgatatgattcttgatgttcctgtatctgttagttcatccattgctgaattgcttcgcattttgacaaacaacagtggcattgctaaaagttctgctgctgcaaaaatggtggagccacttttcttgcttttacgtcgccctgatgttactatgtgggatcagcacagtgccttgcaagcactcgtaaatattttggagaaacctcagagtctagcagcattgaagttgactcccagtcaaataattgagcctttaatatcatttcttgagtctccctctcaagcaattcagcaacttggcactgaggtgctctcacatcttctagaacaggaacattttcaacaggatatcactacaaaaaatgcagttgttcctctggtgcagcttgctggtattggaatcttgagcttacaacaaactgcagttaaagcacttgaaaacatctcacagagttggcccaaggcagtagccgatgcaggtggaatttttgaactttcaaaggtaattgtccaggatgatcctcagccaagtcaagcattatgggaatctgcagcacttgtgttatgcaatgttctgcgttataattctgacaactatgtcaaagtctcaatggctgtacttgtgagattgctgaactccaccatggagagtaccgtcacgatagctctcagtgctctacttgttcaagagaaaagtagctcacgctgtgctgtggccatggctgaggctggggcagtacgggcactcttggagctcctgaagagccatcgatgtgaggaatctgcagcaagattgcttgaagccctgataaacaattcaagggtccgtgaaacaaaagttgccaagtatgctattgctccactggcacagtacctgttagatcctcaatctaagaaccagtcagcaaagtttctggttactcttgcactaggtgacattttccagcatgaagctcttgcaagggcaagtgactctgtgtctgcctgccgtgctcttgtaagcctacttgaggaccagcctacggatgacatgacaacagttgctatttgtgcactgcaaagcttagtgatgcacagcaggacaaataggcgtgctgttgctgaagctgggggcattttggttgtgcaagaattgcttctttcaccaaatgtggatatttcaggacaggctgcccttctaatgaagtacctattttcaaatcatacgctgcaagaatacgtgtcgaatgagcttattcgatctcttactggtgagtcggcaatcttaatggtgaagtgtgtccatgatattcttatttaaaatgtgtatttgctcatgtccatgggtgaagtttcatgcccttctattttgaaaatgaaatgttttttttttccatttgccattttgtctttgttactatagacaagaatatctaataaaagcagatgcattaagttatgaaatgattgaattgcaaatgcttatgggtgttatcctgcttgctgatggatcgatttgattattttctaatgtcaaatacaatttgtatcagctgccttagagagagagctgctctctacgtcaactatcaatgaagttattctgaagaccatatatgtgatattcagcaacttcaaaaaggttcggttttctgaggccgcaaccttgtgcataccacacctggtttgtgctttgaaggatggaaatgaggctgcccaagagagcgtgcttgacaccctttgcttgcttaaagaatcttggccgcaaatgaatgaagacatcgctaaagcccagtccctgatttcagctgaagccatacctgtactacaaatgcttatgaagacatgtcctcccagttttcacgagagagccgatagtttgcttcattgcttgcctggttgcttgacagtgaccatcattcgtgggaataatctgaaacagacaatggggggtacaaatgcattttgttgcctgcaaataggaaatggtcctccaaggcaaactaaggtaattcttgtaganaattgtactcaatagttaatttgcggtgcagttggttacttatgtctgtgctgaacgtcaggtggtaaaccacagcatgtgcccagcttggaacgagggtttcacttggttatttgacgtggcccctaaagggcagaagctctacatcatatgcaaaagcaaaaatacgtttggaaaggtatggtcgtaactcgtaagaatgtcatgccttcttctcttggtccttggcttatttattgcctgtgattcttgtgtgttattttctcaaatgttggtacttccattgcagtcaacccttggaagagtgaccatccagatcgacaaggttgtcaccgagggtgtatacagcgggttcttcagcctcagccacgacggaggtaaggacggctcaaggaccctagagatagagatcgtatggtccaataggccatccaacgactgtatgtagcgtacggatgatttacctgacgccaattcttgtactcttggcttccatgtaaatcagcccccccataatcatccgaattcatttatttgtacgtagaaagttaagacacttagataactcgcgccatcattcaattattgaggtcatttccgggattgtggccctgctgctgtaaactgattttgcacccgggtattttttttttgtacaggtgaatttatttcatgtagttatagcttagtgtagattggtggtgagtacggacaagccctagtgacagtaacattgggtgtgatgtgtggcgtgatatttgctcccgtgggtgtgtttccggcacttgtagcctcaggatacacatggctgagcttggcactgttctatttgtcaggcatgtttgtttacctgtttggttctggctacgcaaaactttttttttacatccaccttgccatagccgtaccagcggtacgaggaatctgaggtacctttttcttccatctcggcagaagtttgatgtttggcgaaactgtctcaggttacatggtaataacaatactatttgcaaaaccaaacacgccacataccagtactgcttgctggcagcctgaaccaatgttttaacggtcccacaatatgctaacacatttgaatgctatactgtagtagtacttggtggtcaacgtagcggaagtcgcagagtgtgccgtggctgcctatgtattttctttttattgatttggttaaacttttatctttcttgaaaggtagaacaaggctgcaggctggcagcctgacaatataaagctgcagacttggcggctttggcatcgaccgtccaggtcgtatctattgtaaccataactcctattggtcgcttgattttgattactatatagtataaaaagtaagtcagatataagttaaagagtgatgaccttctttttttattacctcttctaaaaagggtgatttagggggtaggtaaaaaagagggagtgaagacaaagtaacaatgtatggaaacatgatggagaacaaagtttgttacccatcttatgtgttttaacactcttcattctatcttcctctatatattataaatttacaggcataccttcagctttacaagtgagacagctcgaacatacttcgaaagctaagaagaatgaagcctaggatcctccaaaaggtgaatgtatgcatgaaactgttcacctatttatagagaagaggcacaacttcatgtaaagtttaaaattatgatttacaaaatattatgggggcatcaatgtcttttctctttctttcttgctgcacaactagatgccttctccatcaccgctttgcatagaaatccttttccacgccgaagctggtgacttcggctcattccttcgccacatacgtgcccagtcgaagcctctttttaggctgcttcggccaaaggctatcttcgtccacccttcgttgtgtgcatgaaacacattttcttatgccgaaggttaggtgttttgatgatcttcggcagactaggcctcaacagtagccccttgcgggatgaactcgttttttcatatcgagccaggaacacaaaaaatatatctaggaggccttgtgctgacggttcgaaaaacaacttcccaaagctcgttatcgaaaaggttaaacaaatacttcgatacaaatggagccaaactcgcggtccactagatagggagaaggtggaagggctatcgtccacgcgcgcaaatttttccatggctcgcgccctttcgtgcccatttcttagtataaaagcgatagagcaggtggggtgagtcacattaactaccctaaacctcgtgctgccaaaatattaggtgacttcaaagctttttctccaccgccgcttcaaagactaatttcggcaaaacatcttcgggtaaaataccctcgatggctagaatctgctcaacttttgcatggtgtttctatgtgcaaaaa

SEQ ID NO: 14554 - DNA, 1626 bp, Zea mays
ggccggccgacactatgttccagtctcaatggctgtacttgtgagattgctgaactccaccatggagagtaccgtcacgatagctctcagtgctctacttgttcaagagaaaagtagctcacgctgtgctgtggccatggctgaggctggggcagtacgggcactcttggagctcctgaagagccatcgatgtgaggaatctgcagcaagattgcttgaagccctgataaacaattcaagggtccgtgaaacaaaagttgccaagtatgctattgctccactggcacagtacctgttagatcctcaatctaagaaccagtcagcaaagtttctggttactcttgcactaggtgacattttccagcatgaagcacttgcaagggcaagtgactctgtgtctgcctgccgtgctcttgtaagcctacttgaggaccagcctacggatgacatgacaacagttgctatttgtgcgctgcccccctgtccgccgcgccgcaggacaaataggcgtgctgttgctgaagctgggggcattttggttgtgcaagaattgcttctttcaccaaatgtggatatttcaggacaggctgcccttctaatgaagtacctattttcaaatcatacgctgcaagaatacgtgtcgaatgagcttattcgatctcttactgctgccttagagagagagctgctctctacgtcaactatcaatgaagttattctgaagaccatatatgtgatattcagcaacttcaaaaaggttcggttttcagaggccgcaaccttgtgcataccacacctggtttgtgctttgaaggatggaaatgaggctgcccaagagagcgtgcttgacaccctttgcttgcttaaagaatcttggccgcaaatgaatgaagacatcgctaaagcccagtccctgatttcagctgaagccatacctgtactacaaatgcttatgaagacatgtcctcccagttttcacgagagagccgatagtttgcttcattgcttgcctggttgcttgacagtgaccatcattcgtgggaataatctgaaacagacaatggggggtacaaatgcattttgttgcctgcaaataggaaatggtcctccaaggcaaactaaggtggtaaaccacagcatgtgcccagcttggaacgagggtttcacttggttatttgacgtggcccctaaagggcagaagctctacatcatatgcaaaagcaaaaatacgtttggaaagtcaacccttggaagagtgaccatccagatcgacaaggttgtcaccgagggtgtatacagcgggttcttcagcctcagccacgacggaggtaaggacggctcaaggaccctagagatagagatcgtatggtccaataggccatccaacgactgtatgtagcgtacggatgatttacctgacgccaattcttgtactcttggcttccatgtaaatcagcccccccataatcatccgaattcatttatttgtacgtagaaagttaagacacttagataactcgcgccatcattcaattattgaggtcatttccgggattgtggccctgctgctgtaaactgattttgcacccgggtattttttttttgtacaggtgaatttatttcatg

SEQ ID NO: 14555 - DNA, 2553 bp, Zea mays
  misc_feature (2501)..(2501): n is a, c, g, or t
gccggccgggtctggggggaccctgaggcccgcccggcaagtttggtgcttgacaccgcgttcctgttcctaccatctaccaacacctgcaccgcagaaccaaacctagctgcgcttcctccagatctcggcgctctggccccatggccaccctcgttactagctccagtctctccgctcaccgcccttgcgccctctagctccggatcgcccgcgcacacgaggccatggagcccgcagccgaggacgttgcagccgccgcgccggactcgtgggaatcggccgacatcgacgggcccataagccggcttatcctctccgcgcgccgcgtgtcctcctcgccggacctcgctgacaacccggacccgccccagccgccgcctgcgctgcagccgcagggcccgccttcggttccctcggctgcgcgcgaggatttgatggctcaggtcgatcagttcctacgagaggctctagagaagccgagggagaggctttctgtgctaagaatggagcaagaaattttgaagttcattggtgaccctaggtttacagagtatgaattcaatggtcttccaacttcatatttgcgtctcgctgcacatcgcctggcgcagcattacttcctgcagtccattgccataccagacaacagtttgcctgatggaactggttcgcatatcatccttcgtaagacatcatctgagtgccaactgcctgatgtctgccttgcagatattccagttaacctaccacaagaagaaaacatctctgtggcgaaagtagctattaagcagaggcctcaaaagaatctccatggcatgaacagctcaagtgctcactcctttagagacaatcaccagaaaagcgttgaagaaagaaaagaggaatacaacaaagcacgagcgcgtatatttaacaacggcgtcagtaatgctactgatgggagatcagctgaggaagtgacttcactcactactcttcacaggtccacttccttggagttgaactcaaacaatagaatgggccaaggggctgaaattactcttgagaggaccttgactaccacttcagctagcagcatgtcaaatagaagcaagagtgataaggagcctgcagtcaatagaaacagacagaacaatagggttgcaattttcagagaccgtgagtcagagcgcagggatcctgattatgacagaagctatgacaggtatatgcaaagatttgatcctggatttggatttagtggagggtcatacacaattcgacctctgtatgcccctgctgttaactacaacactgaattccctcagcttggttcagcacaccaatcacctgttgctgtcgaacagcaacctcgtccaatagctcagcacatgcctgtgacatggtctgcggctcaagcaaccaatgcaattggctatgggccagatggtgtcatggggccttacagccctggccatattcgtgcacctgtgagatcatctgttttcatgcatgcttcacagcaatatgccataccttcacgccctggagttccatttgtacatccacaggaatccatgggaccatttgcacaaactcaccaacaacaatctaatgctagtttgcgctttgctcggccctggtgaggggggccgtgcatgcctgcacctgccagtgtgcaatgaacacattacccttcgtttttctggcagatggtagcaggcattaaagaacccagaggtgtaaggcagagtcagccatccatttgatattgtcagcctgtacacactctcggtgtagttgctccctggtccctgcatactgagatgcaggagggacacttcatactctgtactctaaacagaagcaactcgaggtttattgggcaacccctcttccaatccacaagaagctgggaggtgaagcttgggctgtggggccacctgcatgcccctttcaacttccttctgttgcttgctcctcacaggttgagatgctgaaggagcacatcttgccctatttgaatgggctctgttgtcgaaggactgatgacgatgatgaaaaattgggattcgcagtgagtgggcgatcagggaggagagcaaagattggggtggtccagtatgtgaacaggcgacagggatgtggccccattgtgcataggatggttgccgggttgaactgaggaggcatgaagaggacgttgtttcttgctttgcctagtgcgggcccggcaccattgttgatcaggtttagaagcagaggcatctctgttgacacaattgatggtcaggtttacaagcagactcatctggtagtcagtgttgtgttgtaaattaatgagtgttattgaattaccgaacctatttcttgtaccatgcatgacaagcaacgacactagttatgatcatgacgaatcatgtaacagacctgtttactgcagtgcagtgtttaatgttagaccgggttatttgctaaaaaaaaaaaaaaaattaaggtttcactcttctttttttatnaaggtattgctggaaactaatacttcctctataccaaaagattagttgttat

SEQ ID NO: 14556 - DNA, 2076 bp, Zea mays
tccctagagacccacgcgtctatcttctatcccgcctacgcgcgtcgccagtccccgctcctccacagcgccgccgccagcccacgctcccgccgccaccgctcctccaccccgcccgccgccagcccgctcctccaccgcgcccgcactcctccacctccaccgcgcgcgtccgccagaccgcgcgccgccgacccccaccctagctgcgcttcctcctccagatcccggcgccccggccccatggccgccctcgtttctagctccagcttctccgcccgccgtccctccgctctctagctccggatcgcacgcgcacgtaaagacatggagcccgcagccgaggacgccgcagccgctgcgccggactcgtgggagacggccgacatagacgggcccatgagtcggctcatcctctccgcgcgacgcgtgtcctcttcgccggacttcgctgacgaccaggacccgccccagccgccgcccacactgcagccgcagggcgcgccttcggctccctcagatgcgcgcgaggatgtggtagcccaggtcgatcagttcctacgagaggccctcgagaagccaagggagaggctttctggtaaaattaacgcctcctccgcagttagtttaccattccatttgtttgttatgcgattctattaacttgattgggcgacaaaaatgttagcttagaattcgtgcagagtgttccttgcttgttttgagatgtgcgcaggcggctagctgctttattcatagggtacatgtattcttggtcttacttatatactgtgtgctatctttatgtacttcatcccttatggcttgccactatagtgaggtatctggaaaatgtgactggtgttttccatacagtttatgtccttttcacctgtgcaaacatgctggtcccatgggataagagattttgtacagccatcagatagtaaaatcccgttccgaaaattatgaattgcaagtgtttgttccaagcagcttgtgcatctgatggtcgcgtggttctactatttaacccaattatcaccaactggaactttacattttgactgttccattgcctaatgctttaatattaatcgacaaaatacgcctagtccttgtatttgaccccagtctattcctttctgcagtgctaagaatggagcaagaaattttgaagttcattcatgaccctagtcgtacagagtatgaattcaatggccttccaacttcgtatctgcgtcttgctgcacatcgcctggcgcagcattacttcctgcagtccattgccataccagacaacagtttgcctgatggaactggttcacgtatcatcctccgtaagacaacattcgactgccgactgcctgctgtccgccttgcagatattccagttaacctgccacaagaagacatctctgtggcgaaagtagctattaaacagaggcctcaaaagaatttacatggcatgaacagctcaagtgctcactcttctagagacaacctccaaaaaagcgtcgaagaaagaaaagaggaatacaacaaggcacgagcgcggatatttaacaacagcaatagcagtactgctactgatgagagatcagctgaggaagtgactttacccagtactcttcacaggtccacttccttggagttgaactcaagcaatagaataggtcaaggggctgaaattactcttgagaggagcttgactaccacttcagctagcagcaggtcaaatagaagcaagattgataaggagcctgcagtcaatagaaacaagcagaacaatagggttgcaattttcagagatcgtgagtcagagcgcaaggatcctgattatgacagaagctatgacaggtcagtttcttttgtcgtaacacatctctttgatgctaaactcttagcacaccgtagacaggaaatcttttatggctatttttaccatgcttctgctccgtagtttcttatgcattgtatgaagttcttcatttgactatcgtccaaaactttcaagtcaactgaaaaatatcagtttgattgctaatgatgggatcctagtgaagcatggcaata

SEQ ID NO: 14557 - DNA, 1381 bp, Zea mays
gcaagggtaacatcgtaacttcactgcacaccctatcctccctcgccttcgcctagattcctatctccaccgcgttcgggttcctcccaacacctgcaccgcagaaccaaaccctagctgcgcttcctcctccagatcccggcgccccggccccatggccgccctcgtttctagctccagcttctccgcccgccgtccctccgctctctagctccggatcgcacgcgcacgtaaagacatggagcccgcagccgaggacgccgcagccgctgcgccggactcgtgggagacggccgacatagacgggcccatgagtcggctcatcctctccgcgcgacgcgtgtcctcttcgccggacttcgctgacgaccaggacccgccccagccgccgcccacactgcagccgcagggcgcgccttcggctccctcagatgcgcgcgaggatgtggtagcccaggtcgatcagttcctacgagaggccctcgagaagccaagggagaggctttctgtgctaagaatggagcaagaaattttgaagttcattcatgaccctagtcgtacagagtatgaattcaatggccttccaacttcgtatctgcgtcttgctgcacatcgcctggcgcagcattacttcctgcagtccattgccataccagacaacagtttgcctgatggaactggttcacgtatcatccttcgtaagacaacattcgactgccgactgcctgctgtccgccttgcagatattccagttaatctgccacaagaagacatctctgtggcgaaagtagctattaagcagaggcctcaaaagaatttacatggcatgaacagctcaagtgctcactcttctagagacaacctccaaaaaagcgtcgaagaaagaaaagaggaatacaacaaggcacgagcgcggatatttaacaacagcaatagcagtacgtcctactgccttggagttgaacccaagcaatagaataggtcaaggggccgaaattactcttgagaggagcctgactaccacttcagctagcagcaggtcaaatagaatcaagattgataaggagcatgcagtcaatagaaacaagcagaacaataggtttgcaattttcagagatcgtgagctagagcgcaaggatcctgattatgacagaagctatgacaggtcagtttcttttgtcgtaacacatctctttgatgctaaactcttagcgcaccgtagacaggaaagcttttatggctatttttaccatgcttctgctctgtagtttcttatgcattgtatgaagttcttcatttgactatcgtccaaaacttttcaagtcaactgcaaaatatcagtttgattgctaatgatgggatcctagtgaagcatgtcaat

SEQ ID NO: 14558 - DNA, 1708 bp, Zea mays
gcttcgatccacccccgcgtcgaccccgcgtcctccacttcactcctcctgcccacttacggcgatggccggccgcctcacgggcgccgccgcgtcctcaccgctttcccgcgcgctcctcctcctcgccgcgctcgggctcttctccatctccttcctctcactccgctccctccgccccgccgcggaccccgccgacaagtcccgccccctcctccggctccactcctcttcgacggtgtatcactctccggaggcgttcgcggtggggtacgcggagatggagcggagcttcaaggtgtacatctacccggacggcgaccccaagacattctaccagactcctcgcaagctcacggggaagtacgccagcgagggctacttcttccagaacatccgagagagccggttccgcaccgatgaccccgaccaggcgcacctctttttcgtccccatatcgccccacaagatgcgcggcaagggtacttcatatgagaatatgacggtgatagttaaggactacgtagaaggtttgataaacaagtatccttactggaacaggacactaggagcagatcacttcttcgtcacctgccatgatgtgggtgtgagagcatttgaaggacttcaattcatggtgaaaaactctattagagttgtatgttcaccaagctataatgttgactttataccgcataaggatattgcccttcctcaagtactgcagccgtttgccctacatgaaggaggaaatgatattgacaacaggataattcttggcttttgggctggccatcgcaattccaaaataagggttatcctagcacgagtttgggagaatgacacagaacttgctatcagcaaaatcggatcagtagagctattggagagctagtttatcagaagcagttttaccgtaccaagttctgtatctgtcctggcggctctcaagttaacagtgcccgtatatctgattcaatacacttgggttgtgttcctgttattctgtcagactactatgatctgcctttcaatgatgcccttgactggagaaagtttgcggttatacttagggagagagatgtgtatcaactgaagaatatcttgaaatctatatcacaggaggagtttatgtcattgcttcattgccgctaagcgccagttcaggtgcagaaacactttgtgtggcattcacctcccgtctcatacgatgcattccacatggttatgtatgaactgtggttgcgtcataatgtaattaagtactgaagcctctcagcctctgagttttgattgataacccaaatgactgatctatcagaaagacactaccaagtctgacagcttgctgttgctaccttggaaacggcaatttggttagttgctctttgaatatccagctggatggatcattgaataaatgttagctatgcatggtgcaacgaagagcatgttcaagaaagagttggccgctgtccagcatatatgacaaaactgtagtcctggttaattgatagattagctgattcttttaacaatagttagccttctcatatttcaatcttttcttatatttcacagatcagcttggttgattgtatgtagtgtctcgtgcaatttttttgtgttcaatggcttcaggcatgtaaggttgtctcccacaaccttcctataccttctcccttttccctataccatctcccatttc

SEQ ID NO: 14559 - DNA, 1333 bp, Zea mays
tgtttggttctagagccaattgggatggaacgactctatcccagagagcggctccgtctattatgggaatttgaggagccggatggtttaacatttaagcataattttttagattcattcaattctatatggaatcaattcaaacaacaacaaattggtagcatagcgatttcgtcccaccatactctaaaactaatactacctaaatatatactcttttttttgtcacgttttagttttaaaataaattaattgacgacaaatatttgagaatcaaggtagtagcgtatattattggagagttactgtatttttatttggctatatatgacatgctaatatcatatagccggctgagaaggaatcaacgaccgacccgtctattttcgcagaaaacccctcaaattctccgttcccttcgatccaccccgcatcccagggagtcctccactacagttcttgcccacctacggcgatggccggccgcctcccgggcgccgctgcgtcctcaccgttaccccgcgccctcctcctcatcgccgcgcttgttctcttctccatctctttcctctcactccgctccctgcgccccgcggcggaccccgcgcttgcgtccgccgccgacaagtaccgtcctcttctccggctccagtcctcctcgtcggtgtaccattctccggaggcgttcacagcggggtacgcggagatggagcggagcttcaaggtgtacatttacccggacggcgaccccaagacattctatcagacgcctcgcaagctcacggggaagtacgccagcgagggctacttcttccagaacatccgagagagccggttccgcaccgacgacccggaccaggcgcatctcttcttcgtgcccatctcgccccacaagatacgcggcaaggtgtctcttcctcccctgtctctctcgaactctaaccactactgatgctattagtcatcggtggacgcattgcattaatgttgccacatccgcgatggttggaccgtgtgaccatttgctgatgccacattgcctcaagggagttaagttattctgaatcttttggttatggtaagcataatgtggggtgtagctacgatcatcagtcttggttggttgcattatgatgctcccactaaggtttggacaaatcatgattaatagtttgacagtgggagtagcatttgtgaaaatttcattttagttgagcttgcacttagaccaagtttaataatagagccaactattggtggtaaggatgcttacagcttgccatttagcccgttaactcttcagtattaatgcaagactccacttatttctctc

SEQ ID NO: 14560 - DNA, 1543 bp, Zea mays
  misc_feature (1534)..(1534): n is a, c, g, or t
cctggatcctcagctgcagtattctgctggaaccaggcgtctaggatcagcctcatatctcttccttccccagtctgccgtcatccagcagcctcatccaccaccgctcatgaccggtccttatctcgttgctagattttctctcctccccgtctcctgcaaccggccgccatttcccagcatgccatggctatggcttggctcctggatgtcatggagcacggcccttccttgcctctccgtagcgccaggacctcctccgagctctgtctgctccgcttgaccgtcagaccctgcttcctctcgtgtctcgcttcccagccggccagacactctctcctcgtcgcgcccttggcctttcgcacagttggacgacctcctctgtctattgttgccgtcatgcgtcgcttgccttagcgcacggtttcccagccatggaactccctgcgtgcacccgaccagatctccctggtccttgccggagtttgccggtagcccgcgtcgtccctggcttcagctccagctcgccggccggctgctcgaccccgtcagtccctgcgtgccgccgtgtccctgccgctcaatcagccgtcgttccctgctcgactctagcagttcccatagccgtcctcgttaaattatgttgccgtgctgctctgcgtgatgcaggccacgtccctgttctgctcccgcgccgctccttccctttcgcctacttgtcgtccatgggtgtgccaccgtgaactccctgctccagttcgtcgactcctgcgcgctcggccatctctactcgctccctcgacatcgtgtgtcatgacccctgctcgtcttccccaacatgatgtcgtgccatgtccttgccatcagcctcaccttgctgctggtccactaccttggcgtcagcttccacagcacctcctcgcgccctcccggtagctcgcgtgctacctactcggtgaaatatgaaaaccagtggccgatcttgctccgccattaatttcgcttcgcagctcgtctgatgttatagtgctgctatgccacgacacgcgtgccggtgcatcgtctgtgccttgtgttcgtgctggttataactttgtgctgctattgatggtgttaagtgccggtgggctcggccttcttataagtctaaattgcaatctcgctgatggagagtacgtgctcgtccccgagcaaggagctgtccacgaggaagaccaggagcaagctcccaagactaccatcgaggatctccccgcagccccagcatttgaaggtacgcttcaggacatggttgatggtgtgacttggcctaccaccctaccaccgggatggacggtcgagtgggatgctgctccggcaggagaggagcatgaggggtagtgggctaggccttgtcctattcctcgctttcgacaatatcgatcatccgctgcagtctattttgtggacttatataagctacttgaaaaactccgatttatgtaataactctagtactttaatttgaggttttcctattttattgtatttcttnctgtgaaac

SEQ ID NO: 14561 - DNA, 2090 bp, Zea mays
tacaaatatttcgtccaaagtttgaaactctggtgtctctggcatatgggagctgcaacaatgagcagaactccaagtggcaacctgtagaggctaccctgttttgtatacaagcaattgctagatcagtctcaattgaggagcgagaaattttaccacagattatgtcactgcttccctgccttcctcaacaggtgccctcccggctctcccggggttcgaccattggagcattttcaaaatggattgatgctgcaccagctgaattatctattctaccacctctagttgatattctcaataagggtatgagtacatcggaggatacagctgcggctgcttctatggcctttaagtacatatgtgaagactgtaggacaaagttctcagggtccctggatggcctcttccagatataccatattgcaatcagtggagttggtggttataaagtttcttcagaggactcgttgcatttggttgaagccctaagtgtgattatcacaacgcttccaccagaatctgctagtagagccctggagttaatctgccagccagtaatcaatcccttgcaagaatttatccagcagggtgatcaagttcttcaacgagtccctgctcggcatttaactgtacatatagaccgactatcaagcattttcagtaatgtgaaacaaccagaagttgttgctgaagctgtatatagatattggccgacactcaagagtatctttgatcaacgagcatgggatacccgtaccatggagtcaatatgccgatcttgcaaatttgctgtaaggacatgtggaagggtcatgggaatgacgattggtgcaatgcttgaagaaatccaaactctctaccaacaacacaaacagtcttgttttctttacttgtccagtgaagttatcaagatttttggatctgatccatcttgtgcgggctatcttactaacttgatacaaatacttttcagccatacagtgcagcttctcagaacgattcaagattttactgccagaccagatatagctgatgattgctatttgttagcatcaagatgtattcgttactgtcctgatctgtttatacctacagaaacgtttcaaagattggttgactgcgcaatggctggtataactatacatcacagggaagcctgtaaatcgatcttgtcttttctatctgatgtcattgatcttccaaactcatctggcgggggacagtaccgtgaagttattaacacaatcatacttcagcgtggtacaacccttactagaataatgattgctgccttaacaggggcgctaccatctggtcgtctggaggaggtttcatatgttctgctgtcacttagcagagcctttggtgaggatatgctgaactgggcaagggaaagcattaatcttataccaccacaagccttggcggatgctgaacgtttgcgattcttcaacatcatatctgatgctacttccgggtctagtcttcataacataacagatagattcggagaaatctcagatatctgtagacgaaacaaaacagtgcaagacctagttcaaagtgccttgcggcctcaggatttgaccgtcacggtggttcgacaacagatgtgataactggatgtctctgcaaggcaagtttagaaagccagtgagtcagtgttgattgaagactcacgtcatcttgggaattttttcttagttcatacaggtttgagttgcggcggcatacagttcagatttgttcagagcatagataggccagttagcattgtaattctttcgtgtttcccctttgtacatgtgccacaaattgtgtatttggggagggagataagttgtgttgtattatctcaaaaaacagtgttatacttggtataactggcagatcatgaggtatggtgatctaccgtgggcctgattttgcgttggccgttcagcttctttttgtaaagtagggtggccatcgattttattatgtaagcttataccggttgttaaagaaaattctagtctgtgttcccttatggtcaccaaatgtaatggccctaaaggtaattcaagtttgatgattagaacttgtgc

SEQ ID NO: 14562 - DNA, 1634 bp, Zea mays
gcttgcatgcctgcagaagagtagcacttgatttcactactctaggaactgaacgctggtctaagattttggtcaagacttttaacatgaacaaatagcatgggaacacgaagcagtcggtaaaaaattcgctaggattatccggttctgtagtctagtgaaaatgcagatgcagtgggtgaaatcatgtagcgtggtattgcttgcagctttcttcttatggcttgctgtgtggcgctgatgatatgcccgcggctgtctgtcttgatctatctcagacacttattcgatgagatggccaaggtcttcgagatactgatggacatcgcctttttttcttctttctttccttccgtgtttgcaggaaagctgataaccgtccggcaaaccatcctctatgaggttggttctgcgaggaaagctgataatagtagcttgcgaatcatgaggagggggggtggacatcacatggacgtgctcgtcgttacctgtgagaagctaataagaacggacctggtatttggcgtggaaaaggccgtgtgtttatttagttagacttgatcacaccaaaagctgtgcctggagagatggctgaatctgctgtgccttcctttttcacgatccatttgttgttctcgtctgcttaaactcttggcgtgatctggacggaacatatttttggcaattttcttacttggacgaagaatgaccatcatcatcgatgttgtcgtcgtgctgttatgctaatgttttttgttgttgttaaaaaaaaaaaaaaaaaagtgcgtacgcttgatgggcgagtcatccggccctcggccggccccccctgctgtgtcccagattgctccggtgcatagtgcaaatgcaaatctgcgagaggagcgtgggcgtatatgatgccgacgaggagggggcgggcatgaaaagaagaggaggcaaagtgcaaagcaagaagggtggagcaaaagcaggctgtatgtatgatgcctcgttgaaatctttcttgtcacgccggaggtggggggatcatgatttggcccacgctgcgtcgcacagcattttacacttgctgattgattcatgcggaaatcactgccgtttctctcgtgaagtttccgatgaatcattgcgttccaatcagggtcacaggccctgtgaaattaggtagccctttgtttcttccattcatcgcttggtgctgaccttagaccgacctgcggcagtgccctaaatttaggtacaagttttttctaccattaaatataagatgtcctcttttctctgtaaatttttttatactctaaactacaaattaaacacagaagtaatttatgtttaccattttatactataacaaatatatatataattcaatatatattaggaatatgacgtattgtgtatagaaggtggagggaaccactaccggacgggatttaggaacataaaatcttatagaaaatggtaaaaaaggtagaagttaggaggactgtagagagagagaacagctgccgggcgtgcaatctctagtctaaagtattaaaacttgacctgttttcggcgcctccccgcacttggcgggccttagaccatcgcgcatttgacgcgcgtctggccacggacccgaaaaa

SEQ ID NO: 14563 - DNA, 1522 bp, Zea mays
  misc_feature (916)..(916): n is a, c, g, or t
  misc_feature (1208)..(1208): n is a, c, g, or t
ttctgcgcgcgcggaccattcgacctacatgtcagcccgcctgttttgcggctcaacaacttccaaacaggccgtaagttgtaacagtaaacaataacgttgatgtaggtgtttcattgctttatttgtgtcgaatttaacttgttggttaataaatcacgggtttaaacttggttcaacaccttcccggtctgccatttacccagcaggttggctttggccatttctcaagctcctgcttcattttacatccaacacacgggccgggctgtatttcgcaaaaagacgcggcccagccgtaggagggttctgttgtctctttcgcttgctccgcgccggcatcctccccccttcgccgccacagcgatcttgttctcaggtctgcggcggcgataaccccctccactccccaccctgtcacccccacaaaataagttctgcggcggcgatggcgctctcctcctcccggccgaagcacctcctgcgccccctcctgcggggtttccacgcctcagcgcgggccctggcgcgggtggagccgcacgagttctccaagcccagcgagtacctgggcagctgggagcccgcggcggagcctcgggaggcgtgggcgcggctggaccggctgcgcaaggggtacgcgagcgaggtgcgggagctgcggcggcagtacgcctacgaggtgcagctgttgcaggccgagcggcagcggaaggccgacgccagagccgaggccgcccgcgccgccaaccaggagcgcaaggccgccaagctcgccgccgcccagacgcgcgccgccgagcgccgcgcgttcgaggaggacttccgccagaccctcgtacgcttcgatccttctccctccttcgctccctgaccccggccgtccttagtacttgcacgcttctccgttgcacanaacttgtttgattaattgcctcgtcgttccggcttctaaaataagagccttaacattttcttcgtttgctattatacagcacggttaatttctaattgtgtgggcatgtgttcgtaggcttgcctggttgagttcagaaggatccctagttcagaaggatccctaagaacagcgtctctaggcaccagtagcactcgactagccaactatgcagcgaagtgaaaccatatagtcgtatataacagatagatttgtacctaagatgagatattgtgcagatgaaagaaagagntgagaagctggagagctggcggaagaaggagaagcgcaaagaggagaagaaggcaataaagaaggagctcctgcgcaggaagagcagcatgtggctttctgaagataagattgaagaacaaatacaaactgctatcatgcaaaccactcctctatgaggttggttctgcgaggtgagttgtaccgtctttccttttgtggtgttgcttatttttttctcacccttcttaatttcggaacagggaggacatccatgtttaactttatttaacgtgtttcgaataggaaaactgtacacatataaccttatgaagc

SEQ ID NO: 14564 - DNA, 1094 bp, Zea mays
atttcgcataaagacgcggcccagccgtaggagggttctgttgtctctttcgcttgctccgcgcccgcgcccgccccccttcgccgccaccgcgatcttgttctcagttctacggcggcgataaccccctccactccccaccctgtcacccccacaaaataagttctgcggcggcgatggcgctctcctcctcccggccgaagcacctcctgcgccccctcctgcggggtttccacgcctcagcgcgggccctggcgcgggtggagccgcacgagttctccaagcccagcgagtacctgggcagctgggagcccgcggcggagcctcgggaggcgtgggcgcggctggaccggctgcgcaaggggtacgcgagcgaggtgcgggagctgcggcggcagtacgcctacgaggtgcagctgttgcaggccgagcggcagcggaaggccgacgccagagccgaggccgcccgcgccgccaaccaggagcgcaaggccgccaagctcgccgccgcccagacgcgcgccgccgagcgccgcgcgttcgaggaggacttccgccagaccctcatgaaagaaagagctgagaagctggagagctggcggaagaaggagaagcgcaaagaggagaagaaggcaataaagaaggagctcctgcgcaggaagagcagcatgtggctttctgaagataagattgaagaacaaatacaaactgctatcatgcaaaccactcctctatgaggttggttctgcgaggaaagctgataatagtagcttgcgaatcatgaggagggggggtggacatcacatggacgtgctcgtcgttacctgtgagaagctaataagaacggacctggtatttggcgtggaaaaggccgtgtgtttatttagttagacttgatcacaccaaaagctgtgcctggagagatggctgaatctgctgtgccttcctttttcacgatccatttgttgttctcgtctgcttaaactcttggcgtgatctggacggaacatatttttggcaattttcttacttggacgaagaatgaccatcataatcgatgttgtcgtcgtgctgttatgctaatgtttttggtt

SEQ ID NO: 14565 - DNA, 1305 bp, Zea mays
  misc_feature (11)..(11): n is a, c, g, or t
ttgggtacccncatcgaggcccccccccggcagctgccacgccggccgggccgggaattaggcccgcaaacaacaccgctagccatgtggcgccgcgcctcccacctcctcatccgcaccgccgccgccgccgccgccccgacccgccgcctcccacttcctcacccgccgctacccatcgccccaagagtggcctccgcatcctcatcctatgccacagcggtcgcggcgagggcaccgcggacggtagggaccctgctgcggctcaacgacctgtgtgacaacccgggcgcgcggaagcagaagacgcgcaagggacgcgggatcggctccggcaaggggaagacggcgggacgcggccacaaggggcagaaagcgcgaggcaccgctaggttcggcttcgagggtggccagaccccgctccgccgccgcctgccccgccgtggattcaagaaccccttctcactcacatttcagccctgtggactggggaaaattgcaaaactcataaatgctgggaaaattgattcctctgaattgattaccatgaagacactaaaggaaacaggtgccattgggaagcaaataaaagatggaattcgtttaatgggccgtggagcagaagaaatcaaatggcctattcaccttgaggtgtcaagggcaactgcaagggccaaagctgccgtggaagctgctggtgggacagtaaggctggtgtactacaacaaacttggattccgggcactcctgaaacctgagtggtttgagaagaagggccgcctgttaccaaaagcagcaaggcctccacccaagcagcgagataaggtcgatagcattggccgcctgcccgcgccgacaaagccactccccttcacggtagaggagctggagtttgcagcccagcgtgaggctgcccgcgtgactgcataagatgggagcacgttggcagcacctttttttctgaaagcatgcgccactggatgtgtatcacattagctttagcaggacatgcataagaatggaccgttttgtcttttttttttcttttccctcaaggaatggactgttataaattaaatatccattcattggaatcagatgttgctgtaatttctgaacttaccttgggttttgattgataaatgccattttttctgaataggctcatgtatgatgtcattttacctgccaccttttgatcctgtaatgacaattgagaaatgccgtttatttctgtgaaaaaaaaaaaaaaaaaaacaaaaaaaaaaaaaaaagcctgtgacttacgtaaaattcgcccacgtg

SEQ ID NO: 14566 - DNA, 867 bp, Zea mays
ggggtggggtgggcaacatgggacttaatcctgttagttataacttgtaagatatttattcagctgtgagacttttcttttcatgatgcatcttactgaaagttgtccttccaactctgacaaaactttcaaatgcaccttactgaaaagttgtttttccttctctgaaaaattcatgcccttgcagggaatggttgagagaggatgaagctgaccttgttcagaggtttgatccgtcatcatcagtggataccattggtttcttcatcgcgaaatttgatgttggagagaaagatgaataaacaaacgggactgaaattccaatgtttggcattcgcaacttacgctagggataccagcattgaactttctgcaatcagatggctcacgtatacccatggagtggaatgcagcgtgccccctgaaattttgtttgccagtgtttgatattttcttttgttcgaagaacattgttcattatggtgaaatgatggggcaaattagattcaagctcctgtagtcccgtttccaagaaaaaagttaccgggtacccgtatccgtccgggtgtaccgggtattttctgggtattggtcctcccattccgtcctgtatctagggagcatttaaccgggtagcaccagcaaaattgtcctgatttaatattcgatatttggtttggctaaaaaaaaaaatttaaaagggggggccgccgcttttctggaaaaatcatagcttaaaacaaacatgtacctcaaattataagttagctaaaaaactagatccaagagagtgagaagggagaagctcttgcactcgttgctcttccagattgtgaaatttaaatagaggcatacacaagtggagat

SEQ ID NO: 14567 - DNA, 5501 bp, Zea mays
  misc_feature (3583)..(3583): n is a, c, g, or t
  misc_feature (3724)..(3724): n is a, c, g, or t
acggcggaggctggggctgcggcgcgccgacgctagccgccgctaggaccttgagcgcggctgccggctgcgctcgcgcgggcatgcgccgtgcggacggtacctgagcgcaacgacggatgggcagcgacggcggatgcagactgctagccgcgtccgccgtcgaacgccgccgctcgtccgctccttcgctcggccagaagggaggaagacagaagggatactaggggttctactccggcggtaggtggggcagctgccccaccgtgccgcatggggagctccgcctctgctggcggatgaaatgatcctgcggccttctcttctggccgtcgcccgccctctcagcaccgtagccgtcgcggcggccgtccgccgcggggacctcgccggcgcggaggaagccttcgcgtcgacgcagctcaagaccacgaccacctacaactgccttctcgcgggatacgcgaaggcgtccggtctcgtccgcctcgcggacgcacgccgcttgttcgacagtatcccgcacccggacaccgtctcctacaacacgctcctgtcctgccacttcgcctgcggcgatattgatggcgcgcggagagtcttctccacgatgcccgtcaaggatgtcacgtcgtggaacactatggtctccgggctctccaagaacggggccagcgaggaggccgcagccatgtttcgggtcatgccggtgaggaatgctgtttcctggaatgcaatggttgccgcgctcgcgtgctctggagacatgggtgcagcagaggacttgtttaggaatgcgccggagaagacggatgccattctgtggactgcaatggtgtcagggtacatggacaccggcaatgtccagaaggccatggaattcttcggggcaatgcctgtgaggaacttggtttcatggaatgctgttgttgctggttatgtaaaaaactcacgcgcagatgatgctttgagggtgttcaagaccatggttgaggacgctattgtgcagccaaatgcgtcaacgttaagtagcgtgcttcttggatgcagtaacctgtctgcacttggatttgggaggcaggtacatcagtggtgcatgaagttgcctcttagcaggaatgtgactgtgggcacatctcttctcagcatgtactgcaaatgcggcgatttgaatgatgcctgcaaggtgtttgatgagatgagtacaaaggatatagttgcatggaacgccatgatttctggctacgcccaacatgggggtggaatgcaagctatcaagttatttgaaaaaatgaaggatgaaggagtggtgccagactggattactctgttggcagtattgacagcttgtatccacactggattgtgtgattttggaatccaatgctttgaaacaatgccggctccagataacattgaacctcagattgatcattactcatgtatggtggatcttctctgccgagctggtctgcttgaaagagctgtcaacatgatccattcaatgccctttgagccacatccttctgcctatggcaccttgctgactgcttgtagagtttataagaatttggagtttgctgagtttgctgctagaaagctgattgaacaggatccacagaatgcaggtgcctatgtacagctggcaaatatttatgcggtggcaaataagtgggctgatgtctctagagtaaggagatggatgaaggataatgcggtagtgaaaacacctgggtatagctggatggaaataaagggtgtaaggcatgagttcagatctaatgacaggctgcatcctcagcttggtttgattcatgacaagttggaccgcttgcagatgctgatgaaagcaatgggctacgttcctgatcttgattttgcactgcatgatgtcgaggacagtctgaagtcacaaatgctgatgaggcacagcgaaaagcttgctatcgctttcggtctgattagcacttcccctgggatgaccttgaggatcttcaagaacctcaggatctgtggagattgtcataatgcagccaagcttatatccaaaatcgaggatcgggaaataatactaagggataccacacggttccaccattttagaggtgggcattgctcatgcggggattactggtgaaggaaagaatctcgataacagtttcagacacactcgcaatgtagtacttgcaacactatataatcccatcgacaggaataaaatgtgtggtaattttttgttaacttaatgagtggctaggacgatctgcagagagttagccagagaaactgatcatttgtttgatggctgtgtttttgccaaacttttttggtttcggttgtttggaaaggttaatcttcaaagtttggtaccacagctgggggtcaacaattttatggagttgcggagataggctgctgggcagatcactggtgttgttgtagaggagctgaaaacacttttagttttaggagcttggaccatttggaaacaccgtaatggttcgatttcaataaaatctttcccgccgtaaggctgctctcacttggatgctgctctcagtaaggctgaactagaagtggagtttggaggttggcaggggctaagaatctttccctcctaactgctccaacccctgttttgatagtccgattagttgtagtagtcgtgtgtgcactgttttcttagacggaaaacggtagacggacggtgaggagctgtctaaggtttagacgtgtttagacgtgtttagacggaattaaacggcctaaacggtatgttactgtagcatagtttcagcaggataaaaaagattttttcctaaccttttttgaagcaaacatgaagcttttgttgtccttgtcccaatttgagatatgtacctgaaaaagaagcgagatttgttagtatgtgcccatgtgatatgtataagggtccatttgatagttgatacactgaacaagaacaactttcagcacaaatggtaggttgatagacacaatagagaacaaacactttcacaaagcacaaatagaaatagttctcacaaatgccaaacaaagcataaaagcaatagtccataagttcattttcaacatagacaaatagataagataattagatagtgctaatataagatagatgatggcagctaaagcctcccatcagccatcattgtcttcctccgcatctagctcatagtcatatccagctgtgatcacatcatcttgatccgactcaaagtcaacatcttcctcttgtggtgcttcttcttcactttcagtttcagacagcggtgtgtcttcaacctctctttcaacagtcaatcttgcactcctacgtagttttgtgacctcttcagcaccacatgtctcagcaatcaatttccatgtgagaccggtcaccggctcaacatcagacccttcttcatccttctcagcaccatcaaccatccatccttgagcaaaagttgcatcggttgctacaagaggatctgcctttttattcttttgggctctaattcttctctttgcatgaatatggttgaatctaacatacacaagcttgtcaactctgtcacatgtnagtctattccttttctttgtatggatctacaaggtatcaagtaaatttgcaagcaattagtatggcagaaacttgacatatgctgaaatgaacaagtaaaaagaaaggcttagttacgtaccccttcaaaacagctccaantcctttcacaacctgaagcacttgatgtcaaagagagaattctaacagcaaacttttgaagtaatggaacttgtgttccataatttgcccaccacttagctatataacaaaaatattaagatttcttgatcatataatttatacaacagccaactaccaaatctgattcaaatacaaataacaaaatacctggattgaattcaggatccttgcagccaaacaaagctacttttttcccaaaatgtccaagtttgtccttaaacttgtgaaagtcattattgatcacttcattttgcttctgaaaatcaccatggtagaatgtttcaatagctgcataaaacccatctaccacatcctcattgtcaaagattgagggactattgtagctataataagggtttaaacaatatgcagccatgtgaataggacaatccaatcttttcttcatttttccctccacaacttccataaggttcttgtacaaaccagtccctgtcttgtctaagtttcctacagccactctaatttcttccttggctttaagaatttcaccatacacccaaggcattgatggtttaatgtctccatcaacaaggcgaagaactttaactaatggctcaaatactctcaaacaaagagaaacaccattccaaaaggttggcttcaccaatgtggctgtggctgttacacctttagcacttttcttcacatgactaattttacaccattcctcactttgggacatcatccttagctgctctttcttctcatacaagctttgtaaagtgagaaaagcggaggcaaatcttgtcacacctggcctaataatatctcttttctttgtgaacttcctcattagagacaaagtgctgtggtgtgcataaataaatatggtcaatccttttgctgaatcaattacattcttgaaccttttcatctttccaattccttcaagcattaggttaattgtatgggttgcacaggaagtccaaaataggttgggtctcttgacataaagcaaatcctttgctgccatattatttgatgcattatctgtgaccacttgcacaagatggtccttaccagcatccaatttctcaataaagttatccacaaactgaaaaatcatttcccccgtgtgtgactcagctgaaacctcttttgactcaacaaaatatgtaccgatggcagaattgatacatatgttcattatgctcctcctcttttggtctgtccaagcatcagtcataagagagcaaccggttttttcccattcttgtgcatgatctttaatcatcttctttgtattctccacttcctcatgcaacagtttctcccgcagctcatgttgataaggtttctttgcacctggaccgaagcggccatcagcttccaacacttggtcaaactcatcacagtttatggcattgaaaggtattcctgaaaataaagtacagtagcagcttagccccttcaaaagttagaaagcaagataaagaatgcaagataacacgtaaaaagataacaaatcatttaccttgcacatacatccacctagcaacatatctcttcaatatatgcaacctttctttcattacatgttcagaaatcttttgttggtgaaggtttttttgtgtggaacccaaagaattggagtcaagagacattgtgaacttgtccataggacccattgtccttggttgagagctgccaatgtcatcaaggcccgtgtcatcattaacatccatctcatctgcaactgcatcaataacctctt
